United States Patent 10,160,976 (CHROMOBACTERIUM SUBTSUGAE GENOME) - sequence listing, part 3

SEQ ID NO: 1 - DNA, 4705025 bp, Chromobacterium substugae (residues 3,136,685-4,705,025 of 4,705,025)
  modified_base (5)..(5): a, c, t, g, unknown or other
  modified_base (7)..(7): a, c, t, g, unknown or other
  modified_base (20)..(20): a, c, t, g, unknown or other
  modified_base (380784)..(380784): a, c, t, g, unknown or other
  modified_base (398396)..(398396): a, c, t, g, unknown or other
  modified_base (453151)..(453151): a, c, t, g, unknown or other
  modified_base (500151)..(500151): a, c, t, g, unknown or other
  modified_base (808684)..(808684): a, c, t, g, unknown or other
  modified_base (916888)..(916888): a, c, t, g, unknown or other
  modified_base (1139584)..(1139584): a, c, t, g, unknown or other
  modified_base (1271431)..(1271431): a, c, t, g, unknown or other
  modified_base (1293924)..(1293924): a, c, t, g, unknown or other
  modified_base (1514851)..(1514851): a, c, t, g, unknown or other
  modified_base (1516434)..(1516434): a, c, t, g, unknown or other
  modified_base (1528711)..(1528711): a, c, t, g, unknown or other
  modified_base (1672252)..(1672252): a, c, t, g, unknown or other
  modified_base (1824790)..(1824790): a, c, t, g, unknown or other
  modified_base (2147963)..(2147963): a, c, t, g, unknown or other
  modified_base (2153200)..(2153304): a, c, t, g, unknown or other
  modified_base (2158890)..(2158890): a, c, t, g, unknown or other
  modified_base (2292853)..(2292853): a, c, t, g, unknown or other
  modified_base (2361816)..(2361816): a, c, t, g, unknown or other
  modified_base (2370011)..(2370011): a, c, t, g, unknown or other
  modified_base (2474461)..(2474507): a, c, t, g, unknown or other
  modified_base (2989447)..(2989447): a, c, t, g, unknown or other
  modified_base (3032640)..(3032640): a, c, t, g, unknown or other
  modified_base (3106965)..(3106965): a, c, t, g, unknown or other
  modified_base (3170939)..(3170939): a, c, t, g, unknown or other
  modified_base (3246515)..(3246515): a, c, t, g, unknown or other
  modified_base (3352429)..(3352429): a, c, t, g, unknown or other
  modified_base (3816903)..(3816903): a, c, t, g, unknown or other
  modified_base (4217325)..(4217325): a, c, t, g, unknown or other
  modified_base (4230954)..(4230954): a, c, t, g, unknown or other
  modified_base (4357679)..(4357679): a, c, t, g, unknown or other
  modified_base (4403286)..(4403286): a, c, t, g, unknown or other
  modified_base (4450659)..(4450659): a, c, t, g, unknown or other
  modified_base (4468392)..(4468392): a, c, t, g, unknown or other
gccgacggcacgctggccctggattgccggctgctggtgatgttcgccaatatcgaagccattcgcgccggcgagcgctacctcggctatgacatgaaccggctgttcaacggcgcccatgccaaacacgccgacctggccgagtcccggcgcgccgccgagctggaagtcctggcaggacgcttcttcgcccaggcccgggcccgcaagctgcactacgacctgcataccgccatccgcggttcggcgttcgagaaattcgccatctacccgtacttgcacgaacgcgtccataaccgccaacagctggcctggctgcagcaaagcgggatagaggcggtgctgctgcacagccagccagccaacacgttcagctaccataccagccgccgcttcgaggccgacgccttcactctggagctgggcaaggcgcggccattcggccaaaacgatctggcgcgcttcgccggcatagatcaggcgctgcgccgcttgctgtccgcgccggccagcggcgtccccgccctccagcccgacgcgctgccgctgttccgcgccaagtacgatctggtcaagcgcagcgagcatttccgcctgcacctggccgacgacgtggagaatttcacccggctgccggacggcatgctgatcgccgaagatggcgatacccgctatctggcgaccggcggcgaagagcggatcctgttccccaatcccgcggtcaagcccggcctgcgcgccggcatcgtggtggagccggcgcggctggattgagccggacaagacaaagggccgcatccgcggcccttttcccacgccacctcatcgcccgtcagccggaaatgtagttgaacagcgacagctgcgacacctgggcgtaggttttctgcgtgtactgcagcgaggtctgagtcatggtgaaggtggagatcgcctgcgccatgtccaggttctgcaaatcgccgatgctggtgttgtattgcaagtccaagctgctgctcatcccctgcagattggcgttttcctgttcgcgcgcgccgaccgacgccaggctggtggtcatctgctgcgtggcgctggtgatctggttggtgatcgcgttcagctgggtctgatagttggccggcttgggattctgccccaacaggttgtacaggttgatcagggagtcgaacgcgccggtggcgctgccgccggtgccgggcgtgccgaaaatggcattgcccggatcggaaatggtcatgatgcgggacgcggccacctgcacgctgcgctggccgctgtcgccgttataggtcgcggtcggcggcgacgatgccatgttgacggtgaacggcaccgtggtcacctggttgccgctgaacagatagctgccgttgccgtcggtggcgttggcgtagccggtcagttcggaaatcccctctttcaccgtttgctggatcgcctgcagctgggtaggggacagagagccgtcgccagcgtagatcgattggctcttcatcgcgttcatcagattgatcgcgctgttgatggtggtgtccgacaaggacagccaggactgcaccgactgggtattggtcttgtactggctgttctggccgctggaggtattcagcaactcgatgcgcgcggatgccaccggatcgtcggcgggggtcaccacccgcttctggttgtcgatctgcatattgacctgcaccaactgggcttgcaggttggacatattatctatgccggactggtataaagtcgctgaactgatgcgcatcgccgctctcctctcgcgaatattcaggacatgatgttgagaatgctggaaaaggtgctctgcgcaatctggatcaccttgctgcaggcctgataggactgctggtatttgatcagattggcggcctcctggtccagattgacaccagtcaagttggaattggcccgggtagcctgttgcagcgtgttctgcgccgacgtgttctgcaggcctaccgcgtaagtctggttggccaccgtggtgaccgtagaggtgaaataagtctggtacgactgtccattcaccagcgcgatgttctgttgcgcggtcagctgcagcagattgctgttgtcgccggacggcggcgtgacagtcccgaccgccggaatcggcttcggccccaccgtgaaggtctggcccgggtcaggcgatccggacagctggaagcctatgcccacgtccaccggcggtgtcgccgtggtttgcagcttgtaggcgttgggctggccggtgaccggcaccacgttgtacggtccgccgccgttggtcccggcgatggtggcggtcatcgacaccggcgccgccgacgcggtgatggtcatattggtcaggccgctggacgggtggctggtggtggccggaaacgacggcggcgtgccattgatgctggtggcgtaagtgcccggcagactggaccacaccgcgctcatcgtcacgccgctgggattgccggcggtgccggtggcaaccaggttggaggcggtggccagcagcttgggatcgcccatcgtcacctggaactgcccggcggcatactgcggattgctggcgtaggcggacaggtccttgaagatgggcccgcccggctggccgttgtaatccactcccagcgaattctggtaattcatcgccgcggcgaaatcgatcgccatggtgcccagctggttctgcgtctgcgccagcgccccgtcgcggaagttcagcaagccgcccagctgcccgctgttgaggatggtgtcgggcagaatggtcagggtgttgttcggattggtgaagcccacctgcagattgctgggattgttcgggtcggcctgggtggccagctggttcaccgtgccgccggtcaccagggtctggccgctgccgatggaaaccgtgtaggagccgtcgctctgcaccgaggcggtggcgcctatcatctggttcagctgcagcaatgcctgatcgcgctgatccagcagagtgttgggttgcggcgcctgggtgttgccgccggtggccgcgccgatctgcttgttcagattggcgatttgttgagccagcgcattgatgctttgcaccgcggtctgaacctggccgttgacgccttgctgcagctgcaccagctggctgttcagcgaagtgatggaggccgccatcgcctgccccatgctcagcacgttctgccgggtaggcagcgacgaaggctgctgcgacaaggtttgcatcgcgccgaagaaggactggatcgccggattcggactctgggtggagttgccgatcatgttgttgatctggttcaactgctgcagctgagtggtgtaatagctgctgccggtctgcgcgctctgcacttggccggccagatactggctataggtgcgcagcacgttggtgacgtccacgccctgccccaggaagccgaagccgacattctgcggctggcgtcccgcttgcgtgatgtactcgacgttgtagcccggagtggacgcgttggagatgttgttgctggtcaccgacaacgcgttttgcgccgcattcagcccactcaggcctatgccgaaaatatcagctccgacgattgccatgattaccctctacaattcttcatctctatcggccgactctgccaaaacttgatcaagttttggccacttgttgcgccaggctggcggcgacatccaccagtttgcgcgcgtagcgcggatcggtggcatagccgcccgactgcaggccctgcgcgaaaccgtacatgttctgcccctggttcaacacgttcttgtagcgcgacgagcctttgagcaccttggcgtaatcgctgaacgcatcggcgtaggagtcgtaggaacggaaggtttccatccgcttttgcgctacgccgccgctgtattcggtagtcatgatagtggtggtcttgccctgccagtcggaacccgccttgatgccgaaaagattatggctgtccgagccgtcgctgttgcggatggcgcgcttgccccagccgctttccagcgccgcatgcgccaccacgcactccggcgccactcccagctgctgcgccgcggcgcgggcatgcggcagcaggctgctggcgaaggcgcggccgccgccgaccggcgtggcagccgtcggcgagtccgccacggccgcgccggatgcgccctgggcgctgcggtaagcttgctgcatgcgctggccgatgggctgaaccggcgaccactggccggcgaccgggcggctgttcaacgcgtgcgtctggccttcgtcggggctgaagccggattgcctggcgatctggcggtaaatcatgtcgcccaggcccaggccgccgttggcgctcatcgcctgcaccatctgctggtccgccatgctgcgataggtatccatgccgttcgactcttccgaatcgtcgaacttggtctcgcgcatggttttcagcatggtgttcatcaacagcgcctcgaactgcgacgcggtttcgcgcgccgcggctttggggtcgctgctggccttggccttcaggctgcgcatgtggctggggtcgatcgcgagctggcggctaagcgcgtcctgcggcgcgacggcttggaatttggcggtcatcaattactccttgagccgcaaaaagcaataatcatgccaccacgccgtaacccacgcaggctcagatgatttgcaggtccgccttcagcgagccggccgatttcatcgcctgcagaatggaaatcaggtcttgcggcgtcgcccccagcgcattgagcgcgttgaccacctgcgacagattggcgccccccttcaggcccaccaccttgccgccggtgctgttgatcacgatatccgcctgattggtgaccgtggtcttgccgcctgagagcgagttgggctggctgacttgcggcgtgttggtgaccgtcaccgacaggttgccgtgcgacaccgcgcaggacgacagcgtcaccgcctggttcatcacgatggagccggtgcgggcgttgatgatgaccagaggggaaacatctgccgggtcgacggcaatattttccatccgcgacaggaattgcacccgctggttgctgtcgaacggcgccctcacttcgatcagccggccatccaccgcgcgggcggtgtcggcaccgaaggttttgttgatcgcctgcaccgcgcggttggcggtggtgaaatccgcctcctgcagctccagatggatgaattcgccgtcgcccagcgcggtttgcacctcgcgctccaccgtggcgccggccggaattcggcccacgctcaactggttgatctgagtggagctgccgccggcggacgcgcccgcgccgccgaccaccacattgccctgggccatcgcatagatctggccgtcggcgcccttcagcggcgacaacagcaaagtgccgccgcgcaggctcttggcgtcgcctatcgacgacgccgtcacgtctatcatctgcccgcgcttggagaaggccggcagcgtggcggtcagcgacaccgccgccacgttcttcgggtctatcttggtgccgggcggcacctgcacgccaagctgattgagcatattgatcatcgcctggccggtgaacggcgaggaagtgaccttgtcgccactgccgtccaggccgaccaccaggccgtagcctatcaactggttgggccgcacgccgccgatattggcgatatccttcaagcgctgcgccgacaaggccggcagggacgccagcaacagacaggccagcacgatccatttcttcatcattccacccctatgccgggcgccgatcagatcggcagcagcgacatgaaaatcttcgacaaccaacccggctcattgtataggcggttgttgcccttggtctgctgttcgacgcgcgcgtcggctatcttcagcgaggacacggtgcggtccggcgcgatgtcgcgcggattgaccacgccggacaggcggatggattcggtatcgctgttgatccgcacctgcttctcgccgctgacctccagattgccgttggccagcacgtcgatcacagtgacagtgatggagctgacgaagctggtggccacctggttgttgcccttgccggtattgttggccgagccggagctgttgaagttggtgccgcccaggccgccggccaggccgcttggcaggaacggtatcttgacgccggcggtgatgttggacgttagcgccgaagtccgggtgtcggtggtctgctcggacgccgaagtcgaggagttttcctggatcatcacctgcaaggtgtcacccacctggaccggcatgccgtcctggaacagcggccgatagctggccgcctggaaaatggcgccattggcgggaatgcccatcgcccgcggctgcggcttcgccgtcgtcggcgtctgcaccagcggcggttcctgcaccgcacagcccgccagcgccaacagcgccacggccagcatcaccagattggttttcatcgccattcctcccttcggcccggcggccgccggcgcccattcattacatattgctcagtttctgcagcatctggtcggcggtggtcaccgcgcgcgagttcatttcgaacgaacgctgggcagtgatcatattgaccagttcttcagtcacattgacgttggacgactccagaaaaccggacttgatcgcgccgcggctgtcggtttgcggattgccgtcctgcggatcgccggaagcggcggtctgcagatacaggttgctgcccaagctttgcaggccctgcggattgatgaaagtcgtcagctggatggtgccggcggtctgcggcgcggtggcgccggccagcgtgtactgcaccaccccggcgctggacaccgtgatctgctgcgcggtggccgggatattgatgttgggattcagcggcaggccgtccggattgaccacgtcgccgttcgagttgcgctggaactggccgttgcgggtgtaggcggtggtgccgtccggctgcaggatgcggaagaaaccgtcgccgtcgatttccagatccagcggctggccggtttgctgcggactgccctggctgaaaatgcgcgacgaagccaccgccgccgcgccggtgccgatctgcaggccggtgggattggtattgccattggccagctggccgcccggctggcgcagcgtctggtagtacagatcctcgaacacgccgcggctgcccttgaagcctatggtgttgacgttggccaggttgttggacaccacgtccagctgaaactggctggcgtccatgccggtcttggcgatatacagtgcgcgcatcatggcgagttaccttgcttgttctatggccgcggtcagctggtgaccgacaacaattgcgccgcctgctggtcatcctgctgggcggtctgcatcattttgatattgagttcgtactggcggccgtgcgaaatcatctgcaccagcgcgtccaccgagttgacgttggacgattccagcgtctccggcaccagcttcacgtcggcgctggccggagcggtgccgccgccgttgacgtgatacagccggtcttcgcccttgtacatgtctttggggccaggattgatcatcttgatctggcccaccagctgcggggtgcggttggttccggacagcggaatggccagcaccgaaccgtccgcgcccagctgcacctgcgagccggccggcaccgtgatcgggccgccgtcgcccatgatgggcaggccggtgcgggtgcgcatcaggccgttggcgtccagcgcatagccgccgtcgcgggtataagcctcctgcccgtccggcccctgcaccgcgaaaaagccgggcgagcccagcgcgaaatcagccgggttgccggtgtgctgcaggctgccctggctggcgtcgaagcctatggtgttgtccaccacgtaggtgcgcgtcggcgcgccgtcccccaccaccggcagcgcccggaacgccgccaagtccgccttgaaggcgttggtgttgacgttggccaggttgttggcggtggtggcctgctgccacatttcatgcttggcgccggtcatggccagaaacaacactttatccatgcttcagtctctacctggattagatgttcagcagggtctgaatcagggtgtcctgggttttcacggtctgcgcgttggcctggtagtagcgctgcgcggtgatcatgttcaccagttcgttggtcagattgacgttggagtcctccacctggccggccgacagcgtgccggtattgccggagcccggcgcgttgacggtggccggaccggaggtgccggtctgcgtccacagattgccgccggtgtcttgcaggccctgcggattgatgaagttggcgagcgccacctgaccgatggttttggtctggctattggagaagctagcctggatcaaaccgttggcggaaatattgatggtctgcagcgtgcccggggcggagccgtcctgggtcaccgggctggtgaagaagttctgcgcgatctgggtggaatgcgcgaaattcaccgccacggtctgcggcgccgcggagccgttggccgaaggcggcgtgaaggtcacattgaacggcgtgttggtggtcaggttgccgttggtgtcgaagctcagcgtgaaggtgctgggcgccgtcgccgccgcgccgtcgacataggcgttcaccgtccaggtattgcccgcgccggccaccggcgtattcagcgagtaatagaacgtcatctggtgcgaattgcccaggctgtcatacaccgtctggttattggtccagttgtaggacgacggctgcgccggattgttgatcggcgcggtggtcggcggcgtggacgcggaattcagcagcaccgccatattcatcttgctggtggccgtcggcggaatggaggtattggtcagttgcagattgccgaccggcccctgcgagatcgcgccttgcgcgttggcggtccagccttgcaggtagttgccggcggtgctaacgatgtagccctggttgttcacctggaactggccgttgcggctgtaggcctgggtgccgttgggcaggcccatgatgaagaagccagagttattgatagccaagtccaggctgcggccggtagtctccagattgccgctgcccatattctgcgtcaccgccgacacctgagtgccgatgcccggcgtggtggaagtcatgccgtacaggctgttgccgtacaagtcggcgaattcggtacgcgaactcttgaagccgacggtattggcgttggcgacgttgttgcctatggtgtccagctgcgtggacgctgcgttcagaccactcaagccttgctgaaagcccatttttcctactccttaacttaagcttgttttcggcagagtgcttcaggacatctgcgcaacactggacaacggaacctgcgtattgccggacagcaccagcatcggcgtgccttgcgcccaggacacggccttcacctgctggttgctgtaggcggtggcggtggtggtgccgccggcgctggcctgggtgaccttggcggtaaaggtgtaattgccggccggcagcgggttcttattggaatcggtgccatcccagctgaaagtgttcagcccggcgcccggattggtcagcggaaccgaatccaccacgttgccgttcttgtccagcacgctgatggtcaccgacgcggccgggccgctcagcaccacgccggcctgcacggtcttgcccgccgccggcgcggtgagggcgttgcccgccaccatcacgttcttgcctatcatgctggaggccatcagcgactgggtggagttctgcgccgtcaccagctgctgcatggtctggttcagcgtctgcaggcccgagacctgactgatctgggccatctggctggtcaactggctgttgtccatcggattgagcggatcctgcgcgttcaactgcgcggtcagcagggtgaggaagttgttctgcagggattgggcgctggcggccgcggtgccgctgccggtggacgagccgttggccgcctggacggaagtgctgcccggagcgggctggttgttcagcgagttgtagttgaacggggaggttgcactggtagcggaggccatggccgtcatccttgcgataaaatttactgacccagctgcagggttttctgcagcagactcttggcggtgttcatcatttcgacattgttctgataggcccgcgaagcggcgatcatgtcggccatctcttccaccggattgacgttgggcatggtcacatagccgcgctcgtccgccagcgggttgcccggctcgtacttcagccgcggcggcgattgatcctcaaccaccgaagtgactctcacgccggccacctgcggctgcgccgcgtccaccggcaccgcggtgaacaccacatgcctgcccttgtagggctgaccggtggagctggtggcgctttccgcgttggcgaggttgctggccaccacgttgagccgcatcgactgcgccgacagcgccgagccggagatattgaacagattcgacagagacatctaaccttaactcccggaaccttgaatggccgaattcagactgctgatgcgcttaccgaggaaggtcagcgtggtctggtactgcaaggcgttgtcggcgaaggcgccgcgctcgacgtccatgtccaccgtgttgccgtccaggctgggctgcaccgcattgcggtactgcatcggcacgttggcgttgacgccgccggcctcgctggcgaggtggcgcggatcggtcaccgccatggccagtttgccctgtttgtcctgctgcgcctgcaaggctgccttgaaatcgaaatccaccgccttgtagtacggggtttccgcattggcgatgttgctgcctatcacctcggcgcgataggcctgcagattcagcgcgcgctgctggaaatcgaaatagtgggcaatcttgtctagcatgaacaacctccttgctggccatcgataaagcacaaagcgtgccagcccacgcgacgcgcccaaatccttgttttaaaagcctctcgccaatccccggcaaaaaccccgccgcacgccgcgccggcaagcggcaaaacttgccgccaaggccttccgcccgcgccagatcagctttgttgaggattttgcttgcccgatgagaaaaatcgtgccaaaaccgtcaataatgcaataaagcgcaatgcaggagcagaggcatgctggctctagaacaattactgatctccctggccgagccctcgccggtccaggcccagatcatcaccaaggcgctggaggcgctgggcgccgcccagatcgaaatccacccgaacggcgaagagttgatccagcaggcgcgcgagcgcatgcccaatctggtgatcagcgcctaccacctgccggacatgaccggcagccagctggtgcagacgctgcgcgacagccatgacctgtacgacgtccctttcatcctgatctccagcgaaaccaagcaggagcggctggagtccatccgccaggccggcagtttggccatcctgcccaaaccgttcagcgaagaagagctgcacgccgccatgcaatcggtgatgagcttcatcaactgcgacagcctgggcgcggaagtggacgccgacatggcgctgatgaacgtgctgatcatcgatgacagcagcacctcgcgccaccacatccgccaggtgctggagaagctgggcttcgaacacttttgcgagagcagcggcggcgagcgggcgttgcagctgatagagcaggaggcgttccagctgatcatcaccgactatcacatgccgcagatagacggcatggagctggcgcggcgcatccgcgccagcggcacgcaggaaggcgcgcccatcctgatgatcaccagcgacagcgagcatgtcggacaggccgaactggaagacgccggcatcgccgcctgctgtagcaaacccttcgacatcgacaagctgcgcgaactggtccgccggctgctcaacgaatattagcgctcagcgcggcgccacccacaccaggcgcgaatggcccttgtcgccgcccagcgcctgccggcgccagtaaccctggctggaatagtccgctccggcagccagatccgccgcctcgcagaaagtgatttcgccgaagccggctttcagcagctggctacgcgccttttgccgggtcttggcgcaggtcggatgcccggcggcggccacccattcggccggcgccccggcttcccaacccttcacccgctccagcttgggctgggtcatcatcgccaggccattgagcaccgccgccaacaggccatgccatgtctcgcccacctcggccaattgcggcgccagctcgcccggatactccacccggaccacctccacctgatcggcggcctgcagccagttgacgccgtccggcgcgaaacccatccgcaccagggtcagcagcaaggcgcgccgctccggctggtgcgcgacaaaggccccgccctcgcccggcacatgcaggaagaacgcctcggccggcaaggccagcgtatccggcagattgcccggctgccgggtctgccccagcgccagcgccagcgcgtcccgcaaatgcgacaccacccggccctggcggacgaaatgcccccaggcctcggccagcgccagctcgcagcctatcgccgactgcggaatctcgaatacctgcgccgcgcgctccagctcacgccggatcacatccttcatctgcgccctcgcctcggcgacctgcgctgcctggacatatagctggcccacccgcttggcccaaggccgggtggccgcgtagcgctgcacggcatactccattccactgcttccttacaaacaaaaaagggccgcattgtaacaaacacggccccgcgccccaacccgccagccctagccgccgccccggtccgatgcgcgccgccccgtcggcgagcggcgctgggcgtggcgccggtcctcgacaatgccggaatacagccactggcgaaaatgattgagcgtcatcggcttgccgaaatagaagccctgcagcagctcgaaacccttcacgttcagatagctttgctgcccctgcgtctccacgcccttgacgatcacccgcacgcccatctcctcggatgacagcggcagcccgtccagcacattgccgcgcaggcactcctgccccagcgccgaaacgaagcctttctccaccttcaggtaatcgaagccccagcgctgcagataagccttgtcggcatagccggcaccgaaatcgtccaacgccagcttcacgcccagcaggcgcaactcacgaatcacgtccagcgcgcccgacgcctcgcgcagcggcgtctgctctgacacctccagcaccagcaccgcctgcttttcgttcagcatgtccagcatttcgcggcaatcgttgaccagctccggcatggacaagtgctcgctggcgatattgatgcccaccatgaagcccggcggcagcaccacctggcgcagctcgccggccacccgcttcagcaggtagcgggtgagcggcacgatcaggccggcgtctatcgcggtctggatgaacaagtcggaacggacattgccctgcaccggatgacgccagcgcgccagcatttccaccccgacgcactcgccgctggccgcggtgacgatgggttggtaatgggcgaagaactcctggtggcgtatcccctccaggatttcccaatcgctggcattgcgcactccggcgccgcgcaacagccacgcggccagcatgcctcccgccagcagcgacagcagcagcgcctccaggctcgccgcccagctgcggctggcgaaggcccagacgtcgacgcttcccgccaccgccatgtccgccgccaggttcgccaccgggaacgccgcctcgccgggatgcccgcccgcgggcacgatggcgccgtcggcggacaagcgcccgccctccagcctcacctgcagatccactcccgcctcgcgcgcttgcgacagcagcgcccgcagccagccggtttccagctccagcgccgccatgccgccgcgcagcaccagcgtcgccgcccccgcgccggagcgcgcccactccagcggccgctcgccggacagcgcgtcggagcgggcctggtccgatccgcaccagcggccatcgggcaggcggcggatcgcgtagcgcgcatgcggcgtctgctggaccagcgatgtcaatgccgcgcgcgcggacaggcaggcgggcgcatcgatcgccaccgcgcccgctctcggcagcgccgcgccggccggcgccagctctgccgccaactgccgcgccagccactgcgcgcgcgccgacaattcggcgtccgccgcccaccactgcagcgccaatagcgcggccatggccagcgcggcgctgccggccatcgacaggccgtacacgaccgcaggccgggcctgcgccgctcgcccggacaaccaccgcaccagatttcgcatcatgaatgcccgccccgccatcgcggcgaacgccgcgacacggcctgcctatccgcgccgaatggccggcccatcgccaggcccgccagcccggtagcccggtagcccggtagcctttatatatgtccagtgtagcggccggcgtccgaatcgccagcgccaggcgcaccctccgtggacggacaatctttttttaaaaaaacctcatcggcaagccataaacaatcaaacacttacccaggctgattgcgaaaaatagttgcaatcgagcgaaaattagcgtacagtccggcctcttgcattttcaccgggcaaatccaaacctcacgcctcttgcccgagtgtgttttcatcgtccctgaccctttccaggcttcgtccaagcaataatgtcgctttcgactggaccgctgttcgccgcttgccaggttagtgccgatgatttacggcccacaggcgccgtataaccgccacgaaatctggctataagtgacgccggcatcatccggcctgaaaggatatacatgaacttttccgatctgggcatcgccccgaccatcctgcgcgctctggaagctgccggctacacctccccgacctcggttcaagccgaagccgttccggccgccatcgctggccgcgacctgctggtttccgctcaaaccggcagcggcaagaccgccgccttcctgctgcccgcgctgaccaagctgtcggaacgctccaccggcaagggccaaggcccgcgcgtgctggtgctgaccccgacccgcgaactggcgcagcaagttgagaagaacgcgctggaatatggcaaggacctgcgctggatgaagaccgcctgcctggtgggcggctcctccttcggcttccagattcgcgccctgtcccgcccgatcgatctgatcgtggccactccgggccgcctgatggaccacatgcgctctggccgcatcgacttctcccgcctggaaatgctggtgctggacgaagccgaccgcatgctggacatgggcttcatcgacgatatcgaagccatcgtcaaggctacgccggaaacccgtcaaaccgtgctgttctccgccacgctggacggcatcgtcggccgcatggctgaaaaaatgacccgcgatccgcagcgcatcgagatcgcccgcaccgaaacctcgggcggcaccatcgaagagcacctgctgtacgcggacgacctgaaccacaagcatcgcctgctggatcacatcctgaaggaatccggcttcgaccagtgcgtgatcttctccgccaccaaggcgtataccgaagagctggccgacaagctggccgaccagggctattccgccgcctgcctgcacggcgacatgccgcaaagctggcgcaaccgcaccctgaacgacctgcgccgcggccgcatcaaggtattggttgccactgacgtggccgcccgcggcatcgacgtgccgaccatcacccacgtggtgaacttcgacctgccgaagcaagctgaagactacgtgcaccgcatcggccgtaccggccgcgccggccgcgacggcaccgccatcactctggcggaagcgaaagagtcgcacaaggtgcgccgcatcgagcaatacctgaagcgttccatcaccgaaggcgtgatcgaaggcatggagccgacccgtcgtccgtccaagggcggcccgcgccgcaacggcaagccgggcggctacggcgatcgtcgcaacggcggctaccaaggccagcgtcgcgaaggcggctaccaaggccagcgtcgcgaaggcggctaccagggccaacgccgcgaaggcggctaccaaggcaaccgcggtccgcgcaccagcgcgcagtaatcgcgtcaagcacgaaaaagcggcgggtcatcccgccgcttttttcattgcagcccgccccgcctacttggccgcagggcaatccatcgccgagccgcccatgaacgagccattgggcacgccattgctgtaagtggtgccgcccagcatcaagcccttgttcgcatgcgcgccgccggccgggaacggtgccaggtagttgatgcgcgaattggcgttggccaccccggcgctgttatagccgaaggaaacattgccggcgaacacgatcttggccgtcgtcatcacgctgcccgccccttggcccggcaggtgcgaccaaccgctgatgtccatttccttgccgttgatcaccaagctggtgatgccgccgcccggccaggccgctccggccaggttgccccagctgccgctgacggtgaagcccaccaaatcgatgtagcgggtcacctgcatgccgttcacattgccggaaatcatcagctgattaggcgtgctggcgccgatgtagttgatcgagccattggtgccgcgcatgtcgaaaccgctgttgatcaccgcgtaagtggtgccgcaatcgtttatccccgccgaggcagccatgctccagcccgccgccgccgccagcgccgccattttccatccgttcatcgcttcgctccatctgagttgctctgcttcatcgaagcagggttggaaacattccaacctatgcatattgcatttcaattgatggccgcgccagcgcggcgggcgaaaatcggctgcctcattgcgcgccgtcaaaccactgccgcaacgccagcgccagcaacagccaggcgccgtgcggcagccattgctcgctccagcgccacgattggctgatgtcggtttcctccggcagcaggaaggcgatgccgccctccgcccccggcgcgccggtgatgccgttgcataccccgccgcaggcgttgtagtagccgggctcgtaatgcgggttgttgcggccatggccctgcagcatgcaggtatcgaaaggattcatgcccagaatccagtccagcgctgactgcgcgtagccgtgcagccgcggtgccagctccggccagcgccggccgcccgcccaggccgcggccgccagcgaagccagcctggcgttctctccctgccaccagtagccgctggcgttgtcgtgcggcatgaagaagcgcgcccccggcgtccggcccggccgctgcgcccattgccgcagatagccgaaggggttcccctcctgaacggcgctgcgcgccatctcgccctgcatgaccagccgccagccccgttccgcctccgccgcgtacagtccatccggcagcgtttccagataacgcgccagcgccagcgccggcaggccggcatcggacgcgtggcaataactgaactggcgctcgtcgtccagccaaaaccagccgtcctcatgctggcgcgccagcaggcaagccactcgctcggccgccgcgtcggcgtaatcgccgtcgccggtggcggcatgcagttcgcacgcggccaacagcgcgcaatagtcgtcgatcaggttttcccggccatcagccaggtaggacaagccatgctcctgcaaatggacgaagccgcgcctggccgccgccagcatcgcctcgcgcggcgcgtcgccgtcgcgcgacaagccggccgccgccgccagcgccgccaccgccatgccgccgccctggcgccagccggcttggaaggcggacgagcgcagcccctgctgggtggaataggcgcacaggctgcgccggtcttcgtctttgctccagccatcgaacaatgtctggtagaaaaagcccgattcgtgttgcatgcgcagcagaaaggccgcgccatgcagcgcctcgtccgtcatccgctcgtcaaaccacttgggctgcgccgacagcgcgcggcgggctcggaccaggctccagaccagcagcggcgtctgttgcggattcaggtggttggcgtaagaaaggtggctgagatatttcgagcagtcgccggaggcgtcgaaccagccgccgcgcgcgtcgcgccgctcatccgtcccctccacccgcgcctggcggtcggcctggtcgtacaggccactgcagcgctgcgatttgaagtagtgcagcagatcggacagcaacggcgtgccgaagcgccgatccgccacctcgaacggcgccgacagcagcggcggcgcgctgccgtccagccacagctggtagcggcccggcgcccgcagcgcgctgatatcggcctgccagtagtgccaatcgcgccagccgtccacgcgccccaaagcatgcagcgggctgcgcagcaccggacgccgctcggcgtccagcaccgtcacgctgtccaccgccgcgtcgcccggcccctgcagcagcgcgcgcttggcggcggacgtttcaaaccccagatgattgaacagaaactgcagcgccatcacgccctcctctgccggatatcaggaatgagcggcccgcccgttcagccgcggccgcttttcagcaacacctcgtactgcggattgaattcgtcgaaaatcgccagggcggcggcgcccagcgccaccacgtcgcgcccggcgctgcccagccgcaggcgctcgccgccgcggtgccgggtggacaccggcaagggatccagacgccgtaccagcgcctccatccaggccgggggcagcaggccgccgatcaccaccgcgtcgatgtccagcaggcattcgaggatgttcaccgcctgccgcaagggagcggccgcgcttgccagccaggcctcgccggccgcgtccacttcccgccgcgccaggtgctcgggcgtggccagcgcgccatccgccagccccagcgcctcgtacagcgcccgcaaggacacgtagcgctccagacagccctggttgccgcactcgcaggcgcgcccccccggcaccacgatcatgtggccgacctctcccgcgttgtggcggccgcccgcgtacaggcggccatccagaaacaagcccgcgccgaggccggtgccgatgaacaggtaaacgaagttttgcagctggctggccatgccgtacaggcgctcgcctatcgccgccgcggtggcatccttctccagcagcaccggcatgcccagcgccgcgctcagcaccgcggcatcgatgttttcccagccgggcagcgtggtcggccccaccgaggtcatgccctccacgccgaacggccccggcatcaccaggcccattcccagcaaacggctccaatccaggccagactcgcgccgcagccgttgcgccgcgtcggcgatcaagggcagcgccgcccccggcgacggccgcttcaccgccagttccaccctggcgcgcacctggccggccagatccaccaccaccgcgatcagcgattggtgatccagctgcacgcctatcgaatacgcgccgtcggggttgatgctcaacggaatggccggctggccgcgcgcgccgtcgcgcagcggctcgccggccgacagcacgccggcctccagcaattcggcggcgatgttcgataccgtctgcggcgtcagcgccgtcattctggcgatatccgcccgggtaagctgccgattgcggcgtatggtttccagcaccgcccggcgattgtgcgaacgggcgtgctccagattggttccggacaccatcagcgggtccggcttggcggcaggcgatttcatgaggcgggagtatggcgcggcccaccgccaccggcaagcatttgtcatttcaaggcaattaaataaatcaacttgacgaaataaatagccaatgctttactgctgaaaatccaaatgtcatcattgatgaggcggccgctaggccataccaagcatgcacattccagcgaaattcctgatcggcgtcgacggcggcggcaccggcacacggacctgcgtcgccgcgcccgacggcgcggtgctggcgcaagcggaaggcccgggatcggccttgtcgctgggcgtggaaaaagcctggcgcacgatactgtccacgctggacgcggctttcgcgcgcatcggcgtcgccagccccagctaccgcgactgcgcgctgggcatcggcctgtccggcgtgcacaacagccaatgggcgcggcagtttcaggctcaatcccccggcttcgccgcgctcaagctggccaccgacggcttcaccaccttgctgggcgcgcacgccggcaaaccaggcgtgatcgtggcgctgggcaccggcagcataggcgaggcgctgtacgccgacggcagccaccgcgaggtgggcggctggggctatcccagcggcgacgaagccagcggcgcctggctgggacagcgggcggcccagctcacccagatggcgctggacggccgcagcagccacggcccgctgactcgctcggtgctggaattcgtcggcggcagctggcaaagcatgatgggctggaacggccgcgccacgccggcgcagttcgcccagctggcgccgctggtgctggccgcggcccgcaccgatccgcaagccgacgcgctgctgcggcaggcgggcgaggacgcctgggccatcgcccgcgcgctcgatccgcgctcggagctgccgacggcgctgtgcggcggcctgggacaggcgctgcgcgactggctgccgcccggtttccgccagcaactggtgccgccgcagggcgatgccacccgcggcgcgctgctgttgctgcaacgttgaaaaacactaaggagaagactgcgatgaaaccccaccgacaggcgctggcctgcctcgccctgctggcctgcgccctcggcgcgccggcccatgccgacaaggtcaagctggaattctggaccgactcgctgaagccgcgcttcgacggctatttcgccgcggtgaagaaaacctacgaagcacagcacccggatgtggaagtgcagtgggtggacgtgttcaacgacaacttcgaaaccaagctcaacgccgccatcgccgccggcaagccgccggcgctggtcaaccacgacgtgccgcggctgttcaagtattcgcaaaaaggctcgctgatcccgctggacagcgcgctgggagccgacaagtccgcctacctgcccaacgcgctggccgacctgagcttcggcggcaagctgtacggcctgccctggtacaacaacgtcaatgtgctgacgctcaacggcgagctgttccgcaaggccggcctggatccgcgccatcccatcgccagcctggacgacgagctgcggctggccaaaatcatcaaggccaaaaccggcgtgcccggcctgctgccgcaattgggccagatagacggcatcatgctgggccagggcctgccgctgatccagaacggcaaggcggtgttcaatagcccggcgcacgccgcgctggtccgcaagttcgccgacgcctaccgggccggcgcgctggcgcgcgacagcctgttcgccgacgacaactatcaggacagcgtcaagctctacaacagcggccggctggcgatgatggaaaccgcgcccaccgccgcgcaaaaagcccgggaagacgcccgcggcatctacgccgccaccgtggtgcagccggcgccgctggggccgacccgcatcgtccagggcggttacctgttcagctgggcagtgtcccgcggcctgccggcgcgcacccagcaggaggcggtgaagttcgcccgcttcctgaccagcgacagccagcagctggccttctccaaagtgaccggcgccaccttcccttccacacagaaggcgctcgccgacagttatttcgtcaaggcctcggccgacggcggcgcgatcgaaagctcgcgcatcgaaggcgccaaggtggcgcgcaatatccgtaccctggtgctgaccggcgtcccccgggtcgccgatctgaaaaagagcctggtggacaatgtggaagccgccgtcaccggcaagaaagacgcgcagaaggcgctggacgacgccgccgccttctggaaccggcacttgcagtagcgacaggagcccagtctctcctcctcgccccttccggttagccggagaggggcattttttcagcgcccgcggaaaccctccatgaaatcgtcggaacgcaacgcctggctgttcctggcgccggccctgctgctgctggccgtgttcaccttctggccgctgctgttcggcggcttcatcgccttcacccgctacgacctggtgtcgccgccgcaatgggtcgggctggacaacttccgcgacctgctggacgacgcggtgttctggcaggcgatggccaactcgctgaaatacctgctggtggtgcccgccatccagctgtccggcatcgcgctggcggtgctggccaaccgcagcctgcccggcatccggctgttccgcgccgccctttacctgccggtggtcaccaccgtgtcggtggtgggcatcatgtggaactggatgtacgccgattacggcgtgctcaacagcgcgctgcactggctgaagctgttggcggcggagcgcgacatcggctttctcagcgacgacagcctggcgctgtattcggtgatgttcgtcacctggtggcgcggcctgggctattacatggtgctgtacctggccggcctgcaatcgataccggcggagatgcaggaagcggcgcggctggacggcgccaacgcctggcagcgcttctggcgcatcaccgtgcccatgctcaagcccaccattctgttttgcagcctgatctccacgctggacgcgctgaaggctttcgaagaggtgctggtgatgacgcgcggcgcgccgctcaactccacctacaccgtgctgtactacgccttccaccagggcttcaaccagctggacttcggccgcggcgccgccgccggcctgacgctggccctggtctgcctgctgctggcctggctgaatttcaaactgatccgcgccgaccaccgctgaggacgccatgaccgccatcgccctgcttcgccccgccgcgcgccgccgcgcgctgcgccgcctgccccatagcctgttgctgctggcgctgtccttcgcctgctgctatcccttcatctggacgctgggcatcgccttcggcaacggcgagcaggtgttcgacttcccgcccgagctgtggccgcgcgacgccggctggcgccacttcatcgcggtgtgggacgccattccgctggggcgcttcttctgcaactcgctgtggatctccgggctgaccaccgccggcacgctggtcgtttcggcgctggccgccttcccgctggccaagctgcgctttcgcggccggcaactggtgttctacgccattctcgccaccctgctcttgcccagcgaaatcaacttcatcagcaactacgtcaccatttcgcggctggggctggacgacagccggctgggcgtggtgctgccatccttggccggcgccttcggcatttatctgatgaagcacgcgttcgaggagattcccgatgaaatcgtcgacgccgcccgcatggacggcgccggcgactggcaggtgttctggcgcatctgcctgccgctcagcctgccttacctcgccacgctgggcatcttcacgctggtgtggtcgtggaatgtctatgtctggcccagcgtggtgctgaaaacaccggaactctatcccttgtcggtgggcgtgctgtacctgaagggcgccttcgccacctccacccggatggtggcggccggcgcggtgatcgccatcgctccggtgctgctggtgttcctgtgctgccagcgcttcttcatgcgcggcatggacggcgcggtgaaatagccgccccccatcgtattgtcagacagcggaggctcctttactctggctgcagcggccgacattccaaaaccatacggtccgctcataactagaccaagacaagaggagagccaccgatggacaagcacccacccgttctgccttccgcccgcccgctgcaacgccaggattacaagaccctgagcctggccgcgctgggcggcgcgctggaattctacgacttcatcattttcgtgttcttcgccgtggtgctgggcaagctgttcttcccccccgccatgcccgactggctgagccagctgcaaaccttcggcatcttcgccgccggctatctggcgcggccgctgggcggcatcgtgatggcgcatttcggcgacctgctgggccgcaagcgggtgttcaccctcagcatcctgctgatggcgctgccgacgctggcgatgggcatgctgcccacctaccacgatatcggcatctgggcgccgctgctgctgctggcgctgcgcattctgcaaggcgcggcgataggcggcgaggtgccgggcgcctgggtgttcgtcgccgagcactcccccagccgccacaccggcttcgcctgcagcatgatcaccgccggcctcaccgccggcatcctgctgggctcgctgatcgccaccgccatcaacctggccttcaccccgcagcagatcgccggctgggcctggcgcctgcctttcctgatcggcggcgtgttcggcctggtggcgatgcagctgcgtcaatggctgcatgaaaccccggtattcgccgagctgaaagcgcgcaaggcgctgtccgaggagctgccgctgaaaacggtgctgaagaagcacaagacggcggtggcgctgtcgatgttcgccacctggttcctggccatcgccatcgtggtggccatcctgatggcgccggcctatctgcagaagcaattcaacatcctgccggtggacgcgctgcgcgccaacagcctggccatcgtggcgctgaccctgggctgcctggtcgccggcgtgctctccgaccgcatcggcagcggcctcaccttcatcggcggcagcctgctgctgggcgccagcagctacgccttttacaccgtgctggcggtggacagcagccaactctatccgctatacgcactgcaaggcttctgcgtcggcatcgtcggcgcggtgccgctggtgatggtgcgcgccttcccggcggcggtgcgcttctccgggctgtcgttttcctataacgtcgcctacgccttcgccggcggcctcaccccggtgattttgtcggtctggctgaaatacgacgcgatggcgccggcctactatctgctgctgcaatgcctgctgggcttgctggtcggcgtttacctgctggcgcggcggcgggacgccgggctggcggccggcattcaggcctgaggcgggggcgggggcggcagcaggtcggcctccgccacttcgggcagccgcgcggccgggtcttgccggtagaacaggctcagttgccggtacagttccgggtaatcgcgccgctgcagatggggaatctcgaaaaatgcctcgctctgcaccgcgaagaactccgccgggttctcgctggcgtacgggtccagccagccttccaagccatggtccacctcgcggcagaactgccggtaggcctggttccacacccggctccacaacgcgcggtccatgcctttgtgcagcggcggcgcgccgttggccgggccatccagcatgtcgaactgatgggcgatctcgtgcagcgccacgttccagccatccaatagcggcgactcgttgacatccggccaggacagcaccagcggcccctggtaatgcgcctggccgatcagcacctgctcgccctcgtgggtcagccccatgccgtcctgccagcggctgcgcaccacgaagggcgccggatacagcacgacctcgcgccagttgccataggccccgattcccaggttcatgccgggcaacgccaactgcagaaccgcccggcagcgcatggcgtcgtccacctccatatcctccagcgcggtgatggtcttggccatcagcagctcgccggccaactgcagcaggcggccgttttcctcggcggacaggccggccagcaacggcatcgccgcggcttcttcccgcagtttttccagcaatgcggggggcgcccgcttaccgcccaggcggcgcatccagtctagcagcatgaactcttggccttgaatcgcgtcagtcatgaatacctttgggcgcggcggcgcaattcaatggctccccgccctgcatcacaggagaaaaacatgaccgtccccatctggcacgatctggcgctgaacccgctggcggcgttcggcatattgctggccctgggcgtgataggcggccagatcgccgtgcgcgtcgcccgcttgcccgctatcaccggctacatcgtcaccggcctgctcatcggcccgtacagcctcaatctgctggaccagcagctgctgaacgaagcctcgctgttcgtgcagctggcgctgggcatcgcgctgttcgaggccggccgccgcgtcgacctgcgctggctgcggctggagaaaaccctgctggccaccaccctgctctactgcctgctggtgttcgcggcgctgtacgcgctattgagcggcaatggcttcggccccgccgccagcctgatgctggccgcgctgggcatggccacctcgcccatcgtagtgctggagatcgtgcgcgaatcgcgcgccgacggccaggtgagcgaacggctgctgaccgccaccgcgctgtccagcctgctggcgatgataggcttcgcgctggcgctgtcctacagccatttgtccgcaaaccacagcgtggaggacggcatcctgatgccgggctggctgattctgggctcggcggcgctgggcctggccgccggcctggtcaccacccagctcaaccgctggctgggcggccaccagcgcgacgcgcagcgggtgatgctgttcggcctgatcgcgctgctggtcggcctggccgacatgctgcagctgctggcgctgctggcgctattggtggccggcatgagtacccgcagcctgcgccacggctacaccgtcagcgaaccgggcatcctgtcgctcagccacgtgttcacggtggccttctttgtctccgccggcgcccacctgtcgccgcaggcgctggcctcgcattggcagctggccttgctgtgcctgatcctgcgcagcggcatcggcatgctggtgtggtggctggccgcgcgcggcaacggcctctcgcgcaagcagggcgcctggctggggctggcgctcagcccgctcaccggcggctcggcgctgctgctgggcctgggcatggtgtcgctgggcgaagccgccacctcgttcagcgccgcgctgatggccgccctgctgatcaacgaaatcgtcgcccccatcctcacccggctggcgctgcgcctggccggcgaaaccgcaggagccagccatgcttgaattcaaccaaagccagccgctcaccctgggcgtggagctggagctgatgatactgaaccgccgcgactacaacctgacgcgcggatccgacgacctgctgttgcaaatcaaccgcaagccgcacggcttcgacatcaagccggaaatcacccagggcatgatagagatcggcaccgccatccaccacgacgtcaaccagatgctggaagagctgctggcgatacgccaattgctggtggacagcgcccacaagctcaacctgggactggccggcggcggcgcccacccgttccagcactgggacgaccagcgcatctaccccaaggagcgctaccaactggtatccgagctgtacggctatctggccaagcagttcaccgtctacggccagcacatccacatcggctgtcccgatggcgacgccgcggtgcgactcaaccactacctggcgcgctacattccgcacttcatcgcgctgtcggcgtcatcgccgttctaccaaggcgtggacaccgccttccagacctcgcgcctgaccagcgtcaacgccttcccgctgtccggctgcatgccggtggtggacagctgggacagtttcaaccactacttccagcgcatggcctcgctgggcatcgtcgccagcatgaaggacttttactgggacatccgtcccaaaccggaatacggcacggtggaaatccgcatctgcgacaccccgctggcgatagacaccccggtgctgctggccgcctacgcccagatgctggcgcggcgctgcttcgccgaggactggcacgacatcagccccgagccctacctcacctacagctacaaccgcttccaggcttgccgcttcggcttcgacggcgtgctggtggacgcccgctccaatcgccagcaaggcctgcaggaagacctgctggacagcctgaaagcgctggacgagcacgccgaggcgctgaattgccaagcccagctggcccagctgcgccagcgcgcgctcaagcgccacagcgacagccagtggctgcgccagatccacgaccagagcggctcgctcagcgaagtggtgcgccggcaaagcgaacactggatgtacgccgggccgggagtgggcgtaaactgaacgcgtcgaaacatgcctgaggcatcatgccctttcaacttccgcaacagccggcgccggcgctgcccgcgcgctggtgcgttttcgacggcagccagctgtggctgctggacaagcgcctcccctccctgccgccggaaggctgccagttgaccggcaccagctttctcggcgtgcacgaagagcacaatctgttcatggccgaactggtgggaaaccgccccgagcaaggcgaatggctgccgctgcggccggccttgatggcgctgccggcggcgcaaatccaggccgcggcgcgcgccgcccagctgcgccagttccgccacagccaccgctattgcggccattgcgcgtcaccgctgcaaaccagccgggaccaggtcggcaaacactgccccagctgcggccaagtctactatccgcgcatctcgccggcgatgatggtgctggtcaaccgcggccgcgagctgctgctggcgcgcagcccgcacttcacccccggcatgtacagcgcgctggccggcttcgtcgaacccggcgaaacgctggaggaatgcgtgcaccgcgaaacgctggaagaagtgggcatccgggtcaagaatctgcgctacgccttctcgcagtcctggccgttcccgcactcgctgatgctggccttcaccgccgagtacgacggcggtgacatccgcccgcaggaagacgaaatcgaggacgccggctggttcgacatcgacgcgctgccgacgctgcccagccccatctccatcgcccaccacctgatcgcgcatggccgcgagctgattctcaagcaggaaacttaagctcggctgaaaacctgaaacggcggggtgtttcgatcccgccgcccctgcgccgcattcgcccaaccgcctcaaaaaccagcccgacttcggcaatatcccacgtcggcgtcggccaaacccatcccctgtctttcatgcataaaactcacgcgcaatccctcgcgcgccgcggcaaaaattcaaatagaatatttgctcaaaaaggcgctgcacaatgccgctcgccttgcccacccccggatgaaagaagcaatcgtgaaacagaaaaccctgctgagccttgccctgacgctgagcctgccgcttgcctgcgcccacgcgcaggctgccgccatgaccgtggacagcctggatgggccggtcacccgcaatgaaatccagtccttcgtcgattacgcccagggcctgcagccaggcgcgtccaatgtcggcaatgaatgggcgcagggccgcagcggcgaaaacctgaaagccatggcgctggtttacgacatcgcccccagccagccgctgttggacaagatggtgtcgttttgcgacgcgctgctgtcggaacgcaatgacatcgcgcccgcccctacgggccagcgcgtgatctggaccggccgcatcgacccggtatggccgaacacgccggacgtcagtccgatccagaccggcggcgaacaaggcgacccggtcggccacctggccagctgcgcgcgccaaatcctgaaaaccagcgccatctacgaccaaaaggtcgccggcggcgaccccttcctcttcggcgccacttatttgcaacgcgccaagacttatctgcgcgaggccgacaagacggtcgaccagcacattctgaaatcgctgctcaagctcagcgacggcaaactgatgtacttcgccgccaacgcgccctacaagggcggacagccggtgccgtggaaccagcagatgatgttcggttacggctttctcaacctggcccaggcacatgagctgctgcgagacaatccctccctggtcaaacgctacgaccagatcctgcaggccaacctagactggttcctccagtccggcctcacccgctacaccgacaaagccggccgctccgcctacgattggggctacaccctgcccgacacctccggcgaggacaatagccatggcagcctggacaccgccggcctgtaccggctgtatcaaagcggccgctacggcctgaaagccgcgcagctggcgcccatcgccaacaccgtcctcgacgtgatgcgccttggcgaccgccactacgctggccgcctgaacggcaccaccggcgccggcaacagcaaggacaccaactacctgcgcagcggctacctgttcacctccctgttccagcccagcgcctactacaccatgatgagcgacgccggcatccaggacggcagcaccacctcccgcatcgacgccttctcccgcttcctggcggtgaaggccgcgcgcgccgccggcaaaacacagcgttaagcgcccacgggcctgaccgcaaaagcaaaccgcacagactggctgtgcggtttttcatgtgcgcgccaaagcgccaagctagccgtccagccccagcatgatgtgcaggccccactccccgccatggaaacgatagcgccgctccgccaccagcaaccgcagcggcgggtcgcccagcaagaagacatcgcccttggccggcgccggatatccatctggcagttgcttgatcggcggcgggtccccctttaaggcggcaatggaaaacggcgtgtattcaaaggtgattttcatgcaaaatcctttattccaaaagggtcatgaaattcaaccatagcaggcccgccggcatttgccagatggcgacgggctccatcccgcgccaacaatcatcaaaccctgccatcagccaaagcccttccgccaccgccatatccgataccgcccactcgccaccaacgccatcgcatctcggcatccccgcctgcgcgcgtcgcgccacgcgagtccctggccgcatgccgaacacatgctaatataggcaaatacgcgacataaccttgctcgttttatccaaacaacatctcaagccaatatgaaacttatcaagctcatcagtcccttgatcgccatcggtctggccatggccagttccgtgagccacgccgaaccggaagaccagcccctgccgggcgacttccaggccgctccggcggcaaaaccgctgcacaaatcacgtgccagccaggcagccccccgcgccgccagccacaacaaagccgcgcgcgccaagcatcacgcccccaaggccagccacggcaaactgaaacccgccaaagcccacgctcacgccaagcaccaccgccacaccggcaaaaaacacgcgaaaaagccgcatggcgcgcatcatgccgccaagaaagcccacaagccggccaaagcacacaaaaacaaacaccataaaaacaaaaagctagccaagaagcatcacgccaagcataaaaaaacgcagtgactagcttgtcaatccaaagaaagctcggcataatgccaatctcttcgccggtgtagctcagttggtagagcacctgacttgtaatcagggggtcgcgagttcgattcctgccgccggcaccaagattcattcccagaagcttctgggaatactgaaaaagcccgcagacattagatctgcgggctttttcatttccagagccgtccgcagccatctcatggattccagcgcaaaagcggggtatgtttcggggtatgatccagtttgattattgagatacccgacagcccttaccgcccagaccgtgaagcacatcccctcttgaagcagcgcatcgttgtctccaccaaactgcggcgcgataagcgctccagcgtttccagattcgtcgccccaagcgtttgcacgccgcaatcgctgcgttgcggacttcgcggcctgcaattccactagttgacgctcttgcgcggcggagtcaccggcataatccctcgcccaagcagcgcagcgtaacaaccctgcgtgtcataagcaccatccagcgtcgccgtagctattggcttatccgcaggcaactgcattaacaactcaggcagtataggtgcgtcgcccacgccgttgccgctcacttcgatggcacggatttccagcgcttcggcattgatgcccagatgtaccttgcgccactggcgacgatattcggcaccgtactttttgcgtttcccctcgccctcgtcgtgaaactggatgccggtgctatcgaccagcagatgccgcgggccgttgctgcgacgatagctgatccggacccgcaaggtacgctggcgacggcatggtggagtgatccggcacaggccagtcaaacccagccaattgcagcaggctatgcaccatgcccagactcttccgcaacggtagactgaacaggcatttgatgctcagacataactggatggcagcatcggtatatttggctggccaaccgtgtgacctcctcccgcaaaaacgtagcggcgaaaagtagagatttctggcaaattgacctccacccgactaaccaagcggtctagtctagagatttccggcttcaaggtgagcaagtcggaactcgctcggggtctggtcgcccagcgaactgtgcggcctgaattcgttgtaatcctgccgccaacgctcgatcttttcacgtgcgtcgtccagcgatagaaaccaatgcacattcaggcactcatcgcgcagactgccgttaaatgactcgataaaggcattatccgtgggttttcctggtcgtgagaagtccagcgtgacgccttgctcataggcccactggtccagcgccaacgaaataaactcgctgccgttgtcgacctgaatccgttgcggcgtcccgcgcaaggcttgcacatgctgcatcgtagccaccacgtccgcggctttcagtgcgaaatccaccgtgatcgccaagctctcccggctaaaattatccaccacagttaaggcccggattttctggccgttgaacagctgatcggcgacgaaatccatgctccagcacgcgttcaaattggagacggccggccgagcgtggcgatgcgccgctgccactcgccgtttgggccgcttgcgccgcagattcaagccttcctcgcaatagatccggtaggtcttcttgtgatggatccgccagccttcgcgccgcagtaggacgtagatgcggcgcgcgccataacgaatgcgagtggcggcgatcaatccgcgagatcgccgccactcgcattcgttatggcgcgcgccgcatctacgtcctactgcggcgcgaaggctggcggatccatcacaagaagacctaccggatctattgcgaggaaggcttgaatctgcggcgcaagcggcccaaacggcgagtggcagcggcgcatcgccacgctcggccggccgtctccaatttgaacgcgtgctggagcatggatttcgtcgccgatcagctgttcaacggccagaaaatccgggccttaactgtggtggataattttagccgggagagcttggcgatcacggtggatttcgcactgaaagccgcggangcgggccttcgccggcgcgctggcgcgcggcggctatgccaccgatccggactacgccggcaagctggcgggactggttgggcgtctgcgtggagagagtttgtagattttggcggaagagggtggggaggtgggcgcggaggcgtccttttttctttatttgcggaattttggaaaataaaacggaaaaagccgaaatcttgcgatttcggcttttttactggtggagataagcgggatcgaaccgctgacctcttgcatgccatgcaagcgctctcccagctgagctatacccccggtaaactgtttttgctgcccgctttccgcctggaatgcggaatgcgtttgaaacctggtggagataagcgggatcgaaccgctgacctcttgcatgccatgcaagcgctctcccagctgagctatacccccagttgaagctggcgtccccacggggattcgaaccccggttgccgccgtgaaagggcagtgtcctaggcctctagacgatagggactaaattgtggtggagataagcgggatcgaaccgctgacctcttgcatgccatgcaagcgctctcccagctgagctatacccccacatattctgtcgattccgctttcgcggcggccgtttggtctcgacaggaagcgcactatacattgccggttttttccgtgcaagcgttttgcggaaatatttcaaaaaatcggacaaattacccgatttgactagccgtggcgctgtttggcgggcgaggcgcaggcgttatgggtatttatatttccaaaagaaataaataagaaaaatattattactttgaggtctatgttgcgactgttaaggtgccgacatgcccgccgctgcggcggcgatcctggatatcgcggagaacctgaagatgaaaaaactgaatgcagtactggcgctggcgctgaccctgggcgcggccgccgcgcaggcggacgatctggcggccatccgcaaggcgggcgtgctgaagatcggcaccgagggcacatacgcgccgttcacctatcataacccggccggcgaattgaccggcttcgacgtggagctgggccaagccattgccaagcggctgggcgtgaaggcgcaattcgtcgagggcaagtgggacggcctgatcgctggtctggacgtgaagcgctacgacgtggtgatcaacgaagtggccatcaccgacgcccgcaagcagaaatacgatttctccgagccctatatcgtgtcgaaggcggtgttgatcgtccgcgacgacaaccgcgacatcaagcgcttcgaagacctgaaaggccgcaaatcggccaataccctgaccagcaacttcggcaagctggcgcagcgctacggcgccgaaatcgtgccgacccagggcttcaacgagtcggtggctttgctggagtccggccgagtggaaaccaccatcaacgacagcttgtccttcctcgacttcaagaagaagcagccggcctcccgtctgaaagtggcggccaccgaagccaatggcgacgcttccggcgtgctcctgcgcaaaggcagcccggagctgaaggcggcgatcgacaaggcgctggctggcatcaaggcggacggcagctatcagaagctgtcccacaagtacttcggcgccgacgtgtcgcattgagttgaggagcagcaatgcccccgtggttgcagttgatggcggactccttgccgtcgctactttacgccggcttcgtattcaccgtgccgcttaccctgctgtcgttcgccggcggcctggcgcttggcctgctggtggcgttgatccggctgttcgggccgcgcccgctggtgctcttggtgcgcgcttattcctggctggtgcgcggcacgccgctgttggtgcagctgttcgtgatcttctacggcctgccgcgcgtcggcatcgtgttcgatccgtttccggcggccttgctcggcttcgtgctgagcgtgggagcgtacacttcggaagtgatacgcgcggcgatcgcctcggtgcccaaggcgcagtgggaggcggcgtattcgctgggcatgagctggtcgcaagcgatgcgccgcaccatcctgccgcaggcgggcagggtggcggtgccgcccttggccaattccttcatctcgctggtgaaagacacctcgctggcggcggtgctgacggtgccggaaatgttccaggcggcgcagcgcatagcggccaccacctatgagccgctgctgttgtatctggagaccgcgctgatctacctgttgttgagcacggtattgacctggctgcaggagcggctggaaaaacgttttgaccggcacgtggcgccggtgggagccgcgtcatgatcaagctgagccgcatcgtcaaatctttcggcgagcagaccgtgctgcatgatgtcagcctggagctggccgagggcggcgtcaccgcgttgatcggcccgtccggcagcggcaagagcacgctgctgcgctgtgccaacctgttggagacgccggatggcggcgagctgcagctcgccggcgaaaccttgcgtttcgagccgggcagaaagctgtcgcgcgacgccgtgctgcgcgtgcgccgcgtcaccggcatggtgttccagagtttccagctgtttccgcaccagacggtgctgcagaacgtgatggagggactgttgaccgtgcagcgctggccgcgcgataaggccgagcggcgcgcgcgcgagttgctggacaaagtgggcatggcgcacaaggcggatgcctggccgtccaccctgtccggcggccagcagcagcgggtggcgatcgcccgcgcgctggcgccgtcgccgcagctcttgctgtgcgacgagccgacgtcggcgctggatccggaactggcggccgaggtggtggcggtgctgcgccagctggccgcagacggcgtcaccatgctgatggccacccatgatctgcggctggcgtccagcgtcgctcgcgatgtggtgtttttggagggcgggcgcgtcgtagaggctggccccgccgcgcagattttccgccagccgcgcgaggcgcgcacggcggaatacgtgtccacgctgaccgccggcgccagggatctggtgcagatctgaagcgtctcaggccgcgctgacgcggccgcggccggcgcgcttggcctggtagagctggcggtcggcggcttcgatcagcgtctgcggcgcggtgtccggctccggctgggcgacggcgacgcctatgctggcggtcacggcgccgcccagctccgaatcctggtgcggaatgcccagctcgcgtatcgattgcaggatggtttccgccaggtgcgcggcgccttcgcggtcggtgtccggcaggatgcaggcgaattcctcgccgccgtagcgcgcggccagatcgtgcggccgctgcagcgcgcggcgcattgcctgcgccacctggcgcaggcagtcgtccccggcctggtggccgtagcggtcgttgaagcgcttgaagtagtccacatccagcagaagcagcgcgactggttggcgctgcctggcgcacagcagccagctggtctgcagctcctcgtcgaacttgcggcggttggccacgccggtcaggccgtccatcagcgcgatcgaattgagcaggtccgtctggaatttcagcgccaggtgggtgcggacccgggcgcgcaagatggtgcggttgaccggcttgacgatgtagtcgacgccgcctagctcgaagccgcgcgcttcgtcggcctcctcgcgctgggccgagatgaagatcaccggcaccgcgcgggtgcgcggatcctcctttagccggcggcagacctcgaagccgtctatgcccggcatcaccagatccagcaggatcaggtccggcatcagcgcctggcattgcgcgatcgcctgttcgccgtccagcgccatgaaaatctcgcactcgtccttgaataattcgcgtatcagcaagatgttggcggtttggtcgtccaccaccaggatccgaggccgcggcgcgccgggcaactggttcagggattggtccatgtcatggctcgctttcgatcagggttttgagcagatgcagggcaggcgcgaattgcaatcgtccaacctgcgccaccaggctttccacttgcggccgcatgcgctctcccgccagcggcagcagcgcggtggccaggtcgatggcggccaggttgccgcgctccagcagtggctggatcgcctgcagccgctcgcgccattcctgaaccgacagcgccggcgcggcggccggcgcggcagccgcgaccggttcgggcaggcggcgggccagctggcgcacgctgtcttttgccagctgctgcagcgccatggcggcttcgcgccaagcatcggcatccagcgggcgcggcgccgacggtttcgcgcattgctccaattcgccggcacggcgggccagcgcggcggcgccgaccgtggcggcgatgcctttgagcgagtgcagcgtcgccgcccgctgcgcggcgtcgccgctttccagctgcagttgcagcaaattggccagcagttccgcttcctcgatgaagcggcgcagggcgttgcgcatggtgtcggcctgctggccgaaacgccgcagcacgacttcctccggttcgatgtcgaaggcgggcgcggcgccgacgaccgccgcttcggtccgcggcgcgcgtccgcacagcgccagcagccgcggcgccagctgattgatgtctatcggcttgccgatatggtcgtccatgccggcggccaggcattcggctcggtcggcggggctggcgttggcggtcatcgccaggatcggcgattcgcagccgctggcgcggatgcgccgcgtcgcttccaggccgtctatgtccggcatctgcatgtccatgatgatcacatcgtaatcggcgtcggccgcggtggctttttccacgccgctcagcccgccttccgccagctctacgcgcgcgccttcaagggcgagcagctccgacgccacctgccggttcagcgcgttgtcctccaccagcagcagccgcatgccgggcaggcgcggctcggcggcgatctggcagggcggcccggcgcggccgctcaggcaggcttgcaccgactcgatcagttgccgcggcgtcatcggcttggtcagcagttcggcgaacggcgcgtcggcgatgtgcgacagggtctcgcggccgttggcggtgaccatcatcagcaccggcggcttgccggcgccggcggcgcgcaggcgggccgcggtttccacgccgtcgctgccggccaggcgccagtccagcagcaccgcgtcgtagcggcggcccgcctccagcgcgcgcgcggcctcggcgccgctggcgatgtagtcgctatgccagccggcggcctgcagcgtgtggcccagcacttctcccaccagcgggttgtcgtcgacgatcagcactcgcagtgctttcccgccgggggccaccagcggcgcgggatcggcgattttcagcgtgatttccagccagaagcggctgccgcggccgggttcgctctgcgcttccaattggccgcccatcagccgcgccagccgctggctgatcgccagccccagtccggtgccgccgaagcggcgggcggtggacgcttcggcttgggtgaagccgtcgaacacgcgcttgagctgttccgcggcgatgccgatgccggtgtcgctgacgccgaagtgcagcgtcgtcgcgtcgccttgtctgaggatctgcccgacgctgatgatcacctgtccgcgttcggtgaacttcatcgcgttgccggccgggttgatcaggatctgctgcagccgcagccggtcgcctatcaccgcggccggcagttccgggtcgatttcgaacaccggctccacgtccttgtcgccgtggctgccggacaagatgatgcccaggtcgcgcagcaggtcgtccagcgcgaaggggtgggggtccagctgcagcttgccggcctcgatcttggagaagtccaggatatcgttgagcagccccagcagtgaattggctgcggcgcgggtcttggccacgtagtcctgctggcggatgtccagcggcgttcgctgcagcagctgcagcaggcccagcaccgcgttcagcggcgtgcggatttcgtggctcatattggcgaggaagcggcttttcgcctgattggcctgttccgcctgctgtttggcttgccgcagctgcatttccgagcgccgccgctcggcgatgtcggtggcgatcccgacatagccgctgatggcgccgtcgccgtcgcgcatcgcggtgaccgccagcgagacggcgacgtggccgccgtctttgcgcacataggtccattcgcggatttccgcgccggccgattccggcacatggacgaatacccggaagccggcaatgtcttcgccgtactgttggctaagttcgcgcccgcgggccgcgacttcgtcggccaggtggaagcgggccggcgtgcagcgacccaccatttcatcctggacatagcccagcatccgctccgcgccggcgttgaacaccgtgatcaggccgtcgcggtcggtggcgatgatggaaacttccgatgcggcgctcagcacattggacagtagcaggctcagccggctgacttcggcgtcgatcaggcgccggcgcgtggcgtcgatgcgcagcgcgatcacgcgttcgatcgcgccgtcgccgtcgcgctggaggacgatcacggtatcggcccagcgcagcgagccgtcgcgcgcgcggttgcagatttcgccgtgccaggcttcgccgcggtccagcgtctggcggatgccctgccagaacggctcgtcgtgcaggccttcggccagcatgcggtggttgcggcccagcagctcttcgcggcgatagccgctgatctcgcaaaagcggtcgttgacttccaggaagcgtccctcggggtcggtgaccgcgtattgcagctgctcgttgatgatgccgagcaaggcttggttctcgcgcagcgccgccgccagttgcagccggccttcaaccagttcggtgacatcgtgcaccaccgagtagaagccgcgcacttcgccgtccatcacgtcgggcagataatggaccagagtgtggcgggggttgccgtccagatcggggagggtgcgttcgaagcgcagcgattcgccgcgcagcgccgcttccacgtgcggccggctgatggagaacgacgcctcgcccagcaggtcgggcagccgggtgccgggcaggctgtcgggctctaggccgaaccagttgtgataggcatggttggccacccggttcaccagattcttgtcccagtagcctatcatcgagggcaccgagtccagcaccgtgcgcaggtcgcggcgagcgccttccagttgcaaggtgcgttccgccacttgttcttccagcctggtattcagcgccagcagctccgcttccatcgctttttgccgggtgatgtcgcgcaccgtcttggccgcgccaatcaccgcgccgttgtcgccgtagatcggcgccaccgacaccgccacgtcgatcaggctgccatccttgcggcggcgcaccgtctggaaatgggcgatgcgctcgccgcgggcgatgcgggacaggatgtcgtgctcttcgcgctccttgtcctccggaacgatcaattgccatagcgagcggccgagggcttcgccggcgtggtagccgaacatctcctgcgcgcccttgttccagctgatcacgatgccgtccagcgtcttgccgatgatggcgtcgatcgagctttcgacaatggtggcgaggtcattctcgcgtccagcagccgcttgcgcgacagcatttcgctgcgccaggcataggccagcgcggcgcagaacaggctgaacagcaagctgcccaggttgagcagccgcgttggcggcagctgcaggctgtcggcgaaggcggggctggcgtggaaggtcaggcgccagacgcggccgaaaatcggcgccgattgggtggcgacggcggcttcggccgagcctgaggcgtagctgcggaagaagccgagcggattggccggattggtggcgtcgctcagctccacccagccgtcctgcggatcctgctccaggccggccagcacttcgggcatcaccaccggggtgtagctccagcctagcgcctgcgcgcgacgttcggccaggctggccggcgtgaggatgtcgcggtagataggcatcaggatgagaaagccctgtttgctgaggcgcggcgcctgcagcagcgtgaccggcgcgctgatgcgcgcctcgccgctatcgaccgcctcctgggcggcggcgcggcggtcggggtcggaggcgatatccaggccgacggcctggcggttggcggccagcggttcgatgaactggatgatggcgtgctcggcgcggtaaggctggaactggtgaacggaaaagccggtggcggcgcgcatggcggcggcgaaggctttcagttcggtttccggcacccgcctgacgaagccgaagccgcgcgcgccgggaaattcgcgcggcagctcccggctcaggctgtagcggtggaaggcttcctgagcgtgggggccgtcgccggcggcgactaccgcgccgcgggcgccgcgcaggccataggcgtagcgctgcagccgctcgacgatggcggagagcgctcgttgcgcctgctggctggcggcctggcgcaacgtttcggcattgcgctgctcgatctgccggcaggccagcgtggtcagcgccagcgccagcagcagcgtggccgccgcccagcgcgcggccgaggagaggtggggcttgctcgtcatggcgaatgtcgtcgcaacggttgggtgggaccggcgcgggcgcgcgcccggcttaaattgatcatagttatgatcggggaatttgcgacgcggggcgtgtgggcgaaaggaatgaaaaaagcccgcttgcgcgggctgtttttttgtccgcctgggaagggcgggccgtctggcggcgtgtgaagcaggttttggtggagataagcgggatcgaaccgctgacctcttgcatgccatgcaagcgctctcccagctgagctatacccccatgcgctgcattcacagtgggagcgagtatatgtcgccgacgggcgcttgtaaacccggggcggcgcaaaacgtgaaatttcccgcgccgcgacgattggcatggctgaggacatgcgcgcatggcattgtcaggcctcaggacgctgtggctgggcgggcgctcggttataatcggcagtctggatgagggcgggaaggcgcggatgtcggttggtcattacgagaattttccggtaggttcgctgctgctgccgcgccggatgcggcgggcggtgcatgcgatctatcatttcgcgcgctacgccgacgatgtggcggacgagggcgacgccgacgcggccgcgcggctggccgaactggaccggctgtccgccgatttggcgcggatcgaggccggcgcggagccgcagatcgaactgatgcggccgctggcggcggcgatcgccgcgcatgggctgccgtttcagccgtttcacgacctgctgtcggcttttcgccaggatgtggtcaagacgcgctaccagagcttcgccgagctggtcgattactgccgccgctccgccaatccggtgggaaggctgatgctggcgctgtacggcgtcgacgacgcgcgcagcctggcccagtcggacggcatctgcaccgcgctgcagttgatcaatttctggcaggacgtggcggtggattggcaaaaaggccgggtctacctgccgcaggacgacctggcgcgcttccggctggacgaaggacggatcgaggccggccagtgcgacgacgcctggcgcggcatgatgctgtaccaggtggagcgcgcccgcaagatgctgcaggccggcgcgccgctgggccgcacgctgcaggggcgcctgggactggagctgcggctgatcatcctgggcggcgagcgcatcctgaagaagctgcacgcctcgggcggcgacgtgttcaggcagcggcccaagctgaacggcctggattggatatacatgatgtggcgggcatgccgggccgtatgaggccggcgcccgcgatggaaatcttgccggcgcccgggcggcgccggcggcagcataggagaggcgtgtgacgcccgatcagtattgcgaggacaaggccgcggccagcggctccagtttctattacagcttccgctttctgccggccgagcggcgcagcgccatcaccgcgctgtacgccttttgccgcgaggtggacgacgcggtggacgagtgccacgacctgggcgtggcgcaggccaagctggcctggtggcgcggccaggtgggccgggcctaccagggcgaggccgatcatccggtgatgcgcgcgttgctgccgcatctgtccgccttccagctgccgcgcgagcaactggaggaaatcatcgacggcatggagatggacctgtccatggtgcgttaccagcgtttccaggacctgctgctgtattgccaccgggtggcgggcgtggtgggccagctggcggcgcgcatcttcggctatagcgacgagcgtacgttggagtatgcgcatgagttgggcgtggccttccagctgaccaacatcatccgcgacgtcggcgaggacgcgcgccgcgaccgcatctacctgccgatggaggagctgcagcgcttcaactgcccggcgatggatatcctgcattacgaggaaagcgaggcgttcaagcaattgatggccttccagatcgagcgcgccgaggagcactaccgcaaggcatgggagctgctgccggcggcggatcgcaagtcgcagcggccgggcctcttgatggccgccatctaccgcgccacgctgcgggaaatccagcaggacggcccggccaaggtgctgaaccagcgcttgtcgctgggcactggccgcaaattgtggctggcctggaaaacctggactctcggctaccggccgtgaagcccagggtggcggtggtgggggccggctgggccggcctggccgccgcggtggagctggccggagaggcggacctcaccgtgctggaagccggacgcgaacccggcggccgcgcgcgccaggtcggcacggatggcgacaggtttgacaatggtcagcacattctcttgggcgcttatgcagaatgcctgcgcctgatgcggcgggtgggggccgagcccgaaagcctgctgcgccgcctgccgctgcagtggcggcgcgagggcggggtggacatgcgctgcccgcgctggccggcgccgctgcacctggcagccggcctgctggcggcgcgcggcctgggctggtcggccaaatggcagctggcgcgggcgctgctgggtttgcgcgccgccgcttatcgcttgccccaggactgcgcggtggccgactggctgcgcgaccacggccagcaggaggaggcgctgcgcgaattctggcgtccgctggtgttgtcggcgctgaacacgccgccggagcaggcatcgatgcaggtgctggcgaccgtgctgcgagacagcttgggcgcgcgccgcgcggccagcgacctgctgctgccggcgcgccacctgtcggcgctgtttcccgagcccgcttggcgctggctggccggccagggagcggacttgcgtctgggcagccgggtgcgccggttgtcgcgggaggcgggcaggctgctggtggatggcgaggcgtacgacgccgtggtgttggccgcggctccctaccatgcggccgctttgctggacgagccgcgcttgcgggcgcagttgcaggattaccgctactgtcccatcgtcaccgtctacctgcgcttcgcggcttcgccgcgcctgccggcgccgatgatgggcgtgcgcggcggcgcggccgactggctgttcgaccgcgaggcgctgtgcggagaggccggcctggtggcggcggtgctcagcgcgccgccggcgctgccggagcaggacgaactggtgcgcgcggtgctggacgacgtgcgtcggctggcgcctcatttggaacagccgatcgaatgcaaggtgatagtggaaaaacgcgccactttcgccagcgcggtgggtttgcggcgggcaacggtccgcagcggcgcggaaggaatttatctggccggcgattgggcatgtcccgattacccggccacgctggaaggcgcggcgcgcagcggggtggccgcggcggcagcggtgatgcaggatttacgaatgaaagcacgacaatgaaaacagagtttgccaaagatgccctggcagggcgcgtgatcctggtgaccggcgcctcccagggaataggccgcgaggcggccctggccttggcgcgccacggcgccgcggtggtgctgctcgcgcgcagcgtcaaggggctggagaaggtctacgatgaagtggtggccaccggcgcgccggaaccggcggcggcgccgctcgacctcctgaacgcgggcgagaatgagttcggcaacctggccctgaccatccagcgcgaattcggccggcttgacggcatactccactgcgcctcgcatttttacgcgctgtcgccgctgtcgaaccagaccatagaagaatggatgaaccagtaccggatcaacaccgtggcgccgttcgcgctgacgcgcgcctgcctgccgctgctgaaggcggcgccggacgcgtcggtgctgttcgtcggcgagagccacggcctgcatccggcggcgtattggggcggcttcggcgcgtccaacgccggcctgccttatctgaccaaggtggcggccagcgagtgggagatgcacgccaatctgcgcgtcaacctgctgacgccgggaccggtcaactcgccgcagcgcaaccgcacccacccgggcgaggccaagggcgagcgcggcgagctggccgatctgatgccgcatctgctgtactggctgggcggcgacagccgcggccgcagcggcgaggtggtggagctggacctgcgcaagccgcaatcgtgaacaaggcgggaacaagatgaaagcactggttttgctgatgacgctgctggcgctggccggctgcaactgggtaggcacggtttccggcttgaccaaggattccgacaaggcggtgggcgcggcctgccgccagaccggccgctcgctggaagagtgctatctgcgcaatccggaagccgacaaggcgtcgatttacgccggctggcgcgagatgaacgaatacatggcgaagaacaagctggagacgatggcgccgccgccggaaaaaccgaccggctccagcgccgcgatgtcggccgaccggccagccagcgccgcgatgtcggggggcaagaacggcgacggccccaagccgctcaccagcgaagaggccgaccgcgccgccaagaacgacccgcaggtggaagcggtgctggcggcgatgcgcaacggcagccccagcagcgcgggcagcgccgcgcgccagtccagtggcaagggcgagccggaccagaagcgcctgctcaacatcatccaggatctgaacaagaccgatccgggccgcgcgccgggttgagcgtttttccagagcccgctcgcgccgctcctgctatccttcccgccttgactccttccaccttgtcctgatttttccgatggccaaaaccaaaaccgtattcagctgcaccgagtgtggcgggcagacgcccaaatggcagggccaatgcccgcattgcaatgcctggaacaccctgaccgaagcggtgtccacgccggcggcggccggcccgcgcttccagtcgtgggcggccaatgtcaccaaggtgcagcggctgtccgaagtgcagaccgaggaaaccccgcgcgacccatccggcatcgacgagctggaccgggtgctgggcggcggcatcgtgcgcggcgcggtggtgctgatcggcggcgaccccggaatcggcaagtccacgctgctgttgcaggcgctgtcggtgataggccagcgccgcaaggtgctgtacgtgtcgggcgaggagtcggcgcagcagatcgcgctgcgcgcctcgcggctggcgctggataccagcagcgtcaacctgctggcggaaatttgcatagaaaacatcctggccaccctgaagaacgacccgccggaagtggtggtgatcgactcgatccagacgctgtacaccgagcacgtcacctcggcgccgggctcggtgtcgcaggtgcgcgaatgcgcggcgcagctgacgcggatggccaagcaaagcggcatcaccgtgctgctggtgggccacgtcaccaaggacggctcgctggccggcccgcgcgtgctggagcacatggtggacaccgtgctgtatttcgagggcgattcgcactccagccaccggatgatacgcgcgatcaagaaccgcttcggcgcggtcaacgagctgggcgtgttcgcgatgaccgaccgcggcctgaaaggcgtgtccaatccgtcggccatcttcctgtcctcgtaccgcgacgatgtcgccggctcctgcgtgctggtgacccaggaaggcacccgcccgctgctagtggaggtgcaggcgctggtggacgattgccacggcggccagcccaagcggctggcggtgggcctggagcagaaccggctgtccatgttgctggcggtgctgcaccgccacggcggcgtcgcctgtttcgaccaggatgtgttcctcaacgcggtgggcggggtgaagatcatcgagccggcggccgacctcgccatcatcctggcaatggtgtcgtcgctgcgcgacaagcccttgccggaaaagctggtggtgttcggtgaagtagggctggccggcgaagtgcggccggtggcgcgcgggcaggagcggctgaaggaagcggccaagctcggcttcacccgcgccatcgtgccgacggccaacaagccgcgccaggaaatcgagggcctgaaagtgctggcggtggaccgcctggaccaggcggtggaattctgcagggagtagacccggatgatagacgcccaactgatagagcaggagcggccctacctgctgcgttacgcgctggcgcagctgcgcgagcgcgacgcggccgaggaggcggtgcaggaaacgctgctggcggcgctggagtcgcagaacaatttctccggcaagtccaccttgcgcacctggctcacctccatcctgcgcttcaagctgatagacggcatgcggcgcaagggcagggagaagctgttcgaatcgctggaggacgaagccgacgacggcgatttcgatggactgttcagccaggatggccactggcgcgagccggtgaaggcctggagcgggccggaatcgcagctgatttcgcggcagttctggcaggtgttcgagcaatgctcgcaggtgatgcccaagcgcaccgcgatggtgttcgtgatgcgcgaggtgatgggtatggaaatcgccgacatctgtaacaatctggagatcaccgcgaccaactgttcggtgctgctgtaccgcgcgcggatgagcctgcgcgaatgtttttccatacgctggagccgggagggcgagctatgaagttgagttgccgcgcggccagccggctgatatccgccggattggaccggccgttgaccacgggcgaacacctgaagctgagaatgcacctgctgctgtgcggcaattgccgccagttctcgcagcagctggccttgttgcagcaggcggcgcgccgggcggggcagggcgagtaggcgcatgaaggaatgacgaaaccggcggcagccggttttttcttggcggccgattaattcattgtcatgattcggtctgaattcgaaccaggagcggaatgatggaacccagccggatgctgcagaaactgcttgccgatcatgacgacgatttgccggcggcggccgaagggctgcgtctgctggcggatgcggaaccgttgagcgacgaagaactgtccagcctgagctggctgatcaaccatgtggtcggcgagtcgcagggcggctgggaagccgcctggtcgctgcagcaaaagctgctgtcgcgagccgccgcgccccggctgctgcgcagcgccgccgtggccgccggcctggggggacaggaggcggatgcccggcaactggaggcccgtttggccgaagcctgcggcgtcagcggcgaactggcgggccgcgtggtgcgtttcgccagcttgcagcacctggcggccgggcagccgccgcggcaaacggcgcaggcgctggcgccgctgctggccgagtccttgccgccggccagcgggcaggacgcggcgctggccgccgcgctcaacaatatcgtgtccgcgctattggaccatccgcagctggacgaagcggacgaggcggtggcgcaggcgatgcgccaaggcgccgatcgcgcgcatgatttgtggctgcgggccggcacttggctgaaccgcgaacgcgcgcgctatctgcaggcgctggtggaaaaccgcctgggcgacgccgaggcggctttgcgggcggccgacgccggcctggccttgatcgccgccaatggcccggaggacgtggaccgggcgtttttgctgctggagcgggcgcgcgcctgccggcggctggataggcgcggcgaggccgaggcggcgtgggaacaggcgcggaggctggcggaggctttcgatcccgctttgcgcgagtggttcgaccgccggtcccaggcgctggcggcggcgccggcctagcgcggcggcctgcgccgccgggccaacttgggtatagtgtcgcctttcgccggggcggatcgccccggttcgcatcgccgcttcaggagtttccatgcccgccaaaccgtccgccccgcccgccgcccgcttgcacccgcgcaaccgccatcagggacgctacgatttcgccgcgctgatcgcggcatttcccgggctggccgcgcatgtcggcaagaacgctttcggcgacgagtcggtggatttcgccgacccggcggcggtgagggcgctgaaccgggcgctgctcaagctgttttacgatgtcgacggctgggacattcccgccggctatctgtgcccgccgattcccggccgcgccgactacatccacgcgttggccgatctgttggcgcgcgggcacaagaccggcattccgcgcggcgccggcatccgcgcgctggatatcggcaccggcgccaacgcggtctacccgctgatcggccatgccgagtacggctggagctttgtcggcaccgatgtcggcgacgaggccctgagcaacgcccaggccattctggcggccaatcccggcatggcggcgcatatcgagctgcgccggcagacctcgccgcagtcgatattccgccatgtgctggcggccgatgaatgcttcgacctgacgctgtgcaacccgccgttccacgcctcccaggccgaagccgacgccgctgcgcggcgcaaatggcagaatctgggcaaagacggcggcaagcgttcgcccaagctcaatttcggcgggcagaaccgcgaattgtggtgcgcgggcggcgaggaagccttcgtctgccggatggtggaagagagcgcggcgctggcggagcgggtgtactggttcaccagcctggtgtccaaatcggccagcctggccgcgatccagcgcgcgctgcggcaggcgggcgcccacagcctgaccgtgccgatggcgcaggggcagaagcagagccgcctggtggcgtggaccttcatggaccggcagcggcagaacgactggcgccagcgccgctggcagccgccggcggtgcggctggcggaaggctgaggcgaaaaaaagagccggcttgcgccggctcgtcaatctacaaaggtagagcttagagaaaagctttgccgcggccggtcagcgcttgcgcttgccggccttttcgctggcgcgttgcgggcaggcggcgcaagggttttcgcacatgccggcgccggtgagcgactgcttgagcgcgcagacggaacggcgacaggcgatgaagcggatcttctcctcggcggccaggtcgcggaaatggcgcatcacgttgtggccgagaaaatcggtgaacaggatcagcaggtcggtgcctgccggcaggcggtccaccttgcgctggtgcgagctgttgcggccgctcaggtggcggtggatggtgatgccgtagttctgcagcacgtcggggatattgcccagggtatcggctcctaccagcatggcgttcatctgacttgctcctgtgtgggtttttgaaaatgataataattatcatttgcagagtcaatcgcgtttttcaaggtttttttcctcagcctggcgcggaagcgtggccgccgctttgggctgccgcgcgcggaatgccttgtcggaaaaggattttcctccgctttttcctggccggccggtggccatcgcctattttgtaaagatggggcttgcccttaatgccagtgaggcgcggggagggaagcgatatgacggtggcggtgtgggggaggtgggcgctgtgcgcgctgctgctggcgccgctggcgcgggcgggcgacggcccgtgggcgagggcgcagcgcgatcatgccttgctgatcggcctggaggggacgtttccgccgtacagccagatgaaggacggccggctgcaaggcttcgaagtggacttcggccgggcgctggcggcgcagatgggggtggcggcgcgtttccagaccgtgctgtgggagcatatgctgaatagcctggcggccgggcggctggatgtggtgatcaaccaggtggtggcgacgcccgaacgcgccaagcgcttcgatttttccattccctatacctattccggcttgcagctggtggtgcgcaaggcggacctggcgcgtttccataacgccggcgatctggccggctcccatgtcggcgtcagttcgggttccaattacgagcaatggctgcggacccatgcgccgcaggcccacgtgcatttgtatcaggacgatccgaccaagtacgacggcctgcgccgcggcgaggtggacgccatcgtgatcaaccggctggcggcgttcaatctgtcgctgcagagcaagggcgagctggtgccggccgggcgcatgctggcgcgggaggatgcctgcgtggtggtgcgcaagggcaatccgcagctgctggccgaggtgaaccgggcgataggccatctgcagcgcgacggcaccttgcaggcactatcgcgcaaatggttcaaggccgacatcgtcagccggccgcaataggcgctcagccgtagacgtccagctggctgatcatgccggcttcgccgtcgtctttgacgaagacgccggcgcgccgcatctgcgcttgcggggcggggtcgctggcattggcgcgcagcgtcagcggcgcgtcgacgctgggcagcaggatggcgccgatgccgacatccttcagcgatagcagctggtccttgccgctgctgtcgcggccagtccagatcttcagctgggcgaaggcggggtcgttctcgtcgatcacgccatcgtgattgctgtccagcttggccaggtcggcgaagccattgcccgactgcgggccgaacagctcgctgccgtcattgatcttgccgtcgccgttcttgtccagagccagccagccgccctggctggagaagggcaggctcgccatctggccgttgtcctgcaggtcgaagctgacgctggcgccgtccaggctgccggcgttgctagccaggttgaccatcagcgggtcgtggcttgcggctccgccggactggtagcgctggttgctgtggtattgatagctgctctgcatctgcatgttcagcgagaattgcaactgcttgccgtcctgggtggtgatctgcccgctggcggtgaaattgagccgctgctgctcctggtaatctatgtcctgctgcgcgctgacttcgggctgggctgcggccggcgcttgcgtttggtctgggttgagcggaaacaggcacagcagcttgaagtggacgccgaaggctttctccagtatcgcttcgatcaagctgtagacggcgtccttgtccgaggccagatggccgagcaggctggactgggtcgcctggctgctcagctgcacgctgtcggcttgcggcattggttgctgcacggcgagggtctgggtgacgctgagggattggctctggctgaagctgctgccaaggctgacggtggcggaggcgattttcatggcgatgtcctgatgggcgcaccccctgctatcgacctgtccgccgtcgacttgacgccgcagttttccttattgccaatggttccaatggctgcttgccggcttataagtccttgccggagcgccagatcgaccagaccagccacacgctgttgaacagcgccagcatgaagccgacgaagccgaaaaagggcaggccgaacagcttggggccggcgttcaccgtcatcacgatggacgagcctatgatcaggcagccggtgacgatgcccatggtcagccggttgctgctgcggtccagctgcttgccgaagttgtccagccgctgcaggtcgaggttgacgcggaatttgccgtggcgcatgtcgcggccgatgcgcaccaggtcgcgcggcaggccggtgatcatctccagcccttccgacagcgactggcggccgcgcttgagcagcgccgccggatgatagcgggcgacgatcaactccttgacgaagggggtgatgtgcgcgaccagctggaagtcggggttgagctggcggcccaggccctccagcgtgatcagcgccttgaacagcatggccatgtccggcggcagcacgatgccgtggttgcggatcagcgtcatgatgtcggcgatcagctggctgatgttcagccccttcagcggcacgtgttcgtactggaacatgaattcgcccacttcgtcggcgaatttctgcatgtccaccggcgtgttgccggtccactcgaccagcacgtcgatgatcccgtgctcgttgtgctcggccaccgcagacagcaagtcgacgatctcgtcgcgccgcacgtggctgatgcggcccaccatgccgaagtcgatgaaggcgatgcggtgctcggccaggaagaacacgttgccggggtgggggtcggcgtggaagaagccgttgaccagtatcatcttcaataccgcgtcggcgccgcgttgcgccagcaacaccgggtccagcccgctcgattccagccgggccagttcgccggcggagacgccgtcgacgaagtcctgcacattgaccgcggcccgggtgtattgccaatgcaccttggggacgacgacgtgcggatcgtcggcgaagtccttggcgaagcggtccatattgcgcgcttctatcgccaggtcgagctcgcgcctgagcgagcgcgagaactgggcgacgatgctggagggctggtagcggcgcagctcgggaaactccagctccaagaggtgggcgaggtgggccaggatgcgcaggtcggcctccaccttttccatgatgcccgggcggcgcagcttgaccgccacttcgcggccgtccggcagccgggcgtggtgcacctgggcgatggaggcggagccgatcgggcgcatgtcgaattcggcgaacagttcgtccggttcggcgcccagcgcttcgcggatcagcttcttcaccgcggcggccggcacttgcggcacctggttctgcagtttttcgaattcgtctatccagtcgggcgggaatacgtccacccgggtggacaggatctgccccagcttgatgaaagtgggccccagctcctcgaacgccagccgcacccgcaccgcggtgggttggccggcagcgccgtcgggcaggccgagatttagccactcgccggccttttccaccgcgcgcggcagtttgagccgctgggcgaactctcccaggccatgacgaatcaaaattccgctgatttctcttagtcgcggtaagtcccgcattgcaatcaaggtttcccgaatcatgtgctttccactgtcccgcctggctttacactcccggtcccgtccgatagagtgcggcctatgaaattgcaactccgcttatcagcgctggcgctggcgggcttcatggtttttgcccaggccgcgccagacaaggctacaccggacaaggctcccgcagaggggaagcccgccgccgaaagcgcggcgccggacaaaccggacgaccccatctccaaatacgccgcgccccaagaggatgcggtgggcgacctgcttttgcaagcgatgagcctgctgggcgtcgcctaccgcttcggcggcaacacgcccgacgacggcctggactgcagcggcttcatccgctatgtatttcagaagtcgctgcgggtgaacctgccgcgcaccgccgccgaaatggccaaggtgggcaagtcggtggcgcgggccgaactggtgccgggcgacctggtgttcttcaacacgcgcggcttcaactattcccatgtcggcatctacatgggcaacaacaagttcatccacgcgccgcgaaccggcaagaacatcgaggtgtccaacctgacgcagagctactggagcgcgcgcttcaacggcgcgcgcagggtcaatcgtagcactgccgggcagacggcggacacttccgatgacgtcagcgtaaaaggcgcggcgaaaaaggccgcgccggcggcggaggtcaaatgccgcaagggccacaagaagtgcaaggcggaggccgcccgcggcaagtcgtcaggcaaggcggcgaagggcggcaagaagaaaaagggcaggcactgagcggcctggccgaaccgcgatgcccgcattggcgggcatcgtgttttcaggaactgagtcaatggcattgaatatggaatttccggtgtggcgcgaccccgacggcaacgtggtggcctgcgtcgaaaaactgaaagtgatgcgcgagaacctggaggagatcgcgcagatggcgcaggacgccttcgaggacgccgtgctgatgggctgcgacgaaaaacaggtgcgcgacttcatggtggcgatgatgcagaacctggacaacccctaccgcaccgaatgagagaaccatcttgatgccatttgaagcctttatcgggctgcgttacctgcgcgccaagcgccgcaacgggttcatttccttcatttccctgatttccatcgtcggcatcgccctgggcgtggcggcgctgatcatcgtgctgtcggtgatgaacggtttccagaaggaaatccgcggccgcatcctcagcgtggcttcccatctggaagtgagcagctacgatggccgcctcggcaactggcagggcgcgcgcgacatgctggtcaagcagcctcacgtcgtggcggccgcgcccttcgtcaacagccagggcctgttcgtcgcctacggcaatgtgcgcggcggcctgctgcgcggcatcgatccggcgcaggaagacaaggtggtggacgtgggccgccacatggtggccggcaagctggaagacctgaagccgggcagcttcggcatggcgctgggcgtggagctggcgcgccagctgggcgtcggcgtcggcgacaaggtgacgctgatgacgccgcaaggcaacatcacgccggccggcatgattccgcgcaccaagcagttcaccgtgaccggcctgttcaaggtggacatgttcgaattcgacgcctcgttggcgatggtcaatctgcgcgacgcgcagctgctcgcccgcatgggcgacaccgtcagcggcgtgcggctgaagctggacgaccccatgctggcgccgcagctgaaggccgatctgcgtccgcagctgccgcagctgatggtgaccgactggaccgacaccaacgccaactatttccgcgcggtgcagatagaaaaacggatgatgaccatcatcctgacgctgatcgtcgcggtggcggcgttcaatctggtatcgacgctggtgatggtggtgaccgacaagcaggccgacatcgccatcctgcgcacgctgggcgcgtcgcccggcagcatcatgaagatcttcatgatccagggcgcggtggccggggtgctgggcacattgtccggcgccgtcggcggcgtggtgatcgcgctcaatctggacgtgatcgtgccggtgatcgagcgcatcatcggcaccaagattctgtccagcgaggtgtacatgatcgactacctgccgtccgacgtgcagtggggcgacgtgtccaccatcaccatcatttccctgttgctggccctgttcgccacgctgtaccccagctggcgcgcggcgcgcacccaaccggcggaggcgctgcgctatgagtaaggtattgagctgccaggggctgggcaagcgttacgaggaaggcaagctggcgctggacgtgctcagcgacgtcagcctggaagtcgccaagggcgagcacctggccatcgtcggcgcgtccggttccggcaagagcacgctgctgcatctgctgggcgggctggacagccccagccatggcacggtggaggtgctggggaaggacttgtccaagctgtccgagcaggagcgcggcaagctgcgcaatgaatcgatgggcttcgtctaccagttccaccatctgctgccggaattctcggcgctggagaacgtgatgatgccgctgttgatccgccgcatggacaagaaagaggcggcgcgccgcgccggcgacatgctggagcgggtggggctgggcaagcggctggagcacaagccgggcgagctgtccggcggcgagcgccagcgcgcggccatcgcgcgggcgctggtgaccgagcctgcctgcctgctcgccgacgagcccaccggcaatctggatgcccagaccgcgcgccaggtgttcgagctgatgctggagttgaaccggacgctgggcaccagcctgatcatcgtcacgcatgacctggacctggcggcgcgcacccagcgggtgttgcgcctgaacgaaggcaggctggcggcgcccgaatccgcctgagcctgaaaaccgccccggcgaggggcggtttgccgttaaacaaggagtggaacattgctgttcatccgcaaggaaatgaattttttcgcgttgcttgacgcgctgcagaccgagaacggcctgatcgagctgggcctgggcgcgctgtgcgtgctggccgcctacgcgatcgcccgccgcttgttcatccactggttcgcccatcaccccgagcgctacgaccgcttcctgccctataccggcttccgcctggtgctgccggtgtcggcccagttgctggtggtgctggtgagcctggcctggagccgcttcgagcacgcgcctatgctggtgctgcacatcatcagcgcgctgctgttctggctggcggtgatccggctgtgcacggcggtggtgcgccaggcgctgccgcaaggcaagttcgagcgcaataccgaacactttctggcctcgatgttctggctgggcttcgtcagctggaccataggcttcgacgtggcggtgatggactggctggagtccatctccttccacatcggcaagacccggctggatctgctgaccatcatcaacggcctgctgtgggtgacggtgatcgtggtggtggcgctgtgggccagccgcctgcttgaagcgcgcatcatgaagctcaagcacctcgaccccaatctgcgcatcgtgttcgccaagctcacccgcaccggcctggtggtggcctcggtgctggtggcgctgccggtgatgggcatagacctgaccgtgctgtcggtgttcggcggcgcggtgggcatcggcctgggcctgggtttgcagaagatcgccagcaatttcgtgtccggcttcatcattctgctcgaccactcgatccgcatcggcgaccggctgatggtggacaaccgcgtcggctacgtcaccaagatgacttcgcgctacgtggtgctgaagggcgccgacggcaccgaggcgctgattcccaacgacgcgctgatgtcgaatacggtgatcaatcagtcgtactccgacaagaatatgtggaccagcctgccggtgcaggtggcctacggcaccgacctcgaccttgcgctgtcgctgctgaagcaggcggccgaccagccgcgggtgctgaagaacccggggccgaacgccttcgtcacgctgttcgccgacagcggcatcaacctggagctgggcttctgggtggctgatccggaaaacggcttcatggggctgaagtcggacatcaacctggccatctggcggctgttcaagcagcaccatatcgagattccgttcccgcagcgggaagtgcgcatcatcggcgacaagcccgcgcaggcgtgaggcaggagaaggcaatgagcgcaaaacggctggccatcatcgacgacgacgaagcggtgctgcaatcgttgctgtggctgctggatggccagggctaccgcgccgacggcttcgacagcggggaggcctttctcgccgacggctgcgaggcggagtacaacggcatcattctggatctccggctgtccggcatcagcggcatcgtgttgctggagaaactggccggccggccgtactgcccgccggtgatcatgctgaccgcccacggcgacgtgccgcacgcggtggcggcgctgaagctgggcgcgctcgatttcatcgagaagccgttcgacgacgtgcacctgctggagcgcgcggcggcggcggtggcgctggacgagcagaaccgccaactgcatggccatcagcgcaaggtgtcggcggcgctggcgctgctgaccgagcgcgagcgcgaggtgatgcagctgatcctggccggcaagctgaacaagcagatcgccgaggaactgagtatcagcatgaagacggtggaagtgcaccgttcgcgggtattcgagaaaatgggcgtcaagtcggcggtggaactggcgggcatgctggcggcgccgggcgcgcagggaggcaagctctgatgggcagcaagcagccggtatcggtactggtggtgatacatagcaaggacggccaggcgctgttgatggagcgcgccgacaagcccggctactggcaatcggtgaccggcagccgcgaaggcggcgaggcgctgatcgacaccgcgcgccgcgaagtggcagaggaaaccgggctggacatcggcgccggccagctcagcgactggggcatcgtcaaccgctacgagatctacccgcattggcgccaccgctacccggacggcgtcacccacaacgacgagcacgtgttcggcctgctgcttgacgcgccgcgcgcggtgacgctggccccgcgcgaacacctggcctaccgctggctgcgttgggacgaggcggccgcgctggcgttttcgccgtccaacgccgaggcgctgcgcttgctgccgggccggctgggcctgccggaagcgtagccggcccggcgcgagaaggcgcacccatggaaaaagcccgcgcaatgcgggctttgtcgcgtttgccggctgcgcttacggcttgcgcacgtgcacggcgccggtcatatacgggtgcaccacgcagtagtagttgaagtcgccgggcgtggcgaaggtgtattcatacttgtcgtcggtgtccagcgccttcgacgcgaagatcttgtcgcggctgttgaccgtgtgcggggtgtcgtcgcggttggtccaaataatgcgggtgccgggcgcgacggtgatctccttggggttgaacgcgaatttggaaatgtctatggtcacggtcgccggcgccggccaggcggccggggcgagcgcgaacagcagggccgccagcgcggcggcgatgcggtggagtgtcattcgggtggtctccatggaatgtggcgatcagcggaccagcggcctgtctatcatcgccagccgctgcgcgccgggcactaccgtcagttggcgggtgcccagcagtttgcccagctcgccggccggcaccttcagcggaccgggctcgccgacgccggcctggccgggcgtgggcaacgggtaggccagcgagcgcgcggtgtgcagcgcgatattgccttccactttttgcagcacctggtggatgtggccattcagcacggtcaccgagccgaacggccgcagcagcgccagcgcctgcgccgcgtcggcggtgccccagccccagggttcgtagacggtccacatcggaatgtgggccatcaccacgatgggagtggagcgcgaaacgccggccaggtcgcttttcagccaggccagttgctcctctcccagcgccgccagccggcccatattgaaattcagcacattgttcagcgcgatgaagtgcgcgccgccctggtcgaagctgtaccaggcgcggctcttgccgtcgtggtcgaagaatttcagatagccgctgacgccgtcgtctatcgcgtcgtgttcaccgggaatggcatgcacgcggtcggtgcggatttccttgaagatatcgcgcgccagcgcgaattcctccggtttggacaggtggctgacgtcgccggtgtgcagcacgaaggccggcgcttgcggcagcgcgttgatgtcggctatcgcctgcctgaggctgcccaccacgtccggattggcttccttgtgaaagcccaggtgggtgtcgctgatctgcacgaaggtcagcgccttgccgtccgcggcggccgccgcgttgccggcgcccagcgcgtgggggatgcctcccgatatcgtccagacgatggccgcgccggaccattcggccagacaggacaaggttttgcgccgtccgccgtcgggcgcgtctccgtccgtcgtctgctgcctgctttcctcttgcttcatggcacgccctcccgctgagtggaaatcggagcccgtccggctcgggtgcgactcagtccagcctagatgccgcattgcgacatcacaagggatttgcggcgaggagggaagggaaagagaagccccggcgggcgccggggctggcgtgcttagcgggaagacgcgccgggttcgggaatcggttcgatccggcctagcaggaacacgaaggccaggatgccgatcaccagcatgaagccggccaccagaaaggcgttggcgaaggagtgggtggcgccgacgatgatgccggtgacgatgggagccaccgcgcccatcatgttgttggcgaaattcatgatgccgccgacggtgccggtgccgccgcgcggcgcgatcagcgacggcagcgaccagcccaccggcgcggctgcggccaggccgctgagcgcgatggtgatccagatgatggcaacgtaggggtcggtggtggtggtcgcgccgaacaccgccatgcccatggccatgccgcacagcagcaccgtcttgcgcacgcgggtttcgtcatggccgcgggcgatcagcttgtcgatcagccagccgccgacgaacaggtcggcgacggtggcgaacagccacgggatggcggaaaaccaggccgatttcaggatgtccatgtgcatcgcctgcaccaggtagccgggcagccaggtcaggaacaggtagaacacatagccgtaggcggcgaagccgatggacagcccccacaccttgcgctggcgcagcaggtagcccagcattgccagcgacccttgccggctgacgccttcctcggccgcgccgccctggatgatgtactggcgctcggcctcgctcagcttggcgtcggcgctggggtcgcggtagagcaggtagaaggcgatgaagtacagcacgctgaggatggccgacacgccaaagccccagcgccagcccaggtgcaccaccgccagcgccaccagcggcacgcctatcacgttggagaatttggcggcggcgtcgaagatggcggtggccatcgcccgctcgcggcgcggaaaccagtagccggtggccttggcgctgaccgggaagcccggcgcctcggcgacgcccagcagcacgcgggcggcgaaaatgccggcgaagccgccggcgcaggcggtgagggtggcggccacgccccatagcagcgcgcccaggcggccgatgcgggtggcgccgaagcggtccaggatcacgccggtgggaatctgcagcagcgcgtagctccagaagaaggcgctgaacagcaggcccagctcgccgttgctgagtccaaactcctgctgcagctgcggcgcggccaccgacaggctgatgcggtcgaaataattgaccaggatgccgacgcccagcagccagcctatgcgccagcggcgggtgggaatcttgtacgagtgcggggacggggcgttcattgttgttctcctctttcttctttgggaatgccgcctgggtccgttcaggcgagcgcctgcaggatttgccgcagcaaggcggcgggcggctgctggatgtcgcagtggatggcgcgctcgtcggcgccgggggcttccagatctccgaactggctgtccagcaggctttccggcatgaagtggccgctgcgctcgcgcatgcgttcggcgatcagcgcgcgctcgccggccaggtggatgaaggcgaggtcggggtcgccgccgcgcagcacgtcgcggtagcggcgcttcaacgccgaacaggccagcaccatgcgttcgccgtcggcgcggccctggcgcagccgctcggccagattggccagccagccggcgcggtcggcgtcgttgagcgggacgccggcgcgcatccgcgcgatgttttccggcggatggaagctgtcgccttcgatgaagctggcgttcaaggcctcggccagcagccggccggcgctgcttttgccgcagccggccacgcccatcaccacgatatttccgtatttcatgttagcgctaacattgatggttgaaatgatggccggcggtttggccggcgcgatctgtctgcggatgttagcgctaacaaatctgcgataacaagcagcgggatcaagttttcggccgggcgcgggaaatatgtagtcgccgcgcaacgcggcggcatccaaggcggaaggcccgccggcgctggctttcagctgctgcggcgcagcatcagctggaagcctagatcggtctgcagagcgtcgggctcgccgccgtctatcatccgcagcagctggcgcgcggcatggctgccgatctcgcggcgcggggtggccacggtggtgagggcgggcgtgcaccaggcggagggctgcaaatcgttgaagccggccagcgccagccgttgcggcacggcgatgcccagttgctggcagcgcgccagcgcgccgatggccaggtcgtcgttgcagcagaacagcgcgtcgcagtcgggccgcgccgccagcgcggcgtccagcatgtcggcgcccatccgcatgctggacggcgacgggtccagccattccaggccggcgtcgcgcagaccggcggcatccagcgcggcgcggtagccgtccagccgcttcatcacccgctcatccaattgggcgcccagaaagccgatgcggcgcttgccccgctccagcaggtggcgggtgatggcggcgccggccgcctcctgggaaaaaccgacgcagcagcggccatcgtcggccaggtccatcatgtacaccgccggcagcgcgcgccggcgcaggatatcttcgaacggcgcggcatgggtcaggccggtgagcagcacgccgtccggctggtgctgcaggtaggcgcgcagcagcagcagctcctgttcggcgctgtaatggctgttgcctatcagcatctggtagccggcggcgtccagcacgctttcgatgccggccagcgtgtcgaggaacaccgtgttgtccagcgaggggatcagcaccagcacggtgcgagagcgcgccgaggccagcgtgcgcgcggagcggctgggcacgtaagccagcgcgtccaccgcctgcatcactttttcgcgcagctgcggcgatacttgctgcggctggttcagcgcccgcgatacggtgatggcgctgacgccggcggcgcgggcgacgtcgtgcatggtggcgccgccgccggagcggatccgcggttttctcgacatgggtttcctgtggcaaatgcgcgtccggcggcgatggcggccgggctcggctattgtagcgcagccggcgcgcgcggtccttgtccggcgatgacgattgattgtatggtcaagtttttgccggagagcgccatgtatctgcccaagcatttcgccgtcggcgaccgcgaggccctgctgcggctgatgagggcgcggccgctggccacgctgacgctgaacgggccggacggtttgatcgccgaccacatcccgctgctcgcgcgcgaagagggcggcgtgttgcggctgtgcggccatgtggcgcgggccaatccgctgtggcggctgttggagggcggcgcggacgcgctggccgtttttcacggcggcgacgcctacgtgacgccgtcgtggtatccggccaaggccgagcacggcaaggtggtgcccacctggaactacgcggtggcgcacgcctatggccggctgcgggcggtggaggatgcggcctggctgcgcggcctgttggacgagctgacccgcacgcatgaagccggcttcgagacgccctggaaagtggcggacgcgccggcagattacatcggcaagctgctgggggcgatcgtcggcatcgagctggaagtggcgcggctggagggcaagttcaagctcagccagaaccaggccgaagccacccgcgacagcgtgcggcgcggcctggcttcgcggggcgccgaactggcggacaggatggccgaacgccgctagcggcggtatttctccagcagcgacgcgacttcggcgcggccgtgggcgtcgccgcgccgcagttgctgcaggaagttgtcgagaaagcccggcagcagcgcggcgctggaagcggtggcgccgatgccgtcgcggtcccactccactaccacgccctgcagataggcggtgagccggttgctgtcgtcctggaacgagtggtacaggctgatcgccggcgcgccgcacagctggtagtactcttgcaggccggccttgtccagcttggcgcggctgaggatgtcgcggctgtcgaactcgacgaacagggggtggatcacctggctgcggcggctgtcgccgcggtaggcgcgggatacgatgccgatatggctattcagctggctggcgggtttggggccgcgcaccgggtggcccagcagcagggtgaaggcgctggcaagcgggtcgggcgcgccgccgtgatccagcgcgaaaccatgcggcggggcgtgccgctccagccagggctgcggcaggtggatggcggcgatgtccatgtgctgcggactggcgcaggccagatcctgcagcggcagctgcagcttgtcgacgcaggccagcacttgctggccgtgggcgacgcaggcctcggccaacaccgcttccgcggtgacgatgaatttctcgccgcggtagtccagcagcaggccgctgccgaagcagcgtccgggcttggcgccgggctgctgcggctggaaggccaccaccatcgggctgagttgttggtagatctgctccagacattgcaggggatcatccagatcgaacagaaactccatccccatttcctcgcgcgacaaggggttaccgcccaatcatagttcatactcaaaccaatattggcgcattcgcggcgcgcggcggcgcgggacaatgcccggcgacggcgcgaggagtgctataccgttattgggtgcgcccgcgagcggtcgatacccccgctgaattgctgtccgccgcgggcttgcggtccggcatcgggacgactgcctgccagccagactttggggaaatggggtatgccgatgagcccgcggatgaaattcatcctgcttgccgtaagcagctatgttctttttgccctggcttggattttcttcgccgatcagctgccggttggggcggaaacgggccgcttgctgccgttgccgctggtcaagggagtcgccttcgtcgcggtctccgccgtcttgctgtcgctgctgctgcgctcggtgccggcagccgaggcgccggcgtcgctgacctggctgggggccgtgtccagcggcatgaatccggaccgctggtcgggctggcgcggctatgccgcggcgctggcgcttaccgcctgcgcgttggggctgcgccagctgctgctgggcggcgacagccatcccatgctgatgctgctggccctgccggtcatcctgagcgccggcatcggcgggctggggccgggcctgctggctaccgtattggccgcgctggcggccgatctgatggcgacgccttatctgcatgatccgctgacgccctggaccgagcgcttgcagctggccttcctggtggccaacggcttggcggccagcttgttcaacgccgcgctgcggcatgcgttggcgcgggttgagctcaaccgcaggctgctggacgcggtggtgtccagcacatcggacgccatcttcgtcaaggatccgcaagggcgctacctgctggtgaaccgcgccggcctggcttttgtcggcaagagcggcaaggaggtgctgggccaggacgaccgtgaggttttcgacgcggagacggcgcgggaagtgatggccagcgaccgcgtcatcatgcagggcgggcgcgtgcagacccacgaggaattgctgacgctgcagaacggcgagaagctggtgtttctggtgaccaaggggccgatttacagcccggatggacgcctgggggggttgttcggcatttcgcgcgacatcaccgtgcacaaggcggccgaggaggcgctgcaggcgagcgaggcggcgctgcgccaggcgcagcagttggccggcatcggcaactggtcctgggacttggagacggacacgcatcgctggtcgcacgaagtttaccggctgttcggcctggacaatcgcgcgccgccgccgggctacccggcgatacagcgctatttcgtcaaggagagctggaccgtgctgtccgaagtggtggagcgctgccgcctgataggcttgggctacgactgcgatctggagctgcagaggccggacggcgccgcgtgctgggtgacggcgcgcggcgaggccaagcacggcgcggagggcaagatcgtcggcttgtacggcacggtgcaggacatcaccgaccgcaagcagatatcgatgcagctgaaggccagcgaagcgcggctgcagctggtggcggaagcgaccagcgacggcttctgggattgggacctgcgcaccgggagagtctaccgttcgccgcgctattacgaggtgaccggcacgcgggcggaggacgataccggcgatttccgctttttccggcaactggtgcacccggcggatctgcctttcgtgctgcaggcgatcgaggcccatcgccgcggcaagacgccgcgcatcgaactggagttccgcctggcgcgacaggacgacggcgtgcgctggctgcaggtgcgcggccgagcggtggaatgggacgacaagggcgcggcgctgcggttggtgggcaatttgtccgacgtcaccgagcgcaagcgggtggacgacgacctgcggctggtgctgaacgaggcgggcgacgccatctgggtgaccgacgccgacggttattacatcttcgccaatccggcggcctgccggctgacagggcacgtgctggaagagttgaagtccatgcatatccgcgacctggttgcgccggaatgcctgggcgcgctgcccgagcatctggccaagctgagcaacgggccgttccagcgttcggagtggctgctgcggctgaagcagggcggcagcatctgcgtcgacctgaccaccgggcgcttgaaggacggccgatacatggctttcggccgcgacttgaccgagcagcatcgcgccgagcaggcattgcgcagccgcgaacagcagctggcgcgggtgatagacggttcggaccagggctactgggactggaacctgaaaagcggcagctttcaggtgagcccgcgctgggaaagcatgctcggttacggtccaggcgaaatgcgcatcaccgccgagaattggtacgaccatgtccatccggaggatgtcgaacggacgcggtcgtcgatccagggcaatctgcgcggcgagctggccagccatgaggtggagatacgctgccgcacccgcggcggcgactggcgctggattctgtcgcggggccgggtggtggagcgcagcgacgagggcgaggcgctgatgatgtcgggcacccataccgacatcaccgagcgcaaagtgttcgaacagacgcagaaggaagcggcggcggtgttcgacagcagctacgagggcattctgatggtgagccgcgagggcgtgatcaccaaggtcaacagcgccttcacccgcatcaccggctacagcgccgaggaggcgataggccgcaagcccagcatgctgtcgtccggccagcagtcggccgaattctacgaggatttgtggcagtcggtgctggggcacgatttctggcgcggcgagctgtggaaccagcgcaagaacggcgagttgtacgccgaactgctgtccatttcggtggtgcgcgacgctcagggcgaagttttgcactacatcggcattttttccgacatcaccaagctcaaggcgcacgaagccgagctggaccgggtagcgcatttcgacccactcaccggcattcccaaccggcggctgctgtccgaccgcctgaaccaggccatcatccgcgccaatcgcagcggcaagtcctgcgcggtgtgcttcctcgatctggacgggttcaaggcggtgaacgaccagcacggccatgcggcgggcgaccagctgctggtggcggtgagccgccatctgaaatcgatactgcgcgccgacgacaccctggcgcggctgggcggcgacgagttcgtggtgctgctgtccgatgtcggcacgctggaggagtgcatgctggtgctggaccgcatcctgagcgcggtggccacgccggtgcgtctgggcgaggcggaggtgcgcgtgaccgccagcattggcgtcagcctgtacccgcaggacaatgtcgacgcggacacgctgctgcgccatgccgaccaggcgatgtacctggccaaggacggcggcaagaaccgttaccagctgttcgatccggaaaacgaccgcaaggcgcaatcgcatcggcagttgctggatatgctgcgccgcggcctggcccggaaggagttcgtgctgcactaccagcccaaggtgaacctgttcgacggcgaggtcatcggcgtggaggcgctgatccgctggcgccaccccaagcgcggcctgctggcgccggccgagtttctgccgcatctgcgcggcaacgagctggagctggcgttcgacctgtgggtgctggacgccgcgttggcgcaggccgccgaatgggtggggcgcggcctgaacatacgggtcagcgccaatatcagcgccagcctgctgctgcggccgaatttctgcggcgagctggaagcgatcctgggccgccaccccgcggtcccgtccggctatctggaactggaggtgctggaaagcgccgccatcaccgatgtggagcaggcgacgcgggtgatggagcgctgccgcgaactgggcgtgcgcttcgcgctggacgatttcggcaccggctatgcttcgctgacctttctgcgccgattgccagtggataccctgaaggtggacttgagcttcgtcagcgacatgctgggcaaccaggaagaccggcgcgtcgtcgaaagcgtgatccagctggcatcggccttgagccggcaggtggtcgccgagggcgtggagacgctggcgcacggcatgctgctgcgccagctgggttgccgttatgcccagggcctgggcatagcggcgccgatgccggcggacgaggtgcctggctggtgccggcagtggcgcgacgacggggcctggcagcgcttgcttgccgcggagccggcgccggaccggggttgagcgcggctggcaatattggtattgaagccgcatgcgttttgcatgtatatgttggcctggcggcggatggcctgcgttccggggattgccttggcaatcgatggccgcaggccttgtttgttacagggggcggaatatgacggggatgacggcggcgagtccgaaagcgaccatccgtctggcgcgcgcagccgatgccggcgaattggcccgcttgtaccggcagttggtggacgacccggccatccgggtgctgcccgaacgactgcaggcgctcgcggacggcgaacgggcgcaggtgctggtgtgcgaaggcgaaggccggctggcggccagcgcctggctcggtttttgcgaggacgtgatgtacggcggccaacctttcgccgtgctggaaaacatcgtggtggaccgggactggcgcggccgaggcctgggccgcgcgctgctggacgaggcgcggcggcgctgcctggctaggggatgctcgaagatcatgctgctcagctcggcgcagcgggccgacgcgcaccgttttttcctgcaggcgggctttcgcggtgacgccaagcgcggcttcgtcatgtaccggcgggatatggccgcggcgcaaacatgatcaacacaggatgacgacagtggcacgcaatatcgaaatcaaagccagggtggcggactgggcggctctggaacgcaaggtgggcggcctggcgcagccggagggcgcgctgctgcaggacgacagctttttcgcctgcggcaacggcaggctgaagctgagggtggatggggaggggcgggggcggctgattttctaccggcgcgaagacctggccggtctcaagccttcgttctttctggccagcgaaaccgccgctccggacccgctgcgcgaactgctggccgaggcgcacggcttgctgggccgggtgcgcaagcagcgcagccgctatcgcttggggcgctgcgccatccatctcgatcgagtggaaggcttgggcgacttcatcgagctggaggcggagctggccgatggcgagccggaagcggcggcgcgcgccgaaatcgaggccttgatggcggcattgggcatcgccggcgccagcctggtgcgcggcgcgtatttcgatttgcaggccgaagcggcgcgcgacgccatccgcatcgggctggagcgcgccgatcagccggaagtcgtggcgctgatcgacgagctggatgcctatcagaagcccttgtctccgccggaaagccatcatggcgtggatatcgagacgctgctgcgtcccgacgtggcgttcgccgtcgctcgcgacggcgaagggcgggcgctgggttgcggcgcggtctggtgcgcggacggcgtcggcgaattgaagcggatgttcgtgcggccggcgtggcgcggcctgggtgtggcgcggcggctgatggcgtttctggaggaccaggcaagggcgcgcggctgcgaggcgatggcgctggaaaccggcgtcctccagcatgacgccatcaccctttaccagcgcgccggctatggcttttgcgggcctttcggcgcgtaccgggaagacccgcacagcgtgttcatgcagaagccgctgtgatcagggcgccttgcccaggtgggcggccagctggcgggcgctctgccggcaccagtcgtcgaccagcggtttgatcaggtccagcgtcagcggctgctccttgtccttgctcttggcgttctggcgcaggttgacggtgccggccagcaggctggcgtcctgcgaatcctccagctgcgccatgctggcgatcttcagcagatagggctccttgccggcggccagccgcgccagattgaacaccgccttgaccggcagcaggtcgatcgggtcgacgccgggacgttcctggctcaatccggtgacggcgacgcgcagccgggcgacgcccggcgccggctgcagcgcgatcggcacgcctgcggcggccagttccgcctgcagccgttggtggaaatagctggcgatggcgttctcgtcgcccggctgcagcagctgccagttgccgtccggcccttggcgcatgaacagcagcggctccggcagcaccgcgtgataggacttcagatccacgcccggtttcagatacacgcgttgactgggctgcgccttgctttgctggaaggcgtccagcggcagggtgaacaggttttccgtctgggcgggcgtctcggcccgggccggcaggctcagggccatcgcggagcatagcgccagcatggcgattttcatggcagtttccttgtcggcatgattgaagaggcatcgatatgtcgacgccttgcagacaggatagttcggcggcggcggcttgtcgccgcccgggtttagttgcgcaggtaggtgaacagcgtcaacaggaggatgcagagtatcaccgccaggttcagggcgaactcttcttgcagatggccgaaatgcagttcgtcatgagcgctcaagcgggagccggtgagcttgtgcagccagtattgcagcagattgcgcggactggggccgtcgggggacgtcatggtggttggcctgtgtaaagaaaaatagatgtggtgtcattctactcctctcccgtatgccttcaacattttcgcattaattctattcaaggttcgtaagcgaacatcgccaagtggccagacggcgttgcgcggcgggggccgcggcattgtggcgcctgcgccgcaggccgcccgcgcctggcggcaacggcttggccggcgtgaggctggtctacactgtactgatgcgcattaatcgcgcggacagaaatggccggagatggcgcaacgccgccgcgcctggccggcggggaacgggcaatgggaaagatgaagggcgggtggctgctgctggccggcttggcgcaagcggcgccggcggcgcattaccaatcctacacgctggcggtggagccttggggcatgctggacaccgaccggggagtggggccggacttcatccgttttctggcggcgcaggccggcttcgaggtgacggcggaggccaggccttaccggcgggtgctggacggcatgcgcagcggcgagaacgccatcaatctcggcatcccttcgccggagcgcaatcgctacggcatcgccatctgcacgataggatcggtcaaggtgtcgctggtgtatctgaagtcggccgggcgcgagcaccatagcgccgccagcttctccgggctgcagataggcgaactgcgcgggagccggacgctagaggagtttgaccgcaccgtcaagcacaggccggtgttgctgagcgacatgagccagggcatgcggatgctggacgccaccgtgtgcgtgcggccgggctgcggcaatctgctggccgaagccggagtggagccggcggggctgggagagtggctgttcgccgaacagccgctggagatctacgtttcgcgcgccagcgccttgtcgcgtgacgccgccgccatgctgcgcctgcggttggcgtgcgactccgccgccggccggcaggaaatgcgccggctgctggcgccttaccgctagccatcgcgcaagaaaaagcggcctccggcgaagaggccgctttgtttgcgcgcgcaggatcagaccgacagcgacatgagcaagctggagatatcgttgctgccggcattggcttggtacaggctcagcgcggcctgcaattgctgggtgttggtcgcgctgctgctgctgctgccggcggcgctggcgccgctggtttgcgaagtgccgcccagcgcgctcaggagctcgttctgccctccgctctgcccgccgttttcgccgccgccatggtggtggtgatggtggtggccgcccgcgctggcttgctgggtgccgccggcttgctgcaggccttgctgcagttgctggaagtcctgctgcgcctggctgatgttgccggtttgcagatcctggcccagggtgttcagcaacgacgatatcgagctgctagcgccgctggtggtgctggagttggcggcggcgaacggatcggcggcgctggcggcggtggtgctggagccggccgccgaggcgctgctgatggcgttgttcagcgcggcgctgaagtcctggctgccgctagcgctgctgctgttggagccgttcagctgctgcaaggcggccagcgcctgctgcgcgccggagatgtcgccttgctggaccgattgggtcaggttgttgacgtcctgccggcgttgctgatgcagggcctgcatctgctgccagtaggtgttcgagtcgctgctggtgctgctgatagacatgttgcctctccttgagaagatgtttgccgggcagagcttcacggatccgctcgtgtccttgacggaggcgaggccgtcggcttgccgctggactggcaattcttgccgccgcgccgcccgtccttgccgccgtttccggttcaagcggctggatttccgctttttcttgcaggaacaatgacttggcgatgtgggtttgagcaagaggcatgccagaatcaggcatctcggaaagggaaatgtttacaaatattgtgtcatgcggtttcagccgaaaccgcgttggcgcagcgcctggtacagcatggccgcgcccagcgcatcgcccagcgcgtcgtggcgcggcggttcgggaatggccagctcccggtacaggcaggacaggtgcaggtcgatgtggccgccgggatgctgtctgagcttgtagtcgtagtagcgcgacgagatttcaatccggcgctgcggcaggcctattcccagcagcggcctgacgtatttgtcgagcaccgcgacgtcgtattccaggtaatagcccagcaggggccgcccgccgatgaaatcgagcagccgccgcaccgcgtcttccggcgccaggccctggccgacgtcgcggcggcgcaggccgtggatggcgatattgtcgccggcgggggcgatgccgggccgcaccagcagatacagcgcctcgctgtgcaggatgcggttgccgcgcagcttgaccgcgcctatcgacagcagttcggcgcgggagacatccaggctggtggtttcgcagtccaggctgaccagttcgtccggatggccgtcgaacaggccggcatagcggggatcgcgcaggcggctgcgccgccaccgccggcaaagggcgccgagcatcagaagcttcccagccgatagcggtgctgcaactgcgacttgaagcgcttcaccaccgccagcgcgtccttgagcaggtcgcgctccagcgtgctcagcttggccggctcgatctgattgtccggctcgcgcccttcggccaatcggcgcaggccgtggtccagcttcagctgcagcaggaaggcgagcgcttccagaatgtcgtcggccagcgccggatccagttggccggcctccgccagccggcgcgcccgctgctggctggaggcttcgcgcacgccatgctccagcgccagcgcgcgcaggccatgcaccagcgggaagatgccgccttttttcaggtccagcagctcgcggccgtcatgttcgcgggtgcgcagccgcgaaaacggcccgagcggggtatcgaattgcccgatggcgcgggcgaagcgcgaaaaaaaggcggcatcgtcctgcaggccgtcccgcagatagctgcggcagtcgtccagcaagccggcgtcgccgcacaccgcttccgcgtcgcaaaaaatggccagctccatcatggtttcgccgtcgctgtcgtggatccagccgtcgatgcgctgccgcatctgcgcgccgctcagccgccagcgcggattgttcaccatcacccggccggggcagggcgggtagccgaagccggccagggcggcggagaaggcgtcgcagcaggccgccaggccgtccggcgcgaaaccgtcgcgcagcagcagcgcgttgtcctgatcggttttcagcaactgctcgccgcggccttccgaccccatcgccagcaggcagctgttttccagcagcgccggcggcgcgatcatctgccaggcgcgggcgaacaggcgggcgttgagcgcctgcaccagccgtcccagctgcagcggccgcacgccatggccggacaggatgccgaccagccgggtgatctgccgcgccgcgtcggccagctgctccaggttttgcgcgcgctccagccgctgcgcgatcaggtgggagtgattggagaaataggacagcacgtcgacctgggccaggatgcccgccgcctggccgtcttcggtgaccaccagccggcgcagattgcgctgggtcatcagcagcagcgcgttgaacaggaagtcgtcgatgtcgatggtgagcagggtgtagctgcagtgccttcccaccggctcgccgctgtcgacgccatcaatgatgatgtcgcgaaaatcggtggtggtgaagatgcccaggcgctcgccgtctctcaccagcaccgatttgctgcgctgcgcccgcatcgcgcgggcggcgtcgcggatgctggccgctgcgtcgacgaataccggctggcggcagcctgcgtcgcgcacggtggcggcaagcaaggtctgcagttcgcggccgccggcgcgctgcgccagcaggctcagtttctgcgacgcgctggcgtagaaataggcgccgaattgcgggtttttttcggtcagcgccagcagcgcgtcgcgcggcaaggcaagcagcaacgcttcttcctcggccacgaagcgatggagcgtctggccggccgccacggcgcgggcgtcgaagctgtcgctgctgaggtagcgcgccaccgcctcgtcgccggccagttcgcacactacgcccttcaacaccacgtagagcgcgtctatcggctggccagggccgcaaacctgggcgccgtcagggtggtagacgatgtcggcgcgggcttccagcgcctcgcgctcggcgggcgtcaggctgtcgaatggcgggtggctgaaatcgaagcggctcatcgcgtatccctgaatgaggagagccgctccgcggcgcttcaggcgggtcgggtccggctcagcagcggcgcgccgtcgcggaacagaatcagttctcccggcgacagcgcctgccagtgctcgttgtcggtcagcggctgggtggcgaccatcgccacctggtcgcgcggggtggtgacggtggcgaagtccacgctgacgtcgtcatccaccaggtgggcggtgttgaacggcgagcggcggatgatgtagtgcaaatgggtggagcagtgcgtgaacagcgcttcgccgttgctcagcatgaagttgaacacgccgctcgcgctgatttcgtctgacagccgcgccacttcgtcgaacagcgcttccagttccggcggctccgaccatttggcgcgcagtttttccagcagatggcagaaggcgcgctcggagtcggtggtgccgaccgggcggtagtgttggccgggctcgggctggaaggcctccaggttgccgttgtgggcgaagatccagtactggccccacatctcgcgcatgaaggggtgggtattggccaggttgacctcgccctgggtggctttgcggatgtgggcgatgacgttttccgactttatcgggtagcggcgcaccaggtcggccaccggtgattccaccgagggcttgtcgtcgaggaacacgcggcagcccttgttctcgaaaaaggcgatgccccagccgtcggcatgatgatcggtgaggccgccgcggcgatggaagccttcaaaggaaaacaggatgtcggtagggatattgcagttcatgcccaagagctggcacatcggcttgattccacgtctttatcagtttgcattcggactggccgtattgccagcgtaaccattcagcctgagcttaggcgatatggggccggcgggcaatcgccgcatgcccgtatttcgccgccggcgatatgggaaaatttcataagctgatgactttttacgtggatggcatggcgcaggcgcgcgcagcggtcatggctggcggtcccatggcgcttgcgggccgctgaagcgctcggccaggaagtccagcagcccgcgcagcgccagcggcagcagccggcgcgaaggatagagcgcgtggatccccagcaccgccggctcccagccgggcagcagcgccaccagctcgccgcggcggacgtagggagcggccaggtagctgggctgcaggctgacgccggcgccggccagcgcggcgctgagcagcgcgctggcctcgttggcgctgatgcggccgctcacccgcacgcgcagcgcttcctccgcgccttgctggaagcgccactcgctgcggccgaagttgctgtagctgaggcagcggtgcgcttcaagctccagcggatggcgcgggacgccgtggcgcgcgaggtaagcgggggaggccaccgccagcgagcggcagtcgcacagccgccgtcccaccaggccgggatctggctcattggtgatgcggatggcgaggtctattctttcttctatcaggttgacggtgcggtcgcccaattgcaggtccacccgcaactgcggatggcgttcggagaattcggcgatggcgccggccagcactgcctggccgaaggaggtgctggcggtcacccgcagcaggccgcgcatctggccgtcgcgctggctggcgtcggcccgcacttcggccgccagctccagcatctgctggcagcgggccaggcaggcgaggccggcgtcggtgagggtgaccttgcgggtggagcgctgcagcaggcgcacgcccagccattgctccaattcgtcgacgtagcgggtgaccatcgggcgggacatgtccagcttgtcgccggcggcggtgaagctgccgagttgcgccacctcggcgaaaacctgcatggcggtgagcctgtccatcaatatgctcgttttttgaaacaataatgtgcagtttaacccatttattggtgcgattcctgcgcttatagtgtgcgcatcttcaccgaatcgctttcaacccgccggcgggcgccggcaccagacttaaggagtcacaccatgatccgtcaaaccctgatcgccgccgccctgtccgccgccggtttcgcccatgcgggcgacctcaagctgtcggtttacaacgccgacggcaacagcttcaacgtcagctcggtgctggtgtccggcgacaaggatgccgtgctgatcgataccggcttcacccgcgccgacgcctaccgaatcgccgcccgcgtgctggacagcggcaagaacctgaaaaccatctacatcagccaggctgatccggactactacttcggcgcctcggtgctgaagcagatcttccccaaggccgagctggtggccgcgccggaagtgctggcccacatcaagggcaatgtgaagggcaaggtggcgttctggggcccgaagatgggcgccaacgcgccgcaagccaagccgctgctgccgaccgagatcaaggccgacaagatcatgctggaaggcaaggcgctggagctgcgtgacaccaagggcgtgatggcgcaccgcggctatgtgtggattccgtcgatccgcgccatcgtcggcaatgtcggcgtgtattccggcatgcatgtctggaccgcggatacccagaacgatgccgagcgcaagggctggtacaagcagctggacgacatggaagcgctgaagccggaaacggtggtgccgggccatatgatcgccggcgacaagatggacgtgtccgccatccgctacacccgcgactatctgaagacgtttgaagccaagaacgccgccacccgcaacagcggcgagctgatcgaagcgatgaagcaggcttacccgcaagcggccgaagtgtcgacgctggagctgggcgccaaggtgcgcaagggcgaaatgaagtggtaagcgagcgcgcgatgaaactgcattacttctacgacccgctgtgcggctggtgctacggcgcctcccccttgctgaaggccgtggcggcgctgcccggcgtcagcgtggaaatgcacgccggcggcatgatagatgagtccgaaggccgcaccgtcacgccggactggcggggctatgtgatgccgcacgacgcgcgcatcgcccagatgagcggccagcctttcggcgacgcctacttcaacggcttgctgaaggatatcggcgcgccgctggcctcggatccgccgatcgcggcgatcctggcggccggaaagctgggggccgatccgctggcgatgctggcccgcatccagcgcgcccattatctggaaggaaagcgcatcgccgaactggagacgctgagcgagctggcgcttgagcagggcctggccgcggcggacttcgctctggcctggcgcgaggcgagggcggaggcggagcggcatatcgcccagacgcgcggcctgatgagccagtgggggctgcgcggcttcccgtcggcggtgctggagcaagacggcaagctggagcggctggaattgtccggctggttcggcaagccggaacagctggccgccgaactggcgcagcggctgcccaagttggcggcatccggtgacgacgcgctgttctgcacgccggacagctgccgctgaacctgtccccgcggatgaaaccgctgccttctggcagcggttttttttgcgtctgggctagggctgggccagcaagtcggcggcgatggcttgcagggttttctgggcgcgggcgcgccggctttcgccaggctgcgccggcaccggcaggtcgggttggatgccggcgacttcgtcgccgccatcggcgcgcagccgcacgcagtcgggaatgcgcaaacgcaggccggagtggggcagcagcagcggctccagcttgcccatgaagccgcagccatcgccgccggtgcgcgcgccgacgattttcgccagcccgttgtcgcggctgaccgcgacgaacatctcggcggcggagtaggttttctggtcggcgacgatatagaccggcccttgccaggcgcctttcagcttttccgtctgcgctggccagaacagcgtttccgccacttcccgcgaatagctaccaggttccaggtgagccaccgcgccggacgcgtagccggctgcgatcagccggctgtagccggcctgagggtcccatcggcgctgttcgcgccacacccagctcatgtccggcgccggccggctatccagctcggcgcgcttttggcggaagtcctgcaacaggccttgcagcttggctttgtcgctggcgctcgccgaggcgggaaggccgctgctcaagtcctcaatccactggtccagataggctttgccggccgggctcctggccatccacagcgacggagagcggaccacgccaggggtgagcagccgggtcatcgcgtcgccgctgtcgttgccgccgggattgttgcccacgtcgaggatcagcacccgggcgccggcctggcgcagttcggccaggcgctgggccacgtcggcgaaccattgccggtaggtcagctggaacagtttttccgagtcgaacgccccggtttgcggcatcgccgcgcgccagacgcgctggcatgccagcggatagcctttgggactgaacgtggggatgcgcagcaccgccgcctgtccggcccggcccaggtcggccaggccgctgcgcatggactcagacaggccgtccgaagtcagatggaaaccgggcagggtttcgaacggcagcgagaacccgatcttgctgtcctgctcgtagcccagggcggcgcagccgtccagcggcttgtcgcgcgccaggtcgcgcggcgccggctcgtcgcggccgctgctttccgcggcgcttggcgtgttggccagcagcgagaaatggccgtcgcggaagccttgctgaaaaccgatgatggcctggcgagcctcggcgtcgtcgcgggcttgccgcagcgcggcttgcgcctggcggtccagcgcgggcagggcgatgccgctttgcggcgaagccatccaggccagatgggagtagcgctgctgcagcgtctgtttcagcaattggtagtcctgctgccaggcggcgcgatcgaaaccggccgtcgggtttgcccacgcgcagcccggcagcgccagcaaggcgagtgccggaagaaggcgggcagctgggtggcaatggcggcgcatgcggaatgtcctgaagggcggaaggcaagagagagtcgtgctggcgtggggcttagagattctatatgccaatatgcatttgtcaatatttaaccttgaggtgatgattgtttggatatttgttttacatttattccttgcaagttcgcccctatcgcatagtctgaaataccagttaaataccaattatggttgactgcgagataaggagacggcaaatgcataaagggatcagcagggttttgcgcgggatgacgctggcggcggcgctggcctatggcggcttggcgctggcggcctgcccgaattgggcggaaggcaccgcctacaaggcgggcgatgtggtcagctataacaatgccaattacaccgcgctggtggcgcataccgcttatgtcggcgccaactggaacccggcggcctcgccgacgctgtggacgccgggcggcagctgctccggcggcgatcccacgccgccgaccccgccgaatcccccgacgccgcccagcccgccgccgggcaataccgcgccgttcgccaagcatgcgctgataggctactggcacaacttcgccaaccccagcggttcggccttcccgctggcgcaggtcagcggcgattgggacgtgatcgtggtggccttcgccgacgacgccggcaacggcaacgtcagcttcacgctggacccgggagccggcagcgtcgcccagttcatccaggacatccagacgcagcaggccaagggcaagaaggtggtgctgtcgctgggcgggcagaatggctcggtgacgctgaacaatgcgacccaggtgcagaatttcgtcaacagcctgtatggcatcctcacccagtacgggtttgacggcattgatctggacctggaaagcggcagcggcatcgtcgtcggcgcgccggtgatcagcaatctggtcagcgcggtgaagcagttgaaagccaaggtcggccccaacttctacctgtcgatggcacctgagcatccgtacgtgcagggcggcttcgtcgcctacggcggcaactggggcgcctatctgcctatcatcgacggcctgcgcgatgatctgtcggtgattcatgtccagtactacaacaacggcggcttgtacacgccgtattccaacggcgcgctggccgagggctcgaccgatatgctggtggcgggcagcaagatgctgatcgaaggcttcccgctaggcaacggcgcctccggcagcttcaagggcctgcggcctgaccaggtggctttcggcgtgccgtccggccgcagttcggccaactccggtttcgtcaccgccgacgccgtggccaaggcgctgagctgcctgaccgcgttgcaaggctgcggcagcgtgtcgccggcgcaggcgtatccgactttccgcggcgtgatgacgtggtcgatcaactgggaccggcacgacggctacccgttctccaagccggtggccgccagcctgcatcagctgccggcgacgcaggccaaagtgaaaaaggccgtccgcgcggtgcggacggcctggtaaggcggaaaggatgggcgcttactgggcgctcatcgaatagccgctgatgtcggcggcgccgaccaggccattcaggtattcatgcatggcttggttggcggccagatcggtcaggtattgctgcaggcggtccttgatctcgtcgaagccgatcttgctgccttcggcgcgctcgttgacctggatgatgtggtagccgaactgggtttccaccaggtggggcgtgatttcgccggcagcggtgctgaataccgcctgttcgaattccggcaccatctggccgcggccgaattggcccaggctgccgccttgttggccggacgggcaggtggaatgttcgcgggccaggtcggcgaagcgcgacggggcggcttgcacttcggccagaatgccttcggccttggccttgattaggccggcttccaggccttcgcccttgggcagcaggatgtggctggccacggcgctgtcgccgctgacgaaacggtccggatattgttcgtagaattcgcggcagctggcttcgtcgatcggggcgacttgcagcttctggtccagcagcgcctggatggcttgctgctcgtcggcgacgtccaggccttcgctcttggcctgctgcaccagcagggtgtgcaggatcagctgctggatggcggtgtcgcgcgggctgggggtgtcgctgtagtgttccagttgcgaggcgatcatgtcttcgctgatttcaacgccgttgacggtgatggtcatgtgagtttcctgtgagggagcggccatgtcttggcgtttccgaatgaggccgccggaggcagcgcaaagaggagcagggcaggcctgcgggcgaatgtgcgcgaaggtaagcgcggcggcagcggctgtcaagagaaacggggacggcatgccgtccccgttgtgttgcccggaggagcttactgctggatctgggccttggccttcagatcggcgacgtacttctcgatgcgggagcccatcacgcgctgggtcagctgcggacggatttcctccagcgacggcacattgcgttgggtgcgcacgtcgtccagtttgatcacgtgccagccgtattcggttttcaccggcttggcggtgacttcgcccttagccagcttgctcatcgcttcggagaacggcgctacgaaagtgccggcttcctgccagtccagatcgccgcccttgttcttgctgcccgggtcgatcgacttttccttggccagcttgtcgaaggccttgcccttcttcagcgcttcgatcacggccttggcttcggcttcggtcttcaccaggatgtggcgggcgtggtattgcttggtttccggcaccgaggcggccagcttgtcgtattcagccttcaggtcggcgtcgctgaccgggttggccttctcgaaatccttgaccaggcggttggccagcgccatcgcttgcatattggccagctcggcggtgaattccgggctcttgtccagaccctttttcacggcttcctgacgcaggacttcggcggtgaccagctggtccttgatctggtcgcgcgcttgcggggtcacgttctggccctgggcttccatcattttggcgacggcgtcgatgcgggcgtcggtgatttgctggccgttgatggaggggccggccacggcgatggcgctgccggcgaaggcggcgacgagggcggttgtcagcaggagtttacgcattttcttctgttcctgggtcgggtatgggtggattactgaatcttgctcttggcgcgcaagtcttcaacggccttggcgattgcctcttcctgcaactggcgggcgatctgcggtttgatctgttccagcggcggcaactgggcgttgcggatgtcggcaaccttgaatacgtgccagcccagttgcgactggtacggcttgctgctgtactggcccttggagagcggcttcagcgcttcggccagcttggggtccatctgcgacagattgccccagttcatgtcgccgccgctttgcttggcgttgggatcgatggacttggatttgaccaggtcttcgaatttggcgcccttcttcagcgcggcgatcactttttgcgcgtctgcctcgttggccagggtgatctggtaggcgtggacttccacttccttggctgcggcgagcttggcggcctgctggtcgtagaaagccttgatctgggcgtcgtcgatgccggctttctggacgatgtcgccgaacagcgcgtcgcgcagcatgccggcgcgcacttcgttcaggcgctgggcgaaggcgggctgtttgtccaggccgcggcgggcggcttcctgcaggatcagttcgcggttgatcagcgagcttttcagctgttcgcgcagttccggcgagtcctgaaccttgccgccgttgctttgcaccacattggcgacggcggcgtccaattccgccttgtcgatggaggtgccgttgaccacggcgatggattcggctgcggccggcaggctgatcgtggcagccagcagcagcgcggcgatacgggaatgcttcatgcttagccctttgtagaaattcagagttcttctggggtcagggcgcggatggccagcgcgtggacgcggctggtcatcagttcgcccagagtttgatagaccaaccggtggcgttgcacccggttgagattggcaaagcgcgcgctgacgatggtcagcgtgtaatggccgccaccgtcccgggcgccggcatggccggcgtgcagggcgctgtcgtcctgaatgtcgaggtgttccggcgcgagcgactgcagcgccgcttccagcatggctaccgtgctgctcatgcgggaaacacctggcggaatggcttcgcttccaccgcggcgtagacgccggcggcggcataggggtcggcggcggcccaggcgcgggcgtcgtccagcgaggcgaattccgccacgatcaggctgccggtgaagccggccgggccggggtcgatgctgtcaatcgccgggaacgggccggccagtttcaggcggccggcatcctgcagcgcctgcaggcgggccagatgggcggggcgcgcggctagccgctgctcctgggtgccgggggcgtcttgcgcgatgatggcgtacagcatcatttcttttcctcgatgtacttggccaggaacaggctttgggcgatgacgaacagcagcatcaggcccatgccgccgaacagtttgaaattcacccagacgtcttcgctgaagtgataggcgacgaacaggttgagcccgcccatcatcgcgaagaagccgccccaggcccaggtcagcttgcgccataccggatcgggcatgctgatctgctggcccatcatcatgcgcaggccgttcttgccggcgaagtcgctgatcagcaggccggcccccatcgcccagtacagcacggtgggtttccacatgatgaaatgcttgtcgtgcagcagcaaggtggcgccgcccagcaccacgatcagggccaggctgaaccattgcatggtttcaaccttgcggtgccggatccaggcccatgccaccatgatcacggtgacggcgatggcgacgccggtggcgacgaacatgtcccgggtcagccagtaggcgccgaagaacagcaggacggggaggaggtcggtaaaaaatttcatgcgggtgattatgggggcaggccggcgcagattcaagctgcgccgggccctggcgcgagattaacggttagtttgtttgacgacgcttagggcgctggcgaccaggccgccgacgtcggcgacgttgcccggcatgatgatggtattgttttccttggccaatttgccgaaggcggcgatgtattgctcggccactttcagattgaccgcctccagtccgccgtcattctggatcgcgccgccgatgcggttgagcgcgtcggctgtggcgtcggccaccaagcgcagcgcttcggcctcgcccttggccttgttgatggcggcctgcttgtcgccttcggagttgttgatggtggcctgcatctcgccctgcgacttctggatcgccgcttcgcgcgcgccggtggccaggttgatctgctccatcttcacgccttcggactgggcgatgcgggcgcgtttttcgcgctcggcggtgatctgcgcctgcatcgcgtgcaggatgtcctgcggcggcaccaggtccttgatctcgtagcgcagcaccttcacgccccagttgatggcggcttcgtccagcgaggcgactacggtgcggttgatgtcgtcgcgctcttcaaaggttttgtccagctccagcttgcctattaccgaacgcagcgtggtttgcgacaactgtgtgatggcgacgatgaagttgctggtgccgtaggacgccagcttggcgtctgtcacctggaaatacaggatgccgtcgactttcaactgggtgttgtcgcgggtgatgcaaatctggctgggcacgtccagcggtatttccttcaggctgtggcggtaggcgatgcggtcgatgaagggcaggatgatgttgaggccgggcgccagcgtggcgtggtagcggcccagccgctcgacgatgaaggcgttctgctgcggcaccaccgccagcgacttgaaaatgaagacgacgacggccagaaacagtatcagggggatcagggcggtatccatattggcgttattccggttgtgtggaggagattttcagcagattgccttcgcggccgcagatgtagccggcgtcgccggcgttcaggccggcgtcgagcagctgggcgtcccattcggcgccgcggtagaagacgcgggcatggccgggggaggtaagcgagcggatgctgacttgctggccccagtcggggtcgtcgcgcggcggcggcggggagggatggcgccgtttgcgctggcggatcagcagcacgccggcggcgccgcaggcgctggcgatcaaccattgcgtgaattcagccagcccaagccaggcggcgagcccgcccgcgcccatcgccagcgcgatcatcagcaggtagaaggtgccggacatgaattcggcgatcagcgcgatcagcgcgcaggcaaaccagaaggtgatggcttgagacatggtttccccgttgaatggccatgacggatattgtccggccaaaccttgaaaatgacaacggccaggccaggccaggccgctcggggacgccgggacggctagacgtggtcgcggtcgggcaggtaatgcgacaggtggatgcgctcttcgctctccagccaggttttccggatgtacagccacaggccggctgcgaccaccgcgcacaacagcagcaggattttcatgacgccgttccttgcaagcccttgttctgctttcagtttagaccgttaatgggcggacagcctgtcccgggtatacaatccggtcctttcagaccgcaggaagacgcgaatgttccagttgcaggcccgcgccagcgccgaaatcgaaatccgcaagagccgcttcatcggcgtgctgctgccggcggccagccgcgccgaggccgaaagcgcgctggccgacatccgccggcagtggccggacgcgcgccattattgcgcggtgttgctgtgcgccggggattcgatgctggacgacgacggcgaaccttccggcaccgccgccaaaccgatgtataacgtattgcagcacaaggaaatcaccaatgtgcttgccgtggtggtgcgctatttcggcggcatcaagctgggtgcgggcggcctggtgagggcctacactcaagctgtcaacgccgcgctggagcaggccagcctggccgaggtggtgaagatgcgccggctgcggctggcggtggatttttcggccgaatccaggctgcggcggctgtgccaggagttggggttcgccgtgctggcgctggagtatggcgagcaggcgctgctgaccatagcgctgcccgaggcggcctgcggcgcgggcgtggcgcggctgacggacgggatgtccggcgcgatccggctgttgtcggacggctgagggcaacgcgggagaaacgggagaacgggaatgacgcagaagcaatatcgtctggtgacgcgcagcgatttcgatggcctggtctgcgcggtgctgctcaacgagctcaagctgatcaacgaggtgaagttcgcccacccaaaggacatgcaggacggcaaggtggacatcagcgccgacgacatcaccaccaatctgccgtatgtggccaaggcccacctggtgttcgaccaccacctgtcggaaacgctgcgcaacgccaccgacgccgacaactacgtgatcgatgccaaggcgccgtcggcggcgcgggtggtgtacaaccactacggtggcaagaagacgtttcccggcatcagcgatgagatgatggcggcggtggacaaggccgactccgcccagttcagcgccgaggaaatcctcaatcccaagggctgggtgctgctcaactacctgatggacgcccgcaccgggctggggcgttttcgcgagttcaaggtcagcaattttcagctgatgatggatctgatcggctactgccgcaatcacggcatcgatgaaatcctgcagctgcccgacgtgatggagcgggtggcgctgtaccgcgagcacgaaacccaggccaaggagcaaatcctgcgctgttcccgggtgcacggcaacgtggtggtgctgaacctgctgcacgaggaaaccatccacccgaccaaccgcttcatgatctatgcgctgtttcccgactgcaatatctccatccacgtgatgtgggggctgaaccggcaaaacaccgtgttcgctgtcggcaagtccatcctggaccgcagcgcgcgcaccaatatcggcgcgttgatgctgcagtacggcggcggcggccatgacgcggccggcacttgccaggtgccgtcggaccgggccgaggacgtgctggacgagctgctgtcccgaatccgcggcctgggctgagcggctacagcgcgcggatcagctccagcgcctggtgcaggtcgccgcacaccgccagcgcgctggcgcggtcttcggcgctgggggtgagcagatccggcaccagaatcacccgggcgccggcggcgacgccggcctgcaggcctaagcgggaatcctccagcaccaggcagcgttgcggcgccacgcccagccggctagccgccgcgtggtagacatccggcgcgggcttggcgcgcggcacttcgtcgccggcgacggtgatgtcgaaaaaggcgtccaggccgctgcgggtcagtttgagatcggccttgaagcgctgggtcgaggtggcgaccgcgcgcgggatgccttgctgctcggcccagcgcagcagctccagaatgccggttttcagcgggataggctcgtggcgcaggatgtgctggtaatgcttgtccgaccccagctgcagccggtccgccgcttcggcgtcatccaggtattcggcgacgaaatcgacgcaatccttgaaggacaggcccaccatcgcgtccagcatttcctccttgatttcgattcccagctcggcgccggcgcggcgccaggtctcgttggaaatgcgctcggtgtccagcatcaagccgtccatgtcgaacaatagcgcgtcgaagctgcgtgacatcgtgtttctcccgcttggattgactgtttctgtctggattgtgcaaccagggccgccggcttgtcgaggcgggcgcttgccatccggcagcggccggcgccatggctctggtatagtggctgggttcagcagacaggggaggacgatgtgcagtcggtactgatagccaatcccaagggcggcagcggcaaatccacgctggccaccaatctggccgcttatttcgccgccagcggcaagaaggtgatgctgggagacgtagaccgccagcagacttcgctgcattggctggcgcagcgcggcgccggtctgccgggcatcgccggctgggaagtggcgcccaacgagcccaagcgtccgcccaagggcaccgaagtggtggtgctggacagtccggccagcctgcacggcaagaagctcacctcgctgctgtcgcaggtgggccacgtgatcgtcccgattcagccctcgccattcgacatgtgggccagcgaggctttcttcgagcagatgctggaggaaaaggccatccgcaagaacaaggcctatatggcggtggtgggcatgcgggtggatccgcgcacccgctcagcgcgcgaactggagcagttcctggctcgccacgacgtgccggtgctcagctggctgcgcgacacccagctgtacgtgcaggcggcggcggagggaatgtcgctgttcgacttgccggcctcgcgcaccctgcgcgaccgcgaggcctggctgcctatcctgcgctggctgggcgaagatccgagcgcctggtgcgacaagtaggaaatatttttacttcgaaacacttgacggccgccgccaagcggcgtagctttgtttcgtaactgcgtgcgagccgaaacaggcgtcgcaggggtcagtgcaaatgggagcccatcgggctcccgtctttgtttggggcccctgttttttcatccatacctgtctttgggagcacacgcatgatccagaccgaactcaactacggcgacgtatacctggtgccgaagaaaaccgttgtcgacagccgcaaggagtgcgacaccggcgtgcaattcggcccgcgccgtttcgccatgccgatttacccgtcgaacatgaagtcggtggtgtcggccgaaacctgcgagttcttcgcccgccagggctggttctacaccatgcaccgcttcaatgtggacgcggtggctttcaccgccgacatgcagggcaagggcctgttcgcctccatcagcgtcggcgtcaacgacgacacctacgagcaactggccgcgctgcaagccgccggcttgtcgccggaatacatgacgcttgacatcgccaacgcctggtgcgtgaaggccgagcgcatgatcaagcacatcaagcggcacttccccgccaccttcctgatcggcggcaacgtcgccaccgccgccgccgcgcgcgacctcgaagcctggggctgcgacgcgatcaaggccggcatcgccggcggccgcgtctgcatcaccaagaacaagaccggcttccaccgcccgatgatttccacggtgcgcgactgtgtcggcgcggtgagcgtgccggtgatcgccgacggcggcatcgtcgagcatggcgacatggccaaggccatcgtgtgcggcgccgccatgatcatggccggctcgctgttcgccggctacgacgagtcggccggcgaaatcgtggaaatcggcggcaagcactacaaggaatacttcggcagcgcctcgcagttcaacaaaggcgcctacgtcaacgtggaaggcaagaagattctggtggagtacaagggcagcattcccaagctgctgcgcgagttgcaggaagacctgcaatcgtcgatcagctacgccggcggccgcaccctggccgcgctgcgcgatgtggagatgatccaggtccaccgctgagccggcggccagacgccggccggcctgtctctcagtcggcggtcggcacctggctgtcgcggcattgcagccagatcgcgcactccagctgcatggcggtttcgccgcgttggttgcgggtttgccagcgcaccttaaccacgccgaagccgggctggctgccggagcggcgcttatccagcacttccacttccacctgcagcgtgtcgccgggccgggtcggctgcggccagcgcatctggtcgatctgcatgccgatcaggccgttggctgcctggcccagcgccgatccttccaccagccgcatggagaggctgctggtgtgccagccgctggcggccagcccgttgaagaaggagtctttcgccgcagccgggtcgatgtggaaaggctggggatcgaactggcgggcgaaggcgatgatttccgcctcgctcagcgtgtgggtcgggctgaggaagcgttggccgggctgcaggtcttcaaagtaaatcatgtctgaacttacgttaacgtaatgctaagcctcgaagcataacgccggcatcgacattggtcaaagtcaagacagtcacgggcggcattggcgcgggatcgtcagtctgggtccgccagcgcgccggcgatggcggcggccaggcccgccggattgtcccaggccagcgaatggccggcgtcggcgacgatgcggatggcgacgccgtgccgcggcagccattcggtgtccgggtccggcagcgattttgcgccgaagatcaggcagcgcggcatggtcagcgccagcaattgctcgcgccagccgaccgggcggcccttgaccagttcggcggcggcgcggtgcgcggccagcggcgaagcggccgccatgctgccggcccaggcgggattgtcgccgcggcaggcggctatgatctcggcgtgcccgcgttcgatgtaatcccgctcgtcccaggccgccagcgcgcggctgaaactgccgccgccgctgtccagattgggctcggcggcgatgagccgccgcacgcggccaggctgtagcgtggccagctcgatggcgacgctgccgcccatgctgtggccgaacaggtcgacggcgggcagatccagccgctccagccattggctgagcgccagggcctgcgagccggtgtcgtagcggaagtcgtcgggcttgtcgctgaagccgaagcccagcaggtccaccagcaacgcgcggcggccggcgagggccggttcggccaggaggcgcgggtagtcgaacgacgaggcgcagccgaggccgtgcagcatcagcagcggcgcgccgtggccgggaaggtcgtggtagcgcagcaccgcgtcgggctgggccagcttgaagttttgcatgtcggctccggtttcggcgtgttcagttggtcagcgcgtacagggtggtgttgcgcaggctgccgtccggcgcgatgcgctcctggcgcatgatgccctccagcgtgaagccggcgcgttccgccacgcggcggctggccacgttttgctcatcggccaggcaggcgatgcggcgcaggcccagttcctgccgcgcgaatgcgcagatggcgcgggcggcttcgctgaccaggccctggccctgccagtcgcggtggacccagaagccgatctccgcccgccggtgtttccagttgatgtcatgcagtccgctggcgccgacgaagtggccgccatccttcaaaaacagcagcatggtcagggttttgcgggagaggtaatcgacgcggctttggcggcagaaggtttccgagatatcgaccgacggctcttccagcgcccagggcatggaggccgggaaagcgcgcagcgcttccagcgaggcgcagactgcggaatatacgatggggccgtcgcccggctgcgggctgcgcagaatcaggcgttcgctttcgatctggtcggggatgtcgcgcagaatatcgtccatgccatgctccttgcattgtgcgatgcaatattaacgtcacggcatgaaatattacaattcgaaattcagacgcgcagcgcggcgatcagcgcggtttccagcgccagcgcggtcttgtcgtccttcagcgccgcgccgcggatcaggaaggagtcctcggcgcggctgcccagggtcatgatcttggccgactgcacgtccagccggtagtcggccagcaccttggcgatgcgggccagcaggcccggccggtcgccggcgacgatggacagcacgaaggcgctgtcccggtcgtcgggccgcatcgatacctgcggcgtgatggggaaatgcttgaggtggcggctgatgcggcccggcggcggcagctgcagcggcttgtcctccgccaggctggcggccagctcgaattcgatgaagttgatcatgtcgcggtagtcgccgtcgtgatgctcggggacgaagacatgaaaggtgtccagcgcgtagccgtggcgggtggtgtagaccttggcgtcggcgatgctgtagttggtgcggccgaagaaggcgcaggcgcgggcgaacagctcgggcttgtctggcgagtagatcagcacctggatgccttcgtggtcgtcggccagccgcgcccgcaccatgggttgggccggcgccagctggcggttgagcgcgcgggcgtgccaggcgatttccttggcctcgtggcgcaggaagtagacggtgtccagctgcgcccacaggccggcctcggcgccgtcggggatcgcgtgcagccgcaattgcgcgcgcgcctggtttttgcgggcttccagttcggaattgatgtccatgccgccgccgcgcgacagcacccggtaggtggcgtggtacaggtcctccagcaacttggccttccaggcgttccacaccttggggctggtgccgcggatgtcggccaccgtcagcaggtagagcgcggccagccggcgcggcgtttccaccaggtcggcgaagcgctgcacggtttccgggtcgtagatgtcctgtttctgcgcgatgctggacatggtgaggtgctggccgaccagccagctcaccagccggctgttttcctccgacaggccgtgctggcggcagaaggtttcggcgtcggccatgcccaactgcgaatggtcgccgccgcggcccttggcgatgtcgtggaacagtccggccaggtacaggacttccggctgctcgaaatcgccgatcagccgcgacaggaacgggtactcgtggttgtaggcgctgatggcgaagcggcgcagattgcgcaccaccatcaggatgtgttcgtccacggtgtagacgtggaacaggtcgtgctgcatctggccgacgatctggccgaagttgggcaggtattgtcccaggatgccgtacagattcatgcgcctgagcgtgcgggtaaggccggcgggctcgcggaagatctgcatgaaggtctggcggttgcgcgcgtcctggcggaaacgttcgttgatctggctgcgcgcgtgccacagcgcgcgcagcatgcgcggcgcgaagcccgacagttccggatggcgctgcagcgtgaggaaggcttccagtatcgcctgcggatgcttgtcgaagacattggcctcgcggatgcccagcatgccgttgaccgagtggaagtagtcgttgatgtgctgggtgacgcgcggcacctggcagtagatgcggccgcgcagattgggcagcaggatgccgttgagctggttcactgtcttggcggcgcggaagtagagctgcatcagctgctcgctggcgcgcttggccggcgtgtcagccaggccccaggccagcgccacctgttgctgcaggtcgaagatcagccggtcttcgcggcggcgcgccaacaggtgcaaatcgatgcgcagcttcagcagctggtcttcgctgtgcttgatcagcctggcttctgccagggtgaggatgccgcgccgcaccagcgcgtcccagttgtcgcccagcccggtcgccttgctgatccacagtatggtgtgcaggtcgcgcaggccgcccgggctttccttcaggttgggctccagattgttgctgacgccgaagtggcgggtgtggcgctgctgctgctccagcgtcttgccttcgaagaaggccagcgggtcgcgctgcgcctccagccgcgccatcaaggcgcgccacggctcggccgggcccgccaccagccggttctccagcagattggtttccacggtgatgtcggcggcggcctcgcgcaggcattctcccggcgtgcgcgcgctgtggccgatctccaggccgatgtcccacatcagcgcgatgaaccggctggccttgtcggcggtttccgccggggtgggctcgggcagcaggatcagaatgtcgacgtccgagccgggaaacagctggccgcggccgtagccgcccaccgcgatcaggctggcggattcgtccaggccctgttcgcgccacagttcggccagcacttcatccaccgcctggctgtaatgccgcagataggcctgcggattgcgctcggcgcggtagcgttcggccagttgctgtcgcttgtcggccagcgtctgccgccagtgctggaggggagcggccgcaagcgccatgtcagcgcctttcctgtttgacgatgatggcgatgccggccagcaggaagctcagcgtcggcaaggtggccgacaggatggcgttccagtcgtacaggaggcccaggtggccgaacaggcgattgacgaagtggaagctgacgcccaggcagatgccggcgaacagcttgatgcccagctggccgtggcggcgctgctgcggggtgaaggccagcgccaccagcgccatcgaaatgcaggccagcggatagaacagtttgctccacagcgcgatttcgtagcgttgtgtctgctgcttgttctttttcaggtgctcgatgtaagtgagcagattgagcgccgacatttgctccggcactaccagcagcacggacaggatttccggctcgacgatggatttccacttcagcagcgggtaggtgctgctggcggtgtggtcgcgcgcgatttcggtttccttgacgttctccagctgccagctgcgctcgttcttcaggaaggtgcctttctcggccagccgggtgcgcaccagtttgaaattctggtcgtaggtgtagatgcgcacgccgagcagggtgttgtccggcagcatttcatgcacgttgatgaagttctggttgtccttcacccagatgccggagcgaaactcctgcgccaccatcgagtgggtggccgacaatttcatccgttccgcctcctgcatcgcccacggggagagaaattcccccagcaggatggtgaggacggcgaagcccagcccgaatttgagcagcgtggcggcaatctgccgcagggtgacgcctgaggtgcggatgaccgtgtattcgctggaactggccagctgggtcatcgccaccatgccgccgatcagcaccgccagcggcatcagttcgtaggcgtggcccggcatcaacagcgccacgtagcccgccatcacgccggcggtgtaattgccggtgcccagcgcgggcacttcgcccagcaggtcgaaaaagccatacaggcccagcagggccagcagggtgaacagggtggactgggtcagcgtgctgacgatgtagcggtgaatgagtttcatcggaaaggtctgtcagtttttaccgagcatctgcgccagcgactggccgaacggaatctgcggccggttgcggtgcttgagcagagccaacgccagcagcagcatcaggatgtggaccaccgccaccgcccacacgccggttttgccttgcgtgatccagttgcgcgcgacggtgaggccgttctgatagacgaagaacgccaacagcgcgaacagcaggttgtaggtatggccgctgcgcggattgtagtaggacagcggcagcgccagcagcgccaggatgatgcagctgatcggcatggatagccgccaggccagctcggccttgtactcggggttgccgctgcccagcaattggctggtggggatggattggcggttgctggccgggctgttgatcgcctggccttcgcctatgctggccgtatagcgtttgaattcgccgacttgataatcggctttgcccggttcgccgacataacgctggccgtcttccagcaccaatacccgttcgccgtcgggtttggtcgaaatatagccatgcttggcgaaaatggtgctgactttgccgtcggtcatgtcttgcatgaaaatattggtggcggcgctgtgcaggccggaataattttcaatgaagtaaaccttggtcgacgacgccgattccttgaacacgcccggggaaatggcggagatctcctcgcggcgtttgatgatttccgcgtagtcctggctgcgctggtcggcccacggcccgacgaacagggtgacgccggcgatcaatatcgccaagggcagggcgaagcgcatgatgggccagatccagtcgcgcagcgacaggccggaggacagccacaccaccatttcgtggtcgcgccagctgcgggtgagcaccaccagcacgctgacgaagacggtgagaatcatcagtaccgggaaaaagcccagcgtccagaagccgatcagcgcggtcaccgcctcgttggcgatctggccttcggcggcgcggcccagcaggttgatggcttgggtggagacgatgatggccagcaacacgacgaaaacgcccagggcggtcaaagtcaattcgcgtgtcaggcttttttgaaaaaccatttattcagtgcctttttgactttttgtgaaaagcattgtgataattcgatgagacaattctgaagcgccgtttttggcaaatttggaccattacaacaatcttgcgttcaccggcggtaagcgcgcccgtctttcccgagcttagacggccgtcatgaggtggagcaaccgacactcgttctacaagcggagtacctatggaatttaacataaaaagcggcagcccggagaagcagcgcgtcgcctgcgtgatagtcggcgtatacgaatcccgcaagctgacctttgccgccgatctgctcgatcgcatctccaacggcttcatcagcgacgtgattcgccacggcgacatggagggcaagctgggcagcacgctggtgctgcattcggtgccgcacacgctgtgcgaccgcgtgatgctggtcggcctgggcaaggaacgcgaattccgcgccaaggaataccgcgaggcggtgcgcgcctcgatcaaggcgctgacccagacttccgccggcgaagccgtcagctacctgtccgaactcacggtgaagaagcacgatgtcgagtggatgatcgagcaggccgcggtggtcaccctggacgtgctgtaccgcttcgaccgcttcaagagcaagtccgacgagccggtgcgcgagccgcgcaagctgacgctggccgtgccgcgccgcagcgacctggccgacggcgaaaagggcctgcagcgcggcctggccatcggcagcggcatgcggttggccaaggacctgggcaatctgccgcccaatgtttgcacgccggcctatctgggcggcgaagcgctgaaaatggccgaagctttcggcgccgcggccgaggtgctggggccgaaggaaatcgccgaactcggcatgcattccttcctgtcggtagccaagggcagctctgaagaggcccgcctgatcgtgctcaagcaccagggcgccaaggacaagaacgacaagcccatcgtgctggtgggcaagggcatcaccttcgactccggcggcatttcgctgaagccgggcgagggcatggatgaaatgaagtacgacatgtgcggcgccgccaccgtgctgggcgccttccgcgccgcggtggaaatgaacctgccgctgaacctggtggccatcgtgccggcctgcgagaacatgcccaacggcaacgcggtgaagcctggcgacatcatcacctcgatgtccggccagaccatcgaagtgctgaacaccgacgccgaaggccgcctgatcctgtgcgacgcgctgacctacgccgagcgtttcggcccggccaccgtgatcgacgtcgccaccctcaccggcgcctgcgtgatcgcgctgggccatatcgccaccggcctctacagcaaccaggacagcctggcgcgcgagctattggccgccggcgaagaagtggcagaccgcgcctggcacatgccgctgtgggacgaataccaggagctgctgaagagcccgttcgccgatatggccaatatcggcggtcgtccgggcggcagcgtcaccgcggcctgcttcctgtcgcgtttcgccaaggcttacgattgggcgcacttggacatcgccggcaccgcctggaagggcggcaaggaaaagggcgccaccgcgcgcccggtgccgctcctggtgcagttcctgcaggaccgcgccgacatcgcgctgggcaatgtggtgcgcaggggccgcccgcgtcgtgagacgcctgaagtggcagaagatgaccaggattgatttttacaccaatgtcgccgatccgcaggcttttgcctgcagattggccgataccgtgcagcgcaagcaggagcggttgctgatctggctggacagcgaacgcgaagtcgaggtgttcagcaaccgcttgtggagtttcggcgatacccgcttcgtgccgcattgccggctggaagcgccggaggcgggccagactccggtctggctgacggcccgcctgcccgacgatctggcgcatccggtactgctgaacctggggccgcagctgccctatgcaatcgaacgcttcgagcgcattcttgagatagtagggcgggatccggcctcgctggcgaccgcccgcgagcgcttccgtgcctaccgtgagcatggctgcgaagtccaacatcacgacatgagccaaacgtcatcatgactgagtcgccgaaggccaatgacgcagactggaacggtctcaacctgccggttttgaccgatgtggtggaggagccggcggtgccggttctggcggaagaggcgccggccgtcgcggcggaggttcccgagttcgacttctcttccgagctggatgtgcttgccgccgagctggatggcgaggccgaactggaaatcccagagctgtcgctggccgatctgctggccgatgacgcccccgcggccgacgagtccgcctctctgggcgggctggacttcagcaacctgccttcgctggagttgagcgatgccgacggcgcggacgagtcggccgatgggctgggcttcgtgctggagccccgcgacgcgcagctgccgtctgccgcgccggccgccgaagatttgacgccgtccgagcctgtcgaggcgaaggctgcggaagcggccagcgcaagcacagcctcggcggaaccggagctgagctgggaagacgtggtggcggcatcttcacaagcggcggaatccgcattagcggagccgatggcgctggatatggcgacgccggaggagagcggcgaagccgcgccccactcggaaccgtccccaatcgcggagccgcccgcatttacttcgatatcgatagacagcctgccaagcggggtgctgggcggcggcgtgggccgcgagccggcgccggcggaaaccggcctggaatggctgtcctccctgcccaaaccggaaatcccgccggcctcccaggagcaggtgctgcaggaggccgaacgcgttctggcggatgagcgggccatgcaagatgccgggcaagcgactgcgccggaattgagcgaagccattgccgagccggaagcgccgatgccggaagaactgcctgccgctgaagcggccgcgcagccggaagccgcggcggcattcgagccggtcgaggcggagacgattgcgtccttcgacatgccggtggtcaccgacgcgcaggagcctgagccggccgaagcggcggctgcgctggaagtgggcgaggccattgccgagccggtagcgccgatgccggccgaactgcctgccgcagaagcggccgcgcagccggaagccgcggcggcattcgagccggtcgaggcggagacgattgcgtccttcgacatgccagtggtcaccgacgcgcaggagcctgagccggccgaagaggcggctgcgctggaagtgagcgaagccattgccgagccggaagcgccgatgccggaagaactgcctgccgctgaagcggccgcgcagccggaagccgcggcggcattcgagccgttcgagacggaggcgattgcgtccttcgacatgccagtggtcaccgacgcgcaggagcctgagccggccgaagcggcggctgcgctggaagtgagcgaagccattgccgagccggaagcgccgatgccggctgaactgcctgccgcagaagcggccgagcagctggaaccggtggcggcattcgagccggtcgaggcggatgtgatggagtccttcgacatgacggtggtcgccgacgcgctggagctggagcccgagccggccgaagcggcagctgcgctggaagtggcagaggccgtcatcgagcctgaagcgccgatgttggaagcgcagcttgtcgacgaagcggccgagtccggcgatgcggcgtttggcgtggtcgaggatgaggatttgcccgcattgtccggcctgctgggcgggcggagcggccatgccgcgcccgaggcggctcagccgccagctggcgacgcgtcagttttgccagctctggctgagcccagcccggttgcggtggtgaagatcgccgcgatggcggcggcgggcagcgccggccgggggccggccgctcccccgttcgatgagcaagcgctgttcaattcgctgtatgagcagatgctgccgcggatgaaggtggagctctccttgtggctgcaggaagcggtggaggttcaggccaagcagatgctgtcgggcatgatgcaccaactgaaggaagactatgaaatgctgttcggcgacgcgttgaaggaaagcctgcgccaggcgctgggcgatgtcggcgcatcgatgaaggatggagacggccatggctgaccgtttgtcggatatcgtcacccgcaccggggatgacggcagcaccgggctaggcgacggcagccgcgtggccaaggatagcgcccgcattcaggcgctgggcgacgtggacgaactcaattcggtaatgggcgtgctgctggcggagccgttgccggagccgctgccgcagtggctgagcgaagtccagcatgatctgttcgatctgggttcggaactggccgtgccgggctatcaagcgataagcgattcccacgtccaggcgctggaaggcctggtgtccttcatgaatgaggagctggggccgttgagggagttcatcctccccggcggtttgcgcagcgccgcgctggcgcaccaggcgcgctcggtctgccgccgcgcggagcgggctgtggtggcgctggcacgcgaggaagagccgtcccaggcgctgcgccgctatctgaaccgcttgtcggatttcctgtttgtgctggcgcgttatctcaaccgccagggcggggtgcccgatgtgttgtggcaggcgggccgccagcgctgatcctgtttcgagccgcatgcagacggccagctgcctgagtgcttcaggcagctggccatttttattgtaggctgcgcttttcccgatattttcaagcttttttgatagtgttttccttgcttgccggtgaattatgccttgcaatgaaagagcgggcatccggggcgaggactggtctctgttgaagacgggcgatagccgatgccgagccaagacgtttctccgcggaggcgctatatggccagtacggtgctgttggatctgataggcggggtggcgctgttgttgtggggcttgcacatggtgcacagcggcatcgtgcgcgcttttggcgcgaacatgcgccattggctgggccgagccttgcgcaaccgcgcattggcgtttctggcggggttcggcatgactgcgctgttgcagagcagcaccgccacggcgctgatgctgacttccttttccgtttccggcatggtggagctgacgccggcgctggcagtgatgctgggggcgaatgtcggcaccacgctgatcgtgcagctgctgtcgtttcatacttcgttgttctcgccggtgctgctgattggcggcgtcatcgccttcaagcgtggatctggcactttgacccgcgatatgggaagagtggccatcggtctgggcttgatgctgctgtcgctgcatgcgttgatggaaacgctggcgccggcggaaaacgcgcctttgacgcgcgaggtgctggcggcgctcacccatgatcccatgctcaatctgttgataggcgcttttctcagctgggccgctcactccagcgtcgctaccgttctgctggtcatgtcgctgagcgcttcgcatttcatcgcgccaggcgcggcgctggctctggtattgggcgccaatctcggcagtgcgatcaatccgctgctggaagcggcctctggcggcaactccgccgcccggcgcttgccgctgggcaatctgatcaatcgcgtggcgggatgcgcgatctttctaccggcgctggggccggtggcggccttgctggctacggtcgatcccgacccctggcggcagccggccgatttccacaccgcgttcaatctgttgatggcggcgctgttcatgctgccgttgaagccgctggcgggctggctggagcgcctgctgccggagcagaaggcggtggatgacctgtccgcgccgcagtatctggatgccagcgcgctggagacgccgacggtggctctggcttgcgccgcccgcgagaccttgcatatgggcgacatcattgaagacatgctgcgcaagacgatgacggtgttgcagaccgatgatcgcaaattgatggcggacgtgtctcggctggatgatgccgttgacggcctgcatgaggcggtcaaattttatctggtgcggcttaccagcaatagcctggaggagcaggaggggcgcaaggcgatggaaatcatggccttgtcggtcaacctggagcacatcggcgacatcatagacaagaacctgatggagctggccggcaaaaaaatcaagcataagctgcagttttcccgtgagggggcggaagagctggcggcgatgcaccgtacgctgatcggcaatctcaaactggctttcagcctctttctgtcgggcgatatcggttcggcgcggcgtttgttggatgaaaaggcaaaattccgcgaactggaattggccatgtcggaaagccacctggcgaggctgcgggaagggcgattggaaagcctggaaagcagctccttgcatctggacatcctgcgcgacttcaaacgcatccattcgcacatctgcgctaccgcctaccccattcttgaggaggcgcgcgagttgcatcctaccagattaaaaccattgcccttgatcggaaccgatacttgacctgacctcctcccgcaaaaacgtagcggcgaaaagtagagatttctggcaaatttaagcccatccgggcaggagatttgtcatgaaaaaatcgaagttcaccgaagaacagattgccttcgccttgcgccaggcggagtccggcaccaccatcgccgaggtctgccgcaagatgggcgtctccgaagccaccttctacaactggaagaagaaatacggcggcctgggcgtcagcgagctgcgccgcctgaagcaactggaagaagagaacgcccgtctcaagcgcatggtcgctgacctgagcctggacaagcagatgctgcaggaagtcatccaaaaaaagctgtgaagccggctcgcaaacgcgagctggccaacttcctgatcgacgcgtaccgcgtcagcattaggcgtgcgacggccgttattcagctgcggcaagctacctatttttatcgccctcaccctcgagacgatcgtgcggagcggcagcgaatccgcgagatcgccgccactcgcattcgttatggcgcgcgccgcatctacgtcctactgcggcgcgaaggcngccctcggtgccgatcttcagcacgcccgccttgcggatggccgccagatcgtccgcctgcgcggcggccgcgcccagggtcagcgccagcgccagtactgcattcagttttttcatcttcaggttctccgcgatatccaggatcgccgccgcagcggcgggcatgtcggcaccttaacagtcgcaacatagacctcaaagtaataatatttttcttatttatttcttttggaaatataaatacccataacgcctgcgcctcgcccgccaaacagcgccacggctagtcaaatcgggtaatttgtccgattttttgaaatatttccgcaaaacgcttgcacggaaaaaaccggcaatgtatagtgcgcttcctgtcgagaccaaacggccgccgcgaaagcggaatcgacagaatatgtgggggtatagctcagctgggagagcgcttgcatggcatgcaagaggtcagcggttcgatcccgcttatctccaccacaatttagtccctatcgtctagaggcctaggacactgccctttcacggcggcaaccggggttcgaatccccgtggggacgccagcttcaactgggggtatagctcagctgggagagcgcttgcatggcatgcaagaggtcagcggttcgatcccgcttatctccaccaggtttcaaacgcattccgcattccaggcggaaagcgggcagcaaaaacagtttaccgggggtatagctcagctgggagagcgcttgcatggcatgcaagaggtcagcggttcgatcccgcttatctccaccagtaaaaaagccgaaatcgcaagatttcggctttttccgttttattttccaaaattccgcaaataaagaaaaaaggacgcctccgcgcccacctccccaccctcttccgccaaaatctacaaactctctccacgcagacgcccaaccagtcccgccagcttgccggcgtagtccggatcggtggcatagccgccgcgcgccagcgcgccggcgaaggcccgcgcgtccgagcccacccccaaggcggcgcgatagcgcggattggtcgccagcaggtcggcgtagtcggcgaaggccgcccgatagtcgggataggcacgaaaaggctctacccgcgattgcctcttgccgtccaggtattcggtagtcaacgacgccgccacctcgccgcgccagcgcgaatcggccttgatgccgaacagattatggctgtcgccgccgtcggcgcggcgcaacggcttgcgcccccagcccgactccagcgccgcgtgagccaccaggatatccggcgccacgcccagcctgtcggccgcttcgcgcgcatacggcgccaattcggcgacaaaagcctgccgatccggcggcaccgccggcatcgcctggccagccttcatctgctgctgcacgcgccaagcctcgggagacagcgcagtcggcgcggccgcgtcgccgtcggcgatgaaacgctccacttcgccgcgcacgccggccagctgctcggcgaaacccgcgcccggcgccggcaacgccagcggcaaggcgacgccgtcagcagcctgagcgaacgccgcgcccaagccagcctcactgcgctgcgtaaacatccgactccccctccagcacgcgctgcagcaatagcctgcgctgctgcagcaactggccgttgcgcaaattcaattcgcggcaatcggccaccatgccgcgcagccgcagccaatgccgctcgccctgctcgcgctgccgctccggcaacgcccgcaagaccgcggccatcgtcaactcagcccccgccggcagcaagcgctccgccgcgcccaggcgttcgcggcggcttagctccaggcgtcggcacaacgcgccgatctcgtcggcgcaaaccgacaaggcctgcgcgtcatgcgccagcgcggcggcgaactgccgctccagacacgcctgcagcaagggataagccgccaggtcgtccgccaccgtggcgaacagccggcgcaagtcctgctgcctatccatcaacgaccgccgtgatactgctcgatcaggccggcgagccgctgcggatcgaagcgcacttcgccgcgcgccaatgcggcgcgcaccgcgtcgaccttggccagatcgacttccggcatcgcctgcaaggccgccgccagcggcgcctcggccgcggcgggagccggacgggccggcgcatcggccgtcgcggcggcgtcggtcttggcaggcgcggccttgtcggcgcgccaggaggaaagggaagatatctgcatcagtctgcctgctactgtggaattgggtgtgatacccatacagggcgacgccgggccgccaaacttaaatccgcaagcgaaacggccgcctggcggttagcccgggcggccgttggcgcatcagaagttttccggcagcatcttcagcaccacgatgcggcggttctccatccggatatagtggccgtagatcagctccttcaggatacgcgccaccatctcgcgcgaggagccgatctggtcggcgatttcctgctgggtcaactgcttgcgcaggatcagcacgccgtcctgctcgatcagcatctggttgatcaggatgcgcaccctgccatagacatccagcaaggccagattgcgcgccagcgtagtcatgtggcgcaccagcgaaaccaggtagcacatgatgctgctgcgcaccttgtcgcagccggggaggccatcctcgctgtcgaacaggccgctgagggcctcgcgcgagaacatcagcaacacgctttcctcatcggccaccgcgctgctgccgcggccgccgccgtccacaaacgactccatgcccagcatcccgcccggcatcgccatctgcagcacgtatttcttgcccacggcatctgccacatacacctgcatgcagccccccagcagcaggtagaccgcatccgaagcgtcgccctcctcgtacagggcctcgcccctagccagacggacggtttcgcaacattccagcgcccgatccagcgtatcgtctgccaaatgaccaaacaacggcgtttgccgcaacatctgcgtaacttgttcttgattcatctcggtaacacgtccccgactatccggcagcccaagccttgaacggcaaagccatgcccaagtcattatttattgttcgcgatatgagatctggctcatacaccgcgtattgttatcaacacaggggaaattgtaaataatttgattaaaatttatgtgaaaatcgcacaaaaaaagaccttgcaacgcaaagtcttttgtgattgcacaatattaacaaatactcacctgataccgatggtattttctctaagtttttgcaagtctttctcatttggtagcgcggacgcaacaccgggcagcccggtcttgccgtcggcggccgagccgaacatcgccaccaccgcctgagcctggcccgaagtcaggatcagcagctcgatgcggcggttcgccgccgccagcggatgctcgcggtcgagcggcgcgcgctcggccatgcccaccacctgcagcaccgaagccggggccaggccgccctgcagcatgtgcatccgcgccgccatcgcccggttgctggacagcgaccaattggacaaggcggcgaagccgccggcgctgtggtactgcgccgcgtcggtgtggccgaccagcaggatctggttgtcgatctcgcccagcatggcgcccatttgctgcagcaggccgcggaagcggggttcgacgatggcgctgccgcgctcgaacatgccctgctgatcggtatcgtgcagggtcacgcgcaggccgtaaggcgtgatgatggtttgcagattgctggacaggccggcctgctggctcattgtcgacaactgcgcggccagcttgcgcaggtcggcctcgctgtcgtagctgcggcgcggcatttccggctgatcttgcgccgaacgcttgtcgctgtcgcgcagcgccgacttgctggcagcctggctgccggtcgggccggggatggggtcgcgcgggatcaggctgccaggcggattgcccatgtggtcgatctgcttgccgtcgccctgcatcagcgggctgccgccggaggtggtcaacagctgccgcaggttttcctgatcgcgcgcggccagcacccacagcaccaggaacaggcacatcagcgccagcacgaagtcggcgaacgccactttccacgcgccgccgtggccttcttcctcatggcggcgcgacacgcgcttgatgaccgcgccttcgtgctcgtcctttttcttcaagccggccatggatcagccctgaccttccagcatggtgatccacgactccagctgcgagaagctgggcttggtgttgagctgcaccaggcggcggccggcgtcgatggccagcagcggcggcttgccggaggcgtgggtggtcagcaccactttcaccgattcgaaattggacagctcttccttcaccagctggctcatcacgttggaaatcgggtccagcacgccgtagcagaagaaaatgccgatgaaggtgcccaccatggcggccgccacgctgttggcgatttcgccggcgctggcgccctgggcgacggtgttcatcgccatcacgatgcccagcaccgccgccaggatgccgaagcccggcatcgcctcggcgatcttatgcagcgacttggacggctggttcagctgctcgtggatcgcgtccagctcctggtccagcacgccttccagctcgtgggcgttgatcttgcccatcgccatcaggcggaagttgtcgacgatgaaggccagcagcttggggctttccagcaccagcgggtagcggttgaacaacgggctctggcgcggcgcctccacgtgctggtccagcgccttcaggccgcggctggcggtgatcagcaattcgtacatcagcagcagctgctggcgctggaattcggcgccctgcttcttgcgcgtcgccacccgcttgagctggccgcccatctccttgagcacatgcggcggattgcccagcacgatggcgcccagcgccgcgccgcaaatgatcagcaactccaccggctgccagatcaccgacagcacgccgccatgcagcatgaagccgccgaatacacaaaccagcacgatcaggatgccaaacagttgctgcatgggatgtttccttgcttcaggccgccatcaggcaggcctgcatctttttcagggcgctcttgttgatctggcagatgcgggcctcggtcagctccagcactgcggcgatctccttgagactcagttcaaattcgtaatacagctggatcacctgctgctcgcgctcgttcagcgcggtcagcgcgcgcgccagctcgctctgccgctccagccgcgcctccggcgaatcctccgccgccaattccatgccggatgccaccaattcgtcgaagctggccatcgcctcggcgttttccgccagcagcgcttcgcggtaagcgtcggcgtccaggctcagcagcgtcatcgcctcggcctcggacggctcgcgcctgagcttgcgccgcagctcgcgcaggccgtcgcgcacccggtgcgcctcctgcctgaccgaacgcggccgccagtccagccgccgcaactcatccaggatggcgccgcggatgcgcagcatggcgaagccggcgaagcgctcgtccggctcgccgccgtagcggcgcaggcaatcgagcagcgccatcaggccgatctgctccatgtcctcgcggtcgaacaccccgccggcctggctggccagctggcgcgccgcccgcttcaccaacggcgcgtacaaggccagctgccggctttcgtcggcggcatggggagcgggtgcgtagctttcggcgtacatcgggcttattcgatgatcagcttgctgaccatcacttcgctgaacggcaattcgttttgctctcgcgcggcgcttgcgcggtaggccttgtccagcaggcgctggtagtcgtctatgcccagcgcgttggcgcgctcgcgcgacaattgcgacaaggcgcgcaccgccacgctcttgagcagcggcagctgctccttgaccttgggctcgctctccgggctgctgcggaacaccaggtccaccgccatgtagcgcgggtcgccgccggcttcgctgcgcagcatcaccacgatcttgtccaggctgacgaaacggtagtccatcggcttgggcttggccggcgccgcatgggcggattgctggtagtaccaccagccgccgacgccggcgctcgccgccagcgcggcgaccagcgccgcgacgatcagagtcttgctattcattcacttccttccttgtccggctttcagccctgatccagctcaaaggcttccgccgtctgccagccctgctcgcgcaaggcgcggcccggattctgctgcggctgctgctcgcggttctgtctgccgccctggccgtagccggaaggcgcgccctccttcacctccaccgccacctgggtgtactggcggttgcccaggtcctggcgcaggctgtcgcctatggtttgcagctgcttgaccacctcgctgtgcgaagccgtcagctccaccgtcagcgcgccggcctgatggcggatggcgatctccagcgtgcccagcgccggcgggtccaggcgcagggtggcgcggtcctggttctggctggacagcacctgcaggcgctcgcccagcgccgcctgcagcttgccgctccagctgtccggctgcgacgccggcagttgcaggctgaacgtgtccgccggcttggcattgtccgccgcgtgcggggccggcaacggcaacgccgccagcagcgccgtttgctgcgcgtcggcccgcggcgcggcggcgtcggccgtcaacgcggccagcgccttggcgtcaagcaagctcggcgccgccgccgcgatggcgcgcggcgcgggctccgatggctgcggctgcgcgtccgccgccaccgccgggagcggcgccggctgcaattgcggccagaccagcggcggctgcatcgccgggctgagcgcggcaacatcgacctgagccactccgccctcgtcttggtcctgcttgccgtcgctcggcttggcctcgtcggccacggcggcggcaagcgccggcgcggcaggctgcgcgccttggcttggcgccagttgcggctgcgcagcgtccgccggcggcgcttgccgcagcgccagcagcgcgctggcgaaatcctgcgccggctggccggccggcagcgacagactgtcgatatccagcgcctggcctacgacatcgtcggccatcgccggcaaggcattgccggcttgcggcggggccactctgctcatgcttgttcccattcactgaattgcgcgtaggccatctggccttcgcgctgttggcccatcgcggcgagcttgtgccgcagcgcgtcgatttcggcctggctgcaatccagcgcagcgcggtaggcgtcggtcagcaagcggcgctggccggcgtccaacgctggctcgccctccgacagcagccggcgcagcgcctggtcgagctgcgccagcttccgccagtcttgctcgcgcccggcctggctgatcgcctggctccaggcggcggcgtcaaacggcggcatcttggtcccgcacgcctatccagccgcccttgagcttgaccagcagcgcctcggcctcatccagcgccgccacgtccatctccacgctggcctggtacagcttgtgcgcgcagtagtcgtacaagcgcgccaggctggtcaccacctcgccgccgttgtcgaagtccagcgcgctggacaggccgttgaggatattgatgcacttgttgatgctctcgcccttctgctcgaaacggcggtgctgcagatggccgcgcgcgcgcgcgatttcctccagcaggccgtcgaacagcaccagcaccaggtcgacctggctggcggagtgggtctgggcttccaggttcaccgcgtggtagctgcgataggcttcgtaatccactgtctagatcctgctttcttgctcagttgtaacccagcatgcccatggtctgggtcatttgggtctgcatgttctgcagttgggtgaattgggccagatagcgctggtaggtctgctgatactgctgctgcagtgcgtcctggcggcggttcagatcctgctgcgcgcggtcggcgctgtccttgcgctgcttgatcaggccattgctgtagttcagccacttatccaggtaatcgctgctttgcttgagcgcgccgctctggccgacgccgttgaaatagcggtccagcgcgtccggcgtgttcttcagcgcgtcgcccagcttcttgctgtccagcgtcaggctgccgtcgcggctggcgctgatgcccagctggcccagcgtgatgccgtcgtaggattggcgcaggatggcgttgagctggcttttcaggccgcggatgctggagtcgtcggcgaaggggccggcggtggcgccgttgatgcccggctgcgacaggtcggaaatcgccttgtagatcttgttgtagccgtcgacgaaggcctgcacgttggcagtggtgtcgttgtcgctgcggctgaccgccagttgcagcggcgcgtcgccgtccttcatcgccttattgacggtgaagctgacgccgtcgatgttgtcgaaggtattggaggcctgctgcatgcgcacgccgctggccttgccgcccagccataccaccgcgtcctgcgcctgggtcagctggcgcgaagcggacaggccggttttcaggccggcgtcgctcacttgcgacaggtccagcgagatggcgccgttcaggccggtcttgccggaggacagcaccagctggctcgcgccgttgttgttcagcaccatggcgttgaccttgccgccgttgccgctcgcgcggttgatcgccagcgccagctcgctgggagacagcttgccgtcgccgtcgcggtcggccccggccatcgagacgtcgaaggtatcgccgccggctagtttgacggtgaacttgtcgccggcctgcgcggtggcgccggacagatcgcccatcgccagttgctgcgcgctggccagctgctcgacgaacaggctgtagttgccgggctgggcattgcccttggcggtgaccgtggccgccccgtcgggcagcgccgtggcgttcatcgccaccaggctcttcttgttggtcagcgtgcccaggctggtcttgtagtcctgcagcgccttttgcagctgccccagcgcgtcgctgcgcgccttggcggccttggtctggttgtccagctgggtctgcatattgcccaggctgttcttggccaggttgtcggcccaggtgctgggaggcatcgcattgaaatcaatcgccatcgctattcctttcgtcggctaacggtatccatcactcaatggcgaccgcgcgcggccatccctgaaacaccgtgaatattcaccaccccgccgctccccgcagccaggcttggccggcggcttcgtcggtgcgcttctgctcggtccgcgcctgctcgtcgcgccaggccagcaggctttggtcgcgcagcagctccgcctgctcctgacgctggcgcgcggccagcagctggcgctggctgaccgcggcgtcggcttccgccagctgcagatcctgccgctgcgactggctcagccccgccagatggctcttgtagccggcgcaattgagcgccaaggccgggtgcccggcggcggcgctggcgccgctggcggcgttcagctcctccagccgcgcgatattgcggcggtagcgctcctgcagccggcgcttgccggccagctcggtttccaactgccggctgtcgcgttcgcgcagctgcagcagcaaattcagttgctggatggcggtattcatgcgcgcgccagctcctgcaagcggccgcgcgtatccgcgaacgaggccgcctcggcggcgtcctggcgcagcagcgcttcgatgccgggctgcaggcgcagcgcgcggtcggtggccggatcggcgccaggcacgtaggcccccagcggcagcaggccgcgcacttcctggtaacggccccaggcggcgcgcagctcgcgcgcggcggcggcgtgctcggcgtccaccagctggctcatgcagcggctgaccgagcgggagatgtctatcgccggatagtggccgcgttcggccagctcgcggctcaatacgatgtggccgtccagaatggcccgggcggtgtctgccaccgggtcttgctggtcgtcgccttcggccagcacggtgtagatggcgctcatgctgccctcgcccctctcgccgttgccggcgctctcggccaggctcggcagcaggccgaacaccgacggcggatagccgcgggtggccggcggctcgcccagcgccagcgccatttcgcgctgcgccatcgcgtagcgggtcagcgaatcgaccaacagcagcacgttgcggccctggtcgcggaaatgggcggcgatggcgtggcacagctcggtggccttcagccgcatcagcggcgattcatcggctggcgccaccaccagcaccgccttggccaggccctgcggccccagcgcgtgctcgacgaattcgcgcacttcgcggccgcgctcgcctatcagccccactaccaccacttcggcctcggtatggcgggtgatcatgcccagcagcacgctcttgccgacgccggagccggcgaacaagccgacgcgctggccgcggcctatggtcagcatgccgttgatggcacgcacgccgacgtccagcggcatgtcgaccggttttttcctgagcgggttgatctgcggcggatgcgcggccagcggcgcgtcgccgcctagcctgcccttgtcgtccagcggctcgcccaggccgttgacaatgcggcccagccagccatcgcctatgctgaggccgccgctttccggcgccggcagcacccgcgcgccggtggcgaggccgacaggcttcttgaacggcatcaggaaggaaacttcgcgcttgaagcccaccacctgcgcctgcagccagccgccggaggcggtttccaccaggcagcgctggccggtttccagcgggcagccgacgctctcgagcagcaggccgctcacgcccaccagccggccgctgacggtggcgacaggcgcgtccggcaccgacagctggctgagcgcctggcgcagcatcgcttaagcctcgccctgcgcggccggctcggcctgcagttgctcgcgcaggctgtccacgcaatgcgccagccgctgctggcagccggcgtcggcctcgaattcggcgccgcgcacccggcactcgcccggcgccaggccggaatcggccagcagccgccacttggcggcgcgctccggcgccagctcgcggatgcgctggcattcttcggggttgagcagcacttccacctcgccctggctgtgggaggcggccggcagcgcggccagcgtctcctccaccagatcgaggatctgcaccggcttcaaggtcagctcgcagcggatcacctggcgcgccaccttggccaccagttccaccacctcgtcgcgctgggcggcctgatagtcgcggcacaagcgccgcaattgctcgatggcggcgtccagcggctcggccaggctggagaagcgcgccagctcctcggcgcgcgcagcggccacgccctcctgccggcccagcgcgacgcctgcctggtagccggcgtcgcggccggcggcttcgccgctgtcaaaaccttcgcggtagccggcgtccatgccctggcggaagccgtcggcggcggaggcctgcgcctcggccgccgccagcggctccagcggcgcgccgtcgatcaacggcgggaaacggaaggggcgccagtgtttcactcgaccacttcctcggggaacagctgcaggtcgatctcgccgccgtcggccaattgccgcacctgggccatgatctcgcgccgcgcctcttccacccggcttttcggcaccgggccggagcggcgcatggtggcgtcgaagttttgcgcctggcggcgcggcatggtctgggtgatggcgtcgcgcaccgcgggctcggcgcccttcagcgcgatcgcccactgctccagcgacacgtcttcgcagatgcgggtcagcacggtttcggtctggcgcgacaggatgaagaagtcgtacatcctcacctcgatctcgtcgacgatttccgggtcgtgcgcgcgcagcagctccatcatgcggctgcggtcgcccggcaggcggttgatgatgtcggcggtctgctgcatgccctgcaccgcggtgctttgcgtgtgcaggctttccaggcagcggttgaccagctcttccaattcctgcagcagctcgcggtccacatcggtgaggcgggccacgttgaccagcacgctgtcgcggctggcggccggcaaggcgtccaccacctggccagccagcgccggcggcaggaaggcgaggaacaccgcctgcatccgcacgtgttcggcggcgatgcggtcggccagccattgcggcgacacccactgcaaacgcgccatcttgggacggatggcgtcgccgtagatggtgtccagcacgctgccggcgatgtcgccgcccagcgccagctccagcgaacgcttgaggaagctgcggctggcgccgtgcacgccgctttgctcgcggtattcgtcgaagaatttctgcatggtggtcttgaccgcgtccaccttgatgccgctcatgccgctcatcgcctgggtcacctgcagcagctcttcgcggctgaggcagcgcagcaccgccgccgccggctcttcgcccatgcacagcagcagcaccgccgcctgctcgatggcgctcatctggccgttgccggctgccgccgcggggacgtaaggcgccgcttccggcgcgaaattattgcttgcgtccattgttctgcacccattgtttgaccacttccgccacccgctccggctccttggccgccagcaccttcaggtggtccaccagcacgtccaccggcgaaccggcgggcggcaggtcgtaattttccagcagcggcaccaccgggctgtcgcccggcgcggccgccagcgcggcctggcgctggccggccgcctcgcgcagcggacggttgtccagcagcggatcttccggcgtcacgtccacctcgcccggcgcgtagtcgcccagcttgcgctccgccaactggcgggcgatcttcaaaagcggacgggccagcaacaggtaagccagcaacagcgcgatcgcgtagcccagccagcgcgcgccctcgaaccaggtttccggctgctgccagaacgcttcttccgctaccggggcggcgaagttcagcgtggacaccgccagcacgtcgccgcgctcggcgctgatgcccaggccgttgcgcagcagcttgtcgatattggccagctcggccggctgccatcccttcttgctcggagcggcggcctggttcagcaccaccgccacgctgaggcggcgcagcgtgccgcgcgccttcttgatgttcatgatgttgcggtcgtaggcgtactggcgggtgaccgcgttcttgctgttgccggacttttcattggccgggccggaggagtcggtgttgaccggccggttgctcagcgagcccggcacgcccagcgccatccgctcggtgctggtttcctcgcgcgaggcctcgttggtgaccttgggcgcctcgccgtatttctcgcgggtttcctcgacgcggtcattgtcgacgtcggcggtgacgctcaccttgaagttgcccgcacccagcgctggcgacagcaggtcgcgcgcgttctgcagcgcctgctcgcggaagcggcgcgccgcctcgttgtcggaacccaccatgccgccgtcggacaggtcgacatgggcggacagcagattgccggcctggtccaccagggtcacctgcgccgggtccagcgtggagacgctgccggccaccagcttgaccaccgcggcgatctgctcgctggacagctgctggccgggctttagcgtcaccaccaccgaggccgagcccttgtcggtgccggcggtgacgaaggaagtgctgcgcggcaaggacagatgcacgcgggcggcgcgcaccgggtccagcgccaggatgctctgcaccagctcgccttccaggccgcggcggaagcgcacgtcctgcacgaattggctgacgcccagcgggtcgttcttgtccagcagttccaagccggccggcagctgcgccaccacgcccttggccgccagctgcatgcgcacgcggcccagctggtcttccggcaccaacacctggccggtttgcggatggatgcggtagggagtcttgtcggcgtcgagcgccgccatcatatcggcgctgttgaccttttcctgcgcgccgaacaccggcttgtagctggcgtcgtcgcgccacagccacagggtcagcgccaggctcaggccgatggccaggatcaccatcggcagcaggtagcgccaggcgttcgccggcagcagacggcggccggccattttttcttgtacggcggcaaagccgctccgcaattgcttgaccacgtcgcctcccggcttacagctgcatcttgatcaggtcgtcgacggcgccgaccaccttgttgcgcacctgcatcagcatcgagaaggacaggctggcctcctggctcatcagcatcgcgccgaccagatcgtcgctctggccgctgtccacctcggtcatcttgtccgaggccaggcggttctgctggtcgacatcgcgcaccgccgacaccagggcctggctgaagctttgcgcggccggcgcgtcgtccgcggccggacggggggccgccgcggcgccctggcccagcttggccatctcgcccagcaattggctgcgatcggcgtggatcatcaaacccagattggccatcactacatccttaaatcaacaggtatcaaaacgcggcgcgcccagcgcaggcatccaccagcaatgcttacatgcaagctggcggattttaaactcaacgctttattactcagttggtatttttcacattcgcaaccgtgaattttccccctttaccactggcggacagccagtaagatgcacactcccagcaattgccgggggctgcccgaccgcctccggccacgaacgaaaatcgccatgcccaaagccaaaatcgttgcgccgcaggaaggcgcccgcctgcaggccttggatctgcgaaccctggggcgcccgatacacctgctgccactgttcgcccgcgcattgcagcaagagctgggcgacttcctggagcgggaactcaaccgccgctaccacgccgccttccgcatcactgccctgcgccaagacctgcccgccgccgacgagctgcgctggcaatggcacgcgctgggcgactggcagctgggcagccatttcgaccgcagcctgctgctgggcatcctggattaccgcttcggcgccagcgccgcgccgatcgccgaagacttgccggcggaaaccgaaaccgagcgccggctggcccgcaacctggccgaacggctgctgccgcgcctggccgccgccatcctccagctggaacaggcgccgggcgcctacggcgacaagccgcgcccgcagcccttcgccggccagcctgcctggcagctggaaatcgaactctccgacggcgacgcgccgcgcggcgcgctgcgcctgcgcctgggcgagtcagccttcgaaaccctgctgcaaaacctgtccggccagcgccgcaagctggccggcgaccgcgccccgggcagcttccgcgaccggctgacgctgcggctggacgcgcgcctgctgcagcaggagctgccgctgggcgccatcctcgacttgaagcccggttcggtgctgccggtgacgctgccgccgcaagccgaagtgtgcgtgcgcggcgcggccttgttccgcgcccacgtggcggagcgccagggcaagctgtgcctgagcggcttcgccgataccgaatgacccccatcgcactggacgactacgcatggacctgaaacaagatttcgacctggacggcatcctggacagcctggagccggaagccgccgccgcgcccgctcccgcgccgcgcgacatgacgccctttctgcgcaagatacccgtcaagctgacgctggaagtcggcagcgccgacgtcagcctggccgacctgtgccagatcggcgcgggctcggtgatcgagctggacaagctcgccggcgagccgctggacatcaaggtgaacggcaccgtgatcggccgcgccgaagtggtggtgtccggcgaaaactacggcctgcgggtggtggaattgaacgacctggaactggacagcctggcctgatgaaacggtacaagctttacgccccgctgctggccggcctgctgctggccagcccctgcggctgggccgattcgctgaagctgctgaccgccacctccggcggcgcggcggtggacttcaccgtcaagacccagatcctgatcctgatgacggcgctgggcctgttgccggtgctggcgctgatgatgaccagcttcacccgcttcgtcatcgtgctgtcgctgctcaggcaggcgctgggcctgcagcagggcctgcccaaccgcctgatcaccggcgtggcgctgatcctgaccttgctggtgatgcggccggtggggctgcaagtatggaacgaggcgatggtgcccttcgaccaggacaagatcaccatgccgcaggcgctggagatcgcctccaagccggtcagccgcttcatgctggcgcaaaccagcaaaaccgcgctgtcccaggtggcccggctgtccggcgaaggcgacgtcgcccgcccggaggaccacgccttcaccgtcaagctggcagccttcgtgctgtccgaattgaaaacggcgttccagatcggctgcatgctgttcattcccttcctggtgatagacctggtggtgtccagcgtgctgatggcgatgggcatgatgatgctgtcgccgctggtgatctcgctgccgctgaagctgctcttgttcgtactggtggacggctggtcgctgaccgtcaacaccctggtcacgtcgatccaggcctattagaaggacgggaagcatgctgactccggacatcgcggtagacatcgtcaacgacagcctgcgggtggtggtgacgctggtgacgctgctggtgctgcccagcctgatcgtcggcgtggtggtcagcctgatccaggccgccacccagatcaacgagcagacgctgtccttcctgccccggttgctgatcgtgctcttgaccatcgcgctggccggccactggatcaccggctacctgatggacttctgcgtcgccatgttccagcgcgccgccagccaggtgggctaggcgatgagccagggcctgttcgcccagttgctgcagctgctgccggccatctggtggccgttctgccggctgatggccgccttcagcgtcgcgcccttcatcggcgacgccatggtgccgctgcgcgcccgcatcgccctggcgctgctgctggcggtggcctgcgcgcccggcatgccggcccactccccgatcgaccccttttcgctgcacggcgtcgccgccagcctggagcaggcggtgataggcttgttgttcggcttcgccttccagctgaccatgtccatcctgtcgctgctgggctttttgctgtcctcgcaaatgggcttgtcgatggcggtgatgaacgaccccggcagcggcaatacttccgacgtggtgtccaatctgctctacctgctggcggctctgctgttcttcgccatggacggccacctggtgctggtgcaggtggtgtacgccagcttccgcgcctggccgctgggcggcggcattccgcaggcggcgctgccggtgctggcgggcagcgtggcctgggtgatggccgccgcggtcgcgctggcgctgccggtagtgttcgccaccttcctggtgcaggccggattcggcatgatcaaccgggtggcgccggcgctgaacctgttttccttgggcttcccggtggtgacgctgttcggcctgtccacgctgaccctgctgatgcaggtgctgccgccgcaatacctgagcctgagcgagcagacgctgcggctattggacagcctgctggagctgggccatggctgagacgcgccagggcgacaagaccgaaaaagccaccccgcagcggctgcgcaaggcgcgcgagcaaggccaggtgccgcgctccaaggacctggccgccgcgctgggcctgatcctggcgctgaagctgatgttctggctggcgccggactggctggatgatttccgcgagctgttcgcgctggccttcgccccgcttgccggccaaggcgcgctggagaacagctggtccaagctgttcggcggcaccttgctgctgttgctgaaaatgctggcgccgctggccgtcatcccgatcaccatgctgctgatcagcctgtttcccggcggctgggtgttcgtgctgtcccagctcagccccaagttcgagcggatgaacccgctggcccacctgtcgcggctggcctcgcccaagcacgccagcgaaatcggcaaatccatcgccaaggcgctgcttttgggctggctgctgtaccgcatcgcctcgtccgcgctgcaggacttcttcgcgctgcacggcatgccgctgctgcccacgctggccggcgcggccgacctgctcttgtcctgcctgctcaagctgtccgcggtgttcctgctgttcgcgctggccgacctgccgctgcaggtctacctgttcatgaaacagcaaaagatgagcaagcaggaaatcaaggaagaatacaagaacaccgaaggccggcccgaagtgcgccagcgcatccgccagctgcagcagcagatcgcgcagcgcggcgtgcgcaaggtcctgcccggcgccgacgtcatcatcgtcaaccccagccactacgcggtggcgctgaaatacgacgagaaccgcgccgaagcgccgttcatcatcgccaagggcgtggacgagatggcgctgtacatccgccggcaggcggaagaactggaaatcgccgtgctgccgctgccgcccctggcccgcgcggtctaccacactacacaggtcaaccagcagatccccgcgccgctgtaccgcgcggtggcccaggtgttgacttatgtcttgcaactcaaggctttccagacgggcagccgcgccaaccggccgatattgccggaactggccgtgccccaggaattgtccgatcccaagcccgcatcatgaactcgctgaccaaactgctcgccgacatcggccgccacaagctggccgccccgctcttcctcttggccatcctggccatggtgatgctgcccctgccgcctctggcgctggacatgctgttcaccttcaacatcgtgctggccatcatcgtgatcctggtcagcgtgtcggcgcggcggccgctggatttctcggtgttccccaccatcatcctcgccaccacgctgatgcgcttgtcgctgaacgtggcgtcgacgcgggtggtgctgctgcacggccatgaggggacgcacgccgccggccgggtgatcgaggccttcggcaatgtggtgataggcggcaacttcgtggtcggcatggtggtgttcgtcatcctgatgatcatcaacttcatggtggtgaccaagggcgccgagcgcatctccgaagtgtcggcccgcttcacgctggacgcgctgccgggcaagcaaatggcgatcgacgccgacctcaacgccggcctgatcaaccaggagcaggcgcagcagcgccgccgcgacatcgccaccgaagccgatttctacggcgcgatggacggcgcctccaagttcgtccgcggcgacgccatcgccggcatcctgatcctgatcatcaacctgttcggcggcgtggccatcggcgcgctgatgcacaatctgtcgatgggcgacgccttccgccagtacgcgctgatgaccataggcgacggcctggtggcgcagattccggcgttgctgctgtcgtccgccgccgccatcatcgtcacccgcatcagcgacgacggcgacatgcagcagcaggtgggcagccagatgctggcctcgccggtggtgctgatgagcgcggccggcatgatgctggtgctggccatcatccccggcatgccgtggccgactttcctcggcttcgccgcgctgctggcctatgtggcctggcgcatgcacgcgcgccggccggtcgccgccagcgcgctcaaccagaccgcgatcaaggcggcgctgcagggcgaggcggaaatcgagctggaatggagcactctgccctattccgatgtgctgggcatcacgctgggctaccggctggtggccctgctggaccaaggccagggcgcgccgctgctcaaacgcgtcaagggcgtgcgccagagcctgtccgagcagatgggcctgttgctgccgatggtgagcctgcgcgacgacctcaggctcaagccttcgcaatacgcgatccagctgtccggcaacaccgtggccgaggccgaagtctacgccgaccggctgatggccattccttcgccggaagtttacggcgacatcgacggcattcccggcatcgacccggccttcaacatgccggtcacctggatcgcccaagccgacaagagcaaggcgctgggcctgggctaccaggtggtggattgcgccagcgtgatggccacccacctgaacaaggtgatgcgcgagcacctgtccgagctgttccgccacgacgacgtggcggcgctgggcgagcggctgaccgcgctgtcgcccaagctgggcgcggcgctggccgccgcgctgccgccggtgcagcaattgaaggtctatcgccagctgttgcaggaccacgtatcgctgaaggacatcgtgccggtggccagcgcgctcttggaagccagcgaaaccaccaaggatccgatcatgctggcggccgaggtgcgctgcgcgctgaagcgccagatcgtgcaggccatcgccggcccgcgcgacgagatccgcgccttcaatctgtcggcggaactggaaaacctgctgctggcggcgctgagccaggcgcagcaaaccggcaagccgcagctggacagcttcccgatcgaccccaacgtgctgcagcagctgcaggccaatatgccggtggtgcgcgatcagatgaaacagatgggccagccgccggtgctgctggtgatgccgcagatccgcccgctgctggcgcgctacggccggctgttcgctcccggcctcaacgtgctgtcctacaacgaagtgccggaaaaccgccaggtcagcctgaccggcactttaggctgaaccagtcgcatttcttgcgccggatcacgatatccggcgcggctccctcgctttgcgccaagcggcatccccgcgtaaaagcttgccgcacggtcttttccgcgtgccgactatacgcgcagggtagaatctttctcggataaaatgccaatgttatttttcgcatgttgtgaaaatgcaaacgcatgatttgcaaattaagaaaatgcgcaaaatctgacactttggccacccatgtcggccgcatgagtgatagcatcccatatatgaatatcatgtgacggcataagcccatggcaaacctgaaaaccgccaaccagatcatctgcgacaatatacgcatccagctggagcaattccgctggccggaagcgcaacaggccggcctgatcgagcagatcctcggcctgagcacctcgcaggcctaccgcaagctcaacggcagcagcccgtggcagctgtcccaggtggaaaggctggcgcagtacctgaacgtgccgacttccaacctgctggtcgaccacagccagcagcacagccagactccggtggacaatgagctgatcccggccatcctgcatctgaacaatcaaagcggcgaagcccattgctggatccagctcggcgaaccgctggccgacgactcctgcgcgccgctgctgctggccaagcgccttcacgactgctggcatgtattccccggcacccagttcgacgccgaggacggctacgaggtcacctacctgaccatccgcccgcccaaacgcgccaacaccaagcgcctgctggtggcggtgctggacgacaatgacgctgatctgctgtccgccatcctggtgcagcaaggcctgttctccctgccctaccaccacccgaaagatttgctggaagcgctgccgcgcgaggatttcgatgccttcgtgctggactgggtgctgggcgagccgaccagctgcatggacgtgatcgaggcgatccgccgccacaaccccaatgtccccatcgtggtgctgaccggctacgcgctggagcatgagagcgagctgtccaaagccttgcagatgcgcggcgtctactacatcggcaagccgacgcccggctccatcctggcgctgcagatcaagaacatggtcaccaacgggctggagcacgcataagcggagcgagccgcggccgcatggggaacaggcgcccgagcttatatgcgcttgcatgcccatgactttcatctgtttgaagcccgccttgctgactcgaggcgggctttttgctgccgtcttgccgggggatagaacgccctaagatggccgcccggcgcttctgccgcgcaataagctgtcgccttctcgacgtcccgcatgcccgctgctgatgcggccgccggcaggccggcgacgccttcgcgcgcgcggaaaagacgccgcccgcaaaccataagcttgcaggcggcatgaggcgtgcgcttaagcttccgccgcttccgcctgggcggcgcgcgccgtttgccgcggcatggccaggtcgcggcggacttcctccgcgctcatcacatgatggccgcgccgctcaagctcttcgcgcaaggctttcacctgttcggcgctgcgggccttgcgaatgccgccgggcgcttggggatcgatcaggttcaacccatcttcaaggccgacgcggatgccatccaggtccagagcgacggcgacgtcgaccaggatggcatgcaacgcgcccggcagcagcaaggaaatccggcagtcgcggaaatgctggcgcaattgcttgacggtgggacgcaaacattccgcggcaagcttggcggcggcgacggtgtcctgctgctgcagaaacgcctgtatctgtttgcgggaagcggtgtcgatcagcgagtcgtcatccatttcgccgctgaccggatcgcgcctatgctggtccacgccggccaccagcatgaacaagaccggcgccccgctggccagcagaggctggcggtataaggtgaccgcgttttcggtgatgatgtggttgaacacttcgatttccggacgaacgccggcatgttggaaatgctcgagctgcgcctgaagaaaaccattcggattgtcatagccgccgccggtctggaaaaccacggggcctgggctgagggaggcgatctccggcgccgcgtagccggcatagtgcttcaggtgggcgcgccgcaaggcgctttgcgaagccgcgcggtcgccgcgagcgctggtggacaaattcagcaggaccgagggggcggacaggcgcagggccggcacgatgttctcgtattggtccagcacgatttgattgcgttgctggccggcgctgatcggcgcgcccaggccggggatcgtcagcttggcctggtctgcgagatcgcgcgtatgcaggtggatgaccgcggcgccttcgcgcgcgcagtgcagcgattctgcgacgatgcgctccgcggtgatcggcaggtgcgggctgcgcgccttgcccggttgccacatgccggcctcgctcgcatgccacccgcaagcgaggaagcgggaggcggcctcggacgattgcgcctcgatttccgccgccatttccggcgggagatagctgctcagacgcggatgcgtccaaaccagatcgcctcgctcatcgcactcccagccatgcgtggtcaattgttgcaccaattggcgaaccagcgcctgtgagggcaagagatcgaacagcgcgcggggcaggcggcgggcggaggcggcatggccggagggctgcggccgccagacgccattgtccagccgccatcccgcggccagcagcgccttgatgctttgcgcctgctgagtcgcgctaagcgcgcagatatcttctcggctcgccgcttgctcatagccgtcctgcaatagccagccgccggcggctacggattcccacccttcgcgtttcaacaattgcagcgcttcaggcagcgcatcgttgggaaccagattatccagcaacaggccaggaatgaattttggctcttgcgggtccagatacttgggcacggcgccaaccggagccgccgtgatgtaaaaagctttactcatgaatcgctccctgggtttggcatgcggacatttcctggcatgctcaaccgcgtatcgttgatggtgtgtcaatcactagcttgtttcgcccaaaggcgaaacagccttgcgccatgtcttggtcttcttggtttcatcgcaagcgaaggaagggtataaattcttgcctgttcagaatggcattgtgagtcgcgatcttttaatccaataacaagaattgtcgatatcggcattgattgttttttgaaaatccatgctagtattttctgcaatagcctctgattgactgacagaaatgccgcgccaccgtgttttcaggcttaggcggaaaatcgtcgtttggcggatgggattatgagggggcgcgagcgaggaagcgacaataaaatgcaaatagcatatcaatgccaactcaagtgtgttttttatccaaatggaaatatttaatgtttgccgcagtttaatatgattgagtaattttatttatttgactgtcttggttgcttcaccaagcttggcaataaaaatagaatggtgtttatttttttggcagtttccatggattgaaaatgaatttttcgcctccaatggagaatatattttctttatctggattattaaatcaagaatgatattgaaaagtataattgcaatatcaattaaatcagcatcgattcacatcatgaaaatcgacaccccggtcagttggctttctggcggacagtgcgtccaagcaagcagcggaagggagtaaaagcaaaagaaggatataatttcgcgcggacaattaaaaaacacatggcgatgaaagcttgcccgatgccattgctcccacccattgcgtctgcttttgccgtgcagattctgcctgttctgggcgccttgataacaggacacagccattgggctgggcgggaggcgagcggagccgccgtgcaagcaagcagggacgatcaatcttcccggcgggcttcatgacagcattgcggaaggcgcttgaggctcgtggcgaggcttagccgctgacaatacaacccaccttgcgtcacaaggtgggctgccatgccactattacatctgacaagtaggcctgtagcggcaaaccgcgctgcggctcacccgcatcctaatttgtcaggacttccactccggataacatccggagcctgttttgttttccgcgcggcgctgaggccggatcacaaaggcaggtcggccagcgccgccctgagggtgtcgccgtcgaagggcttgtccagccgggcggcgaaccaggcggcgcgcacatcggcgaattcctcggggtcggcgctcatcgccagcatcagcggccgctgcggctgcttgcgcgccagctccgccagccggtagccgctatcctcgcccaattgcatgtccaacagcaggatgtcgaaacgctgccgggccaggcagtcggccgcctggctcagcgtggacgcgcaggcgatctgaaaaccgtcctgcgccagcaactgcgccaccgatgcccggatcacctcgtcgtcgtctaccagcagcaggctgcggctggcgctcgcctcctgcacttcccgcagcggcaaccgcacggtgaagacgctgccgacgccgaccgcgctttccagctcgatgctgccgccgaacagccgcaccagctccttgacgatggacaggcccaggccgctgctgcccggacggcggttgcgcccctggctgaacggctggaacacccgctgcttgtcctcctcggcgatgccgatgccgctatcgctgatctgcagccacaattcgagatgctcctggcacatctggccgcgcgccttcaccgccaccgcgccctgatcggtgtagcgtatcgcgttggacaccaggttgccgacgatctggcgcaggcggatctcgtccatcagcaccatctccggcagtccctcgctctcatagcgcagcgccagccccttggcgtcggccaagggctgcatcacgtcgaccacggtgcgcagcgcgccggccagccgcacccgtcccggattgaggcgcagctgcatgttcttgatcgccgacacgtccatgatgtcgtgcacctgggaggtcagctgggccatacccgccttcaggcgcttgagcgccagctgcgccgggccgtgcggcgacaccgccggctccaccagttccaggcacatctgcatcgattgcagcggcgagcgtatctcgtgccccagcgtgccgaggaaagtggtgcgatccagctccagcgccaccgtggcctggtgcgccagcctctcctgctccagcagcgactggcgcgccttggccagatcgctgacctcgcggtagcgcatcagcatcagcagcacgccgcagatgccgccgcacagcaccagctgcagaatcagcatctgcgagcgctggctggccagcgcgctgctgcgcgccacccgcgccgtcacttcggcctcgcgggtctgcaccgcgaaattggccagcaccggccgcaatgcgtcgatgcgcaccaccatcttgcgcgcctgcgcctgcgtcagatgcggccaggccttgtcgcccagcaacgggcccagcgcgccgaccagcgcgtcgaaaccgctgacccggctgagcagccggtgcaccagcacgctgtccggcgcctcgaacacctggtaacggctttgcaacacctgcagctgctgctgcaagtcgggaaattgcttttcatcggccgcgtagccgatcagctcggcgcgcgtccgctccagctccacgtgcagttgggcgacagtccaatattgctgctcgctcttgccgttgcctatcagcgcttcgctggcgcggtccatccggtagaaattccagccggcggccagcaacagcaacagcagcgaggcgaccagccaccacggcgcctgcacgcattttcggatccgggcgagcgtcacatcacctccatcgcttccacctgccacaccagcttggcgtccagcggcggccccttgtcggcgtcgggcatgtccggcagcggatacatcagccacagcggcccgtagtgagcgacgtcaaacggcttgttgtcgatgcgccgcgccagcaccaccttgccgcgcaccagctccgccacggaaatgtcgtaacggtaatagttgatcgccagcaccctcaccgtggcgcctttggcctccaccttggccaggatgtcccgcaccagaggaccgctgaaagtcaccgacggcgtccagctggtggccgtggtgaaactcatctgccgcaggcgggccaggtcgctgtcgcgaaactggtagacgccgcgcttggcgtcggtgaaccgccctatcttgccggacaccgtcagcaccaccgggtccgaatcggccaaaacgcaggcgctcaaacacaggcctatccatgccaaccaggcctttcgcatagccatcctcatcgtcacgcgtaaaaaatggccaattatattcatccagcggggccgacaaccagccttgtatggacaaatcgacgcgcgcgccagctgcgcagcgcgttttagccaacgtcaaaagcaaaaaagccagtgggatgcccactggcttgcatggtggcggcgcgcggccgccggctgcggttactgcagcaaggacatggccaggctgttcatgctgccgctttgcttcagcatcgaggtgctggcttgcatcagcatctgcttggcggtcatggtggagctttcgctggcgtagtcggtgtccatgatgcggcccttggctgccagcgtgttgttgttcacgttgttcaggttgttgaccacgtggtccagacggttggagttggcgcccagggcggagcgcacggcgccgacgctgtccagagcggtattcagcaggtcaatcgtggcggccgaaccgatttcgccgccggcagtggcgctcggagtcttgtactgggcggaagcggcttgcagcgcggtatccagcccggtgatctgggtggatacgtcggtggacatcacttcggaagagctggcgccgatctggaagttcaccgccgcggccagcttgccgccggtcttggccagcagcttctcgccgccgaaagtggtgttgctgacgatgttgttcagttccttgcccagcgcgtcgtactcggactgcatcgcagtcttgtcgttggcggtggcggtgccgttggcgccttcggtggacaggtccttcatccgttgcaggatgttggtcacttcgttcagcgcgccttccgcggtctgcatcatggagatgccgttttgggcgttcttcatcgctacggtcatgccgcggctttgcgcgtccagacgggtggcgatctgcaggccggcggcgtcgtccatcgcggagttgatgcgctggccggtgcccagacgcgtcatcgaagtcgacagcgcgttctgggtggagttcatgttggacttggtgttcagtgcggcgatattggtgtacaggctcagcatggaaatgctccgtctaggttggtcgaaaccggcatcgtctgccgttacccacacaaggcggcacgccgcgcgcgcaacttaagctccaacaatttgtgaataatcacagcgcttttcttaaactaaacatctctgccagtttgttcgccgccgtctataactgatgaatacagaatgaccccgtgatatttccccgccagggagggcacaggccatgaacgctcaatcgaatccctttctgtttgaaagcgcggcgctcactcaccttcccaactacggcgtcgtcaagaccacccagttggccggctatctgtcggtcggcgacgccgccggcggctggctgtatttctgcttcagcgaagccagcgccaaccctgcccaggcgccgctgctgctgtgggtcaacagccacccgcgggacagcgcgccggccagcctgttcgacgagcacggcccctatctgctggacggcaacggccgcgtctacggcaatccgttcagctggcaccaccatgtcaattacctggtcatcgatcagccgctgggccgcggcctgtcgttttcgattcacccgcgctacctgccggaaagccacgacgaggcctgccagcagctgtaccacgcgctgcaggaattcctgttgcgctggcccgcctaccgccagcaggatttctacctgttcggcagcggcgcggccggccacaccatcgcgcgcctggccaactgcatcctggacggcaacggctgcggccagccggaaatccggctgaaggggctgggcctgggcaatgggcaggtgtcgccgaaaatccagctgcccagccacatcgaatacgcccgtcagcaccggctgatcaatgccgaggaagaaaaacgcgcgctggaaatgctggcggacttccacgacgcccacgcctcgccgataccgctgcggcgcagccaggccagccgcagcgcgcgggaaatcgaggactacatccagcaatgctcggggcgcgacaagcacgatatccgccatccgccgggcgatggccgccagcgcgtggacgagtacctggccaagccttccgcccatcaggcgctgcacatcgatccgcgttcgcgcaacgagctgcagccggcgccgcagcaactgagcgaggcggcatggctggacgactcctcccacttgttcccccgcttgctggatcagctcaaggtgctgctctatcacggcgaatgctgcatggaaggcaattacctgggcatggacgcctggctgaacacgctgctgtggcagcaggcgccggacttccgcgaacagaaacgccagccctggcggccatacgggctgccggccggcctgatccgccgccaccggcgcttgtcgcaggtcatcatccagaacgccgggttgcgggtggcgcgcgaccagcccgccatcgcgctggcgatgctgaagaactttcttggcgaggaaacggacgacgccgagccctgagccgcgttaaccggccaagcgccgcaggttcaggctggccggaatgcggatatcggccgccggcaaaggctcgccatgcagcaatgccagcgtttggcgcaggctggcgtcggccagcgcctgactgtcctggcggatggcgtccaccgccagcggcaggcagtccagcaagggatgatcgtcgaaagtgagcaggtagcgcggcgcctcgcgcatgcggtggcgttcgcggatgaaggacaacacgccttccagcagggtgatggaggcggtgaacaaggcctgcggataacggccgtggcgctgatgccagtcagccatcagccgatagccggattcgcgctggaagtcgcgctccgccacccagcctggctgcggcgccatgccttgcgcccgcaacgcctggtgatagcccgccaggcgttcgcggctggccgacaggtcgggctggccgccgaaataggccagctcggccacatcacgctccagcagcggcgccagcaatctggccacgctgtcggcggcgtcggtgaccgtggatgggatgccgctgccgggaatatggcggtcggcgaaaaccagcggcaagcgccgggtccacggctggtagcggccggcgtcgccgctgcacggcaccacgatcatgccgtccacctggcgcgccgccagttggccgatgccggcgctttcccgttccgggtcctcgtcgctggtcaccatcaacagctggtagcccagcgcgcggcagccgttttccagcgcctgcgccagcgccgcgtgggtggagttggtcagatcgggaatcaccaggcctatgctgctgctgcgccggctgcgcaggctgcgcgcctgttgcgagggattgaagtggtgctcgcgcgccaccgcttccacccggtccaccgtggcttgggagatgcggtagcggccggcatggccgttgagcaccatgctggcggtagtgcgcgatacgccggccagcgcggcgatatcgtctatggtgaggcgtttgaagctgctcatggaaacctgccgcgaaacgcgaggggggacatgataaacgcgatagggaaaaacggggccggcttgccgccggcccgcgcccgtccgaagcttattgcttgaccagattgagcggcaccgggatgaacttgtccaccttctggccgtccagcagccgcttggcggtctgcacgccgtactggccgatcagcgccggctgctgctgcaccgtggccgacagcgtgccggccttgaccgaagccaccgcgtccggggtggcgtcgaagccgaccaccaccacgttcttcaggccggccgcctggatcgccttcagcgcgcccagcgccatttcgtcattgtgcgcaaacacgccctggatgtccttgttgccctggatgatgttctccatcaccgacaagcccttggcgcggtcgaaatcggccggctgcttggccagcagctccacgcccgccttcttgtccaccacgtggtggaagccttcgccgcgctcgcgggcggcggaagagccggcgatgccttccagttcgacgatgcggcccttgccgcccagcttgcccagcaggtactggccggccatcatgccgccggcgatgttgtcggaggcgatgtgggagctgacttccgcgccgttgacgctgcggtccagcgacaccaccttgatgcccttggcggtcgcctccttcaccacattggccaccgcggcggaatcggtggggttgatcaggatcacgcccacttttttctggatcaggtcttccacgctggcctgctgcttggccggatcgtcctgggcgtccacggtgatcaggttgatgccttccttgccggcttcggcggccgcgccgtcgcgcagcgccacgaagaagggattgttgagcgtggacaccgccaggccgacggtggccttgccggcggccgccggcgcgctggcttcgccgccgcttgcgccgggcccctgcttggagcaggcggcgatgccgaacgccagcatgccggccatcaacggggtgagaatgcgtttcatgccaaaactccttgagaatatagacagattgcactgcggatggcggctgccgccgccggattcatttcttgccgctgcggtccagcagcaccgccagcaggatcaccgcgcccttgatcacctgctggtagaacgacgacacccccagcagattcaggccgttgttgagcacgccgatcagtagcgcgccgatcagggtgccgaagatccagccgcggccgccggtcaggctggtgccgcccagcaccaccgcggcgatggcgtccaactcgtagccggcgccggcggtgggctgcgccgaattgaggcgcgaggtcagcaccacgccggccatcgccgacatcgcgccggaagcggtgtacacccacaacttgatcctgtcgaccttgacgccggacagccgcgccgcctcctcgttgccgccggtggcgtacaggtggcggccgaacacggttttcttcagcaggaaccagaagccggcgaacaggatcagcatccacgccaccggcaccggcaccaggccggcgatgtagccgccgcccagcatcgagaacagttcgctgtcgaagccggtgatcgggctgccgttggaaaacaccagcgccaggccgcgcagaatggtcatcgtcgccaacgtggcgatgaacggcgccaccttgcccttgctgatcaccaggccgttgaacaggcccatcgccgcgccggccaggatgcccagcaaggtcgccagcatagggtcgacgccggcttgcagcaagctggccgtcaacaccgacgacagcgccaggatggagcccaccgacagatcgatgccgcccagcaggatcaccagcgtcatgccgaaggcgatcagcgcgttgatcgacacctggcgcatcacgttcagcaggttgttgacggtgagaaagtccgggctcatcacggacaggccgatggccaccagcaccagcgcgatgaaggggcccaggcgttgcagattggctttttgttgcggggtcatgcttgtttcctgatttcggtgggaacggcgccgccggtcgcggccgccatcaagatttcctgcgtgcagccggcggcgtcgaagatgccggcctgccggccttcgtgcagcaccaggatgcggttgctcagcgccagcacttccggcaattcggacgacaccatcacgatggcggcgccggcggcggccagctggttgacgatgtggtagatctcggccttgccgccgacatcgacgccgcgcgtcggctcgtccagcagcagcaccttgggcggattggccagccatttggcgaacaccaccttctgctggttgccgccggacaaggacttgacgtccagctcggcgtcgcgggcgcggatgcgcagctgcgcgatcaagccgtccaccgcccgcttctcgtcggcagcctgcaccacgcccaggcgcgcgtactggtccaaatgcaccagcgtggcgttttcgcgcagcgacatgcccagcaccaggcccttgctcttgcggtcttccggcacgaagccgaggccggcggcgatggcgtcgcccggcgcggccactttcaattcctcgccatccagctcgacgcggccggcggtgcggcgcttggcgccgaacagcgtcttcaggatgtcgctgcggcccgagcccatcagcccggcgatgcccagcacctcgccggcgcgcacctcgaaacggataccggcgatcatgttctcgtcggccaggttttccaccttcagccgcaccgcgcccggaacggcttcacgcttgggatagcggtcgccgatctcgcggcccaccatcatccgcaccacctcgtcgaaatcggtgccggcgatctcgcgctcgccgacgaagcagccgtcgcgcaacacgctgatgcggtcgcaaatgcggaagatctcctccatccggtgcgagacgtagactatggccacgccgttcgccttcagttgcgccatcagcgcgaacagcgcgtcgatctcgcgctcggtcagcgccgccgtcggctcgtccatgatcagcacgcgggcgttcagcgccagcgccttggcgatttccaccatctgctgctggccgatggacaggctgccggcctcttgctcggggtcgatgccctcggcgcccagcgccgacagctgcgccctcgcctcgcgccgcatgcggccgtagtcgatcaggccgaagcgcgacggctcgcggccgagaaacaggttttccatcaccgacagttgcgggatcaggttcaattcctggtgaatgatggcgatgccggccgcttccgccgccgcggtgtcgcgcagctcggcctggcggccgtccagcagaatctcgccggcatcggcgcggtgcacgccgctgagtatcttcatcagcgtcgacttgccggcgccgttttcgcccatcaacgcgtggatctcgccgccgcgcagcgtgaattccacattttccagcaccgtcaccggcccgaaggccttgcggatgccgcgcatggtcacttgcatggtcctgctcctcagaaaatcacgccggagtgcaggatcacgttggcgtacggcgcgcattcgccagtgcggatcaccgcccgcgccgcctggcagcgctgcttgaattcctcgtggctgacgaaatccagcgccacgccggactgcgccatttcctcggccttgtcttgcaccgcctggttatgctgacggcattctatggcaaataccgcccgctcgcactggaagtcggccagaacgctgtccagcaccgcggcaaaacccggctctcccagccgcaacgccagatcgacgcactccacgccgggcggaatcggcaggccgcagtcggcgatcaccaggctgtcggtatggcccatgccggccaggatgcgggcgatgtcgcggttcaaatggccatgcttcttcatgcccgcgcctccagaaaagcgtccagctcggccagcgtcggcatgcctccctgcgcgcccggacgagtgaccgacaaggcgcccgcggcggcggcgcggcgcaccgcctcttccagccccagcggcaaaaacgccgccagcgcgccgttgaaggtatcgccggcgccggtgctgtccaccgccttgacctcaaaacccggctgatggcgcaactggccgcgggccagcgcgaaataggcgccatgctcgccatgggtcatcaccagcttgccggggcgctcggccagcagcgcgcgccaatcggcgtcaggctgggccagcatggtcaggaattcgtgctcgttcggggtcagcaaagccacccgctgcagcagctcttccggcagcggcaccgccggcgcagggttcaacagcagcggcttcttgtggcgggcggccagttcggcggcgcggcgcaccgtcgccagcggaatctccagctgggtcaacaccacatcggcgtcgatgaaggcctgttcggcggcgtccagatccgcgggcgtcaactggtgattgacgccgggcgccaccaggatggcgttgtcgccgccgctgacagtgatggcggcgatgccggtggagccagccacgcttcgcacgcggcggcaatccacgccctcgcttgccaggtgggcaagcagctcgcggccgaaagcgtcgtcgccgacgcagcccagcagcgccacgctggcgcccagccgcgcggcggccaccgcctggttggcgcccttgccgcccgggtaggtggcgaagccgtcgcccagcagggtttcacccagctgcggcatgcgcttggctgtcaccaccagatccatattgatactgccgaccaccagcacccgagtcatgcgccctccttgtaccttcgctacattgcagtgcgaaagcggaaaatatttagctaaaacgtaatcagcatccagttataacagagttttcgcccgaattgaaaggggctcccagcaaaatgtagtggatcaactacatatctccacttgaaaatatctgcacaaaacaatccatctccgcctatccggctccaggatcgcgtcatggcgctgggttggccgccgccgatatgggatgatgtccgcacatcgcaccccggcgcgaaaaattccaaaagcatacacggagacggcttgaaaatggactggcaacaactgttcgatctttactggagcgcggcgaagtggcaggtcaatctgctggtggtgggcaatctgctgggcgggctttgcctgggcagcctgctgggctatgagcgctggtacaacggccgcgccgccggcatgcgcacctacggcctggtctgcatggcgtccgccgcggccatcaccatcatcggctacgccggctactggtacggcggcgccgcgccggccgccgcgccgccggacatgacccgggtggcgcaaggcgtgctgaccggtatcggttttctcggcgccggcatgatcatgaaggaaggcctgagcatcagcggcctgacctccgccgcctcggtgtggatgtcgtcggtgataggcatcctgatcggcgtcggcttctacgccgcggccatcgcgctgacgctgatgtgcatgatcttcgtcaccgtggtcaaccgcatagaaaacgtgctgccgcgccgggtcagcctgttcgtcaccgtgcggctgcgcccggagcacaactggacggtggaggcgctgtccgaccggctgacgcctttcggcctgcaactgcacgacgaaagcatcagcatcaaggccggccccgactgtaccgagtggaatttcatgatttcggcgcagaaccgccgcaccttcatcaacgtggtggacctggcgcgcgacatcatggccgccgaccacatcctggagttggatgtgcagccggcgcgcaactaagcgcttacagcgccacgcccggcggcggctggtcgtggctttgcgccatcgactggtgcggcagctccagatagctcttcgactgcatctcggtcaggcggctggcggtgcggaagaattccccggcctgcacgccgtcggtgtagatctcctccggcgcggcggcggccgaggcgatcaacttgacgcgattgtcgtagaacacgtccaccagccaggtgaagcggcgcgccaccgaggcctgcttggccgtgagcctgggaatgccggacaagaacaccgtgtggtattcgctggcgatttccaggtagtcggtctgcgcgcgcgggccatcgcacagcgcggcgaagtcgaaccagatcacgccgggcgacatccgcttcaccgcgatctcgcggcccagcacctggatggatttttgcggcagctcggcgccggtggcgacgcgcttgaacagctgcgccatccggcgctcgctgtcggcgtcggccggcaccatgaacagcggctcgcgcgtcagctcgcgcagccggtaatcgttgccgccatccacgttgagcacgtccagctcgcgcttgatcaactctatcgtcggcaggaagttctgccgttgcaagccgttcgggtacaggccgtccggctcgtaattggaggtggtcaccaccaccacgccgcgctccagcaacgccgacagcagcctccccagcatcatcgcgtcggcgatgtcggacacgtggaattcatcgaagcacagcagccgggtggccctggcgatctggtcggcgtaagccagcaacgggtccgggctgccggccagcttgcgcagctcgcgatgggtttcggccatgaagttgtggaaatggatgcggcgcttgcggcgatacggcacgcaggcgtagaaggcgtccatcaggaagctcttgccgcgccccaccccgccccagaaatacaggccgcgcggcacttgcgggctgcgcaggctgcggccgaggaaacggttgcgtttggatttgaaatccaccagctggtgccacaggctgtccagccgctctatcgccgccgcctgggcctcgtcgtggatgaagcccggcttttcgctggccatccgataccagtccttggggctgcagtggacgttctcgtccggagagaatgtgtgttgcgacatggttatgcttgttctgcgctgcgtttggcgccgccgccgggcggcaagggaatgtctgcatgataaccgctttgaccgccccttgccgcattcagcggcaagtcgccagccggatgccggacggcgcggccagccgcgccaggctgccgtcgcggcacatgtcgtccagcacgcggttgaaggtttccagcatgccgggcttcaaccggctgcgggtgaagccgtaaagataggccagcggcttcacctcggccagcttgcgcacattccccaagccgtcgcgcttgatccagtagcgggctacgtcgtcattggagaacgccaccgcgtccgcgccgtagcggcccgccgccaacttgcgcagcaccgtttccgggtccagctccaccgccaggctgacgccggacacgccctggaccagccgctcgctactggcctgcgacaatgacgggccatacaccgccatggtcttgccggccagatcgccgggctggcggtagcgcagcgcgctgccggactgcacgtagaggccgtagctgctggccagcaccggcttggacaactccatcaccgcccgccgctccggcgcgtcctgcgccagcaccaggccgtcggcgccgccctggccgacggtgagcaaagcgcgcttccacaccatcgcctgcaccttgcagttccagtccgcccgccggcaggcctcgcgcagaatggcgatcaaagcgccatccagcttgccatcggcgctatcggtaatgaaggggggaaacagctgggtgacgaaatacagatcgcgcggcgccgcctgagcctgcgcgccggcgcaggccagcagcaggccggcccacagcctggcgcccgttttcgcaacgctcatcgcatccgcccccgcccactttttgccagtatagagcgcgaggccgcggcgcagcgagcccgcccggcgcgcgataaaccggctcagccaaacaaaccggtggacaggtaacggtcgccgcgatcgcataccaccgacacgatcaccgcgccggtcaactgcgcgtccagccgcagcgccaccgccagcgcgccgccggacgacggcccggccagaatgccctcgcgccgcgccagcaggcgggcggtgtcttccgcgtcctgctggttgacatgctgaatctcgtctatgcgctcgaaatcgcagatcttgggcacatacgggtcttcccatttgcggatgccggcgatctggctgcccggctccgggtggacgccgatgatgcggatggcaggatttctttccttcaggaaacggccggtgcccatgatggtgccggtggtgcccatgctggaaacgaagtgggtgatcttgccgccggtctgctcccagatttccgggccggtggtttcataatgcgccagcggattgtccgggttggagaactggtcgaggatgcggccctcgcctgccgcctccatgctgcgcgccaagtctatcgccgccggcatcgaacccgcggccggcgtcaggatcacttccgcgccgtaggcgcgcatcgcctgcacccgctcggcgctggagttctccggcatgatcagcaccatgcggtagcccatcatcgccgccgccatcgccagcgcgatgccggtgttgccgctggtgggctcgatcaaagtgtcgccgggccggatgtcgccgcgccgctcggcgcggcggatcatcgacagcgccggccggtctttcaccgacccggccggattgttgccttccagcttcagcagaatcacattgccgttgtcgcccggcaggcgcttgagacggaccagcggcgtgccgccgacgaaatcttccagatgcttgtacacaaagaatctccctgaactggccccattatatcgattggctatcagcagatgcgaaatcgttatttctaatctaataaccggcggtaagggcgggggcaggcgcgggatggctgaatacattttcctctctcgccctctcccttccgggaaagggctaggcgagatgtaagcgccgtagcgcgggctggccgctaggccatgcccgcgaagggcgcgacaatgcgccactcggcggatcgccccgccagcggggcatccgccctaccccatatgcgccatcagccaggtcatggcgccgacgaagctgcagaagatcaggctgtgcttcagcgtgaagcggaacagatccgcttccctgcctatcagccccaccgccgcgcaggcgaccgcgatcgactgcggcgagatcatcttaccggtgacgccgccggtggtattagccgccaccaggagcacatccgacacgcccagctggtgcgcggtggccgcctgcagggccgagaacagcgcgttagacgaggtgtcggagccggtcaggaacacgcccagccaacccaaaaacggcgagaagaacggaaaagcctggccggtgccggccagacacagcgccagcgtgctggacatgcccgaatagttggcgacgaaggcgaaggccagcaccatgcctatcgacaatatcggccggcgcagctcggccagggtctcggcgaaggcgcgcgcgccttcggccggacggaatttcaacaaggccatggacagcagcgcggccaggaagatggcgctgccgacagcggagacgatgtcgaacttatacagcgcctcgtaaggcgtgtcatgcgcgacgatgggcgccgtcttcaacactagcttgtccagccccggcacatgcagcttccagatccagccttccagcgcgccgcccttggcgaacatggccttgaacggtttgacgctccacaccgtcaccaacgcggtcaggatcagaaacgggctccaggcgcggatgacctggcccaggctgaagccgctggcctggcgcgcggacggcgcgcggcggccgtcgaacgtgaagatttcacttggctgccataccttcaggaacagcgtcaggcacaccaggctgaccagggccgaagtgatgtccggcagctccggcccgatatagttggacgtgaaaaactgggtgacggcgaacgagacgccggccaccaggatggcgggccaggtctggcgcacgcccttgaggccatccatcatcatcaccagccagaacggcacgatcaccgacaggatgggcagctgatggccggccttggcgccgatcaggaacggatccagcccggtcacctgcccggcgacgatgatcggtatccccatcgcgccgaacgccaccggcgcggtgttggcgatcaagcacagcccggccgcgtacagcggattgaagcccaaccccaccagcagcgcggcggtgatggccaccggcgcgccgaaaccggccgcgccttccagaaaggcgccgaaggagaagcccaccagcagcatctgcagccgctggtcctcggtcaccgacaacaccgaagcgcggatgatgtcgaactgcccggtcttgacggtgatcttgtacaggaacaccgcggcgatgatgatccaggcgatgggccacaagccatagccgaagccgaaggccgccgccgccagcgccatcttggcgggcatgccgtaaaacaatatggccaccgccagcgcgatcagcaccgtcaaggtgccggcgacgtgccccttcagccgcagcaccgccagcgcgacgaagaaaaagacgatgggcagcgcggccatcaatgccgacagcgcggggccgccggccgggaaatactgctgggtccagatttcatgcatgttcagcttctcctcattcgggtttcgccggcgcagccgctcccctgccggtcaacggaaccgttgcggcatggcggggctggctggcgtttcttaggttgacttcagcgttgaaaaggcggccttcatgacgggccgttgatgggggtggtgcagaaatccagcaacgcctcgatgctggcatagggaatcccgccatgctcggtcagaccgatctggcaggtgcggctcatcgacacgccgtggcggcaggcttccggcaaagccggcttcagtctcctcaggctgtgggcgttcagttccggcgcggtgaagcccttgtcgccggcgaagccgcagcaggcgatatccggcacggtcagctcatcgcagcagctggcggccagttgtttcaagcttccagccgcgcccatcgccgtcgcgctgcagggaatatgcagcgccagttgcggcaggcgccggacgatgctcagccgcggcagaactttttccgccagaaaaccggcggcgtcgaacagctgcaagcgcgggtccagcaagccctcggcctgcgcctgtttgacccgcgccgcgcacggactgttgtcgagataaaccggatggcggccctgcccgctcgcctgcagcaaggcgtcattcaacgatgcctgactgatggccaatgcgtccgcggcattggccgaggcgaacggctggccgcagcacagtccgtcatggccgggcggatagaccggcgcgaaaccggcgcggcgcagcagattgatcgtatgcgccgcgacggactcgccgccctcgccttccgccagcgttcggttgacgcagctgacgaacaacgccaccggctcgccctcgcctcccggcttcggcagcagcgcggcggcgcgcggcaaggccgctgggatcagcggaatgatcttgcgctcgcctggccggcggcgcgtcaatgcgttcaagcgctgcgttcccgcgacatgcgccagcttcaaaccggtcctcgccgccgccgtcatcagctgcatgtggcgggcggcgaagccggccaaggcgggacgccggctcgggccctgcaattttttcatcagcaggccggtgttgattcccacaggacaacgcgtggcgcacatgccggtggcggcgcaagtatcgacggcgcggtagcggtagccggcttgcaaggccgccagttcttccgccccctcgccgtcgcgttccaactgacggatgcgccgccaggcgacgatgcgctggcgcgggctcagcgtcagcccgtgcgacggacaggccggctcgcaaaagccgcattcggtgcagcggtcgaccagatcgtccgcggccggcatcggcttcaggttctccagatgcagcctgtcgttgtcggtgatgatcacgccgggattgagcaggccttccggatcgaacagcgccttgatgcggcgcatgatgttccagacggcgtcgccccactcctgccgcacgaagggcgccacattgcggccggtgccgtgctcggccttcaaggagccgtcgtattcgccggccaccaagtcgctgacgtcctgcatgaaagcatcgtagcgcgccacctcggccgggctttcgaagccgggcgcgaacacgaaatgcagattgccgtccagcgcgtggccgaacagcagcgcctcgtcgtagccgtgcttgtcgaacagggcggtcagcctggccacgccatcggccagttgatggatgggaaaggccacgtcctctatcaccaccgtggtccccaacggccgggctgcgcccaccgcggggaacaaccccttgcgcaaagcccagtaggtctcgcactcgcgcgcgtcgcggctgaagccgctggagactttgggctggaaaccggccagcagcatctctatctggaccgaacattcgtccaacctggcttcgctctccgcccgcagctcgatcagtagacaagcgctgtccagccccaccggctgatacaggaaatccggcagtcccggcttgccctgcaccgcgcggatgctgcggctgtctatcagctccaccgccgacacgccgctagcgtcgcgcgccgcgctcagcgccgacaccgcgcggcagcagcgatccagatcgtcgaacagcaccagcgccgacgccttgtgcggatgctcggccacggtatgaaaagtgatctcggaaataaaacccaaggtgccttcggagccgatcatcaagtgcgccagcatctccaccggatcggcgaagtccagcagcgcgttgatgccgtagccagtggtgttcttcagccgatacttgcggcgcacccgctcggccagctgcggatcgccggccagctggcgcgacagctgcgccaagccatcgagcagatcggcgtgcgattcgcggaaggccgccacgctggccggatcggcggtatccagcgcggcgccgtcgagcagcagcagccggatcgcctgcagggtgtggtagctgttgtcgcgggtgccgcagcacatgccactggagttgttggcggcgatgccgcctatcttggcggtgttgatcgacgccggatcggggccgatcttgcggccgaacggcgccagcagcgcgttggcgtgcgcgcctattatgccgggccccagccggatgcgcgcgccgccgtccagcacctggccgcggttgaagccatcgcccagcaccgccagcaccgaatcgctgaccgcctggccggacaggctggtgccggcggcgcggaaggtgacggcgacgcggtgcaatctggccagccgcagcagcgccgccacctcgccctcgtcttccacccgggcgacgatttgcggccgcaggcggtagaagctggcgtcggtgccgtaggccagcgtggacaatgggtcggtgaaaatgcgcgccggcggcatcgtttggcgcaaatcctgcagaaaatcggcgtgggcgggcgtcatgcggatttccccttgttcgcctcgcgttcgcgcagcagctcatgcagcgttttgggagcaggcgtcaacggcaggtggttttgcgtccagcccagctggttcttgggcgcgtgcttgcgcagccgcgtcgccgcccagccgaacatccggtacagattgggcgaggcgttgaccagccgccatccggcccaggccatccgttccgcgccgctggccgccgcgccctggccgcgcagcggatgcgccacccgctcgccggccggccgctggctttcctcgcgcagtcgcatcagcatttccggaatggggatgcgcaccgggcacacctcgccgcaggcgccgcacaggctggacgcagtagggaggtcgcgggtgttttccagccccatcaggtgcggcgagatgatctcgcctatcggccccggataggtggtgccgtaggcgtggccgccgatgcgggtgtagaccggacaatggttcatgcaggcgccgcagcgtatgcattgcagcgtcttgcgcagctgctcgtcggcataggcctggctgcgaccgttgtccagcagcaccaggtgcacctcgcgtgggccgtccttctcgcccggcttccttgggccgctgatcatattgaaatacgtggtgatgggctggccgatggcggaacgggtcaacaggctgtacagcggcaccacgtcttccagcttttccaccaccttttctatgccggtaatggcgacgtgcacgtccggcacggtggtgcacattcggccgttgccctcgttttccactaggcacagcgtgccggtttcggccacggcgaagttgacgccggacaggccgacgtcggcgtccagaaacttgcggcgcagcacgcggcggccgatctggatcagcgcgtccacatcctcggtatacggcgtgtccggcaactgttcatggaacagtttggcgatgtcctgcttggtcttgtggatggccggcatgatgatgtgggtgggtttctcgcccgccagctggacgatgtactcgcccatatcgctctccaccgcctctacgccttggtccgccaggtaatgattgagctccacctcctcgctgaccatggacttgcccttgaccatcagcttgccctgacgggcggcgacgatgccgtggatgatgcggttcgcctcctcggccgtttccgcccagtgcaccttcacgccatttgccgcgagcttgtcctccagctgctccagcaaatccggcagccgggacaggcagcgctggcgtatgccctcgcccagggtgcgcagtgcggacagctccgcctcgtccggaaactccgccaaccgcttggccatcaaaaagtccatcgatccgcgcaggctttgccgcagcttgccatccgtcagcgccagtctggcgttgtccttgaaggcgcgcgacgggtaaacggtgatcttgctctcgctcatcgcccgtctccttccacgtcatggatggcgatatgcggcggcagcagcgccaacaccagcaggtcgcgcgggccatgggcgccgtaggccaaggtttgctggatgtcggcggttttcgacggcccggaaatcagcaaagcgttggtgggcatgccggcggaccagttttcgccctgcagcgccgaataaaagtccgggtacagcgtggcggcgtcgaacaaggcgatgtgcaagggcggcaccaagctcatggtgcgcggctcggcctcgtccggccacagcgccagggtgccggtggcggctatgccgcagcgcgcgacagtgaagccggcagcgatgtcgaacagctccgccttccagccatcgacttcgcggtcgaaccagacgatgtgcggcgcttcgtccacgccctccagcctgcgcgccagccggcggccatgcggcgtgtccgacagcagcagcgagtcttgcggatgcacggccagccagtcggccagggcggcgtcccactccgcctcgcgcgtccacagaatgtcggttttcaccgaacgcatcatcgccgcccaatggcgcaggcgggcgatttcatcgtccttggccgcgaaatgctggaaatggccggccaaatccggccgcgcgcgctcctgccgcggcgcggcgcgcagcttttgcaagatggaggcgcgggcgctcatcgcttgcccccggtgcgctccagcagaaagctggccagatggcggccctggaagccgctgccgcactgtcccagcttgccgttgatattgagcaggcagccgccgtcggcggtgacgaactccaccgcgccgctgtcctgcaaggactgggccttgtccgccaccatcgcgccggcgatgtccggatgcttgatggagaaagtgccgccaaaaccgcaacattcggcttcatggtcttgcaccacgcgctcgacgttttgcagcctatcgaccagcgcccagctgctcttgtgcacgttcatctcgcgccgcgccgaacaggaggtatgcaccgccaccttggtgggcgggcccaagtcttgcggctgccagtccagatggttgagcaggaaatcggaaaactccaccacccgcccggcgatggcgcaggcctccatctcgtccgcctcgccggcgaacaacttgggccaatggtgctggatcatgccgccgcaggagccggacggcaccaccaccggccagtcctcgggaaaacagcccagctgcgcgcgcgccaccgccagcgcctccttggaatggccgctggtataggccggctggccgcagcagctctgggcctgggggaaatgcacccgcacgcccaggccttccagcagggcgatggcgtctaggccagcttccggcaggaataggtcgagcagacaggtgccgaacaggtaaacgtcggcaggcgtcttcatggcttcctttgtaaattggtaagaccaattatttttataaattcactttagagtgaatgcttgagttcgtcaatatgacaagcgcgcccgaaacgtacagaagcgcctctgtcatcactcgctcacgccgccgtccatgaggcaagcggaatcgcgccgacttggccatgtggtttttttggaaaaagaggaaggcacgcaaataagaaagatggcgcaaaacacggtctgacagacctcgcgaaaccaagcgccgcggacacccggctgacgctgcgccggcaggccgcgcggcctgcatcgcatcaacaggccttgcctaagacgcttagctggagaaagtcggcggcgccaaggcggctggcgatcatgcgcgattcgcaggtcgaaacgcctttttcaggcgcgcagcggagtcgctcgcgcatcatgtcctggcattgaatcaatatttccacaataatggaaatatggaaactttaaccgccgccgaacgcctggccgccctgggacatgagtcccggctatcgatctaccgtctgctagtcgaagccggccaacagggcatgatcgccagcgccattgccgacaagctgagcctgcccgccgccacgctgtcgttccatctgtcgcatctgagccgcgtccagctggtccggagcgagcgcgaaagccgcttcatccgctatttcgccgaattcgacaccatggacgccctgctcggcttcctcacccgcaattgctgccagggccagccctgcctgccaagcgcgtccgcctgttcgccgcgaaacgcggcgagcgcgaaaggagaagaccaatcatgagccggctgaaaaccgtattggtgctgtgcaccggcaattcctgccgttcgcagatgggcgaagccatcctcaaccatgagctggcgggcctggcgcgcgcgctgtccgccggcaccgcgccgcagcccaaggtcgccgacggcgccatcgaggctttgcgcctggccggcctgcccaccggcgatctttatcccaagccagtggaagcggtgatgcacgaggagatcgacctggtggtcagcgtctgcgacaacgccagggaaagctgcccggtgtttccccggccggtcaaacgcatccatgtcggtttccacgatccgcacggcgagcccttggacagtttcatccgcgtgcgcgacgacatccgcgaacggctggtgccggccgtccgcgaagccttgggcatctgaggagacatcatggctacccgtcaacacgcggctgcaacgccagccgcccaaagcgccgccatgggccggttcgaacgctatctgacagtgtgggtgctgctctgcatcgcggccggcatcgccgcgggccaattggcgcccggcctgttccatgccataagccggctggagatcgcccgcgtcaacctgccggtgggcgcgctgatctgggtgatgatcatcccgatgctgatgaaggtggacttcggcgcgctgcatcagcttaagcagcacgcgcgcggcatcgccgtcaccctgctgatcaactggctggtcaagccgttctcgatggcgctgctgggctggctgttcatccgccagctattcgctccctggctgcccgccgaacagctggacagctatgtcgccggcctgatcttgctggccgccgcgccctgcaccgccatggtgttcgtctggagccggctgagcggcggcgacccgctgttcacgctgtcgcaggtggcgctgaacgacgccatcatgctgttcgccttcgcgcctattgtcggcctgctgctgggcatctcggccatcgccgtgccgtgggacacgctgctggcctcggtcgtcctttacatcctgatccccgtcatcctggcgcagctgtggcgcaaggcgctgctggccaggggccaggctgccttcgacgcagccatggccagcataggcccatggtcgatggcggcgctgctggcgacgctggtgctgttgttcgccttccagggcgaagccatcctgcgccagccgctggtgatcgcgctattggcagtacccatcctgatccaggtgtttttcaactcggcgctggcttactggctgaacaagaaagccggcgagcagcactgcgtagcctgcccgtcggcgctgataggcgcatccaatttcttcgagctggcggtcgccgccgccatcagcctgtttggcttccactccggcgcggcgctcgccaccgtggtcggcgtgctggtggaagtccccgccatgctgctggtggtgaaggcggtgaaggcgagcaagggctggtatgagggcgcgtccggccagcgccgcgatgagcgatgacagggcgccagggcctctgctatccttggacatctggtcagaccaatcttagcaaaccatggcctatccgaaagtctccctgcccaagctgtccgacgtcatcgtccagcagctggaaaaacgcatactcgacggcgtgctcaaacccggcgaccgcctgccgccggagcggcagctggccgaggaattcggcgtgtcgcggccgtcgctgcgcgaggcgatccagcaactggcgtcgcgcgggctgctgtccagccgccagggcggcggcacctgggtgaccgacagactggaaaccgccttctccgacccctgggagaaactgctgggccagcacgaggaactgcgcggcgacctgctggagtttcgccgcgtgctggaaggcacggtggcgcgctgcgccgccagccgcgccacccaggccgacctggagcggctgcagcgctgcgtggaccggctgcagcaagcctatcgcggcggcgatctggccgagcaggcccaagccgacgtggaattccaccaggcggtggcggaggcctcgcacaacgcgctgttcgcccacctgtccggcagcctgctggcgatgctgcatcgccacgtgaaggacaatatcgccaacctgttcgcggtcggcgaagtggcggaggcgctgcgcggccagcacctggccatctggcaggcgatacgcgacggccggccggacgaggcccaactggctgccgaacgccacctggacttcgtctccgacaccctgcagaaccagcgccagcaggccgagcgcgacgcgcgcgcgcggatgcggctggcgcaggacgacgccgggcgctaagccggcaatccgctgcggcatgaaaaaagccgcgcgtcttgcgacggcgcggctttggtttcgcccacccgatgggtggcccggcgatcagccctggcggctgatcagccaatccacgtaacggtccacgccttcgccgaccgatagcatcggcgcggtgtagcccgcctcgcgcagcttgccgatgtcggcctgggtgaagctctggtacttgcctttcagcgcgtccgggaacggaatgtactcgacgatgccttgggagatcatctcggccaaggtcagcgccggcttgccttcatggcggcggcaggcgttgacggcggcttcggccacgtcgttgaacggctgagagcggccgctgcccagattgtagatgccgctcttgcccggattgtccaggaagtacaggttgaccttgaccacatcctccaccgacacgaaatcgcggctttgcatgccgtcgccccagccgtcccagccgccgaacagcttgaccttgccgtgctcgcggtactggttgaaatggtggaaggcgacagaagccatccggcccttgtgctgctcctgcgggccatagacgttgaagtagcggaaacccaccgcctgcgaagccaggccttccttcatgcgctggcgcagcacctggtcgaacaggaatttggaatagccgtagacattgagcgggccctcgtactggcgctcttccttgaacacggtgcccttgccgtaagtggcggcgctggaggcgaacaggaactggatttcctcgtgctgacagtagtcgaacagcgccagcgtgtactgatagttgttgtccatcatgtacttgccgtcgtgattcatcgtgtccgagcaggcgccctggtgcaggatggcggtcaactcgccctcgtattcgccatccagcagcaggtgcaggaattcgtgcttgtcgaggtagtggctgatttcgcaatcgaccagattatggaatttgtcgccgctggaaagattgtcgacggcgatgatgtcggtgatgccgcgctggttcagtcccttgaccaggttggagccgatgaagccggcggcgccggtaacgacgatagtcatgtgtttgtccttgttctgcaatgggccgtccggcccgaaaatgaatggattcagaaccccgcgcccggcgcggcgagatattccagctccgcggcgctgctgctgcggcccaaggcggcattgcggtgcggaaagcggccgaagcgcgcgatcacctgatgatggcgccgcgcgtaatccaggtaattgccgccggcctcggcgtccagcgcctcgaacagccgcagcgacagttcctgatcggccagcgactcgctgtgctcgaaaggaagataaagaaagatccgcgccaccgccggcaagccgccatccagcccctgctccagcgcgcgcggcgcgccctggcgcgccgccgcgtcgcaagcgaaagcccgcgcctcgccgcgaaacagattgcgcggaaactggtcggccgccagcagccaggccagcgcggcgcgggcatcgccgtcggccatctccagctcgccatcggccaattgccggcacaagggcgcgaaccgctggcggatggccgcgtcgaaagcctcgtcgcggcggaaccacgcctcgcgcggcgcggccaggctggcatcgtcggacccgccaaaccagaattccagcacggcctcgacttgcgccggcgtcagtgtcgccatcccagcctccccattagcgaatggacccggcagctgccggggcgttcccatcaaagcgcgaacagctcctgctgcgagcagaccgcggtgcccagcttgccgaccaccacgccggcggcggcattggccaggctcatcgccaccggcaggctttgcccggcggccagcgccaggcccagcgtgccgatcaccgtgtcgccggcgccggacacgtcatacacctcgcgggcgaaagtaggctgatgcagcgcgccgtcggcgcggaacagcgtcatgccctcttcgctgcgcgtcaccagcagcgcgtccagattcaattcctcgcgcagtttctgcgccttgcgcaccaatacatcctcgtcgcgccaggagcccgccacctggctgaactcgctgcgattcggcgtcagcagcgtggcgccggcgtacttgctgtaatcgtcgcccttggggtcgatcagcaccggcttgccggcggcgcgcgccagctcgatcatccgcgccacatgggtcaggccgcccttgccgtagtcggacagaatcaccacgtcgtgatcggcgacgatagccgagaattcctgcagtttgtcggccagtatctcgtgactgggcgaatcttcgaagtccaggcggatcagttgctgctgcctggccaccacccgcagcttgaccgtggtggcgatcttggcgtcgcgcttgaacgaggtggcgatgccgtcatcgcgcagcagccgctccagcacaccggccgcctcgtcgtcgccgaccaccgacaaaatggtcgccttcccgcccaggccggcgatattgcgcgccacgttggccgcgccgccggcgcgctcctcgctgcggcctatcttggccaccggcaccggcgcctctggagaaatgcgcgacacatcgccgaaccagtaacggtccagcatcacatcgcccaccaccagcacccgcgcgcgcgccaggctttccgccagcctgacggcatccagctccagctcttgcatcaaacccatagctctgcccccttatcggccaatggccaggtaatcgaagccctgctcgcgcagccatgacgggtcgtacatattgcggccgtcgaaaatcaatggctgcttcaggctggccttgatcgcgtcgaaatccggcgcccggaacattttccactccgtcacgatcagcaaggcgtcggcgccttccagcgccgccatcatatcgtcggcgaagcgcagccgcgcattgccgcccatcacgcggctggcttcgtgggtggccaccggatcgaaagccaccacttcggcgccccgccgagtcagttcgtccacaatcacccggctcggcgcttcgcgcatatcgtcggtattgggcttgaacgccaggccccacaacgcgaagcggcggccggccagatcgctgccgaagcggcccaccaccttgtccaccaaccgcagcttctggatatcgttggcctcttccaccgcggtcagcacgcgcaacgtatggccgtgctccttgccggtctgcaccagcgccttgacgtccttggggaagcaggagccgccgtagccgacgccgggatacaggaactgatagccgatgcgcggatccgagcccatgcccagccgcacctgctcgatgtcggcgcccatggtctcggccagattggccaactcgttcatgaaggaaatgcgggtggccaacatcgcgttggcggcgtacttggtcagttcggccgagcgcacgtccatcagcagcacgcgctcgtggttgcgctggaacggcttgtacagccggcgcatgatctcggcggcgcgctcgtcgtccacgcctatcaccacccggtccggccgcatgaagtcgtcgatcgccgcgccttccttcaggaattccggattcgacaccacgctgaacggcagcgccgcgccgcgcgcggccagttcttccgctatcgccgcgcgcaccttgtcggcggtgccgaccggcaccgtggacttgtccaccaccacccggtaatccgccatgtggcgggcgatattgcgcgccgcgcccagcacgtattgcaggtcggcggagccgtcctcatccggcggcgtgccgacggcgatgaactgcacctcgccgaaagcgaccgactcggccacgtcggtggtgaaatgcaggcggccggcggccacgttgcgtttcaccatctcttccaggccaggctcgaaaatggggatgccgccgttttgcagaatttcgatcttgcgcgggtccacgtccaggcagcacacctggtagccggtttccgccaagcaggtgccggtgaccaggccgacatagccggaaccaatgacagtgactttcatggcttctgattccggtattgctgaatgtcttgattgatctggcgcagcgtggccagcggatcggcggagccggtgatggagcggccgatcaccaggtagtcggcgccggcttgcagcgccgccagcggcgtcatcacgcggcgctggtcgtcattgccgctttcggccaggcggatgcccggcgtcaccagcttgaaatcctggcccagcgcctgcttcagcatcgaagcctcctgcgcggagcacaccacgccgtccaggccgcaatcgcgggtcagcgtcgccaggcggcgcacatgctcttccggcgacacggcgatgccgatttccgcgaggtcggacgcatccatgctggtcagcaccgtcaccgcgatcagcagcgggcgctggctgtagccggccagcgcttcgcgcgcggcttccatcatgcggcggccgcccgaggcgtgcacattgaccatccacacgccggcgtcggccgccgccttgcaggcgtgggcgaccgtgttgggaatatcgtggaacttcatgtccaggaacacctggaagccgcgcgcgctcagggtttccaccagattgcggccgctggaggtgaacagctccttgcccactttcagccggcattcggacgggtcaagccggctggcgaaatccagcgccttggcggcgttgtcgaaatccagcgccaccaacaccggcgaatcgatccgcgcatccgcagctgcgatcaaagggttcatgcatgctccatcattctatttatatgtgcgaagcgccgccgagggtcagcggcggcgcgaagttcaagacggcgtcaggcttccgaacggttggcggtgaagctttcccattcgccgcaggcggggcaatgccagaagaaggcccgcgagcggaaattgcagcatttgcagcgatgcacgctcaaacgctgggaatgtttgagtatcagcgcgcgcgccacctcggcgtccatccggccctccggcgacagctcgtccatctgcgcctctatcatccggtagacgccggacaggctgggacgcgcgtgcaccgcctcgcgcacgccttccagcgcgcgcgcctcgccctcgtaagtggcgattttctggtacagcaggtcggtcagttccaactgcgggaaagtgcgctggtagccgcgcagcagggcgatgccctccgacggcttgcccagtttctcataggcgtcgaacagacgctcggccgccatcgccaggtattcgtagttctgcttctctatgccctgccaggccgccatcgccgcttcgacatggccttcggcgaattcgatgtcgccgaggatcaggctggcgcgcacgcacttgcggttggcggcgatcgcctccgccacatactggcgcgcctgctcgtaatgggattggtacagctcgccctgcgccagttcgcaatagaactgcgccacttcatgctggaaggaatgcgcgtcgctgcgcagctcgcgggcggtttcaatcgcctttttccagtcgcggtcctgctggtagatgtcgagcagctgccgccgcgccgccagcgccatattgccgtccagcagcttcagcaggatttcctcggcgcgatcgaccaagcccgccttgcggaaatcctgcgccagctcgttgcgcaccagatcgcggtgctcgccgggcagatcggacgagtccagcatctgctggtgcaggcggatggcgcggtcgttctcgccgcgcttgcggtagagcttgcccagcacatgctgcaattccagcgccgcgccctgctggcgcgccacctcggacaaagcctgcgcggcgacgtcggtcttgtcgtcaaccagcgcgtccaggccgcgaaaatacgaaatcggcaccgctttcgcctgcttcagcacggtgcgcatatccacccgggccgcaaaccagcccaggccgaaaaaggctggaaacagcagcagccaccacaaatcgagttccaacagcaatcctttcgggataatagaatccgggccgcggacgcggccggcaggctaggcggccatcaatcggcgatggcgtcgctgggatcgctgacaaccttgctggcaggcgggcgattgcgcagctctttcttcagttgcgaaagctcgcggcgggttctcaggtagaagctgaaagtggccagcaggcctaccaccgcgccggcgacgaagaacagcaacaggaagacgatgaacggcgccgaccaagattggccgaagaacagtttgaattcgaccgcgtggctgttctgcacggtgaccgcgaccagcagcaacaacagggccagttcgacgatacgcaacaaatatcgcatgggttcgctcgatgggtttgccggagtgcaattttaaacgatagccagccacaacccaagccgccgcgcgctccgaatacgaaaaaagcgccgcaaaatgcggcgcttttggcacgacaggcgtcaaagaactgccatcaggcctgggtctgctccaacagggacagatccacgcgctcccgcagttccttgccagccttgaaatgaggcacgtatttctcaggaaccgagacgctggtgcccgacttaggattgcggccgacgcgcggcggacggtagttcaaatcgaagctaccgaagccgcggatttcgatccggcttccctgagccaggttgttggccatcgcatccagaatggtcttgacggccaactcagcatctttgtagaccaactgagaattgcgctcggcgagtctctcggacagccgcgcgatcagctcagatttggtcatgacgcaattactcgttggaaccggacagttttgccttcagcagggcacccaggttggtggtgccggcggaagcgctgtcaacggtggacaggttcttcatcgcggcattctcttcctgagcgtccttggccttgatcgacaggctgatgttgcgcgacttgcggtcaacggcaacgatcacggcttccacttcttcgccatccttcaggacggagcgagcatcttccacgcggtcgcgggacagctcggaagcgcgcaggtagccctcaacatcggtatccagagcgattacggcgcccttggcgtcaacggacttcacggtgcccttgaccagggcgcccttgtcgttcatcgcaacgaagttgttgaacggatcgccttccagttgcttgatgcccagggagatgcgttctttttccacgtcgatggacagaacaacggcttcaacctcgtcgcccttcttgaacttgcgcacggcttcttcgccagcttcgttccaggacaggtcggacaggtgaaccaggccatcgatgccgcccggcagaccaacgaacacgccgaagtcggtgatggacttgatcgcgcccttcagcttgtcgcccttgtggaagttgtcggcgaactcgttccacgggtttgccaggcactgcttcatgcccagggagatgcgacgacggtcttcgtcgatttccaggatcatgacttccacttcgtcgccaacttgaactaccttggacgggtgtacgttcttgttggtccagtccatttcggacacgtgcaccagaccttcgatgccttgttcgatttcaacgaacgcgccgtagtcggtcaggttggtcaccttgccgaacagacgggtgccggacgggtagcggcgggacaggcccacccacggatcttcgcccagttgcttcaggcccagggatacgcggttcttctcttggtcgaacttcagtaccttggcttccacttcatcgccaaccgccagaacttcggacgggtgcttcacgcggcgccatgccaggtcggtgatgtgcagcaggccatcgatgccgcccaggtcgacgaacgcaccgtagtcggtgatgttcttgacgatacccttgatgactgcgccctctttcagggtttccagcagagccttgcgctcttcgcccagggtttcttccagcacggagcggcgggaaaccacgacgttgttgcgcttgcgatccagcttgataaccttgaactcgatctgcttgttttcgtacggggtggtgtctttcaccggacgcacgtcaaccagagagcccggcaggaaggcgcggatgccgttgaccatgacggtcaggccgcccttgaccttgccgctgatcaggccggacaggatggtgccggcttccagagcttcttccagctcaacccaggcagccatgcgcttggctttttcgcgggacagcttggtctcgccgaagccgttttccagcgcgtcgatggcgacggtgacgaagtcgccgatggcgacttcaacgacgccttggtcgttcttgaattcttcagccggaatcagggactcggacttgaggcctgcgttcacggttacaaagttggaatcaactgccacgacttcagcagtgatcacttcgcccacgcgcatatcgtgcagggtgaggctttcctcgaacagttgagcgaagttttccatggagagggtagtcatcaagcgtactctcggttgcatgccttgcggcgtgcggggttagggttgaacacgcggcggcttttgcaacgcagcaaaaacagccgttaaaaaatcaatggccggaaacctgtctttcctcaaaccacccgaggaccttgtcgaccgcctggtctatggtcagctccgtggtatcgagcaaaaaggcgtccggctcctggcgcagcggcgctaccggccgggcggcatcgcgcgcgtcccgatcgataatgtcctgcataattctggggaggttagcagattcccccttgccgatcaactgcttatagcggcgctcggcgcgctcctcggcgctggcggtcaggaatatcttcaacatggcgtccggaaacaccaccgatcccatgtcgcggccgtcggtcaccaggcccggcgccaagcgaaaatcgcgctggcgctgcaatagcgcggcgcggacttcaggcagcgcccccaccttggacgcgccgatgccgatttcctcggcgcggatatccaggctgacatcgttgccttccagccacaccgcgccgtcggagaactccaccggcaggacgatcgcggcgccggccagcgccgcttcgtcgtcccaggcgatgccatggcggcgggcgtgcagcgccagcagccgatacagcgagccggagtcgaggtagtggaaatcaaggcgcgaggccaccagggcggccaccgtgcccttgccggaagcggaaggcccgtcgatggtaatcaccggaactgtcatgggagtttgatcctgttgcaatctcaagccaccggctccgtcggcgcgccgaaagaagccggtaaaaccgcgcattgtagcgcaagccggcgccttgcaggggagcggatgccgccgttctcgcgcggccggcgattgcgcgcaggcggcggcggcgggtacagtgtccgctcaccctttcgtccaacccgcgatacgcacccgaaaataaagcgcgccccgtcaatatggaacaactgcacctgctcccctgccctcgcctcgccggcgccgtcaagctgcccggctccaagagcatctccaaccgcaccctgctgctggccgcgctgtccggcggcagcacgctggtgcgcgacctgctggattcggacgacatccgccacatgctgggcgcgctgaagctgctgggcgtgaaaatagagcagcagggcgacagccgcgacttccgcgtgcacggcgccggcggcgctttcccggtgaaaaacgccgagctgttcctcggcaacgccggcaccgccttccggccgctgaccgccgcgctggcgctgatgggcggccactaccagctgtccggcgtgccgcgcatgcacgagcgcccgatcggcgacctcgtcgacgcgctcaacgccgccggcgcccgcatcgcctatctgggccagcccggcttcccgccgctggccatctccccggccgacgtgcgctgcgcccagcccatccaggtgaagggcaatgtctccagccagttcctcaccgccttgctgatggcgctgccgctgaccggcggccaggccgagatcgaagtggtgggagagctgatctccaagccttacattgaaatcacgctgaatctgatggcgcgcttcggcgtgcgcgtcgaacgcgacggctggcagcgcttcgtgattcccggcggccagcactacatctcgcccggcgaagtctatgtcgaaggcgacgcctccagcgcgtcctacttcctggcggccggcgcgctggccggcggcccggtgcgggtggaaggcgtcggcaacgccagcattcagggcgatgtgcgcttcgccgaggcgctggaattgatgggcgcgacggtgagccgcggcgacaactggatcgaggcccgcgccgagggcaagctcaaggcgatagacctcgactgcaaccacattccggacgcggcgatgacgctggcggtggcggcattggccgccgacggcaccaccacgctgcgcaacatcgccagctggcgggtgaaggaaaccgaccggctgtcggcgatggcgaccgaattgcgcaaggtcggcgccgtagtcgaggaaggcccggactatctccgcgtcaccccgccggccgagctgacgccgaacgccgaaatcgacacctacgacgaccaccggatggcgatgtgcttctcgctggtttcgctgctgggcgcgccggtggtgatcaacgaccccgactgcgtggccaagaccttccccggctacttccaggcgctggccgcgctgcaggcgcaataatcacaatatattgatggtttaatcgatagactccacaatatacgccttgcaaaggagtctatcgatgagcgacctgttccggatgcgccgcgatttcatgcggcgcttcgacatcccctccccctcccatcccgaatatcagcccgaacagctggcgatgtggcagaccatgctggacgaagagctggacgagctcaaacaggcgctggcggattatcgcgagctgccggcgcaatcgcccgaacagcaactgcgcagccgcgccgaactcgccgccgaggccgtggacgtgctcaatgttgtgtgcggcctgctgctgtcgcagggcctgccgctggaggcgatgtgcgaggcgatacacgacgccaatctgcgcaaatgcgtggacggcaaggtggtgcgccgcgccgacggcaaggtgctgaagccggaaggctggcggccggcggacaagctggaagtgatccgccaggcgcaggaccgcaacaatacgtcgcaatctttgtcctgaattaaaacgtccttaagccatcccggctaagcttgaatcttgacccactcgcatccgggaaccgaaatgctgcgcaattcctcgcaaagctacggccgcgtcgcccgcgcgctgcactggctgtgcgctctggcggtgatcgccgcgctggtcttcatcgaactcaaaggcaacttccccaagggcgatccggtccgcggcggcctgagctacgcccacatccaggccggcctgatcgtcctgctgctggtcgtgcccagactggcctggcggctgggcaatccgccgcccggcatcactccccgccccagcccgctgatgaagctgctggcccatgccggccactgggcgctgtacgcgctgatgctggcgctgcccatcctgggcatcgccttcatccaggccaggggcggcgaagtggccctgttcggcctggcgctgccagccatgctggcgccggatccggccttcggccgccagctgaaggacgcgcatgagctgctgggcaacgtgctgctgtggctgagcatcctgcacgccgccgccgccgtctggcatcatcgcttcgtcaaagacgatacgctgacccgcctgatcggcccgctacgctgattccgcgcgccggctggagcctctggccaccagccggccggacagcaccaccttgcgcggcggccgctccggctgccgcaagcgttccagcagcatcgccatcgcctcgcggccgatggcgtccaccggctgctcgatcaccgtcatccccggttccgccaattcggtccagctgtcgttgtcgaaacccgccagcgccagctgccgcggcaccgcgacgccgagcgcccgcgccgccttgaccgcgcccaatagcaacaagccgttgctggcgatcagcgcctgcggcggatcgtcctcccgcagccaggccgccaccgcctgctcggccgccgccgcgctgggcgcggcgaagcgcgcgtccgcggccagcccggcccgcgccagcgcggcggcgaaaccggcatgccgctcggccccggtgctgctggtattgccgaacaatccgccgatgcggcgataaccctgctccagcagatgcgccaccagttgccccgcggccgcggcattgtccagcagcaccgcgtcgccgccgccggggccggcgcggtccaccatcaccaccgggaaacccagcgccgcgatgtccagccgcgccgcggtcgcgcgggtggcggccaggatcaccccgctcaccctctcctcctgcatcagccgcagatacatcgcttccttctccgggttttcgtcggtattgcacaggatcacccgcatgccggcgcgataggcggcgtcctccaccgcccgccccaccgcggtgaagaaagggttgcagatatcggacacgatcaggccgacggtcaggctggattgcgagcgcaggcgccgcgccgacaggttgggccgatagccgctgccggcgatggcttcttccaccttggcgcgcaacgccggactcaccggcccgttgcccaaaacccgcgacacagtggccaccgacacgccggccaaccgcgcgacatccttgatactggtcgtcatatggaatcgttttcaattgattttcgccatgctgcgcctagttagcgtgacgcgcaagcgcttgaaaatccagcaacagcatgctgcattgcaatatccatactttattggcacgaatgaattgacagaaaaaatgtaatcgttttcaatcgctgacataccgatcccgcctacgaggtgcgccgtgtccgatgccctgctcaatccccaactgatacgcctgggctgccggcccgccgacaaggacgccgccatccgcgaagccggcgcgctgctggaggcagccggctgcatcgccccggactatatagacagcctgctgcggcgcgaggcggtggccaacacctacctgggcaacggcatcgccattccgcacggcatggccgaagaccgcgcccaggtgctgcgcaccggcgtcgccatcctgcagattccggacgggctggaatggaaccccggccagcgcatccacctgctgtgcgcgatcgccgcccgctccgacgaccacctggtgatgctgcgccagctgacccggctgctgcaggacgaagcccggctgctgccgctgttcaccaccaccgacagcgccgacctgctggcagcgctggcccagccggaagcgccgctgccgcccgacgccgaagcgcacgacctggatctgtgcgaggaatggcggctggactaccccaacggcctgcacgcccgccccgccgcgctgtgggtggaggcggcgcgccgcagcccggcgcaattgcaggtgcgccacggcagccaggccgccgacgccaaaaacctgatcgcgctgctgcagctcggcctgcgccagggcgcgctgctgacggtttccgcgcgcgggccgcaagccgccgacgggctcaaacaactgctgcgggcgatgcgcgaagccagcctggccgagcagaccgccgccgccatcgccgcccagcgcgccgcggcgcaacggccgcgcgccggctggcagccgtcgggccagccggtttcgctgcccggcatcgccgccagccccggcctcgccatcggcaccgtgcgcgtgctggccggcgaacagctgcgcatcgtcgaccgcccggtcagcctggccgaaggcggcgaccgcctgcacgaagcgctggccgccacccgccgccggctggcggcgctggccgacgccactcaggccacgctgggcgccgccgaagccggcattttccgcgcccaagccgaactattgaacgacaccgacctgatcaccctcagctgccaactgatggtggccggccatggcgtggagtggtcttggcaccaggcggtggagcggctggcggaaaagatctcggcattgggcaacccactgctggccgcccgcgccgccgacctgcgcgacgtcggccggcgggtgctgctagagctggacccatcgctgcaaggcaacgcgccgggagagttcggccccgacaccatcctgctggccgccgacctggcgccgtcggacaccgccagtctggatctctcccgcgtcaagggcctggccaccgcccacggcggccccaccgcccacaccgccatcctggcgcgcacgctgggcctgccggcgctggtggccgccggtccggcgctgctcgacgtggccgacggcagcccggcgatcctggacggcgacgccggccggctctacctgaacccgagcgagcacaatctcgcctccgcccgcgactggcaacaacgccagcgcgaggcgcagcaacaacagcagcaggcctgcctgcagcccggccagaccgccgacggccgccgcgtggaaatcgccgccaacctcaaccggccggaacaggtcgccggcgcgctgaacaacggcgcggaaggcgtcggcctgatgcgcaccgaattcctgtttctggagcgcgacgccgcgccggacgaagaagagcaataccagacctacctggccatgcagcaggcgctgcagggccggccgctgatcgtgcgcgcgctggacatcggcggcgacaaacaggtgccctacctgaacctgccggtcgaggacaaccccttcctcggcgtgcgcggcgcgcggctgctgctgcgccggcgcgagctgctggagccgcagctgcgcgcgctgtaccgcgccgccaaggccggcaagcccttgtccatcatgtttccgatgatcagctcgctgaaggagatcacccggctcaagggctggtgcgagggcgtgcgcaaggaattggacgcgccgccggtgccgataggcatcatggtggaagtgccggccgccgcgctgctggccgaccagctggcgccctatgtcgacttcttctccatcggcaccaacgacctcacccaatacgcgctggcgatggaccgccagcacccggagctggccgccgaagccgacagcctccaccccgccgtgctgcggctgatccgccagacggtgcgaggcgcggccgcgcaccagcgctgggtgggcgtgtgcggcggcagcgccggcgacccgctgggcgccgcggtactggccggcctgggcgtggacgagttgtcgatgagccccagcgacatcccggcggtcaaagccatgctgcgccgccacgactacgcgcggctgcaagcgctggcggaacaggcgctgtcctgcgacagcgccgaggaagtgcgccagctgctggaggcactggcatgagccccgccctgcacaccatcacgctgaacccggcgctggaccagaccgtcaccctggatgaactgctgcccggcggcgtcaacctggcgcgcgccgcccaattgaacgccggcggcaagggcatcaacgtggccagctgcctggccgactggggcctgccggccaccgtccacggcctgctgggccgcgacaacagcggggcgttcgagcaactgttcgccgccaagcgcatccacgaccgcatgctgcgcctgcccggcgacagccgggtcaacatcaagctggccgacctcaaatccggccgcaccaccgacatcaacctgcccggcctggccgccgccgaggccgacctgcaggcgctggccgcccggctggcagagctgcgcgccggcgacagcgcggcgctggccggcagcctgccgcccagcttgccgccggacgccctggcccggctgtgccgccagttgaaacggcaaggcgtgtgggtgcttctggacagcagcgggccggcattggcctcggcgctggccaatccgcccgaggcgctgcccgactgcatcaagccgaaccgggaagaactggcgcaatgggccggccgcgagctggccgcgctgccggatgtggcgcgctgcgcgcaaggcctgcagcggcggggcatcgcccaggtggtggtgtcgctcggcgaacagggcgccatgctggtcgacgccgactgcgcgcggctggccagcctgccgccgcagcggccgctgagcacggtgggcgccggcgacgcgctggtggcgggactgatggccgcccgccagcaagggctggccggcggcgacgcgctcaggctggcagtggctttcgccgccgccaagctgcaaagcgtcggcccgcacctacccgccgccgaacagatacgccaactggcggacgcggtccgcctgcaagacctggccgcggcctgaagccggcgcccatcatcgatcacaggggaaacgcaatgagcatcgtcgccatcatccgctccggcgagcgcagcacccaggcgcgcctggccgccgaagcgctgcgcctggccgcccagcggcggcagctgccgatagacatcgagatagacggccagccggcgttgagcgccggccagatcgccgccgccggccatgtgctgctgataggcgaagaggacgacgcccgcctgggccggcgcgccgcgcgccgcgccacgctggacgcggtgctggccgacccggccggccagcttcaggtgcaggaagccggccgcgccctgcgcatcgtcgccgtcaccagctgtcccaccggcatcgcccacaccttcatggcggccgaggggctggtccagggcgccaaggcgctgggccacgcgattcgggtggaaacccagggctcggtcggcgcgcaagacgcgctgagcgatgccgagatcgccgccgccgacctggtcatcatcgccgccgacacccaggtggcggtggagcgcttcgccggcaagcggctgttcaagagcggcaccaaggccgccatcggcgacggcaaggcgctgatccgccacgccatcgaagaggcgcagccatgggcaggcgccagcccggccgccgccgaagccgccaatcaggaaaaagccaaggacgggccctaccgtcacctgatgaccggcgtgtccttcatgctgcccttcgtcaccgccggcggcattttgatcgcgctcgccttcgcgctgggcggcatctacgccttcgacgacgcgcacaagggcacgctggcctggtcgctgttccagatcggcgcgaaatccgccttcgcgctgatggtgccgatcctggccggctacatcgcctactccatcgccgaccgtcccggcatcgcccccggcatggtgggcggcatgctggccgccagcctgggctcgggctttctcggcggcatcgccgccggcttcatcgccggctacggcacccgcgaattgaaccgccggatcaagctgggccagcatctggacggcctgaagccggtgttgatcctgccggtgctgggttccctgctgaccggcctcttgatgatctacgtggtgggccagccggtggccgccgtgctggcggcgctgaccgaggcgctcaagggcatgcaaggcagcagcgcgctggccctgggcgcgctgctgggcgcgatgatggctttcgacatgggcggcccggtcaacaaggcggcctacgccttcgccaccggcctgatcgccagccaggtatacacgccgatggcggcagtgatggcggccggcatgacgccgccgctgggcctggcgctggccacccgcttgttccgcaaccgcttcagcgccgacgagcgcgaagccggcaaggccgccggcgtgctgggcctggccttcatcagcgagggcgcgataccgtttgccgcgcgcgacccgctgcgggtgatcccggcgctgatggccggctcggcgctggccggcgccatctcgatgaccatgggcgtgcagctgaaagtgccgcacggcggcgtgttcgtgctgcccattcccaacgcggtggaacatctgggcggctatctgatcgccctggcagccggcaccgccgtcaccgccttgctgttgggcctgctgaagaagccgctgccgcaaaccgccggctgaccccgcctccctcccttccgccgacaggcctgcgatgctcacgcatcgcaggcctgtttacattagaaataatgaatagttaatttgttataatgcgttcacaaacggcacacagatgccgcgaattcattgcaaacatcaatcaggaaaagccatgtccattacccgccgcgacttcctcaacggtttcgcgctgacggtggctgccgggctcacaccgctggaaatcctccgtgccgcgccccgtcagatcagcgccagctactacccgccttcgctcaccggcctgcgcggcaatcacgacggctccttcgaaaacgcccacaagctgggccgcgcccaccacgcctattcgctctccggcgccaaggtggaggagcattacgacctggtggtggtcggcggcggcatcagcggcctttccgccgcccactactaccgcaagaagcacccgcaggccaaggtgctgatcctggacaaccacgacgacttcggcggccacgccaagcgcaacgagttcaaggtcggcgatcgcctggtgctgggctacggcggcaccgaatcgctgcagtcgcccaagcacgtgttcagcaaggaagcgctggcgctgatgaaagagctgaccgtcgacatcgatggcctggccagccacttccaccgcaatttctaccccgacctcaagctgtcgcgcggcgtgttcttcaataaggaagacttcggcgccgacaaggtggtgggcggcgacccctatctgcaggtggcggacgacatcgaccccaagcgcctgaacgcgcggccgatccgcgacttcatcaatgattttccgatgccgaagaaggaccgcgacgcgttgatcgccctgcacaccagccagcgcgactacctgggcgacatgcccaaggccaagcgcgaggcttatctcgccaagatcagctacagcacctacctgtcccgccacgtcggcctgagcgccaccgcgatccgcttcttccagtcgcgcagcaacgacttccaggcggtgggcatcgacggcctgccggcgctggacgcgcgcaatctggacctgccgggcttccacggcgtggcgggcctgggcaagatcagcgccgaggcggaagccgaactgcgcgacccctacatctaccacttcccggacggcaacgcctccatcgcccgcctgctggtgcgcaagatgattccgcaagcggcgccgggcaaggacatgaacgacatcgtgctggcccgcttcgactacagcaagctcgacctgccggaaaacccggtgcggctgcggctgaacagcaccgtggtgcgggtggaaaacggcaagagcgcggtggatatcggctacctggacaagggcggccagctgcgccgcgtgcaggcgcgccacaccgtgatggcctgttacaacatgatgatcccgcacatcatgcccagcctgcccgacgaccagaaacaggcgctggcgatgaacgtcaaggcgccgctggtctacaccaaggtagtgctgaagaactgggacagcttcatgaagctgggcgtgcacgagctgtactgcccttccatgccgtacagccgcatcaagctagactacccggtggacatcggcggctaccagcatccgcgcaagccgtccgagccgatgtgcctgcacatggtctacgtgcccaccatcgccggctccggcctggacccgcgcacccagtggcggatgggccgcgccaagctgctggccatgccgttctcggaaatggaaaccatggtgcgcgagcaactgcagcgcatcctcggccccaccggcttcgaccaccagcgcgacatcgccgccatcaccgtcaaccgctggtcgcacggctattcctacttcctcaactcgatgtacgacgacgaagacgagtccaagcgcatcatcgccgccgcccgccgcccggccggcaatgtgacgatcgccaactccgactccgactggaacccgtacacccacgccgccatcgaccaggcatggcgcgccgtcaacgagctgagctaacaggaaccccgcgatgaaattgatgaaaaccctgggcctggcggccctcttggccgccgccgcgcaagcggcgcaggccaatgtcgacaccgacagcgtgcggcgcggcgcctacctcgcccgcgtgtccgactgcatcgcctgccacagcgcgccggacggcaagcccaacgccggcggcctggcgatggacaccccggtcggcaagatctactccaccaacatcacgccggacaaggaaaccggcatcggcgactacagctacgaggacttcgcccgcgcgctgcgccagggcgtggccaaggaaggccactcgctgtacccggcgatgccctacacctcgttcgcgcgcatcaacgacgccgacatgcgcgacctctacgcctatttcatgcacggcgtggcgccggtggcgcaggaaaaccgcgacagcgacattccctggcccttgtcgatgcgctggccgctgacgctgtggcgctggttcttccacgacgacagcgcctaccaggcggatgccggcaagagcgccgaatggaaccgcggcgcctacctggtgcagggcatggcccactgcggcacctgccacaccccgcgcggcgcggccttccaggaagtggcgctgaacgacaagaaggcaggctacctgaccggctcgcagctggcgggctggtacgcaggcaacctgaccggcgacgcgcgcgaaggcctgggcggctggtcggcggacgaactggtggaatacctgcagaagggccgcaaccgctacaccgccgccttcggcccgatggccgaagtggtgcattacagcacccagcacgtcagcgcgggcgacctggcggcgatggcgatctacctgaagagcctgccgggcgccggcgccgccgacgtgcggccggtgcgcaccggctccgcgctgttcttcgagaactgcgccacctgccaccaggccaacggccagggccacgacaacgtggtgccggcgctggccggcagctcggcggtgatggcgcgcgacgccacctcgctgatccgggtggtgctggaaggcggcgtcaacgtccgcaccggccatctgccgtgggaatacagcatgccgggctacgcgcggcagatgtccgaccaggaaatcgccgacgtgctcagctatatgcgccagagctggggcaacaccgccagcccggtcgaagccgatcaggtggccaaagtgcgcgcgctgtcggcccagtccgcccactagcccgcagtctgccgcccgcatggcaacgccgccgcgccctcacgggcgggcggcgttttttcatgtcggcgcgggcctcaaatcgcgccgaagcggactggccagacacactgcagcaagggctcgtcatcctcgtccaccagcacgccgccgcgctgaaaccccagcttgcccaccaccgccagcgacggctggttttccggattgacctgcgccagcacctcggccacctcgccgctgtcgcgcgcccgctgcagcaaaaggcgcaccgccgcagccgccgcgccctggcggcggcaggccggcgccaccgcgtagcctatctccacccggccggcgcgcggctcgcccttgaagccgcaagcgcccaccacccggccctcgccatccagcatgtaaaagggcaggcaccaatacggacgctggccggcccgcaggcgctcccgcgcgcgcgccgccacttcgggcggcggcaaggcctgctccgccacccggcccgacaggcggcgcggcgtcgccgctttttcgatatcggccagctcgtcgggcggaatcgtttccagaatgatatgcatgaggatgggcgtgctacaggaaactgacatcggcgatccagctgctagcgcgtctcgccagccgctccgcctcgctttcgccgtcgaacgacaccggcgcgggttccagcaccggcaccggcgcatcgtccagcgcgttgacgctgaccaccgcgtatactctgcctgctatccggctgctgaccagcggcaccgcgccgcagaccgcgcagacgtggaaatcggcggtggcggtgccgaaacggtatttcgacacccgctccggccggctgacgcgcaccttcaggctgtcgcccgggcatgcggtccacactccgccgtgcttgcggcagaaatcgcagccgcagcgccgggccggaatggccgccggctccggcagccagtcgagttcgaacgagatattgccgcaatggcaggcgcctcggatcaacatcgcaaacttcacgcctcatgtcaggtggggaaatggcgcggcgatgcgccatcgattcggcaacaccatgcgcggccggcggcggcgtcaggttttgcgctgttgcagcacccggcgcatgtcgcgcgccgccttcagcggcgtggcggacagattggtggtggcgaagtagccgacctggcgcgacgccttggacatcgccgcgccggacgcccagcccacttccagcgcctgccgcatcgccgccaccggcgcggcgtcgtaatcgggcaactgctgccgcagacagcggctcacgtccgccagcagcttttccgccgccagcatcagttcgcgctgggtgtcggcctgcgcctgccacagcgacgcccccaccagcaggccgccgtcgattcttttctccatctcaccctcggacagcggaaaaccgggcgaccaggacgacagccaggtgcgacaggcgtcctcctgcacttccagccagcgccgctggccgcgctccatcgcgccgcaataggtttccatcgctccgacgatccagcttgccatgcggactcctcgtcaaacgggcgcgccacgcgcctcagacaacacactgcggacgcggcagccgccacaccgccagcagctcccgcaacagggtttccagcaccgggtcgcccgcccggtccgccggatagacaaactgcaactcggcgttcttgcgcaattccggcaccagccagacgcggccggccgcctgccaggccagcgcctcctcctcgcgcaccagcgccacgccgacgcccgaggccaccagctccaggatcaccgacaaatgatcgctctccgccacttttttaggcgaaatattcagctcccgccacaattccgcggtgatcttggacaggctggaaaattgcgaaatgccgacccagggcagcttgcccagctccctgagcttgccgccgtccagctgcccggcccaggccgccggcagcgccacgcggaacgacagggtttgcagcggcacggtgctgacgttcatatagggattgcgtcccaggtagaaaccggcgtccagctccttcttgcgcaccagattgagcacgtcgaccgatacgccgtggctcagttgcacttccagcagcgggttggcttccaccagcgccgccacccacggccccagcttgaggatgtccggcatcagggtgacgccgattctggcctggccagccagctggcccttgagcttgcgcgcgtggttgatgatatcgcgcgccgcgcccaacacgccctgcgcctccggcagcagctcctgcccggcgcgggtgaggctgacgccgccggcgttgcgctcgaacaactgcatgcccacttcttcttccagcgccttgatctgcgcggtcaccgccggttgcgacaggtgcagcagctcggccgcctgcgtcaggtggccttgctgcgccacggtgacaaaggtccgcaactggtagatttccatgctctcccctgctgtttcatcacggccgccccgctttgccgtccgcggggccgaatatgccaaatgtcgcctaggctagcacaggctcgcgcgcccgctcaaaaacaaaccgcctgccgcttcgcgtgcggcaggcggttggatcacggcgcgccggctgcgcgtcgcatcagtcgtcgtcctcctgcgcccagctgggcgggcgtttcgccatgaaggcggccacgccttccacttgctcggcgccgcccaccaggcccagcgtggcggcgcgttcgcgcgccagatgctgttccagcgtcaggttggggctgtcttcgatcagcttgcgcgccaccgccaccgcggccgcgccctgcgtcgccaccttgttggccaggctcaccgccacgatcttggcgaagccctggtccaccacttcctcgatcagccctatgctcagcgccttttccgcgctgaccacctcgccgcccaggatgatgcgcttggcccaggacacgcccaccttgtcggccagcgtcttggtgccgccggcggccggaatcaggccgaccttggcttccggcaaacccagcttggagccgcgctcggcgatgatgtagtcgcacaccagcgcgcattccaggccgccgcccagcgcatagccgttcactgccgccacggtgacgccgcggtagctgcgtatcgcctgcaacgcgtcggcgaaggcttgcaacaagatatccgccgcggccttgtcgcccgcggcgaactgcttcaaatctgctccggcggaaaagaaagcgtcgccggcgccggtaatcaccaccgaacgcacagaatcatcggcattcaacgcctgcagcgtggacgtcaactcgttcaggctttccgtcgtcagcagattggcaggcaggttggaaagcgtgatgatggctgatttgcccagccgttcaagtgtcagatacctggccatattgtgttcctcactgtattccccatctatcttcgttagcctcccggtccggatcgatccagcctgatatggctggcgtcgctcccatttccgttccggggccggcgcattccgccgcggcgctcgcgcgcggcgttccgcagccagacggacattctctttgcaaactgtacttttagccagtaggcaaaacaattatatccaaccttttttgtagaatgcttgtttcgacaatgccaaaaagaatcaatcggatccgccgccacccccacggcaagcccatccgccgccatctgcaacttcgtcatgaccctctgttaccatagagctttcgtcggcagcttgcggcatgattgaaacgaatttctggattttgttcttggccggtttgctcggcggcgggcactgcgtggggatgtgcggcggcatcgtcgccgcgctcaccctgaaccaccccgccggccggcggcgctggcgcgttctcgccggctacaacctgggccggatcagcagctacgcgctgatcggcgcgctgctgggcggcctggccgccgccggcctcagcctggcggcctcgcacccgttccagcttgccctgtacgcgctggccaacctgctgctggtggcgatggggctgtacctggccggctggtctgcggcgataggctcgctggagaaactgggccagccgatatggcggcggctgcagccgctggtgggccgcatgctgccgatacgcggcgcgctgggcgccgccgcggtgggcgcggtgtggggctggctgccctgcggcctagtgtacagcgcgtcgatttcggcgctggccagcggttcggcctggcgcggcgccggcctgatgctggccttcggcctgggcaccctgcccaatctattgctgatgggggtgttcgccgacggcctgcgccgctggatgcaacaacgcccagtgcggctgattgccggactgggcgtggcgggactgggcgcgtaccggctggccgcgctgcttatcggaacgatttcatgatggtgtcgacgttgtagcgcaccagctgcaagtagctggcggccgggcccttggggctggacagcgcgtcggcgtacaactgcccgcctatcttcaccttggcttcattcgacaattgctgcagcaggcgcttgtcgctcatgttttccatgaacaccgcggtgaccttttccttgcgcacctggcgcgtcagctgcgccacgcccttggccgaagcctcggactcggtgctgacgccctggatcgccagcaccttcagctggtagtgctcccccatatagccgaaggcgtcgtgcgaggtcagcatcttgcgcttggccgccggcaccgtggcgaactgcttcttcgcccagtcgtccagcgcctgcaccttggcggcgtaatcggcggcgcggcgctggtactcggccttgccggccgggtcggcctggatcaggccggcgctgatgttcttgatataggtttgcacccgcgacgggtcatgccaggcatgcggatcgacatcgccgtgatcgtggtcgtgctcgccttcggcatgctcttcctcaggcgcctggcgggtctggatacccttggacgccaccacggtcacgccgcggaaattggccgccttgtccagccgcgacatccagccctccaggcccaggccgttgacgaccagcaccttggcagcggacaccttcttgatatcggccggcgacggctggaacacgtgcgcgtcctgatccgggcccaccagcgacaccacctccacccggtcgccaccgatttcgcgggtcatgtcggcgatgatgctgaaactcgccaccaccggcaccttggccagcgcgaacgccggcatgcccagcaacagcagggcgccaaacagcttcttcatgcttttcctctcctcaggattccagatggcgggcgcggatatagcgcggcaaggcgccgcccaccggggcaaacagcaaagacagcagatagaccacgccggccagcaggatgatggcgggtccggacggcaattcgaagtggtaggacaacagcaggccgcccaggccgctgaggaaggcgatgccgaccgacagcgccagcatggcctcgatgcgctcggtccacagccgcgaggtgatcgccggcagcatcatcagccccaccgccatcagcgtgcccagcgactggaagccggccaccaggttgagcaccaccagcatcaggaacaacagatgccaccaggcgccgcgcgcgcccaccgcgcgcaggtagaccgggtccaggctttccagcagcagcggccggtagatgacagccaaggtcagcagcgtcaccgaagccacgcccgacaccagatacagcgcggcgttgtccaccgccagcaccgagccgaacaggatgtgcatcaggtcgacattactgccgccccgggacaccagcagcacgcccagggacagcgacagcaggtagaaggcggcgaagctggcgtcttccttgatgctggtgaagcgggtggccagcccggccagcagcgccaccagcacgccggcgacgaagccgcccaggctcatcgccggcagactgaggccggcgaacatgaagccgaccgccgcgccgggcagcaccgcgtggctcatcgcgtcgcccatcaggctcatccggcgcatcaccaagaacagcccgatggggccggagcccagcgccaaggccaggcaaccggccagcgcgcggcgcatgaaggcgaattcgacaaacggcgaaaccagtagatcgtacagatgttgcatcaggcgcttactccatccaggccgcaaaccggcgcctgggcctgccagtgggcggcggtttccaccgcgcgccgcagattgtcgtcagtcaggaccgcggcgctgtcgccccaggcgatcacctcgcgcgccatcagcagcgtgtgcgggaaatgcgtccgcacctgcatcgcgtcgtgcagcaccgcgatcacggtgcgcttctcgccgcgccactgcgccaccagccgcagcaaatcttcggtggttttggcgtccaccgcgttgaagggctcgtccagcaggatcagcctggcgtcctgcaccaggatgcgggcgaacagcacgcgctggaactggccgctggacagcgcggcgatcggccgcaacgcgaaatcggccagccccacctgctccagcgcctgcagcgaacgctccatgccggcgcgccccacccggccgaacgggccgctcttgtgccacagcccggtgccgaccagctccagcacgctcaccggcatgctgcggtctatctcggcctgctgcggcaagtaggcgatgtcgctgcggcggtggccattcaggtccacgctgccggaatccggcgccagcgcgcccaccatggccttcagcagcgtgctcttgccggcgccgttgggcccgaagatggcggtggcgtcgccgtcggcgaagcggccgccgatatggtgcaccgccggatggcgctggtaggacaccgtcagattgttgaggatgatgctcatgccagctcctgcaaggcccaccacaccagcagccacaagccggccagcggcagcagggtcagcgcgacgcgctggccggccgacatcgccagcaggctgagcggcggccgcaacgtggccggggtcaggtgttgatgttcgtgcccatggtcatggccatgcgagtgcgatccgctcattccaggcactccttcagccaggcttccaccttgtcggcctcgaacgccggcgcgatcagctcgaagcggctgtcgcggcgccaggacacctgggcggcgccccactgtccggcggcccagttcagccacacccagctgtccagcacgcggaacacccccttggctcgcgtgaggcccggcaccttggccggcaggtcgtcgaagaagcgtgtcaggcgctcgccgtcgaaattcagctccggatcgaaagtccagccggccgattgccacgcgctgctattgtccggcagcgccgccggacggtagcgcggcttggcggcgcgctcggcgtccagccaggccacgtccagttggccgtcgcgcacttcgccgaccagggacttgggcggaaacaacgccgccgcctgcgcgcggaaggcctccatggtcgggatgtcggcggcgtctatcttgttggccaccagcacgtcggcgatggagatctggtcgcggtacagcggctggcggtgatagtccggctgaatgaactggcgcgggtccaccagcgtcagcaccgccgccacttccagcgcctcgcccagcggcttggcgcgcaattcgtcgatgacgccggcggcatgggccaggccgctggcctcgatcagcaggcggtcgggcttttcgcggcgcagcaaggtcgccacggtggcggtcatctgcgggccggccacacagcacaggcagccgccggcgatctcggccaccgccagctcgtcgttgagcaaggcggcgccgtctatgcccacttcgccgaactcgttgacgatcaccgcccacttctcatgctgcgggcggttggcgatcaggtggcgcagcgcggtggtcttgcccacgcccagaaagccggtaaacaggttgactttggtcttgttcatgatttttcgacggttcagatggcacaggactggcaacggccggccagcaccaggttttgcgggctgagcgtgaaaccggcggccagcgccatgtcgcgcaggctggccagcccgccggcggcgtccacctcgttgacgcggccgcattgttcgcacaccaggatcaggctttcgtgctggcagtcgaagtggtcgcagacgatgaagccgttcaaggcatccaccttgtgcaagaggccgtgctccaccaggaagtccagcgcgcggtagacggtgggcggcgcggccgagccgcgctgttgctgcaggtcggccagcacctggtaggccttgaccacgccgcggcggctcagcaccagctccagcacctggcggcgcaattcggtcagtttgctgccgcggctggcgcaatggcgctcggcggcggcgagataggcggaggaatccatggtgggggcccggctgaataatgggcaatgttactgtataacatcaccattgctcaaccatttacataatgcgggttttgacggtttgcccgctgtgataggctgctggcgtcgttttcatgccaaaacagggggaatttcgatgaaaaagatgttgctggcttcgctggcgctgctgctggccggccaggcgctcgccgcggatccgatcagccagcgcaaggacgcgctcaagcaatacaagccggtgatcggcgagatgggcaagatgctgaaaggcgacacgccctacaacaaggacgagttcgccaagctggccgtcaagctggagcagctgtcgcagcagccctggcaatacttcccggccggcagcggcgccggccgcaccgacgcgcgcccggaaatctggagcaagcccgccgactggcaaaaggcgatcgagcggcacaaggccgccaccgccaatctgaagcagacggcgcaaggcggcgacctcgccgcggtccgcaaggccttcgccgacacccagcaaacctgtaaagcctgccacaaggacttccgcaaggattgatccggccggggctgcccacccggccccccatttcccgccgtcatcgatataatcggcgttcggcgccacgcgccgccgtccgacaagcttagccaccgattcgagatgccatgaacaaaacactgaccgcgctgctgctggcagccatcgccattcccgccgcccatgccgacacgccggccgaaatccgctcgcaggcgttcaagaagatgctgctgcagtcgttcgagccgatgggcatggcggtgcgcgggcgcgcgccttacgaccaggccaagttcgcgcagcaagcggaggcgatgaaaacgctggccgccgagccgttcaagcacttcccggcgaacagcatcaccggcaagagccgcgccaagccggaagtctggagccaggccgccaaattccaggccgaccgcgacgccttcctgaaatcggtcgatgcgctggccggcgccgccaagggcggcgacctcggttcgatcaagaaggcctacggccaagtggcgcaaaactgcaagacctgtcacgacgccttccgcggcccggaaaaataagcgcccggcgcatcaaaaaacaaagccggcatccgccggctttgtcgtttgcgcgcgccgcgttcagcgcagcagcgcgaaatacagcccgccggccgacagcagcaaggccgccagcgccagcgcgccgtgggcgaaacgcagcctgggcttctccccggccatttgcttgtagccggtcagcatcggcttcaccaggttctgcttcttcaccacccggtaaacgacgatggcggcgatatgcagcgccgccaggcccagcaggccgttgaacagcagcttgtgcacgccggtggcggcctccgccacgccgctgtccacgtgcttggccagcgggccatcgtacagataactgtccacgtcggcggcgaacaggccggtcagcacctgcgcggccagcgccagcagcatcgccaccaccatccagccgcccagcgggttgtggccgggcgcctcgcgctccggcaattcgccccgcagatagcgcaagatggcgcgcggaccgcgcacgaagctggagaaacgcgcggtctggctgccgatgacgccccagatcaagcggaacaccagcagcgacgccaaagccacgccgcaatagatatggtattgcagccagtcgccgccctgctcggcgcaaaaccacatcgccgcgaacaacaaaaccagcgtccagtgaaacaaacgcgtcggcgcatcccacaccttgacctgctgcgacattcttaaccctttccctatcccggatatccatccattttgccgcatccccgcccggacaccaagatgccgccccgccatttcagcaataaaatgggcaatccgccgccatgtggccgcaaattcggttaagatgaattccccactccagcctggcgacgccgtcgtcccgctggagccgtttttttccgacgccgcccgcggcgtctttcaccgtgttggagactcagtcaaatgacgcaaaccgcccttcttcaggatctggaggcccgtggcctcatcgcgcaaaccaccgatatggccgcgctgcaggcactgctgaacaaggaaacggttacgctttattgcggcttcgacccgaccgccgacagtctgcacatcggcagcctggtgcccatcctgatgctgaagcgcttccagcaggccggccaccgcccggtggcgctggtcggcggcgccaccggcatgataggcgaccccagcttcaaggccaccgagcgcaagctgaacaccccggacatcatcgagagctgggtggagaagatccgcgcccaggtggcgcccttcctcagcttcgaaggcgacaacgccgcgctgatggccaacaactacgactggtttggcggcatgggcgcgctggagttcctgcgcgacatcggcaagcacttctcggtcaacgccatgatcaagaaagaagcggtgcagcagcgcatcgcccgcgaagaccagggcatttcctacaccgagttctcctacagcctgctgcaaggctacgacttctccgagctgaaccgccgcctggactgcaagctgcagatcggcggctccgaccagtggggcaacatcaccgccggcaccgatctcacccgccgcctgaaccaggcccaggtgttcggcctgaccatgccgctggtgaccaagtccgacggcaccaagttcggcaagaccgaatccggcaccatctggctggacgcgaagaagacctcgccctacgccttctaccagttctggctgtccaccgccgacgccgacgtgtacaagttcctgcgctacttcagcttcctgtcggtggacgagatcgccgccatcgaagaggccgacaagaaccgcgacggcaaaccggaaggccagcgcatcctggccgaacaggtcaccgcgctggtgcacggccaggccgcgctggaagcggcgcagcggatcacccacagcctgttcagcaacaacctgtccagcctgaccgccgacgacttcgcccagctggcgcaggacggcctgccctgcgtcaagctggacgccggccacagcggcctggtggacgcgctggccgccgccggactcgccaagtccaaaaccgaggcccgcaccttcatccagagcggcgcggtcagcgtcaacggcgccaaggcggacagcatcgagcttgaaatcggccaggaccagcgcctgttcggccgctacacgctgctcaagcgcggcaagaagctgtacgcgctggccgactggcaataagccgccgcggcaaaaccaaagcccgtccggatggacgggctttttgtttgcggcaggctcaggcgacgctgaaggcctccccggtggcgaagaaggcgccgccagcgatgtaatgcacgctgcgcctggccggatcgtcgtcgaaatgccaatggccggcgctgaacagcgcatcatcggcctgggcggcgacgacttcgccgatgaacagatcatattgcgactggttgcgcggctccggcaccaccttgcactccaggtagcctatgcagcccgccaccaacggcgcgccgaccttgcgcgccggcaacggctccagcccgctggcggcgaatttgtccagctcatggccgctctcgctgcctactcgcaccacctgcgccgcctgggctcggcacgggatattcagcacgaattcgccgctggcctcgatcagctcacggctgtaggtggacttgtccaccaccaccagcaccttgggcggatcgaaatccagcggcatcgcccaggccgccgccatcacgttccgcctgcctcccgccgcgctgctcaccagcacggtggggccatggttcagcaaacgataggccttggccagttccacgtccgccagcatgttggtctcccttgcgcaaaacagccattctagcagctgcggctcaatgcagcgccggcgcctccaaatggcataaccggcgctgcaggcgcgcgtcccgcgccaggatgtcctcgaacagccggctgcgcgcggcgatgtgatggccggcgcgccagtccttcagcaaggcgagccccagctcgaaatactgcggatcgatctggcacaggcggcgcaaatcgaaaggcgcgcccagttgcaagtccacggccagctgcagcaagacttcggtttgttcttggtccacgcgctgcgccagcagcagccgtatctttttcgctgcgttcacgccgattccatgattaaaatggcataaaaatttagcatggaatacatattcgcgtaactaactcttcacgatggtcatataacaaaaaaaggcccgggctttcgccgggccagtttgccattatcctcaagcacaaagacagaggagatgtcatcgtgatgacaatcgcgttatagacaacttcgtgctgcgctgcaagatcgaatgtcagaaaatatacatcgcccctctgcccaggctgttgctgctgccggcgaagcctatgtagacgttgcggccgtagaagaacggcaaaccccaatcgaaatcgccgctcaggctgccggtcattggcgcgcctatgctggggaaagccgcgtagttgctgcgagtgagcacttgggcgctgatcaggctgaaattgaccgtgctgctgctgccgccgctcgacaaggtggcgctcagattgagctgagaacccgggcagaaccaagtgccgccgcccaccgtgcaggtagcgatgctgctgtcggtgaagtacagaatgttggatccgctgtcgaggaagctagggtaaatctgccccttgtagacgccggtgatggtgaaaccgtcgctggagactgggtaagccttgacccccgacgcgatagcgttgttggactgggtgccgatgccgaaagtcagcgtcccctgcgcgctcgcctgcccggtcaccggaatggcgggcagctgcaacagcacgccgttgttgtcggcggcgaagctggccaccggattcgccacctgctgcgcgaccggcacggtgccgggctggcaggtcagcgcggtggcgcaaaggtaataaaatccgttgttggcgttgccggcgcaatcgctgccgcaatcctgccggttcaagcccacgccgatgatgccgttggcccccagcccggcgaggtttccttcattgctccccacgctggaacagctggcaggcaccgtggtgtaaaccggatcggagaccagttggatcggcaccgaactggccacctcgcccgccatcttcacatcggccacattgaccgccccccaagtgtagccatcggcgaactgggcgcactccaccacctgcttgccattcacctgctggctgcccagagcgctgcgcagcccgctgcccagcaccgaggacaacacccgcaaaccgctggaaccggtatccaccagcacatggtctatggtctggcagttgctggcgctgccgggcgcgcacacagtcaccgacacataggggatgttcagctgtccctgggcgccgcttggcccggtatcgacagtcatcgcgacgctattggacgtgctgctgccgttgctaccattcgaaatggccccaccgccgccgcctcctcccccgcaaccgcccaacaccagcgccagcgcgaaccaacccgcaagcatcttgttcatatcgcccccttatttgagctgatccggcgtcacgccggcaggcaacagcgcgctgtcgtaagcgaagcccttgaacgcgcccatccgcccatgcgagctcaccacgaagctgccgacctgcccccgcatcacattgagaccgttgcggttggccagctgggcctgccgataggcggggaaatagctgccgagcagttgctgcagatccggcaggctgccgccgctccaggcgacggcgaataccgtgccgtcggcggcggcgtattgcttgatcagccgcccggcggcgtcctggctctgctgcacgctgaaggcgccgccagccggcgcgagcgcggtcatctgcttgccgccgctcgcggcctgcgcggcatctagcttctgccccagctccgcgcgggccaggagcggcgcggcgagcaatagcaacaaaattttcgaagatgccttcatcatcttgttttcctccggagtctggcgacggcaaccgccactcggcatcgccatggcatgttttcgggcacataacactttcagcatacaagatcgccggcgcgacatcccacgccaacatgttaataaaaaagcgggaggccaaggcctcccgcatcccctcgttcagccgcccggacaatccggctcggcctcacatctcaaacctttcgcatcaataggttaactcgtcatgccgggtttccacccactgtccagcgcccagcgacaacattaacaaagccacgcgctcatgcacgatcaccgtgtgggtgttgccggaaaactgcatgtagcggcgcagatcgtcgcgcaccttgcgcgagccggtgacgtcgatgatgatgtcgacccgctcgccctgctccgcgatctcgatgaaattgtcggtgaccgccacgccgcgctccttggccagcaatacgccgggcagctgcaaatccagatccgccactcccaccatctccacaaatggcgcatccagcagctgcttcagcaaaggcgtgcccgtctctcccactccaaccatgccgattctgaatttttgcatatataccccgcctgtccatttatgcctgtcgtataaccgtcgtcactctagatcaaggcttgcgaaccggatttgaggcaggtcaaaccatcgccgcccaaaatgaaacggcccggcatgggccgggcctggtttcgggaatggctgcggggattcagtgcaggttctgctgcgacaggaagcgcagatagcccagcccttccagccagaagccgccgtccgccagcggcgtggcgtcagtcaggtcggccacggtcaacaccagctcctggccatccagattcgcttccagcaccacgtcgtcgtcgtcggaaaattcttcggaaaccgcatggaagtccggcttgacgaactggttgttgacctgaatgtagtcggactcattcagcatacgcaggatgttcatgatggcctccttttgctgcggtgggaacaaggtcaaacggacagttacgcttcacaggctccgttccggatggccgcactgtcagaccgccatcccatcgacaacccgcatctacagccaaccgcgttcggcaaacgattccgcgtgtccaccggtcaccacgaagtgatccagcaacttgatatcgaccaatgccagcgcgcgcttgagggtatcggtcaacaccctgtccgcagtcgacggctcgctcaccccggacggatgattgtgcgcgacgatcaccgccgccgcgttgtgccgcaaagcccggcgcaacacctcgcgcggatacaccctggtttcggtcagcgtccccttgaatacttcttcgacctcgatcagatggttttgtgccgtcaagaatatcacgacaaatatttccacctcgcgccgccctatgctcagcctcaggtagtccctgacctgctccgggctggacagcgcgtcgcccatccgcatcgactccgacaaggcccgccgcgccagctcggtgcaggccatcagctgcgcgtacttggcttcgcccaggcctggcatggacttgaactccggcagcgaggcggtcaacagccgcgacaaggagccgaaatcctgcaacaggcgccgcgccagctccaccgcgctgacgcccttgatgccggtgcgcaggaaaatcgccagcaactcggaatcgttcagggaaccggcgccttgctgcagcagcttctcgcgcggacgctcggattcgggccaactggcaatcgacattgcgcatcctccctctggctatagcattgtttgtgcctgcaggccaacaagatagaaacaggcaatgacattaacatgccacaatctgccgacgccagaaccatcccgccgccaaatccgctaaaatggccagtttacggctgctttgcgaagacataacgatgactgccaaacgcattcttctcggcatcagcggcggcatcgccgcctataaatcggccgaactgacccggctgctggtcaaggcaggccaccaggtggaagtggtgatgaccgaatcggccacccgcttcgtgacgccagccaccttccaggcgctgtccggcaacacggtctacaccgatctatgggatccgcgccccagcaacgcgatggcgcatatcgagctgtcccgccgcgccgacgtcttcctgatcgcgccggccaccgccaacttgctgttcaagctggcgcacggcgcctgcgacgacctgatctccacgctggccgccgcccgcgcctgcccgctggtcgtcgcgccggcgatgaacctacagatgtggcagaatccgcccaaccagcgcaacgtcgcgcagctgcgcgccgacggcgtcgccgtgttcggccccggcaacggcgcgcaggcctgcggcgaaaccggcgacggccgcatgctggaaccgcacgaaatcttcgagctgctgcaaggcgtcttcgccgagaaaacgctggccggcagaaaagtgctgctgaccgccggcccgacttacgaagccatcgacaccgtgcgcggcatcaccaacatcagctccggcaagatgggctacgcgctggcgcgcgcctgccgcgacgccggcgccgaagtgacgctggtatccggtcccaccagcctggccgcgccgctgaacgtgcgccgcgtcgacgtggcaagcgccgccgaaatgcagcaggcggtgttgacggaagtcggccgcagcgacatcttcatcagcgttgccgccgtcgccgactaccgggtgagaaaccgcagcgagcacaagatcaagaaaggcgcttcggtccccgtcatagaactggaagaaaacccagacatcctggccaccgtcgcatccttgccggccgcgccgttctgcgtcggcttcgccgccgaaagccagaacctgctggagttcgccgaggccaagcgccggcgcaagaaactgccgctgctggtggccaatctggcccagcaggcgatgggcgccgacgacaaccaggtggtgctgctggacgacgccggcgagcacccgctgcccaatatgcccaaggacgaggtggccgccgccatcgtccgccatctggccgccctgctgggccggcgctgaagaatcaaccatcgggcggcctccgcgccgccccgcatcacaaggaaacaccatgccagcccaaatcgacgtcaagatcctggacgcgcgcctgcgcgacaacctgcccgcctacgccaccccaggctcggccggcctggatctgcgcgccgccaccgaagagacgatgaccatccagccgggcgaaaccaagctgatcccgaccggcatcgccatccacctggacaaccccggcctcgccgccatgctgctgccgcgctccggccttggccacaagcacggcatcgtgctgggcaatctggtgggcctgatcgattccgactaccagggccagatattcgtgtcggtatggaaccgcggccaagagccgttccgcctggagccgatggagcgcatcgcccagatggtgatcgtgccggtggtgcaggtgggcttcaatctcgtcgacgacttcgcggcatccgaccgcggcgctggcggcttcggcagcaccggccgcggctgagtccgtccgatcgcgcccgcccgccggcgggcgcttgcctataatcgggaaagcgagggcgcatggccggatgggccgtccgccgccccaggagcctcccgatgacgcagacaccgcttccggatcagaccgaaagcaaactgatactcgacagcctggtcgagctgacgtcgcagcgcgaacaggatatgctggagtccagcctgctctccaccctggtggaggtcatgcgcgtcgaccgagtggagctgttctcctgccgctgggtcaacaacgctccctatatccgccgccggctggaggcccgctccggcgccggcaagccggacatccgcgaaaccagcgccgacagctggcagccgccgccggtttttctttacgagctgctcgaccagctggaccgcggcgacggcatccaccgcattcccggcggcatgtgcctgccgctgcgctgcatgggcagcatcacctcgctggtgatcatccacgccgccggcgacgccaagatcaaccgcgccatgctcaaggcgatggcgcggatacacgagaacttcctgcgcgtgctgttcgaggccgaccgcgacatgctgaccgcgctgcacaaccgccgcaagttcgaccagcgcatctacggcctgatcgccgcgctgcaacacccgcaagccccgcctgacccttgcgtgctggccctgctggacgtcgatctgttcaagcgggtcaacgacctttacggccacatggtcggcgatgaggtgctattgctgctcgcgcagctgatgcagcaaagcttcggcgaggacgacggcctgttccgctatggcggcgaggaattcgcgctgctgctgcaggcgccggatctcgagcaggcggaagcggcgctggagcgctttcgccagcgggtggccctgcatgtgtttccccaggtcaaaaatctcaccatcagcataggctacacccgcgtcaaccctgcccagttgccgggccagttggtggagcaagccgaccgcgcgctgtactacgccaagagccacggccgcgatcagatccgcagctacgagaagctggtggcggacggctcgctggccgcgccgcaggccggcggcgaaatcgacgtgttctgaaggccggacgccgcggcgcccggccccgtcaaccgtcagggcagctggacgatgcggttcagcggcggcgcatccacccgcgcccgcgcctggaagtaatccaccagcacatcgacatccacgccgccgcccacccggttcgccccctgggtcagcacggtgaagccatcgccgccgccggcgatgaaattattcacctgcacccggtagacctgccgcggatccaccgccagcccgttgatgcggatgctggcgatgtcgaccttgctgccggccggcgcggactggctccaggcgtagctgaagccggccgacacctgcagcatcttgggctgggccgggttgctccactgctgctccagcaattggtcgatctgctggccggtcaggtccatcgtcatcatggtgttgccgaagggctgaaccgtgtagagctgcttgtagctgacgctgccgtcgccccccggcagaatgtccgcccgcacgccgcccgggttcataaaggccgccagcgcgccctgcgcctggccggccgccaattgcgcgtcggccaccacatcgcccagcgtggtttccccggcggcgttggaggcgcgggtcagcgggccggacgcctgtcccaccaccttgttggcgataggcgccaccaaggcctgataggtctggatcaggctggcgacgtccgcgcgcggcgcgatgtcctggctcaccacccggttggccgcctggatcgagccggggacaaagcccttggtcgccgggtccagcttgaagtctatctcggtgaacagttggccatagttcttggcgctggtaacccgccggccgtctatcacgcagttgtaggcctggtgtgtatggccggtcacgaccaagcccaccgccttgtccagcttcttgacgatgtcgacgatggggccggagatgccgttgcagtcgttgaagctgccgctttgatagccgccttcatgcaccaccaccaccacagcggacacgccctgcgccttcagcttgggcaccagcgcgttgacggtgtcggcctcgtcctggaagctcaggccctggatgccggtgggcgacacgatttccggcgtccccttcagcgtcatgccgataaaggccaccgggatattgccgtagcgcttgatctcataggccggaaacagcgtgccgccatcggatttgcgcacattggcggccaaaaacttgaacttggcgccggcgaacttgccgccgttccggcaggtggtgctggagccgggcttgcagccgccgttttgcatccgcagcagctcctcctggccgtcgtcgaattcgtggttgcccaccgcgttgatgtccagtcccagcaggttcatcgcctctatcgtcggctcgtcgtggaacaggccggacaccagcgggctcgcccctatcaggtcgccggccgataccaccacggtattgggcgacttgtcgcgcagtgacttcacccaggccgccaggtagtcggcgccgccggcgctcaccttgatggttttgccgggattggccgggtccggcaccgacaaggcgccgggcgtttccagattgccgtggaaatcgttgaaggcgatcagcttgaccgccaccgcgggctggcgctgctgattattgttttcgcctcgtcctcccacggaagaagagtccgacatgcaggcggccagcgccaggctgacgctcaggcacaggctcagcggaatcagtttcattgacttgctccattgttatgttggcgtcccgccgcgggccgctgccacggaccgcatgcggggcctgccaacatacacaagtcgaatgaaatttaataaacgtttttcatgaaattcagaaattaaattctgaaaaatatccttttcacaacaaaattccgaaatgaaaaacgccgcgagcaagctcgcggcgtttggcgcctccggcctcgcggccggaaatccgtttggccgatcaggccagcagatggttgttcagctcgcgcatgccggcggacagcatcgccaggtccagcgcgctgaacgattgcagttcggcgaacatctggccgcacacttccaccgccgcgtgctgcttctccagccactgcaccgcgaaggtttccgtcgccgcgccatccagcagagcctggcgcgccaggttgcggtgcacgcggtacaggtcgtcgcgcagcgccgagcgcgccagcgactgccagcggttgtcgcgcggcaggctggtgatggcgtcgcgcagccagtccagctgcagcgtgctgcccagctggaagtagttggcggccacctgttccagggtcagcttgctgccctcgctgatttcgatgatgtccatcagcggcacggcgaactccaggcgcgccagcacctgggtcagcgcctgcggcagattggcgtgggcgatgcgctgttccagcgccgccaccgccgggtagcgttccgacggcaccagcttgggcagctgggccagcaggccctgcaccttggcagcgtactgttcgatcacggcgttgaccgagccgaacggacgcttgttgcgcagcacccagcgggtgacgcgctccaccagcgtgcgcaccagcaccatcagctgcatctgctgatcggccggcaccttgttgtccagcgcctcgatctggccccacaggctttccgcgtcgaacacgcggctggcgatccaccatgcgcgggagatgtctgccgcggagaacggcgactcttcctgcatgcggaacacgaaggtggtgcccatgcggttgatgatctggttggccagctggttggagatgatctcgcggcgcagctgatgctgttccatctgcttgccgaagcgctgttgcagcggtttcgggaagtagttgaccagcaccggcaggaagtcgcggtcatccggcagatcggtggccaggatggcctggtccagcgagatcttgctgtaagccagcagcacggcgatctccggcacggtcaggccctggcgggccaggcggcgctcgttgatctgggtttcggacggcaggtactcgatctcgcggttcaactcgccggtcttttccatgtgcgcgatcatacgcgcatgggtggtcagcatcgccgccgactcctggcgcttgatggccaggatctgggtctgcagcacgttgttgcgcagcaccaggtggcccacctcctcggtcatctcggccagcagctcgttgcgctgcttcagcgtcatgtcgcctgcctgcatcaccgcgcccagcaagatcttgatgttgacctcgtggtcggagcagtcgacgccggcggagttgtcgatggcgtcggtggcgatgcggccgccggccagcgcgaattcgacgcggcccagctgggtgcacgtcaggttgccgccttcggcgaccacgcgggcctgcagctggttgccgttgacgcgcaccggatcgcaagcgcggtcgcgggcgtcagcgtggctctgcgtcgatgccttgacgtaggtgccgatgccgccgttgtacagcaggtcgatcttggccttgaggatctcatggatcagctcgttcggcgccatctggtccttgtcggtttccagccacgccttcacttccggcgacagcgggatggacttggccgagcgctcgaaaatgccgccgcctttggagatcagctcgcggttgtagtcggaccagctggagcgcggcagattgaacaggcgcgcgcgctcggcgaagctcttcttcgcgttcggcgtcgggtccaggaagatgtgcaggtggttgaacgccgccttcaggcagatgtgctcggacagcagcatgccgttgccgaacacgtcgccggccatgtcgccgatgccgatcacggtgaaatcctgctcctgggtgttgacgcccaggtggcggaagtggcgcttcaccgattcccacgcgccgcgggcggtgatgcccatgcccttgtggtcgtagccggcggagccgccggaggcgaaagcgtcgcccagccagaagccgtaggcttccgagatgccgttggcgatgtcggagaaggtcgcggtgcccttgtcggcggccaccaccagatacggatcgtccggatccaggcggcgcacgtccttaggcggaatgatctggccggtcaccaggttgtcggtgacgtccagcagcgccgagatgaagatcttgtagcaggcgatgccctcggccaggaaggcctcgcggtcggacggcgccggcagttgcttgccgacgaagccgcccttggagcccatcggcacgatcaccgagttcttcaccatctgcgccttgacgagacccagcacttcggtgcggaagtcttccatccggtcggaccagcgcaggccgccgcgcgccaccttggagccgcgcaggtgcacgccttcgacgcgcgggctgtacacccagatttcaaacagcggacgcggctgcggcaggaacggaatctggttcgattccagcttgaacgaaatgtaggatttgaactcgccgtcggcgcccttctgccagaaattggtgcggcgggtggccagaatcacagccaggaagccgttcaggatgcggtcttcgtccaggttggccacgccgtccagcatgccgcgcacggcggccagcaacagttcggccttgtcgtcgtcgaagccggccggatccaggcgggcatagaacagctcaaccaggctgcgggtgatggccggatagttggccacgcactgctcgatataggcctggctgaaggtcaggccgccctggcgcaggtatttggccagcgcgcgcaccagcgaaatctcgcgccaatccagcgccgccaccagcgccagacggttgaagccgtcgttttcgcaacgcctggcgaagacttgggccagcaactcctggaagtcatgctgcacctggtcctgggccatctgctcgccgaagctgccgacatccaggccgaagtcgctgatccatacctgggagccgtcgccgcgcttcacgcagtacgggtgctcgtcgcgcaccttgacgcccatgttttccaggatgggcaggctggcggacaggcccatcggctcgctctcgcggaacagcttcaggttgaacgccgcgccgccgcggtggaaggggcggtacagcttcatcgccaacggctggctggcgtcgatggcctccagatgctgcacgtccagcaccgcgttgcgcaccgcgaattcttcgcggtaagccagcgggaagccgtctttatagcggttgaacaggccgttgccgcgctcttcgccatgagcttccaccagttgctggtgcagctcttcgctccaaccgcgcaccaggcgcgcgatttcggcctcgatgtcggcggtgtggaattccggcagcttggcggccgcggtgcggatgatgtagtggacgcgggccagggtgccgtcgccgatctgcacgctgaattcggcgctgctgccgttgaaggcgttcatcagcactttttcgatcttcagccgcacttcggtgctgaagctgtcgcgcggcacgtagaccaggctgctgacataacggtggtagcggtcggcgcgcacgaacaggcgcacgcgcgggcgctcctgcaggctgacgatgccttcggcgatcggtcccagcacttcggccggaatctcgaacagctcgtcgcgcgggtagctttccagcacgaagcccaaggtcttggccttgtagctgtcgtcgacgaagtcgcagcccttgatcaccgcgccaactttctggcgcaggatgggcacgtccttcggcgacatctggtaggcgctggcggtatacaggccgaggaaacggcgctcgcctatcacttcgcccttgtcgttgaagcgcttgatgccgacgaagtcgacataggccgggcggtggatgatggagcgggtctgcgatttgttcaggatgatcagttgcggcaggtgcgcgagctcgcgcagctcctgcggcagctgttcgaagctggcggaatactctttgtcgccctggtcctgcaggatgcccaggccggatttcttgacgatcttcaggctgtccttgccgtcgcgcttgaccaggtcgtagtcgcaatagcccatgaacaggaagttgcggccggccatccactccaggaaggccacggcctccttggcttcgacagcgcgctcgcccttcagcttggcgaggtccttgccaatgccggccagcacttcgcgcattttcggctcatcgctgaccaccaggcggatgtcggccatcactcgcttgaggtcggcttccagctgttgcagcagcgccgcgtcgctgatgcggtcgatctgcacatggatcagcgattccagcggcaagctgcggtcttcggtgcgcttgatttcttgcagcgcgccgctcttgtcgcggcccaccgccagcaccgggtgcaccaacaggtgcaggttgaggttgtagcgcgacagcagcatggagatcgaatcgatcaggaacggcatgtcgtcgttcaccacttcgatcaccgtgtgggtgctttgccagccgtcgcgttcgaaatcggggttgtagatgcggcacttgacctgtccggcagagcgtttgccggcgaactcgtaatgcgccatcgctgcgccgaacagatcgagcgaggagaactgccgcaggtcggcgtgttcggtctcttcgaagtagatcgggaagaaggcggcgagttgttgggtctccttggtagaaagcttgctctcggctacggcctgaatatctgcgatcaggcttgccagttcggtcttgttggtaagcgacatttagcttctcttgttgtgagcagggaggttgtcggggcattgtagatagcactacccgcccgggatttccttaatgcgacatggtcttacataaaaatggtaagccctattccgaaggcaatacgccataggcatccaccccggcggaatcctcgcgataccttacagcaaagcgacgggctgttacacaaagactattgcagagcgcattgtagacaactcaacaattagtgcataagtatttgatttttatgatatttccatttttgcaccaaagtaaggtagaatgtgcgcacttgcttatggggattgaccaattccgccacttgttgttccagtcggcggcgccccatggccgccaataaacaaaagacggcccggatcggaacaataacgctgcctccggtgcggggtttacaagcgggttgcccgcgcgctgcgcgccacgcgcccaaatagagaagcagaagcaacatcatgaaaaaagccctgatcgcaagcgccagccttgccttgttcgcctccctgtccgcccaggcggaaactctgcgcttcggcatcgacctcaactacccgccgttctccaagcaaggcgccgacggcaagccgcagggcttcgacatcgacatggcctacgcgctgtgcgcggcgatgaaggccacctgccagatcgtgccgcaggactgggacggcctgatcccggcgctgaacgccaacaagttcgacgccatcatctcgtcgatgcagatcacccccgagcgcgagaaggcggtggacttcacccacaagtactacaacatcgccagccgcatggtggccaagaacggcgccaaggtggacccggccagcctgaagggcaagaagatcggcgtgctgcgcgcctccacccaggaaaagttcgccaaggacttctggggcaagagcggcgccagcgtagtcgcctacgccaagtcgcctgaatccttcctcgacctgaagtccggccgcgtggacgccgtcttcgtcgacagcgccgtcggcgagcaggaattcctcaagacgccgcaaggcaagggctacggcttcgccggtcccaactactccgacgtcaagtacttcggccccggctgcggaatcgccgtcaagaagggcaacaaggctctggttgagcgcctgaacaaagccatcgagcaaatccgcaaggacggcagctacaagaaggcccaggacaagtacttcagcttcgacatctacggcggctgaccccggcatcctccctcggacgggcgcgcccggcgcgcctgttccggcaatccccttttccgagattgcttcatgcttcaaggctatcttcccagcatcctcgaaggcggcgtgctgaccctgaaactggcgggcaccgcgctgatcgtgtcggtcgcgctcggcctggtcggcgcgctgttcaagtccagccaatcgcgcgtactgacgctgcttgccgagctctactccaccgtggtgcgcggcattcccgacctggtgtggatgtttctgctgtttttcggcgcgcagatgctgctcaacgacgtctgcggctacttcggctggcaaagcccgaacatcgatcccttcgccgccggcgtgctgaccctgggcttcatcttcggcgcctacatgagcgaaaccttccgcggcgcgatgatggcggtgcacaaaggccaaatggaagccggcctcgcctacggcatgtcgccgctgcgggtgtttttccgcatccagctgccgcagatggtgcgctacgcgctgcccagcttttccaacaactggctggtgctggtgaaatccaccgcgctggtttccgtcatcggcctcaatgacgtgatgtaccgcgccgacgccgccaaatcggccacccagcagccgttcgatgtctacgtcgtcgtcggcatgctgttcctcatcgtcaccggcgcgtccaatctgctgctccactggatggagaagcgctattcgctgggcgccaaggagagcggactgtgatcgatcccaaactgattatcgagcggctgccggaatttttcggcgcccatgacggcgggccgatgctggccagcaccgacggcctgatcctcaccttgcagctgctgggcgtctcgctgctgctgggcctggcgctggccatcccgctggcgctggcgcgggtttcgcaaaaccgtcctctgtccggcgcggtatggctgttcggctatgtgttccgcggcaccccgctcttggtgcagctgttcatcatttactatggcctcgcgcagttcgactggatccgcgacagctgggcctggcagtatctgcaaaacgcttacgcctgcgccatcctggctttcacgctgaataccgccgcctacaccaccgagatcatcgccggccagctgcgcaacacccactggggcgagatcgaagccgcccgcgcgatgggcatgagccagtggctgatgctgcgccgcatcgtgctgccttcggcgctgcgccgcgcgctgcccgcctacagcaacgaagtgatcatgatgctgcagagcaccgccatcgccggcctggtgaccctggccgacctcaccggcgtggcgcgccgcatctatagcgaaagctatatgccgttcgagcccttcctcaccgccgccgtcatctacctgggcctgactttcatcctggtctggctgatgaagcgggccgagcgccgctacctggcctttctcgcgccccgcaagtcataagcctgcaaacgatagcaagcggcagcaattcttctgcctgccggctgaaataaatcgtacaatgcacggcaagatacgccgccatgccaggcctcccggcatggcggtctttttgccaaccgagtacagacaatcacaccatgggtcatccgccccaaaccggcaaagccctgcgctttggcttcctgcttctgccccacgcctcgatggccgacttcgccgccgcgtccgaggtgctcgcccacgctaacttgctggcggaaaagcgcctgtacgaaactctgctgctgtcgctggacggcggccaggtgcagctgtccaacggcgtcaagctgggcgtggacctgccgctgtcctacgcgcccaagctggactatctgctgatcctggccgatgaaatcggcaacgaattcgcgctggaagagttgagcaagggcatcgccgcctgcaacaccgacaagctcacgctgggcggcataggctgcggcagctactggctggcccgcgccggcctgctggccggacagcgcgccaccatacactggcgcgaaatctcgcggctgaccgaggagtatccggatgtgatcgtcacgtccaatctgtatgaaagcgaaggccgctatctgagctgcgccggcggcgccgccaccttcgatttcatgctggacttggtgggcaaacagcagggccatgaattcatcgcccagctgtccgagctgttcagcatggagcgcatccgcccgggcaacgagcgccagcgcatcccgctggccacccgcatcggcggcagccagcccaagctgaccgaggcggtcagcctgatggaggccaatatcgaagagccgctgtccaccgacgacatcgcctactacgtcggcgtctcccgacgccagctggaaaggctgttcaagcagtacctgggcacggtgccgtccaagtactatctggagctgcgcctgggccgcgcgcgccagctgctgcagcaaaccagcaagtccatcgtgcagatcggcctggcgtgcggcttctccagcggtccccacttctccagcacctaccgcaaccacttcaacatcaccccgcgcgaagagcgcgcccagcgcacccagaccagcgcgctgcagcgccagcccgcccagaccgagcgcggctaggtcagctggcgctccgcctgcagcgccagcggcagctcgatgcggaagcaagcgccgctggccggtatgttttccgccgaaatcagcccgccgtattgctccacaatggtctggcagatcgacagccccaagcccatgccatgcggcttggtggaaaagaacgggtggaacagcacctccagcaggtccggtgtgataccgcggccggtatcgcgcacctccagtatgcctttgcgcccctcgcggcgggtatgcacgatcacatggcgcttcatcgccggctcgtcgcgcagggcatccatcgcattggacagcaggttcagcaccacctgttccagctggatgctgtctgccatcaccggaatggaatagcctgacagcagctgcaccacctccacgccgcgctcgcgcagatcgtactccaccagaaacatgcagttgcctaccacctggttgacatctatcagccgcgtctctatcgcccgcttgctgaccagcgcccgcagccgcttgatgatctccccggcccttcccgcctgcgccaccgccagcttgagcgccgaattcacctgcggcggcgcgtcctccaccccatccagcagctgcatcgccgcctggcagtaattggaaatggcggtcagcggctggttcagctcatgcgcgatgcccgacgccatctcgcccatggtatgcagcctggccacatgcgacagcttttccaggtgctccttcacccgggtttcgctggcctccagcgcctccgccgtgcgctggcgcaacggccccatatctcgcagcgcgcataccacgccgatcaacacgccctcgcgcgacagcagcggcgccaccccgccctcgacgaaatgcaccttgccgcgcgcagtggtcagctgcatccgctccgccagttccaccgggcggcctgtgcggaagcactcgctgatcggatcttcggcgaactccgacgccaactcgcccaacaaccggaacacctcgtggcacggctggcccagcacttcctcggccggcatgtcgaccagccgcagcgccatcgggttcgccatctcgatgcttctgtcttgccgcagaatcaccacgccgtcatggatcgcgctcagcgtcaccgacgcgcgctcgctctgcaggaacagctcctcgtcggcctgattgcgctcccgccgcaaggccatccgctgcgaatagatcaagccgaccgccgccagcagcaaggtgatgaacagctcgcgcagcaataacggcagcaaggcgaggtcgttcaaacgcacatcctgggccacgccaagcacgaaaggctgcgcctcgctgctcagaggaagccgcgcctccagccgcgtcaccaccggccaccaatcatgctcggcaaagcggtgcagacgttgatacaaaggttctacgccatcgcccttgggcaatagcgacagatccaggctgcccggcagcccctgatccaccggcaactgcaacaatctgtcgtagaacaccaccagcgccaccatgccggccagctcgcgcgcgccggatgccctcctcggctcggccgatggacggaacaaaggctgcatcagcatgtaggctcggccgccgccatcgtataaatcaaagggacgagaagacaccttttgcccgctggacagcgccctgcgcaactccggggcgaaatgcgggtcgcccagcacatcgtaaccaaacaccgggctaaccgccggcagatccggttctatcatcgacaccaccagcgactgcttgcgcaccggcgccggctgccagctgcgcttgcccatcacgtcgaaatcgcggatataaaaggtctcgccgaagcgggtttccatttcacgcaaaaacggaccgcgattctcagccgtgacattgcggaagaattcaatcgcataaagctgttgatagcgcggcaacatttctcgcgaaaacgcgctcaaagccttggcatcgagcggctcgcgcgacaacagcagggcatctatcgccgacagcaccgactcgttctgatccaacctgcgcgccacgcccgcgtatgcctgatgcgcagccagctcgaatccatcctgcagcctgcggtactcacccatcgcccactggctcagcaccagcagcgcgcaaaccagccagatagcaccaaacagaagccactcgccacctttgaatttgctcaagacttccgccccagggatatatctgacatttcaaataatatgcattgcataaaacatctgccgcgcatttttgcaaaaatcgctcaagcaggcaatgaccgcgagccaggcgcctagccgcaccagctgaagcgttgaaacaaggcccgcgatcgggcaagcggcacgtcgactgcccagtcaaagcccgccaggcgcctggcgggcagcgggatgcgccccctcgcggggactggcggatgggcagcggcgacggacggtcgccgcgcgggttcggggaggggacggcaaggccgaaacggcgccgccccacgggcggcggccgaaacgcagaaaccccagctcatcgagctggggttctgtatggggcgtctggcggtgtcctactttcacatggcgaatgccacactatcatcggcgctaaggcgtttcacggtcctgttcgggatgggaaggcgtgggaccacctcgctatggccaccagacataaactgtacaaacttaaagaagcccgaacccgtctctcagacagattcgcatatattcggtatttgacgtacgtcgcacatccactctcttgtgtctcagtttcccaagccactcaaatgataggatcaagcctcacgagcaattagtatcggttagcttcacgcctcacagcgcttccacacccgacctatcaacgtcctggtctcgaacgactcttcagggaggtcaagcctccagggaagtctcatcttcaggcaagtttcccgcttagatgctttcagcggttatctntagttagccggtgcttattcttccggtactgtcatccccgccaggtattaaccagcgggatttcctcccgaacaaaagtcctttacaacccgaaggccttcttcagacacgcggcatggctggatcaggcttgcgcccattgtccaaaattccccactgctgcctcccgtaggagtctgggccgtgtctcagtcccagtgtggcggatcatcctctcagacccgctactgatcgtcgccttggtgagctcttacctcaccaactagctaatcagacatcggctgctcgtataacgtgaggccttacggtcccccactttccccctcagggcgtatgcggtattaatccggctttcgccgagctatcccccattacacggtacattccgatgcgttactcacccgttcgccactcgtcagcggtgcaagcaccctgttaccgttcgacttgcatgtgtaaagcatgccgccagcgttcaatctgagccaggatcaaactcttcagttcaatctcatagcaaattttctggcacgcaagttcaaagaaataaacaagtatctcttgtctcttgcagtgcaagtttttggctttcgccaaacacttacacctatcggttattctgtctgttaaagagcggtgccgatcgctgcgtcgtcatcaccggaaccgtttcgtttccgccgtttcgttcgctgcgtcagctgaggaggcgaactatacgcccgggacccgcacccgtcaacaccttgcttgcgaaaaatcagaaaaattcatcgcaaaccgccccgcgcgccgccaagcccatgatctggctgaagatatgaacacagggtatttgcaaaagccatcgacaaaacggatggcgcgccgccagccccgccccgaaaccccgaaaacaaacaggccggcgcacccgccggcctgcttcaacccctctcatcaggccttatagatgatcaagcagctgcagcgggtgatcgatatcggcatccgccccccactgctccggcttgtcgtccgccgagaaatagccccagttgaccagcaccgtcttcatgccgacattgcggcccgcctggatgtcgcgctcggcatcgccgacatacatgcaatgctcgggcgcgatgccgatctgttcggtggcgtgcagcatcggacgcgggtcgggctttgccacgcccacggtatcgccgctgacgatgacagctggcggaatggcgaacggcagccacggcaccaggcggtcggtgaagcgcatcgacttgttggtgatgatgccccaggccaggccgcgcttgtccaattcggcgatcagctcgttgacgccgtcgaacagcgtcgtctcctcggcgaggttggcgtcgtacagatccatgaagcgcacccgcagcgactccatccgctcggcatcgagtccggcaccgaagcccagccgcaccaggccgcgcgcgccatggctggccatcggccggatcgcctcgtatggctgcggcggcaggccctcttccttcagcaggcgattcagcgccgcgcccaggtcgcgggcggtatccgccagcgtgccgtccaaatcgaacaatactgccttgatcatgattcctgcttcaccagattggaaataaggccgacattgcaccatcaacggatggtcttgccaagaaacagccgataggccggattatcggtttcctctatataagggtatcccagcgtttccagaaactgctggaaggcctgcgcgtcgcccgggggcacctggatgccgaccagcacccggccatagtcggcgccgtggttgcggtagtggaacagactgatgttccagtctgtgcgcatcgcctccagaaaacgcatcaacgcgccggggcggtcgggaaattcaaagcgcagcacccgctcgtctttcagctgcggcgcatgaccgcccaccagatggcggatgtgcagcttggccaattcgttatcggtcaggtcgatgccgtccaactccgccgcgcgcaagtccgtcaacaagcgctccacatcttccttgccggcgatctgcacgccgacgaacacgtgggcgacgctggggtcggcgaagcggtagttgaactcggtgatgttgcggccgccgatcaccgaacagaagcgcttgaagctgcccggcttttccgggatggtgacggcgatgatggcctcgcgccgttcgcccagttcggaacgctccgacacgtggcgcaggcggtcgaaattcatgttggcgccgcaggagatcgccaccagcgactgcccggcgcagccttcgcgctcgatgtatgccttggcgccggccaccgccagcgcgccggcaggctcgacgatggagcgggtgtcctcgaaaatatccttgatcgccgcgcagatggcgtcggaatcgaccaggatgatctcatccaacaattcgcggcagatgcggaaggtttcctcccccaccagcttgaccgccacgccgtcggcgaacaggccgacgtctttcagctccacccgctcgcccttctctatcgactggcgcatcgcgtcggagtccaccggctgcacgccgatcaccttcacctccggcttcagccgcttgatgaagctggccacgccggcagccaggccgccgccgccgatggcgacgaataccgcgtccaggtcgtccggatgctggcgcaggatctccatgcccaccgtgccctggccggcgatcacgtccggatcgtcgaacggcgggatataggtgcggccgctctcttccgccagcttcaccgcgtgcagataggcctcattgaaggaatcgcccgacaacaccacctggccgccgcgctgcttcaccgcgtcgatcttgatctgcggcgtggtcaccggcatcacgatcaccgcttcacagcccagcttgctggctgacagcgccaccccctgcgcatggttgccggcgctggcggtgatgacgccgcgcgcgcgctgctcggcgctcagcttggccatcttgttgtaggcgccgcgcagcttgaacgagaacaccggctgcaggtcttcgcgcttgagcagtatcttgttgccgtagcgccgcgacagattcggcgccagctccagcggcgtctccaccgcgacgtcgtaaaccctcgatgtcaggatgcgttccagatagtcttgcgtattgctcatagcgatgccttcgtccctgtagtttcttgtatttgaactgtcagagtatcaggaactccaaacgaacgggaggcccgccgcgcactgtctgctgcattgcaatatcaacgccggttcgggtttttccggcaacggtggtggccacagcgtgtataatcagcggctactgtttgtgacccctaagcaagtcctctccaaaatgaaaaaactcaccactgccctggtggccgccgccctggcgctgccgtcccttggctttgccaataccgccttcaccccgccggcgccggacatcgccggcaaggcctactacctgctggactacaacagcacccaggtgctagccgaacgcgaccccgactcccgcgtcgagccggcctcgctgaccaagctgatgaccgcctatctgaccttcaaggcgctgaaggaaaagcatctgacgctggagcagacgctgaccgtatcgcaaaaaggctggaaaaccgaaggctcgcggatgttcctggatccgaaagtcccggccaaggtggaggacctgatccgcggcatgatcgtgcagtccggcaacgacgcttgcgtgacgctggccgaagccatcgccggcagcgaagacgtattcgcgcagatgatgacccagcaggcgcagaagctcggcatgaagaacacccagttcaggaacgccaccggcctgccgcacgccgaccactacaccaccgtgcacgacctgggcatcctcgccgccgcgttgatccgcgactaccccgagttctatccgatctactcgatgaagtcgttcacctacaacaacatcaagcagcctaaccgcaacctgctgttgtaccgcgaccccaacgtcgacggcatgaagaccggctacaccgacagcgccggctacaatatggtaacgtccagccaccgcgacggccgccgcgtgatctccgtcgtcgtcggcaccgccagcccggaagcccgcgcggtggaaagctccaagctgttgaactacggcttgcaattcttcgacacgcccaaactttatgcagcgaacacccgcgtctccgacgtggccgtctacaagggcagcgacaagatggtggcggtaggcttcggcagcgatgtttacgccaccgtggccaagggccaggccgccaagctgaaggccgacctgaccaccatgcagcccttgatcgcgccgatcaaggccggccaggtggtcggcaagctgacggtttcgctcgacggcaagccgctcttggagcgtccggtggtagcattgaaagcggtggaggaaggcaacttcttcagccgcctgtgggacagcctgaagctgatgctgggctggaagtaaccgcggcagcggttttggcggcgccccggcctggctgcggcgccgccggtttcgcaattggcaagagtagatctgacatgtctgatgaaaaacaggaactgatggagttcccctgtcgcttcccgctcaagatcatgggcgagcggcacgacgaattcgtcgccaccatcaccgaagtggtgcgcatcaacgcccccgacctcgccgaggtcgacattgtgctgcgcgaaagctccggcggccgcttctacgcgctgaccgtcaccgtcaccgccacctcgcgccaacagctggacaacatctacctgtcgctgaccggccaccccatggtgaaaatggtcctctgacccgggagctcaggtgcaacgcatcatcaaacatttgggcctggccgactacgagccgacctggcgcgccatgcaggcgctcaccgaccagcgcgacgacgacacccgggacgaactgtgggtggtcgaacacccgccggtgttcacccagggactggccggcaagccggaacacctgctgcagcaaaacgacatcccggtggtgaagaccgaccgcggcggccagatcacctaccacggtcccggccaactggtgatctacctgctgattgatttcaagcgcatgcgcatcggcgtgcgcgaactagtgcgccacatcgagcaggccatcatcgacatgttggccgaacagggcatcgccgccaacggcgatgtcgacgcgcccggcgtctatgtcgacggcgccaagatcgcctcgctgggcctgcgcatcaagaacggcgccacctaccacggcctgagcctgaacgtggacatggacctgagcccgtttggctggatcaacccttgcggctacgccaacctcaaggtgacacaattgaagaatctgggcgtgaacctcacggtcgccgaagccgccgacaagctgctgccgcacctggaacgccacctgagcacaagcaaggagaccgcatgaagccggacaaccaggccggggtgaagcacaagggcgcggccaagaccgcccgcatcccgatcaagatcgtgccgctggacgaaaagctgagaaagccggagtggatccgcgccaagctgcccaacagccagcgcttccacgaaatcaagcagatcctgcgcgatcagaagctgcacaccgtgtgcgaagaagcctcctgccccaatatcggcgaatgcttcagcaagggcaccgccaccttcatgatcatgggcgacatctgcacccgccgctgcccgttctgcgacgtcggccacggccgccccaacccgctggacgagaacgagcccaagcatctggccgagagcgtggcggcgatgcggctgaagtacgtggtggtcacctcggtggaccgcgatgacctgcgcgacggcggcgcccagcacttcgccgactgcatcaacgcggtgcgcgccgcctcgccgggtacccagatcgaaaccctggtgcccgacttccgcggccgcctggacatcgccatcgacatcctcagcggcaccgcgccggacgtgatgaaccataacctggaaaccgtgccgcgcctgtacaagcaagcccgccccggcgccgactacgcccactcgctgcagttgctgaaagactacaaggcgaagaacccggacgtgcgcaccaagtccggcctgatggtgggcctgggcgagaccgacgaggaaatcctggaagtgatgcgcgatctgcgcgctcacgacgtggacatgctgaccataggccagtatctgcagccgtcggacggccacctgccggtgctgcgctacgtgcacccggatgtgttcaagatgttcgaggaaaaagcctacgaaatgggcttcgtccacgccgcggtaggcgcgatggtgcgctccagctaccacgccgacgtgcaggcgcatgaggctggcgtgtaaactgacacgtccaacgctaatggcgactaaacaacgctaatttgtactctacatcgctaaatgctactgaggagggcgggtgtgcgaaaggcaattccaaagatcaaggagtttccagacgacggccgcatctggagggtagattggtttggcggtgtagagcgcaatcctcagattccctccgaacctaaaatccaactcatcatcagcccggtggtggatggcgccatcgattacgctgccagcaactccgtcaatcacgaagaacgtagctcaatcagcatcggcattggtcagcttcccctcattaccatcggttcgctttggcaaaaccggcattgcttgatcgaaagtgccggcaaaaccaaggtcttcgaaaatctcgtcatctcgcctaagacggccctcttggtaaaatcggacgctctagtaggcgggcagccactcgtccgtaaaaagtaccaccagatcggcgcagggcttgctgcaaactgcttggctatcgaatggcagggagacccatacggcatcatcatcccgacagccgaggtcattcgtttttactatgccacgtcaacagatctcgccaaggccatttttgctggcgattttcgacatgaactgggttcaatcgtgaatccaactcagtgcggttacatcaagcaggaaaatcgctgcatcctcaagttgcgtaaggagtttgccgatgcggatgcctggactattggacgcatactgaatagccatgaagcgttcaatggtgccgtcctagtgcatgactcgatgatcaagcaagccgtacagagtaagtcccgcctgtatccagaagctgcgtttccttttgtcggggaaaccaacctacgggtgcggatgaaagcgatgaggtcgccagatgagaaacgctggcgtttcatcgtttttgcgttggaacactgcacgggaccatttccattcagtgctattacctgcgaccgtgataacagcaacctgcgcccagaggaagggcatgatcagccggatgaattgaaggcccctgcatatcctcgcaagcagcaatcggggaaggatgttaccgatggcgaattgcagagcaatgaggatgcctccaaggagatccagtcggctgttattgatctacctgaagggcggtttggcgcgctggcgaatatggaattggagaagcccgagaagaatatttgccactatttcaacgcggggagtgctcacccgctcgagctcccctctgatgtacttggcacgagcgatggcaattattctggtggtatcatgacgcaaacgtcaattgaggttaagcatgagcgccaagaggcgttgcccgcgagttttgcaaacttcgaggcgatggtgcgacatctggatggtttgcctgggtaccaagcaaagattcgccccagatctgatgccacaatgcacatcccgctgacgaaaccacaccgggcttggcagtggagttacttggattcgggaacacggcaaagacgtgcagttgtaattgcagacattacgcatgattgctgcgtgtacagcttagttgagtttcagtggcgagaagaggaatcgtttaagctcgcaatggtgtcgttatctggaggcgccaggctgagcgatgagcaattgcacttactgctcagaatgttggctaaaaaggaaggtcgctggggaagcactaagccattaccctggaatgccaagcttatcaccttcaagcacacatggccttccgttgacgcatatgcccaggcaattttggcaagagtaagcacattttcaaattaagaattacttttttgttttgctaaccaatgtagctgtgttgtagtagggtgaattttgacataatacatgctatttaagttatttaagcgagaggaatatggaaatggtaaatccagggttcaggaatcaagacgaggtttctctaaacaggcttcaccttgacacccagaacccaagacatgacccacttgaagatgaagatgagatcatcgctcagctctacaaagacgaacaggttctgaatcttgcaaaggatattgttgccaaaggaacgttgagtcctcttgaccgccctggagtgattgaaatggacgacaatcctggtcactacatcgtcgtggagggaaatcgccgaacgtgtgcactcaagctgttgcatgacccgcagaaagctcctactccagaagttcgtgctacatttgaagctttgtcaaaaaggtttgaagtaccctcctcgttttctgtcgttgtatttacagatcgcaatgctgctcgcccatggattggtttgcgtcacttgggggctcaggaaggggcgggaactcgcacttgggatgctgcacaaaagtcccggtatgctgaaacagaatcgcccaatcagttagcattggcgctgctggaccacgcggagaaatccggctggatagatgccgatatgcgtgagcaactggcaattactaccctcacgcgatatcttagtagcccactggtacgtgccgcacttgggcttggaaaccatcgagagctgttatatacccatgatgcttctgaagtagaggccgcgctacgtcagtttcttgctgacgcggctcctgtgcatgacggaggtgtgccacgtgttcattctcggtctagaaagttggaacgagaagcatatgccagagagcttgccgtgcgagggatcactcctcggagcttgttgccatttccaagtcagcctcctgaacctggttggcaggatgacctatctcccgacgtagtcgaacccgctccaattcatggtgtagatcctgggccagaaccccttgaccctggcattactcctccgcaacctgaaccggatcctttaccacccgcccctgatccaggcaagcccgctcaaccaagacctccacgtgggaaacaacatccggatgatcgcatgtacctcatgccaacggactttactttcactcatagtgataagtcactgcgtcgtttgcgcggtgaatttcgcagcacgccaatcgatgatcatgagttcgcagtaaattatctgctgagagcctttatcgagcgggtgttggttctctatgccaagcaccgaggggtacataggtcaaagatggcagatcagaaattggtgcaagtttgtgtagaggaactgggcaaagaaggcgtgccagataacgatctgaaattgatgagggttgcaatgtctgacgaaaactcggcgcatagcttgcataccttgggtactgctgttcacacaagccttgtcgcaactcgaaagagcctggtgggggcgtgggataactgggagaaggctctaaaaataatgctttctcgtatgtaaaaatgtctggccagccggggtcatttttgctatcgtaccgccatgcctacgactgaatccccattgagatacccaggcgggaagacacaactaacgccatttgtgagcgatcttctacgtgtaaacgacctccagcaaggcgtgtatgcagagccattcgctggaggagctggactcgcctggagactgctgctgtcaggccaggtaggcgaggtatggcttaacgatattgatccctgtgtttatgccctgtgggatgctgtactcaatcagccaggggcgttgtgtgagctaattactgaaacaccaataacgctagatgaatggcatcatcagcgtagcgtatttttggatagcaatgcaccaacgctggatcgtgcgttttcaacactgttcatgaatagaacgaatcgttcaggcatcttgcttggtggtgtgattggcggaaaatctcaagagggtgcatataaattagattgccgttttaatcgcaatgagttggttcggaaaattcaacgaatcgcacgccatcgtgatgtggttcgactaactcggcttgatgcggccgagtgcattactcaatggtcagaacaacttcccccgcgatcgcttataaatattgacccaccttattttgcaaagggtcaagagttgtatatcaatttctatacgccttcggatcacgccagtcttgctgctgtaattcgtaagctacggtgtccgtggatgctgacatatgatgatgtacctcagatcgaagagctatatgcaggtcttccagtctatcgaaagagccttgtgtattatgcgcaagttaagcggaaggcaaatgagctgttggtgctttctccgcagctacgtgcccctgatggtttggtgagtccgattattgaggcggcctagtaaaaatagtcatagcggatcaaggtccctttcgtttttgtgtccttgttcctatttttttcaagcttaattgctggtgcagtttatctgcagcgtttctataccatgatggggcgtggctgaagtcacgcattagccagttgtacttaagcgcgcgttgggtccaggctacccaaagtcggcttggccacctccctatcaaccaccaagccaagcccataatgtagtgtcgatcgattagctcccggctctcgattgatagctttccagtcaccattctgggatgagcaagtccagtccttgtcgtgacatattccgccagtttttgtttcgcgccattgctagatagcaacttggccatttggtgcaacaccgccagcatgtcgtaatcaaacctgctagatgaaggcgttccgctatcgattatgcgtaacactttctcccaggactggaaagtacgcccgttccatttgtggactggttcgattttcgattggcgataatcaaagctgcacgcccagcagatacagagcggctccatgctcatttctcgggggtgtcccagttcaatccggtgataggccacgccttgcccacactgtgggcatcgatctagcaacatgcaattatgcttggggcagaaggtgtagagtgcgacacgccatgctcggcggaagtagggctctacgtcctcgctcaagcaaattggacagaattgcatgccatgcccaagtcgcttgcggtgatacatttgaagcgaaagcatccattttagttggccggatgccttctcttgctcgaatagtttgcctcggtaggccatcagtgtagtttgccagacgcgctcaattgtcgtcccggttcttgttgccatagcctcaatcagccacaggggggcaagcctatcgatgtctcggttccacacctgccgttcatttccaaatgtcagccgacaaaatgattgcactttcagcccattcgcatgggccacgcggacaagccaagatgatagcaactcatctctgtatggatgaggatgagcgggccaaagcatgtcagttgctcagttgagcttgccgctttcgatcagatggtgatatccaaccgactccgtcgagagcgcgtgcatcgatctgctcccgccctgttttgattgcatgctcggcggcattggccagtaaccgtgagagctctccgatgtagccttcgctcatcgaaaacagctttgcggccagggtagtgctgtgcagagccgatggctctcgaagcggcagcatccgttcgaagctggccaacaggcggagaaagtcggtatcgaattcccagcggggcagcagcgccggttcgaaacggttggccaactgtgggtcagtttgcagggcgcggaaggcatctcgggtgccgacggccacgatcggaacttgcagctcgttgcccaagtatttgagcacattcaagaaggcgcgctgtcggttcagatttccggccagaacatggtggatctcatcgatgatcagcatgcgcagtccgacgtatttcagcagcttgatgacctggaattgcttcttatccacccggtcattcggcttatacggcgcaaacagcagttcgaggatggcattgtagaagcggccttcatcgggaaccggtggcgcttgcatgcaaagcaccggtactcgaatgccttcgccggaggggttgtcgtcggctgggtgttgggagcagaaccgctgtaccagcatggtcttgccgttgttggtgtcacccaccaccagcaggttcggcatgcggtgcgatttcgggtaggtcaacagatcatcgagcttagccaggatcgctttcgcctgcggatagccaatccaacgcggcgccctgatcctctctatccgttctggatcgcttagctcgagcagcttgagggtcgagtcgttcaagtggctcatgccaagtcatccatttcatcaaaaggcaggatcgccggcacagtttgcggctgcggcgtggtgtgctctaccatttgcgccactggcggagtaggttgacggaccacctcctgatggtctttgcgccgctgagttgcgcgccgcgccgacatcgttttggcttgggcgttttgttcgatctcccgcatacggtcataggcggcgaaaagtgcacgctcatcgacatgtcgtcgtccatcggcctcggctcgacgctttgcctcgcgcatttcccagatgctgataggagggtgggatgtatcccggtaggggatcgggtagtagagatcgacctcggggtcgtagaaccagatcgtgctgatgtcacgcggatcgcggcgaaacatgaacttgcgcttgtacttgggcgctaccgggtcaggggcattgatccagcggcgtagcacatcatggtagtagtggatctcgtcgatcaccacaccgtagtcctggaccgtgcgctcctcgtacggcatgagatcgagccgcaaacgatccacgtcagtgatccgcgcaggtaagccgcggcctggcatgtccttggtgccgaagatcccctggcggtatttctctatcggcggcatccggaggccggaatgcacgcgctggtgatatacgttgacgatgaaggtcaccagccactcttctaattcggtgagcgatagcgctgccctgccctccgagtcataaccgcctcgctcctgaacattggaaaatgtagtgcccggtagggtatggatttcattggcgaaagtgcccagcaggcgttcgatgtgtccaccgaaatgtggtcgagcaactggccgccattcgatgtctatgccgtattggtcgcaggcccgcttcagcatattgccgcgaaactcccgggcattatccatgtgcagctttgccggaatgccccagcagggccattcccccttgacgccatgcttggccagccagccctccttgggaagaatcgcattggccagacactggccggccgatagagcgccgggcggatcgaacgatacgtagaatccgaccgccattcgactgaatacgtcgatcgccatggtgatccatggcttgcccactggccgacggtcgatgtcgtccaccaggatgatgtccagcggggtgtggtcgatctgcacaacggcgagcggccaatccgcgccagggaagctgccttcgattggcgaataggcttggtcagctgctttgcggcctctgcgcttggccataacatactcgccggccagcagtttcaggcggttacgtacggtgttgtcgtgcggcggttctatgccggcattcaaacagcgcttgcgcacctcgtcgcagactttctgctgcgattttcgctgcttggtcaggtattcgctttctactaccacctggatgatcgcttcgatttccggcgtgagcttggtggcgcccttgtcgctccgagtacgaggcagcagcgaggtcagtaaatgattgtcttcgtagcggcgtagccactcgtagagcgtattcgcatggtggccgaaagctttgcctcggtcggtgacgtcttgccggctgcggtctgctttgtcgagcagcgggcggatgatctcgtaacgccgttttgcctcctcccaatccttgtccagcacttgcaataagtccggccgtgccgacggctgcgaattgccgaccaccgcttccaagtctcccaccttggcgtggctgacctggttggtttcgtcgtcggccagcagcacctcgtcgagatccagcacatgggtgatgcgatggagtcgattttgatagaccaccgctgtgcctggttggagctgcaatagagtggtgggcgtactcatttatgaaggctccagatcggactggtcatcgtcagcttcttggtaagatcgacgccaacctgccctgttccgaccaagtaccaaagggagggaagcaggcgcgcctgattccactggtcctgaaacactgcggacagcagctctgccggcgtggcgtggcggatcagacgcagctgatcgtcgagtaggtccatgtgagcttcttctgccggcccctgtcgaacgaacggcagcaggaacttggcgttgtcgagatactgggaacggatctctacctctgtgacgatcttgaaacgccagccttcgatgcgggcgaaatgcacggctgcgcggagcttcggacgcagttcttgccaatccctacgcagttcatctcggtacttgacctcgtaaagtgtcttgctttgctgcccatgaggtagcttgaaagtggcgagcgcgtcgggcgtgtagcggcggattttgccgtcggaatcggtccactcgagcgtaagcggttggacctcgaaggtttcgacaaccgggtcgaattccagcaacgtgataaagtcacgctccagtgtggactcgaacatggccggcccgttcgccttgcggtgcgcggcgatgccggtgacgttacggtagttcttggggatcttgcgcacgggcatgatgtacctcactcagtacacgatagcactgtagaactccggtgggtacaagaaagcgacgtcagccagtagcgaagagctatgtggacgttgctgaaaaatcgtcaaccagtacagtcgagcgttggaagccacataaacactcgccatccagcaaaaacggcatccgagcttcaacccggatgccgtattttcatgcggccgccgctcaaacggccggcttctcgatcaccagcacgccgggagcccaggcatagctggcgccgccggcatattcgccctgatagaatttgggttgcgcaagcctagcaaccaggctatccctcgccaccgaactctgcgccgcgctgagcaatctgtcagacttgaacttcagccaagccacaggcgaatcatgaatctttcgcctgggctcgcccacgcccaaccagaacgctaggcagcagaactccagctcgccattgctcttcatgctcagcgccagactatcgcgcaagcggcccacgtcttgttccagccgcccccccaggctccgccaggtaattctttacctcgatgatcgacttcggcacgccatgcccgccggcctcgggcgccacccaccacacgatatccgcacggccatcccctctcaggctggatcgcgggcgccctctcaagcttacgttcgcgcaacccagcggctcccgcacattggcctcagacgcgacatgacaatcgtcatccacctcggccaattccctcgcgacagcgcaagtcagcagatactctggcgcgccttccccatccgccaccaaaacccttgacttcgtcattgcgcaacccgcccaaaccatgtcccgcggcgaaaccgccactacttgtccagcatagacaaatccatgcatgtcaagcgcaaagcgaacgcatgcggctggaatgccgcgctatccatatattgcaaatcaatataaaaaagacgaatccgccacgcttgccgcgaaaacagcaatttggtttgatttaataggcagtttcgcttatagtcggattgttattaattttgcaaaggcaaaccgtggacaacgacggttccagtcgatcttcgatcgcagtatcgccttgcaggatttaagcagaccgaattccttccttctgcctcatcctgcaaagccaggatgtggcatccgttccggcctgaaaacaggctgacgcgccaaacgcaatccactcagtcacacagcatcgccttatgccgcggcttccagtccgcgctgcgcttctgcgtcccgaatggcttgccagcatcccccagcatcagaccgactcagcaaaccgaccgaattgtttacgctagctgcgtgcgccaaaggagattccatgccggaagaaccagaaccgcgaacgtatgcgccgcgtagctgcgcgtcaggctaattccgctattgggcggaaataaccggctcggcagccgcgccatactccgctcattcaatatcggaccgcattcccgcatacggttattcaaaccggaaaggggtgcttattctctgctgctataaaaatagggggattcaatatgcgagccctgaaactgtcccaactgctgaaattctttacccgcggcaatacttccgctcaagttgccgacttccgcctgaatatcgtttgcgacaaagccgtcatcaccacgctgcgcaaacgcctgttctgggaaatgcacgacctcggcctgcgcgcctcgcaagtcaccatcggccccgacagccatgacaaccagtgcaagctgtcggtggtgctcaactgcccgctgacgcaacgccaggacctggacgacatggcgctgcgcctgagccagctgccggaaatccgccgcgtgcactggggccgccgcctgcatagcgcgcagccacatcaccgctcgttgttcggcagccgtccgcgcatcgccgcctaacgccgaacccgtcgcgccggcgtccgcaaagaccgccggccaaaccgccgcaccacaaggccccagccatgcccgaagaacccgaaccgcagacagccaggtcttcgccgccggcaccgcactgatccaccccttcccgtaagcgatggacagcgccgccgccgcgccgtccatcatgccgcttcccggctatcgccgcggaagacggctgcctgtcgccatgtgaaaccacacgcgccattccacaggagcttacgatgcaaaacctgttcaccaccccccgcaatcagcagctgtatcagctgtccatcatctgcccatcgatgtcgctgggcgccgccagacgcgaaatccgcaccctggcgcaaaaacacggcttgcgcattcagcaatggcaggagcagccgcagccggccgcgcgggaaagccgccatacgctgacgccctggctgatctgcgccgatttccgctgcggctccgaggcctgcatgcatttcctgcagggcatcgcccagcggctggccaccatgccgcttacccgggtcaagctggattgcctgtcgctgccgccaagcggcatgcggcgtccagccagcgcctgatcctccccgcccggccgccatgccggccgccatgccggccgcggcaagaccatcatccgcaggagaaggcatgccatagacacgcaacacgctgattgagatgccatccgctggggcgttcgcatagagccccccaacgggcggcaatgttctctcgatttcgagtcgacacattgtcggcgctgatgcctcacggcagggatggtcacgcccgttgtcagcgccaggagatacccatgaccaaacacaacacccaacgcagcaagaaccgcggcttcatcgccaccccgggaaaacggcaggacaaagtcgccttccgcttggccgacgaagcccggctgccgctggaagacaccttcaagcgggtgcgcagccagccggacggcctctccgcgatggaggccgcgcagcggctgcagcaatacggccgcaatgaagtggcgcacgacaagccgccgcacccgctggttcagctattcctcgcgttcaagaatcctttcgtgatggtgctgatcgtgctgggcgtcatcagctacgtgatggacatcgccatggcgccgccggacgaccaggattggaccaaggtcatcatcctgtccgccatgatcgccatcagcggcctgctgcgcttctggcaggaattccgctcggccaaggcggcggaaaagctcaagtcgctggtgcgcaacaccgccaccgtgcagcgccgccccgccggccccaatccgccgctgcgtctggaggtgccgatgtcggaactggtggtgggcgacgtcatccatctgcaggctggcgacatgattccggccgatatccgcttgctggaatcgcgcgacctgttcatcagccaggccgtgctcaccggcgaagcgctgccggtggagaagtacgacacgctgggggcggtggccgccaagtcggccgagcgggacgccagccacgccgacgacctgctggacctgcccaatgcctgcttcatgggcaccaatgtggtgtccggcaccgcccgcgcgctggtggtcgccaccggggccgatacctatttcggctcgctggcgcgcaatgtggtcagccacaagcgcatcgaaaccagcttcgacaagggcgtcaacagcgtgtcctggctgctgatccgcttcatgctggtgatggtgcccatcgtgttcatgatcaacggcgtcaccaaaggcgactggatgtccgccctcaccttcgcgctggcggtggccgtgggcctgactccggaaatgctgccgatgatagtctccgccaacctggccaagggcgcggtggcgatggcgcggcgcaaggtggtggtgaagcggctgaacgcggtgcagaacttcggcgcgatggacgtgctgtgcaccgacaagaccggcacgctgacccaggacaagatcatcctggagcaccattacgacatccatggccgcaaggatgaaagcatcctgcaactggcctggctcaacagcttccaccagagcggcatgaaaaacctgatggacatcgccgtagtggagcatgccgacgagctgggcgaccgcatcaagctgcggcagtacgccaaagtggacgagctgccgttcgatttcgagcgtcgccgcctgtcggtgatcgtggaagacggcggacagcaattgatggtatccaaaggcgcggtggaggaaatgctggctgtctgcagccatatccgcgatggcggcgaaacccgcgcgctgaatgccgaagaacgcgccgccctgctgcgccgcagcgaggaatacaatgccgaaggctaccgcgtgctggtggtggccacccgcgacattcccgccgccgagcaaaaacgcagctaccgcaccgccgacgaacagggcctggtggtgcgcggcttcctcaccttcttcgatccgccgaaggactccgccgcgccggccatccgcgcgctgaaggaatacggcgtggcggtgaaggtgctgaccggcgacaaccccatcgtcaccgccaaggtgtgccgcgatgtcggcctcagccccggcctgccgctgatcggcaaggaaatcgaggcgatggacgacgtggcgctgtgcaccgcggtcaagcacaccaccatcttcgccaagctgacgccgctgcaaaaatcgcgggtggtgaaggcgctgcaagccaacggccacaccgtcggcttcctcggcgacggcatcaacgacgcgccggcgctgcgcgacgccgacgtcggcatctcggtggacagcggcgccgacatcgccaaggaaaccgccgacatcatcctcttggaaaagagcctgatggtgctggaagaaggcgtgatcaagggccgcgaaaccttcggcaacatcctcaaatacctgaacatgaccgccagctccaacttcggcaatgtgttctcggtgctggtggcttcggcctggctgccatgggagcctatgctggcgatgcagctgttgctgcagaacctgatctacgatctgtcgcagatgttcctgccatgggacaagatggacccggaattcctgaaaaaaccgcgcaaatgggaagccggcaacatcaagcgcttcatgctgtggctcggccccacctcttcggtgttcgacatcaccacctacatcctgctgtggacggtgttcggcgccggcgcggcctaccatctgcacggcggcgacggcggccagctgatcatgaacaccggttggttcatggaagggctgatctcgcagacgctggtggtgcacatgctgcgcacccgcaagattccgttcctgcaaagcacggcgtcgctgccggtgctgctgtccaccagcgtggccatcgccatcgcctgctatctgccgttctcgcccatcgccgcctcgctgggcttcatccagctggacgccagctacttctggtggctgctgctgaccatggccggctacctggcgctgacgcagacggtgaagaccatctacatcaagcgttacggccagtggttctaagccactaacgcgccgacgcttggcgcgcgcaaacgaggctggcccccaggccagcctctttgtcgtcttgccaacccgccgttagtccagcaaaagccaatatcaagctcgtcagccggcatatccggttaagactgtccttaatgcctaatcgtattcacacctagccaccccaggcccacccacaagatttcatttgaaatcatcaaattaaaatagccacgcccacccaaaacaccgctgttggcatttatccgacaaggccttgttcgtttctatccgcatccggctgcattaccactcacatatcggtttcgcactttcacgcgggaggaaaagcatgagcatggatgagacaagcggccagaaacgctgggcccgggactatgtgttcgacatcctgagccagctgggcatacaccggattttcggcgtgccgggcaccaacgaaattcccatcatcgacggcacctcctacccggaaaaccgggtggagtacatcgaatgcctgcatgagaacatcgccatcggcgcggcgatgggctcggcgcggatgaccggcaagcccggcgtgctggtggtgcacgtcacccccggcatcgcccacagcataggcaacctgttcaatgcctggcgttcgcaagcgccgctggtcatcctgtgctgccagcagcagaacgaactggtcacccaggaaccgctgctggcgtccaacctggtggacctggcgcgccaatacaccaagtgggcgcacgaagtgcgcaccgagcaggagttcccgatggtgttgcaacgggcgttcaaggaggcgatggcgccgcccaacggcccggtgttcgtcgccataccgtgggaattcaccatgcgccgcatcggaggcgacgaccgcatcaagggcgtgaccaagatttcgccgcacttcaccgccgacccgcaggcgatagaacaggccgccaaactgctgcgcgaagccaagaaccccatcatcgtcgctggcgacgccgccggctacgcccaggcctggcccgaactgcagcggatggccgaactgctgggcgcgccggtgctgcagcaaaccttcagcagcctggccaacttccccaacaacgattaccactggcaaggcgaattgcccggcagccaggccggcgtgcagcaagtgttcaaggaccacgatgtcgccttcctgtgcggcttcagcaaccaggcgcaaatcaccgtctacaagtacagcgacggcccgctgattccgccgcacgtcacccaggtctatctcagcaacaacacctgggacataggcaagaactactacggcgaagcggcattgttcggcgacctgaaagccacgctgccgttgatcaaccagttgataggcagccagccctcggccgccgccgccgcgcgcaatcagcaactgcgggaattcgccgtcaagcgcgccgcggattgggaggtttacctgcgcgaagcgatgcatcagaacgaaatctgggcggtggtgatcgccgacgcgctgcgcaaggaaatcggcgaacgcaaactggagaagcaattcgtctacgtgcatgaagcggtgtccgacccggcgccgttccagttcctgctgccgttcaccgaccaggcggcgcagccgatcagctactactgcgtcggcggcggctcgctcggctggtcgatgccggccacgctgggcatcaagctggagcaggacggctaccagggcatagacacccgcttcgtggtggccgccaccggcgacggctcctcactgttctatccgcaaacctggtggaccgcgcagcaccgcaagctgggcgtgctctacatcatcaccaacaaccacgaataccacacgctgcagatggggctgacccaggtggaaagcatctacggcgaagcgcccggctatgagtggacggcgaagacccaggacccggaatacctgcgcatccatcgccccaaaccggacttcgtcacgctggccaagtcgttcggcggcatggagggcgaaatcgtccgccatccggaagacgtgcgcgcggcggtgcggcgcggcatagaccatgtgctcagcggccaggcctatgtgctggacatgcataccgtgggcctggaccagcccacgcccgacctgcagccctccaacgcccgctatgagaaacagccgcggctggactgcgtccacttcagcagcgaagacggcctgcgcgcggcgtcggccggccagccgggcaatgtgccggtgatcttctgatcgcccaccctcaaggagaaacagcatcatggcagacgaaaatctggacatcgccatcgtcggcggcggcgtatccggcgtttacagcgcctggcggctgaaacaggagcggccgaacgacaagatcgcggtgttcgaagccagcaaccacatcggcggccggctgttgtcggtgcggccgccggacattccggacatggtggccgaactgggcggcatgcgcatcctgccggcggtgcagccgctgatcacccggctgatcgccgacctcaaccgcgaattgccggccgatcagcagatcacgctgtacaacttcccggtggatgaaccgcagaacatcgccttcctgcgcggcgtctacctgcggctggccgatttgacccacgcgccggacaaggtgccctaccagctgaatttcctggaccacggcgaaagcgccggcagcctgatcgtcaacgcgatcgaacagatcgtgcccggcatcaccaacccgaacctcaacgaggcgcagcgccgcgaaatggcgcagcaggccgaattcggcggcataccgctgtacaagcagggcttctggaacgtgctgctgcgcgtgatcaccggcgaagcctaccactacgccgaagatgtcggcggctatgactccacgctgtgcaactggaacgccgccgacgccattccctggtatctgtccgacttcggcgtcagcccggaatacaagggcttctgcaacggcttccagcaggtgccgctgacgctggcgcaattcttccagcagctgggcggcgaagtgcggctggagtccagcgtttccaatatcgtcagcaagggcgaaggcttcgagttccaggtcaagggccgcaccatcgccgccaaatcgctgatcctggcgatgccgcgccgctcgctggagctgctgtccgccaccagcccggtgctgcaggaaatccagccgctgatcgccagcgtgacggcgcgcccgctgttcaagctgttcaccacctacaacagcccgtggtggctcaataccggctactccgctcccgacggcagctatgtgccggtgcaggcaggccgctcggtcaccgaccttccggtgcggcaaacctattactggccgaagagcaacggcgagccggccacccagggccacgccatgctgctggccagctacgacgacggcgacaacaccggcttctgggacggcctgcgcgccaggcgccgccagccgcgcgccgtcggcctggacgtggcgccgctggccgaccccttcatcggcgaagacgacaatgtgcgcaacgacgagctgacctggcaccagtacaaggcgccgcgcctgatgactgaagaagtcacccgccagctcaccgtgatgcacagcctcagctacacgcccaaggtgcgcaacgccgcctaccgcgactggggcgacgatccgtacggcggcggctggaacagctggaacatcggcgtgaagagctgggaagtgaagcaccgcatcgtgcagccgaccgatctgccgctgtacatctgcggcgaagcgtattccgacgcccaaggctgggtggaaggcgcgctgcaaactgccggctatctgctggaaaagttcggcgtgctgccattccactaggccgcgccgcccgcttcaagctccgcgccgcgggcaagacaaaaccgccgcctccttgcggagagcggcggttttgacatccggggccgacgtcagcccatcggcccggcagccattcctaaccgttgccggtattagaaggagtgaaccatgttcaggcccagaccacgcagcttgttgccggcgctggagccatcggctgcgttggagaagatggcctggtcagccttgacttcgccgtattgcagaccaaccacggtgcgcttggacatctggtagtcaacgcccaccaggaattgcttgtagccgctatccggggaggaggcgccgtcgatcttgacgtcctggccttgagcgtaggagaacttcggcgtgaaggcgcccagggtgtaggcggcggtcagcgcgtattcctgcgacttgtacttgctgccgttggtcggaacgttcgcgtccttcaggaagctcagcgggctgatggtgctgtcgccgcggtcgttgcgatagccaacggccagcagcaggttgttggcgttgtagccggcttccagacggtggctgtcgttggcctgggtcttcacgccggcaccagccacggtcaccacaaccggggtctcatggatgtactggtacttgccgaagaagccgctgttctcgtacgacagacccaggttgtaggtctcgcgctgagcggagtcggtgttcgcattggcgaaggtgccgttcttcacttccttggtgccgtacagcagggcgccctggaagccgccgtagttggcggtgtcgaagcggatggcgttcttcacgcggatgtcgtcgcgggtgaaggcgttcagttgcagcgcgttgctggagctttcccacgggttcacgacgctcatgttggagtcgctgaaggtggagatgttacccagacgcaccttgccgaaaccggtatccagaccgatgaaggattcgcggctggcgaagctgccgtagccttggcggttggagccgtcgatatccaggccgctttcaacctgccagatggctttcaggccgttgcccagatcttcgctgcccttgaaaccgatgcgggagcccaggtcgtcgatattggttttgttcatgccgccggcatcaacattttcaacgccagccttgatttggccgtagatggtcacatcagcaaaagcagctgccggcagggtggctaccgccagggcgatcagagtctttttcatttcgtacatcctgttaggttgtcttagaaagcgatcaaatactaatttctcaagacaacatacgcaagcatacgctcttttttgtgtagtgaaaaagacacacagtgtgcataaatacaacaccagaaaattatgtcttacgataacaactttatgtgattttgttgcttaacgaaaatttacaaagctgttaagccggaaaataaataatttccgaaaaaaaaggcccacattcacgtgggccttacaaggatagacttgaccggagatctgttgaacctgccgaagctcagttcaataaactcacaattagagtgtatttgcttgcaatcttaaggtcaatgtcttccacccctagctttgtcaaatagtgttaagcggcacgcactggctgcgctccgccggaaagctgagctcggcgcacaaaccgccctcgggatgattggacaattggatgtcgccatggtgctcgcgcgcgatggcgcgggcgatcgccaggcccagtccgctcccgccggtgtggcgcgcccgggagtcctccagcctgacgtagggctcgaacacccgttccaggtctttatcggcgatgcccgggccgtgatctcgcacctggatcgccagccggccctcccgctcgcgcaaacgcacctcgatcggcccgctgccatagcggcgggcgttctccaacagattggcgatgcagcgccgcagggcttgcggcctggcgcacagcggcttcaccggctcggggcggtaaaccacctccgcgcccagcgcttcgacatcctcgatcaccccttgcagcatcccgtccacattgagcagcacgcaggtctcgctgcgctgccccatgcgcagataggccagcgtgtcgcctatcagttggtccatgtcttccagatcgcgctctatcgcctggcgagccggcgactcatccagttgctccagccgcagccggatgcgggtgatgggcagccgcaggtcgtgcgacacgccggccagcatctggctgcgggtctgcagatagcgctgcaattccttctgcatgcggttgaaggcacgggtggagttcaccacctccagggtgccggtttccggcaacggcggctggtccagattggccgccaggccggaagccgcctgcgagaataccgccagcgggcgggtcagccggcgcaccgcccaggccgatacgcccgccaccaccagcgccaccagcagcagccaggcggtcacccgccatggcgtctccaccgccgaggcgatctggccgatgcggaaggtcgccaccgcgccgtcgcggagcttcacctgcacggtggccatctggattttcagctcctcctcgccatcctcccgcttgctgggcaaggcacgcacccaaaactgcttgccggcggtgaacacgtgctggccgggctccaggaaaggccgcagcaggtcctcggccgcgtcgggcgtgtcctcgcggaaggacagcacttgcatgcggtaggggaaattgagatcggtgcggatcagctggcacagcttgctggcttcaggcagatcggactggcggttttccacccaggggtggtccagcagcacctgggcggacggagaagtgagcgcgctggccagcttggggcggttggacgccgaagtttcgtccaacagattgatcatgtcggccaggtgctgggcgacgtactccgcgcgcaaagtgcgggtcaggcgctcgcggtcggtcagcaccagccctatgcctatcacgttggccagcagcacgctggtcagcagcgtcagcagcaactggccgtacagggtgcgaggcaggcgcctcatcgcaccgataccacctcgcatgccagcatgtagccgccgctgcgtatggtcttgatcagcagcggctcgcgggcgtcgtcgcccaggcggcggcgcagccggcctatcattacgtcgacggtgcggtcgaacggcccggcttccttgccgttcatcgcttccatcaactggtcgcgcgacatcacccgctgcggattttccgccagcgcctgcatcagcttgaattcgccgccggacaggggcgtcaccacgccgccgctgtccaccaggtgctgcgcgcccagctccagccgccactcggcgaactgcaggctgcgcaaggcgctgttgctgcgcttctcctccacccggcgcaggatgctgcgcactcgcgccagcaactcgcgcgggttgaagggcttgggcaggtagtcgtcggcgcccatctccaggccgatgatgcggtccagctcgtcgccgcgcgcggtcagcatcaggatgggaatgctggaacgcgagcgcaggtcgcggcacagggtcaggccgtcggtgccgggcagcatcaggtccaggatcaggatgtcgaaggattgttcggccaggatgcggttcatcgcgtcgccatcccccaccgcggccacgaccatgccctggcggctcagataatcgctcagcagatcgcgcagatcgggatcgtcatcaacgataagcaaacgggacgcttgggacatcggaactattcctagaattttggattgaaagataagcgcgccgtcggcgaaaccggcggcggcggcgtcctgcccgcgcgcggacggcagacgcctcgccaggtttgagggccgtgggcggcgattggttccctcgccgccctcttcccgtcaggactgcgccggatcgcgccgggttttatgccaggaatagccgatgccgccagccagcagcagcacggtcaacaacagcgacagcagcgtgggcagcttgaacgccaccaggccgacgtcgtgcagatacaccagccccaccttcacgcctatcagcaccagcaccagcgccagcgcgtacttcaggtagtggaagcgatgcaccatcgccgccagcgcgaaatacagcgcgcgcaggcccaggatggcgaagatgttggaggtgtagaccagaaacggatcctgcgtcaccgcgaagatggccgggatgctgtccaccgcgaacaccaggtcggccgactccaccaggatcagcgtcagcagcagcggcgtcgcccaccagccgcgcgccatgccgtgcttttcgccgcgcagcaggaaggcgttgccgtgcagcccgggcgtcaggcgcatatggcggcgcagccactggtaaaacttctgctcggcaagcggcgtggccgcgtcgtcgccgctaaacagcattttcaggccggcccacagcaggaaggcgccgaacagcagcagcacccactggaattcggccaccagcgccgcgccggcgcctatcatcagcgcgcgcatcgcgatggcgcccaatatcccccagaacagcaccctatgctgataggcgcgcggcaccgccatgctggagaagatcaacgagatcacgaacacattgtccagcgacagcgacttctccagcacatagccggtaaagtactgcacgccggcgtccgcgccgcgataccaccacacccagcagccgaacaacaggccgatgccgatgtaaaaagccgacaacttcaggctggccttgacgccgatttcgcggccgtccttctgcagcacgcccaggtcgaaagccagcagcgccagcacgcccgccaggaacatcagccacacccacagcgggtagcccagcgccggggaaagcaaaaactcgatcacttcatcgctccattttcatcagtgttgtcggcgacggcttgggccgccgcctccgcgtcaggcgcggccttccagcctggcgatgcgctcttccaggctcgggtgggtggcgaacagccccaacaggccgcggccgcccgcgatgccggacgcggccaggctttgcggcaggccgtcggcctcgatgccgcccaggcggcgcagcgcgtcggccatcggccgggtggagcccagcagttcggcggcgccggcgtcggcgcgaaactcgcgctggcgcgagaagtacatcaccaccaccgaggccaggatgccgaacgcgatctcgcagacgatcacggtgatgaaatagccgatgccggtgccggccgcggcgttttcctcatcgcgcttgagccagctgtccaccaggtagccgaccacccgcgccaggaagtagacgaaggtgttgaccacgccctggatcagcgtcagcgtcaccatgtcgccgttgcggatgtgggcgatctcgtgcgccagcaccgcctccacctcttcctcggtcatgcccgacagcaggccggtggacaccgccaccagcgaattggcgcggctggggccggtggcgaaggcattgggctcgccctcatagatcgccacctcaggcatgggcaggccggcgcggtcggccagccggcgcacggtggccaacagccaggcctcggtctggcctttgggctgggtaatcacccgcgcgccggtgctccacttggccatggtcttggacaaggccagcgaaatgaaggcgccgccgaagcccagcaccgcggaaaacatcaacagcatgcccagattcagcccgccggcggtgataaagcggtccagtcccaataggcgcacgctcacgctcaacaccagcatcaccgcgatgttggtggcaatcagcaagatcacccgtttcatcattcctctcccgatagtcgtttattcaggcggccgcgacgcagcgcgggccacactgcagtgtatgcaaggacacgcatcgaaaaaataaattaaactctgatcattactacgattttttcgaataaatacgtggaaaagctcaactacaagcatctgtactatttctgggcggtggcgcgcaccggcagcgtcacccaggcggcggagcagctgggcatcagcatgcagaccatcagcggccaggtggccaagctggagcagcagctcggctgcgcgctgttccgccagcagggacgcggcctggcgctgaccgaggccgggcgcaccgcgcagggctacgccgaccagatcttcatgctgggcgaggcgctgggcgaagcgctggccgacgcgcggctggatcaggcggtgcggcttgccgccggcgtgtccgacgtgctgcccaaacgcatcgccagccatttgctgcggccggcgctgcaaatgggccgcaagctgcggctaagctgcagcgagggcgacttcgacgagctgctgggcgacctgggccggcatcggctggacctgatcctggccgaccgaccgatagccagcagcgagcagcagcaattccaatcctggctgctgctgcgctgcccggtgctgctgtacgccgcgcccgaactgtgccggcgctaccgcccggagtttccagccagcctggagcaagcgccgctgctgctgcccagccgcgacaacgtgctgcgccggcagctggaccactggctggaatcgcaaggattgagggtggaggtggccggcgagttcgacgacggcgcgctgatggaaaccttcgcccgccagggcctgggcctgctgccgtcgccggcgctgccggacgcggcgcaggatctgtcggggctggaactggtgggctgcctggacggcgtgtgggagcactattatgcggtggccagccgccgcaagctgcagcacccggcgctgcaggccatcctgcaggcctggggctgagccggacgacaaacggcggctcgcgccggaccagcggagcaatcggcaatacactatggttttgacttgatcgataataagcaacgagtcccgtagcgcaggcgtcctccatgccaggcaagcgatcccgcccgatgcaccccgacaacggcttcaccctgctggagctgctggtcgtcatggccctgctggcggtggtgctggcgctggcggtgccggcttatcagagcaccatcgccgtcaacgccatcctgtcggaaagcaacaatctctacggcgacatcctgttcgcccgcaacgaggcgatcaagcgcggccaggtggtgctgctgtgcccgtccagcaacggcagcagctgcaatgccgccagcgccggcggcgccaactgggcttcgggctggctggtgctggtggcggccaccggcagctgcgccgacagcaccggcaccctgctgcgccagcaaaaagccttcaccagcggcgacaccgccaactacagcaacagcgccaatcccgcgctgtgcttcaaccgcatgggctacgcgccggcggccaatgtcggcatggtcaccttcaacacctcgtccggcctcgcggccgaccgccgctgcgtggcgctggcggcggtcggccatccgcagatcctgtccagcggccagaccgacaccacgggacaatacgcatgtccgtgaaccgcgccgccgcccatgccggcttcagcatgctggaagtgctggtcgcgctggtagtgatctcgctgggcctgctcggcatcgccggcatgcaggccgccgccatcaacaacaccgccatcgcgcgcacccgcagcctgggctcgatcgccgccgaaagcatggccgccgccatgcatgccaacaccgcctactggggcaacttgtccgccgccgccagcaacacctggtcggtcaacgccagcggcgtgaccggcacccccagcctgagccagaccgtggactgctcggcctcgggcaccgcctgcagcgccgccaacatcgccgcctacgacgtcacccagtggggcggcaacggcggctcgctggccaccctgcccggcggcagcggccagatcgcctgcgccgccgccagcgcgtcctcgcccaccgcgtgcacgatcacggtttcctggctggagaagaaaagcgcggtcaacgccgcctcggtcgcctccggggtcgccatccagagctatcaaatggtggtggagccatgagccgccgcgccgggcaaggcggcagcggcctgatagaagtcatggtggccatcaccatcggcctgttcctgctgagcatgctgatcatgatcttcacctccaccgaattgacggaaagcaacgaaaacggcctggcccaactgcaagacaaccagcgtacggcgatgacgatgatcaacgccatcgtccagtcggccggctactaccccagcccgcaatcgcagaccgccgccgccgcgctgcccgcggcgggcggcttcggcgcgggccagtccattctgggcgtcagcggtccgcctgacacgctgagcgtgcgcttcgccgccgcgcccaacgacggcgtgctcaattgcaacggcaacggcaacaccggcagcgccaacgccgtctacatcaatcagttcgccgtcaacgccgccaaccagctgacctgctcggtcaacggcggtagcgcccaagtgctggtggacggcgtcagcaatatgaccgtgctgtatggcgtggacggcagcggcagcggctcggtcaaccactactacagcgccgccaacctgcccgccggcgccgccgtgcgctcgatccaggtgacgctgaccatggccaatcctctggccgccaaaccgggccagccggccagcgtgaccatgtcctggctgataggcctgatgaaccagctatgaacgccgccgccctccgccccgcccgccagtctggcttcacgctgatcgccgcgctgatgatcctgatcgtcatcaccatcatcggcctggccatgatgcgcagcgtcggcctgcaagagcggatggccggcaatatgcgcgagaagggccgcgccttcgaagccgcgcaatcggcgctgcaatacgccgaatggtggctgacccagggcagcaacgccggcggcgccgccgtcagctgcagcggcgccttgagttcgctgcagatctgcagcaacgcgctggcgacgccgaccacgctgtcgtcgtgggccaccagctacacctattcgccgccctacctgagcgtgccggccaacggcgcggccggcggcagccaaaccttctaccagccgccgcagctttatctccaatacctgggcctgaacgccgccggcaacggcgccctgtaccagctgaccgcgctgggctacggcggcaacgcctattccatcgtggtgctgcaaagcacgttcacgctgtactccggcgtcaccaacctggggaaatgaccatgagccctctgccgcgcccctccctgccccttgcctgcctgctggccgcggcgctgtggcccgccgcctgcggcgccgtcacagtcggcgacaacttcaccggcgccagcgcccaattgaattggctggtattcggcggcgcctgcatgactgccggcaacggcagcggcagcattcccgcctgcggcagcaaggaccccagcggcaacacccaagtgggcggctacgccggctcgctgccggacagcaacggcaacggcgcgctgcggctgaccaacagcgccggcagccagtccggcgccatcgtctacaacagcctgtttccatccaatagcggcctgcaggccaccttcaccagctacacctacgccggcgactcgggcggctcggcgggcgacggcgccgacggcatgagctttttcctgctcacagccatccccagcgccgtcggctccttcggcggcagcctgggttacagctgctccaacgtcaactctccgtacaacggcatcatcggcggctatctcggcctggggctggacgagtacggcaatttccccaacggcggctacaacaacgacaacacctcgtccggccccggcgccaagccgcagaacatctcgctgcgcggcgccggttcggtggccgccagcgcgctggccagccagttcggcggcagcttcagcgcgtcggcggtgcaaaacgtgtgccgcaacggcagctacgccggccacagcgtgatgaactacccgttcatcaacatccccggcgccagcggcggcgtctaccagttgccgggctcccagccgatggcggcggaatcggccgccacccgcggccaggcagtgccgatcagctacaagctgaaaatcaccaccggcaacctgctcagcctctggtacagctacaacaacggcgcctacgtgccggtgatcaacaactacgacatcaacaacaccgcggtcagcggcccgctgcccagccagatcaccttcggcttcgccggctccaccggcggcagccgcaatgtgcacgagctgacctgcttccaggtgcagccatccacccagtcggccagctccagcggcctgaacagccagcaaaccagcctgatcaagaccggcactcagcaatacgtcgccagctaccactccgacaactggtggggtgaggtggcgtcctacgcgctgctgggcaatagcggcaccggccaagtgaccgtgtcctccaccgccacctgggacgcctcctgcgtgctcaccggcggcaactgcagcgccaccggcgccagcaatatgagcgcgcagagcagccgcgccatcctcagttggaacggcagccagggcatccccttccagtggaccagcctgtcctccgcccagcaaaccgcgctcagccccgacggcaacggctcggcgcgggtctcctacctgcgcggcgcgcgcggcaacgaagtcaccacactgggcgccggcctgttccgcgaccgcgacagcgtgctgggcgacgtggtcaacagcagcccgatctgggtgggggcgccgcagaacagctatgccgacgcctggaaggacaagctctacccctcagcctctgttgccgaaaacgccaccggcgcgcaggcctacagcaatttcaagtccagcaaccagacccgggccaacatcatctacaacggcagcaacgatggcatgctgcacggctaccgcagcggcgccaacgacgccagcggcaactactccaccgcggccacgcccaacgacggccaggaagtcatcgcctacctgcccgccgccgcccaggccaacaccgttcagtacagcaatcccacctatgcccaccagtatttcgtcgacgccacgccggccgccgacgacctgttctacaacagcaactggcatacctggctgatgggcggcatgggcgccggcggccaggcgctctacctgctggacgtcaccaaccctgccaacttcgcggaaagcaacgccgccagcctggtggtcaaggagatcagcagcgccaccctcagctgcgtcaacaaaagcagctgcggcagcgacctgggctacaccttcggcacgccggtgatcacgcgcttccacaacggccagtggggcgcggtgttcggcaacggctacaacagcggcaacggccacgcggcgatcttcgtcatgctggtgaacggcagcggcgtccccagcttctacgagctggacaccggcagcggcagcgccaacgacccctccggcggcggcaacaaaaacggcatttactacgccaccgcggtcgatcttgacggcgacggcaccaccgactacgtctatgccggcgacctgttcggcaatgtctggcgcttcgacctcaccagcaacagccccggcagctgggccgtctcccagtacggcaccggcgccgccgcgccgctgttcaccagccagtacacctattgcaacgccactcaggccgccaacggcagctgcacccgcagcctgcagccgatcagcagcaagctgctggtatcggccattcccaccggcaattccagcccgcgcgtgctggtggccttcggcaccggccagaaaatccccttcaccacttcggccgccgacatctacgccggcggcacgcaaagcctgtacggcgtctgggactgggacatgtccggctggaacacgctggcgggacagtcggcctattaccccgccgccgcggccgccattcccgccagcgcgctgcgccccgccaacctcaccgcccagaccgtcaccgcctcgtacaactccaccctgagcagcgtgcaaggctaccgctcgctgtccagcaacaccgtctgctggcaaggcaacagcgcctgcgcggtcaacaccaataccagctacggctggaagctcagcctgccctccagcggcgagcaggtggtgtacaacccggtcaacgagctgggcaccttcaccgtcaacaccaccatcccgcccaacaacaacgcctcgtcctgcaccgtggcctcggccaccagcttctcgatgtcgctcaatatgaaaaccggcggcgccacccggctgtccttctacgccaacgaccagggcaatttcaacggcatcagcggcagcgtgatcaacggcatcgccatcaatatggccggcagcccgaatgtggtcagctaccagaacaactttttcgcaatcggcagcagcaccaacggcggcccgatcgccaccccgccgcagatcaacccggcggccttcgatctgcatacccgcttgaactggatagaattgcgctgaacacacagagggaaacatcgccatgcctagccgccgcgcccgacagggcttcaccatgctggaactggtcatcgcgctggcggtgctgtccatcctggtggccatcgccctgccgtcgtaccgcgccttcatcctgcaatccaaccgcacctcggccaaaaccgcgctgcaggacctggccacccgcgaggaaagctattactcgctgcagaacacctacgccagccagctcgccacgctgggctacgccagcaacaccgtctacgtgcccggcaacggcaacaactattacgcgctgaccataggcagcgccaccgccagcagcttcgcgctgaccgccgtcccgcagggccagcaggcgcaggacagctgccagacctaccagctggacaatctgggcaaccagagcaacctcgccgccaacggcgcctcgctcagcgtcagcggctgctggtagccggaaacggaaaaagcgcccgatgggcgctttttctgcagtcggccgccaggcggccgttgcgagcttactccgccagcaggcgtttcaccacgtcgacatagccttgcttcgcgtcgtcggcggattggcctttcagcttttcccaggcatcgaacttggcgcggttgatgaagtccatcatgcccgggcgctcgccggtggcgtcgccttcggtcgcctgcttgaacagcgcgtacagctgcagcagggtctggttgtccggacgttcggacagggttttgacgtcggcctgggcctgggtgaaaagcgtctgcagatcagacatgactgtatcctttgttgtaagccgggatggttgtccatccctgatggtgttagccctccggcatgcgccggaacctgcgccaatttatcacgaagcgccctcaatgcgacagtggcggcaaggccgcggccggctgcggctcgatccggatccgcttgtagcttttcaccggcacgccgtccttcagcgccggctgataactggccgcgccgaagaccggggaaatggcgtcggccagccgggccggcgccgcgccttcgaagcgcacgccgtccacccgtccggtttcgctgatgaacaccagcacggtcagcgccggcggcgcctggccatccagttcgacgtcaggcagcgtgatcgcgccctgctcctgcgccagttggtccagttcgcgggccgggtagtagatgtccgcccccagccgcagcctgccgtccgcctcgcgcggcgcggcgccggccggggccgatgcttcgccgccggcggcagaggccggcctcgcgcctgggagcgcggcaggccgcgccggggccgccgccggcatcgccagccgcacaaggaggcctgcatgcgccgccggctggcccagccgcgccggcagccacaacagcgcggcgtgcagcagcagcgacagccacagcgccagcaacccgcgctcggccaggctccagggacgaaatttcatcaggctatccctttcggccgccggcgccaaaaaaaacgggcctggcattcgcctgacccgttttccgcttacttggcgttcagcagctgttcgatgtcgctgccgtctatcgcgcccggcaccagccggccgttggcgaacaccagcgccggcgtgccggtgacgcccagcttctcgcccagcgcctggatcttgtccagcgcgctggtatcgcaattgtccgggccggtcagcggcttgccatcgcgcatgaaggcggtccacaccgccggcttgtcgctggcgcaccagatttgcttggacttgcgcatcgcgtccgggtgcagctgggtcagcgggtacaggaaggtgtagatggtaacgttgtcgacatccttcaggctttcgcgctccagcttcttgcagtacgggcagtccgggtcggtgaaaaccgccatcttgcgttcgcccttgccgcgcacgtccttgaacgcgtactggaacggcagcgagttgaagtcgaccttggacagttcggccatcttcttctcggtgaggctttccttggtcttggtgtcgatcaagtcgccgacgaacaggtagctggcgtcgctattggtgtacaccacctgcttgccgcccaccaccaactcatagatgcccttgaccggcgtggcgctgacgctcttcacttccttgtccgggaaatgctcggcgaaggccttcttcaccgcgtcgagattgccgccggcggcctgagagcaggcggccagcgacatcagcatcccgctggccagcgccagcgacttcaatcttgtcttcatcaagtgtcctttgaggatcagtatccaatcgcctgcctggcgaactgccgcttcaatggcgcgcagcagttggtcagggacaggccggtattgcgcagccatgacaggccgggcattttggcatggaacagccggtacaggctgtcacagccgagttgcatcgtggtgaccgcttcgcggcgctggcgctggtagcggcgcagcagcatccagtcgccgcagtcgggcgcggcccgcagcaggtctgccagctgcgccgcgtcctggaagcccaggttgacgccctggccggccagcgggtgcacggtgtgcgcggcgtcgccgatcaacgccacccgctccgacaccaccgcctccggctggatcagccgcaaggggaaggccgccgcggcggtcagggtggaaaacgcgcccagttgacggccgccagcggcggcgactttctccgccagcgcctccggcgacaagatcagcaaagactgcgggtcaggagtggaccagaccatggagattcggttccccgccatcggcagccaggccaggatgctgtcgccggtgaaccactgccgcgccacgccctggtgcggcttttcgcaggcgaagttggccaccacgccgctctggccgtacggtttgacgctggcggcgaggcccagttggctgcgcacccaggaattggcgccgtcggcgccaaccaatagctcggcgctcagctgccggccgtcatccagcgccagccgcgcctcgctcgcggtggtggcgagcgattgcgcgccgccatggaggcagtcgacatcgctatcggccagctgccgccacagcgccgccagcagccagcggttttccgcgatccaggccaaggcgtcggcatcggcgtcgcgcgcggaaaactggatgcgcccgccggcatcgccgcaaacgtccatcgcggcgatggcgcttatccgctccatgccgggccaggcgcccaggctttccaggaagcggcgattggccggactcaccgcgtagatgcgcgcgtcccagccggaatccagcccgtcgaaggacggcgggcgggcctccagcagggccacccgcttgccggcgcgcgccagcgccagcgccaggctggcgcccaccaggccgccgccgacgataatcgcgtggtattgactgtctcgcatccgcttatcctcgcacgccgaacaccaggtggccggcgaatttgcgccgcagcggcggcagcgcgtccagcgcggtcatgcccatgccgcgcagagtgttcatcaatggatggtggccgtcgaacagcttgatcagcccgtgggtgaagcccaccaccgcgtggctgtccagcttgcgcgccgcggcatagcgccgcagcgcccgcgggtcgcccggatcggcctcgcctgccagcgcctgcgccaggccgacggcgtcacgcagacccaggttcagcccctgggccgccaccggatgcatggtctgggcggcgttgccgatcagcaccacccggccgctgaccaccttgttggcctggcgcagcgccagcgggaagctggcgcgcgggccgatggacaggatgcggccctggcgctcgccgaaggcctgctgcagctcggcgcgcaattcggcctcgtcgccgcgcgacagccgctcggcgtcggcgtggctgcgcgtccagaccagcatgtagcggtcgccgtgcggcaatagcgcgaacgggccgctggcggcgaagcgttcgtaggcgacgccgtcggccggccattcggtttccacttcggccaacaccgcgcattgatggtaatcgtgctccagccggcgcacgcccggcagcgcgccggccagcgcgccgccctcggccaacaccagcaagcgggcggtcagcagccgttcgccgtcgggggtttccacttcggcgcaggcgtattcgcgcaggctgctcaccgaccgcacccggctgcgccacagcacctgcacgccggcctggctcaacacctcggccaggttggccaccagcgccgggtaatccaccaccacgcccaggtgcggcaactgcaagtcgtccttgtccagccgggcgcggccgcagctgccctgctgcgacacgtgcacggtgtctatcgccgtcgccggcaggctgtccggccaggcgccggcttcggccagcagctcccggctgtgccaggacagcgccagcgcgcgggcgtcgcgcaccgcgtcgtcgcggccgcgcgcctcgaccagcagcacgctgcgaccctgccgcgccagccgcagcgccgccagcgcgcccaccgggccgccgccgacgatcagcacatcggcgtgctcgctcgttcttgctcgcatattcttcactctccgcgcatcagcgcctcgatctcgtccacccgcttgggcgcggcggcggtatacacctcattgccgtccgccgtcaccagcacatcgtcctcgatgcggatgccgatgttgtggaaggcctccggcacatccggcgccggccggatgtacaggcccggctccaccgtggtgcacattcccggctggtagttgcgccactggccattctgcttgcgctggccgacgtcgtgcacgtccagccctatcatgtggccgatgccgtgcatgtagaagcggcggtagtcgccggattcaatcactccgtccacgctgcccgccaacaggcccaggtccagcatgccctgcgccagcacccggagcgcggcgtcggccggcgcgttccatggcgcgcccggccgcaccgcggcgatgccggccagctcggcctccagcaccacctcgtacacgtcgcgctgcgccgcgctgaagcggccgttcaccgggaaggtgcgggtgatgtcgccggcgtagccgtccagttcgcagccggcgtctatcagcagcagttcgccgtcttgcaggcgggcgttattggccgagtaatgcagcacgcaggcgttgccgccgccggcgactatgctctcgtaggccggatagcgcgcgccgcggcggacgaaagcgcgcagcagctccgcctcggcctcgtattcgtactggccgggccggaccgtccgcatcgcggcgacgtggccggcggcggaaatctcgccggcgcggcgcaacagcgcgatttcggcctcgtccttgaccatccgcatctcgtccagcagcgcgcgcaggtcgccgtaatgcgccggcgcatgcgtgccgacgcgggcgcggcgcacgccgtccagccagccgttgacgcggcggtcgaaggcctcgtcatgccccagcggccaccacagttggcggcaatcggccagcaggtccggaatgcgctgcgccatttcgtccagcgcataggcttcatcgaagccgaaagcttctttcgcgccctccggtccgtaacggaagccgtcccaaatctccatttccggattcttcgcgcggcagaacaggatggacttgccgctgcggccatccagcagcagcaccgcctccggctcggcaaagccggtcaggtaaagaaaatagctgtcggcgcggtaaggatagaggcagtcggcgttgcgcgtcgcttccggcgcggtggccaacagggcgacgccgtcgccgagggtcgacaacaggcggttgcggcgagttgcgtgcggctgatacatgttcggcttctccgcggcgtgggcgcggccatggcaaaaacgccagtttacaccctggccggcaagcgcccaagcctgccgctgccgcccgcgacgacgccggcatgaaaaaacccggcgatgccgggtttcgggtccgccccgcctggcggcggcgagcgcgcttattcgtccagcacggcggaagtgtagacttcctgcacgtcgtccaggtcttccagcgcgtcaagcagcttctgcatgcgggcggcgtcttcgccgctcagctcggtgtcgttctcggcgcgcatggtcacttcgcccatctcggccttgaagcccttggcttccagcgcttccttgatgtcggtgaactcgtacgggccggtgatgacctcgatggagccgtcgtcgttactcaccacgtcatcggcgccggcttccagcgccgcgtccatcagcgcgtcctcgtccacgcccggggcgaataccaggtagccgcagtgcttgaactggaaggacacgcagccgtcggtgcccatattgccgccgtacttggagaaagcgtggcgcacgtctgccacggtgcgggtcttgttgtcggtcaggcaatccaccatcaccgccgcgccggcgatgccgtagccttcgtagcggcattcgacatagtcgacgccttccagctggccggtgccgcgcttgaccgcgttttcgatgttgtccttgggcatggactcggccttggccttttccaccgccaggcgcaggcgcgggttcatgttgacatcgcccccgcccatcttggcggcgacggtgatttccttgatcaggcgggtgaagatcttgccacgtttggcatcctggcgacccttgcggtgctggatgttagcccatttactgtgacctgccatatttgcctctgtctgttatctggttccgacgaacccaatcgtcaaaaaatcgcgctattttagcagaaagccggccgccgctacgagtctcgccgcgctacttcgcctgcagcatcttcagcatcatttcgaaaccggcatggtacatctgctctatcaccggcaccatcatcggcagcgtcaggtacagggtgccgaaacccaccatgatggtgagcgggaagccgaaagtgaagatgttgaactgcggcgccgcgcgcgtcatcacgccgatggccaggttgacgaccagcaaggcgccgatcaccggcatcgccagccacacgccccattccaccagatggcggccccacaaggccagcgccttgatgccctgctccggcatcggcatgcctatcggcagcacccggaagctttccaccagcgtgtacagcaccacgtggtggccgtcgaaggacaggaacaggaaaaaggtgaacagcgacagcatctgcgacagcaccggcacctgggcggcgtggatcgggtcgaagaacatcgcgaagcccaggccggtctgcgcgccgatgatgaagccggtcaactccaccgcggtgatcacgatgcgcatcacgaagcccatcgccaggcctatcagcagctgctgcagcaatatggcgaccccgcccgccgaaatcagcggcaccgccggcagcggcggcagcagcggcgccagcatcacggtgagaaacagcgcgaagcccgccttgaagctgcgcggcacgccgcggtaggcgaagatgggttcggccaggaacagcccgacgatgcgggcgaagggccagacgaaggccccgaccagcgcattgatctgtacgtcgcttatcgtcagcatcagccgatcacgttgggtatgctctgaaacaggcgcgtggtgtattcgatcagcgtattgagcatccacggccccgccagcaccagcaccaggaacatcgccagcagcttgggaatgaaggtgagcgtcatttcgttgatctgggtggccgcctgcaggatgctgaccagcaagcccaccagcagcgaggtcagcagcaccggcgccgacacgatgatcaggatgtacagcgcgttctgcacgatgctgatgatgagttccggactcatgcctcctcctcccgccagccgcccttggccagcagccaattatccagcgccacgccgttgcgctgcaggcggttggcgcgcagcaaaagatatcccgcccgctcgaacaccggccgcgccgcatggctggcccaggcgtgcagcgccgatacgccctcccgcgcagcacgcgcttccagctcgcccagcatccgccccgccagcccctgccgtccggcccagggagcgacgaacagcatgtcgaactcgccgccgcgcttgagccaggcgaaaccggccaggcggccgtcgccggccatcgccttgcagccccaggacgctgcgagcctggcgcgccagtgcgggtcgatctccgcatcccacgcccgctccggcgcccaggcctggcattgctcggcggtgtagacgccgccagccagcgcctgcacgctggcctggaacaaggcgtggcaggcgggcagatccgccgcagacaaatcctccagccgcatcgccgtcatccggtgtagaagctctgcaccagcgagcccatcagcagcgtccagccatccaccagcacgaacagcatcatcttgaacggcagcgaaatggtcaccggcgacaccatcatcatgcccatcgccatcagaatgctggccaccaccaggtcgatgatcatgaaggggatgaacaccatgaagccgatctggaacgcggttttcagttcgctgatggcgaaggcgggaatcagcgtcttcatcgacacgtcttccttggtctgcggcttggccgactgcgaaatctcgatgaagaaggccaggtctttctcgcgggtctggcgcagcatgaaggccttcatcggcttgctggcctcgtccagcgcctgggtgatgttgatcttgtcgtcggaaaacggcacccaggccttgctgtacacctgatcgaacgtgggccccatcacgaacagggtcaaaaacagcgccaagccgactatcacctggttaggcggcgactgggtggtgcccagcgcctgcctgagcagcgacagcacgatcacgatgcgggtaaacgccgtcatcatcagcagcatggccgggatgaaagtcagcgaggtcatgaacagcagcatctgcaggctgagcgaatagttctgcccgccgcccggtcccggagtgctggtcatcagcggcaagccgcccgccgcgtcggcaagcaggggcagcagcaaggccccgccggacagcagggcgatcacgatattctttttcattgcttgtcctgcggccccttgggcgggcggctcttgtccagcgccgccttcagccagcgggcgaatggttcggcgggctcaggcggggcctggtccgcgccttccggccgcggcatcttgctcagcaggttcacctggctggcggtcacgcccagcaccaaccattcgccttccagttcgacgatgaccacccgctccttctgccccaccatggcgccgcccaccacgcgcaagcgcccggcggcacccatcatgccgccggacagccggcggaacagccaggcgacgccgacgatggcgcccagcaccaccgccaggcccagtatcacctgcaccaggctggccagcggcgacggggccgccgccgcggccggagccagctgcggcgcggccagcgcgggggccgccgccataaagcaaaatgcgccccgcagcgccaggcgcactttcgatgtttttgccatgtccattatttctgcaaacggcgaatgcgctcggccggggtgatgatgtcggtcaggcggatgccgaacttgtcgttgaccaccaccacctcgccctgggcgatcaggcagccgttgaccagcacatccatcggctcgccggccatgccgtccagttccaccaccgagccctgcgccagctgcagcaggttgcggatggcgatcttggtccgccccaactccacggtcagctgcaccgggatgtccaggatcatgtccagattgggcggcccgccggagatggcgcccgcgcctatctcctgaaacaggttctgcgccggcaccgcctcgtcggcggcgggcgcggcgctttcggccacctcctgctcggccatcgcggccgcccagtcgtccatcgacacttcttcttcggcgccggccgcgccggcttgctgttcttcttcgctcattgctctttatcccccggcgactccatgaactcattggcgcctgccagtatcttttccactttcaacgcgtaacggccctgcaccgtgccatagctggcctcgaacaccggaatccccgacacgtcggcctccaccagttcggggatttctatcatcaccacatcgccgttcttcaaattcagtatctgccccagcgtcaccttggtgtgcgccaggctggccaccagctccacttcggccgcctgcacctggtgggtcatcaggttgacccagcggttgtccacttcggtgcggtcggcctgcatggtgctggacagcaggtcgcggatcggctccaccatcgaatacggcaggcagatgtggaaatcgccgccgcccgcgcccagctcgatgtggaaagtcatcgccaccaccacttcggtcggggtggcgatgttggcgaactgggtgttcatctccgagcgcaggtagacgaactcgatcggatacaccggctcccaggccttctggcattcggtgaacaccacctccagcagacggtggatgatgcgctgctcggtgggcgtgaaatcgcgcccctccacccgcacatgatagcggccatcgctgccgaacagattatccacgatcagaaaaaccagatcgggatcgaagatcagcaggccggtgccgcgcagcggcttgacatgcaccaggttgaggttggtcggaaccaccaggttgcggatgaattcgctgtatttctgcacccgcaccggccccaccgagatttcggcgttgcggcgcaggaagttgaacaggccgatgcgcagattgcgcgcgaaacgctcgttgatgatttcgagggtcggcatccggccgcggacgatgcgttcctgccggccgatatcataaccgcggacgccctgcgcatcctgactgccatcatcatcttcgtcctccccggagacgccccgtaatagcgcgtctacctcttcctgggacaggatatcgtcgcccatggcgcttattgcttctgaatgatgaaggaagtgaagagcacgctgtccacgaccggctcgtcgcccgcgtccatggactcgttgatgatctgcttgacctgggccttcagcttgaccttgccttcggcggtgctgacctcggccgcgctcttggacgacagcagcaggatgacggcgctgcggatcttggggccatagtcggcgaatttcttcttggcttcctcgtcgccaagctcggcctgcatgtcgacctgcagcaggctgccgtcgttgccggccagattcaccacgaaggtatccattttctcgaaaatgggcgggccgtcatgcttcttcttcggtttttccttgacctgctcggcctgcgctcccgccggcgccttgcccatattggtgaacatataggcagccaagccacctactgcggccaaaaccaggatcaacaacacgatgactatcagcatcagtttgttgccgcccccgcctggttttttttccgctttttccgcctttttatcatccgacataagttatgacctgttctttatggagtgcctagtgaaatcttaaacgatttcctcaccatattttccagttttctcggccggctgaacagggtcaatctcaaatcgggtcaggcaaaaatgctgagtatgccgcgcgcggccttgatcgcgctcaaggcatccacgccttccacctcgccaaccacgggttcggagcggccttttttctgctggtaagcctgttgctgctggccggattgcccgctggacacctgggaatcggtcagctggatgccgctggacgacatcatcgagcgcagctggtgcatattgttttccagcgcctcgcgcgtcgccggcaccgccgcggtgaacaatacctgcgcctggtcgttgccgttcattttcagggtgatttcaatcggccccatctgcggcggattcagctggatttgcgccttgtcggccttcatgttgaccatgctcagcatctgctcgcccagcgccttgccccaggccgggtcgttcagcgtttgcggcagggtcagcaccggcatattggcattggtctgcgcctggacgttttgcaactgctgttgcggctgcaattgctgcagcggcaagaattgcgccgcatccgcgtcggcggccggcaatttttgctggttgccttgccaattgaatgccggcttcgcctgcagcaaggccgtcaaatcgggcttgctggccgcttgctgcgccagcagatcctgattggcggccttgctatccaccggctgcggctgcgcctgcaggctggcctgcagcgcggcgagcagcggcatcgccgcggcggccggcacatcgccgccgtccgactcgtccttggccgccggcttgtcgctggcgggcttggcgtcgccttggtcgctgatgccgggcagcgtcgagcccatcgcgctcatctggatgcccagcaggctggcgaacagatcgctggccgcgccgttgcctgccgcgccgggcgccgcgccgccgggagcggaagtggccgcggaggcggcattggtcactggcgtgtttaccgtgatggtcatgatggggtctcggctgagtgtaacgacgctagaaaagcaagtagcgtgccaactcaggcgtcttcgccgtgggtccggtcccagaactgccgggtggcgaattcatcggtctgcttctgctggcgccgggcctcctcccgcgcctcgcgctcttgctcgcgttgcaacagcttttcgtaagccttgagcttcttgtactccatctgccaggcctggcgctccatcacgaagcgctgagtgcagcggtccagatcctgctgctgctggatcatcgcctcatccaggcgggaaaggaaacgatggaaatcctgatactggacgatggacatgcccttgccgccgccgcccaccagccgatggcggtattcctcgcgaaaggcgtccaattgctccagccgcgcccgcgcttcgctcagccggttctgcgccaggctcatccgctccgccgccgcctgctggcgctcttcggccaggtggatcagcagctggtatttgccggacacgccgccgctcctcaggccagcacgttagccaactgcgcgcagcaggacgcgtagtcgtgcgattcgtgcatgggctgggtcaggaagctgaccatgggaagctggcggcgcatcgcgtcgtccagcaccggatctgagccggcgacatacgcgccgacgctgatcaggtcgcgattgcgctggtaacgggaataaagctgcttgaaatggcgcgccaggtccatctgcgactgcggcaccacgtccaccatcacccggctgatcgattgttcgatatcgatagccggataatggccggactcggccagatcgcgcgacagcacgaagtggccgtccagaatggcccgcgccgaatcggcgatcgggtcctgctggtcgtcgccctccgacagcacggtgtagaagccggtgatggagccgccgccctcctcgccattgccggcgcgctcgatcaattgcggcaggcgcgcgaacaccgagggcgggtaacccttggtcaccggcggctcgccgatggcgagcgcgatctcgcgttgcgccatcgcatagcgggtgaccgaatccatcagcaacagcacatccttgccctgggcgcggaaatattcggccagcgcggtggcgtaggcggcgccgtgcagacgcatcaagggcggcatgtcggccggcgcggccaccaccaccgagcgcgcgcggccttcctcgcccagaatgttttcgatgaagtccttcacctcgcggccccgctcgcctatcaaccccaccactaccacatcggccttggtgaagcgcgccatcatgcccagcagcaccgacttgccgacgccggagccggcgaacaggcccaggcgctggccgcgccccaccgtcagcaggccgttgatcgcgcgcacgcccacatccagcacgtcgtgcaccggcgtgcgctcgagcgggttgatcggttggctgtaaaggggaaaccaggcatcgggatggaccggccccaggccgtccagcggacggcccagcgaatccagcacccggccgagcaggctggcgcccaccggcacttggcggccaacgggtccgttcgcatgcgcgggcgcggcgtcgcggccatagctgggcggacgaaaagccggcaccggcgtcaccggcgtgcccggctgcaggccgtggacattggtgagcggcatcaggaataccttgtcgccggagaagccaaccacctcggcctccaccgcgccatggtccggcagcgccacctggcaggcgctgcccaccggcagcttgatgcccaccgcctccatcaccatgccggtcacgcgcaccagcctgccgcagggttgccacagatcggcggcggcggccgattcggcgcaggccgccagccagccgcgctggcgctcaagcaggccgttgcccatcatccgcctccagccccagcgcgcggctcatcgccgccagccgcgtgggcagcgtcatgtccagcctggccgaagcggtgtcgatgacgcagccgccgcgggccatggccgggtcttctatccattgccaaacggtttccggcgtctcctgccgcagaaactccctggcggcggaaaggtcggccggattgacccgcaaccgggcgttgcccagcgtggacggtagctccgccagcgcggcctgcagcaaagggagcagcgcctgatcatcctgccgcagcttctgctgcagcagcttttgcgccagctgccatgccagctgcagcacatcgtccgccagctcgcgctccacccgcgccagctcgtcggcgaacgctccgcccatccggcacagcccctgccaggcatcttccatccgcggcagctgctcggcgcgcacatcggccatgccctgctcgcggccggcctgcaggccctgctcgaaaccttcggcgcggccggcatccagcccggcgtcatggccggcctgccaggcttcctgatgaatggcttccagttcggcggcggtgggatagccgatgccggacacctcctcctcttcgggaggaaggtcggcctccggcgcttcaggctgaggcgcggacacttcggaagccggttccgcttccgcctgcgctattttttcggccagactggcgccgggacggcgcatctggctcatcgacaccagttgcgccggggtcaatgcccgggtgaagccgtcgagcgactcggggctccagctggtccagccctccagctcctcgccgggaatgatgggattattactcgatgaggccttcatctccgcccttgctgcctagcacgatctggccgtcgtcggcgagcttgcgcaccaccttgaggatttccttctgctcggcttccacttcggacagcttgaccggccctttggattccagatcgtcgcgcagcatttccgccgcgcgctgcgacatgttgcggaagattttttccttcaattcggtgctggtgcccttcagcgcgatgaccagcgaatcggactgcacttcgcgcagaatggtctggatcgaacggtcgtcgatatcgaggatgttctcgaacacgaacatcttgtcctggatccgctgcgccagctccgggtcgtactcgcggatgaagctgagcgccgacgcctcgacgttgccacccatgaagttgaggatttccgcggtgaggccgacgccgccggaagcgctcttcttgatgcggtcggagcccgacagcagctgggtcagcacgtcgttcagttcgcgcagcgcctgcggctgcacgccttccagcgtggcggtgcggatcagcacctcgttgcgcatccgctcggggaagaaggacaggatggaactggacaggtccggctccaggtgcaccaggatggtggcgatgatctgcgggtgctcgtggcggatcaggtcggcggcggaggacggatccatccacttcaggctttcgatgccgctgtggtcgttgccctgcatgatcttgtccagcaggttggccgccttgtccggccccagcgcctcgatcagcacattgcgcaggtattcgtcggacgcgccgatgctggcccgggcattgcactccttgcggaagtcggccaccacgtcgtcgatctgctcgtagctgaggttgttgatcgccgccatggccagggaaatcttctgcacttccttggggccgaggtatttgaacacctcgaccgcctcgttctggccgaggctgaacagcagcaccgcgctcttgcgcactccgttttcactcatcggcgcttatccattccttgatgatctgggcagccatgcgcgggtcggatttcaccagttcgcgcactgcttccagattactactgtactggcgcttctgcacctcgcgcggatcgtcggacgagccgccggcgccgcccgcggccaacgccgcgcccatctcgccctcttccgccgccacgcccagcaacctgccgcccgcggccgcgcccgccgcgccttcggcgccgcccggatcgggcgcggccgccggcttgaccaggtcgcgcatgatcgggcgcaccacgccgaacagcagatacagcacagcgatggccagcaagccgtacttgaccaggctggtgccgttgtcgctcacgtagtcgaccacccggtcttgcatggtcaccggctgggcattatcggcgaaggcggcgttcaccacgttcagcgtgtcgccgcgcggcgcgttgtaccccatcgcctctttgaccagattgttgatctgctgcacttcctgcgccgacagcggcgtcggcttcatctcgccgttcttgtcgggcatgcgccggtagttgaccactaccgccgccgacagccgcttcaccacgccggtcggcactttggtgtgctgaatggttttgtccacctcgtaattggtggtgatgtcgcgctgcagcgtgccgttctggctgatggtttgcccggacagattggcggtgcctggcgcggcgcccggcggcagcgtgatcggcgccgacgccgctgacggcggctgattggacagcgcgcccggcacgccggtgggctgggccgcgccgttggccagcttctcgctgatctgctggctgcgggtggccgacggattcgggctggagttggggcgataggtttcggaggtctgctcggtctcagagaagtcgacattggccgtcacctgggctcgggcgttgccgtggccgaagatgggctccaggatgtcctcgatccgcttgacgtagccgtcttcgatctggcgcacgaagcccaactggcgctggtccagcccggagttctcgtccggcccaagctgcttggacagcagattgccgtcctggtcgacgatggtgacgttcttcaccggcagattcggcacagagctcgacaccaggtgcaggatgcctgccacctggccgccgtccagcatccggcccggatacagctgcagcatcaccgaggcggtgggcgcctgctggtcgcgcacaaacacgctttgcttcggggtggcgatgtgcacgcgggcgctctgcaccgaagataccgattctatggtgcgcgcgagctcgccctcgatggagcgctggtaattgacctgctcggcgaactggctgatgccgaatttttgattatccatcagctcgaagccgatgccgctggccttgggcaggccctgggccgccagcttcaggcgcacgtcgtacaccttgtcggacggcaccgagatcacgccgccgtcggtgagctgataggggatgttcatctgctgtagcgcagccgtcacctggccgccgtcgcggtcggccagattggagaacaacactttataggaaggggtgcgattgagcgccacggcgccgacgaccacggcgaagatggccgcgatcgcggtcagaaacaggatttttttgttgttcgggagggtcttgaagcgatcgcccgcttcattcaatcgagcccgccaaacaggcgttgcgttttcttctgccagatcagccatacggtggtttttggtttaggtccaccgctgcccgtctgtgaatccgacagcgctagacttgggtattcatgatttcctgataggcgctcaccagtttgttgcgcgcctgaaccatggtctggaacgacaagctggctttctgcaaggacaccatgacatcctgcaggttcacctccttgttgtcacccaactggaactgcttttgcatctcctccgaagtctgctgcgccgaattcacctgctcaatggtggacttgagcacatcggaaaagtcgacctgcgacgtttgctgcgctgcgggggcctgcttgccggcggccagggccgccgcgcttctcagctcgcccagcaattggtcgatattattgactgacatggctactccgtgccatttccctccgaaacatccaggccagaatccgcagcgtcttcatcacggtatcgctgcagcttgtagcgcaaagtgcgctcgctgatgcccagtttttcggccgccagcttcttcacgccgccgacggctgccaatgtttccagaatatggcgtttttcaagggttttcatgtcggtttcatccgacaccgaactgtctgattcagacactgcccgggtaaactgccccacgcctgcgatatcgcccagcagcagatcggcggcagaaatttccgccccggcggcaagaatcaccgcccgctgtacgacattatccagttcgcggatgttaccctcccaactataggccgtcaaatgacgttccgcatccctggaaaacaccagggacgcgcgcccggcggcctccatatgttttttaagcaggaatcgtgccaagggcaggatatcgtccggccggtcggccagcgccgggatgcgcaagggaaagacgttcagccggaaaaacaggtcctcgcggaatttcccggactccacctcggcctgcaaatcgcggttggaggtggccagcacccggatgtccagcttgatggtgcgggtgctgccgatgcgctccacctctcgctcctgcagcacgcgcagcagcttggcctgcagcgtcagcggcatctccgtcacttcgtccagcaagatggtgccgccctgcgcctgctcgaacttgccgggcagcgcctgggccgcgccggtgaaggcgccgcgctcgtggccgaacagcgtcgactccagcagattgtccggtatcgccgcgcagttcaccgccacgaaaggaccgtcttttcggcgggagtggcgatggatgtaacgcgccagcacttccttgccggtgccgctgggaccgctgaccatcacgctggcgtcgctttgcgccacccgcccggccagggcgaacagctgccgcatcgccgccgattccgccaccacctcgccgccttcgtccccggccatcgtcaatatatgcttttccacctcggccagcaggctgggcggctcgaacggcttgagcaggtaatgagtggcgccggcgcgcagcagctcgatcgcgcgctcgatcacgccgtaggcggtcatcaggatgaacggcacgcccgggtaatgcttcttcacttcctcgaacagcgtgtaaccgtccatcggcgccatctgggcatcggaaatgatcagacccaccggctcctgcctcagcctttgcagggcctgggtgccgtcgccggcctccagcgtggggtaaccggacagggacaaggtgtctacgatggcttcgcgcaggtctgcgtcgtcctcgaccaccagaatcggtagaaacttcatggaatccaatgcttagtttatgcggaaggctggcgctgatgcgccagcgtcaccaatctttgagcgatgccggtcagccccagcacctcgtgcgcggcgcccagcgcgatcgcctccttgggcattccgaacaccacgcagctggcttcgtcctgggcgatgttccaggcgccggcctgcttcagctccagcatgccgctggcgccgtcgcggcccatgccggtcaggatgacgccgatgcagttcttgccaaccagattggccgcggagcggaacagcacatccaccgagggccggtggcggtttaccgccggaccattgttcagcgacgtgctgtagcctatggtcggcgcgttcttgatcagcaaatgggaatggcctggcgcgatgtacaccatgccggcctgcagcctttcattgtcctccgcctccttcacccgcagccggcacagcgaatccagccgctgcgcgaaggattgggtgaacatttccggcatgtgctgcgcgatcagaatgggcggcatattggccggcagcgcggtcagcagcgtgcgcagcgcctcagttccgccggtggacgatccgatgacgatcacggtttggctagccagcggcgtcttgcccggctggcgcggcagaatgacatccgcgctatggctgggaactatctccagcggggttttgctcgctctttcgcgcgaagtcagggccatggatttaccttgctgacatggtccgcccgcgccggcggacgccgttgcgcctcgccggaccttactcgggcctgatagggtttgtttagatagcttagcaggacttgccctgccaggtcagcccgccatcctgtcagccccccgccgggcgcaatcggctcagccagccggcgcatgcctgctccaacaaatccagcaccgtttcaaagcctttgccgccgccgtaataggggtcgggcacctccatctcgccgcccagcggctcaagcatcaggtgcaagcggttctgcaaagtcttgggacagcgccgacgcaaatccgccagattgctggcatccgccgccaggatcagatcaaagccggaaaaatcggcgtccaccacttggcgggcccgcaagccggacaaatcatacccgcgccgcgccgctgcctgaacgctgcgcgcgtccggtgcctcccccgcgtggtaaccatgcgtgccggctgagtccacccggatcgcttcagccagcccggcccgctccgataagcgccgcataatggcttcggcggtgggggaacggcagatattgccgtggcagacaaataaaatcgagacggcttgttcttccaacatccacgatacctcgtcaaaaagtccagccaaaactacagcgccgccagcgtccacccactccctgcgagctcaatcccagccaaacagataagccggttcgctcaactccgccagcatctggcggatggtcgggcaggctgcgccgtcttcatcttccaccggcacatccagttccgcttcctcgatcggactgacatcttccaaggcgagtccggtctcgcctgccagttcctccagcacggccagcgcgccctcctgcgagtaagccgcgacgatatcgttgccgcccacctgataagcctgtaactgctgctccacttcgcgtctccttgactgcattcctgaactgaaatcttcacacgcccatcgacggtcatgccgcggcaagcgcccgcctgcccggcaaggccgaacggcaaatcattagcggcggattttatccgcaaacgatgccagcgggacatcatccgaccgcctggggcacatttcgccgcttagccgccaggcaccgactcccgccggatgcggcgccgctccgccagcgcgaagactaaggggcacaagccgatcatcaaaaacctcatcagcatacgcttttggaatacgcgatctatactcaccctgccaactgccagccgcgggcccaaatctcccgcgcatcgccaaccgcagcgcccgacaggacagaaagcggacaagatgaaaccatccagactgatcgctcgggctgccgccgtcgcggcgctgctgcctcacttcggagcgcatggacaagaactgtgggacccgcatctgcgcggcgtcaacatcggcctcgccgccggcgcgctgccgcccgaagggctgtatggcgtgctgaacaactactggacttcggtggacaagttcgaccataacggcaacaagaccggcctgaaggtggatgcgctgatcgagctgcccgaggtgctatggtcgaccggcatcaagatatggggcgccgactacgcggtggccatcgcccaacccatcgactacaccacgctgaagggtaacggcatcccgtcgaatggccgctggggcgccttcaacaccatcttgatccccggccagctatcctggacgctgccggaaaacttccacctcaaaaccgggctggcggtttaccttcccaccggcagctcgtcgccgggccgcctgcccggtggcaccttcctgggatcggccaacggcttctggtcgctccagcccagcctggccgtcagttggctgcgcgccggctggaacctgaccatggacgccacctattcgtacaatttccagaataccgacacccattaccgctccggcccgcaattggccatagactataccgcggccaaaaccataggcaaatggaccgtcggcctgggaggctaccaggaaaaccagctgggcgacgactccggcagcggcgcggcggcctgcgcgcaaaccggcggctgccgcgccagcaactacggcatcggccccttgctcggctatcagttcggcagcttgaagctgatgggcgtctacacctacggcttccacacccgcagcgacgtcggcggcaactcgttcaacctgcggctgagctttcccttccaatagcctggagccggcgcgtgcagcagacaaaatccgcaacaagccggctaagcgcaaatacggcaaaatattagacctgattgcgacggccgccatatccggcgcggcttgccgcgcttcgacaaaaccaaggcaggaaagccggcagcgaactatcgtcccgccatgcgctatcactgagcttatccgcacgtccgagccttcccgaagaaaggccgccgcgccatcatccgcaaatccaaggggatctcgccgcgccggcccgcgcgcgcatcaggaggccatcatgtccgactcccccatccagcacatcatcgtcctgatgctggaaaaccgctccttcgatcatctgctgggtttttccaacatcaccggcgccgacgccaaaaccgggcgcgccacccgcgcgcaaggcgttccgaccccgccgccagtcaacgttttctccgaccacggcgaaacccatccctatgccgcggcggccggcaacgccccgttccagctgagcaccgaccccggccatgagtttcagaacacgctgacttgcctatgcggcgtagacgcctggcggcagaataccgacgcccatggccggctgaccggcgcggcctatccggtgccggcggccggccaggccaacagcggcttcgtcgccaattacgccgccggcggcgccaacgcccccggcctggccatgcaaagcctcacccccgagcaactgccggtgctgaacgcgctggcgaaggccttcgtgctgtgcgatggctggttctcgtcgctgccaggccccacctggccaaaccgctatttcgcgcacgccgcttcatccgccggcctggacgacagccccagcgatggccagatcgccgattactatgtggccggcttcgccctgcccaacggcacgcttttcgaccggctggaccatcacggcctcgactggaaaatcatagagggcgactcctttccccaggcgttttcgctgcgaggcatgacccacgcggcgctgaacggccatttccgcgacctcgacgatttcggcgaactgatcaacgcggacgacttcaacgccgcctacctgttcatcgagccgcgctacgacgtccacaaccactatctggacggcaacagcatgcacccgctgaacgacgccagggcaggcgaagcgctggtcaaaaccgtctacgaaacgctgcgggcctcgcgcatctggaccaacagcatgctgctggtgctgttcgacgagcacggcggattcttcgaccatgttttcccgcccgccgccacgccgcccggcgatacccagcccggcagcgagcacaatgcgcacaacttcgccttcgaccggctgggcctgcgggtgccgtgcatcgtcgcctcgccctgggtgggcgaaaacctgatcgaccatcgccagtacgatcacagctccatcgtcaaaaccgtgtgcgagctgttcgagctaggcgggccgctgacccatcgcgaccgcgacgccaacagcctcgcgcccttgatccagtccgccagccgccagaacgccccgcaaaccctgcccgccccggcggcgggtccggtcggcgcggccgccaccctgtccggcggcgcgccgcccccgtcgctgcgcggcttcgcccaaatcgcgctggcccgccagctgagcgtggcgccgccggaacagcagcaagccatcaaggacagcttcaacgccatccagggcgacccggacaaggccaaggctttcctgcaagccgcccacgacgccatcagcgcctggaaggcgcgcaactgacgacaaggagacccgccatgaacccacgctacgacgccagcagcgccgcgctgctgaacccggggctgagcgacacgctgttccagttcgaccgcagctacagccacccgcaactggcggccgaatgcgcgcgcctggcctacatccgcttcgaagacggcgacgcggagcgccaccgcctggcatcggcgctgtcgctcgccgggctgcagttggcgcaaaccttcagcgtcgacaacagccactcgcacggcttcgccgcggtgctgccatccacattgacgatagtggcgttccgcggcaccgaagtcagccagatcaccgacatcgccaccgacctgcgggcatcgctgacgccctggagccagggcggcagggtgcatctgggcttcgccgccgccgccggccagctgctgccggccttttccagctggtgggacaaccatgccaccccgcaactgatcctggccggccacagcctgggcgccgccatcgccaccctgttcgcctcggcgcatcgccaggccgaactgatcaccatcggctcgccgcgggtgggcgatcaggacttcgccgccgcctgcgccggccaggccatctgccgctatgtcgactgctgcgacctagtcgccagggtgccgccggaaacgcccgacttcccgctttacgtccacctgcccggcgagcgctatatcgacaaggatggcggcattcacgacgcgcccggcttcgatatcgccgccgaccaggccgccgcgcgcgaggaatacctgctgcagcgcgcctggaagatagactcggtgccgctgcgcgatctggccgaccacgcgccgatcaattacctgacagcgctctttccatgatctcctccgccagccgttgcaacggctggcgcatttccagcaccagccgccacaggctttccgccgccggcgacaaggtgcggttgcggcggcggatcagcacgatgcggcggctggcgcgcggcagcagcggccgcgccaccaggccgcagcccgccggcaagggcatggcgaggccgggggtgatgctgacgccgatgccggcggccgccatgcggaacaccgaatgggaatgccccagttgctgcgccaccgggcaatccagcccgtgccgcagcagcagctggtctatcagcggccggctgccggagctgtcgtccagcaataccagcggctcgccgtccagctggcgccacgacacccaggcgccggccgccagcggatgatcgccgcggcacaccagccagaaatcatccaccagcacttcctcctgccacaggtcatcgccgggctcgggctccaccaccaggccgaagtccgcctcgccgccgcgcaccgccgccacgttgaggcgctgcacctggtcctgcagatgcagccgcaacagcggatagcgctgccggcaggcggcgatgatggccggcatcaggctggccgacagcgtcgggctgctggccacatgcacgctgcccatcgcctggccgccctccttgcgcgcagccagcagcacctcgtccagttcgtccagcacgcgcgccagcttgggcaatagccgctggccggcgtcggtcagcaccacttcgcgggtggtgcggtcgagcaggcgcaactcaagcgcctgctccagttccctcaccgcgcggcttaccgccggctgggtcaagcccaactggtcgccggcccggctgaaactggcttgttcggccaccgcgcggaatacccgcaattgacgcagactgacattcataaaaaatactcatcaattgatcaaataaatacatttgtattctgaatatgactgcgattcaataggcgcatccacgcctcacaagaatcgccgacatgccaaaactgctggactccttcaccctggccctgctctccaccgtcgcgctggccagcctgctgccctgctccggcgccgccgcgcaggccttcaacctgatcaccaatctggcgataggcctgctgttcttcctgcatggcgccaaactgtcgcgcgaggcggtgctggccggcatcggccactggcggctgcacctgaccgtgctggcctgcaccttcgcgctgttccccatcctgggactgctgctcaagccggtgctgacgccgctggtcacgcccgagctgtatctgggcgtgctgtatctgtgcatgctgccgtccacggtgcagtcgtcgatcgccttcacctcgatggcgcagggcaatgtgccggcggccatctgcagcgccaccgcgtccaacctgctggggattttcatcacgccgctgctggtgggctggctggtggtcagccatggcggcgtgggacaaggcatgggatcggcgctggacatcgtctaccagctgctgctgcccttcatcgccggccagatcgcgcggcgctggataggccgctgggtggatcgccacaaggccatgctgaagtacgtggaccaaggctccatcctgctggtggtctacaccgccttcagcgcggcggtgataggcggcctgtggcggcagacgccgccggccgcgctggccggactgctgctggtcaacgtcattctgctgggcctgttgctgggcctcaccacgctggcgggccgcaagctgggcttcaatcgcgaggatcaaatcaccatcttgttctgcggctcgaagaaaagcctggccagcggcgtgccgatggccaaggtgctgttcaccggccacgccatcggcgccatcgtgctgccgctgatgctgttccaccagatccagctgatggtgtgcgcgctgctggcgcagcgcttccgccagcagcgccagcacaccggccgcatgcaagaaaaatccccgctggcttgagcggggatgcgaatggaaacgggccgggctacagatcgctgagccaggccttttccttcagctgcttcagttcgtcgcggatgcgcgccgcgcgttcgaactccaggttgcgcgccgcttccatcatgtccttttccagccgcttgatttccttggccagcgtcttctcgtccatcatcgccaccgccgcctcatccaccagcttcttgcgctcggcctcgacgctgtagacgccgtcgatgatgtccttgatcttcttctccacgccacgcggcacgatgccgtgctcggcgttgaacgccatctgcttggcgcggcggcgctcggtctcgtccatcgcctttttcatcgaatcggtgatgcgatccgcgtacagcaatgccctgccattcaggttccgcgcggcgcggcctatggtctggatcaggctgcgctcgctgcgcaggaagccctctttatcggcgtccagaatcgccaccaggctcacttcgggaatatccaggccttcgcgcagcaggttgatgccgatcagcacgtcgaacatgcccaggcgcaggtcgcggatgatctccacccgctcgaccgtgtcgatgtcgctgtgcagatagcgcaccttgatgccgtgctcggtgtagtagtcggccagttgttcggccatgcgcttggtcagcgtggtgaccagcacgcgctcgccgcgcgccatgcggtcgcggatttccgacagcaggtcgtccacctgggtggccaccggacggatttcgatctgcgggtccaccaggccggtcggccgcaccacctgctccaccacctggccggcatggtccttttcgtacaccgccggcgtggcggagacgaacacggtctgcggcatcagttgctcgaactcgtggaatttcagcggccggttgtcggcggcggacggcaggcggaagccgtactccaccagattcgccttgcgcgcggcgtcgcccttgtacatcgcgcccacctgcggcacggtgacatggctctcgtcgatgaacatcagcgcgtttttgggcaggtagtcgatcaaggtcggcggcggatcgccgggtccgcggccggagaaatggcgcgaatagttttcgatgcccttgcagaagcccatctcgtacagcatttccaggtcgaagcgggtgcgctgctcgatgcgctgcgcctccaccagcttgccctctttctgataccactcgatgcggtggcgcagctcgtccttgatctgctcgcaggcgcgcagcacggtgtcgcgcggcgtcacgtagtggctggacgggaatacggtgaagcggccgacgcgctgtttcgtcgtgccggtcaagggatcgaacagggtcagcgtttccacttcgtcgtcgaacaggctgacgcgcagcgcggtgtcgctgctttccgccgggtagatgtcgatcacgtcgccgcgcacgcggaaggtgccgcggccgaagtccaggtcgttgcggctgtactgcatggtggtgaggcggctgatgatctcgcgctgcggcgtggtttcgccttccttcagatgcaggatcatctggtggtagtcggacggatcgccgatgccgtagatcgccgacaccgtggccacgatgatgcagtccggccgctccagaatggacttggtcgccgacaggcgcatctgctcgatgtgctcgttgatgctggagtctttctcgatgaacaggtcgcggctgggaacgtaggcttccggctggtagtagtcgtaataggaaacgaaatactccaccgcgttatgcgggaagaactcgcgcatttcgctgtacagctgcgccgccagcgtcttgttgtgcgccatgatgatggccggccgcccggtctgggcgatgacgttggccatggtgtaggtcttgccggagccggtcacgcccagcagcgtctggtaggacaggccgtcggacaggccttccaccagttgctcgatggcggcgggctggtcgccggccggcgggaacggctggttcagctgaaacgggctatcgggaaagttgagcagcatggcaggcgcgcgggaagtggcgaaaccgttgattttacgcctattgccggccaatctcacccccggcgtgcgccaggcggacatccgccggcgcggcgacgcgcccccttggctgtttcagccgcccgaaaacgtctttttcgtgccgcgcggcggcggaacattgtttagaatacaagcaggagctatcccgccgcatcatccatgatgaccgcatgttgactgcagttagccgcaaatgccggatggatagcatcctttttcctcacacctcaagcgtactgcggagtgacgcatgatcaagaaaatcgcaagcttgctgatatcggcggccctggccgcgccggtgttggcggcttcgccccagggcgtgatggtagccagcgaaatgtccggctacaccgcccccaggctcaattcccactcagtgctggtgctcaacggcagcaccggcgaaaccctctacgaaaagaacacccaccagcgcatgcccatcgcctccatcaccaagctgatgacggcgatggtattgctggattccggggtgtctctcgatgacgaggtgacggtgtccgacgccgagatcgaccgtctgaagcacactacctccaggctggcggtgggcaccaccctcagccgccgggaaatgctgctgctggcgctgatgtcgtcggaaaaccgcgccgccgcgacgctggcccgcaccgccctccccggcggcagcgccgccttcgtccagcggatgaaccacaaggctcgcagcctgggcatgacggaaaccatcttccacgaccccaccggcctggacgtgcgcaatacctccaccgccgccgacctggccaagatggtgatggcggcgcagaaatacccgctgatccgggagttcaccaccaccgaaagacaccagatcctgtcggcgcgcaaccgcgtgctgcaatacaagaacagcaacgcgctggtgcgcgagggcgactgggacatcgcggtgcagaagaccggctatatccaggaagcgggccgctgcatggtgctgcaggcggtggtcggctcgcagccgctggtcatcgtgctgctggacgccggcgccagctccgcccgcgtcaacgacgccaaaaacatcaagacctggctggaagcccatccgggcagctggctggcgggctgaaccccgccgcgcgacgccccggggccggttcgccggccctttttcctgtccacgcaggaccggcatgccgttttcatcccagcgccggcatgcgatcatatccggcatcgcccgccgcagccggccagggcccgcgcacccgaggaaacgcatgaccatccagattcataccgctcagccgcaggacgcggccgccatccaccgcttcatcaccgagctggccatttacgaacgcgccgaacacgaagtggaatccagcgccgccgacatcgaggcgaccttgttcggccccggtgccaaagcgcaggccctgctgtgccatgtcgacggccggctggccggcttcgccgtgtacttcttcagctactccacctggctgggcaaaaacggcatctacctggaagacttgtatgtcacgccgcaagtgcggggcgccggcgccggcaaggcgctgctgcgccgcctggcgcaactggcctgcgaaaacgactgcggccgcctcgaatgggtggtgcaggactggaaccagccggcgatagacttctatcagtccatcggcgccaagccgcaagccgagtgggtgcgctaccggttggccggcgacgacctgcgcgctttcgccttggacgaaagcgccgtgaacgcctgagccggacccgacggtctagccgccatcgctcaaacgcgagcgcggcggcgccgccggcgagcgtttcggcacagcggcaacgaacgccgccgcctatcatccgccatgtcacccacaggaaaaccgatatgcgcaacaccttgttgatcgccagcctgctcgccctgccgctggccgcccacgccgccggcttccagctcagcagcgaaaccatcgccgacggcaagccgctgacggcgcgccaggtctaccaaggcttcggctgcgaaggcggcaatgtctcgccgcagctgtcctggcgcggcgcgccggccggcaccaagagcttcgccgtcaccgtttacgatccggacgcgcccaccggcagcggctggtggcactggacggtggtgaacctgccggccaacgtgcatgcgctgccggaaggcgcaggcagcgccggcggccaactgccggcgggcgcggtgcagggccgcaccgacttcggcgaatcgcgcttcggcggcgcctgcccgccggttggcgacaagccgcaccgctaccaattcaccgtctgggcgctcaaaaccgacaagctgccggttgacgccaacgccagcggcgcgctggtgggcttcatgctgaacgccaacgcgctggccaaggccagcctcaccgccacctacggccgctgacccgcgtgagcgacctcgcgctgcgcgaatgccgcatcgaagccggcgaagtccgcgcccgcctgccgcagcgcatccgccgggtgccggtattcctgccggccctgtgccgggtgcgccacggcctcaagcgcatctggctgggcgaacgggaaatgtcggccggacccgcgcagctggtattgctgccggccggcagcgaactggacatcgccaaccttcccggccccgccggctatctggcggatgtggtcagcctgccgccggcgctgctggcgcgcttttgcgagcgccacggctcgctgctgctgcggcaacgggccggcaacgaactatgcctcgacatcggcgaaccgggccaccgcgcctggcagctgctgatggacagcctgcgcggcgatacgccgccggaaatgcgcgagcaccatgccgaaggcgtgctgctggccctggcgctggccggccaggccgggccgctgctgcaagcgccggccgcgccggtggcgcagcggatccgccagttgctgatgctggatcccgccgcgccatggagcgtggaaacggcggcgcggaggctgaatctgggcgcctccaccctgcgccgccggctggcggaagaagacagcggcttccagcgcctgctagaagacgtgcgcatgggccaggccctgcaaaacctgcaaaccggcgccaagcccatcgccgacatcgccgccgccagcggctacgcgtcgccgtcgcgcttcgccgcgcgctttcgccagcgctacggcctgtcgccaagcgaactgcggcggacgctgtagccgacgctcaacgacccgccgcaggataaagagccgttgccgcaagccgcgatggcccctccccgccgcgccgtcaatccgcggccggcgccgcctgccgcaattccagcagattgcccgccggatcgcgcaggaacaactgcgtcagccggtccgccaccacgctgcgctggctgaaaaaatccacgccgcgggaacgcaactcctcggccgccgcctccaggctggccacggtgaaggcgacgtgattggacaccggatcgcgctccggcccctgcgcatagcgcgacacgccgtcgctgcccagcacgtgcagttgccgcgcgtcctccacatccagaaagcagccaggcacgtccgggatattccagcgcgacggatcggcacgcaggccgaatacctgctggtagaaatcccgcatcgcgtccacctggcgcttgggcaccgcgaaacccacgtggtgcagttcgcatacttgaatggccatgattttctccttgtgtgatgtcatgtcggcactccatccaaataatacgctaagcatatagttagtcaacctaatttaatggcgaaatcgacgcgctgccgcttttacgctagcatcggccgtctattttcttctccgccgccacgcgatgaacgccgcagactccaccgcccatcacgccccccacttgcaactgatgcgggaaacggccagccaggacaccgaccgcgacgccgccgccgccggcctgctgctgctgtggctgggcgacgatgccttgcaactggtcaacgccagcctgtccaggcacggcctgtcggaaaacaagctgcaggtgctgctgttgttccggctacatgagcaaggcttgttcggcgaagcgccgccgacgccgtccagcatcgccgactactgcggcatcacccgcgcctcggccaccggcttgctggattggctggaaaaaagggactgggtcgcgcgcgcgccgcacccgagcgaccgccgcagcctgcaactgcgcctgaccgaagcggccaggacgctgctggccgaagcgctgcccgggttctggcgcgcctgcgcccgcgtgaccgacgccttgagcgccgaagagaaaagccagctgctgcgcctgctgagcaagatgcagcaggccggactgagctgaatcagttaaagcgcagcagcccggcctcggccacgccgacgccgatctcgccgccgacgaacagcgaagcctgccagcgcgcggcctcgcgtcccgacagattcaacaccagctcgcccgccgccgccaccaccttgacgcgcgcgccatcgggcagccagatcagttcgacgatgcgcgccggcggctgatcgtcccccagcagcagcgcgcccggcggcacagcggcatccgccagcacgttgtcgtagccgatgaaacgcgccagccaggcgtccgccggcgccgccaatagccgggccggcgtgtcgcattgcaacagccggcccgccttcagcaccgccacccggtcagccagcgcgaaggcctcgtccctgtcgtgggtgacgatgatggccgggatgccggcttcgcgcagcagcgcgcggaacgtttgcagcaactggcggcgcagatcggcgtccaggctggaaaagggctcgtccagcaacagcagcctgggccgggtcgccagcgcccgcgccagcgccacccgctgttgctccccgccggacagcgtccataccttgcggccgccatgctcggccagccccacccgcgccagcatctcccgcgcctgcgccgcggcgtcccgcttggcgcagccttgctcgatcaggccgaacatcacgttccccagcgcgtccagatgcggaaacagcgcgaaatcctggaacatcagcgcgaagccgcgccgttccggcggctggcggcacagatcctcgccgtcaaaatggatgccgccgccgtccggccgctccaggcccgcgatcatcttcagcaatgtgcttttgccgcagccggacggccccaacaaggccagcgtctcgccggcggcgacggtcagcgagaccgcgtcggccaccacgcgcgcgccgaagcgcttattcaggtttcgcagcgtcagcacgacggtcctcccatgagccggcgccgccggcggtttcgatgatccagaacgccagcagcgccagcagcatcagcaggcaggacagcttcatcgccgcgtccatattggcggcgccgggccgccccagccgctggtagatcagcgtggtcagcgtcagccattccggccgcgacaaaaacagcgtgaccgcgaattcgcccaccgcggtggcggcggcgaaagccaggccgcgccgcaaggccggctgcagcagcggccactgcaggcgccggaatgtccgccacgggccggcgcccaggctgcgcgccgcctgctcccaatgcggcggctggccgtcgcgcgccgtcagcaaggccttggcgacaaagggataggccagcagcgcgtaggccgccagcagcaaggccagcgctgcgctccactgcggatacagcagcaacaggccgaaagcgacgcaaaccggcgacgcgacgaaaggcaggaagatcagcgcccgcaacgccaggctgcggccggcggccagcgcgtggcacaggcccagcgcgccggcggccagcaccgtcagcgcggtgaagcgggcgctgttgaacaaggccagccggacatcctcgtcccacagcgccagccagccgccgccgccggccaggccgcgccacagcaccgccagcaagggcaggccggcgaacagcagcaacgtcagcaaaccggccagcaaggccagccgcgcccgccagccgcgcgccggccgcagcggcagcggctcgaccttggccgccgtcgccagccggcgcataagcgcggcatagacggcggcgacggcgccgcacaccagcaacaccaatagcgccagcgcgccggcgtcggccaggttcaactcataagccaccaggctgtagatttcgacttccagcgtggcgtagcgctggccgcccaggatcagcgccaggccgaagccggagaagcaatacaggaagaccaggcacaggctggagaggatccagggcagcgccgccggccactccacgcgccagaacgcccgccacggggtggcgcccagcgtgcgggcggcggccagccggctggccggcacctgggaaaagccgtcgcaggcggcgcgcaccaccagcggcagattgaagaacagattgccgtacagcagcagccacggcgtgtcctgcagatggagtccggtcgccccctgcggcccgaacaaggccagcacccccatcgccgccaccagggtgggcatcacgaagggcagcatcagcagcctgagcagcaggccgcggccggggaaatggtagcgcgccagcagccaggccagcggcgcgcccagcgccaggcacagcaggcagctggccgccgcctgcagcaatgaccacagcagccgccagcgcagataagaatcggccagcaggcccggactgaactgcaggccgccttcggccaccagccgcgccaacggcgccagcgccagcgcgctcaaaaacaacacgggcaggctggccagcgccagccgccggacacccgactgcgtcaaacattcgctccagacaacggccagtcggccgtcagcacatcttcgcaaccatcctcgtcgcgcgcctgggccaccttggcgaagcccagctgcgccgccagcgcttgcgacggcaggttgccgggttcgatcgacagcaccattctcccggcgccctgtccggccgcccagccggccatcgccagcagcgcctcgcgggcgtagccctggcggcggaacgccggataaaccgcatagcctagctcgacgtcgccgtggccctgcaaatacggatggcccggccgggtgtggaaattgatgtggccgatcatggccagatcgtcgcggcgcagcatcgcccgcaccgaccacggcgcgtaggcggcgtcttcggccatatcgtccagccgcatcgccatcagttgcgcctccgccagccagccggcgtctgggcggctgcccagcaacgcggcggcgtcgtcgatgtcgccgcgcaggcaggcctgcaggaaatccgcgctcatatggcgcaggatcaggcgggaggagcttatgtctgcgatcatcacttgtgttgccgtttggtcatgggatctggacattatggcctaatgtcggcgccattcagacgccagacttcagcaccacccgcgcccagcggccgacccaggcccgctgcttggcggccagcgtcgcgctgtcgggggtatcgtgcgcggcgggctgctcggcgtgcttgtacactgggtccagcgcgacgccgtccatcgccgggtacatccacatccgcgtcgggatatccttctgcaccgcgtcggaacgcaggaaggcgatgaactgctgggcgagcttgggctccttgccgcccttgaccagcgccgcgccctccacctggcggaacaccgtgcccggcaacagcaggttggcggtgggcgcgtcgctcagcttttccttgctgtagaacacttcggccgccggactggtggcgtagctgaccacgatggggcggccgccgccgttcttggagaagtcggtgtaataggcttcggtccagcccttgctcaccttcacgccgttgtcgcgcagcttgccccacaacgcgaaggccttttcctcgcccagcgcgtggatggtggcggccaggaaggctaggccggggctggaagtggccgggttttccaccgccagcaggttcttgtaggccggcagggccaggtcgttcagggttttgggcagcggcagcttgttcttggcgaaccaggccttgtcgtaattcaacgtcacgtagccgtagtcgatggcggcggcgccgggcaggcttaccttgccgccgcgggccagctcggccggcaacggggccagcgcgccggcctgctcggccttgccgatcagactgttgtccaggccgaacaccacgtcggcgatcggattcgccttggtcaggatcagcttgttggtcatctctccggcgtcgccggccttgatgatggacaccttggcgccgtattgcttttcgaacgccgccagcagcggcttgtcgacgctgaacgagctatgggcgagcacgcgcagttcggccgcctgggcggacaggccggccagactcagagcggcggcgacaagggtgggaagcaacttcatggacatctctccgtgcggtgcggccacggagcaagcaggcagggcggatcatgttccgctcatcacgctccctccgctggcatgatccagatcaggttctcagggtgtctctcagcccgcatggcgggcacccccggtgacagggcgctagtatagcggcctatcggccccgccgccatccgccgcaagcccccatccagctctggaagcttttcccggtttggcattcgacccaggccaacgcttgcggattgagtccggccgctgtaaacgagtcatcctcttttcgatcaaagtagaaatcgtaaaaaatagccccgcgcaccaccgaccttctaatgcattcaagctgcgaaaatggatacaccgtctcgtgccgacgatagaaatccatatcatggatgccatccccagccacgactgtatagctgcgcatggcgggcaaagacagcaacacgctcagccctgcgcatatcgccagcaaacggcaacaccgctgattcaactgcgccaatttttgtcgccgcttggccttgtcccgcttgggcaatttacgaaacccatcgcgccaaccggaaagcgcgcccagcaaagccaacacccaaaacagcagcggcagcacgaaacccggctggttcagaacttgatttgtctccaggtgcagatactgaccgcggggcaaagggatgaatagccaatcccccaatgcccgcagcgggaaaaaaaacagccatgtcaggaagaaaatcagcgccagaagggagaagaaaaaaagcaggaacaagacgtttgaacaggctcttcgccaccacggcgcctgcggcgcagcttccgccatagccacctcacggtaaaatggccaatcatcgcacaccgggcatggcctgtccgccctcaggcagccgccacagcgcatgccataaacattccctcacagtttcccccgagccgacataccttgctaaaaataggcggctaagctggcatggctaccctgcatcgggaacctgcgaccatgctcaaaaaaataatcctctcatccgtgctgttcagcctgccgctttgcgcgctggccgacatcggcgtcgacggcgcgcgccatctgctgctgcgcaccggcttcggcgccaatccggcgcagatcgccgcttacgcgccgctcagccgcgaagccgcggtggacaagatcctggccggcgtccgcacccagccggccacgccgccgcccggctgggccaacgaccccttcgagcgccccggccagcctggcctgaccgaggaacagaaaaaagcgctgcagcaagagcgcaaccagcacgcggtggagctgcgcagctggtggctggccgagatgctcgccacgccgtcgccgctgaccgaaaagatgaccctgttctggcacaatcacttcgtgtcggcgctggacaaggtgcgttcgccgcagatgatgtaccagcagaatttgctgctgcgccactacgcgctgggcgatttcggccaactcttgcacgcggtggcgcgcgacccggcgatgatgcgctacctcgacaccgccaataaccgcaaggaacaaccgaacgagaacttcgcccgcgaggtgatggagctgttcacgctgggcgaaggccactacagcgaacaggatatccgcgaggcggcgcgcgccttcaccggctggggcctggaccacgacgaccagttcatcgtccggccgcggctgcgcgacgccggcgagaagaccatcttcggccagcgcggcaatttcgacggcgacgacgtgatcgacctgttgctgcagcagccgcaaacctcggtattcatcaccaccaaattgtggcgcaatttcgtgtcgccgacgccggacgcggccagcatcaacaagctggccgccgacttccgccgcggccactaccagttgaagcccttgatgcgcgcgctgctgctgacgccgcagttctggcacagccagggccaactggtgaaatcgccggtggagctgaccgtaggcacgctggtgaccttcgacctgacgccgcccgactggcgcgtgatcgccggcctgaaccgccagctgggccaggacgtgttcgcgccgcccaacgtcaagggctggcccggcggcgaagcctggatcaacagcgccaccctgctcacccgcaagcagttcctcgaccgcatcgcccacgacgccgcgccggcgcgcgacaccttcgctcaggccgatggcagcctgaacgagatggccggccgcgaggcgcgcatcaaccgcttcgtcgccaagggtgtcgcatcgatgaagctgcaacccgacgaatgggccgccatctacgacgcccgcagcgcggctgacgccgcgcgcctgttgctggcggtgccgccggccaatccgctgccgcagggagaaagcggcgccaaggccatcgcccagttgctgctggacccggcctaccaggtggagtgaaggagaccgccatgttcaaacgacgcgaattcctgaaagcggccggcgccggcctgatgctgagcgtgctgcccaacctgtcctgggcgctggccccggccggctacaaacgcctgctggtgctggttgaattgaaaggcggcaacgacggcctcaacaccgtcgtcccctacgccagcgcagattattaccggctgcgccccggcatcgccatcgcccgcgagcaggtgctgcaactggatgaggccatcagcctgaatccggcgttgtcgccgctgatgccgctgtggcgggaccagcagctggcgctgctgcagggcgtcggctatcccgagcccaatctgtcgcacttccgctcgatcgagatctgggacaccgcctcggccagccagcaatacctgagcgagggctggctgacccggctgttccgcgagcagccgacgccgaagcacttcgccgccgacggcgtggtgctgtccagccaggtgctgggcccgctggacggtggcgcgcgcgcggtggtgctggccaatccgcaggacttcgcgcgccaagccaagctggtggccgaccagcagcccggccacgccggctcggcgctggagcatattttgaaagtggaaggcgacatccgccaggccgccgccagcctggcgccgctgccgcgcaccgcgcccagcgaatcgcccaccgccggccccaagcccaacggcggcttcggcgtcgcggtgcgcacgctgaccgacacgctggcgcgcggcgtcgacatcgccgtcgcccgcatcacgctcaccggcttcgacacccacggcaaccagcagccggcgcaagcgcggctgctggccgagctggccgacgggctggcacagctgcgcggcgaaatgacgcggctgggccgctgggacgacacgctggtgctgacctacgccgaattcggccggcgtccgcgcgagaacgccaaccgcggcaccgaccacggcaccgccagcgtccacttcgccgccggcggccgcgtcaaaggcggactgtacggccaaacgccgcaactggccggcgtcagcgacggcaatctgccgcatgcgatagatttccgccaggtctacgccaccgcgatcgacagctggtggggcaaggacagccgcaatgtgctgggcggccgcttcgcgccgctgccgctgctgcgggtttgaggctaggggtcgggataagcgatgttgaagcggctgcggtagagccggtccaccacgccgtcgcgcttcatgtcgcgcagcgcgccggcaaaagcccggcacagctcggcgggcacgctgcgtttgctgaaaacataaaaggcgccgcccgcgcgccatgccggcggcagggccacgatggccggctgttgcggcaagcgggccagctcattcggcagcgtgtccatggtcgccagcagcaggtctatccgccccagctgcagcttgcgcaagctgccggccagcgtttccccggcgtccaccctcaccgtggccggaggcgctttcagccagcggtcccatgcgtcgccgtaactgtcgccatgcgtcacgcccagcctgaccaggcccagcttgcccaagtcctgcagctgggcaaccggccagcgcgcagcgcgatcggcgcgcacccacagccgcacctgcgctgagctgtagcccggcacaaaacaggcgtacgcctcccgctccggcgttttcaacgcctgcatcgcgacatccaccgtgcccagccgcaactcctgcagattgcgcgaccagggcatttgacgataagccaggcggcagccaaggcgcgcggcggcttggttcagcagttccaccgagtagcctgcgggccggccatcccgtccctggtaatgatagggcggccgctcctcccaccccacctgaatcggcttgccgcacaccccgccagccatcgccggcaaaatccagcacgccaggagaacgaaattcccgatgaaccgcaccgtcacctcccgtcctcggcaagcgcaagcgcgctcccctacaatgttaggatagaatccccatgccgatggcgtccggcgggcgcagtcgaaccaccaccagcgacagaatcactgccacatgacttcgaacaataccaaaagcaccgaccacccccaggcggcgacggaagacattccgctgccgccgccggaaaacgaactcaatctggccaatctggccatcccgctgggcgaaaccatcctcaccctcaatatcgagggcgcgccgatctacggcatcttgcagcgcagccgcgccatgacttcgcagtccgactacttccgcctgcaattccgcggctacgcccgcgccgacagcaaccagcactggcaaatgctggaaggcgacgacagccgcttccacgccgtgtacaacgtcgcctgggtgcgggtggaccgcccgagcaagtccgtcaccttcggccccaaaagcggcgtcagttgcagccctgcgctgatgggcagcggactggacgcctttttgttcgccagcgtgatcgtctgggccaagggcgtctgccccgactatgcgatcaccccgggcctggtcaataccgggcaaagcagcaccgaagaagaaaggctgcaacgccacgcctttttcgccggccaaggcttccagttcgagtggcaggatccgacccagcgcaccgcgctgtatttcaaggacaaggtgaacaagctgctgggggtgtggaacaaggatgtcatcaaggaattcggcggcgaggacatgctgaagcggctggcgggccaggatgaggcccgcgcctcgctgcagcaaaggatagaccagctggagggcgcgcacgacagcctcaagcgcgcgctgcagaaagaaagaagcacctcgcagatcctgaccggcgtgctggtgctggcggccatcatcggtttgtgggcggtgatctgagccgccgcccggccggcattcagaacgaggccccggcgcgcgcggcctggtcgtaaacgccggccagcgccctcatcagttgggccacctcgcctatggccggattggcgatgccgccgtcgctcagcgtcggcagcaggcactgctcgcgcacctggcggtaacgctcgcacaatgcccggccattctcggtggtggagaacaacacttccttgccgcttttctcgctgcgcacatagcccatcttcaccagcttcttcagcgcgtaggccaccacgtgggtgtcctccatattcagcacgaagcagatgtcggccagtttcttctgccggccgcggtggttgacatgatgcaccagcagcacctcggtgggcgtcatgtccttttctccggcggcggccatgcagcgcaccatccagcggtgaaaggcattgttcaccaccgtcaggctgaattcgaactccgacaactcggggctgcgctccgacaccagatgctgcgaagacacgatcttcggcaaatcattcgtcatggacgttcttctccgttctctcgaaattcaaggccttcccatcctttcattctcataaattgacgagaaattattaacattgcatcattacattcaattaacccataatcataatcatattctcaaatcgcatttcgtcaaaacccgatgccttccgcccccctcacctcgcccgcgatccattggctgggcagccaggccctgacgctggaaatgccgccgcccgccacgctggactgccagcgccgcatctggtggctggcccgacagctgcaagccggcgacggcatccgagaaatcgtgcccggcatgaacaatctcaccctggaactgagcgacgatccggcgctggccgcggccttgccggcccggctgcgcaagctgtggcagcaggcggaacaagccgacatcccgcagcggcgagtggagattccggtttgctacggcggcgaatacggcccggacctggaccacgtggcgcggcattgcggcctcagtccgcgccaggtggtggaacggcatggcgcgagcgattacaccgtgtatttcctgggctttcagcccggcttcgcctaccttggcggcctggatccgcggctggccaccccgcgccgcgccacgccgcgcatcgcggtgccggcgggcgcggtggcgataggcggctgccagaccggcatctatccgtcggcctctcccggcggctggcagatcataggccgcagtccggcccgcttgttcgacccggcgcgcgaacccgcctgcctgctgcagccgggggacatcgtccgcttcgtcgccagcaaggaatcgccatgctggaagtgatcaaggccggaccgcaaaccacggtgcaggatctgggccgcttcggcgcgcgccatctgggcgtatgccgcgccggcgccatggacggcctggcgctgggcatcgccaaccgcctggtcggcaaccccgccgacgccgccgcgctggaaatcacgctgccgccggcctgcttccgcttcttgcgcgccggccagttggcgctggccggcgccgattgccaggcgctgctggatggcgagccggtgtggccgggctggcgcgttgccttccgcgccgggcaaatgctgcagctgcaggcgccgcgcttcggcatgcgcgcttacctggcgctggacggcggcatccaggcgccggccgtgatgggatccgccagcaccgatctgctggccggcttcggcggcctggacgggcgggcgctgcgcgacggcgaccgcctggcgctggggcccgcgcggccgccggcgccgcggctgggcgtctggctgccccgccccggcagccagatccgcgtctgccccgggccggaactcaagcggctgtcgaaacaggcgcaagagcgtttctggcgcgaaccctggcaattgacgcccaacagcaaccgcatgggctaccggctggccggccccgcgctgacaggcggcgagacggtggatatgctgtcccacggcgtgctgcccggcctgatccagctgccgccggacggccagcccatcgtgctgatggccgatgcccaggccaccggcggctatccgcggctgggcatggtgatagaggccgacttgtggcagctgggccaggcgcgcctgggcagccagctgcacttcatcccgaccgaccccgacggcgcccgccaggcgctgcggctgcagcaacgctatcaacaccggatcgaaaggctgctgaatgcaaattgacctcaacgccgacctgggcgaggactgcggcgacgacgccgcgctgctggaacacgtcagctccgccaacatcgcctgcggctggcatgccggcagcgcggacaccatgctgcaagtggtgcgcatggcgctgcggcgcggcgtcgccatcggcgcccatcccagctttcccgaccgggaaaatttcggccgccgcgagatgcagctgccgccggacgcggtgcgcgccggcgtgctgtatcagctgggcgcgctggacgccatcgtccgcgccgaaggcggcgagatgcgccacgtcaagccgcatggcgcgttgtacaaccaggccgcgcgcgacccggcgctggcggcggcgctggcgcgcgcgatccgcgacttcaatcccaggctgcgggtgatcggcctggctggcagcggctttctcgccgcctgccgcgccgagggcctggacacgcggcgggaggttttcgccgaccgcggctatcgcgccgacggcagcctggtgccgcgcggcgcgcccggcgcgctgctggacagcgccgaagcggtgctggcccaagtcagcgacatggcgctgcgccagcgcgtgatcgccgtcagcggcgaaagcgtgccgctgcgcgccgattccatctgcctgcacggcgacggcccccatgcggcggccttcgccgccaggctgcgcggccacctggaagccctgggcatccgcatcgccgccgactgagccaccccgacaccgcgccaggcggcggccagaccgcagcgcggccccacccaaggagaaaccatggacccagctgtcaatctgtggccgctgctaggcatagcggtggtcatcgcaggcttcctgctgcgcttcaatccgctgctggcggtatgcgccgccggcgtcgtcaccggcctggccgccggcatgccggcgctggccatcctggccaagctcggccagggcttcatgaaaacccgcaacatcaccttgatcctgctgctggtgctgccggtggtggggctgatggagcgccacggcttgcgcgaccaggcccgcgcctggatacggcgcatccgcaacgccaccgtcggccgcctgctgatcgtctacctgctggtgcgggaattgtcggccgcgctgggcctgaccggcttgggcggccatccgcagatggtgcggcccatcctggcgccgatgaccgaaggcgcctgggagcaacgccacggcgagccgacgcccgagcaacggcagaagctgcgcgccatgtgcgccgccaccgacaatgtcggcctgttcttcggcgaggacatcttcgtcgccttcggagcggtgatgctgatgcataccttcctgcaggaaaaccagatccccagcgaaccgctgcacatcgcgctgtggggcattcccaccgcgctgttcgccttcatcatccacgccgtccgcctgatgcggctggaacgccagctgctgcggcaagccgccccggccgcccatctgtcggagaagcgcgcatgatcctgcatgtcgagtacctgtactggctggccggcgcggtcctgctcttggtggcggccggcgcgctggccgaccccggccatccgcgccgctacggcagcgcggcgttctggggcctgttcggcatgctgttcctggccggcgactggctgccggcgcagctgtccggcgccatcgtgctggccatggtgctgctggccggcctgggccgcctcggcagcggccatcacatcgcgctgtcggccgcgcggctgcaggacagcctgcgtcggctgggcggcaaggtgtttctgccctcgctgctggtgccgctgctgaccgtggcgctcagcctggcggccaaggacgtgaaactggcgggcgcgccgctgttcgaccccaagaatgtcacgctgctggcgctgggcgtggcctgcctcgtttccttcatcgccgcctgcgggctgacgcgtgagcggccggcgcagagcatccgcgaaacccgccgcctgctggactgcatgggctgggcggtgctgctgccgcagatgctggcggtgctgggcctgctgttcgccgacgccggcgccggcaaggcggtggcgcatgtggccaccgcctacctgtcgctggacacgcgctgggtggcggtgctggcttatgtgctgggcatggcgctgttcacgatgatcatgggcaacgccttcgccgccttcccggtgatgaccgccggcatcggcataccgtttctggtcggcatgcaccacggcgacgcggcggtgatggcggcgataggcatgttctccggctactgcggcacgctgatgacgccgatggccgccaatttcaacatcgttcccgccgccctgctggagctggacgacaagaacgcggtgatcaaggcccaggtgccgaccgcgctggcgctgctggcggtcaacgccgcgctgatgaactggctgatgttccgctgaggagaaaaacatgcaaaccgtattgctgaccggcttcgagcccttcggcggcgaaaccgtcaatccgtcgtgggaggcggtgcgccggctggatggcgcggagctgggcggcgcccgcgttttcgcgcgccggctgccctgcgtgttcggcgcagcgctcgccgcgctggacagccatctggccgagctgcggccggagctggccatcgccgtcggccaggccggcggccgccccgacatcaccgtcgaacgggtggccatcaatgtcgacgacgcccgcatcgccgacaacgccggccggcagccgatagaccagccgatcgccgccgacggcccggccgcctatttcgccacgctgccgatcaaggccatcgtcgccggcctgcgcgcgcaaggcatcccggcctcggtgtcgcaaaccgccggcaccttcgtctgcaaccatgtgatgtacggactgctgcaccggcgcgtgccgcgcgccggcttcatccatattccctatctcccggagcaggcggcaggccatcccggcgcgcccagcatggcgctggacgattgcgtcgcggcgctcaggctggcggtggagctggcgctggcgcatcgccatgacctggcgctggcgggcggcgccacccactagccgcggcgccgctcagccgacgacgtcgcgcccatagtggtcggagaagcgcacgatgtcgtcttcgcccagataatcgccgctctgcacctctatcatcaccagctcgatccggccgggattggcgagccggtgcttttcgccggcgggaatgaaggtggactggttggcctcgatccggcgctcctcggcgccgttgaccaccagagcggcgccgctcaccacgatccagtgctcgctgcggtggcggtgcatctgcagcgacagcgacgcgcccggcttcaccacgatgcgcttgatcttgtagttgccgccctcctccagcaccgtgtaatggccccagggacgcggcgtggtgcggtgcgacagataggccggatggccgcgccgtttcagttcggcggcgatgtccttcacctcctggctgcggcggcggtcggccaccagcaaggcgtccggcgtgtcgatcaccagcaggttgtccacccccagcgtggccaccagacggccgccgctttgcacgaaggtgttgcgggtgtcgcgcagcagcgcttcgccatggctggcgttgccgttttcatcatgcgggtactcggccgccaggctttcccaactgccgatatcgctccagcccagctcgcacggcaccaccgccgccgcgtccgacttttccatcaccgcgtagtcgatggagatgtccgggcagcggccgaaactgcgcggatccagctcccgctgccggcggcccgggccgcgcagctccgggctggcctccaggcatgcggccacgccggcgagcacagcgggcgcatgactggccagctcgccgcgcagggtttcggcgtcgaaacagaacatgccgccattccacaaaaagcggccatcggccagatagcgttcggcgctggccgcgtccggcttctcgacgaagcgcgccactcgatagcccagccgtccaatcgcctcccccggttcgatatagccgaagccagtctcgggccggaccggcttcaggccgaaaacggcgatgcggcccagctcggccaggccgcgagcgcggaccgccgcttcggcgaaagcgctctcgtccgccatcaggtggtcggccggcagcaccagcagtatggggcgcgccccgtcgcggcgggccagcgcgtccagcgccgccgcggcgatggccggcgccgtgttgcggccctccggctccagcaggatctccagctccagcctcgccgcattgaccgcgccgcattcctccagcacatggaacagcagctgccgattggcgaccaccatcacccgcctcacgccatccaagcgcgatgcccgcaggaaggctttctgcagcaggctttggccatccgccatgcggatgaacggcttgggcagcgcctggcgcgaaaccggccacagccgggcgccggcgccgccggcgatgatacagggaatcaattctctcgtttgcatggccgctgtctcatccctcctgtcaggcgccgcgggcggcggcgaagcctgctccagtgtatccagtttgtcagatctaacgatagccatgcccgcgccgttgaccccaccatctgctgtcgcggcagccgctgtccatgaaaaaggcccgcgcgaagcgggcctgccggcatgcaaacctcccggttcagacgtcgtcgctgtccgcccagccttgctggtcgccgcgattgagcacccggtcgtccggcgcgatgtcgcccgcgccccacggctgcgccgccgacaggcgctggtacagcggcgtgaaatcgggagcggtggcgtcgaacaattgcttgaagctgtcgatgacgaagtaggtcttctggaaggtatcgatgcggtagcgcgtattcatgatgcgcatcaggtcgaagcccacccggttgggactggggctgtccaggcagtagatggactccgacttgctggacaggatgccggcgccgtagatgcgcatgccctgcggcgtatcgatcaggccgaactccaccgtgtaccagtacagccgcgccagcatcggcaacgcgcccagttccttggccttcatgccgcccttgccgtatgcctccaggtagtcggcgaacaccggattgatcagcagcggcacgtggccgaacaggtcgtggaacacgtccggctcctgcaggtagtccagctgatgcggctcgcgcagccaccaggtcaccgggaagcggcggttggcgaggtgttcgaagaacacgtcgtcgggaatcaggcccggcaccgcgacgatcttccagccggtggcggccatcagctggcgattgagcttgtcgaagtccggcacccggtcggcgtccacgcccagctgctccagcccttgcaggaattcatcgcaggcgcggccgggcaacagcgcgcactggcgctggtacaaggtggcccaggtggcgtgatcttccgcgctgtaacggtccagcggctgcggcagcgtgtaatcgttggcgtcgtggctgagtccgacattcttgcgggtggtgatgtcgggcacgacgaagtcggcgcggtcgttcatttcggcactcctggaggattgggtcatttactctagtttagcccttcacagatgcgggaagaccgcataatttgctgaaatccagtaaattttgcatacttgccgcatcaaatgtcatatggtgcacaaaatgcgcaaaatagagctggaccgctttgatctggagatcctgcagcaattgcagctggacgcccgcgccacccaccagcggctggcgcaggacattccgctgtccgcctcgcaaatcggccgccgcatccagcgcatggagcaaaacggcatcatccagggctaccaggtggcgctggacccggagcaagtgggcctgtcggtgatggccttcgccaacgtcagcctggagcggcacaacgaagcggcgctgctggatttcgcccaatccatccacgcgctgccggaagtgctggaatgctacgccgcggcaggcgaagccgactacctgctgcgcatcgtggtgcccgacctgccgtcgctgtcggccttcgtgatgaacaagctgatgcagctgtcgctggtgcgcagtgtcaaatccaccatcgtgctcaacgccatcaagcaaaccatgaagctgccgctggcgtcgctgccctgacatttctgccatccacgccgcccgaccgcaaggctataccgcaaccgtgcggccgggactatccagctggcggaatttccttatgcgcaaatacgcatagccgaaccaccagaaattccatcatcatatcgcctgcaaaaaagccgcccaatgcgtcgctaccatatggatagcaaggagaaatcgatggaaacgccgaatgcccgcgccccgatcccagccgagatcagtcccgggctactggccgcgctcaagcggctggaacagtttcaggcccgcctgagcctggaagacattcgcggcttccaccgctcgctgcgcctcggccgcgccgacttcgcgccgttctggctattcggcgacagccaatatcgccgcaaccgcatctatgccgatgatttctgcgaactgctgctgctgtgctggcgcagcggccaacgcagccagatccacaaccaccggggcagcctgtgcggcgtgcgggtgcttcagggcgtggccaccgaaaccgtgttcgaagaaacgccggccggcctgctggcttcgcgcgaaacccgcgaactggccgccggcagcctggtgatcaacggcgatcaggacatccaccagatagccaatcaacaagatggcgatctggtcaccctgcatctgtactcgccgccgctccggcaaatgcggctgctcggcctggagccgcagcatggccgcgcccgcttgccggacgactgtctcgaataccagatctaaccccgccctgcgcgaaaaaaaaaagcgcggcatcgcgccgcgctttcttccttcgcgttcaagccatcagaagcggtattgcgcctgcacgcccagcaggtggccggtaatggagccgtattggccttgcaggtggctttgggtgccgaacgggctcttggagacgttgtcgatcttgcgatcgcccaccgcacgcagatacgcgtagctgacatccaccgtggcctgcttgctgatcttgtagccggcgcccaggctcagccagatgcggtcggcgtccggaatcagcggattgcggtgctcggcgttgggcaccggagtggtttcatagcccaggccgctgcgcagggtcagcgcgtcgttgaagaagtagtcgccacccaccgagaacatccagctgttcttccagtggttgtcgatgcgggtggtggtatcgatgccgccgaactgcgggctgcccttgatcaccaactggtcgaaacggctccagcgcgtccagcgcgcggtggcgccgacggcgaacttgctgttcagcttgctgtagccgctcagcagcagcgactccggcgtggtgacgtcggccgagccggcgtaggtgccattcagacgcgacagcggcatggtcggcgccagatcgacgaagccggaattgatgtagtcgcccttggccttgtggtcgatcttggaacggtaggacagtccgatgcgggtatcggcgctgtagctatacatcacgcccaggttgtagccgaatccccagctgtcggccttgatctcgccggtggccccgggcaggaaggcgcccttcttcagatgagccttcgcgtactgggccgacacgccggcgccgaagctccagcgctcgtccagcttgtaggccagcgagggatttatgtccagcgtcatgatggagctggagatgccgctgtcgcgccctgcccagttgtcgttgtagcgcgcgcccaaaccgaacggggtggtcaggcccacgccggcgtacaactgatcattgatctgatgcgtgaaataggcattggggatggcgacgcccggagcgcggccattgtccgaggcttggctggttcgattcagccgcgggtccggcgaaccgctgacggtattgctgccctcaaacggcgcatcgacttccgcataggtgaagccgccctgcgcccgggtgccttgcagcagggtcatgccggccgggttgtaaaacaccgcggacagatcgtcgccggccatgccggcgccggcgtgggcgcggcccatgccggccacgctttgctccgtcagttgaaagccggcggcctggaccgcgggagcggcgaacaggccggcgacgatgagggaaagcagacgcgccgagcgaggcgaaacagcagattgcattgtgttcatgttcctgaagtgttcttcttgcgccgcgtggccatgccgtgccggcccgggcttatccaatcagcaggcgcatgataaatagatagcgcttgcatcttttttagggcgtggagtctaaactcgaatccgccccatcgcaagagaaaaacacatcttcctgaacttgtatgaacagacgccgccgccgccaaacagccggctggcgatcctcctccgcgcctgtgctagaatcacagccccaacttccctgtcggcacgcatcgctatcatgaagaaactgttctgcagcctggccctggccgccctgcccgcgctggccttcgccgccccggtggtggagatggtcaccaacaagggcaatatcgaaatcacgctggattcggccaaggcgccgaagaccgtggccaatttcgtcgcctacgccaaggccggccactataacggcacagtcttccaccgcgtgatcgacggcttcatgatccagggcggcggcttcgacgccaagctgaaccagaaacccacccgcgcgcccatcgtcaacgaagcgggcaacggcctgaaaaacaatgtcggcaccattgcgatggcgcgcaccaacgatccgaactccgccaccgcgcaattcttcatcaatgtgcgcgacaacgacgccctcaattacacttcccccaatccgcaaggcgccggctacgccgtattcggcaaggtgagcaaaggcatgaatgtggtgaaccgcatcgccaagacccgcaccggcagcatgaacggcatggatgacgtcccgttcgaacccatcgtcatccagaaagtcaccatcaaaccctaaggccgcgcaaccggcctcagcgcaaaggaaagcctcatgatcaaactgacgaccaacttcggcgaaatcacgctggaactgttccacgaaaaagccccgcaaaccgcggccaacttcgagcaatacgtgaaaagcggccactacgacggcaccatcttccaccgcgtgatcaacggcttcatgatccagggcggcggtttcgacgcccagatgaagcaaaagccgacccaggacccgatccagaacgaggccaacaacggcctgtcgaacaagacctacaccgtggcgatggcccgcacttctgacccgcactccgcttcggcccagttcttcatcaacgtctccgacaacgatttcctcgatttcaagtcggaaagcacccagggctggggctacgccgtgttcggccaggtcgtggccggccaggacatcgtcgatcgcatcaagaccgtgcgcaccggccgcagcggcatgcatcaggacgtgccgctggacgcggtcgtgctggaaaaggcggaaatcatctgatccgcccagcctgaaacaccagccggggcgccgccccggcttttcattgcccgataccgatccgctgccatggccacccacttcatttccgacctgcacctcgccgacgatacccccgcgctcaaccagctgttcctggacacgctgcagcaatggcggggccggatagacgcgctctacatcctgggcgacctgttcgaatactgggtgggcgacgacgacgactccagctatctggaagcgccgctggccgcgatgcgcgaattcgccgccgcgacgccgctctacgtgatgcgcggcaaccgcgacttcctgctgggcgccggcttcgaagcgcgcagcggcgcaaagctgctggatgatccgacgctgacagacgtccacggccagcgcatcctgctgtgccatggcgacgcgctgtgcaccgacgacgccgcctaccagcaattccgcgcgctgagccgcagcccgcaatggcagcaggcgatgctggccaaaccgctggcggaacgccacgccatcgcccgccacgcccgcgcgcaaagcgagatgaacaagcagcaaaccggcctcgccgccatttccgacgtcaccgaagccgcggtgcaggcgctgctggccgcccacgactggccgacgctgatccatggccacacccatcgcccggcccggcaccgccatcaggcgggcgagcgcggcgccagccgctgggtgatccaggactggcatggcgggcgcggcggctacctgctgctggacgacgccggcatccgcgcgctgccgctggggcgctgaagcctccacgctttccccgcccctcccggcaggcctgtccgcgacgcccgcggcggcctccatcccctgcacctcccgcccccctcccggccctccgcgaatggcgacattgccacactcgcgccgcgcattttcctgcgcgatccggcgccagcgccgacgccgtgctcagccctccgccctcccgccccgagcgcgtccgccttcaatttaaatgcctgatgaatataaagaatattgcgctgcgaaatttatattgaaatattaatttcagtcaattcattcacaaatccacgcctttattgagcaactctttatttaaagacatatttgtttattctttttgcaatgttggtttcttgaaaatgaaatgacgctcgactagatttgccgcttccaggatattttcaaggcaaaatatgttcgcgccgccgcacaagccgctcttcggaaaacaatccacaatcgtggccgcttttccattccaggtgctcactttgccttgccgactccttcatggctcctccccggtccacgccgcctcccggatcgacagtatccgtttgcttgaacgttagtctgccctacccatcaggcaggacatcggctgcgcccggcaaacaacaatggcattaaaacaatatatttggctcgtataacaaggaaatagaatgaaaccatcaaattacctgcgtcccgtgacgctggccgtcctggccgcgctgggcagtccggccgccctggccgacagcgcccagctggaaaccgtcaccatcaccggcgtcggcgacaagctcggcgtcggcctgctgcagcagcaggaaggcgtgcgtgcccgcagcgacgtcagcaaggcctcgctggaaaagcaaagcccgacgtccaacatctaccagggcatcaatatgctgcccggcgtcaacgcctccagccaggacgcttccggcttgttcggcggcgcgttgacgatacgcggcttcaactccgaccagctgggcatcaccatcaacggcgtgccggtcaacgattcgggcagctacgccgtctatccgcaggaattcatcgacaatgaaaacctgtgccaggccttcgtcacccaaggctccagcgataccgactccccgcatatcggcgccagcggcggcaacctgggcttcgtcacctgcgatccggaaaagacccgccgcttccgcatgtcgcagaccatgggcaacaaccatctgcaccgcacctatctgcgcggcgacaccggcctgttcgccgacaacaaggcgcgcgccttcatcagctattcgcataccgagtcggacaaatggaaaggctcgggcgacgtcacccgcgaccacgtcgacaccggcttccgctacgatttcgactccggcagctatatcaacgcctccatcctgtacaaccgccagctcgccaacgccatctacagcccgacgttggccgagctgcagaagtacggctacaactacgactattcgaccagcttcgcccccggccacctgccgccgaaaaacggcacggcccagatcgagtccggccccagcccggcttactaccagctggcgatgagcccgtttcaaaacgtgatcgccaaagtggacgccgtgctcaagctgggtcccgacacccgcgtcaagatcgagccctactactggtatggctacggcaccggcggcagccagcagcaactgctgtcggaaagcggcttcctcaaccccgccacccacagcaacaccgcctccaaagacctgaacggcgacggcgacaccctggacaagattctgatcgcctccagctcggtcacccgcacccgccggcccggcgtgacggtcaccatggagcaaagcctgggcaaccacttgctgcaggccggcctgtggtatgagcgcgccgaacacgtgcagaccagccccggcgtgccggtcaacaacgacggcacttccagcagcgtctggctgaactccaactacatcacccgtccggacggcagccgctaccagtatcgcgattgggacaccatcagcaccgccagccagctgttcgcgatgggcacgttcaacttcctggaagacaagctgggcatcaccgccggcgtgcgcgcgccatcgatcaaccgcgatttcaccaactacgccaacgaaggctgcggcgccaccgccaactgtccggcggcgtacaactacaacatcaaccgcacctaccgcgaaaccctgcccagcctcggcgcgcgctattacctgacgcccaagcagcaggtattcgtcaacgtcaccaagaactaccgcgcgccgcccaactacgtgtacagcagcaccaacggcaatgtgcaggtggtcaacggccaggtgcagctggtgaacgagatcgtgccggaaaccgcgatcaacaccgacctgggctaccgcctgcagtcggactacgtgacgctgagcggctcgctgttcaatgtcgactacagcaaccgccaggccaatagctacgacccggtgacgctgaagtcggtcaacgtcaacgccggcagcgtccacacctggggcgctgaaatcgagctgggcacggtgccggtgaagggatggagcgcctacgcctcgttcaccaccaaccacagcgagatgaagaacgacatcaactggcagaaaaacaccgtgctcgccacccagggcaaggacttcccgatgaccccgcaatggatggcggccctgtcgctgcaatactcgccgggcgcctggtatgtccgctccgacgtcaagcacaccggcaagcagtacgccaccctggtcaacgacgaggcggtgccggaatacacgctggtggacctggatgccggctaccgcttcggcaatacctccatgctcaagaatccgacgctgaagctgaacgtcggcaacgtcttcaacaccagctaccgcattccgtccggcatgaaggccaacgccagcgacggcggcggcgttcgctactacctgggcgcgccgcgcagcgtggccgtctcgctgtcggtcgacctgtaagcccccaccggccgggactgccgtcccggccattgcgcagaacccggccccgccgggttttcatgccgtccaaacgccgttgtcatcaccagaactttccctcatcatcgaacattacccgttcatcatgatttggagagcctcttgcccagccgtttccccgcgcgccccgccatcctggcccttgcctttcccttcgccttgccggccctggccgccctcccttccggcccggaggccgtggatagccgggcgctcggttattaccgccaggccgcggctggtccggacagcatcgtgttcgtcgccgaaggcgacttgtggagcgtgccgtacagcggcggcatggcgcggcgcctgaccagccgcccggccgacgcctacagccccgccctgtcggccgatggccgctggctggccttcgtcggccgctacgacggcgcgcccgaggtatacgtgatgccggcgcaaggcggcgccaccaaacggctgaccatagacggcgaccgcggcgtcaaggtggaaggctggagccgtgacggccgggtgctggtctccagcagccgctacagcggcaaacccgacacccggctctacctgatccacccggacagcggcgaacgcacgccgctgccgctggccgaagccgccgaagcctgcctggacgcccagggcctgccgacgctgttcgcccgcgagccgcagccatcggacaacgtcgtcggctatgtcggcggcaagcgccaacagctgtggagctggcagcccggccgcgaggccaagccggccttccccggccaccccggcaccagccgccagccgatgtgcgatgacggccaggcctatttcatcagcgacaagggcggccggctcaatctgtggcgcgcccgcctggacgccgacggcgcgctggccgacagccagccgctcacccattaccaggacttcgaagtgcgcggcgccagcctggcccgcaccgccgccggcagccgcatcgtcttcacccgcgccggccagatccatgtgctcgatccgcgcagcggccaggaccagactctgtcgatcgcgctgaattccgatttcgaccagctgcgcgccaagatgatcaacaacccggtcaactacctatccgcgctggcgctgtcgcccaacggcgaccgggtggcggtgcaggcgcgcggctatgtctccatcttcccggtcggcgccggccgccgcgtcgacgcgctcgccgacagcggccagcgcgcgcgcgaactggccttcagcgccgacggcaaatcgctgctgctggtcagcgacaaggacggcgagcaggaattctggcgcgtctccgcccgcggcggcgatgccgccgagcaattgacccgcggcagcgactcgccgatctaccagcccaccccctcccccgacggccgcaagctggcctatgccgacggccgcaggcggctgtggctgctcaacctgggcagccgggacaagaagctgatccgccagctggagcaaggcgagctcagcgatttcaaatggtcgcccgacagccgctacctggcctaccgcgccgacgccgccaacgagttcagccagctgtggctgtacgacagccaggaaggccgcggccaaccgctgtccagtgaccgctaccacgcccgcagcccggcgttcgcgccggacggcaaaacgctgtacttcctcagcgaccgcaatctggactcccaggtttccagcccctggggccagcgcgaccccggcccctacttcaaccggcaaaccaagatctacggcctgatgctggacgcctccgcccgctggcccttcctccccaaagacgagctggccggcaagcgcgcggccgacggcgacgacaaggagcaggacgaggccaagggcaaggacaaagacgccgccgccaaaccggtgaagatagatccgggcctcggccagcggctgtacgaggtgccgctggaaccgggcaattacgacaatctgcaagtggacgccaagcggctctatttcacccgtgccgacacgccggaagcggaggtcaagcaactagccacgctggcgatagaggcgcccaacccgaccccgcccaagccggaaaccttcagcgaaggggtgcgcgaattccgcctgtccgccgaccgcaagcaactgctgctggtgaaggaggtcaacaagcaacccagcctgctggtgctgccggccgccgcccaggcgcccaaggagctggacaagtacaccgtcagcctgcgcgcgtggtcgctgccgctggacccgcgcgccgaatggcggcagatcttcaacgacacctggcgcatgcaccgcgacaaagtgcatgccgccaccatccgggcggtggactggcaggcggcgcgccgccgcttcgaaccgctgctggacaagatcaccagccgccaggagctgaatgacgtcctcgcccagatgatcgcccaagtcggcatccagcacagccaggtcggcctgcgcgaagctggcggcggcggcgagcccgaggtcggccagctggccaccgacttccgccgcgcgcccggcggcctgcaggtggccgccatctggaacggcgacccggaactgctggaagagcgctcgccgctggcgcagccggaggccggcatccgcgtcggcgacctcatccgccaaatcaacggccagccgctgaagagcgaatacgcgctcgccagcgcgctgcgcggccaggtcggcaagcaggtgctgctcggcatccagcgcggcgacggcaagccgcgcgacgtcatcgtcacgccggtcagcctcggccgcgaccgcgatctgcgctatctgggctgggagagccagcgcaaagcgcgggtggagcgggaaaccggcggccgcgtcggctacctgcacctgcaggcgatgggcaaggaggacgcggcgcgctgggcgcgcgaatactacccggtgttcgagcgcgagggcctgatcctggacctgcgccacaacaacggcggcaatatcgaccagtggctgctggaaaagctgctgcgccgcgtctgggtatggtggcaggacggcaatcagaccctggccagccccaatccgccgcacgccttccgcggccgggtggtggcgctggtggacggcgacacttactccgacggcgaaaccttcgcgctgggcctgcagcggctcggcatcgccaccctgataggcgaacgcaccgccggcgccggcatgtggctgagcgacgacaactggagccgggacaagggcatcgcccgcgccgccagctcgccgcagttcgtgaccgacgccggcggcagccgctgggtggtggaaggccgcggcgtgacgccggacatcgaagtggacaatccgccctgggccagcttccagggccaggacgcccagcttgaggccgccatccgctacctgaagcagggcctgccatcccaaccggccggccgcccccaggcgcccgccggcggcgcccagggctcgcgctaccagggcttctgacgcccgggcggcggcctgccaggccgcgccgcctttctccctcgccaacgcgccggcccgccggcgcgttttcgcatccgcgatgccaagcgcgcatttggcaaaaaataccagtacattggcctcaaaagggcaaatctatatacttaccggcacaaaaatggaatgtcgttccacaccttcgccaaatgacaataacaggagcgcaaacatgagtctgcccatggtcaaagagcaggaaaaggtgcgtctggtcttgcaaaaacaagacatcccgcccgccttcaagatcaacgtcaagctgttcgccgatgtcagcggctccttccgcgacgaattcaccagcccgctgcccggcggcggctacgtggtggaccccttcttcaccgccgcactggcgatagccggcgagatcgaccccgaccgcaacatccagatcatcggcttctccgaccgcgcgctggataccggcgactactcgctggaccatgccggcaacctccgccaggaattcctccgccgcgcccagcccatcctgtggggcagcaccgattacggccgcgcgctgcaggcgctgctggaaagcgagggcatggccagcaagctgggcgggctgatcaagggcctgttcggcttcggcaagaaaacgccgccgccgcgcaaggaggcttacctcgcgctcttcgtctccgacggcgaggacatgggctcccaccagtatttcctgtcgcagctgcgccagctggccgaaatgggcaccttcgtcgtgctgatcggcgccaattccgacaaaaaagtccagttcgagcggatgcgcgaagccgccgaagcggtggaaggctgcaccttccaccgcttgaccgacctcgccgcgctgaaaacccagcagctttacgagcgcatattcgaccaggaattcaagcgctggcacgcccagttgccggccgaataccgcgcctgaccgtcccgctcccgatctccttcagaaagactttccatgttaccgatgcaaaaaggcggcagcctgccgctgatcaagaacagcgcgccgctgaatgaaatccgcctggaactgtcctggtcgccgccgcaacacagcgccaagggcagctacgacctcgacaccagcgctttcccgctcaacagccagggcggcggcccgatgggcgccatcgctgatgtcggccacatctgctactggggccagcaaaaaaccccgtcgatggaacacctgctgggcgactcccgctccggcgacgccaaaggcccggacgaggccatcctgatccgtctgcacgccttgccggccaactgcgacgtggtggcgctggtcgccaccatagacaaggcgaccgcccgcggccagaccttcgccgaagtggccgacgccagcatgcgcgtctacaaccagcaaaccgacgaattgctgtgccaggtcgacctggccgcgctggacgccggctccaccggctgcctgttcgccagcatccgcaagcaaggccaggcctggagcgtggaaaacgtcaatcagggctacccgggcaaagagctgccggacttcttccacctgttcggctaccagggctgacatgtccgactaccgcggcctgttcgacgcccagccgccgcgagcgcaagccgccgcgcccgaagcggcgcggccggacccgcgcgccctgttcgaccgcatgcctggcgcgcccggcgcggccgatgcccgcccgccggccgcgccggccagtatcgccacgccgaccgggttgcagcgccgctacgacgaattgctgcggcagaacgaaggcctggcccaccgggtgatagacctcgtgcaatcgctgaagctgcgcgaaacccggctcgaccagcagttccgccaggcgcagcggcaggcccgggagctgcagcaactgatgcggccgcgctggcgcctgccctggggccagccggcggcggacaagacgcgcggccaccaactgatagaccagttgcagggttttctgcgcagcgaaatgaagccggacgtgttcatcagcaaggacatggacgagctgcaaaggcagaccggctacctggagcggctttcggcgacgctgcaaaccgacgccggcgcgctgctgccgcccgacgccgaactgcggcagcgcatcggcacccaggcccatatccttgccatgcaggccgcgtccagccggcaattgatagaacaactgcaacgccaattacaggacatcgaagactggcgcgccaacttcctgtccctgctggtgatagacatccagcaacgtttgtgagaccccgatgccccaataccaaaacctgttcgatcgcccggccgcggcggccacccagagcgccgtccccgccaccaccgcagccgcaagcgcgcccgaccccatcctcatcagtcagctgcgccagctcgccagcgacaagctcgaagagataggcggcagccagacccgccagctgctgggcttgtccgaccagttgctggccaagacccgcgccggcgacaccggcgccttcggccgcggcatgaacgacgtgctgcggctgatgagttcggtgcaattcgaccagctcggcagcccggacggcctgagcggcctggtggacaaggtgcgccgcgccttcaagctggcgaaagtggacctggcgcaggccttcgacagcgccaagggccagatagacaagatttgcgccgatttgcgccagcggctgcaggtgctggaaggcgacaaccggtggctgaacggcgcttatgccgccaacctcaacgacatgcaggcgctggagcagctgctgccggcgctggaagccgtgcgcgacgaagaagccgccaagctggcggcgatgaaccccgccgagccgatgccgatggccgagcagcgccagcgggtggaccggctgggccgccgcgtcgaggcgatcgcgctgcagatccaccagtccaagctgcgcgcgatgcagatcaaggggctggaggacgccaaccgcggcatccacgacgatttccgcgcgctgctggaaaacgcgatccccgcctggagcgccgagatcggcatgggtttgctcagcctgcgccagaaggccaatatcgagatcagcaaccgggtcaaagatcagatccaggcgtcgatgaagcgcgccgctgaccagatccacgacaatgtgctgggcgcggagaaggcactgcagcgccaagcggtggatgtcgccacgctgcgccacgtgcaggacaagacggtggcgatgatccagcaaaagattcagttggcggaacagcgcgaccgccagcgtctgcaaaccatggaggaactggcgcggatggagcaggaactgaagcagtcgctgcgtcagctcggcagctaagccctggccgggtcgccatggccggcgcggaccggcgtccagcgcggccaccagcccggccctgtcgaatggacgaaggaaatcgcgatgccgggcagtgccagcaattggccgtcggcgccatacagcagcggccagcgctggcgcagcagcggcggcaggcccgcttcgcgcagcaggtctttcacttcgcgccggccgacctgggccggcaacttctcgccgccgcggcgcaatgccagccacaaaccggccagcgccgcgtctggcaggccgcgttcgcgccactcccagctcaactcgccgccccaggcgggcaggctcagcgcccgtccgccgcggcaatctggcaacacttctgacccgtgactgagctgaactttcggccaggcctgcagggtatcggcaaaacgcaacagatggccggcaggcagcgccagttgcggagagccggccgcatgatgcgcctgccgcaaaaactccagcaaggcgcccggctccggcgcactccagcccaggctttcgatccaggccagcaccgattggcgctggcgcggccccgacagcgccgccaacgctgggaggctcaaacccgcctcgcagcggcaggcgcgcagatcggcgtcggccacttcctgcaagatggcggcggcgtcggcctgcagcgcggcggcgcgcgccagatggcggcggtaatgcggaacgccgcgctcgatgcgcggcagcacttccagccgcaacagattgcggcggtaacgggtgtcctggttgctttcgtcttccacccaggccaggctttgccggcgaacatgggcttccagttcggcgcgcgtcagcgccagcaacggccgccatagcagcttgccgcccgccagcggccgcagcgccggcatcgccgccagcgccttcgccccgccgccgcgcaacagttgcagcagcaccgtctccgcctgatcatccagatggtgcgccaacaccaccaccccggcggccgactcccgataggccgcgtagcgcgcatcgcgcgccgccgcttccaggctgtcgccgcccgccgccgtcaccgccacgcgcgcgacgcgcaatggcacttgcaacgctgcgcacaactgctcgcaatgccgcgcccaggcgtcggcattggggctcagtccatggtggacatgcaccgccgacaaccgcaggcccggcatctcctcgcgtaccccgcacagcagcgacagcagcgccaccgagtccaggccgccggagaggcccacctcaaaagaacattggccggacaattcgtccggccaatgcttgatgaggcgcccgatcagatcaggcggcatcttccttgaagcggccatagctcatcaggcggtcgaagcgctgtttcagcaattcttccagcggcttggactgcacttccttcaattcgtcctgcagcacgcgcttgatggtagtcatcatttgcgcgtggtcgcggtgggcgccgcccaccggctcgttgaccacccggtcgatcagacccagggttttcaggcgcggcgcggtgatgcccagcgcctcggcggcgtcggacgcgcgctctgcggtcttccacagaatggaggcgcagccttccggcgaaatcaccgaataggtggcgtactgcagcatgttgacgtggtcgcccaccgcgatcgccagcgcgccgccggaaccgccctcgcctatcaccgtgacgatgatgggcacgcgcaagcgggtcatctcatatagattgcggccgatggcctcggactggccgcgctcctcggcgccaatgccgggccaggcgccggtggtgtcgacgaaagtcagcaccgggatgccgaacttctcggccagcttcatcaggcgcagcgccttgcgatagccttccgggtgcggcatgccgaaattgcggcggatcttttccttggtatcgcggcccttctgctggccgatcaccatcaccgattggccattgaagcgggccaggccgcccacgatggcggcgtcgtcggcgaaagcgcggtcgccatgcagctcttcaaagtcggtaaagatggcctggatgtagtccagggtataaggacgctgcgggtggcgcgccaccatcgcgatctgcgacggggtcagcttggcatacagcgtcttggtgagctccaggctcttcttctgcaggcgggcgatttcctcggatatgtccagcaccgagtcatcctgaacaaaacgcagttcttctattttgttctcaagctcggcgatcggctgctcaaaatcgagaaaggtcggcttcattcttcacatcatccggtcaaaacctaatcgcggcatgatacatgaggcgtaaagtcgccgtcacccgttacgctggcaaaacgacagaaaaatggagcaaatattcaaaacgggcggctttgttaaaaaaactacggcaaggcccttgcgcaagcttaaaccctgtgctttaattcgcctcctcgctgaaacgcaagcagcgaaacgaattcagggcgtttagctcagttggtagagcgtctgccttacaagcagaatgtcggcggttcgactccgtcaacgcccaccagttttacggttggagtggtagttcagttggttagaataccggcctgtcacgccgggggtcgcgggttcgagtcccgtccactccgccaacaatacaaagcagtacccgtttacgggcgtttagctcagttggtagagcgtctgccttacaagcagaatgtcggcggttcgactccgtcaacgcccaccagtttgcggttggagtggtagttcagttggttagaataccggcctgtcacgccgggggtcgcgggttcgagtcccgtccactccgccaatagtcacaaaagcagccttagggctgcttttttgcattctcgcctcgccccgcctctcgcccgcccgatatgtcaaataaatcccaaggcggggttgccaaacgcgcccgccgcggtaatactggcaaactttatacatttaacatcaagagattatagaatgaacaaggcaatcttgctggcggcatgcctggcctgtccgcccgccatcgccagcacgaccgccgacaccgccatctggcaataccgggtgcaggctggcgataccctctggtcggtcgcatcccagcacctggtctcacccagctacgttccgaagctgcaagcgcaaaaccatatcgccaatccctacaagctgccgcccggcagcctgctcaacattccctacgcctgggtgaagcaggatgtcgccgacgcggtgctggacgacatgtccggcaaggtgggcgcccagggccgcaacggcgccactctcagcctggtgcgcgggcaacactaccccggcggcacccgcttctcaaccggcgacgacgccatgctgcggctgaaattccaggacggctccatgctggtgctcaacgccaacaccacgctgacgctggaaagccaggcctactaccccagcaccggcgccatccagtcgcaaaacaagctggaaaatggcagcaccggcagctcggtgatccccaatatcctgatgcccagccgctatcgcatccagacgccgtcggccgtcaccaccgtgcgcggcactgaattccgcgtgcgcagccaaagcgacgacgacaccgccgccgaagtgctgcgcggcacggtaaacgtcaatgcccggcaaggcgaggtcgacgtgcccgccggcttcggcagccgcggcaaatccggcgacggccagccggtcgcgctgccgccggctccgccgctgacaggcctgccgccaagctccgcattcaatcccccgccgctgcaatggcaggcggcacccggagaggacggctaccacctgtccatccaccagcaaggcgatcaaccgcgcctgctacaggaacgcgacagcgcggcgccgcgcttttatcccgccttgccgcaaaacggcgcttatcgcctgaccatccgcgcggtcaacgccgtcggcctgcagggcttcgacagccagcgcgacttcgcgctgcgcgcctatccgctgccgccgctgatagtcgcaagccagggcccgcagcagcagcgcggccacacgatgacgctgcgcagcagcgccagcgcaacccagccggcttggctgcaagtggcgcgcgacgccggcttccagcaattgctgttcaacggccgcgtggacgagccgcagaaaagcctggaactgccggccgcgggcgcctggcactggcgcatggcctccatcgccgccgacggcgccttgggcccctatggcgatgcccagatcctggacgtgaccggctggctgggcctgccggatctgcgcgccccggctctcgccacccgccgctatccgctgcccggcctgcgctataccctgtcgttgatccccgccgcgggccaagccgccgcgccggcgttccagcaaacttcggatcagccgctctggccgctgcgcgacttgccgcgcggccgttttgccgtcaccatccatattgacgacaacaccggctaccacgccgaagagaaatacccgtcgctcgacctgccatgagggcggcgccgccctccgccatgtccactccccgagcgtgggtctgaatccggaaaagttaatgcacgccccatcccctcccaggcctggccggctgacacccttgctgctggccatcctgggtttgctgctgacaggcagccaattgctgaaccggctggacctgtggctgtatgatggcctcagccgcagccgcctcgcccatgacgaccacgccgccatcaccgtcatcgccgtagacgagaaaagcctggccgaactcggccgctggccatggccgcgcgcctatcacgcccaattgctggacaagctgtcgcaagccaaggccgtgggactggacatcgccatcgtcgaaccctcggcccagccggaggccgaccagcatctggcggcggccatccgccgcaacggcaaggtcatcggcccggtattcccggaaatgcagggccggcgactggtggagacccgcccgctgccgctgctgagccaggcgatggccgggctgggccacaccgattacgaacaggacgacgacggcatcatccgccgcgtctacctgcaggccggcctgggcgggccgcgttatctcagtttcgccagcgcgttgtgccagctggccagcggcggaaaaccggcaacacctgccgccgcgcccgccggcgccgccgcctggcaccgggcgcaggcggtgatggtgcccttctcctccggcaaccgcccgtatcagacggtgtcctactcggacgcgctgaatcgcttgccgccggccagcttcgccagccgcatcgtgctgatcggcgccaccgccaccggcctgggcgacagccacccgacaccgatatcggccaacaaccgcgggctgtccggcgtggagatcaatgccttcatggtgcacgccctgctggaaaacctgcagatcacccaactggacaccgtctggaaaggcttgctcgccgggctgatcctgctgttggccgactggcggctatcgcgccagcgctcgccgcggcggctgctggcccattacgcgctgacggcgctggccatgctgctggcttccgccgtcgcgctgtacctgggccgcctctggatcggcggcggcgtgacggcgctgctgttgctgctggccggcatgctgcgcttcgtcgccagcctgtcccgcctgcacacgctggcgatgaccgacggcctgaccggactccacaaccgccgccatttcgacgaagccttcgccgcgacgctggccgcccatcagcgccaacgccgcccgctggcgctgctgatcgtcgatctggacaatttcaagggctacaacgatcactacggccattacgccggcgacgaggtgttgcagcgcaccgccggcgcgctgcgcaaatgcttccgccgcaaggacgaaaccgtggcgcggctgggcggagaggagttcggcatcctgctggcaaaccgccggccggagcaggcgctggccgccgccgagcgctttcgccgctatctggaagacctgcaactgcctcatgccgccagcccgctgggcaaagtcacctgcagcataggcgtggccgcgcgtccgccagccgacgacacgccgcgcagcctgttcgaggacgccgaccaggcgctgtacctggccaagagcgaaggccgcaaccgggtctgccaggccgaatccggcccagccgcgccgcaagcctcggctccctaggcacgggaaaagaaaatgccgccctccccgcgcaggatgggcggcatcgcgcttccgcgcgcctggctcagcggcggcggaacaccagccacagcgtccagacgatcaccccggcgaagaacaccgccacccagaacggcatgctcatgccgaggaaggtgccctggatggtcgcgcactcgccgctgcccttcagcaccttggacagcacctgccacaaggggaaggactccatcaggaattccagacccgggccgcattgcggcacctggtccgccggcaggctctgcagccacagctggcgcagcgacacgccgctgccggccagcgccgccagcaccgtcagcccgccccacaccttggcgccggcgcgacctggattatgcagcgccgccagcagcgcgatcgcgcccgccgccatcacccctatccgctgcaggatgcacagcgggcacggctcctcgcccagctgatattgcgcatacagggcaaacgccatcgcgccggcgcacgccgccgccaccagcagaaagccctgcctgttcgtcatattcaaagccatccccctcaacctttcttggtatgtccactgcgttaacgcagtgtaaacggaaaagctgagatttgggcgccggcgcaaagttccggaaatctacagttccagaaaattgcggatttcctccttctgctgcagcgtgtcacggtagcctagcgcgatcagttcccggcaatactcgggctcgaacagcagataggtggccagcgccgtgccgcgctgccgggtggccccggtgcccttcatgatgaaacgcaaaaacggcggaaacaggtgggtgtggcgaaagacgatgccttccagcgacttgctgggattgagctggaaaatctccactttcttcaattgcgtgcggctcgccagctcctcactgctttgcagcagcgaaaccgtgtggttgatgcggctgagccgctccatgtccaccgccatgctgtcgatgaacacgctgttgagcaggtggccgaagatttgcgccggcatcggataagcaccactgctgcgccgctctatggtatcgggccgctggctggccaggcccaccacaaacagcttttccgcgcccagatgcaaggcgggcgacagcggcgatagctggcgcaccgcgccgtcgcagtagaatttctcgccgatgcgcaccgaggggaagatcagcggaatggccgcggtggccatcaaatgatccagcccgatccgctcgcgtattcccaagcgctggtagcgcgtccactcttccagcttgtcctggccttggaaaaacgtcaccgacatgccggtggtgtagcaggatgccgtcaaggccagcgcctgcagcgcgccgctgtctatggcgccgccgatggcgtcgaatggcatcgcccggcccagggtgtcgcgcagcggcgcgttgtcgagaaagctttgcggattgcgccagacatggccggcgctgagcagcgacacgccgaaatgcagaaaggttttcaggaaatagctggtgctgacatcgtacacatcctggatgtgcagctgcttccatactttggccagcgtcgccaccgccagctggtagttggcggccccggaagccagcgccaccgcattgatggcgcccgccgaagtgccgcagatgatgggaaagggattctgcgccggatccggcagcagcttggcgatgcccagcagcacccccacctggtaggccgcgcgggcgcccccgcccgacaataccaaaccgattctgcccggcctgcgcatgactgtccctttgcgaacggcttatttgttctattagagatagtcaataacgcagcgcagcagcaagcctcgccgcggcggaatcagaatccgccagcctgcaacagcgcccacaggtgcgccgccaccagcgcccgccacggcgcgaagccttccagccagcgctgcgcgtccggcgccgacaccttgtcgggcgtcgccagcaccatctgcagcgcgcgccgcaccgccacgtcgccgtgcagcgagccatccagccagccgtagccgcgcagcagcgcgtagctgaccgtccacggcccgatgcccggcaccgccagcaggcgcgccgaaatgtccgcggccggcatgtcggccagccaatcgtccagcggcagctcccccgccgccgcgccctggctcagcgccagcaaggcgcggcttttggcgcgggaaaacccggccaaccccagctggtcggcatccagcgccgccagcgcggcggcatccggatggcacagcagaccggaggaatggcggcggccgcacagctgcagcaggcgccgccgtatgctcaccgcggcctgcacgctgatctgctggccggtgatcgcccaggccagcgcctcgaacggcgtcgcggtctgcggcacccgcatgccggggcgcgcggcgatcagccggcccagttgcggatggtcgcggtagcgccgctcgaacgcctccaccggctgcgccaagcccagcatgcgccgcccggtctgctccagcagccgcgcgtcgccgccatcgccatcgccgtccagcgccaattccagccgggcttcgccgccggcaaagcgcaaagccaggcaagccggcgcgccgcgccatgacagccccttgcgcagaccgtcgccatccacctgctcggccagccgctcgccgtcgcggcggtgaaaagccaggatgtcttgcggacggaagtgcggcggcagggggatagaacagtggagcagcggcatcagcgcgccttgcgaaaagtcaggttgaggcggcgcgcgcccaatagcggatgaacgccgggcttgaccggctgcacgccgtgaaagcgcatgcggtcctccccgccccacaccagcacgtcgccatgctccagcgcgatcttcaacgcgcggtcggcgcggcgcaggccgcccagcaggaataccgccggcaggcccagcgacaccgagacgatgggcgcggagaaatcgcgctcgtccttgtcctgatgcaggcccatgcgggcgccgggctgatagcagttgatcaggcaggcatccggcgcgaaaccggggaagccggcggccgcggcggcgtcgcccgccagccgcagcagacgcgccggcatccgaggccaggcttgcccggtttgcggatcgctggcggaatagcggtaaccgccgcggtcggacacccagccccaatcgccgcagctgctggtggccaccgacatgctctggccgcccggcgtctccatgccgcgcagcggggcctggccgatgacggcgtcgacctcggcgcacaattcggcatcctggggcagcgcccagccatgcagcagcaccgcgccggccgacagccgctcggcccagggctcgccctgcggcgcgaacaggctggcgctcactcctcgccggccaccatcatgccgccgatcagcaccgagcccatgcggcggccgccgcggtccagcacatcggtgccgactgcttcgatattgaggaacatgtcgcgcagattgccggcgatggtgatttcctccaccgggtaggcgatcacgccgttctccacccagaagccggccgcgccgcgcgaataatcgccggtgacggtattgacgccctggcccagcagctcggtcaccaacaggccgctgcccatctggccgagcagctcggcgaagctttcgccggtggaatgcaccaccagattgtgcgagccgccggcattgccggtggtctgcatgcccagcttgcgcgcggaatagctgcccagcagatagccctgcagcacgccgtcgtcgaccagccggcgcgactgcgtcgccacgccctcgttgtcgaacgggctgctggccaggccgcgcagcaggaacgggtcctcgtctatcaccatttgcttcgacatcaccggcttgcccagcgaatccagcaggaacgacgacttgcggtacaagctgccgccgctgatggcggcgatcagatggccgaccagcgacatcgccaccggcgcctcgaacaaaaccggatactggccggtcttcagccggcgtccgcccaggcggcgcaccgcgcgctcgccggcgatgcggccgatctcctccacctgcgccagatcgtcgcggtggcgggcggcggagtaccagtagtcgcgctgcatcacgccgccctgctcggccaccaccgccgccgacaggctgtggcggctgctggcgaaaccgccgttgaagccgttgctgttggcgtagacgaactggttggcctgcaccgacacgctggccccttcggaattgctgatgcgggcatccaccgcgcgggcgctgtcctcgcagcggcgcgccagctcgatcgcctgctccaccggcagctgccacgggtggaacaggtcgaggtcgggcagctcgtccgccagcagctgcggatcggccaggccggcgcagtcgtcctcggcggtgtagcgggcgatgtccagcgccgcgcgcacggtatcggccagcgcctggtcggaaaaatcggaggtattggcgtggccttttttctggcccagatagacggtgacgctgacgcccttgtcctggttgtattctatggtttccacttggcccaggcgcacgctgaccgactggccgacgccttcggaaacatcggcctcggcggcgctggcgcccagcttgccggccagttcgagcacgcggccggcgatgccgctcagcgcgtcggcactgaaactgaatgtcttatctgccatagtatctttcggaatggtggaaacggcccgcggccttttccggtatcataccagccttgaaaaccgagttgagacctagcaacaatgagcgactaccagaacgacggccaggatgacggctttgtcagcaaatcccagcgcaagcgcgacatggacgcgctgcaggatctgggtagcgaactggtcgagctgtccaaggatacgctgaagaaaatggcgctgccggaagatttgctctccgcgctgctggaacacaagcgcctcaccgcccacggcgccatccgccgccagctgcagtacatcggcaagctgatgcgcaatgtcgatcccgagccgatccagcaatacctgcagatcctgaaaggcgaatcctccgagcacatctcctggcagaagctgctggagcgctggcgcgacaagctgatggcagacgacgccaaccagccgctgttcctgcaaagcttcccggaaaccgaccccaagcagctgcactcgctggtgcgccagtcgcgcaaggaaaagcaggacaacaagccgcccaaggccttccgccagctgtaccagctgatcaaggagcagatccccgagccgggcaagccgcgcatctggcaaaaggacgaggcagaggacgacgagtgatgctgaagataggcctggtttccatttccgaccgcgcaagccagggcgtctaccaggacaagggcctgccggcgctgcaggactggctggcgcgcgcgctggccaccccgtttgaaaccgtgtgccggctgatcccggacgagcagcccggcatcgaagccgcgctgaaggcgctggtcgacgacgagggctgccagctggtgctgaccaccggcggcaccggtccggcgccgcgcgacgtgacgccggacgccacgttggcggtggccgaccgcgaaatgcctggtttcggcgagcagatgcgccagatcagcctgcgcttcgtgcccaccgcgattctgtcgcgccagaccggggtgatccgcaagcaaagcctgatcctgaacctgcccggccagcccaaggccatccaggaaacgctggaaggcctgcgccgcgccgacggcagcgtggaagtgcccggcatcttcgccgcggtgccctactgcctggacctgataggcgcgccctacatcgaaacccacgagacggtagtcaaggctttccgccccaagtccgcgatcaagccggcgccatgagctatcgcgccccccgctggctgcgcggcggccacgcccagaccatctggccggcgctggccgtgaaggttgcgccgcccgcctaccgccgcgagctgtgggacacgccggacggcggccatatcgcgctcgatttcgtcgacggcaagcccggcgcgccgctggtggtgctgttccacggcctggaaggcagcagcgccagccactacgccaaggcgctgatgcaggcgctggcggcgcgcggctggcacggcgtggtatcgcacttccgcggctgcggcggcgtggacaacccgctgccgcgcgcctaccacgccggcgacgccgccgaagtgcgctggatactgcagcgcctgtcggcgcgcttcgccgccatcgccgccgtcggcgtgtctctgggcggcagcatgctgctcaactacctggccgaggaaggcgaagccgcgctgccctgcgccgccgccgccgtctccgcgccgctggacctggtggccgccagcacccggttggaccgcggcttgggcaagctgctgtacacccgcatgttcatggacacgctcaagcccaaggcgctggaatcgctgcagcgccatcccggcctgttcgatgccggcaagctgagccgcgcccgcaccttcatcgaattcgacgatctggtcaccgcgccgctgcacggcttcggcaccgcgctcaactactggcgccaggccagcagcaagccccggctcggccagatcctccgcccgacgctggtgctgaacgcccgcaacgaccccttcctgccggccagcgcgctgccggacgccagccaggtatcgccggcggtgacgctggacttccccgacgacggcggccacgtcggcttcgccaccggccccttccccggccggatagactggctgccgcaacggctgctggccttcgtcgagccccacctggcgatgcgcgccgcccaaacgtcataatcattgacgattgcgctcccgcggtggcaagtttgaagccttgccgcccaggagagcgcccatgcaagaccccagcaccatagaacgcagcctcatcgtccagtgggacgacccgatgataggcgcccgcgccgcccgcaccctcagcggcctggaatacctgcgggaaatggagcaaggccgcatcccgccgccgcccatcatgcaactgctcggcttcgaattcgtccgcgccgccgaaggcgaggtcgaattcgccttccgcccgcacgaatcgcacttcaatccgataggcagcgtccatggcggcgtgatcagcacgctgctggattccgcgatggcctgcagcgtccactccacgctgccgagcggcagggcttacactacgctggaattgaaagtgaatttcgtgcgcgcggtgcagccgcgccacggcaggctggtttgccgcggccaggtcatccacgctggcgcccgcatggccaccgccgaaggcaagctgctggacgcggccggccggctgtacgcccacgccaccaccacttgcatgattttcgacgccgcggccgcttagtccgccgaagggacgccccatgctacgctccgccttgctgtgcctcgcgttcgcgctgctgtccggctgcgcgtcgatggccgaccgcctccgcggctcgctgacgccgccgcccggccgcgcctacgccatcctgtccctcaccggcaaggccttcaaccccgacctcgccaccgtgggcatgagcgtccgcgacgcgcaagggcgggtggcggccgaggacgccgccagcctgctgaccgacacggtgttcggcgaggaaggcatgtcgccggtggaaggcaagctggtgctgctggacctgccgcccggcgactaccggctggccggcgtatgggggcactggtccgaagacggcgtcttcggctccgacctgaaaatgaaacagttccggctggacgcgcccttccatctggacgcgggcgaaaccgtttacctgggccaggtgcagctggaaatgtccttcctgccggaagtgaagctgggcgatgagcaaaaacgcgacttcggccacatgcgccgggtctggaagataccggatctaagccgggtggcggtgcggccgctgcggctggccggcccgcggccatagccgctcagggcttgtaccacagcttgtagaggtaggctggcttggtggccgccgccgtcgccgcgaccggctccagcacctggtaggccggctggcggctgtcgcgcagcaagggatcggcgtaaggcggcccgtccagcttgcgcagcgccgccaccctgggcgtattggccttgtcgccgcggtgggtgaccaccgccacctcattgctggccagcaacacgaagcttccgggcggatagatgcccagctctttcaccagcagcgacacatgctgcggtggaaaccgccccagttcgccgcggaacaggctgcccagcaccagcgccggcagctgcggttgcggctggtgcacgcagccgcacaccaggtccaccatctgcaacagcagcgcgtccggcgccacctcgtcgccggccaggcccagcgggtagccatcgccgtccagctgctcatgatgctgctgcaccagctggtgccagcactcgtccaccaccccggcctcgcgcagcatcgccgaccccagcgccggatgggcgaacatcagcccctgctggtcggcgttcatcggctccgcctgcctggccagctggttgagcaggccggtgatggcgatgttcatgctcagcgccgcgcccagcatcggcctcagttccgcgtcggacaaacccagccgccgccccagcaccgccaatatcgccgccacgtgggcgctctgggcgctgcctatgtcctggtagggcagcaggaacacgctggcgagaacgccgtcgggatggcggcggctgatgttgagcaggccgtccgccatgtccagcagactgccggccaggtcgcgcaccgccaggccatgcagcagcacgccttcggcacggcgcagcagaaacgccatttcctgcagcggattggagctattgcgctgctgctccgcctccttctcccgcatcgcggcgcgttccagccgctcgcgctccagcctggcctcgacttcatcgctttcgccatggcccagcctggccaggcggtcgcgctgctcttcggtcagcacgtaatggccccgcttcagcaacagcacgccgttcttggcatacacgtccaccggcgtctgctgtcccgcgcgcaaaaaattgcgcgggagttttacctttggagacgaatccgtcatattccacttgctgaggttgcgccagcggcatgccggcggagctttcaaaattgcttatcgcagccaatagtattttattcaagtttcgcgcgcgccgctccctcgctgcgccgccacaaggagagcacgacatgagccagcaggacgacatcctcccacgccgcagctttctcgccggcgccggcagcctgggcttcgcgctggcggcgcagcccatcgccgccagcgcgatcctgacggacagccaggcgctgcagaccggcgcgccggccatcgataccggcaacggtgtgatggccggctattacgccaaacccgcgcacgccgccggcccgctgccgctggtgatcgtgatccaggagatcttcggcgtgcacgagcacatccgcgacctgtgccgccggctggccaagctgggctatttcgcagtggcgcccgaactgtacttccgccacggcaacccggcgctggccccggacaccgacaccctgctgcgcgagatcgtcgccaaagtccccgacagcgaggtgcagagcgacctggacgccacctggcgctgggccggcgccaacggcgccgacctgaagcgcgccgcggcgaccggcttttgctggggcggccgccaaacctggctgtacgccgcccgcaatgccgaactgaaagccgccgcggcctggtacggcaagctggaagggccggccaccgccaatatgccgcgttatccgctggatatcgccgcggcgctgaaggttccggtgctgggcctgtacggcggccaggatcagagcattccgctcgcgtcggtggaaaagatgcgcgccgcgctgaaacaggctggccaggacgacgatatcgtggtgtacccggacgccggccacggcttcaacgccgactaccgccccggctacaaccgcgcggccgccgaagacgcctggcacaagatgctggattggttcgcccgccacggcgcgcgctgagcctggccgtccgggcgccggggccatcagctcagcgcccgcccaccgacgccctcgcctccagcctggcgcggatcacccggttgaacagctgcagcagctccgggtcgaactggcgctccgacgcgttcagctccaccaccgcgcgcagcatggaacggcgctggccctgctgcgcatgcttgagcatcacggattcgaacgcgtccaccagcgccagcaggctggcgccgtcgcagatgtctccgcccgccaggccatccggatagccgtggccgtcgggcatctcatgatgctgcctgaccatcttggcagcctcctcccagcccggcatccgctccagcagcccggccgcccagccgggatgcgcgctcatctgccgccgctcctcctcgctcatccgccccaccttcagccacagcgcctccggcagcagcatcatgccgatatcgtgcatgtacaccgccgccgccaattgctccacgttcaatggctgcgccatcagctgattggtatccagcgccaacgccagattgcgctcggtgcggccgaaaaagggcggcagacgctgttccagctgcaaggcgagcgagcggaaaaactgcaggtcggcgaagcggcgctccgagcggctacccgtgccgctcgtcaaccctgagtcggccgccgaagcggccgccaccttgcccatcatgctggacaccagcttggcgcaggcctgcggcacttcgtcggcggacagcttgggcagcttctccagcgcggacagcacggtcggcagctgcaaatcgtccagcgcctcgccgttgaacaccgcctccaccatcagcaccagcctgtccatcaccagcagcagcacgtcgcctatcacttcgagatatggcagctcgcgctgccggacgcggtccagcagggtttccagcgcatgggcataaggctcgacgaaatgcacctggcacagactggcgtcgcctttgacgctgtgcaggatgcggaacagctgggctatcttttcggcattgtccgagccgtcgcccagctggcacaccagaagctcaagctgcggcgcgtaatccagcatggcgtcgtgaaactcctggaacgcaatcggatcgacaatttcaggcatctgctgctgcttggccatgaggagattctccgccggatcgtggatgattcagtatatgcaacgcagaaactgtcgcaggacaaaccgccgtcgcgcggccagccgcaagaaaatgtaaatgtcctgggcagacatattaaagattcgtaaaaacaggcgattcctgaagaaaacgcttgccatgggcggcaactagaggcactatgcctcccgcaggatgctcaagttgtggatgtgtagttgtcgtagtggcataggccgtacctcagtcgccatttcccttgatcttcgtgccttttattcaacgctcgttttgaggatttaacaaaatggcaaccggtaccgttaagtggtttaacgactccaaaggttttggcttcatcaccccggacgaaggcggcgacgacgtgttcgctcacttctcccagatcaatgccaaaggcttccgcaccctggctgaaaaccagcgcgtaagcttcgacatcgtcgacggcccgaagggcaagcaagcctccaacatccagccgatgtaatctccccgagagatcatcagcttgatgaaaacccggacatgtccgggttttttgcattccagcccgccgccgggctgcgccaccccaaccggagccaaccatgccagaccatgaaaccgtgatcgccgccaccaagacttggctggagaaagccgtcatcggcctcaatctctgccccttcgccaaagccgtgtacgtgaagaaccaggtgcgcatccgggtgagcgaggcgagcacgccccagcaattggccgaagagctggccgacgagctgcagctgctggctcaggccgacccggaggaaatcgacaccacgctgctggttcatcccaaggtgctgcaacgcttcctcgacttcaacgacttccaggacatcgccgacgccatcgtcgaagagctggaactggacggcgtgctgcaagtcgctagcttccaccccaaattccagtttgagggcactggcataaacgacgtggaaaactacaccaatcgttcgccctaccccaccctgcacctgatacgcgaagaaagcatagaccgcgcggtggccgcctttccggaagccgaagccatctacgagcgcaatatcgaaaccatgcgccagctgggcgcggccggctggaagacgctgttcgagcacaaagccgactgaaatccgcgcgccatgaaaaacggcgcagtctacagactgcgccgccatggccgccaaaccgaccctcagcccggatagcgccctaccttatcggcataaaaagcgcgaatgagcggcatgtcgcgctcgatatcgccgctgggcgtaaacatcgggccaaagccgccttccttgcggctgtagtccaaataagccagcgcgatcggcacccctgcgccgtgggcgatatggtagaagccggttttccactccttgaccgccttgcgcgtgccctcgggcggaatggccaccaccagcctgctgctgcgcccgtagacatccaccatctgctgcaccagggagttgttctggtggcgcatcaccggaatgccgcccagccagcgcatcaccggccccatcggccccttgaacagcgtgtgcttgcccatccagtagatcttggcgcgggcggcgaaacacaggcccagcgtgatggggaaatcccagttgctggtatgcggggcgcctatcagcacgtatttgtctaaggcgggaaattcgcctttgagcttccagccgctcagcttcaacagcagcagggacagccagcggaacagttcccggatcaccggggtatcgaaaatagtgaaatgcatgacggccctgagcagcggcgcggctccgcgtgcaaggctccgcaaccgacgcgcgcccagcgtcggggcaagcgccaaacacgtggaaaagcgctgaactgtactaaataaaataataacggtaaaggcggcatcgccccccgccccgcgccagccggaaaattcccaagacgccgcgactccagcccgccaatcgtacgggccgatgcctatcccggcataacaatcagtaacacaaacaccggaaccactgcccctacgcgcagccaaagccagtgtaaaccactcgtttaatggtaggacaatatgaacacgaccatagcccaaccccgcatcaggctggccgccgccgcgctcatcgccatcagcctgttgtccggctgcgccaatatgtctcatcgccagcaaaacaccgccatcggcgcagccgccggcgcggtgctgggatcggtgctgaccggcggcgacgccatcggcaccataggcggcgccgccgtcggcggcgtgatcggccaccagaccggccggcactaaatcaagcgccaaaccgggccggctccatgccggctcttttgttttgcggccttcgcccatatcatcgataaggaatccaacctgggccacgccatgaatccaagcatgaactgggagcgactgctctccacccgccgcttcaagatcatccagggcgaagtgaaagaaacccgcactccggccacacaggaaggcggctccgggctgcgcaccgatttccacatcgaccacgaccgcgtggtgttttccagcgccttccgccgcctgggccgcaaaacccaggtgcacccgctggcgcggcacgaccacacccacaaccgcctcacccacagcgtggaagtggccagcgtcggccgcagcctgggcaatcgcgtcggcgtgatgctggagcacgacggcctgctgccgcccggctacaccccgcacgacatcggcgccgtggtgcaggtggcctgcctcgcgcacgacatcggcaacccgccgttcggccataccggcgagtacgcgctgcgcgactggttccgcgacgacagcaacgcgcattggctaaacggcctgtcggcggcggaaatccgcgatgtgcaaacctatgaaggcaatgcccatggcctgcgcatgctggcctcgctggaaatgtacagcggcgagggcggcatgcgcctcacctccgccgcgctgggcacgctgatcaaatatccatggacctccgacgcgccgctcgcccgcgagcgcgacaagttcaacctctaccgcaccgagctgccctatttcgaacgcgtggcggaagagttgggcctgctcaggcacagcccgctgcaatggagccgccacccgctgtcatacctgatggaagctgccgacgacatctgctacgcgatactcgacctggaagacgcggtggaaatcggcatccttgacttcaaggagttcgaaacgctgttctccggctttgccgaacacgagcgcgtctggggcgtgcacgacgtccgccagaaatgcggcacgctgcgcggcgtggccatcggccgctgcgtgaccgaggtcgcggaaaaattcatgatgcaccactcctcgctgctgcgcggcgagtttccggccaaggatctgatcaacctttgcgagccggcggtgcaggacgcgctgctgcaagccaaagacctggccagccacaaggtataccgccaccgcaccaagctggtgaccgaactggcctcctacccctgcatcgccaccatcctcaatgtgctggtgccggcggtgcacgccttcatcaccaaggacagcaaggatctgaccccgcgcgaacacctggcgatgggcctgttggacggccatattcaaactggcgacagcctgtatcaggcctatatgaaggtgctggacttcgtcggcgccatgaccgacaactacgccgccaacctggcgcgcgagctgtccggcgtcggcatcctgtaatgctcagagaaaggcgacaatgactcagcccgtgacccgcttctgcctggttcgccacggcgaaaccgactggaaccgcgaataccggctgcaaggccacaccgacatccccctcaacgacaccggcctggaacaggcgatccagctggcccgcgccttctcgcccggccagcaccgtttcgacgcgctctacgtcagcgacctcacccgcacccgccagaccgccgcgcccctggcagacaagctgcgactggcagccctcgacacgccgcagctgcgcgagcgccatatgggagcgctgcagggcctcacctatgccgaggcggcgcaacgcattccggacatttaccaacgccagcaaacgcgcgaccccgactatgacttggagggaggcgaaagcctgcgccgcttccgcgcccgcgtcctggatggcatggccagcatcgccgcgctgcatcccggcgaagacgtgctgatcgtcacccacggcggagtgctggacatcatgtaccgcgccgccaccgccaagccgctggaagacaagcgcgacttccccattcccaacgccgcgctgaactggctggattatcaggatggaagctggacgctgcggcgctgggccgatgaatcgcacctctccggcgcgctggatgaaatccagtgaatccgccgccgcggcaggatttttgttagcctccggtaagaaagccgcccgcgcggcgacccaccatcaagcgcccggcccgccgggcgggacgacacaaggacacccgccatgaccatagagaaaaccgacgccgaatggcgcgcccaactgacgccggagcaataccgcgtggcccgacaatccggcaccgagcgtccgttcagcggcgaacactactttcaccacaagcagggcgactacttctgcgtctgctgcggcgcgttgctgttccacagcgacaccaaattcgacgccggctgcggctggcccagcttctgggcagaggccgccggagccaacatccagcgcatcaccgacaccagccacggcatggtgcgcgtggaagtgcgctgctctcaatgcgatgcccacctgggccatgtttttgaagatggcccggagccaagcggggaaagatattgcatcaactcggtgtgcctggatttcaaagcgaaataacatgtagggaggtgttgtagggaggcaaggttattgacagctcaaggcaaataaattgcaactcactccaagtcgataaaaaaagccttccatcaaaaccccaacggcaaattcaatagcatgtcgtatcaaaattacaacacagaatagatttcatctgttctgtgtttttcatttcagttcactgcaggataaaaagcaaagcctgccaactcccccaatatccaatccccgacttacacctcagtaactcattgaaaattacccattattccttcgcaaatccggaatctccttcggataaaaatcccgggatccaaagaagcatccacgacaaaaattggcttaagttcatcctcggagctagctttatcattcatccacaaaattccaatgtcataatttttcgtagaatatagtttctacgaaaaaacagcatgttacgcagaaaaattgctgtcgcatcaagcagtcgacagctagaatttagaggaaatgcaacgagaacatcacgagaaaacgtgaaaggaacacctatggctacatagcaaaaaaggacaccccctaaatgtagagaagtgccctattgcccgtgcgataaagaccagacggtattaataaccctaagcaagttcagtatcgtctaacgtctcgcactggtcaagctccccgcacgtcttttttccctgtctcgagcctcgagatggaaacgtgcgccctaaaaatcttaggagatcgacatgaccagtcaaatctatgcagctttacttgccacaattcgagaattacttaattccaaacgccctgtccgtgatgcattccacaagcacggaaatggttcttatcgcgggatgtgtccatcaaacaaagggattgacggctgcatcccctatgaatccgggctagcacgcgacgcgatccgactttacaacttggctcctgaggtcatgctcatcatcccggagccgttcgttctggactacgagctcgacggtgaggcccatagctatacgccagattttttgttgcacctacgcgacggtcgacgcgccgttgtagagatcaagtatcaggaggaagctgacacccctgagaaccagcgccgtttccaagtgatcgcgccactgatcgaatccgcaggtgggcttttcgcggtcttgaccgaaaaaacgctgcgagacaaggtcttgctgcacaaccttggcttggttgaaggccagcgtcatcgacatatcccactaacagccaagactgcaatgcttcaaaccctcagagagggctctgcctcactggaagccctcagtagcgctgcaggagatgtccgactggtctatgccgccattggccaggaatggctagcagtcagcctctaccagccacttcgtcccagtaccttgatccggaggatatgatcatgtcactccagatcattctggaaagcccggaagggctttccggccaagaaccactggccagtgctaaacagcgtccattcgacagccactcctctcttgctcaaaccgcggctttacggcggcaggcctatactgacgccttcaatgcccagcgtagcccttgctacaccaaacataagctggaagcgttcatccaagacattgcccaacgcatcggggatagcaacccaccctctagcagtacgctatatcgatggcatacgcgcctgcaaagcagcggaggcaaccccttggtgctcgtgcctaactttgaccgccgcggagggaaaggcccgcggatggaaggcgagttgctcctcttggcagaggccgcaattcaaacaacctacttgaccttgaagcgcccatccatccgactcacctacgaaaagctgcttatccagattgctgctcacaacgatcaagcgcctgcggataaacaactcaaagtcccctgctacgacaccttccgacggttggttcgcaatcaacctcagtatgaggtagatcttgcccgctacgggcgcgagtacgcccgcaaaaagtaccggcacagcagcatcacacccaccacgatgtacctgctggaacgcatcgagattgaccatacgccattcaacatcttcgtcatcgatgaggagtctatgctggtgctggggcgcccgtacatcacggtgatcatcgattgccacacccgcatgatcctgggcttctacttgtcgttctcgccacccagcatcgaggcggtgctgcgttgcttgcagcacgccatcagcagcaaggactatgtgaaagagcggtatcccgacatccagcatgactggccatgccttggcatccccaccactgctgtcgtcgacaacggattggagtttcactcccaggacctgctgcgtgctactttcgaactgggcatcaactatcagttctgcccgccccgcacgccgtggttcaaacccatggtcgagcgatcactgcggacgctggcggaacagttcgcccaccagttgcccggcaccagctttgccaactggttcgaccgctacggctacgacccactgaaagagtcgatcgtcaccctgtcagagctggtccacgccctgcacatctggatcatcgacatctactcccaggcttaccatcgaggcctgaagcagacgccgtatgccgcctggcaacgcgcggcggaaatcgtcacgcctcgcaccatcgatcctgatcgcttacgactggtgctctccaagcaggctgaacgtgtgctgggtcatgccggcattgagctacatggcttgcgttacaactgcaaagatctgctcccttggcgtaaacagctcggcgatcgcatcaaagtgcaggtccgtttcgatccagacaacctgggctcgatattcgccctccacccgcagaccaaagaagctatgcccgtgccctgcctcaccccggactacgccgaaggactgcaactgcaccagcacaagttgattcaggcatcgctgcgcaaggagggcctggcatccgccgatccgctatcgctggctcgggccaaggtacgcatgcaggaggtggtcggccaattgctgcaaagccgcaaactggccgaccgcaaacgcgccgcgcgggccaaaggcgcgcactcaagcaaggtgatgaccaccggcaaactgcctcctacgatttcagaggacgcagaactccccccgacagacagctggtcaccgcccagcacgttgcccgtactcgcccacgatctagaaggagatggccatgagtgagcgctacacattggcggatcttcgacgggcggaacggatccagatcctgcatccacaattcagcacagcgttggaaagactgtcgcacagccatgctctgtcgcgccaaggcgccgcggccaggcatctgctgctggttggcgcatccggtacaggcaagacctctgtgctgctcagctttgccaaacagcaccccagctacgaaacggaggaggcgacgatacgcccagtggtctatgtccaagtgcccgcccaccccaccatccgtggtctggcagaggccattctgatcgcgctaggggccggcgttcagctccggggcagcaccgcggagaagaccaaccagatcgtgcagctaatccgcggcggtaaaaccgaagccttgctgctggatgagttccatcacttcgtcgacgccggccgtagaaccttcgaggaggtcaccgagtggctgaaggccctgatcgatcagatcgccattcccacggtactgtccggcctgccagagtgcgagtggatcctgcgctccaacgagcagttgcgccgtcgcttcgccgcccgcgtggcgctgacgccgatcggtttctcctgcaacgaggacaagtccttgttccgcgacgttgtccatgcctgggacacgcagatcaatcaggggcgtccaatctggggactcgccgagtgggactgcgtcaggcgcctgcactatgccagcaatggcctgctcggctatctctccaaggtaattctgggggcattggaatgtttgatcgaacaggagcagcaagatctcgaccaaagcgtcttggctatggctttctccaactatatctggcgagacagcccgcctgagctgaatcccttcgatgccaactttgtattccgacgcctaaatcagcctgacgagccattcgagccgacacggttctcccggaggaatgctccaaaagccgccatccccgcgttgtaaccccatgaggatcgccacccaggcgatcctccaacggaacacaccatgacctccccactactgcagatccgccccaagccgcaggcgggtgaaagtctgctgggctattgcctacgtctgggacacgccaacggctaccccggacagacttggctaccgttattcgtcaaaaagcacgacgccgccaagcagaatctgaccctgctcaccggccatgatcagacaggtttggaatgcctgacaggccctgcaccagccagcctgggccgccacagccaccatcgattcggtctcaaggtgacgtactggaaccaccaccaccgccgctggtgccccgtctgtctggccgagcacggcatctggcaaacggaatggctgctgaccctgcaaatagcctgcccgattcatcgcctgttgctacgagaaaaatgccccggctgcaaccaactcatccgctggcatcaaggcaccatgtttacttgcagctgcggcgccgacttgcgccatgccgccacacgtccaggcaccgcagccgagctggcactcgccaaactgattgcccaggccatccggccactgattggtttacccgacctcgctgtcagcaatatccccacgccgccggagttagatcatctgcacccggcacagctatgcgacctgctctggttctttggcgcctatgcctcgcatcggcccaatacccgaccacaaaaaatagccgatcatggccggatcgaaatcattcagccctatctgcagctggccatgcagatcgctcagcattggccgcaacgcttccatcagctgctggaggagtacacgctgcccatacccgggaacacggcatcactgcgagtgtacttgcgggaaatacatcaggccctctaccggctgctgatccatccagaactgctatttgtacgggaagaattcgagcgttatgtccatgcacgctggccggacaaactgatcctgcagcaggacctgcgccaggcccatcccatcatcagcttggccaaggcagcggaacagctcaatctctcaagaggagctgtacacaagctgatcgaaagcggcgccatcaaaggctgccaatcctcatcggctaaagggaaagccacttggatggtggagcgaagctcgctggatgcctacgcccgcaatgagcacggcacgctgaccatttcggaggtggaacgcatgctgcgcatcaccccaaaacggatccgtttgctgatcgaaagtggtttgctgcaacccctgccccacgataaaaaacgtactcgatggtgctttcaactggaaaccatcaacgccttcctggagcagttgaaccatagccagatcagcccagaaccgaacaatccagaactgctatcggtgtgggaaatcactaagcggtggatgcaaggcagccagcccttcttggcggtggtccgcgccctgcaagatggctcgctggaggttgtaggccgcaccccggccgaccatggcctccgcgcgctgctggtttcccgacagcaattcacgctctggcatgagcaataccgccgctcccgcggcttcttcacggtcagggaggcggcagccgccatccagatggacgtcaacttgctctatcacctgattggcgccggacatgcccacgctagccagcagcagtatggctatgagaagcggatgctgctgggtatcgaggccaaggagctggaacggttgaccaacaactacatctggggcgaacacttggcggaaatggtcaacaaaccggtgcgacaggccgccagacacttggttaaacaaggactatgtcccctctatgggccaatggagaattgcggggacgagtatgtgttttggcgcgcggatgtagctgcaagcctaacttgagtggattatgcaaattatgggaaaccaataattatgggattcccataattttccatcgacacgcgataatacgagttcgactgaactggcctggatataaagcatatttagcgaagtatgtgtggtttatcagaaaaagataaacttatagatcgagcgttgtagcaccagctggccggcaaccactaagtagctggatcttcccacgaacacccaaatcgagatgatcctccaaggactacctgccacagctagtcacgccgtcagccaagagtttggcactccccttgagtatctatacttggtacttggtccttcgccacggctaacctcgcaccgcatcagccagcagcgcctgctagactcgccggccagcgaaaaactgcttcgcatcatgaggattgcccgcgtagctgaaggcattctgggaaacaagaaactggccggaacctggctcctgcaacacaacatcacgctgagcgcatccccgctttcgctgatggatacggaattaggaggcggaatggctcgccgagtcctcgcgtccattgagcatggcttgccggtctaaggcggccaagtaaggtaccgccatcgcgctggagatgggtcaggctgacaagagcttttcgacatgcggcctcggcttctgcttggcctgccaaagctcccaagccgtctgcatgccgagccacaactccggactcgtctccagggactcggctaggcgcaacgccatatctgcgctaatgccagcgtggccgtgcagaatccgcgacaaggcagccctagtcacccccaacttacgggcagcttccgtcacactgatgccttccagccattcttgcagcacctcacctgggtgtgcagggttatacatagggctcatcctgaaggctcctagccatgactggtctgttttgattctagtaaaccttatacgtgagtagtcgatccgacgacctgaactgtgaaatgctatcaagctaggaggacctctgaaagtcgtgcgttggacatccctccgcatgataccctatcgtcattcgtgcattagatcggcattgccaagcaagtagagctgcgagtcaatgctcaagtacaccttttcatacggtatacgtgagccactccccagaattccggcccaaccaaaattgaaacttgcattagccgcttggtctagaagtacgatcaacgaggtctggagcagagactgttttcgccaatgcacggtttgacggtcgatgtttccgtgcattaacggtcgtgaaaaaaacgggggaattgcatgaatcgaagggagaacggcgaaggcaatgatgaccagccctttgaagacgaggatgaagtgctaagtgagccaacgtctgtggatgacttagacgacctagactctatcaggccggaagtcgttgaaaaggtgtttaaggcactctcggccgatgctcaacgtggtgatagtcagctccaaaggagcgatgttaatcgtgcttacttacgcaagaatctttcgatcgctgaatgcatggcagttgaggacagaattctcgccgcaggttaccaagttctcgatgaagatgaaacagatggtgaagggataactggttcaaaaacatatcactatttgacagaagttgaggaaaaggatttcgggcgtcaaattcagcttgcgttgcgtattcccaaagacacaagtggcctagatccgacctacgtcgatcgcatactcggggatgcggagcgagctaaagctgcattcgttgtcagcaacatccgattcgttgaacagcttgcacggcgtttcggagagcatcagcatttgtccttagaagatgtaatacaagaaggtgttcttggcctactccacgcagccgatctatacaacccggagcgtggcttccgcttcaagacgtatgccgcgtggtggatcgagcagcggatgcggcgcgccattggcaactgcgatcggaccattaggcttccaatccacgttcaacagaagatggcccagataaagaaagccaaaaagaagctgacactaacttgtggccgcccgccgactttggaggaactagcgatcgccgtcgggatggagcaagagaaattgatgaagcttctctggcacgtggagaccacagactgtgccgaaggagatgttgtcatccgggaagactccagcttactttccttcgttgcagattcggcagaatcagtttttgacacaattgtgcatcaagaattgaaggagcggtttcgccatgtcttggccacactcacgcctcaggaagcacacatagtacggatgaggttcggcattgatgtggatcgagagtacacacttgagagcttgggcaaagattataacgtgacccgcgagcgaattagacaggttgaagccaaggcccttaagaaattatgccatcctatccgcaaagatcaattaagcgacttcatagacttataatatggcgacatacataggattaggggcagatatgcctattgaggactccgaacgacgggtagctaatgccctgaagcgtctgccagatggctggaggattcttcaccatgtgagctggcagtctaagcgcggtggacgacagggggacggggaagccgattttatcgtcctccaccctaacaaaggcatgctcgtcattgaagtaaagggtggtggcatcgatatcgaggccggtcgatggtttacaactgatcggtacggcaaacgccactcaatcaagaatccctatgagcaggctattatctcaaagcacgctctagttggctggctgcgcgagcatggactgggagcaagggtacgtgttggccacgccgtggccttcccgcatatggatagccttccattttcggggcctgcggccaccgctgagatcagtctagccaagccgcaactagagaatatctgctctgcaatcacgaattgtttcgagcactgggaacttgaagcggggatctcgcaagaggaagctgacaagcttgtcgcattgcttgcgccgaccgtttccatgctcccaaagctttcaagccaaagctctgaggccgaaaccgaaatccttatgtttaccacagaacagattgaggcattctcgggcttacgggctagccgtggaggtttaatcttaggtggagccgggacaggcaaaacagttctcgcaatcgcgcgggcccaacagcttgcaagagacggctttcgcactctcttggtttgttacaatgaattattaggtcgggatttgttggcacgcacggagaatcttccaaaccttaccgcgtgcacataccattcactatgccttcgagaagctcaccgagcagcactcgacataccaggacacaaaccttcacattggtgggaaaaagaggcccccaacctgttaattgaagcttgtgcaattaatgggacgttgtacgatgcagtgattatcgatgagggacaggatttctcaccactctggtttaattcacttcgctgtttagtatccactcaccctgacgcgcctttcttcacgtttgcggaccccctgcaagatatgtggaaacgggattggctccgagacatggattattcctttgcctgggagttaacgcgaaacatgaggaatacccagccgatagcaacttgtgttgtggccaccctgaatatggaatgcagaggcaggggaatccctgggccaaaaccaacctggaagatttcagagggagtaccgagtgaaaaggacgtgatatctgcggttgaaggtcttcttgaagagggtttcgggccatctaacctagtcgtgctttgcggatcagcgggcctaattacacgactacacgagcgttcagttggcccttattcctttggtaagtggggaagtcgcggaattgctaccgaaacaattgcccgctttaaaggtttagaagcacaggcgatcatcctagcactcccctcgatcaccacagccaatgatcgaatcgaagcctatgttggtatgagccgtgcacgttcaatgcttgttgtcattggacgagactctgatcgccgcctacttaattggcctgagccgctgtagttacatcgaaatacccatcgcctccggcgagggctctgcgtgtaagcgccgcattgaacatctggcatgagggttcgccaagatgcaggcataccgcacaggcagcaccgttatcctcacagccggggtctaacgcacagcgatgctcatcgtcgactaatccatcaaggagtatatgaagctccgattccaaaagagcctgcaacccgccaagcacaaaactacctcgagccgctgcgtagacaaagaacgagaatgccgtcggcaaaattagttcagacaagccatttcgatcaattccggagtacactgctgcacgcttgataaaggcatgcgagaacgaatggacaagttcggtcaccctgcgagtcacctcgtttggccggtccatgggagacatagccgatagaatggcctcagcggccccccttttatcggttgcaggtcctactgcctgccccacccttaccaaccacctatggagcatcattgggtcgagacgtatcaaaagtgcttcagtctgtgctagttcaccataaatgctatagtccccattcttgtcacgataagtacgaagacggcttttccctggctcggagcccccccgggtgtaaccaaattgagccgtcagtacaggaaaacgatcgataagttcgactcgctccacacccgcgcgtgccagggctagaggatagtcatccttatacaactgtctggtcacaaatccttctgactgggcgagcaaatcagacagcgttatacgactctcaaacgtggccaatgctatctgctttgcctgtctttcagcatctgtccgtaattgtggatcaattgccattggcgaacgggtatttccttgtcccgccggaggcattgcagcaatcatggcgtcgatggtcgcagtatcgaatccccgtccctcaagcagtttcttaattgattctgaattgcgagcgggtgcagagtcagtgacacgcttccctgccattccatcgagaatccattcgagggcacgttcgccaccaccagcctgctcgatagtgtttagaatttctcgccgaggagggttgatcatgctgatgccgcgaggcttgaaaaccgttccggagcgatggacagtaaaggccaatgttccaccttgatcacagtcgcaagcagcaccaaacccccgctgaatgatatcgttgcattctggacagtagaaaattaattctgcagccgatgcggtgcctgggaagcggacagcccgctgcccatgtgtacggcacttttttacgtatggggtcttgatggatccgcaggcatcatggtatccaacaaaaggaagctgacctctacgccggcgagaaccacattcacaaagccccagaggttcatcatgaagccgcttacatatttggcaaaggtatagacggggaaatggctcacaccatatcccctcctcacggttcaatgatctcaccctgacagtacgttgggcatagagatcatcaacaagaccaccgtcgcatttttcctccttccatggatatgctgcacgaatgatctcttcacgtaatgcagcaacatctattgcagactcagtcttggggtcgttccagcgtttaactttccaaataccaccatctgcatctatggtttgttcgggaagatgaccaaacaggatttgcgacccactcctcttttccttcatcgcgtactatcccctttaattggcacttgctcttcaacgtcccgtagtgaggtcattgcattcccagttgggcaaaggtctgaaagaaattttgagtcacttggtggttcgcgcagattccgagaaaaatcggtgaaccattgacttagctgcttacgcatgaactcatcctcatccgcaagccccaaatcctctgcaatcgactgttcatcattggcaaggacgccctgattcgcagatacaaaggcattcagggatctgatcgtcgtgataggggctgctgaggaaggctcatggatcatggaaatcctcgcaagctcaaggccagagattgtacgctccaaaacacggcggcttttcctggtgataggaattggttcaacgaatcgatcaccatgagtaacgaattctggaaatgcacgataaacacttgcatctcgttcacgtgtcatctttgggatgacaagtactagtgacggccagaagcgtcctacgcgtgccgtagcctgaataaattcagcaaccccaagtggaaaggctaacataatcatgatgttcagtcggtcaatatccacaccatgggacatcatggatgatgccgcgataatatgaaggcgtttatcaaattcaggctctggcgactctaagcgatctaaagtctgccgcacttcttcgaaattcgtacgaccagtaagggtcgccacatttggtgggggtacaagctcagcatactgagtctctgacgaacgcaccacggcatcgatgtcctgcagcgtgtttccatagacaacattggtgccatacaaatccaccagtaacgatgcataagatggatcgatattaagttcgctacaaattttaccaggagtgttaaggagactacgtattgcgttctggagcgttacaatcagcttatcaacaacgaattcgactgtgagtcggcgcggcgccagcgctacatagcgacgcatcaacttatctgaatcagtggcccagaatccctgtccatccacaggcgggggcaatgggaaaacgcgagccttacgcctataaagtacatccacctgctttttgtaccccgtaagcgtcgcagaggaagccagaatttttggtttgctgccagcgatcctttcctgaattccgtccatagcgcattcgtagtgcgcgtctacagcaccgagactatctcgcaggagatggagttcgtcctgaagccggaacattgcagggtatagctcctctgccatagggagcccctcaggagccccccctcgacaatccggaactaaacaaccattgggaaaatcacttctagtagcatatgtgtagccgtgcccaggcttagtacatttcccctttgggctgccaagcagaccacgcatgcctgtttgcctagcgatattcgcagccttatcaagcgtgccaatcacaacggttggcaaaaaccgccaaatctcatcatcaacaacataaattggcagcggccctccctgactcgggcaatcaccgtttgaacacagatgattcaggcgccaatacacgcgatcgaatgaggtagatacatcacgctcacgacagaatgggcatcgatcaagcagcttgaatggatttgttcgctcttcgattttgtcgacgtcctcattcgccttatcgctctctttctttatgcgattaggagttgacgagccgccgaccaggaaccccagcgagaactgatcaccttcaatttttgcttcgcggcgaatcagttcggccgccgccagcgcgtttgcaaagcgctgcgtctgctgaagcgaaagcatccgaagtgggaaacgtgaccacgcggtaacaccggatatctttccgcgcatacggtcaaggaaggccgcagtgagaataagcccgagataagtctcagtctttccaccacctgtcgcgaaccatacgatatcgacaatatcactctcagattcatgattaacgaggcattcgaggtttgcgaggagaaacgcaaattgaaaagggcgccactttttgtaccgacctctcgccgatatcgtcattgaacgattcatccgctggaatgccagccgaagattcgggttggtagcaagaagctcggcaccacgctttatgcgtctcaactcgtcctggaattcctgccgtgcagcagctgcttcttctcgcatgcctgccgaccaactttcatctttggcacgctgcgccagagtctcctcagaccagacatcagaggcccaaagctcaaatatgccaaccaaatctgtcgcacttgcacacggatcatgtgcaagcccatcaaaactaacatctaccttcttctcagacgatgccgaaaaatttgggcgaaatcttgttgcgttgggtccgtcactagtgcggtatgcttcaccatcgatctcaacaccacagttaataccataggctggcactttccgattgaatctaaagctgtcaggaaggctttcgagatcgaaaggaacgcattttaatcccgttaccgacaatgaggcttcgaagaatcgaccatccgccagatcgacatcttcacggctcgtattcacgaacgtaacctcgattgcccgggagcttgccgttcgccctgttaagcgcacccgtacttcagctgagagattattcgcattccaagtgctaaaagcctcactgaaagcgacttcaccaaatatttggtctccggtacgctcttctacagttactggcacttgaacttcaatatatggcgtcttgtcgtaagcccaacgtaaccctttctcttctgtcgaacgacggcggagccaaagggaaaatcggacggtaaccaggaatgcccatggaccactctctgcagggcgaaggcgcaagccgatagcgcagggttcaagacggtccccccgtaaatcagggcgtgttacgaagtccttaggacctagtcgtcccaaccagtagcggccagttgggtcaaccggagaagtagtctcgtcatcaccacgcgcctcaatgagaacacgtttttgcaaccagttaacaaaccgctcggctgcttgatacttgctctcatccgtctgcatcggaccaatgaattccatttccattcttcctgccgctagtgttccatcattgggatcaccgctcttcaagccatcgcagaggaaggcgcagcggtcgcaaaattacccaaatatcattttatagcacaaatttacaatccctcaacatcagcaaggcaaaacttccccggctaccgtttatggaaacaagagcgcccactctcgcgcagctcaacccaccacttgttttttttgtgctctcggcaccatatcgacgtgacctgacaactccatgttggccaacgatccaatcagaagaccagccaagatcaagggtgcgttccgtgccagctttgctaaaccaggaaggccacccgcagcctgaccatactcggccataatcgcatcgctaaccaacacctgcgcaaggagttcgtctccacccaacagcttaaccatatccgtaccggactcatcgagtctatctagcagcatgaatggggtcgtacatccgacccccttatggctccatatgcgctgcatatgagcaacgtctgcattgcggatgaaattcaatagcgatgcaagcttttcctcgaccttggacctaagcgttttcggcaatttaccaatgaggaatgtgtgtagcgtattgtcgagtcgcaaagactgaatagacttcgaagtgccaaaatagaaatcaactttccacaccggctggctgccctcgaacgtgttgatcatttcgaagcgaacaccgctctttagtcgaagactagggatcgcaaatcggaatttccgcttctcaggatacttgacccctgacctatctggctttgcatctacgggcagggggattgggcattccaagccagtagcagcatctgacagcttcgtaagcttatcagcacttacattcttgagtgcctgcgcaagataaaaagtgaagacaggcggaatagcattgcccaccatctgttggcgctgtccataagtctccccataaaattgaaatgtgacaggaaacccctgtagacatgcacgctccctgatggtcaaccggcgatatgcaccagctctgttgggatcctcaatgacaatgctctcccgggaaacacgtgtgcatgtggcggtgatcgtgcgtaccggtcggtctagccgatctggaaaagacatgcagttgtacactgggtgagtcacctttgctgccttgtttatgcgcacttcctcagcactcaacacctcttctgcaacatggtcacggagatgctgcctgttgagctgcagaccataaacaggatcgacgatcgaatcggaagccagtgccctgatgacttgcccaaacgtctttttcggtacttctggcacatatgatgacaacagattgaaatcgaaattgcccgcaatgcagcgcaagcgcttctgaggaacgccgaaatccgccatattgattgtgtgcggaacaatatttagatgcttgaagcggtgaagacgtcccttaggtaggagctcagtttcgataatcttggcaacacggggcacgttctccattgcccacatcttaggcttcacatgatcaacgatttcgaggaacttgatgatatcctgaagaccatcctcaatgtcgccattgccaccacgattggaaaaagagaattgagtgcaaggaggactaccgacgacaatgtcaatattcttaggcagctcattgaggtcgagacgccggatatcgacagtctgggcctgatgccggttattcttgaaatttgtctcgttagcgacacccctgcgctcatatgatgcaactatctcgatgccggctagtctcaatccaagcgcccatccaccgacacccgaatataagtctattgctcgcaaatttttcgtcttcttgttcatacgagcccctcttggcatctcattcgtcttttcatgatgcgatttaacctgaatccagttgcacgatcaagatccgcagcaaccgactccccaagtaggcatcacacgacagcacatcaccgccccacgtgagagtgaggttaggctgatctacccactgatctgctccccaaacaacccaaccgtttcagcaaacctcgcgacagcatgacgcgtaccgccagatgaagggtgctttcaacggaaaaatcctgttcaaagcacccatttcaggattcgggacaccttgaccaacagattttttcaacaactacgcagaaaagttggtttttttcaggaactctgcacctgatcagtcttgctacgctgacaagaaagtgcaaaaagccttatctggcaaggaaggcttttttcactaactttgcttccctacaggtgtaggcattcctgccttatgcaaaatctagaaaacggaggcgattcagaaagcacttccggactaccaccaagcccgccggaacaggctcagctgattcaccctgaacaagcgagcaggccgttggctcccgcccaagaaatcctccgtagccaccagtatgtttgcgtcatcggcagcttcaccggcctgcacctcgccaaccctgatccccagccgggaacggaaggtgccgcgtgatacggtttcgccgaaaatctgctcatatacacgctgcagttgagtcagcgtaaatgtctctggcagcagccagcacggtagcgtggagtagctggccttgttgcgcaccctctgcactgcctcagccacctgctgcgcgtggtcgaatgccaaatcggggagctggtccacctcatagaagtggaacactccctctcctgccgattgcagctcctctaccggcatcagcgccacataggaaatggcgacggaccagccgcgaggatcgcggtcccgccccgcaaaggtgcgcagctgttccagataacggggactgagccccgttttctgccgcagcgtgcgaatagccgcctcttcaagagtgaggtcctcatccacatggatataccctcccggcagcgccagacgatcctgaaatggcgcactgttccgacggtgcaaggcgacctgcagtttgttgtcgaacagggtaagcagcacgatatccacgctgacatcgggtttctgatatggagccatagcggcatatgtccctgcttgttgcggcagtgccaaaattctttcacacatagttgctattttcaactaagaagaagtacactgcaacctagttagtcgataaaaacaactaagtggagcgtgaagtgaaaatattcaagattgcaaacggcagtcacaggctgccggtatcgctgcaaagcctggtctttcccggaggcgaagtacacgtcacggtcgaaaccgatgtccccggcgaagccttgctgattgatgcccacctcccggattcggcagccatcatgaccctgctgctagtaaccgacgcgttgcaccacgcttatcccggcacgccgatcaccctgcgtctgccctatgtgccctatgcgcgccaggaccgggtggccaatccgggcgaagcgctcagcgccaaagtgttttgtcagctgatcaatagccagcaataccagcgcgtagtgattcaagacccgcacagcgatgtggtgtcggcgctgctggaccgcgtcgaaatcgaagatcctctgcccgcgctgcgtgaggtcatccagcaaatcggccctgtcgccctggtggcgcccgatgccggcgcgcgcaagcgtgtgctgaagctggccaaatcattggcgctggacgtggtcttcgccgacaaaatccgcgatacccgcaccggcgccatcaccggcacccaaatcgcctccccgctgcctgatctccccctactggtggtggacgatatctgcgatggaggccgcaccttcaccgagttggccgcggccctggccacgcaacagcaaacgcagaaccaagaccatccgctttatctctttgtgacgcacggcattttcagcaagggcctggagcctctgctgtcctgctaccacggcatcttcacgcgcaacaactggacccaagacaaccgctgccagctggtttgaaacctgatattggaaactgagatgaacacaaacacccctatcgctgaaaaaaacgccctggttccattcaatcttgccgacttctacaaaaccggccaccccgccatgtacccgcaagaaaccaccaagctagtggccaatttcacgccgcgctccgccaagtacgcgccggtgctgccggaactgttcgacaacaaagtggtgtggttcggcctgcagggttttatcaaggaatacctgcaagagctgtttcagaaggagtttttcgccaaacccaaaactgccgccgtacgaaagtttcagcgccgcatggatacggccctaggccctgaggcggtgcccgtcaaccggctggaagccttgcatgacttaggctatctgccgctggaaatccgctctttgccggagggtgttcgcgtagacatcaaggtgccccctattgtcttcatcaacactcaccccagctttccctgggtagccacgtatttcgaaaccttgttcagctgcgaatcgtggaagccctccactgtcgccaccatcgctttcgaattccgcaaactgttgagctatttcgccaaactgaccggcgcgccgcaagaatttgtcgactggcaaggacacgacttttccatgcgcggcatgagcggcgtgcacgacgccatgcgcagcggcgccggccacttgctgtccttcaccggaacagacaccattccggccatcgactatctggaagacttctacggcgccaatgccgatcaagagctggttggcggctccatcccggcatcggagcacagcgtgatggcgctgcgcatcctgctgacccagcagcggctggctcgcgatccggcacatgcccacctggacgccaaatccttgcgccgcctggcggaacgcgaggtgattcgcgagttcgtgacccaggactatcctgtcggcatggtctccttagtcagcgacaccttcgatttctggaatgtcatcaccgtcatcgccaaggaactgaaatccgacattttggctcgacaagccaacgcgctgggcatgtgcaaagtggtgttccgacccgactccggcgacccggtacgcatcctgaccggttatgccgacgatgaggttcgagcagatgccgaagctggcgggtatgaggtgatcgccactggacaacgcattaccgatgcggaacgcaagggcgcagtggaatgcctgtgggacatttacggcggcacggtcaccgaacgcggctacaaggtgctggattcgcatgtcggactgatctatggcgactccattaccctgcagcgcggccgcgacatcatgctgcgcctggcggacaaaggcttcgcctcttgcaatgtcgtcttcggcatcggctctttcacctacaacatgctgtcccgcgatacttttggctacgcgatgaaggccatctatgccgaagtagacggcgagtgcgtggacatttacaaagacccggctacagacgatggcaccaagaagtcggccaagggcctgctgcgggtagagcaagaaggaaaccagtatgtcctctacgaacagcaaaccttggagcaatttgatagtggcgcgctgcaaacggtattccgcgatggcgagttgctgatcacacagtcgctggcggacatccgagctagactccaagcttcgtggacttgccccgaaccgggtgccatcgcttggggctaacaacacatggattcgctcgtggcgaatatattacgtattttccaggatcttcgcggaaaagtaggatttttccactaaatctgcacacgaacctctgccacaagtgttcatgcaagtgaaaaaagccttaccagacaaggaaggcttttttcactaactttgcttccctacagttttcagagttagtaaaaactctgtgcgcataattgaaaaaacaccgactcgggggcgtagccattgatggttacgcccttgcctatccctatctcaacgccccctctcagccccttccaatcaccattaattttgaaattgaatcgccttctgcctgtctagatatgagtcaaccgaaataaacctagcgaattttcgtcagctagcggactacaccaaacaggcatggagccaaccttccccagccaacaagaagcccaccaaagcaatcctgcaacacttattgcatcctgccgacaacaaatccatgtcgtctgaatttaaatggtggcatgatagcgcccttataaagaaatcacgacattcgatgcttggcgcgaagacgcattcggatgccgctcgtggacgaataagggacgtatggtttctatccatgtagatggcgaagacaagaccgctcaaatcagcgactggacaattgcctggagtaaaaaagacgaagctctgaagttgacctgccattttccatccaagaaaacctacacgcgcccgctcagcgattgccgcatagtgcctacccgggagctgggcgagatgctgctgaagaagcgcaacagtagcgtcgtcaagcctatagaaaaagcgatggtctacggcgagcgctatgcccttgtctactatccgggcacagccaagccctatctgcacaagttggacagcatcagcttcgtcgcacagaccgcgctgaaggaaagctcggtctttcgctactttgcaaacgttgcgcatgcccggcgggaccgcgccagctcatcggaccaacaaaccatcgcagccaatgtcattcgccaactggaaaaactcccttcctgcgccgataccgctttgcacgcctattgcacgggtcagaacggaaggcaagcgccgggagaagcactgatctatccgtttggtgtcaatgaaagccagctggcggctgttgagcaggccttcagcgcgcaaatcagtgtgattgagggtccaccgggcaccggcaagacacaaaccatcctcaacattctggccaatatcctgctgcgtgggaaaacagttgcagtgctgtccaacaacaatgcggcggtggaaaacgtctacgacaagctggaaaggtttagccttgaccacctggtcgccaagctcggcagccaggagaatcgggacaacttcttcgccaaccagcctccctggccatcagctgaacccgaagctgcaccggaaatggccgagatccaggagatgctggcgcggttgaaacagcacctgcacgatcacaaccgagcggcccagctacaggcggaaatcgacgagctgaacatcgagcggcgctatctgcaacactggcagaaagacagcggagtatacgtatccgttcccctggacaaatacggcttgtccccgcgcaaaacggcggacctgatggcttatctatcccatcttggcgaacagcgcgtccggctcagagaccgctttgaattgctattcaacttcaagattttccgtaccaagcctttcgcccagctcgatgatcgcctgtccttcttccatgccctgcagatgcattactacgacaaggcgctaaaagacaaggaagcggctctgcagacttgtcgcgaatcgctggcgcgcgggaatttcactgccctgttgcaagaattgacgataagttcaatgcactatctgaagcaacatctgcatactcaagatcgaggatcagataccttcgacgcaaaaacataccgcaatcatttcgatgacttcgtgaagcgctttccaattgtcggcagcagcacgcactccatcgtcaactcaatcgcgccaggaacgatcctcgattacgtgatcatcgacgaggcctctcagcaggacatcgtgcctggcattctggcgctgggttgtgcaaagaacctgatcatcgtcggcgacagtcgacagctggcgcacattcccgtgaagctggacctgccggcccccgccgacgcctatgattgcgagcgatacagcctgctggactcctgcatcgccgtgttcaaggatgccgtacccaggactttgctaaaagagcactaccgctgccatcccaggatcatccagttctgcaactggcaattctatggcaatgagttgatcccaatgacccaggacaagggcgaggcacccctgcggctggtgctgaccgccaagggcaaccacacccgggaaaacaccaatcagcgagaactggactccttgctcaaggtgttggacggcaaaggcgagtccatcgaatgggaccaggacggccgcggtttcatttcccccttcagagcacaggtcaagctctccagtacctgcctgcccggggatttcgtcaaagataccgttcacaaattccagggtagggagtgtgacgaaatcgtcttctccaccgtgctggacaagaagcgccacaatcaggaacgactggattttgtcgatgatccgcgcatggtcaatgtggcggtgtcgcgggccaagagccgattcaccctggtgaccggcgatgaggtttttaccgcaaacaacggccatatcgcggccttgattcgctatgtggagtattacgcggaggacggacaaattgcgcgggccccggtggtatcagcgtttgatctgctgtaccgggaatttgaccagtcactggcacgactccagaccaggctacgccccgaagactcgcgcttccaatccgagcaaatcgtggcgcaactgttgcgtgaagctctgtccaaggagccataccggacattgacatgccacgcccagatccggctgaaccaggtcgcctcttcactcaatccggctttaacggagcgcgagctggcgttcatgcgcaaccgcgccagctgtgatttcgtagtgtatttcaaagtgggcaaaaccccgctgggggtgattgaagtggatggcggctctcacgaccggcctgagcaggcaatgcgcgatgccttgaagaacagcatcctgacgaagagcaatattcccatcctgcgcctgcgcaccgtagaaagccacatcgaagaaaagattgatagctttctcgctcaatgggcgagtgctacaacaaatgactgaagtaacaaacgggcagccacgataacgtgacggcccattccgatccatctggaaacagtcgattggacacaaccggtcgatggcacccatcggccagaacctggcctcctacaacctccactgcccgcagcgggaaatcggcccctctagtttgttgttaagattttattggatgttgaatgttcacttgcccatgctgtggctacgaggttttcgcagggccacctggttcctacgatatttgtcccatctgtttttgggagaatgatgtctttcagctttactatccaagccaatcaggcggcccaaataaatgctctctaattgaatcgcaagtaaacttcattcagttcggtgcctgtgaccacagtatgaaaaaaaatgtacgcatagcgacgaaagcagacagcagagacctattgtggtttccactttgggttaggagagttgagctaccaaaccatgagtcagatatgtcacacccacagcatgaaaagtcagttgctaagctttgctattggctgcgcgcctaacattttattcgaactggatggactaacgctcgccggcttatccaaaaatttttgcagtcacgatgctccgcagtccttgctcagcatggccgcgcaaatgcaaagagccttgagtggcaaggctcttttttcactgattttgccgccctacagtggcgtcggcactagggtaaacaccacccccgccaaacgctgaccgggcttggcggatgcggggaatatcaagccgcgccgccggcctccggctcagtcaatcagcccgcaatttcaccaccactttcaaacccaaccgttcagcctcttcgctccagttgagggcgatgctgccgcccagcctgccagccacctcgcgcgcgatagccaagcccagcccggacccctgctgctcagtccccagcattcggtaaaacggatcgaatacccgttcgcgctcgggctccggaatgccggggccattgtcggccaccaccaaaaaaacgccatcgggcaggacgccggcggataaatccaccttgccgccagatggcgtatagcggatggcgttgtccaccaagtttttcaccaccgtggccaggtccagttcggaagccttcaccgcgacatccgtcccatcctccaccccgatatcaatgcccttggcttccgccaagggcatcaagtcctccaacacgctgcgaaacaccgcctggatggacaccggcgcagccatgccggcttgcggagcggccgtagtctgcacccgcgccattgtcagcagctggttcaacaagcggcggctgcgctcaatgccgcaacgcaaagtcgccatgcgttcccgggcattgtccggcagatctatcgcggccaagcgctccgcctgcaaggacaaggcggtcatcggcgaacgcagctcgtgcgcggcatcggccagaaagcgccgctgactgtccacgctctgcgacactcggtccagcaggcgattgatcgccaccgcgaagggacggatttccaatggcaaacgctcctcctcgacggagtgcaactccgttacctggcgcagatcgatttcccgagataattccgttatgggccgcaacatgtttttgatcaggcgcgcgaccagccagatcatgaagggcagcaacaaaaaaggcggcaaggcggtacgcatcgccacgtccgccgcgatgtcgtctcgaatatgccgctcctgcgccaccgccacgcgaaccccgttgaatagcgttttcaccagcacgcgataaggctcgccgttcaattgcaaggtctgcaatccattcggcagatcggctgggagcggcagccggcccggcacggcttgatgcgcggctaaaaattgaatcagcaccctagactcgttttccaacaccaccgggtgcatggccgtggtctcgataggcggcacccgctcttggtccagcagccatgccgcctgattcagcatgccgtcctgcatgtcgttggcttctttgaaagccgaccaataagacacgccgcccaccgccagcgtcaacagcaggatcattgcgatcagtgaaaccagcagccgcagctgcagcgaatctctcaggcgcttttggacaccatccatcccattcccctgacattcttgatcacggcgctgcccagcttgcggcgcagggaatgaatcagaaactccaccgcattgctttccacctcttcgccccagccatagatgcgctcttccaattctccgcgcgacagaatggcgccaggccgcgccaacaacgcctgcaacagcgaaaattctcgattggacagcaaaacgggatcggcgccggcggcgcttgcctcgcgagtggccgggtccagcgttaccacgccgttccccagacaggcggccgcgtggccgctttttcttctggccaccgcgcgcatccgcgccagcagctcagccatgtcgaagggcttgagcaagtaatcgtccgcgccgccatccaagcctttcagtctgtcgtccaggctgtcgcgggcactgacgatcagcacggggaccggattgccgcctcggcgcacggcagccagcacatccatgccatctcggccaggcagacccagatccagcaataacaagtcataaacatgattttccaaagccaacagcgcgcgcttgccgtcccgcacccagtccgccgcgtagctggcgtcccgcaatgccgacacgacagcctcgcccaccatgggatcgtcttctatcaacaaaaccctcatgcgtcccctttcgacagttgcgcggcgccccagcttgcacattgatttcacagcaggccgctggattctttcagcatatagcgtcattgcgccatcgcataaacgggatccgggattcagcgcttgcgcgttctgccacgctcagtctcccggcgcggcacatgcccttttctccaccgctgcgcaatccacgccgcgcagccggaacaggcaaccgccagcgacaacagaaacaagggtaaaaaaataagatgcgccccatggccgcgccaagcgcatcgcgcgaacagaagcaaaaacggaggatgcgcttcaaacagcgccagtgcgtgcgacaagaacatgtcgatcattcgcaagcagcgcaggcggggcggcggacgatgacgacacctccgcgcccgccgagccggcgatcagctttgtccgctcgccgcctcttgcgcggcttgggcggcggactcggcggcttcttcctgttgtttggcgcggcccgcgctgctgatgcggacctgatcctgcgccggcgcgccattggcagcggcaggctgataggccgcggctgcgtttgcgccgcggaacgtcacgggagacaaagcttgcggccccgttgccgcgatgggagcgatagacatggttttctccatttaaactgcatcgttctgccggaccagccggcccaagccgttggggctgttttcagattagccacgcagacttagcggcggcttagttggccaaagattatttaacactcccggaatgggaggaaaaatagctggacagctgacgctccatcgccaatgccgcgcaataaacaggcggcaaataccgccaggccaatcgatacgcaacccaggcgctgaaccaggccaccgccgccgcgcccagcatatcgagcggaaagtgcacgcccagatagattctggcccaagccataggcaagccggccgccagcaaaccgtatccgcagtttcgcatcgccctccccaaccagaagctggcggcgacggaccaccacaaggtcagatggtcgctcgggaacgaggcatcggcggcatgattgagaaagcaatgtcccagccccagcatgaaaggccgaggctgcggccacagccaggcgatcagctgattaagccccagcgccgacaaggccgccgccagggcctccaaagccgccttgcgctgccgggcccctccccagagccaacagccggccaacagcagcggcatcagcgcaatcaagtattcgcctaaaaatttggccagcgccaacaagcaaccagatggcaaagccggcgcgttgagccattcaaaaagcgtgtaattgacatcatccatgacaacgcgttccgcttcagcgtttcacgccgcgcatgggcagcatccgcgcctgccccaagccgggatggctgatgcgatgccacagcgccgccgcgacatgcagcccgatcaacaaagcaaacaaggcggccaagctttcgtgcatgccgccgaaccagtgcgacagagtgcggtttgtcgccgccagcgccggcaaatccaagccggggaacaacgtcacggcgtgacccgcagcattggttttcagccaccccaagagcggcactcccagcatgcacagatacagcaagccatgcgcccacttttccgccagatacggccaggagccgggcggattgagcgaggccggcaagcgcttgcgcaagcgcatcttgttcgcggcccgcgccaacgccagcaataaaatccaggccccgatcaatttatgcgcggccagcagcgactcttcgtcatcgagcaagtaaccgagcgcgaaatttaaaaacaccagcaaggccaataaccagtgcaacaagctgacggaaagcggatagcgagcattgtccgacatgatgtccccccgtttcagttgagcaaatggtgatagcgcttcttggtctgattggcggcttgcagcgattgcttcgccgccgcaaggttgcccgctcgggcgaactgttccgccttgttcaaatcgacgctcaaagtgcgcatgccctcccgataatcggttggattatcgggataaggcagtttcgcggcgcggtccacatccaggcgcaagcgctgcagacaattggaaaactcgttgacgtcggcgctgcccatcgcgccgttcatcgcggttttcatatccttcatcaagcttttcagctcgccagcctgcgccggcacagtcagcgccaacatcagaaccgccgcgcctgccgcctgagcccaccgccctggcatatccagtgaaaacatatcgctcccctcctgacgacgatcgcaaagacatcggccgcgcctgcgcggcagcggccaaactctgctccgaagcataaccagagcggcttagaagaaacttagcgtcataaacacaatgcgccacggcgcggacaaggggctttggcagccgcgctcaaggggaaagcagccatcttgcatctatcccaaaagacaactcagacgacctaccgccagcaggcgaaagcggccgcggctccgccctcccacgcgcgatcatgcgcgggacaaggaagcggcccggcgctaaccaggctatgctttccactgacacggctgaaatccggtactttggcattgcgccccatgatgtttctcgccaggaatgctaacaaaagcggcaaaagccccaggagctttttcgctgacgccgcttctctacgcgccctcgttttgggcctggccggcggcctgcttgcggcgacctccgccgctctcgcctcgccgccgctgaaaaactggttcgacgaccccttcttccaggcgcgcggccggatagccgcttgcccgctgccgcagggcccgttcgccaccgaggcggaaatgaaacagcaagcgcattcgcgcatcgagcgcggcaccagctgctggctggccaaacaatgcgccaagcccaacgcctacatgtacgacgccgacatcgccgccgatttgcggcgccgtttttctcaaagccgccgtttcgccgacgccagcctatggctcaccgtgcagcgccgcttcgtctacgtggaaggctgcgcccgcgcgcgccgcgcggtggccgggatagagtctttcatcaagcgcacccccaatgtgcagctggtgatcgccaacatccgcgtcggcgcggaaaagccaggctacgcggtgatgcccgcgccttaggcgcaagcttaaaacaggccaggctaacgcccgccagtcacggccctgccgcccggcgcatggcccaatgccctcatccgcgccgatccgccgctaccggcagccggcccgacattttcacctcgcgcagcgacaagctggagcggatcgacgataccccgggcagctcgcgcagcacgtcgcgcacgaaaacgccgaacgcttccagatcctcggcgaccacctgcagcaggtaatcgcactcgccggtcaggttgtggcaggacaacacctccggaatcgcctgcagttgcgcctcgaaacgcagcggcgcatcgccggtatggctgccgaaaccgacctgcacgaaggcgagcaccccgtagcccagcttcttgcggttcagcaccgcctgatagccctcgatatagccgtcggcctccagccgcttcagccggcgccagcacggcgtttcgctcaacgccacttgctcggccagcttcgcattggacagcctgccgtcccgctgcagcagcgccatcatggcgcgatccacatcatcaagctctgattttggaagattcatttacataaaaccaaaatttagaaagagtctttctaaatttagcgtgacagcgcaagggaaagcaaagcaatttcagcatgccgcgggcaaactaagcctatcgccattgatgccggaacccgccatgctgccactctccctgctgtcgctatacctagccgccctggtcgccgtctatgtcttgccggggccggacatggcgctggtgatggccacctccgccagccgcggcgccggcgccggcctcatgaccgcgttgggcatcgccgcatcgcgcttcctgcacgtgatgatgtcgggcctgggcctcgccgcgctgatggccacccacccgctgctgttcaacgccgtgcgctggataggcgcgggctacttgctgtggctggcgtggaaagtcgtgagcgccaagcctgcggctgaaaacgcgcctcaagtggcggaatcgggccgcgccgcgatcgcgcgcggttttctgaccaatctgctcaatcccaaggccttgatgttctgcgccttgttcctgccgcaattcgtgtcgccggcgtatggcgcggcgctgccgcagttcgcattgctcgcggccatcctggtcgcggtcgggctgtgcttcgataccgcctacgccttcgccgccagcggcatcgcacgccgcctgaaaaccagccgctcgacggcgaagctgcaaaaaggcctgctgggcggcatgttcgtggcgatggccgggcggctgatcttcggctgagcccctctccaggccggcgcgccgccgcgccggctattcccaaaatcctgctctcatccgacaatccaggggctcggcctacaaaccgggcccgccgccacggcgtgcccatgcctgacggatgccccatgccactgcctctgaatctgaacctgctgcgttcgctggaagcgctgctggaaacccgcaacctcacccgctccgcagacaagctggggctgacccaatcggcgatgagccgccacctggtgcagttgcgggcgcagttccacgacccgctgctgctgcgcgagggacagcgcttcgtgctgaccgagcgggcggaagagctgcggctgggactgaaaacggtgctggagcaggtggagcggctataccagccgccgcagttcgatccggccgtctgcgagcgggagttctccttcgccggctccgactacctggccgaatacatgctgccggacatcctggaccaggtgctgccgcaggcgccgaacatgcgcctgaaattcctgccctggcaggccgggcgtttcgacatgctggtggatggcagcgcggacctggtttccaccatcgccgacgaaatcccggacaacatctacggcaagtcgctgggccaggatcagccgctgtgcgtgatggcgaatgaccaccccttgcgcggcaagtccgcgctgaaacaggacgactacctggcctggccgcacgcgcgcgtcagttcggccagcgacaaggacggcttcgtcgacgtgcagctggcgcaaaacggtctggcccgccaggtgcgcatcgccaccccctatttcgtgtcggcgctgagcatcgtctcccgcagccagatgctgctgacgctgcccgagcacttggccgtccgcttccagcgccaattcccggtatgcgccaagccgatgcccttcatcgattacacctaccgctactggctgctgtggcatggccgcgcggacaaggacccggcgcaccgctggttccgcggccacgttttcgacgcgctgcaccactccatccacggcgtcagcaactatgcgggagacgcatagcggctatcaggccatggcggttctgcccgccgcgtccacgccatagactttgtcctgactgtcatcaaacaaggagaaagttatgacctggacgatctggctgcaattcgccggcgtgtgcatgctgggcgcgatgtcccccggccccagcctggcgatggtgctgcagcagacgacccgcggcggacgaagcagcggcctggccgccgcgtcgggacacgcgctgggcgtgggcctgtacgcgctcgccgcggcccagggcctggcgctgctgatggcggcgcacccgctgttgttccgaatcatcgctggtctgggcgccgcctatctggtgtggctgggcgtgcagggcctgcgcgcggcggcccgtccgcgcgcggccgccggcgcgaccaccgccgccgccgcgccgacgtccgcctggaaagccgcccgcaccggcctggccgtgtcgctgtccaatccgcatctggcggtgatgttcgtcgccctgctcagccagttcgtcaccgtcgatatgccagccagcggccaggcgctgctgatcgtcaccgcgatggggctggattttggctggtacgcgctgctggcgctgctgatctcccagcccgccgtcctgggcggcctgcaccgcaaggccagatggatagacggctgcggcggcgcgctgatgctgctgctgggtctgcgcatcctgatggtgtgacgatgcgggaacatgccatgaaatggaatccgcaaactttcgccgcgctggccgcgcgccacggcggcgaattgctggagcacgacgcgccgctgcgctcggcccgcgagggtgccgcccacttcggcatcgccatggcgcagaccgcgcccacgctgattgtggaggccgacggcgacatcttcgcctgcatcctgtctggcggccgcaacggcgtggactgggacaagctagcgcggctgctggaccgcgcccatgttcgcctgcttgaccgccgccgcgtccgcgatatcaccggttgcgacgccggcgcggtgccgccgctgggcctgggcctgggcctgccctgcgtgatggaccgcctgctgttggcccacgacttcgtctacggcggcgccggcgatccgctcagaacgctgaagatcgctccccgcgtcctggcggaactgaaccgggtgtcggcctggtacgaatagcgcccgcggcttacagatgctcccgcaggagtcgagcgccggcagcgccacccagacccggcggcatggcctgcggccagaacgccgcgctggcgaccacaagcctggcgcggcatccggcatggcgggtggcggggtgtacgctggccgtcccggcatcggcctgggcttcccgatattgtcggtgccgccccggaacccagcggccagcgcagccatccgaaaccgcgccgtcacaaggcttgcgggtcgatgtcggcgacgctgtcgaacacgtagtccggctgataggggaattgctccatcgattcgcggctggagacgccggacagcaccagcgcggtgctcatgccggcctccaggccgccgacgatgtcggtgtccatccggtcgcctatcatcaccgcctcttccggatgcacgcccagcttgcgggtggccagcatcatcatcagcgaattgggcttgccgacgatgtagggcttcttgccggtggcggcctctatcgccgccaagagcgtgccggcggccggctcgtagccgccgccttcgatcgggtcgatcatgtccgggttggtgccgatgaacttggcgccctggtcgatgaagcgcaccgccttcttgatctgctcgaagctgaaagtctgcgacttggccaccaccacgtagtccggatgggattcggaaatggagaagccgacgttgtacagctcgttgatcaggccggccccgcccaccacgtaggcggtgggcatcgccttgcgggtctggcttctcaggaacatcgccgtcgccatcgcgctggtgatgaagttgtcttcggtcaggccgcctatgcccaggctctccagcttcagccgcaaatccagcggcgtctgctcggcgttgttggtcagaaacaggaaaggggttcgggtgtcgatcaggcgctggatgaattcgcgcgcgccggggatcagctgcttgccccgatagatcacgccatccatgtcggaaatgatgcttttgctcatgcggtgtatccagaacacgagtgccggttgcgcgggcacggtcgcgggctgcggcatgccgccgcagcctggacagcatagcatggccgcaagacggcttgattgcgccactggcgccccagcgcgcctgcccgcagccgcccatccttagccgcgcgccagactggccgcgtcaatgcggccgcagcgcggcgcggccccagtggatgcggtctatctccggcagcttgctgatgctgagcgccagctcattgcaggcctgcggccccagcgccgagccgctcagcacgatctgcaggcaggcgcggtcgttggcgcaggccggcatgctgacgatgcggcacgcgcacaggccccggcttcgcagctcgcgcatcacctgcctgcgcaggctggtcaactccgccgccgcgcaggtcagggtcaatttgaagcctagcgcggcgcgttcgcgcggggccgcgccgccgcgccgagccaacatccggaaaaaggccgccactcccatgcccaccccctttcggcgcccggacgccgcgcatcggccgctccccgcgccttattatcgtttgtcgatgccggcgcccgccctgctgccgcgcgccggccactgatgcagtaaaccgcgttccgcataaagaaaacgaaaaaagtgagaggatgaggataaacatttcgccggaccggattggagaaaatccagccgggcgagagccggctagccggccgacggcaggtcgatggtgaccgtcaagccgccgccgacgcggttggccgccatcacgctgcctccatgagccaggatcacgcggcgggtgatggcgaggcccaggccgtagccggcggcgggagggcgcgaaccgctgcggaaaaagggctcgaaaatggcggcgaggtcgccgtcgaacacgccaggcccccgatcggacacgctgacgcgcagccggccggcgtcggcgcgggcggcgatctccacccggctgccgtcctcggcatggcgcaccgcgttgcgcgccacattctcgatggcgcggtgcagcagctcgcggctgccgcgcgcgctcagatgcccggcgcaatccacgctgatggcgcaggccttggcctccgcctccaaaccggcgtcggcggcgatatcggccagcatctcggccagatcgaacgtctcttccacgccgtcggcgatgccggcgtccagccgcgccagggtcagcaactcgcccaccagcgcatccatccgcgccgtgtcgcgctcgatgcggtcgatgaactccgccgcgcgctccggctgctgccgcgtcaggtcggccgccgcctgcagccgcgccagcggcgaacgcagttcgtgcgacacgtcgtgcagcagccggcgctgcgcgtccaacagtttttgcagccgctcggccatgcggtcgaaatcgtcgcccagatcggccagctcatcgttgcgccccgccatcgcggcgccggcgcggacatccagccgtcctgtcgccgccgcgtcgaacgcggcccgcatagtccggatgggtttggcgaaataccaggccaacaaggcggcgaacagcaagctggcgatgctgccggccagcaagggcagcaacagcatggacaggccggcaggcggcggaccatggcgcggcggccgcggcgggccgtgcgccggggggccggcatccggcggcggcccctctccggcggccagcgccggccggggccgatcaggatggcccagccacaccgcggtggccacgccgcccatggtgagcagctgcgccagccacaaaaacaggaagaacttccagaacaggcggcccatcgcgtcaaccggctatcaattggtaacccttgcggatcacggtctggatccgcgggctgccgtccgccagcggccccagcttgtggcggatgctgctgatatgcacgtctatgctgcggtcgaagcgggccaagggccggcccagcgcttgttgcgacaattcggccttggacaccggcatgccggcgtggcgcgccagcgcctccaccagattgtattcggtgctggtcagctccaccgcttgcccgccgcgctccacccgccgcagcgccggccacaccgtcagcgccccggccacgatggccggcgccgccggaagctgcgccgcgcctgccacacgcttcagaatggcgcggatgcgcgccgccagttcgcgcggcgtgcatggcttgggcacatagtcgtcggcgcccagctccagcccggcgatgcggtcggcatcgtcgccgcgcgcggtcagcatgatcaccggcatcgcgctcgcggcgcggatgcgggacaacgccgctatgccgtccatgcccggcatcatcacgtccagcaccgcgatgtcatgccgccccgacaaggccgcggccacgccggccgggccgtcgtgggcgcaggacacggcgaagccttcgcgcgccaggtagtcgcgcagcagctccagcaattcgatgtcgtcgtccaccagcagcacattcatgtcaaaccgcgcctcatgatcgcaatgctgcggatattaaggcacgcccccgcggcggcggcaatcctttaccccgatttacaccggcgctaacgccgtttaacgccggcgcgggaaacaatggcttccatggcgcggccggcttcttcggcaggccggccagactggagggaatgcaaatgcagaccgcgaagaaacgatggaccatccgcctggcggcgggaatggcggcggcggcgctggccgccggggtgatggcgcatgaaccggccggcgacgagcagcctgccgaatgcccgcctctgccgccgctgcacggcgccggctggctggccgtcccaggactgccgcaggcggcgctgcgcggcatcaagctgaccgaggcgcaagaggacaagctattcgagttgtcgcaggcgcaagcgccggcgcggcgcgcgctggccaagcaagcggcgcgctcgcatgaagacctgcgccgcgccgccgaaaccgagcctttcgacgaagcgcgggtgcgcgcgctggcggaagtgcacgcccaggcgatggccaggctgtttctgatgcaggccgagctggatgccaaagcccgcgcgctgctgacaagcgagcaacgccgacaatacgccgcggcgcgcccggcgccctgccctcctcaggcccgctagccctgccgaccaacactgacggcggcgcatcggcagcccggtcgcccctcccgccatggccggccgcccgaaacgcctgccgatgcatttatcattttaatgttaatataccggttctgaaccttcattcaggccaagttgaaattcattacaaaaataatacttaaaagtactttattcggcgccgcgcgcactgtagatcgcctgcgcaacgcttgccgcctcccggctcatgattcggcttttgccgcggaaaaccagctatccaaacaagctattcgcgcacactgatgaaatgggatttccatggaaaacatcaattttcaaagcgatgccttctacgccaccaatccgtcattcactgccaccaatcatattattgaattcaccaaaccgctgaaaatcctgaaaatagattacttcacgtttgatcggcacttcaaagacaactccagagtggtgctgaccaattcgatagactggatcacccactactggcgcaacgacatgtaccagcacgccattttcgagaacaatccgctgagtttctccgatggccatgtcttctggaactggctcaaccgcgaacctatctattccgccgccagccaattcggcatagacaacggcatcaccatgatcgagaagcacatcgactacaccgatttctttcatttcggctcaatcaatgacaacagcgtgaacaacaactacatcatgagcaaaatgggaatcctgcaccagttcatttccctgttcaaatacaaaatgcaggacatgatcagcgatgccggcaagaaaagaatctatgttccggatttcaagaaaagcctggcttcgatacaggaaggcgaagtcaacaatgaaatcgtcgggctggatttttacaagctgatcaatcggcgcgatgtttcccggatctacctgggcgaggaatacaacaacgcctatctgaccaagaaagaggtagagctgatgaaggagctgaccagcggcaattcatgccaggaagcctcgctcaatctgggtatttccagcgacgcggtcaacaagcacatcaagaacatcaaggacaagctgaattgccgcacgctttgccagcttggcttcgtgatgggcaagctgagctcgaaaaacatctatccgtttttaataggcgacaggagttgagaatgaagatttggctggacacgatagatttcgacatcatccgcaatgcgcaagcgctgggcgttctcgccggggtaaccaccaatccggcgatactggccgcggccgacctgccggcgcaaaccgtcatcgaaaccctgctggacatccaggatggccaggtggcggcccaggtcacccgtgacgacttgccgggcatgctggcccaggcgcgcgcgctagcgcgaatcagcccgcggatggtgatcaagatcccggcgatccgccacggcttccaggcgatcgccaccttggaaaaggaaggcatcgccaccctggccaccaccatcttcgaaacccggcagatcctgatggccggcatggtgggcgccagctacgccgccccctatgtgaaccgcatcgaacaatccaccggcaacgccttcgccatcctcagcgaatcgcaggccatcctcgaacgctaccgctacaagaccatcatcatggccgccgccatcaaatcggtcgaacaatgcgtgcgctgcgcgcagttgggaatcggcgccgccaccctgccgtccgacatctaccgcggcctgttcgcctccaaccacgatatcgacgacagcctggccaaattcgacgcggcatgggcggcaagcaagttcacctccggctccagcctgtttcacgttccggccgccaaggaagcccgcctatgaaccgtcccgaccccgcgctgaggaaaaccatcttcctggtgacctgcaccttcttcctgtggggcatgtcctacggcttgctcgacgtgctgaacaagcacttccaggaatccatgcacatcggcaaggcgcaatccggcctgctgcagctgtcttacttttccgcctacttcgtcatcgcgctgcccgcggcggccatcaacaagcgctacggctataaaaagggactgatcgcgggcctgctgctgttttccgccggcgcgctgctgttcatcccctcgctgcgcgaaggcagcttcgccggcttcatttgcgcgctgttcatcctcgcttgcggcctgggcgtgctggaggccaccgccaatccttacatgacgctgctgggcgacccgcgcggctcggaaaagcggctgaacctggcccagtcgttctgcggcctcggcaccatagtcggcccgctgatcggcggcgcgctcttcttcaggatcggcggcagcgacgcgcaagcgcagcacggcgcggtgatgcaggtttacgtgtggatttccgccttcgtggtgctgctggccgcggtgatcgcccgcaccgacatgccggcggcggagcaggcaagcgagcgcgcctccgacccgggcgcgtccctgctcggcaacggccgcttcatcggcggggtggccgcgcaattcttctatgtggcggcccaggtcggcatcggcgccttcttcatcaactacgcgatggaaaaccaggcctcgctgtccgccaaggacgccgcctggctgctgtcggcggcgatgctgctgttcatggccggccgcttcgccggcacctacgccatcgcccgcctgccttcgcaaaggctgctgaccggctatgcgctcgccagcatcgtcctgtcgctggtcgtcgtcttcgccggcggccggctggcggtcttcgccctgatgggcttgtttttcttcatgtccatcatgtatccgacgatattctcgctcgcgatcaaggacgtgggagcgaagaccaaacaggccggctccatcctgaccatggcggtcagcggcggcgcgctctatccgtacctgatgggctatatcgccgaccggcagcccatcgcccacgcctacctgctgccgctggccagcttcgtggcgatcttcgcctacggcctgtacctggaaaacaagccggcgccgctgccggcgcccgccgccgcgcgctgaagcgcagacgccagcccggcatgcccgcgatagccatccttgcgatggctatcgtccgtttcggccgccggaaatctactacagatttctgtacttaccgccgcccggcggatacggtatcttcccgcatgccatcagcacatggctttcggcctgcttggccggcatgggggcaacactttttcaaaccgtctcgacaataacaaaagcatgggaattccggcgcttctacaggcttgaggtgcaaagcatggaactgaaaaacctagtcaagaaaatagaagacgacgacttcgccgtcgacagcatccagggcgactccgtgatcatcacccggcccgtgatcctgggcgagaaagactcggaatgggaaggttcgccgattttcaaccgcgaatacctgatagacctgatcgccatcagcctggcctaccaggtgttggaccactccgacctgaacaccgccttaagcaaagccaacgccttcacctgaagacgccgttccgctccattccgccgcggctgccctgttttcccccggatgcccagcttgcctttcgcctgtcccgcaaccgccagaccgccgccgcaggcaagggaaaccgggcggcgtccgccgcgaacgcggagcccctcgccaacagctcaggcttattgccactcggcggcggccagccccagcgctccggccggatgcgcccaatgcatgggcgcgccggcgatggccagcggcggcaggatgcgccgcgccgcgccccacgacgtgctttccacagcgccagccagatcctccggccgctccggcgacagcgggccggcatcgccggggttggcatgcgccgtcaacagccgggcggtgcgcgccagcgaggcctgggcgctgcagccttcgccgcttgccagccgcccgctcagtccgcggatcgccgccgccgccagcaaatagccggtggcatggtctagcgcctggttcggcaagggcagcggacgctcggcgccgctggcgcgcatgccggcgtcggcaatgccgctgctcatctggatcaggctgtcgaaaccacggcggccgcgccaaggtccggtccagccgtaggcgtccaaagacacgtccaccagccccggattgagctcgcgccgccgcgccgcgcccaggcccagccgctccagcgcatccggccgataaccatgcaccagcacatccgccccgatcaacagccgctccagccgggcgcggccggccgggtttttcagatccagccgcgcgcagcgctttcccagcgtcacctccggcaccgtgcccggctcctcccagccatgcgggtctatccgcagcacctcggcgccgaagccggccaggaaacgcgtggccaccggcccggccaatacccgcgtcagatccagcacgcgcacgccgcgcaaggggcgctcgcgcgtcggcgtccatgccggcgcggcggcgcggatgccggctcgccaacgcagcagcggctcgtccgccaccgcccggccctgcggatgctcggcccattcggccaacgtgcgcatggcggcggcgcagccatggcgttccaccaccgccgcctccagctcatccgcgcgccagccggccaccgcccgcgccaccgcctcccggtcggccgcggcgcccagcaccgccagcgcggcgtcgcggtgatgcggcgcattggtgtgcagccgtatccagccgtcggccgcccggtagtcgccggcgacggcatcccagattggcggcagggcccagccttgcggccgcagcgacgcggtgaaccagaacgacgccagacgcttgtccaccaccacctgcggcatcgccccgccggccagcgccagcagctccgccatcgccaaacccgccgcgcttatcgccgccgcggcgaaatcggtgacggcgaacgccgacggcaacgcgccgtcgcccgtcatcgcgacgtgggccaacaaggcggcatcgccgcccgccgcctgccagaaagccttcagataatgctgcgccggcgctattcggccggctgtcgcgatgcattccgtatcgaacatgacgcttctcctttgcgtgaacccactcgaagaatatgctcattgaaataattgtcaacattgattaatgtaatcaacataacccttggaatcgaccatcatggcccgctacctgagctccgccgccgccgccgcccgcctgggcgtctcccgccaaacgctgtacgcctacgtcagccgcgggctgctgcatgccgacaacagcggcggccagcgcgaaagccgctatctggaaaccgaggtggagcaactggccgcccaacgcacccgcggccgcaagcccaaggaagtggccaaggccaccctcagctggggtctgccggtgctggagtcggccatcaccctgatcgaggacggccagctgtactaccgcggcgagaacgcgctggaactggccgcctcgcagagcctggaagaagtggccgcccacctgtggcaatgcgacgccgcggccgccttcggcgtggacgcgccgccctggccggacacgctgccggcgctgatggcgcattaccggggccgccgcgccgaagagacgctgctgccgctgttcaccgccgccagcgacgacgcccccaccgcgctgtggcagaaatcggcgccgcgccaggccgaaggctgcggcgccatcctgcggctgatgacggcctgcctgctcggcacccggcccgacgccgctcccatccacctgcaatgcgcgcgcgcctggggcgtggacgccgaaggcgcggaactgatccggatggcgctggtgctgtgcgccgaccacgaactgaacgcctccagcttcaccgcgcgctgcatcgcctccaccggcgccagcctgcgcgccgcggtagtcggcggcctggccgcgctgaccggcggccgccatggcgccaccaccgccaggggcgaggcgctgctggacgagataggcgatgacgacagcgggcaaaaaatgcgtgaacggctggcaagaggagaggatttgccgggatttggccaccatctctatcccaatggcgacgtccgcgccatcgccctgctggcgcggatattgccccatcgcccgcgcttgaaaaccatggtcgagcagggtctggccctgaccgggcagccgccctccgtcgacttcgcgctggtcgccgtgcgccggcacctggggctgccgcccggttcggccttcggcctgttcgcgctgggccgcgccgccggctggatcgcccatggactggagcaacgcgatggcgaaaacctgatccgcccgcgcgcggcctacatcggcaagccacccggcatcgcctgaaccggctcccggcgcggcgggaaatttgcctgccgccgcgccgctgcgcatatactcaagcgagcgccggccgcgcacgcagccggacgccggattccgaatcgacgatacatgcgcctgtcccatattttcatcatcgccaccgtctccctgttcgtattgatcagcctgccgctggcatggatcatcagcagcgaatgggcggtcttccatgccaccgacgatggcctggacgccatacaggtggcgcatctggccatggtgacggtggagaagatcgcgctggagcgcggcccgaccaattcgctgctgggctcgccacccgatgacggccggcgcaagcggctgcagcatgcccgccaggccagcgaccacgccctgcttgccctgcggcgcgagctatcgtcgtccgcgtccgacgaccatcgccgcgccatgggctcggtgcgccagggagaggcgatactggccgatgcccgcgtccgggtggaccgcgtggccggcctgccgatgcgcgcgtctacccagatcatggacgcggtgcgccggatgtacgacgcgatcccgccggtgctgcaggcggtaaccgcgttgtcgttccgggcggaaagcatctatccgcaactggccaatccgctggccggtgcccgccaagccaccgagctgagggaatacgccggccgcctgggttcgcagctgaccgccgcgctgacggaaaaccgcccgttgaccgaagaggaaatccaggcggtggacatcctgcgcggccgcatcgaacagctgcacagcaccctgcgcctgcgcatcaacgtgccggaagcatcggccgccacgctgcaggccgcccaggcgatggaagaccattatttccgcgccggcctgcccatggtggaggccatcctcctcgccagccggcagggccgggtctaccaggtcggcccggccggcttcgccgccggctacgtgcccaccatggccaccatcgtgagcttgcgcgacaccatgatcgccgaggcagtcgcctccgcccaggcccgccaccggcgagcgttggtgcatctggcgctcgccgccgcgctgggcctgctggcgctgatcagccaggccgggctgttcgcctacatgcgctggcaagtggccaagcctttgctgcaagcctccacgctgctgaccgccatcgccaacggcaaactggacgccgacattcccgccggccgccgcaaggacgaaatcggcgaagtgctggcggccatcgaggcgctgcggcgcaacagcgtggaaaaaagccggctggaaaaagaaaaacagcggttgatagaagaactgaccgaggtgtccagcgtcgacttcctcaccggcatcgccaaccggcgcgccttcacccaggcggcacaggcggaaatcgcccgcgccggccgcaacgccgcgccggcggcgctgatcctgttcgacatcgactacttcaagcaggtgaacgacagccacggccatgacgccggcgacgccgtgctgaagcacgtcgccgccatcgccgagcaaacctgccgcgaaggcgacctgctcggccgctacggcggcgaggagttcgtggtgctgaccagccacagcggcggagccggcggcgtcagcctggccgagcggctgcgcgccaatctgcaggcgtcgccgctggccctgccccacggccaggccctgactgtcaccgctagcttcggcgtcgccgcgctgaatgaagagcgccattcgctggaaacgctattggccgccgccgaccacgcgctttacgccgccaagcggcggggccgcaaccaggtggtcgtggcggaaccatgaccggccgggcgcccggcccctatctgccggctttcgccgaaccggatcccgcatcgtcgttggcgctgccgcttttggccagctgggtcagcaaatcgggaatgaaacgttcggcgaaaccgaagaagaacgcccagaccgccatcttgccgtaatcgacgccgcgcagcagataaggcaaaacgtcggaggatggctcatgcgggccaaactgcggcgccaaaccgctgctcaaaaaagcggcgcccaagcccgcggcgaatagccagaatcccagaatgccgaacagcaccccgctggccagcgccagatagaggctccaggagccatccatcagcatggcgacgctcgcgccggactgcccattgccgctggttttattgcccacatcctgaatgcgctgcaatatgctcgcataagcgcccaaaatgccgaaaatggcggccactgccaaggagctatccgtccggccgacagacaaccagtaatagcacgcccccagcaacagcagcgccagggtgaacctgcccaaacgaaaacgcagcctgtccaatgcgcgttcgcgtctcagcgcccggaaaaaacgctgctggccaagcaacaccgcggctctcaacgccgcccgcgaaacagcgggggcgcccgccggctgcttcgccgcctcctgcgccgaagcgacgccatcgccttcgctcatgtcgagcgacaaatcgatatcggccgggcggatcatggccagcatgtcgtcgcgggccagttccacgcacagctcctccatctcgaacaaatctccccacgtatagcggctctgcgacagcaactgcttggcccggacaagcttctcgccgttttcaggctcgttcagcaagatcgccttcatggtggtttgcactttcaggacataaccgaacgcgctccgctccacctcattctccgcggcggcaaggcgcacgccggcaagcggcagccagtgctccgccaacggcaaaccattcttcaaatcggaaacggacatggcgggaactcccagatagccggatgccgatccggcatggtcaacagagaacgggaaaaaggctctcgccgcgcgcgcccctggccgcgccgacttccatccaagcttgccaaaacttttgtcgagtcctcgcacggggccggcgggtgtcctacgccgcgcctgtcattacttattgccaagccaaactgttaattcaagctagtacgaacacttaagccgcggcccccgcctacaggacaaaacacgcgtcagcccgcagcggactggcgcgggatcggctggcgaacaacgacgcggccgcgcccggagggatttggcaaatctgcgcgcgccggcgcggaggcgcgccaagaaatcggcgcgtgcgctgggcatgatggcggacatcggggcgccgccccggtttccggagacgaatatgcataaaatccctctcgccgcgctttgcgccgccatggccgccgcgctgctggccttgcccgcgcaggccgcgccaaaacaaaaactgcagaaaaccccgcacctggcgcaggcccggccgcagcaggccgccgcgccgcgcctgtggcgccagcgcccgccgaccgacgcccaggcccgctaccgcctgcctgacaaccgcaccgtgatcggcaaaccgcagagaaaactggcgcgccacgccgccacgccgcaatgccaggacatgaacgcgctggccagccacagcggcgccgatctggccaactacctggccacgctgcccgattacacctgcggctacggcctgttctcgctggacaaaaaactggccgccaccatttacagcgccggcaatctgaacgccgtcgccggccgcttcgcccaggaggctgccggctacaatgcctcgtcgatggcgctggtcaatctgacgctctacctgcgcgccggctactacctggccagcaccggcgtcctgccggcgctggacgccaacctgcagaccgtgctgcgccccggcatcaagcaactggccgacggcgcggcgctgttcgccgccaacgcccaggcccccaccaccgctaacgaggtgatgacgctgatcaccaatatggcggacgaggcctattacctgccgtccatccgcgccatcgtccagcgctacaccaacggcgcggccaatcccgccgccgcgcaagccttgcgcgaaaccaccgcggcgcagggcttcaccggcgcgctgaccgtgttcttctacgcccacggccgcgccaacgccgcgccgctgctgcagaacgacggcagctactccgccgcgctgacgcaattcgtccaggcagacaaggccagcctgatcggcaccgaaagcgcctaccaattaggtgacgccacccgcgagggcctgcgcttcatgcaatacccggcgctcaagcccgccatcaagccgcaagccaaggccatcctggccggcagcagcatgaccggcgccgacaacgagctgtggctggcggcagccgaggcggtgaagtactacgacaatgccaattgctccgagtacggcacctgcaatttcgagacccggcttgccgacgccgtcctggccaaccgctacacctgcagccccaccatccatatccgcgcgcaggaaatgaccaccgagcagatgcagtcgtcgtgcgcgctgctgcagaaagaggaatcgtacttccaccagatgctgcagacgcataaccaaccggtggccaatgacaacaacacctcgctggaggtggtggtgttcgacgactacgacaattattccaagtacgccggcgtgatctacggcatcggcaccgacaacggcggcatgtatctggaaggcaatccggccgatccgggcaaccaggcgcgcttcatcgcccacgaagcgtcgtggctgcggccgacgttcaaggtatggaatctggagcacgaatacatccactacctggacggccgcttcgacatgtacggcgacttcgccgccgccacccgccagcccaccgtgtggtggattgaaggcctggccgagtacctgtcgctgcgcaacgacaatcagaccgccatcgacatcgccaagaccggcacttacaagctgagccagatctacggcaacacctacgacatggccgactacgtcccccgcgcctaccgctggggctatatggccacccgcttcatgttcgagcgccatcgcgccgacatcgacgccatgctgccgctgtggcgcaagggcgattacgatggctacatgggccagatgcggcagataggcaaccgctacgacgcggagttcgccaactggacgcaaaacgcctccactgccggccagccgccgctgccgcccgcctccggcctgccggcatgcgacgagggctacccgaatcggctgggcaagaattgctcgatcagcggccaggcctcgtccagcgcggcttacctcgccattctggtgccggccggcgtgcgcaacctgaagctgtggaccagcggcggcagcggcgacgtcgacctctacgtggccaaggaccgttacccgaccaccggcagctatgatttttcgtccgcctccgccggcaacgaggagtccgtggccatcgccgcgccgcagggcggacactggtattacctgacgctgcaggccaagcagccctttgccaacgtcaccgtcagcgccagctacgagtaagcgcttgcgccaaacgagaacaggccgcgccgcacgcgcggcctgttctcgtagcgcgtgcgcgaggaaacttgcaaacctcatgaatgtaggccatgttattttcaacaaatgccattgtaataattgacccatttgatggaattaatcacgcaatccgaggatggcccacatgctcatgcagcttccgcaacccagcatcatcagcgacctgccggccgcgcgcgccatggcggcgctgttcgaccacctgctggacgtggttttctcgatcaaggacaccgaaggacgctatctggcgatgagcgaaggctgcgtggtgcgctgcgcgctgcgccaccgcggccaggcggaaggccgcaccgcccacgagctgtttcccagcgccatggccaaccgctaccgcttgcaggacctggccgtattcgccgagcgcaggccgctgcgcaaccggctggacctcaccgtctacgccgacggcgcgcccggctggtgcctcaccagcaagcagccgctttatcatcccgatggccagttgctgggcctggtctgcatttcccgggacctggccgaactgacccgcgaaaaactgctggacgagcgcttcgccgcctgcgtcgaccatatccagacgcattaccaccggccgttgcggctggaagagctatgcgggctgtccggactgagcataggccagctggacaggcgcatgaagcgggtgttccaggtctgcgccggcgagttcatccgccgcacccggatggaagccgcctgccatgccattcagcacagccggcagccgctggccgacatcgccgccaattgcggcttttccgaccagagcgcgctcacccgcttgtgccggcagatgctggggctcagcccgcgccagctcaggctgcgcatgccacccggccacgctacggcgctggtatttgcacctagtaaaactactaggcacatcccgcggcacaagaacatacccttataagtggatgcttcgccggagcatgccgcgccgccgcgcgctgttcggcgcctcccctcacccgatgccaaacgcgccatggggaaccacgatgtcgattatcgataacgccatcctgccaggcatcagcgaaagcgatgcctgtttccgcctgctggccagctgcgtggacgactacgcgatcttcctgctggacaccgagggccgtgtccgcagctggaacgccggcgccgagcgcatggaaggctaccgcgccgaagaaatcatcggcgagcacttcagcctattctatccgccaggaaccgacgccgaggcgcgggcgatgagcgaactcgccatcgcccgccaggatgggcgctatgccggcgaaggctggcgcatgcgcaaggacggcagccgctttctcgccgacatcctgctcaagccgctgcatgatcaacagggcgtgctgcgcggctacgccaagatcacccgcgacatcggcccgcgccgccgtctggaagagcgcttccaccaagtggtgcaggaagcgcccaacgccatgatcatggtaaacgccgccggcaccatcaccctgttcaaccggctggccgaatcgttgttcggctacgaatcgcacgaactgcatggcatgcgaatggaaaacctggtgccggaacgcttccgcagccagcacgggcaactgcggcaaaactacctgcaacggcccgaagcgcggccgatgggcgtaggccgcgacctgttcggcctgcgcaaggacggcgtcgagtttcccatcgagatcggactcaatccgatagaaaccgaagacggcccgatggtgctggccggcatcgtcgacatcacctcgcgcaagcaggttcagcgccagctggagatggcgctgcaggaaaaaaccacgctgctcaacgaggtgcaccaccgggtgaagaacaatctgcaggtcatcatcagcctgctgaacatgcagacccattacgtcgaggaggaaagcacgcggcacgtgctgcaggacagccaggcgcgcgtgcgctcgatgtcgctgatccaccagctgctatacgagcgccgggatttctccaaagtggatttgggcgaatacctgcagcgcatcaaccagctgctgctgagcagctacggcttgctgaccagccagttgcaggtggagcaggacgcgccggaagggctggtgtatatcgaactgcagcgcgccacgccgtgcggcctgttgatcaacgaactgctgaccaacgccctcaagcacgcctatccggcgggcaagggatctatcgacatccgcctgtcgctgctggacgacaagcacgcgctgctggtggtcggcgaccacggcatcggcatgccgacaccatccggccccggaccatccaaatctctggggttgcagttggtgcctatgctggcggaacagatgggagcggagctgagcctgcacgacaatcagccgggcgtgcgcttcgaggctcgcttcccggtattcggcacaatggagcctgcctgatgaacttccgcattttgatcgtcgaagacgaacgcatcatcgcgatggatctgcagctgcagttgcaggcgctgggctacgcggtgtgcgccgtggtggccagcggccctcaggcgatagacaaggcgctggagctgcgcccggacctggtgctgatggacatccacctggaaggcgcgatggacggggtggaagccgcgcgcgaaatccaccagcgcctgaggatccccatcattttcctcagcgcctatgccgaagacgccaccttgcagcgggcggaaagcgcgctgccctacggctatctggtcaaaccggtatcgccgcgcgaactgcacgccacgctgcagatggcgatggtgcgtttcggcatccagcgcggcagcgacgaacaggtggagcgcttttgcaaggcgatggaggccgcgcagctggaagtgtgggaatggcatgtcgaaatcgaccagatgaatgtattcagcctgaacgacaatgacatgcgttcgctcagttcggtgctgtgcgagtcgatccgcagcttcctgcagcatatcgacccgcgcgacgaatccgaagtggccagcgcgatcaaccgcacccgccaaggcggcgacagcttcaacgtcagcttccgcctgcgcgccgacgaccaggccgatgtccgctggatggaggcccacggcaagcgcttcgacgacggcgaacgcggcggccgcatcataggcgtgatgcaggatgtcaccgagcgccgccgcgccgaggagaggctgcgccaggcggtgacggtgttcgaatccaccgccgaaggcatcgccatcctcgacgccggccgcaaggtgatatcggcgaatcccgccttcagccagctcaccggctacgccgaggacgaggccaaagcctggcccagcatcgacgcgttgtaccaagtcccgcacagctcgcccttcctggagcagctgcgccatggcgagcggcagatgtggcaaggcaacgccagctatctgcaccggaacggcgccgcgctctgcatctgggaaagcatcagcatcgtacccggtccggacggcaccatcggcaactacgtgctggtgttttccgacatcagctcggtgctggcggtgcaggagcagttggactttctggccaagcacgacccgctgaccagcctgtgcaaccgccgcatgctgcacgacaggctggaatacgaactggcgcaggccgcgcgccacggcagcatggtggcggtgctgctgctggacctcgaccacttcaagaccatcaacgattcgctgggccacggcgtcggcgaccaggtgctggcgctggtggccaggcggctgcaaagctgcatgcgcgccagcgacaccgtggccaggctgggcggcgacgaattctgcatcgtgttcggcggcatcggaacgctgggcgatgtcgatcaggtggcgcagaaagcgttggcgcggctggccgagccgatcgagctggagcacatgacctgctacgtaaccggcagcataggcatcgctttgtcgcccgccgacggcgccagcgtggacgagttgctgcgcaacgccgaccaggcgatgtacggcgccaagcacgccggccgcaaccgctgctgcttttacgcgccggccatgcagaaagccgccgaagtccggctgcggatatccagcggcctgcacgaggcgcttgagcgcaagcagctgctgctcgcgtatcaacccatcgtcgaactgggcaccggacgcgtgcacaaggcggaggcgctgctgcgctggcgccacccgcagcaaggcaatatcgcgccagcggctttcattcccatcgcggaagagtgcggcatgataggcgagctctccgagtgggtgctggacgaagcgctgcgcgccgcccgaatctggcgcgaaaccctgcggcccgacttccggatatcgatcaatgtgtcggccctgcatttccgcgaaaaacaaaaccaccagcgctggttgcgcaaactggcggacagcggcgtgcccggcgacgcgttggtgctggaaatcaccgaaggcgtgctgctgggcgccgattacgcggtgcaggaggcgctggagcgctatcacgctgccggcatccgcatcgcgctggacgacttcggcaccggctattcggcgctgtcttatctgaaacgttaccggctggactacctgaagatagaccagtccttcgtccgccagatcgccgaggacgcgcgcgatttggcgctgtgcgaagccatcatcatgatggcgcgcaagctggggctggaggtgatcgccgaaggcgtggaaaccgaagcgcaggctgccatcctgcgcgccaaccgctgccagtacgcgcaaggcttcctgtattcccaagcgctgccggcggacgaattctccgcctggctgcaaagaagcgacggcatcgccgttccatagcgccgccgcgccatcgcggcggaaacctgccaccgcagccacgcctcccaatcacgctgatggcgggtcaaaacggaaagctccgcctgtggccgcggccggcggcacacgcgcggcccggacgcgcgccaggctgccatgccgccggaattcggcgctcatccgtctgggatccgctgctaaaacgtagttactgaccttaatatcagtctatgccggcgcttaagggtttgaactccgccctgcccctgaatatgatgctgacagggcatctgcccgctacacgaataggatagacacgcaatggcaactggcaccgtaaagtggttcaacgacgcaaaaggtttcggcttcatcactccggacgaaggcggcgacgatctgttcgctcacttctccgcgatcaacaccggcggcttcaagtcgctgaaggaaggccagagagtcagcttcgacgtcatctccggcccgaaaggcaagcaagcctcgaacatcctgccgcagtaaacgcgctgcgataggcatgaaaaaaaaccggcggcagccggttttttcattgcgcccagcaaccgcgcggctaggcccccttcaagtagatgtccggccggtgcagctccatataccgctccggatgctccaacgcggtgaaaccgaacggcaggtaaaccgcatgggcattggacgtgaccagcaccatgcggcgcagccgacgcaacgccggctcgtccgccatcctttgcatcagctgcctggcatagccgcggccgcggcactccggcaccacgaacacatcgcacaaatagccgaaagtcgccaggtcggtgaccacgcgggcgaaacccacctggcgctcccccagataggcgccgtagcacagcgagccggctatcgcctgctcgacggtggcgcgggcaatgcctttggcccagggggcgtggtcgcgcaggaaggcatggatcaaaccgacatccagccggtgcttgtcggtggagatttgcagcctatcgtctttcatcggtgtggaagctccttgatggccaggtgggcgcgctgcagccaactcttgcaagcggccagccggcccgaataaatgttcagcgccagcgccgccacgatcagcgccgaggccaggatgctcaggctgtcgtagcgttctcccagaatgaggtagccgcccagcaggccgaacaccgggctgagcaaggaaaacggcgccaccagcgatgccgggtacaggctgagcagcttgccccagctccccagcgcgaacagcgtgccgatcaatgccaggaacagcagcgccagcagcccgatccaggaaaaatgggccagcgcgctccatgccgcggcgggtccgccctccagcgcgagcgacagcaccagcagcggcagcggcggcaccgcgctcatccatacggtgaagccgaacatgtccaccttgccggagcgcttcagctcgatattgccccaggcgaagcccgcggcgcccatcaaggccagcagcagcggcaacagcggcaaggcgtcatggtagcgggcatagccaagaagcagcacgcccagcaaggccagcgccatcaccgccttctgcgtcgccgagcggttttcctgcaacagcgcggcggccagcagcagggtgatgaacacctgcacctgggccagcaccgccacgatgccggccggcatgcccagcttgatggcggagaacaagccggcgaactggatcacgcccaggcacaagccagcgcgcagatacagccgccgcggcagcgtcggccgcggaaacagccagaccccggccacgaacaccaccatgaagcgcagcgccgccagcagcagcggcgggcactgggtcagccctatcttcaccacgatgaagctcaggccccagatcgcggccaccagcaccgccaacaatacgtgcgccgtcttcatggcatttcctcctcttcttccagcgcggccagcgcgcgccggtacgcgtccaggaaatagtccagctcgtcctcgcccaccgtcagcggcggcagcagccgcagcgcgtcggcatcatgggcggcgggcgcggtgagcacaccctcggacaataattgcagccacaaggcgccggcggcctgctcgccgaaacgccgcttcgcccgcggcgtggcgcgcaaggccagcatcagcccagcgccctccagcgcaaacaggccatccggccaggcgcggcgcagataggccgagcgcgcggcggccctggccggcgcgtctatgccgcgcagcgccgccagcatatgcagcccgcagcgcatggcgagccggttgccgccgaaggtggagccgtggatcttggcgcagccgggccgggcgaacaccgcttgatagatcgcgtcgcgaaacagtatcgccgacaccggcacgatgccgccggtcagccccttggccagcagcagcatgtccggcggcggcccgcccagcgcctggtaggcgaaccaggcgccgcaacgtcccaggcctgactgcgcttcgtcgtagatcagccaggcgccgtggcggcggcacagcgccgccaagccatgcagcgcgtccgcgcgccacgcccgcgcgccggcgctgccctgcactggctccagcatgaccgcggccacgtcgttcgccgccagcgcggcttccgccgcggcaaggtccccccacggcagcctcagcaccgcctcatcctccggcaaaccctgccgccagaaatcgctgccggccagctgggtggcggcaagcgtcaaaccatggaaaccgccttcgaaaactatcgcgcgcgccctgccgcaggccatgcgcgccagcttcagcgcgccttccaccgcctccgctccgctgctggcgaacaaggccttgccgccagccaggcccgccaaatccagcaagcccgccgccaactcgccagctgacgccgaccagcccagcgggtgcaaattgggggtgggatccatcaagtcttgcgccagcagagccgacaaggccggcggattatggcccagcgccgccgcgccgtagccggcgacgaagtccagcaggcggcggccatcgtccagcagcagccagctgccgtcggcggcggcgggctgcgcgtccagcccgcattggcgcaaaatctcgcgccaggccggattgacgcaggcctcgtaggcgtcaccgctggccatgtcgcgccgcatagctgtccagcgagcagatggccaagcggctttgcgcgccatagaaatcagccacctggtccatcgcccgcagattcagttccagcaaatagcccagatttcccagcgcccgctgctgggccagcggcgccagcaccgatatctcgcggaaaaacagacgcgacaatgccgcgtggttcagctccagattgagatcatcgtggcgcttggccacgcgctgatagtcggcgcggccctccaccagctcctccagccgatggtggaccggattgtccacgcccggcatgccctcggtcaccatgatggagccgagatagcctatcggatcgtagcggcccagcacggtgaaggcgtcgacataggcctggaacagcggcagcggcagcgcctggtccagccaggccggcggcacgcccaatgcctcgcaggtcgcgcgttcgaacgcctcgtggcccagctcctcctgaaaatagcggtacacccgctgcttgagcggcgtgcgcaggcgcttggtcatcagcggcgcgatgatttcgacgaagcgctgggtgacgtggtactgctcgatgaacaggccctgcaccagcgggctgaatcccgcgccatcggcgttcagccgccgcacatagcgggactcgccaagctgcgcgaggctgtccagcgcgtactgctcggcgcggcgcatgaagttgacgccgctatccggctcggtcgccgccggccggctcggcagccggcgccgcgcgtcgggcagcggcgcctgcagcagcaaatccatcaggcacagcaaataggcttcgacatgggccgggcagtaaaaacccaggctgtccggccgctcaaccggcgggggccgggaggcggcgcgcccggccagcccgcaggcgtcggcgaagccgttcagtaccctccgccacaggccgatcagctgcggcatgttgtcggccagatacagcttttgcagatagaaggtttgcaacgcgaaattgtcgctccactccggcgcgcctatgccgtccaccgtgaaggcatccgcctgcggcgccggctcatccagcagattcagcatgaccagcgccgccggcgcgtaaaggccgcggttagccgcagtggcctccaacagccgagccacgcagcgctgcgtcagcgactccagctcctgccgccgcgcctccagcgcggaatggtccgccggcgcgtcgcggatcagcgacagctcgtccagctgccgcgccagcgacagctgccacgacggggccgatccttcatgaatgtcgaaccagatttcggagccgggattggccattgccagcacgctgtccagcacgcgtccgccatccactccggtgaaattgatttcgtactcgctggcgtcggcggccagcaccacggtctggccgtcttcggccagatgggcgctgaacggcaccaggcgcggcatgcggtaatgactgatgcgccaggcttccatgtcccgctcctcgttgtcggcgttgttacaggtagaggcgcggcatcgccgcgtcggcgcggctgtagtagtcgacgatttcctcgtcctgcagcgccatggtttccacggtcagcaccagattcttctccaccaccagctgttcttcgcggccgatggccgagatgtcctccagcagctcgccggtgatgtcatcgtgccccagcgtgtcgttgatgtgggcgtggcgcagcagcggctcccagaatgtcctcgccaggccctggcgctcgcagcagcgcaccagcgcctgattgaattgttcgcccggcatttcgaaaaggaacaacacgctcttgaacgacagcagatgctggcgggcgaacacgcccagcgccgagcacaaggcgaacgtggacggcagcggctgcagatgctccagtccggtcacctccatgtccacgctggccaggctgtccgccagcatctggtcgtggtccagctcagacatcagaaaacgctgcagcgagcgctggttctgccggctatcggcgtgcgacagcgccgaggcgatcaatcccggcgcggcacgcaccaggcagtaatattccagcgcgtagccgatcagcacattgcgcggcgcgctgccgtcggccagcatgccgtacagccgcgagcggccgcgcttgcgcatggcgcgctgagccagattgcgcagccgcgaattgaattccagcccggaaatggcgtcggccggcagctcgaaacgggcctcggtcaccagtcccagccggtccagctcctccagcaggccaggcaggctggccgccatgcggggatgggaggcgcgcagttccggcatgctggccggcgcgcgctgcagatcgtcgagcaaggccagcagttcgcgccggccttcgtcggcgacggacaaatcgcaggattggtcgcggtacaacagcgcgacgccgtcttcttgctcctggatttccacgccggcccgcaaggccggccggtggaatagatcgtggacaccgggtgcgcgcatcgcccgcctcctctctcagtagtcttcgatgcggcgcagcagcgggccgtcgccggaatagtgccgccataccgcgctgtaaaaggcgtcgtacagttcgacgaacaggtgggtctgcgcgtgcatgcgacgcgccgtctccaggtcgaccacatcgatctgcgagaagatctgccgggtgaggctgccgtgctcgcccttgaggttgatgtcggagtgggccttgaccgggcgcaggaaggcgggatccagccccagccggtagccggcgtcaagaaaggagtcctggcggatgtccttgccttcgagcacgcccagcgtggtgaagaagaacagcggatcgttgtgcgaccagtaagccagcgcgttgcacaatgccatggtctgcggcagcggcaccgtgcgcgccaggtcttcgcggctgatgccgatgcggttcaacgcctgcagcaacagctcgtcatggccgtactcctcggcgaagaaggcgttcatcgccagccgcgcccgggtattgggcacgtaggacagcaccggcgcgtcgaaatagctttcgcggaacaggaaatggtagttctcgatcaccatgccatggaataccttctccggtatgtcgccgggccggctggcgttctggcagttcacccagaattcgttgcggtacagcgtccggtacagcagctgattggacaggtcctcgatttccagcaggatttccatgccggtcttgccggcggccggcgcgatcgagcggatcacgccgtaatcctccaggctggccagcaactggcggatgctgtccgccgactggcgcggcagcgcgccctgcacttccgcctggctgcagccccgccccagccgcgccaccagttccgccacttccgccgcgctggcctggccggcggacagctccaattcttcgtcgccggcagtcttcaccaccagcggcgactgcgaaatcacttcgccgttcaggcaataacgcgcttccggttggtggatcacgtcgcttccctcccaggacagccggccgccggccaatccggcggcgcggcagtccggcagaccgagggccgcatcgcgacaccccggccggccggcttacaggtgaaccggcaccaggaccggacgcggattgcggggtttgaccaccaccaccgcctcttgcatgctggtttgcatttggctctcctttgcttgcggaaaagaaacagcgcctggctcaggcgctttcttatcttatgcctgacagtccgcctcagaaatatcaaatacctgtcataaataactgtttttaaacagatttaacctaccgcgccagccaaaacctgccggcagcaggccgcgcgcgtctctcccccctgcctgccagcgcgccgctcatccgcatcgacttgacatcgatgcctccccggctataaccaccacatgaatatattccaaacaagtatcaattctaagtaataacacctatatagcattacccggcccaacttccggcccgccggcttgcatatcaagggagaccaccccgcctcggcaatccaccagggagattcgacatgaacctgttccaacgcgcagccgcgccgctagccatcagccgcaacaacctcggccccttggccgaactggccggcaactgggtaggccacggctacaacatgatcgcggtgcccgaccaccaaaaccacaagccttttcgcctgatcgtcaacgccaccaaggaaacgctggccttcaccccgataggcggcccggtgccgaatcgcggctcgctgcaaaacgacatcgacatcttcggcctcacctatctgcaacaggtcaacgacgccgccaccgacgaaggcattcacatcgaacccggcatctggctgcatgtgcccgccaccagcgacccgaaaaaacccgccaccatcgtgcgccaatccaccatcccgcatggcgattcgctactggcagggggagaaagctcctgtgaaaagcgcgctccccacatcgcgccggccagcaccgaaccccatcgggtggatggcaagccgttgccattcggctataccgatccctaccagaacggcaagtttcctcccggcttcgacatgaaaaaccccaaccaggcgctggtggacgtgctgcaataccagcagcagcagctggagttgaaggtggtcgaaaccatcaacctgaaggtcagcaccaacgatgccggcggcatcaccaacattcccttcatcgtcaagaatgccaacgccacccacatggacgccattttctggattgaaaccgtccagcgccccgacggctcgcagttcatgcagttgcagtacacgcagaccgtgctgctggtattcgaggaaatcgtctggccgcacgtctcggtcgccacgctgctcaagcgctaggcctccccgtctcgccatacggcgcggcataaaaaagggatggcgccctttggcgccatcccttgcgccaaaaggcgctcagtcctcatgcatcgctggccgaaaaaatctcgccaggtatcatcgcggtgctcagattgggaaagtcccgcaccgacgcatgctgcctgtcgtcgccggtgaccatgcgcagcagcagattggtgccggcctggaaatacagcgtggacggtcccttgcccgctctttgatacgtccaggcatcggcctcctgtcccagcacggtgtgccgtccggcatagcgcgcgtcatgcgcagccagcacgtcgcgcggcaggaacagctgccggaacgggccggtttcgtcgtccagcgggatgtcgcacagcgcggtgccgtacgccatcgcctcgcggccgtaggccactttctgcttgcgggtgcgtccgctggcggcattgccggtttccgacatccacagccgatagccggtatcctcctccgaccacgggttgaacaggccatcgatgcggcagatgttgcggccgtagtcgaaccagcaatagcccgagctgagctggtcgtcctgcagcatcggcgaccaataggaaacgtaggcgctgctccactgctgcggcagcagcggcggcgcggactgcgggatgggctggttcatgacggagtcctcagcgatcgagcgcatagcccagattgcgcgccagggcctccggcagcggcggcagcgccttgcggcgggcatcgaagctctgcatgaactcggcattgctcagatgcatgcggtcgtccaccgtctcgaaccagtcgcggctgctgttggcatgctcgctgaacagcttgaccaacggcatcgcgcgcgcgtcgaagctggccagcgccgccggcacgctggcctcggcgcacagcgccttcaccagcagctgcgccgccaccaccgccatggtggtgccgtggccgatggagaagtggccggactgcagcgcgtcgccgatcaacaccagcttgccgtcgtaggacttgtcgtggctcagcgtcatgaagttgcgccagcctaggccaggctgcgccaccaggccgtggccgcccagctcggcgcggaacacgcccgccacatactccgccgacgcctcgtccgacatctcccccaggcgcgcgcgctcgaaggtttcctcgctgcactccaccacgaaagtgctcatccggctggagtacttgtaggcgtgggcgatgaaaatatccttgccgtgggtgcggaacaccaggttcatctggtcgaacaactggctggtgccgaaccagatgtatttgttgccgccgtactccagcttgggcgccagcgcctcggtgaagtgcgaagtcttgtggttgacgccgttggccgccacgatcaggtcgtagtcgtccagcggcagttgctcgcgcgccagcagcggcgactcgtaatggatggcgatgcccagcgactggcagcgctcgcgcagcgcctgcaccaggccgcgccgctccacgccgcacagcagcacgccggtgctcatcagattgggctcgttatggtggatcagcttgaaatcctccaggaactgcgggtccagccgctccggatgttccagataggacagcggattagccggatgctggccgggccggccaggcagcaccacgccccagcccgccacttcctcggggtcgttcttttccgcgatgctgatctgccaatcgggcttcgccagcttcatttggctggcgaacaccaggcctgccggacccgcgccgataaccaggatttttttcatcagttgaccctccccaatttgtaccagacgttctgcttcttctggatggtttgcaatttgtcgtacggctcggaagtgaaatacagcttctgcgccatgtccggcggatacagctcgggaaacttgccgtgcatgtagcgggtgtagcgggcgcgcaggaaaaagatggggttggagcagctgagcacgtcgtagttggcgcgcgccatgtcctgcatcgcgtcggcctgcaccttgcgctgcgcggtgaattcggcgaaggccagctcctgatcatggcagtgctggtccagcagcgtgacgaagctgtgcgcgtcctccagcgccatgttcatgccctggcccaggaacggcgcggtggcgtgcgcggcgtcgcccagcagcagcacattgcccttgtagtggaaggtgctggagcggacattgatcaagtcgttgctgggctttaccaggaattgttccagcatctcctcccgcaccgcgtcggacaggctgccgaaatagcgctggaaaaacgccttcatcgcctggcggtcctgggtggccaggctgggcgtgccctcatacggcaggcagacggcgatgctgacgctgccgtcggggatggtggccgcgcggccggcgaacaggccgccggaatccatgccgaagaagtacagcaggtccttgcggtagcccagcgcctcggcgtcgggcagcaccagcgtcttgtagccgtggcggaagaaggtttgctggaattcgaaacggcgcatgccgctttgcatcgcctggcgcaccgccgaatgcgcgccgtcggcgccgatgaccatatcgccttgcaggcgctgcagctggccgtccttgctctggatcagcaccgacttgccttccagatcgacatccaggcatttgtgctcgaagtggtagcggacgccgttccggttggcgtggcggttcagcaggcgctgaaaagcggccctgttcagggatagcggcgacaagccttccagcggctgcagctcgcggatgcggaacttgccacccaccgaaaacgccatgccgacgatgggttcgccgcactggtccagttccgcgcgcggaatgcctgccgccagcaccgccttgatgccgcgcaccgtcatgctgacgccgatggcgcgcgagctgaccgcgtcgacgtaggacgacagatcctgcagcggatcgccccgcttctcgaccacatggacctcgtagccccgtcttgccaggtaaatggcagtcaggccgcccgcgagcccccctccgacaataatcgctttctgcatttcaggcctctcttgtaagctttccacaagccaaatccatcagttgccggcagtagaacgccagcaactccttcggcgcgtccgccacccagcccggctccaggccggccgcctcatccgccagcgcttggcagcgcttggccagcatctggcatcccaagctgtaatcgtcgaataccttgcagtcggccgccgccggcaccggcggcgcggcgttccgccccggcacgccggacggcaggttcatcagcgcggtggacagcggccgcagcaggccggtcatcaggtctatcgccgcgttcatcagccgcgagcgcctgaggctgcccgccggctgcgccgcgaaatgctgcgccatcatcgcgaacatcaattcatagccgccctggtacaggcgcatcagcgcgcgggcctgcggctcggtcaccagattgcagccctcgcgcggcgccagcaccgcgttcttcaacgccggcagcgccggctcgaacggcgccggctgcgccatcagcctgccggccaggctgcgcaggcgctggaaatgcgaatgttcgaagtgcggcgaatccagcgcgccgccctcgccctgttcggtgacgaagcggatgccgaacagcgcgctgtcgcggtcgaagacttccagctggtagccgggaaacgcgcggttggtcagctcattgaggaacagatggtgctcgccgccgcgcttgcccgccgcgccgtcgaacaggtcgggcaattcctcgaaagcctggcggatggacgcgtagaaggcggcgatggacttggccggcgaaggaatgaacgcgggccattccagcttgatgaagcgggccagcacgtattcggaaaacggctcgaaggaaaactcggtgtcgaggccgaacgcgcgccgcgcctcgtcccccacccgcgccgcgccggggtggaagggctcgcccagcgccatcagcaggttgttgaccaccaggtagtggatcatctcctcgtgggctatctccaggatcgcgccgcgcaggccgccgtcgcgccgcctgtcgccgccgccgcaggccagctccagttgctcctggctccacgcgcctgattgcgccaattgctcgccctgcgcgtaattcggaatggaataggcggcgtagacgtactgcagcatgatggacagctcgagatccaccgccgtcttcagcgcttccaccagctgggcgcggttctcgatccgcgccggcgcgccgccatcgggcgcggcggacggcgccgcgcgctcgacattggccaggtatttcagaaacagtccggccttgggccgcgacagctcgcgggtgctgggcatgtagtagcttttgtcgcggttttgcggatcgcacatctgccacatcagccgggcgtaggtctcgcacttgcagcggtcggccaggctgaacaccttgtccgacatgaagggatagaccagctcgtaataactcatcacgtgccggtacaggaaggcgtaatcgacctgctccgccggcacctcggccagctgccagtcgtccggcaggatgcgcaggttgacgcgctggacgccgccgtccagctcgatgcgcgcgacgcccggcttcaggccggtaatcagccattccgcgtcgccgtcgcgttgccgcacctccaccgccgcctggccgtcgccgaccaccttgaacgggatggccgggcgcggccggcgctcgccgcggtaatagcttctcaccgtgacgcgttcgggaaagctcaggccgcgcgccgcgtcgggcgcctccaggtacaggttgttggcgtcggtctgcgacacccagtccacctcgtcccagcgcgccaattcgctcgacagcgacagcgagccctgcggcggattgagcagcggcacgtcgacgatgccgtgattacgccaataatccaggcaggcctgctgcggaatccgcgcgaccagggcgccgccgcgatccttcagcagcaggtcgcccagcgccagcttggggccgagcgcgtgcgtcagccggcccggctcgtcgatgcgcggcgcgcgtgtagtgaacggcagcgccgcgcacaaattcagcgacacccggtcatcgcggatctgcagcgtcagcggccccaggcccgcgcctgcgggctgcagcagccggccggccggatagctggccagctcgtcgcgccgccatacgcccaccgtgccgaccatgtcgtagaacaccggcgtgtccggctgccgcggcgtggacatgttgaacaaggtgtactggacagtcagtcccagcgcgtcgtcgtcttccagcgcccgctgcagcgcctgcagcgtcgccgagccgtcatcgcccagattgaacaggaaatacggatcgctcttgggcaaggaaaactggaacacccgcacccggccgaaatcgtcgtccagaaagtggcctgaacgctcgcagacatgcccgccgcccacccagcgcgcgccgtgggcctggtcgatgtcggcggtgaacaggctgggcgcgtgggcggcggcgccgggcggggaaatgacgaactgcccggcgtagatctgcaccgcatccggccgggtgggatcattgtccacccagcgcgcgcggttgaacgaggtgcgcaggtattcgttgtaatgtccccacaaggccagcttcgcaccgatcaggctgtcgtcggcctcggccgcgccggccctcggctccaccgcggtcaccaccgcgccttcccaggagaaatggttgttgccgttggcgttgtggcccagcgccaagctgaagacgccgtcgtcggcaggcttgccctcgctgtcgaaatgcggacccagttgccgcagatactggtggaactcggccggcgggcgcgccaggtccaccggctggccgccggccgacaccgtattgctggccatgtcgatatggccgtgcggatcgcggttggcggtgggcgcgttgacgcgggcgcaacctcggaaatgaaaacgcggaaagtcgagaatgctcatagggctccagaaggaatggactgcgacggcgcggcgcgaagccgcgggctcatccggccatgcgctgcagcagcagcgcgctggccgccctggcgctgagcagtccgccctccatccagccgcaatgctcggtgtaggcgtcggaacaggcgatgatgccgctgtcgcggttcagcaaggccggcgggcggtccgccgccgccgcgtcctggcaaaactcgacgccgtgcgcccagtacttgtggacatgctggcttggctgcggaatgctggccgccccgatgcccagcgccgcggccagatggacgcgcacctgttccagatagccgtcctcgccgtcggcgacgcaggcgcgccagtaagccgccatttcgctgtcggtatagaagaacacgtacttgtcgcccttgaagtagaccttgcgcagcgggttgtcgacgatcagcacctgatcttccagcttgtagtcgcgccaccacggctcgtcataagacagaaaacccttgaacagcggcagcgagccataacgggaatggccccaggccgccgggaagtccaggttgagcccggccatcgccgacggcggaatggccaggatcaggtgccgggcgtgatgcgtcagctgccagccgtcatcccccaccagcgccagtcgatagccatcctggtcgcgctccaccgacgccaggcgaaagcccaggctgaacttggcgccgcccgccttgaccttgtccttcatccgcgcgatcaggccgtcgaagccatccacggcggaaaaccactggttggcgtcgttctcggtgaagctctggatttccggatgcttgccgacgatgtcataggccatctcggcggagatattgggcaggaacagcgcgtcgtagcccatggacttgatcatgccgatcgcgctgtccgtgccctggtagcggctgacgaaattgaggaaggattccttgccatgctccttcagccgcggcgacagctcgcgcatcgcgcttttcagcgtttgctggacgcggttcttgaatttcagctgggtgaagggatagcgttcgctgcgctggctgtagctttgcatcacgctctggaactgcgggtgcagttgcggcgagtagcggccggcccccagctctatcgcggccttgccgtccaggtttttcgagcggatgcgtccccccgcctccgtctgcatgtcgaaaatccgcagcgacaggccgcggcaggcgggcgattccagcaaatacgtcgcgcagctcaagccgctgattccggcgccgacgatgcaaatatccgaagagtgcttcatcacgaaattccttggttcattcaatcgacacccgccggcggcgcggccgccgacgggtccaaatctgaaggggaatggctcagctcttgctctttgtcttgcagaatcgggaaccgcgcgccgctgtggctgccgtttcccggcgggcggcaagccgcccgccatcagtcattttgaatttttaatactaattaaaaatgcttttggaatttaaacaacactagtcaagttgcatccaattcacaagaatattgtcggacagttcagcactacctgttcctagtgacaggctttccatttgagaaatgcaacacctccggccgagcggccaacccctggccggcgtaaaccagttgcgcgcgccagtccagatattgtcgcgtcgcgccgatccgcactcggaagcgctcgccgtcgccgacggacggctgccatagatacagctggtcggcatggctgccgccgctccaggcggtcaggtagtagtcggccgcgcgcgcccagtccttgaacgacaccacgtcgccatcctgcaagcagccgtcggcccggctctgattgaccaggcgcaactcagcggaccggctgagcggaccctgggcggtgtaataggcgtactggttgccgcccgctccgccccaccaggtccagaaccagccgggctgatcggcgcgctccagccgcacgtattcgccggagcgcacgcagccgttgtcgcgcatcgagaaattattggacaggttgaactgtgcctgcggccccgcctcggccgcgccggctttcagccagccgtcgttgctgccggcgctttgcacataacggccgctggccaggttttgcaggctgacctggcgatagccgccggccggcgcggtcagcgagcgggtcggcgtcgacgcgtcggcccaggcgaaggcctgcaccgggtagtggtcgctgtaatcggcgtaggcgtaggtttgcttcgccaccgccgactgcgccgtccactgcggcgacggcgcgtccagcgccaggttgtgccacatccccggctggcggtggcctttgagcagcaggatgtagtcgatgtattccggcgcgtcgccgctgcgcgcgccgtagcgctccagcgcgatgccgttgccgcgggtgtcgaaactatccggcatgccggcgtagcgcggctcgctggcttgcagaatgtcgagcatcgcctggtattcggcgcttttatggcgatcggtgttcatgtcgccggcgatgatcaccggctcgtcggccggcaggcggcgcgcctggacccaggccgccatttcgcgcagctggccctggcgcaccgcgatgtcggcatgatgggcgcagccgctgtcttccgactgcagatgagtgcccagcacgtggtagaaccggccgccgacattgatcttggcgtaggcgaagcctttcaatgcctgcccgtcccagctgcagcccggcgtctggaacagatactgccgcttctcgacgatgggccagcggctggcgatggccacgccgccgtcctccggtttcagcgcgttccagccctcggtgccgtcccagcccagttgcgcgcggcctatcaccggcgtctgatagggaaaccgcggccgtagcagcgccagcagcttctccgaggcggcattgtcctgcagctcctggaacaccagcacatcctggccttgcaggatgggcgcggccgccatcagctcgacgcgccgcagctggccgtaattgggatacaaggcctgcggcagcagcatcgcgttccaagtggtgagtttgagatcgtcgggataggcggcatgagcagccgcggacagggccagagccccgcatgacaggaaacgccaggctttcatttgacatcctcgcaagtggtgggaaaagcggatcagtctggatagcgcggttttcaatacggttaattttttaaaaattaatacgtcaaaagcatatttgcggaattggcctggaaatccggccaggccatcccgcctggccatgcgaatccggccggcggcgcgccatacgctgagccatccaccctgtcgtttcggccgcttgcgcgtgggaaaggagcaaaccatgcatgccgcgatggttctgcagggcggcatggcgctataggccgcctgtctggcggccggcgcgctgggcttcatcccgctatggctgatcgcctccgggatcgatatgtggctgggcgccagccgcgccggcgactcggcgcgcgaggagctgccgatcttcctgccggcgttcggcgtgccggcggccgtcgccgccgcgctgtcgcggaaactccgttgacggccggaaaccaaaacagcccctggccatgacggacaggggctgcttgcgccaacgggccgcgcgggccggagccaggcttattcgtggatggcttccaccgcgatgtcgatggtgacatcgtcgccgacatagggcgcgtacttgccggcattgaattcggtgcgcttgatcttgacgctggcgttggcgccgatggcgtccttcttcagcatcggatgctctttgttggtgaagctggacagcgccagcgtcaccggcttggtcacgcccttgatggtcaggttgccttccaccgcgctcggcttgtcgccgtcgaacagcaccttggtcgacttgaaggtggcggtcgggaatttggcggtatcgaagaaatcggcgccctggatgtggccgttgaacaccgggtagccggtgtccaccgacttcatgtcgatggtgacgtcaaccgaaccggtcttggcttccttgtccagcacgatcttgccgctggtcttgtcgaaccggctcaactgggtggaaaagcccaggtggctgtaggagaagcgcgggaaggtgtgggtgccgtcgatgacataggtttccggagcggccagggcggcgctgctgaagccggcgacggcgacggcggccagggtgaggcgggtcagtttgttcattgcaggtttccttgtggggtggaacggcgtttacttggcgcgggccagcagatggaacttgatctggatttcattggcgacggtgccgaaatccttccagtcgccctcgccaatggcgaaatcggcgcgcttgatggcgaaggcgccgtcgaaggcggcggcattgccttgcggcgtcatgacggcggtggtgctgacagcctgggtcttgcccttgatcgtcagcttgccgtccacctggaagcggttgccgcccaagggcttgatggcgctggaaacgaaacgggcagtcgggaattgcttggtgttgaaccagtccttgtcggccacctggtcgttggcctcggcggagccggtgtcgatgctggcgatgtcgacattgaacgccgccttggccgcggccggcttggccgggtcgaaattcagctgcgcggaaaatttcttgaaatgcccctgcatgccgacgcccatctgcttgtagccgaaggcgatattgctcttgtcctgctggatggaggtgaattccacggcatgggccgccagcggcgccgacaaggcggcggccagcagcagcgcggtacggttgatctgcatgtttgctttctccgggtaaggattcagggtttgacgcgccagggcagcatgcgcgtcagcacgtcgtccctatcgatcagatgatgtttgagcgcggcggcgacatggccggccaccaccgcggccaacaggtagttcagcacggtatgcagtccagccagcgaatcgcccagcgccttgtccggcgcgatcaggtccggcagcggcagcacgccgaagtagacggtctgcacgcccttggccgagctcatcagccagccggacagcggaatggcgatcatcagcaggtacagcatcgcgtggccggcgtgggccatcgcccgcaccgcgccgcccatggcggccggcaatgccggcgggcgatgggcgaagcgccaggccagccgcagccacaccagcaggaacagcgtgacgccggaccatttatgccaggaatagattttcagcttgaacggcgaaaacggcagtccatgcatgtagaagccgacgctgaacagacagaccaggccgatggccatcagccagtgcaggaagatggcgggagaggtgtaacgcgcttgtgacatgaacggcctcgtgacgaattctgcgaatgcccggcgcaacggccaccggatgacagccactgtaagcggttttcattgcgtgaaatagtccgcttgaacgaattgattatttccgattgataaacaatggccggaaaaaatttctgcctggccaataaaacatggccaaaacaatgccaaataaatatcaccagcgaagcataaaacaaattgaccatataaccgccacgccggttccatccgctgctaagctgggcgcaacagtgactttcgcctcgccccgccatgcctcaagacgccagcaagccgcgcaacgcgccgctgtgcctgggttgccagcactacttcatcacttaccggccgggcttcccctacggttgccgggcgatgggcttcgccagcaagcgcgcgccctgcgtggacgtgcaggaagcgtccggccagccctgcatccgctttcagcccaaggccggcaagcctggctgagcatggccaagccgcatgatgatctcgcggctgtccgcgcgccactcgccgccttgccagtcgcctgccaccccgatgacgcgcaagccggccgcctcgagttcggccgtcagggtcggggcatcacaaaaccgcaattcggcatccacgctccgctcccgcccctgatccagaaaacgataatggctgcgataagccaccaagccatcgcgctcggacagcaggcgatggctcaattccaccgcgccatgacgcagatgcaccgcccggcgcggcgcctgcccttcccactgcagccaggcgagggcgtgcggattgcgggtctcgaacgcgaacacgccgtccggcgccagatggcgcttgacgttgcgccatagcgcgcgccgatcgtcgacgctcagaaaaacctgaacggcgtggccggcgcagcagatgaactcgaagcgctccgccagctggaaacgccgcgcatcggcctgcagccagcgcactttgcgcgcaccgggacgcgtccgcgccaccgccagcatcgccgcggccgggtccagcgccgtcacctcggcgtggcgcgccatcgccgccgccagcaaaccggtgccgcaccccagatccagcacccggccgccgcgcggcgtcagacccaggtagtaatcgttgtcctcgccccagccgttgagcaggtcgtacacctccgccaacgcctgctcttcgtacaagccgtttgtcattgccgtcccgccttcctcgccagccgcctatgatggcgtcacgccgcgcggctgtcatgccggcggaatcccggccgagcacgccgccatgcccggcctcagatttcgagtaaaaattccaatgcatcatgttgatttcaatacagtttcaagttcaatcatcggcatgacaaattcgccacatcagaaaatacgattagattcccccgtctgttgtctcgtatgttttctgcagcgccccgccaggcgccacacctacaaaaggaggatgtcatgaatgaggagacactgaagaagattcagtccaatcccaaatacctggaactggtccacaagaagaccagcctgggctggaccctggccatcgtcatgctggccatctattacggctacattctgatcctggccttcgaccccgctttgctgggcaggccgctgtacgcaggcgccaccatgacggtgggcatcccggtgggcgtttgcatcatcctgtccgccttcgtcctgaccggcgtctacgtgcgccgcgccaaccgcgagttcgacccgctgacccggcagatcgtcgaggagtccagataatgcagccacgcaaactaaccctggcagccggcgcggccatgctggcgccggccctgagctgggcggccggcgcgatagaaggcgacgtcaagcagcaagccaccaactggcacgccatcatcatgtttttcgtgttcgtcgccttcacgctgggcgtcacctactgggcggcgcgccgcaccaagtccgccagcgacttctacgccgccggcggcggcatcaccggcttccagaacggcctggcgatcgccggcgactacatgtccgccgcgtccttcctgggcatttcggcgctggtgttcgacaagggctacgacggcctgatctactcgatgggcttcctggtgggctggcccatcatcctgttcctggtggccgagcggctgcgcaacctcggcaagtacaccttcgccgacgtggcgtcgtaccggctgcggcaagggccggtgcgcagcttcgccgcgctatccacgctggtggtggtggcgatgtacctgatcgcacagatggtgggcgccggcaagctgatccagctgttgttcggcatgagctacggctcggcggtgctgctggtgggcgtgctgatggtctgttacgtgctgttcggcggcatgctggccaccacctgggtgcaaatcatcaaggcggtgctgctgctggcgggcgccaccttcatggcgctgatggtgctggccaccgtcggcttcaatcccgaagtgctgttcgagaaagccgtggccgcccatggcaagggcatcgccatcatgtcgccgggcaaggccgacccgatcgactccatctcgctgggcctggcgctgatgttcggcaccgccggcctgccccacatcctgatgcgcttcttcaccgtcgccgacgccaaggaagcccgcaagtcggtgttctacgccaccggcttcatcggctacttctacatcctcaccttcatcatcggcttcggcgccatcatgctggtgctgaaccagccggggatgatggaaacggtgatgaaggacggcaaggaagtgcaccagctggtgggcggcagcaatatggccgccatccacctggccgacgcggtgggcggcaacatcttcctcggcttcatctcggcggtggccttcgccaccatcctggcggtggtgtccggcctggccctttccggcgccagcgcggtgtcgcacgacctgtacgccagcgtgttcaagcacggcaaggccaacgaggccgacgagatccgcgtctccaaaatcaccaccgtggtgctgggcgtggtggccatcgtgctgggcctggtattcgagaagcagaacatcgccttcatggtgggcctcgccttctccatcgccgcctccgccaacttcccggtgctgttcctgtcgatgttctggaaagggctgaccacccgcggcgcggtcatcggcggcctggtgggcctggtcaccgccatcgcattgatcgtgctggggcccgcggtatgggtggaagtgctgaagcacgagcatgccgtgttcccgtataagaaccccgccatcttctcgatgacgctggccttcgtcgtcacctggctggtgtcgctgctggacagctcgcagcaagccgccgaagaaaaagccaagttcgacgcccagtacgtgcgggcgatgaccggcatcggagccagtggcgccagcaagcattaaatgtcatcatcattgacatgccgcgcgtccgatgacgacgcgcggcgataacacaaagactctggagaaacgcatgtccacgctagattccattctcaaggaaacccgcagcttcgccccgtcggaagacttccgccgcaaggcccagatcagcggcatggaggcctacaacgcgctgtgcgaacaggcggatgatcactacctttcgttctggggggatctggcgcgcgaactgatcacctggaaaaaaccgttctcccgagtgctggacgacagcgcggccccgttcttcaagtggttcgacgacggcgtgctcaacgtgtcctacaactgcctggaccgccacctggccaccgacgccaacaagatcgccatcatcttcgaagccgacgacggcgaagtcacccgcgtcacctacgccgaattgcaccgccgcgtctgccagttcgccaatggcctgaagagcctgggcgtgaagaagggcgaccgcgtggtggtgtacatgccgatgggcatagaagcggtggtgaccatgcaggcctgcgcccgcatcggcgccatccactcggtggtgttcggcggcttctccgccggcgcggtgcgcgaccgcatccaggatgccggcgccagcgtggtggtcaccgccaacgaaggcctgcgcggcggcaagagcgtggcgctgaaggccaccgtcgacgaggcgctgaagctggaaggcgccgagtcggtgaaacacgtggtggtgtaccagcgcaccaatggcggcgccgactggaccgacggccgcgacgtgtggtggcacaaactgaccgaaggccagagcgaggcctgcgagccggaatggatgaacgccgaagacccgctgttcatcctgtatacctccggctccaccggcaagcccaagggcatccagcacagcagcgccggctatctcttgggcgcgatcaacagcttccgctgggtattcgactacaagcccaacgacgtcttctggtgcaccgccgacgtcggctggatcaccggccacagctatgtctgctacggcccgctgggcaacggcgcgacccaggtgatcttcgagggcgtacccacctacccggacgccggccgcttctggcggatgatagaaaagcacaaggtttccattttctacaccgcgccgaccgcgatccgctcgctgatcaagctgggcgccgacctgcccaagcagttcgacctgtcgtcgttgcgggtgctgggtaccgtcggcgagcctatcaatccggaagcctggatctggtattacgaaaccgtcggcggcagccgctgccccatcgtcgacacttggtggcagaccgaaaccggctcagcgatgatcgcgccgctgccgggcgcggtgccgaccaagcccggctcatgcacgctgccgctgcccggcgtgatcgccgacatcgtcgatgagtccggcgcgcaggtggagcccggccgcggcggcttcctggtgatcaagcgccccttccccagcctggtgcgcaccatctggaacgaccccgcccgcttcaagaaaacctatttcccggacgagttcaacggccagtactacctggccggagactccgccaatcgcgatgaaaacggctatttctggatcatgggccgcatcgacgacgtgctgaacgtgtccggccaccgcctgggcaccatggagatcgaatcggcgctggtgtccaacccgctggtggccgaagccgcggtggtcggcaagccgcatgacgtcaagggcgaagcggtggtggccttcgtggtgctgaagggcgcgcggccggagggcgatgccgccaaagcggtggccgccgaactgaagaactgggtagcgcatgagatcggcaagatcgcccagccggacgacatccgcttcggcgaaaacctgcccaagacccgctccggcaagatcatgcgccgcctgctgcgttccatcgccaagggagaggaaattacccaggacgtgtcgacgctggaaaacccgcaaatcctgggccagttgcagcaagccctgtgatttcccgccgccagccggggccgccaggccccggttttcttttgcccgcggcatgccgccgcttgtcgctattatccgcaaccagactgtgcgaaactcgaacggcatcaatttgcggcgcccgcgcggcccgcatggcgaatatgaccacccgagagttaccataatgaaaacaacaccggccaccccgccgctggcgaaacttcccctgatgaacgcctgcctcgccgccgcctgcctgctggccgccgcgcacgcccgcgccgacgaaggcggcatgagctactggcaacccgggcagatcggcaccttcgccgccgtgcagaacgaccccggactgtcatggtcgttcagcgcctaccacgccgaggccgacacctcgaaaacccgcaaaagcctgcgcggccgcaccaccagcacgctgctgagcaccccgagcgacctgctgttcgtctcccccacctacaccttcgccaccccggtcgccggcgcgcaggcggcggtatcgctgaccgggctctacggccgcaccgaggtgtacaccgaggccgacaccaccaccgcccgcggcaagccccgcagccaaagcagcgacgacgcccgcgacggcttcggcgacctctacccgatggcgacgctgaagtggaatcgcggcaaccacaactacctggcttatgccgcgctgggcgtgcccgtcggcacctacaacgtcgaccgggatgccaacctgggcagcaaccactggtcgtacgacgccggcggcggctacacctatctgaacacccaaaccggcaccgagttttccgccgtgctgggactgaccctcaaccagaccaatcccgacacccagtaccgcaacggcaacgacgcccacctcgacgtctcgctgtcgcagttcctgaacgaagacttccatatcgggctggtcggctacgcctaccaccagctaagcaacgacaccgcccccggcataggcaggaaagacctgaaatcccgcgtcgccggcctgggcccgcagctgggctacttcttcccggtgggcaagaaaaagtggtacgccaatctgaaggcctacgacgagttcgacgccaagaaccgcaccgccggctggaacgcctggctgacgctgttcgtgccgatctgacccgcccccggatcggacgcccgcgccatcacgccgcgcccggcgacacgcgtcccacgcggtaatgttcgcgccccggcgcctgtgcggcgggcgcttcgcgcagcagcgcgatgcgggtgagcgtccacgccgcgggatcgaaagcgctggccgccgccagcgcgccgccatccagcaactgcgtccgtccccagccatcctccgccgcgcgccgggcggccaaatcctcgccctcggccaaagccagccgctctatcaccgcgtggcgcgccgccgccgcattgtcctgccacccgccgaaccatgccaccgcgctttgcaccaccggccggccgaacgatgcgcacagcgcggcgaagcccgggccggacaggaagtcgcgcatgccttccgtcgttcgccacagatagaacggcgcataggcgttcgccgctgccccgtcctctcccgcgcggcaatacagataagccttgaggcccagccccggcaggccgtcggtcaagtggccgcgctcggcgatgcggcgctcgatgatctccatcggataatcggccggcagcgcgatccggtagcgcatcgccatcatggccgcaactcctcggcgctcagcgtcgaggcctggcggccatggctgaacgaccagttatccatctcgccgtcgatcagcaccaccatcaggtcggcgggcgccaggccaggcgacacgctcaagcgctcagccatgctggcgtagagcgccgccttggcttctttggtccgcggtcgccccagatgcagcgtcaccagcacgaaatcgtcggagcgcgggccgccgccgtaatccggatcgatgatcgtctcttcggcctcgtgctgatggatcagctggaaacggtccttgggcggcacggcgatgcattccaccatcgcttgatggatgccgtcggccagcgcgcgcagatactgcggcggcttgcctttgcgcagggaaatgcgggcatagggcatggtgttctccttatttggtttgcgaggtcaaaaccgcgtccagttgctcaagcgcggcggtggcggatggccagcctgcgtaaaaggccagatgggtcagcaattcgcccatcgactcgccgctcaggccgttctccaaaccgcggcgcaagtgaaagtccagcgcatgcggccgggcctggccgatcagggcggcaatggtggccaggctgcgttcgcgcgggctcaagctcggccgccgccagacatcgtcgaacaacacttggctggtcaactccgccagctttggggccagcctgggcatggcatctgcgtgggtaaacatttctgactccttgggttgggatggccattgcactgtaaacccgtcacatcatccttaaaatcagatatatttttacagatagttccaaatttcaggatggttatcatgagacgaactttattggatctggacgtgctggccagcctggccagcggcgtggagctgggcagcttcgcccgcgcggccgacaggctgggccgttccacctcagccgtcagcgcccagatgaaaaagctggaggagcaggccggcgtggccattctgcgcaagagcggccgcggcctggagctgacgccagccggcgaggtactgctgtcctacgcccgccggctgctggagctgaacgacgaggcggtggaggcgacgcgcggcgcctcattggccggctgcgtgcgcctgggcctcgccgaggatttcggcgaaggcgtgctgccgctggcgctgggacgtttcgcccgcgcctgccccgaggtgcgggtggaaatgcgggtggcccgcagccaggaattgcaacaatcggtgatggccggggagctggatctggcgctggcctgggattccggcccgcgcgcgccgcacagcgcggctatcggccgctaccccgtgcactggataggctcggccagcggtccgcttcctcccgatccgctgccgctggcgctgtttgacccgccctgcgtcatccgcgcccaggcctgcggcgcgctggaccgcgccggccgcccctggcgcatggccgctagcggcagcagcctggcagggctatggtcggcggtgcgcgccgggctgggcatcagcgcccgcaccgccgttcaactgccgcccggcctgcggattctggacccggcccagcaccgcctgccgccgctgcccgccatcgacctgctgctgtgccgcgccgaagcccggcccgccgcgccggcgcagcggctgcacgacatcctgctggcgcaattgaccgttccgggtgttgaagcggaagcgcttaacatcgataattaacggtttttgaagcggaattccaagcatgcccgtgatcagcctcgtcgaacggatcgacgccctcctgccccagacccagtgcggtcagtgcggccatgccggctgccgtccgtacgccgaggcgctggcgacgggccaagacccgctcaaccgctgcccgccgggcggcgaggacggcatccaggcgctggcggcattgctgggcaagccggccattcctttcgaccctgctggcccgcagccgaagccgcgcgcgctggcggtgatccgcgaagacagctgcataggctgcacgctgtgcatccaggcctgtccggtggatgccatcgtcggcgcggccaagcagatgcacacggtgatcgccgatgaatgcaccggttgcgagctgtgcctggcgccctgtccggtggactgcatcgacatgatcccggtggcggacccggccgacggcgagcgcgcgcaagtgatggcgcgcgccggccaggcgcgcctgcgctacgaacggcgccaggcccgccaggcgcgcgatcaggccgacaaagcccgccgcctggccgagcgcgccgccgtggcggccccggccggcccctcccccgcgccggccgccgctcagcccgccggcgcagccgccgacaagaacgagctgatacgccgcgcgatggaacgggcgcagcaacaggcggccagcgcgccgccggcgaccgccgccaacgacaagatggcgctgatccgcgccgccatggagcgcgccgccgcgatgcgcgccgcgcaagaccccgccgataaggacaagaagtgaacgccgccaaacgcaaagagattttccagcgcctgcgcgacgccaatccgcacccggccaccgaactggaatacagctcgccgttcgaactgctgatttcggtgctgctgtctgcccaggccaccgatgtcggcgtcaacaaggcgacgcgccggctgtatccggtagccaacaccccggcggcgatactggcgctgggcgaagaaagcctggccgacttcatcaagaccataggcctatacaagaccaaggccaagaacgtgatcgccacctgccggctgttgctggaaaagcatggcggcgaggtgccgcaaacgcgcgaagcgctggaggcgctgcccggcgtcggccgcaaaaccgccaacgtggtgctcaacaccgccttcggccatcccaccatcgcggtggacacccatatcttccgcgtcgccaaccgcacccggctggcgccgggcaaggatgtgcgcgaggtggaggacaagctggaaaagttcgtgcccgccgaattcaaggtggacgcccaccattggctgatcctgcacggccgctatgtctgcaaggcgcgcaagccggaatgcgaacgctgcatcatcgccgacctctgcgaatatccggcaaaaccgttatgataaaaatggagcggaaactcaaggccgatgacaacaaacgcattgaaaatgcgccgccccgcccccatttatcgttgagaatcagcttgctaccaaaaggattgcccgtgacaacgagtcttcgcatcatggccggcgccctgctcgcggcgtcgttactgtccggctgcgacaggatcgagcagttagtcaaaggcaacagccagccagcccccgtcgccattcccgcgcaacaggacggccgcgtggccatgctgctgcccgacttcacccagctggtcagccgcgacggcccggcggtggtcaatatccagaccacccgcgagaacgccgcgccgcaacaaagcagcaatatgccgttcccggtgccggaagacgacccgctgtacgacttcttccgccgcttcatgcccaatcagccgcaacagccggaccagagtccggaggaaagcatttcctacggttcgggcttcatcatcagcagcgacggctacgtgctgaccaacgcccacgtggtggccgacggcggccagatccgcgtgatgctcaccgacaagcgcgagctgcgcgccaaactggtgggcctggacaagcgcagcgacgtggcgctgttgaaagtggaggccgccgacctgccggtggccaaaatcggcaacccggccgatttgaaagtcggcgaatgggtggccgccatcggcgcgccgttcggcttcgacaacaccgtcaccgccggcatcgtctcggccaagggccgcagcctgccggacgaaaccctggtgcccttcatccagaccgacgtggcgatcaacccgggcaactctggcggcccactgttcaacctgcgcggcgaagtggtcggcatcaattcgcagatctacagccgctccggcggcttcatgggcatttccttcgccattccgatcgacctggcgatgcaggtggtggaccagctgaaaaccaagggcaaggtcagccgcggccagctgggcatcaacatccaggaagtgacgcaggagctggcgcaatcgttcggcctgcagcggccgtccggcgcgctggtggtgcgagtggatccgaaaggcccggcggccagggccggcctgcagcccggcgacatcatcctcaagctcaacacccaggcgatagacagctccaaagacctgccgatgctggtgggcgcgctgggccccggcacccggatcaagctggtgatctggcgcaagggcttcgaaaagacgctggaagccacactggtggaacaagcgcctgacgccggcagcccggccaagccggccaacgacaccgtgccgcaaggctaccagttcggcaaactgggcctgacgttgtccgagctgacccaggagcagcgcgccgacctcggcatccgcggcggcctcttgatccaaaaggcgcagggcccggcggcgcgttccggcctgcagcccggcgacatcatcatgggcctgaaccagaacgacatcaccagcatcaacgccttcgaaaaagcgctgtccagcgccggcggccatgccgcgctgctggtcaagcgcggcgaatcggtgctgttcatcgcgctgcgcaccgactgagccggcatagcgccaaaccaaacgccgcccctcccacccggaggggcggcgtttttcatgccggccgcgcctcagccaacacgatggcatgcggccaggaaaaagtgagccatactgcagcgagacatccccagccgcgaacaggagccacgcatgtccgacagcaaccgcgccacctggaatttcctcgccgacacttactggtacgtgacccagcccgacctgccggccttgcgcttcgatcccggcgacaatgcgctgagctggcagtcggaccagacggtctggcacatctccggctatcggaacggctatttctggggcgtatgctcggcgctgctgaccgaccccggcgcagaaggcggcacgccgcagctgcgcagcctggtcggcaccgtcaccgccgacggcgcgctccagatcagcttcgtccgcgacggcgcgctgcgcgattcggtgatcaccggctttggccgcctgctgcaatgggacggcgaatgggcatgccagatgcagatgaccgccgcggctagcggcggccagacgctgcattgggccaatatgcggcaaacccgcccgggcgaccccagctgggaccagttgcccggcaccgactactccgtgcccgacatgctggagggcgccagctacccgcagttttcaaccgaccaagcaacatgacaaaaacatttacataaaaccatactcaatcacaaagcatggatgtatataatttccggacgcgcaggcaagccgcatggcggcccgcgcgccgcggctgccgcccaggcagcgcccgacaaaacccaccggaatgctagctgacatgaccgccatcgccctgcccccttccctgttgcccgcgctgggcatcgccgcgctggtgatctggcgcctgtactcgcggatacgccgcatggtgggccggcaacggctgtcacccattcgcccctggctgaccgtgatcgtcttcccgctcctcctcgccggcctcgcccaaatgtcacatgcgcatcccgacaagctgctgatgctgctggccggcgccgtcatcggcgcgctgctgggccgctacggcatccggctgacccagttcgaaaccaccgaacagggccgcttctacacgcccagcctgcacttgggcatcgcgctgtcgctgctgttcatcggccgcatcggctaccgcctggtttcgctctacctgtccggcggctcgctgtccgcgccgccggccggcttcatcggccatcctctcaccttgctgatcttcgccatcctggccggctactatgtgtcctacgccatcggcctgctgcgctgggcgcgctcgaccgcctgaaccgcctctcgcaaagaaacaaaaaaggcgaaaccgatgacggtttcgccttttttcgtcatccggccgtggaccggaatgcgcgtcacgccggattgtgcagcagcgaattccgccgcgagtagccgaagtacaccaccaagccgatcaccagccaagcggcgaagcaggtccaggtcagcagcgacagctgggtcatcaggaagccgcagcacaggatggccagcgccggaatggtgggcaccgccgggcagacgaacttgcgcggcaggttcggttcgcgcttgcgcagcacgatcaccgacagcgcgatcagcgagaaggccgccagcgtgccgatgttgaccagctcggccagcgtgtgcagcggcacgaagccggccagcagcgcgatgatggtgccgatcagccaggtggccttgtacggcgtgccgtatttcggattcacatcggagaagatcttcggcagcaggccgtcgcggctcatcgcgaacaggatgcgggtctggccgtaggtcatcaccagaatcacagtcatcatgcccaggatcgcgcccaggtcgacaaagccggcgaaccagtccagcttggccacctgcagcgccagcgacaccggatggtcgacgccggcgaactgcatgtagggcacgatgccggtcatgatggcggccaccaccacgtacaggatggagcacaccgccagcgaccagatcacgccgcgcgggatgtccttggccgggttcttcacttcttccgccgcgcaggtgaccgcgtcgaagccgatgaagctgaagaagacgatggcggcgccgtggaacacgccggagaagccgaacggcagcgccggctgccagttgaccggcttgacgtgccagacgccgatggcgatgaacagcagcaccacggccaccttgatcagcaccacgatattgttgacgcgcttggactccttgatgccgaaggccaacagcccggtgatgatcatcgcgatgcagaaggccggcagattgaacagggtttccttgcccggcaccgagccggcggcggcggtgagcgcctgcggcagcgtgacgccgaaaccggacagcaggctctggaagtagccggaccagccgaccgacaccgccgacgaggccagcaggtattccagcaacaggtcccagcctatgatccaggcgatcagctcgcccagggtggcgtaagcgtaggtgtaggtggagccggaaatcggcagcatggaggcgaattcggcgtagcacatcgccgcgaagccgcaggcgaaggcgctgatgacgaaggaaagcaccaggccggggccggcgatggtggcgccggtgccggtgagcacgaaaatcccggtgccgatgatggcgccgatgcccagcatggtaaggtcgaacgcggagagctcttttcgcagcccgcgcgaagtctgagcggtttccagcattccctggacgctcttcttgcgcatcaaactcattgtctacatatcccgtatgtcgccgataccggcccgcccgccgctgcgcttggccgcggctggctgaaacgacgagacgcccgctgtccaggcgggcgcctcatgctcggattcggctgttgtgatctgatttgtccctgcgccgccgccctgtcgtttgcaggccgtgtcagcgaaggtttccgatagtacagcaggacgccatggcgacaatacgggaaatccgcaatggcttacaacctaaaattcattagtcataacaagaacttcttacggcatcggcatccgctccagcagccggcgcgccgcctgttccaactgttgccgccggttttctccctctcccagccgctcccgtccctgccataacaccgcgccgtcggcgttcttcaccgtcagcgccaaggccggccaactctccagccgatacggcggctgcccccagtagccgtcgtagcgccagtccaccggccgctccacccattgccgctccacctcctcggtgaagcacagccgccagagcggcggcgcgccgatttccaggccgcgcaaggacagacgcgtcgccagccagtcctgccagccgccggcggcatcggcggccggcaaacattccagctgcacgcgcggcgccgatgccgcggcggcgccatcctccgccctgctccagcccgacagcaacgacaaggccgccaagccgcccatccatacgcctttcatcgccttctccttcacctgcgcctatagcgacagaccggcgccggacggcaaagtgccgcggcaaagaccgcgacacggtaaactttctttacaaaaaaacgccgccccgcgctaccaccacgcctctatctgcacgccgaaagtggtggcctgggtgcggccgcccaccgcgaaactggtcagattggcctgcgccgccgcgttgttccagttgtaatggctggcgtacacccgcaattccggccgagtccagaaatcggtattcggcgcaaaggccagcgccagcgtcgccttgttcaaccgttgcaagggctgattgtcggtatcgcggctggtcaggccgatctcggtcagcagcttgacgttggccgccacgccgtaggacagccggccgcccagggtggcgtcgcggtatttggcggcgttgtccggcgccacgctctgccagcccagcaccgcctggccgccgaagcgtccgcgctgccagtccaccacttcggcgatgcggctctgccgcgcgccggcctgcgccgcgccgttgctgtccagattgtagaattcgccggacaaggacgcgtggccgctggaagcctgcaggaacagcgaattgttgacgccctgggccaggaagtccttctggttatgcaacaagcccagcgccgcgccgggcttgccgatggcgaaatcgccgcctatcgccgcgccggtcagcgtcagcttgccgcccgggttaatctcgatgccggtcagctgaaaattggcgcggcgcgcgttgttgggggtggcgttgttgttggcgtaactgccggacgaggataccgacaggttcagcttggccttgccgacggcgatgccgtccacgccggcgccgtagttgtcgccgtcctgcatcagccagttgtcaaggatgtggatgtcctggatgcgatggtagcgctggccggcccacagcgtcagattgggcgcgaattccagcccgctgatgtagccatagacctgcgaggcgccggtcttgccgttgtagatggtgggcatcacgtaagcgccccagctgacgccattgcccagcgtccatttcttgccgacgccgaactcgatataggtgtcgccctcgttgcccaggcggaagtgctgcagatcgccgcccagctggtactggcccttgggcagattgtcggcggagctgccgtaaaagccgctgcgcagatagccatcgaactggaagcccatatcatccagcgcttttttcactgcgccgctcagctgctcggcgctgatctgcggcgccggcgcggcggcgggcgcatcctccgcccaggccggcaggccatgccccagcggcagcagaatgcacagccagcttatcgttttcgtcctcattctcgtctccttgtcttattagcgggtcgcgcgccgggcgcgggcaaagctccgccctgccagctttgcggccggcatgacgggaaatcggaatgcgtaagggttacggcgcggctggcggcgtcgcccggtacagcagcgaatgccagggccttagctggccggtggcctgcggcgggtagttggacagcagcagttccagcacccagccctccggcaccgcgtccggcggcggctggtaatggaggttgtcggcgccgaagtggttgatcaccagcagcatttcatcggcgcagcggcgggtgtaggcccacaagctggggtggttcggcgtcaggcagcggtagtcgccgtcggcgaacacccggtactgcttgcgcagctggatcagcctgcgatagtggtgcagcgtggagtccttgtcgccgatggcggcggcgacgttgatctcggccgcatccgccgccacgcccagccacggctcagccgcgctgaagccggcatgcgggccatcatcccattgcatcggcgtgcgggcgttgtcgcgcgagcgctggcggatcaccgccatcgcctcggcgtcggcatagccctccgccaacagctggcgataggcgttgaggctttccacgtcgcgcagctggccgatatcggcgaagccggggtcggccatcgcgatttcctcgccctggtagatgtagggcgtgccctgcaggccgtgcagcgcggtggccagcatcttggcggactcggtccggtagcggcggtcgtcgccgaaacgggacaacgcgcgcggctggtcgtggttgcaccagaacaaggcgttccagccgccgccggcgtgcatgccgctttgccagtcggacaggatgcgcttgagcgcgatgaaatccacctcgcccggccgccacttctcgccgtccggataatccaccttcagatggtggaagttgaaggtcatgctcagctcgcgccggtccgggcggctgtaggcgatgcaatgctccagcgaggtggacgacatctcgcccaccgtcatcagctcatggccggcgaacacttcgcggtgcatctgctgcaagtactcatgcacgcgcggaccatcggtgtagaagtggcggccgtcgctgtcatcctcggagaaggccgggtccttggagatcagattgatcacgtccagccggaagccggccacgcccttgtcgcgccagaaacgcatcatctcgaacaccgcctggcgcagcgccaggttgtcccagttcagatcggcctgggtcttgtcgaacaggtgcaggtaatactggccgctggcttcgtccttctcccaggcattgccgccgaacttggactgccagttgttgggcgcgtcgcgccagatgtagaagtcgcggtaggggttgtccctgcccttgcgcgcctcctggaaccaggcgtgctcggtggacgtgtggttgaccacgatgtccagcatcacgccgatgccgcgccgactggcctccgccagcagcagctcgaagtcttccatgctgccgtaggccggatcgatgctgtagtaatcgctgacgtcgtagccgttgtcatgctgcggcgagcagtagaacggcgtcagccacagatagtccacgcccagccaggccaggtagtccagccggtccgccacgcccagcagatcgccggtggcttggttgcggtggctgctgaagctcttggggtaaatctggtacaccaccgcctgtttcatgtccttaggcatgctgcgcggcctcctcttgggcggccgcggccagttggcggcgcgccagcagccaggtcaggccgaagggcacgatcagcgccaccagcgtgcccgccaggaacagcgggatgtactgcggaatgatggagatgaaagccggcaggccgccgacgccgatggccgacgccttgacgtggcccaggctgatcagcaccgccgcgcaggcggagccggccagcgccgcgtaaaaaggcagcttgtggcgcagattgacgccgaacatcgccggttcggtgatgccgaagaaggccgataccgcggaagtggacgccatgttcttgtcgttggcgttcctggccagccagaacatcgccagcgcggcgctgccctgggcgatgttggacagcgcgatcatcggccagatgaaggtgccgccctggctggaaatcaactgcagatccaccgcgatgaacatatggtgcatgccggtcaacaccagcggcgcgtacagcgcgccgaacaaggccgcgcccagccacggcgccaggttgaacacatagaccagcgcgtcggtgacggcgatgcccagatggcgggccaaggggccgatcaccgccagcgccaggaagccgctgaccgcgatggtgacgatgggcaccaccagcaactgcaccgcgttgggcaccctgggccgcagccacagctcgacgcggcacatcacccaggcggcggccaggatcggcaggatctggccctggtagcccactttttcgatacgcaggccgaacaggtcgaagtacggcaccgacgcgccatccagcccggccgccgccttgccgtagttccaggcgttgagcaggtccggatgcaccagcaacaggcccagcacgatgccgagaatctcgctgccgccaaagcgcttggcggccgaccagcccaccagcgccggcaggaagacaaaagaggtgttggccatcatattgatcagcccccacagccccgacaagcccgggtaagcgtccagcaggctctggtccgcgatgaacatgcccttggcgcccaagagattgttggcgcccatcaacaggccggcgatgacgatggccggcaatatcggcatgaacacgtcggagaacaccttgaccagttgctgcagccggttctgtttttcgtcgccgctggctttcacatcggcgatggtggcgcgggccacgccgccctgcttcaccatttcggcgtagacgcggtccacgtcgccggccccgatgacgatctgaaacacgccggcattgctgaagtggcccttcaccagcgccacctggcgcagcgcctcgccctgcaccttggactcgtcgtgcaaggcgatgcgcagccgggtgaggcagtgcgccgcctggcggatattgcccgcgccgccgatgttttgcagtatctgcgcggcgatcgcttggtagtcgtgactcatcgtctctcccctgtcccttgtcgcggcggtggattcgctcccggcacaatgccggaaatccgcctgttcgtggcgattgtccgcatgacaatcgcggtcaagttaactcgtacatacaagttggtcaacactcgtacatacgagtttgcgaaaagtcaaaacgactgccgccatttcgcaacagcgaaaagacgaaggcccgggcggatgactccgcgccgggcctgactcattcaatctattctgccatcggcggtggatcgcccctgcggggcatccaccctacaaaaccgcctgtcgtagggcggaaccggccaagccgggcgttccgccgggttgcaaccatcaatggtaatatccggggtacgtggtacagaaccgcctcctgtagggcggaatcccggccaggccgggagttccgccgggtcgccgaaatcatggcagcgtctggggtacgcggtgtatgaaaaagcccggggttagtgcctcgggctttttgcacttgattattatcgatggtcaaatgaccacttgagtattggagctttttgacttgcgttggattggtaaaaagttaggcaaagattcaatggcccagcattgctcaacgttaaccctcctagtggagtaatagttgcggtctgtaaaccaccggtttcattgcattttatgaatattggattgcagatggtaaaattcagtttgtttgtttcgatataattctcaattacgttgttccacatctctttagttccgatcgtcgtatagttacgaggtggttttgtcttgcttagtgcggcacgggcattttcttcatttatcctttcaactatgtgatgctcttgatcaccatcgggctggagtattgcttcgtaaaatcctggggtgagttttttaccgacaaagtgattgcaataaatttgcaccatgatgttctccatttattggctagccacacatgtggtagtccttaagctggacgtgtgagtgagcggtttatgaaaaagtcaccatgtccgatgggcattatggagaagttgatgtgtctcccgagtcaatgcagcgcctgcagaagactcttgaggggggattgcattcctttaagtggcgtggctcaagacgacatgcaccaagcgcataacgcataacccgtcactcctgccgactctctagtcttcgcccgccgaaaaaaggaaacagaccacaatttccatcatttcagccaaatgaacttgagtgtggccagtttccgcacaccgtcacacagagggaaaatgctaccgcctcgcaatatccgtgaaatagaacttatccaagcgatggcgcgattcggtgtattcaaacagccggccgtcgtagaggtgggtcaagtttttgaccacgatcacgtggtccatgccgttcaggtccaggtagcggcggtcgtcgtcgttgcagggctgggcttcgatggtgcgctgcgcgtagctgatggtcagccccagatcctgctcgatgtagcggtagatggagccggcggcgatgtcttcggtcaggccggggatcaactcagcgacaaaatggttgacgtccaggatcacgttttcgccgtcgatattgcgcaccctcttgatcctgacgatttcctcgccctccgccaggccagtggcctggaccagcgcggcgtccgccggcgcgcgcgccagttccgccacgcgcgataccactttgcgccccatgcgctcgttcatttcctggaagctgacgatgccgctgagctggaactcgatattgcccggcttgagcacgaacacgcccttgccgtggatcttctgcacgtagccgcgttcctgcagcaggtccaccgccttgcgcacggtgccgcggctggcctcgtagctgcgcatcagctcggattcggagggaatcttgtcgccttgcgcgaagcgctgattatcgatatcggcgatgatttcggaataaatttgatggtatttgttcattgttgtctttggccagcccggggcagcccgtaccttagcaagaggcggcggcgcgctcaatcccaatatccgggcgccgcgtaggcggcgcgcagatgatcgacgaagcggcgcacccgcgccggcagcagccgccgttgctgcaccaccgcgcacaccgggtaatcgggcgaggcgaaatcgtccagcaccgtcagcagccgcccctcggacaggtcctccttcacctcccacaacgagcgccaggccaggcccaggccttgcagcgcccagtcgtgcagcaccgcgccgtcattgcactccagcgcgccggccaccttaaggttcaccggccggccatccacggcgaagctccagccgcggctctggctctctcccagcgacaggcactggtgatgctgcagatcggccggggcgcgcggtacgccatgctcggccaggtaggccggcgctgccaccaccacgcggcggttctccgccagccggatcgccaccaggccggaatcggccaggtcggagatgcggatcgcgcagtcgatgcggtcgcgctgcaaatccaccagccgatcggacaggtcgagcgtcactttcacttccggatgcaggcgctggaaatcggcgacatgcggcgccacgtggcggcggccgaaaccggccggcgccgatagccgcagatggccgcgcgccttgccgctgccggatgccgctgcagcctccgcctctgtcagatcggccagtattcgttggcagtcttcataaaacgcttcgccctcctgcgtcggcgccacgcggcgggtgctgcgcgccagcaggcgcacgcccagccgctcttccagcgcgtccaaacgccgccccaccatcgccggcaccacgcccaactgccgcgccgcggccgacaggctgcccagccccaccaccgcgacaaaggtctccagctgtttcagctcgctcattcgctacctaaaagtaaaaaatgttgtgcaattcatgccatttctttttacttggctggcgaatagactgtcaaacattgcattgcagcatcatcatgtcatcttctctactcaggagcgcgcgcatggcagtcaaccttccgcagggcgtggaaatcttcgccgacatcaccccggcctacgccgaaatcctcactcccgaggcgctggccttcgtcgccaagctgcatcgccgcttcgagccgacgcgccgcgagcgcatcgccgcccgcgccgcgcgccaggccgagctggacgctggcaagctgccggacttcctgccagaaaccgccgccgtgcgcgcaagcaactggaaaatcgcgccgctgccgcaggacctgctggaccgccgcgtggaaatcaccggcccggtggagcgcaagatgatgatcaacgcgctgaactccggcgccaaaagcttcatggccgacttcgaggactccaactgcccgagctgggacaaccagatcgccggccagatcaacgtccgcgacgcctaccgcaaaaccatttcctacgcgagccccgagggcaagcaatacaaattgaacgacaccatcgccactctgctgctgcgcccgcgcggctggcatttgatggagaagcacgtcaaggtagacggcgagatcgtgtccggcagcctgttcgacttcggtctgtcgttcttccacaacatccgccacctgcgcgaacacggcagcgccacttattactacctgccgaagatggagagccatctggaagcgcggctgtggaacgaggtgttcgtgttcgcccagaacgaattgaacatcccgcaaggcaccatcaaggcgacggtgctgatcgagaccatcctcgccgccttcgaaatggatgaaatcctgtacgaattgcgcgagcattccgccggcctcaacgccggccgctgggactacattttcagctgcatcaagaaattcaggcagaaccgcgacttctgcctggccaaccgcgcgcaaatcaccatgacggtgcccttcatgcgcgcctacgcgctgctgctgctgaaaacctgccaccagcgccacgcgccggccatcggcggcatggcggcgctgatcccgatcaagaacgacgccgccgccaacgaaaaggcgctggccggcgtcaaggccgacaaggaccgcgacgccaccgacggctacgatggcggctgggtggcccacccgggcttggtgcctatcgccgacgccgccttcagcgcggtgctgggcgacgcgcccaaccagatcgccaagcagcgcccggacgtggccgtaaccgccgccgacctgttgaatttccagccggaaacgccgatcaccgaagccggcctcgccatgaacatcaatgtcggcatccaatacctgggcgcctggatttccggcaacggctgcgtgccgatccacaatctgatggaagacgccgccaccgctgaaatctcgcgctcgcagatctggcagtggctgcgcagccccaaaggcgtgctggacgatggccgcaaggtgacgctggagctgttccgcgaactgcaggcgcgcgaagtggccaagctgaaggacgagtacggcagccgctggagcaaacaatacgaggacgccgccaggatgttcgacctgctgaccacctccgacgacttcgtcgaattcctcaccctgcccggctacgaatacatagattgagccgccgcaacagcggcagtccgaacggcccctcgcgggccgtttcgcattagcggccggtcattttcacgccggccgcatggaacccgctcttgccaagccgatcgaagcggagtctacttcccgcacacctcgccaaggagccagaatgaaaaagtcccgcctcaaacccatgctgatgtgctgcctgctggccgccgcccttcccgccgccgccgaaggcatccagctgaacctgtcggccagcgcccagcgcgacatcgccaacgaccagatcagcgccaccctgtatgtgcaacaaagcaacagccaggccgcggtactggccgataggctgaacaaggccaccgccaacggcctggccatcggccgcggctacaaggacgtgcaactgtccagcggcagctacagcacctggcccagctacgacaagaacggcaagatcaccggctggcaaggccgctccgagatccagctgaagagcaaggactttgcccaggccgccgagctgatcgccaaactgcaacagaccatgctgctggaaggcgtgcaattcggcgtctccgacgaagcacgccgcaacgccgagcagggcatgattccggaagcgatcgccaacctgaaaaaccaggccgaagtggcggcgcgcgcgctgggcaaaaacgccgtcaacatccagcaactggatatcggccagcaaaaccacggcttccgtccgccggtgatgatgatgaaagccgcggtggccggcgccgaatccaacgtcagccagcccgacctgcagccgggtcagacccagctgcaactgcaggtcagcggcaaggtggaactcaagtaaggctttcagccccggccggcttgcgctaaagtaagctctggccggcacttgccggcgccccttccgacttccccatcgcccctgaacatgaaactgatcgcttctttgaccagcccttacgcccgcaaggtccgcatcgtgctggctgaaaagaaaatcgactgcccgctcgaggaggaaacgccctggagcgcggacagccgcgtcccggagtacaaccccctgggcaaggtgccggtgctggagctggacgacggctccacgctgtacgactcgcgggtgattgtcgaatacctggacaacagctcgccggtgtcgcggctgctgccgcaagacaatcgccagttgatcggcacccgccgctgggaggcgctggccgacggcatcatcgacgcgatggtggccatcgtgctggagcgccgccgcccgccggaaaagcagatggaggaagtggtggagcgccagcgcggcaagatcgcccgcgcgctggcgacgctgtcgcaggatctgggagaaaagccgtggtgcaccagccacggctacagcctggccgacatcgccgtcggctgctgcctgggttacctggacttccgcgcgccggaattggactggcgcgccagccaccccaatctggacgcgctgttgcaaaggctgtatgcccgccagtccttcatcgacaccgagccgccagccgcctgaagcgcgccgcgcaagcaaaaacgccacccgtcgaggtggcgtttcgcatgccgcggcaggctagatcagtccggcggcgatattgatcatcagcgccagcaccgtggcgttgaagaagaaagacagcacgcaatgcgcggttccggcgcggcgctggcggctgtcggtgaagctgacgtcggcggtctggcccgacgtgccgatgatgaaggcgaaatagaggaaatcggcgtaatccggcagccgggtgccgggaaactccaatccgcccgaaccgccgcgggcatgctcggcatagaaggttcgcgcgtaatgcagcgcgaacatcacatgggtgaacgcccatgacgacagcagcgtcaacaccgccagcagaatgtgcgcaccgcgcagccagcccttcatgtccttgaccaccgccagctccagcacgatggccgccaggctggcgatcgccgccaacaccaccagcagcatcaccagccactgcccctcgtcctccagccgcgcccaatggcggatctgctgctggcgcgggccgaacatcatccaggccaccagcgcgagatacagccaagcgccggcattccagccgacgatatagcgggtgacgtcgtgcatggccgctacatggggcagtgccaggatcactaacgcgccgaacagcgccgaccacaccagccgcggcctggccagcagcatgcggacgacgatgaaacggcggatgacaggaaaccagaggctcataaagctgtttcactccttgtaatgtgatggaagcaccatggcgccagcgcgcgccgcccggcaatcttgcagcattgcgccattcccgccaagccggatcgcgccgcacagcctggcaacgacgatggcccggcatcgtaaaattcaatatgaataaatgtgtttgtttttaaattcatatgtcgcaaaatcaatcgacaagcgaacaacaagaatcaggaagacaaaccatggccaacaccccgacggcgccccgcccgcaagcgctgcaagaccgggacgcgcaactggaagccctgtgccgccaaatggcctgccgcgacttctgcctgctgccggccgcgctgtcgcgcgatctgctgctgctgcaggacccgcgcgcgctggccgattgggaagcgttccaggatagctggaaccacctgcggcaagacaagttcatggccgacggcggcagctaccgccaacggctgcacgccaccctcagcgccgagccctcggcgcggcgcgcgcgggcggaagcccaccagccccactaccaaagccggcagtacaatccgctcaacggcggcgtcgcccgccacttcgagccgatacgcaacgaaatcctgctgggcgccaccatgcaatcggtgctggagctgggctgctcgatattcggcaagctgtcgccttacacccgctggcatatcgaagcgcaccagttccgcatcgaggcgcgcaaccgcgagcgcggcaagcccaccccggaaggcatacaccgcgacggcgtgcacttcctgctgatgatgatggtgcggcggcgcaacctggtgaacggcgccaccgagctgtacgatctggaacaccagccgctggccgaattcacgctcagcgatcccctcgacatcgcgctggtcaacgacgagcgcgtgctgcacggcgtcaccccggtggcccagctcgacccctcgcgcgaaggcagccgcgacgtgctgctgctgagcttccgccgccacagttgaccccctctgcgcgccgccgccaaaatggtaatcttgctttcctatgctgatagtcactatggcaacgacaacaagcgggatcggggaacaacagagtggccagacagatcgcgatggttttggcggcggcttgctgctggtgcgcggcggcagtagcggcagcggacattcacgcttacaccgaagacgtgccgccgctcaactaccttgagaacaacaacgtccaaggctactccaccgaggtgctgcgcctggtcgccaaggaagccggcctcaagctcagcatcgacgttctgccctggctgcgcgcctatgccaaggtggagagcacgccggacaccctgctgtacaccatcgtgcgcacgccggagcgcgagcagcacttccagtgggtggggccaatcgggccgcgccgcatctacctgtaccggctggccgcgcgcgacgacatccgcatcgcctcgccgaacgacctgctgcgctaccacaacggcgcgctggccggatcggccgccgccagccagctcgccgcgctgggcctgcaagccggcagcgcgctggacatcggccacagcgacgccaccaatctgaagaaactgcagctgggacggctggacctggtggccatgctggactgggcgatggcttggcagctgcgcctgcaaggaaaaaccgaaaaagcggtggccccggtcctgctgctggacggcaagctggagtactggttcgcgctcaaccgcgccaccccgccggaacgggtcaaacagctgcaggacgcgctcaaccgcatccgcgccgacggccgcctgcaggccatccgccgccgctaccgcagcgactgacgcgccgccgtcaggcaagcagccgcagcaggccgtacttcagcagccagccgagctggtaatcgacgtggtcggcggcgaccgccaggctggcctgcacttggctgcgcaccgccgccaccgtttgcgggccggccagcagcgtccgcagcgtgtggctgagcagctcgccgctgctcagcaaggccacctcggcataggtggcaggcatcggcagctcgccgcgcagcaccgcgtgggccaaggcggtcaactccagcgccaacccgccttccagatggcgcgtcggataatcgcggaatatgtcccgcatgtccggccgcggcgttccggtccacggttgcagccccgcggcgtcggcctcgcgcttgagttcgcgccaggcggcgtcatagccctggatcacggcgcgccaggaatattccgccaacgccaccgcgcgagcgcgctcgcccatccggcggcgcagcgcgggatcggcggccagctccagcagccgccggccaaacgcctccatgtccagcgccacgccttgcgcgtgcagcagcgaggacagattgtcctccagcacctccagcatgtcgccggccacccgcggcggctgggtggcgagcgtgggaatgcgaaagccggtctcgccttcgcgcaccagatcgcggtaaccgtcgaaatcggaagccaccaccggcaagccggcggccatcgcctcgatgatggaaatgccgaaagtctcctgataattgtccaccggcgacacgaacacgtcggctgccgccagcagcgcgtgcttgtccgcgtcgctgaccggacccagcaccgtgaccgcgccgtccagccccaactccgccgcggcctgccgcaggttgtccagatcgctggccgcggcgccgccggccagcagcagccgccaatcgacgcgcggcgcctccagccgcaaacgcgccaacaggtacagcagcggcaccaggtcggccttggtggcgggcgacaggcggccgacgtagagcagatggaaagcgccggcctccagccccagttgctggcggcacgccgcgcggtcgcggcggacgaagtattcctcctccactcccagcggcagcagccggcaggccgggcggttgccggcgccggacgacaaggcatgatcgagatggcgctccaccacccctcggcccagcgtggaggtgcagaacagcgcgtcgcccggccgcagcggcgcggccgtcagcgccgccaccttgtcgaacatgtcgccgccgttgaggctgtggatgggcgcggtcagcggcagcggatggctggcatggcgcgcgcgcaggcgcgccatcttgggcaggtaccagtaccagtcgccgaggtggaaagcggaaaagtcggtgcgggacaaggcgtccggcacattgagatgatgcgacaacaccacccgggacagcagcgcgtcgtcgacgcaggcttccagccgccgctgcaccagcttcagattgtccagcgccgggcaaaacaggtggaattcgtcgaactcggcgtagcgcagcaaagcccgcagaaagccgaagttggcgaccagccgccccagcttgagatccgtttccgagctttccacaaaagaatcgatgctgccgaaaacccgcttgcccattgcgcctcctggcgattcagtcggcgcctacccgcggggcgcgccagcgccgggggattccggcgcggcgctattgtgcgccagcgcgccaaacgctggcaatgccggcttattcggcctccagcgccgccatcagcgcctccgcgctggtataggacgccaatgccgtccgcaggcggttgaaagcctgggcggccttgtcaggatgcttggcgaacggcaccaggccgtcgtaactccagccggcggcggccagcgcctgcttgcggaaattcatgccgtcgttgccgccgccgccgatattgaccagcgcctgctcgatcagcgtatgcggcaagggagtgcggctgagggtgacgaaatggctgctgtggatttcatcgaaatgcatggaggacttccccgtcgtctgaaattgttttttagttttagtaggaactttcccgacgcgctgaggggaaatgcgaaaccggagcgcaaggctccggtttcgcacgcaacggcctggcgccacggctcgctcaggaggtatgcgccttcagcaacacgtacaactcatccttcagcttcagtttttcctttttcaggttttcgatttccagcgccgaagcctggatgatgcgcgcctccatgttcttgatctgctgatccagctggttgtgcaaatcgaacaggcggccaaaatgcgggtcttcggttttcaggcgggaaatcagatcgcggtattcgggaaacatctcagcctccttggcgggtgggtacagccggcttcagccggccacgactcatgctaacgtcaactcagccgccgcgatttgatctgccgcagtcatttctgcgtcggcgccggcaggttgagcagcatgccgccgccttcgccgccgcccaccacgctgggcatctggccgttccatttgtctatgtaggcgcgctgcagcttcagcctttcccaggccagcagcctgtcatccagcgacgaggccagcgcgcggttggcggccgcctcgccctcggcgatggccactttcttgcgagcttcggcggtggcggcgcgcacttcgttctcggtgcggatggagtcctgaatcgccttggtcttggcgttcaccgcattggccagctccggcggcggcctgagcgcgcccaccaggccgaactgctggatagacacgcctatcggcatggtgcgccggttcagctccgccgccacccggccgagaaactcttccttcttcacgccgttgacgtcgtcgaagctgtattccgatcccagcgccaccacgatgttgcgcgcggtgtcgcgcaggtagccgtgggtccagttggaaatgtcgtcggcgcggaagcgggtgtagaactccggcaccttgtcggcgcgcagcagataggacaccgccacgtctatcgaaaccggcaccgaatccttggtgttgaagctcagctcctcgttggcggcgctgccttcggtggccgagcgggtccatacttcgcgctggacgaaggtgggatacaccaccaccacgctctggatgggattgaagaacacgaagccggtcaccacgttttccttgctgataccgcggtccaccagccggttgatcttgatgccggtatagccgggattgatcaccgtccagctcagcaccgatttctccagcacattccccaagatgaccagcgtcagcaggccgccggctattttcaacaataatcgcgtcaatggttgcatcgacaagccccttcaggcaggcaacgcatgtccggcgcccttcgccggctgcggcccggcagccagcatacgtccgcgccgcgcaaatatgcaattaagatagaaggcgccgccatcattgccattccctgccgcggatcatcgactaaattggcaatagatgtcatccgtttggcatccaccgcgttaaaccacacatacaccgtggtcaaaatatcaagagcccgccatgcccagccagcctccacagcccaaaaaccatgactcctccatggacagctccgccgccgccctgcgccagcgcctggaccacgccctgcaattgctgggcatgcgcggcaagggcctgttgctgctcggcggcctgctggcggccggctggctcgcctccggcatctaccgggtggagccggacgaacaaggcgtggtgcagcgcttcggccgctggagcgacaccacctcggccggcctgcattaccacctgccctggccggtggaaaccatccagctgcccaaagtcacccagatcaaacagctgaaactggccaatttgtacgagggctcgccgcccgacgccgccgacccgcgcgagaaacagatgctgaccggcgacgaaaacatcgtcgaggccgactgcgcggtgttctggcgcatcaaggacgccggccgcttcctgttcagcgccaaggagccggagcaggcgctgcgcatcaccgccgagggcgcgctgcgcgaagtgatctcgcacacccccatccaggcgtccatgtccaaccgccgccagcaggtggccgaagaaacccgcggcctgatccagcagcggctggacgcgcagcaggccggcatcctgatcacccaggtgcagctgcagcgcgtggacccgccggcggcggtgatcgacgccttcaacgacgtgcagcgcgcccgcgccgaccaggagcgcgcccgcaacgaggcgcaggcctacagcaacgacatactgcccaaggcgcgcggcgaggccgagcgcatccgccaggaggccgaggcctaccgcagccaggtggtcaacctggcccagggcgaggccaagcgcttcgactcggtataccagacctacgcccaggccaaggacgtcaccgcctggcggctgtacctggaaagcatggacgacatgctgaagaaggccagcaaggtggtgatagacggcagcggcaagaacggcagcggcgtgctgccgctgctgcaattgcaggacaaacccaaggccggcaaggagaaccgctgatggacaagcaatggcgcggaatcggctgggtggccggcatcgccgcggtctggctggcgctgtcggcgcagtacacgctgaacgaggggcaaaaggcgctagtggtgcggctgggcgcgccagtcaacgtggacggcgagccggggctgaaattcaagcttccgctgatcgatagcgtacagtactacgacacccggctgcagatgctggccccgccgccggaacaggtgatcctgggcgacgagaagcggctggaggtggaaacctacacccgctaccgcatcgccgacacgctgcgcttctaccaggcgctgcgcaccgaggagcaggcgcgcgcgcagctgacccaactggtgagcacctcgctcaggcgcgagctgggcaaggcgccgctgtcagacctgctgtcgccgcgccgcctcgccatcgtcgcgcgcatccagcaggaggtgaccgaacgcgcccgcccgctggggctggacgtgaccgaggtgcagctgcaccgcgccgatctgccgctggaaaccagccaggcgatttacgaccggatgaaatcggcccgccagcaggaggccaaggaattgcgcgcccaaggcgcggaatgggcgcagcagatccaggccaaggccgaccgcgaccgcaccgtgatcctgtccgaagcgcagcggcaaagcgccatcacccacggcgaggccgacgccgaggctggccgcatcttggcccaggccttcagcaaggacccgaagttctacaagttctaccgttcgctgcaaacctaccgccagtcgctggccgactcggcgccggtgctggtgctgtcgcccgattcggcactgctgcgcgacctgaaaaacggcccggcgggcggcaagccatgagcggggccgacatgtcgctgccaccgtcgacgctgcgccgcctgcgccacctgctggccgcgcttggccccggcctggtggtgatgctggccgacaccgaaaccggcagcgtgatcgccgccgcccaaagcggcgcgcactggggctaccggatgctgccgctgctgctgttgctgatcccgctgctgtacatggtgcaggagctgacgatacggctggcgctgggcaccggcaaaagctacggggagctggtgcgccggcgctggggccgccgggccgagcgggcctccgcctcggtgctgctgctcagctgcctgggggcgctggccacccagctgagcggcctggccggcgtcggccagctgttcggcatcccggtgtggcaaaccatcagcctgctgggcgcgctgattttcctcatggtgtgcaccggcagctaccgctcggtggagcgcaccgccatcgcgctaggggtgttcgaactggccttcctggccgaagcctggctggccaaacccgatccggcccagatgctggcgcagctgacccaactgccgctgggtaatcacgatttcctgctgctggccgccgccaatatcggcacctgcatcatgccctggaccatttgctaccagcagtcggccttgctggacaagggcctgacgctggccgacctcaggccggcgcggctggacaccctgctgggcgccatcctgtgccaggtgatcaccgccggcatcctgatcgccgccgcggtcgccttcggccatggcggcggcggcgccagcctggacaccattccgcagctggccggcggcttcacccgcctgctgggcccggccggcggccggctgctgttcgcgctggcactgtccggcggcgcgctggtggctaccatcgtggtgtgcctgaccagcgcctgggcgctgggcgaattggcgggcaagcgcgaatcgctggcgcggcgtccgctggaggcgccgtggttttacggcagcttcgcgctgatgctgatcggcaccggcgcgctggtgtcgtccggcgtcaacctggtcaagctgtccatcgccacctcggtcgccaacgcgctcttgctgccggcgatgctggccggcctgtactggctggccagccgcgagctgccgcccgcgctcaagcccggacgcggctaccgcctgctgctggccctgttgtttttgttgatcggcggcttcagcctctactccggcatcgccggcagcctggactgacgccccgcgccggatgaatccatggaacccgacagcctcgcccacgccttcggcctgactttccaggtctcgtttctggacctgatcctcagcggcgacaacgcgctggtgattgcgctggcctgccgcgcgctgccgcaggagctgcgccgccgcgcagtgctgtggggcaccggcttcgccatcgcgctgcgcctgctgctcaccgcgctcaccggcgtgctgctgatggtgccgacgctcaagctgatcggcgccgccgtcctgctggcgatcgccatccagctgctgctgggcgacgacagcgcggacgacgacggcgcgcggctggcggaacaggccggccacagccggcagctatggaacgcggtgacgctggtggtcagcgccgacctggcgctgagcctggacaatgtggtggcgctggccgccgccgcccagggcagcctgctgttcctgctgttcggcctgctgctgagcgtgccgctcttgatgtacggcagcctgctgctgtcgcggctgatggacgactatccgctgctgatcccggccggcgcggcggtgctgggctggctggccggcagcctggcggtgagcgaccccttgtggaacgactgggtcgccgcgcaagcgccggcgctgcagatcgcggtgccgctgctcgctacggtcttcgtgctggtggaaagccgcatcatccgcgaacaacggcagcgcctgcccgcgttgccgccgctgcagctgctggccccgctcacccgccgcctggccatgctgggcgaggccggcatcgccggcgagccatcgccctctcccatcgcgccgcccgaaccggccatagccgcagccgcaccgcccgccgcctgcgccgaaacgcccgccgcggcggcgctagaggaaagcgcggctgtcctccagccgcgccagcccgcggcgatagacgaggaagcaggcgacgacgatgccagcctcagcccgccgctcaaggcgctggtgctggcggcggccgtcatcggcgcgctggcgctggcctggctggcctggcacctgcttagccagggctttctgcccacgcccagccaccacccggcggcgccgcgccattgacgcgcgctggcggcgcgcccggatggtctgcatctggtctgttcgatgcgccgccaacgcgtgcctacccgctcccgtccgccgccgccgcgcggtaacttgacgcaaacgcgccacacttttccagcgccactcccgcattttccaccccaattctgcgtgaattcgtccttgccgccagcgctttcgccgcaatgcagcattctccgcaagtccttgtctcccaatccccttcttaagcaaagccgtcaaatcggctgtttcatcccgctttcgccctgacaaaaagaacaggggcatttttaatcctaaccgctacattccatttgttaataccacttaaatacaactagccgtatctttcacagcctcacccacacttagaacaggaggaaagcgtgagcaaaaccctgatgttcctgaaaggcgggttggccgccggcgcgctgggcggcgccgccttgctggccagccacggcgccgtcaccggcagccccttccagccgacgcaagcgtcgtggctggtcaagaccgccgacgccacctgcaccgatcccgcctggagcgcggccaccgtctacaccggcggccagcgcgtcagctaccagaaccagacctggcaggccaaatggtggacgcagggcaacaccccggccgccggcgacgccagcccgtggcagctgatcggccagtgcggcggcggcaatcccaatccgccacccgacccaccgctggtgcaagtgcccgcccccaccggcaacgcgctgtgccgccccgaagcgctggcgcagacccccagcgtcgacgtgccctactgcgcggcctacaagcagggcggcgcggaacaactggccaacggcagccgccgccgcatcatcggctacttcaccagctggcgcaccggcaaggacggcagcccggcctatctggtgaacaatattccctggggcaagctcacccacatcaactacgccttcgcccatgtcgacggcaacaatcagctgtcggtcaacgacagcgccgccggcaatccagccaccgacatgacatggccgggcgtggccggcgccgagatggacgccagcctgccctacaaaggccatttcaacctgttgacccagtacaagcgcaaatacccgggcgtgaagacgctgatctcggtgggcggctgggccgaaaccggcggctatttcgacgccagcggcaagcgcgtggccagcggcggcttctacagcatgaccgtcaacgccgacggcaccgtcaaccaggccggcatcaacgccttctccgactctgccgtcgccttcctgcgcaagtacggcttcgacggcgtcgacatcgatttcgaatacccgacctcgatgagcaacgccggcaatccgctggactggagcttctccaacgcccgcctcggctcgctgaccaagggctatgtggcgctgctgcaaacgctgcgcgaccggctggaccgcgccgccgcccaggacggccattactaccagatcaccgccgcggtaccagcctccggctacctgctgcgcggcatggaaaccttccagggcttgaagtacctggacttcgtcaacgtgatgtcgtatgacctgcacggtgcctggaaccgcttcgtcggccccaacgccgcgctgtacgacgacggcaaggacgccgaactgacgttctggaacgtctacggcaccgcgcagtacggcaatatcggctacctcaacaccgactgggcctaccattactaccgcggcggcttgccggcttcgcgcgtcaacatgggcgtgccctactacacccgcggctggaaaaacgtcaccggcggcagcaacggcctgtggggcagcgcagtgggcagcaactgcccgaccggcctgacggagtgcggcgacggcgcggtgggcatcgacaacatctggcatgatctggacgacaacggcaaggagatcccgggcggctccaatccgatgtggcacgccaagaacctggaaaaaggcatagccggcagctacctcgcgtcctacggcatcgacaccagccagccgatcaaccagctcaccggcagctaccagcgcaactacaacgccaccctgaccgcgccgtggctgtggaacgccagcaagaacgtgttcctgtccaccgaggacgaacagtccatcgcgcagaaggcggcctggatcgacgccaacaacatcgggggcgtgatgttctgggagctggccggcgactacgactggaacgcgcagcgcaacggcggccagggcgaatacttcatcggcaacaccctgaccaacctgctgtacaacaccttcagccagccggccaaggtcagcgcccgccgcgccgacgccgcgccggctccgactgcggccatcgatgtcggcttcagcctgggcaacttcgcgctgggcgacaacaactatccgatcaaccccaagctcaccatcgtcaaccgttcgcaaaccacgctgcccggcggcaccgagttccagttcgacgtgccgacctcggccccggccaatatcgccgaccagtccggtttcggactcaaggtgatcagcaccggccacagcggcagcaatgtcggcggcctgaagggcgacttcaaccgcgtgtcggtgaagctgcccagttggcagagcctggcggccggccagagcgtgacgctggacgtggtgtactacctgccgatctccggccccagccattacacggtgggcctgaacggcaaaacctacgccatccgcgacgaggcgccctacctgccctacctgaaataagcctcaaccggcccgcagccgcgggccgccgcgtttctcttgttccctcgttccggccgggctctcccggccgctttttttctccgcggccgccgcctcctgcggccattgcatcacttcgcgcagctgggccagcgcccgcagcggcgagactccgaagcgggatggttggcgcgacagatagtcttggtaataacgggcgagatcatcggcgttcatgctggactccttgcagtggagccgctattgtcacgctgataacatgaagaaaaaattgctgaacttaaccaaataaatttcctcttttatgccaaccccccgccttctgcagcaataccgccgcctgcaccagcacttcggcggccaggacgccgccgcctcgctgcaacagctggcggacatcctgccctgcacccgtcgccatatgcgcagcctgctggcgcaaatgcagcagctgggctggctggactggcagtcgcgcgccggccgcggccagcgctcgctgctgcgcttcgcgcaaagcctggagcaattgcggcaaaaccaagcggcgcagctgttggagcaagggcgcgtggaacaggccgcggcgctgctgggcggcgatccccggcaattggcgcccattctgctggccaggctgggccggcgctggagccaggaccgccaggtgctgggcgtgccctattaccggccgatgcccaatctgtatccgggcacgccgctgcggcgctccgaacgccacctggtaagccagatcttcaacggcctgacacggataaacgaggaaaaaggggaagtagaaggcgacttggcgcatcattggcaacagcatggcgacgccgagtggcatttccacctgcgcccggcggtgcgctggcacgatggccgcgaactgacgcaggacgacatcgccgccaccttgcaacggctgcggcgctggccgctgttttcccatttgcgcggcatccgccgcctggcgccgcacagcctggcgctggagctggagcggcccgatcgctggctgccctggctgctggccgacagcgcggcgctgatcctgccggccgatcatgacaagcaccccggcttcgcctcgcacccggtgggcaccggcccctaccgcgtcgcggccaacgacgcgcaccggctgtcgctgcaggccttcgacgactacttcggctaccgcgcgctgctggatcaggtggatatctggatgatgcccaagctgggcgacgaactggagcccggcgggcccggcctttgcgatttgacggtggaaatcaatccgcagcccgtccgtccgcaaaccgagatgtcgctggaggccggcgtctatttcctgctgtgcgacggccgcgcgccggccatgcgcgacagccaggcccgccagtggctggcccacgtgctggcgccgctggccatcatgcaacaaaccgcgccagcggtccgacaatattgggtggccgcctccggcctgctgccgcgctggcatcatgccaaacctgcagccgcgccgacccggacgccgttttcccggctgcggctggctttttatgaacagcacccggaataccagttgatcgccgacgccatcgcgcgctgcctgcgtcccttcggcgtggagctggaatgccgaaaatacagctatggcgactgggagcagggccgcggcgaagccgaactatggctgggttcggtcaacttcacccgcgccaccgactacgccattcccgcctggctgctgggcaccccgctgctgcgcggctgcctggcgcccgaactgccgctggacggctggctggacggctggcgccaaggaagcgaaaacgcccagggcctggccgccgcggtggtgcaaacgcattggctgctgccgctgttccacaactggctgaggctgaacggccctggccagatagaagatttccgcctcaacagcctgggctggttcgatttcaaatccgcctggctgcgccccgaagacatgtccgccgcgccgaaatgagaccgacggctcagcggccgggcaactggtaaatccgcaggccggccagcgccgccgggttgaccgacaccaccgcgccggtgcggtagtcgacgatcagcggatggcgcgccggatcgcacggcgtcgcctcccagccgtcgcggtcgccgccggcgatattcaccgaggtcggacccacgccttccggcttttgatccagattgctcagtttgagcgcattggcgaggtcgcccgacagaaacagcggccggatgtccgccggcgcattgcgcacgcacaggaatgactggtagtagcgcaccttgcgatcctggataggataaaaattcttgtcgtagatcgcctcgttcacaacaaaagccacgtcgcgagccgcgccgctggccccggcggcattgacgatgaacttctgcccgggagaaacgcaggcgagacgctggtccagccagatatcgtccatctcccgcgcctggcacttcaactccccgcggtacggctgcagcggctcggcggcatgcgcgccgccatgcgggagaatggccagcgccagccccgacaatgccgccagccaaggccggcgcgcgattcgactcatttgcgaattgtttgaaaccatctcgtccgtttcctgaaacccgtctccccgctggccgccgcgacgccatcgccgcggcgattttgatcacccgctatcctcaaatgccgctttctagttttcgctccgccatgccacgccaacgagccggctggcggatgcgctagcataagcctgaaaaaacacaatgtcatcaatggcgcgctggtaaaaatatggctaagccccggctgcggcgactttacgcggcggctgcgatcggcgactatcggccccgccccgacaccagcacccgccgcaagagcaaacccgcactctccgcgccgcgcccctggccgccgcagacggaaatcgcgcaccccgccgccggccggccccgctgccccaggcgcatttcaccgcgccacagcatgcctttgggataaacttgccggcgcatgcgaaagcaatcgccagcgccatcgcggcccgccaagtccatttcgtatcaatcacttaggattttcgcgccgcaagcctttgccgccacccctgccgtccgggcttttgttgcgccgcaaaaccttgccaaccccggcgaaacccgctaaattcgggggctctagcgaagcgcgcgggtgtagctcaatggtagagcagaagcttcccaagcttacgacgagggttcgattcccttcacccgctccacaggcttccgactacccgtctccaaatactccatgcatagcctctccgagcgatctcctatgaaattgaactcaggccggctgtggctaagaatcgcgacttacggctcgctggccgtggttttgctgctggtattgatccgcgcattgatctactggcaattcgacgaagccgccgtgcgcggcgcgctgacccacgccctgaacgacacaggccgcgccgtccatatcgatggccgcatcactccctccgttttcccctatcccggcatagacatagaaaaagtcagcatcagcgaacccggcaagcccgccgttttcgcccgggtggaactattgcgcgtgtcgctggcctggatgccgctgctgttcggcaaccgcgaaatcaaggcggtggagctatacggccccagcgccagcatcacgcgcgggctggacggccaactgaatatttccgacctgttccagcgccgcagcccaggcgcctacagcatcaagctggaccagttgcgcatccgcgaaggcacgctgctgctgtccgaccagcccacccacaccgacaagcgcctgtccagcatcagcctggacgccgacgatctgcgcagcaccgccagcgtcagcgccggcgccattctcgacgacgacaagcgcccggtgcggctggcgctgaacacgccgctggccatccaggacgaccaggtcagcctgccgcagctggaggcggtggcgatcagcaacatccagggcctgggcgagaccaagctcagcgtcaccggccagtacaagctcaacttcgcctcgctgcaggccaccggcagcgacgtcaccgtgtcgttcagcagcgacaggcccagcagcgaagtgaagctcgcgctgccgcagatcaacgccagcctgcacgagctggccatgccctccggcagcctgagcgccaagttgatctacgcccgcagccagtaccagctgcaggcgcagttggaaaacctcaagctgagcgagggcggcctgtacgccgacaagctggacggcgaattcaactggctggccggcagcaccaaggtcaacgtcaagctcaacgcgccgttctcgctggccggcatgaaccagctgctgatgcagccattgaagctgaccagcaccatcgccaccccggcgctgccgcgcggcaagctggtcaccagcatggaaggctcgctggacggcgacatcgacgagccgcgcttcaatctgcgcgtggccggcaagctggacggctccgacgtgtcggccaccctcagccaatacggcctgatcaaaccgcgccacgaggccacgctgaccataggcaagctcgacctcaaccgctacctgccggaaagccagggcgacccggtggccatcttccagaacaccaacgagattccgctcgattggctggatttcttcgacctcaacggcaaggtggcgataggcgagctggcgatgggccgcttccgcatcaaccacatcagcagcaacgtccgcatcaatccgcgcgcgctggagctggaccagatgtcggccgacatctacgacggccgcctgcagggcgacgcctcgctcagccgccgcgacgtgccgcgcctgcaggtcaagcagacgctgcaggggatgaagatccgcccgctgctggtggacctgttcaatttcggccggctggacggcaagggcaacggcaagatagacatcagcgccgacggcaaatccttcgccgacctgcgcaacaccctcagcggcgacgccgccttcagcctgaacaacggcgcgctcaccggcatcgacctggtggcggcgctgaagaacctgccggcggagctgaaggaatggaacagcgccgcgcagaacgaccagaagaccaccttctccacgctgtcgaccagcttcaagctggacaagggcatcgcccgcaaccaggacctgaagctggcctcgcagctggtgaacgtgaacggcggtggcaagatagacctgaaacagagcatcgtcgactacacgatggacgtgcaggccaatccgcaggagtttgcccagctcaagggcgtcaacgtgccgctgaagatcaccggcccgatcaacgcgccggtgtacgcgctggatttcaacgcgatggtgaagggcaagaagaccgagggcgagaaaaagcaggcgctgaagcagcaactgcagaagcagatcaccaccattctgccctgagcgccagacggcgccaaagaaaagccccggcttgccggggctttttcatgccacgctcaatcgccctgcagaatcctcgactccgccagcgccagttgctccggcgtgcccagcagcaccagcacatcgtcggcgccgatctcgaagctggcgtcgaagtcggtgcggcgcacccgatggcggcggatggccttcacctccactcccagcgcctccagcttcagcgcgcccagcggatggccgatggcggcggatggccttcacctccactcccagcgcctccagcttcagcgcgcccagcggatggccgatggcggcggcgccgccgcacacctggatgctgagcaagcgcggcaccagcgcctcgtccaggctttccacctcgtcgctgctgccgcggaaaaagccgcggaacagatcgtagcgctcctcgcgcaccgcgcggatgcgccgcagcacgcggctgggcggcacgccggcctccatcagcgcctgcgaggccagcatcaggctgccctccatcacctcggccaccacctcgtcggcgccggcctggcgcagcacatccatctcgctgtcgtctatggtgcggacgatcaccggcaattccggcctcacctctcgcaccgcgtgcagaatgcgcagcgccgcatgggtgtcggcgaaggtcaccaccaccacccgcgcccgcatcaggccggcggcgatcagcacctctttcttgccggcgtcgccaaacaccaccggatcgccggcctcgccggcctcgcgcacccgctccggatccatgtccagcgcgaacatattgatgctctccgcctccagcagccgcgccagcgcctggccgctgcggccgtagccgcagatcagcacgtgctcgctcttgctcatgctcgccaccagcatctggtgcagatccagcgactgcagcatccagtcctgcttcaccagccgccgggtgatgcgctcgccgtgcatgatcaagaaaggcgcgatcaacatggagatcaggatggcggcgatggccgcctgggccatcggcgtggccaccagctgcaggtccatcgccagcgccagcagcacgaaaccgaactcgccgccctgcgccagcgccagcgccgaacgcatcgcatcattggcgcggtggccgaacaagcggcccaggccgaacaccaccgccagcttcagcggcagcagcagcgccagcagcatcagcacttcgccgaagcggttgaacagcaccgacagctccagccgcatgcccacggtgatgaagaagaagcccagcaggatgtcgcggaacggcttgatgtcctcctccacctgatagcggtattcggtttccgagatcagcatgccggcgacgaaggcgcccagcgccaggctgaggccggacagctcggtcagccaggccacgcccagcgtcaccagcagcacgttgatcatgaacaattcgccggagcgctggcgcgccaccagatggaaccacggccgcagcagccgctggccgaaaaacagcagcagcgccagcaccagcgccaccttcaatgccgccttgcccagatccagccacaaggtctcgctatggccggcgaaggcgggcagcagaatcagcaagggcaccacggcgatgtcctggaacagcagcacccctatcgccagctggccgtgcggctggttcaactccagccgctcggtcaatagcttgctgacgatggcggtggacgacatcgccagcgcgccgcccagcgcgaaaccagtcagcgggctgccggtcagataggcgatggccgcggccaccagcagcatggtcacagccacttgggcgaaaccgacgccgaacaccagctgccgcatcgccttcagcctgggcagcgaaaattccaggccgatggtgaacatcatgaacacgatgccgatctcgcccagaaaggcggtttccttgccttgcggtatcaggctggccacgcctggtccggccaggaagcccactaccaggtaacccagcatcggcgggactttcaggctgcggcacagggttaccgccaacactgcggccaacaggacgataacgatgggggccatggaatgcatcggcggctgggtctcccgggaatggacatcagatggacggaaagcggggaaaatgcgacggccaagcaaaagttgcaccagctcgcgcgtcaatcgattataacctttgatatacttttgccttatggaaaaaacacactccaccagccgcctggagatggcgcgcgaggttctgcaaaccgaagccgccgcgctcgtcaccctggccgaacgcctgaacggcgatttcctggccgcggtcgacgccatcctggcctgcccgggccgcgtcatcgtcaccggcatgggcaagtccggccatgtgggccgcaagatcgccgccacgctggccagcaccggcacgccggccttcttcgtccatccggccgaggccgcgcacggcgatctgggcatgatcaccggcgacgacatcgtgatcgcgctgtcgaactccggcgaatccggcgaagtggtgtcgctgctgccggcgctgaagctgaaaggcagccggctgatcgccatcaccggccgatcggagtcgtcgctgtcccaggccgccgacatcctgctgcacacccatgtcgagcgcgaggcctgcccgctgaacctggcgccgaccaccagcaccacggtacagatcgccttgggcgacgcgctggccgtcacgctgatggaggtccgcggcttcagccaaagcgacttcgccttgtcccaccccggcggcagcctgggccggcgcctgctggtgcacgtcgccgacctgatgcacagcggcgacgccctgccccgcgtggcgcccggcacgctgctgaaggacgcgctgctggaaatgtcgcagaagcggctggggatggtcaccgtctgcgacgccgacgacaccctgcgcggcatctacaccgacggcgacctgcgccgcacgctggagcgctcggccgacgtctacagcctgaagatagacgaggtgatgggccgctcgccgcgcaccatccaggccggcaagctggccgccgaggccggcttcgtgatgaagcagaaccagatcaccagcctggtggtggtggacgccgcaggcaagctcagcggggtgctgcacatgcacgacctgctgcaggccggcgtattttgattccgccgcgccgcccgatccggcggccggcagcaaggaccaagcaatgcgaatgatttccgagcaggcccgcaaggtgaaactgctgatcatggatgtggacggcgtgatgaccgacggccgcatctactacaacgcccagggcgaagagagcaaatcgttctacgtgcaggacggcctggggctgcgcctgctgcagagcaccggcgtgcagctggccatcatttccggccgcgccgaccgctgcgtcgagcaccgcgcccgcgcactgaagatcgaccactactacggcggcgtccacgacaagggcgaagcgctggccgacctcttgcaaaaaaccggctttagcgccgacgagtgcgcgttcatcggcgacgatctgatcgacctgcccatcctcacccgcgtcggcctggccgtcgccgtgccggaagcgccgccgcaagtgcgccagcactgccattacgtgaccggcaacccgggcggccacggcgcggtgcgcgaactggcggaattgatcatgcaggcgcagggcagtttcgacgccgtggtcgccaggtacttggcatgatgcggctattgcgctcccaccggctgttccccgtgctgctgatcggcctcaccgccatgctcaccctgtggctggaccagatttcgcgctgggacacccgccaccgcgagctggacccggacaagcccgaatacgtggcggaaaacctggtcgccacccatttcgacctgcaaggcaagatcgccgaccggctgatcgccacccgcatgtggcagtatccgagcaaaccggacgcctatttcgaaaaccccgacctgtaccaataccagcaaggggcgctgcaataccacgtcttcggcgagtccggccgctacaacaacaagaaccagcaggctttcttcgacaagaaagtcaccctgatcaaacccgcagacagcaagcagcccgaaacccggctggaaagcagcgtgatgctggtggactccgccaagcacatcgccagcaccaaggcgccgtcggtggtctaccatggcaagtcggtggcccactccatcggcttcgtctaccagcaaccgctgggcctgctcaacctgctgtccaccaccaagatcatctatgccaaataagacccgcatcctgctggccagcctgctgctggcggcttccgccctgacgcacgccgaacaggccgacagcaccaagcccatggaaatcaccagcgacaacggctgcaccatggaccagatcaaaggcgtatccacctgcgaaggcaatgtggtggtgatccagggcaccctgcggctgaacgccgacaaggtggtagccacccaggacaagcaaggcaaccagacgctgcaggccaccggccgcatcgtcaccttccgccagaagatggacaacaacggcggctgggtggagggccaggccagcaagctcgactacagcagcgccggccacttggccgtgctcaccggcaacgcccgcgtcaagcgcaacggcgatctcgccatcggcaacgtgatcagctacgacacccgcagcgaaacctatcaggtgcagggcggcggcgccggcaatgccggcaagggccgcaccaccgtgatcctgcagcccaagaacgcagcctcgcagcccgcggcggccaagccggccggagccgccaaaccatgaacatgaagcacagcgtactcaccatctcccgcctgaagaagcgcttcaagaagcgcactgtggtcaaggatgtgtccctgcagatcgaaagcggcgaagtcgtcggcctgctcggccccaacggcgccggcaaaaccaccagtttttacatgatcgtcggcctggtcggcgccgacgacggcgacatcaggctggacgacgcttccatcacccgctacccgatccaccagcgcgcgcagctgggcctcggctatctgccgcaggaagcatcgatcttccgccgcatgacggtggaggaaaacatcgcgtccatcctggagatctccggccgcaagggcaaggagctggaaaaagagctggacctgctgctggacgatctcaacatcgcccacctgcgcgacagcaacgccttgtcgctgtccggcggcgagcggcgccgggtggaaatcgcccgcgtgctggccacccgcccgcgcttcatcctgctggacgagccgttcgccggcgtcgatccgatcgcggtgatcgacatccagaagatcatctccttcctgaagggccgcggcatcggcgtgctgatcaccgaccacaatgtccgcgaaacgctgcgcatctgcgaccgcgcctacatcatcagcgacggctcggtgctggcctccggcgagccggaagagctggtcaacaacgaaagagtgcgcgaggtctacctcggcgagcatttccacctgtaagcgatgaaacaggcccttcagctcaaggtatcgcaacagctgacgctgacgccgcagctgcagcaatcgatcaaactgctgcagctgtccacgctggatctgcaaaccgaggtggaacgcttcctgctggacaatccgctgctggagcgcggcgacgagccgcgcgacgccgaagccgcgcccgaaggccaggactgccgcgaaaccgccgccgacgaggcgccggacagccatgacgacggcgccggcggcgaactgctggaatggggcgccggcagccgccagggcggcgacgacgactacgaccccatgctcaacgtgccgtgccaggtcagcctgcgcgagcacctgctggcgcaactgggcgaaatcgcgctggccggccgcgatctggccatcgtccggctgctgatcgaagagctggacgacgacggctacctgccgctcagcctggacgaactggccagccacctgccgctggagctggagctggaaagcgacgagctggcggtgggcctcaagctgctgcagcaattcgatcccgccggcgtcggcgcgcgctcgctggccgaatcgctgctgctgcaactgcagcggctggccgcggacgagcccggccgggcgctggcgctggccatcgcgcgcgagcacctggcgctgctgggcggccgcgactacgccaagctgaagaaagcgctgggctgcggcgacgccgagctgcgcgccgcccaggcgctgatcgcccgcctcaacccccaccccgccaccggcttcagccacggcgacgtccattacgtgattccggacatcagcgtgcgcaagcggcgcggccgctgggtggccgaactgaaccgctccgccatgcccaggctgcgggtcaaccgcctctacgagcgcatgctggccgacagccgcggccaggcgggcgaaatggccggccgcctgcaggaggcccgctggctggtgaagaacatccagcagcgatttgacaccatcctgaaagtggcggaagctatcgttgacaggcaacaatcgttctttgaacacggcgaagtggcgatgcggccgctgatcctgcgcgacatcgcggatgagctgggcctgcacgaatccacggtttcccgctccaccagccagaaatacctgctctgcccgcgcggcctgttcgagctcaagtatttcttcggcagcgcgctggaaaccgatagtggaggcgagtgctccgccaccgccatcaaggctcgcatacgcggcatgatagacagcgaggacagcggcaagccgctgtcggacagcgccatcgccgatgcgttaggcaagcagggaattcaggttgccagacgcaccgtagccaagtatcgtgaagccatgcagattccggcggtgaatctgcgcaaggctctgtagcaagccttggggaatacatgccgcccgacaacccgaccgggcggccaacaccagaaggagctagggtatgaacctcaaagtaaccggtctgcacctggaagttaccccgtcgctgcgcgaatacatcgaaagcaaactggagcgcatcacccgccacgtcgaccacgtgatcgacatctccgtcaccctgtcggtagacaagctggtccagaaggccgaagtcaacgtccacctgtccggcaaggacctccacctcgaagcctccgaggccgacctctacgccgccatcgacctgctgatggacaagctggaccgccaggttctgaagtacaaggaaaagctcaccgaacaccgggcgcagagctccggcgaagtttctcaagcctcgctgtgaccgcctgaagaaagccacgggaaccatccggttcccgtttttctttgcgcttgccggttttcagtactatcaaggcaacgtagaattccgggtttatccaagagccgcatgcataatccaatatgaatctcatcggcaagatcctgactccggaccatgtattgctggatctggacgtctccagcaagaagcgggtattcgaacaggtgggcctgctggtggaaaacacccgcggcatcgcccgcagcgaaatcttcgacagcttgttcagccgcgaaaaactgggctccaccggcctgggtcaaggcgtggccattccccacggccgcgcccgcggcctgaaggaggccaccggcgtgttcatccggctgaaggcgcccattcccttcgacgcgccggacggcaagccggtgcaatgcctgttcgtgctgctggtgccggaacacgccaccgatctgcacttgcaggtgctctccgaattggcccaattgttctccagccgccagatgcgcgaacagatgctgagcatcaagatgcgcgatgaactttaccagctcctcagcgagtgggccccccatgcctagcatcaccgtacgcaggctgtatcaggaaaaccagcagaagctcaacctgacctgggtcgccggcaccggcggctcggacaatgtcatcggcaacgacgaccagcggcctacgctggcgctggttggccacctgaacttcatccacccgaaccgggtgcaggtgctgggcctggccgaggtcgactacctgaacaagctggagcagtcggccgccaagaccgcgctggaccagctgttccacaagagcatgtcggtggtgatggtggccaacaaccagccggtgccgcggctgctgcgcgactactgccacagccacaacgtgccgctgatgtgcagctcgctggaaagcccgtacctgatggacgtgctgcgcatttatctggcgcgcgcgctggcggtgtccaccgtgctgcacggcgtgtttctcgacgtgttcgagatcggcgtgctgatcatgggcgattcggcgatgggcaagagcgaactggcgctggagctgatctcccgcggccacggcatggtggccgacgacgcggtggagctgtaccgcatcggcccggacacgctggaaggccgctgcccgccgctgctgcgcgacttcctcgaagtgcgcggcctcggcatcctcaatatccgcaccatcttcggcgaaaccgcggtgcggccgaaaaaagtgctgaagctgatcatccacctggtcaaggccaacgaccaggcgatgcaggcgctggaccggctcaacatccagtcggaaacccaggacatcatcggcgtcaccgtgcgcaaagtggtgctgccggtggccgccggccgcaacctggcggtgctggtggaagcggctgtgcgcaattacatcctgcagttgcgcggcatagacagcacccgcgaattcatcgaacgccacaccaacttcttgcgagaccaggaaaatgcgcctgatattgattagcggcctgtccggctccggcaagtcggtggcgctgcgcgcgctggaggattccggcttctactgcgtcgacaacctgccggccaccatgctgcccgaggcgatgtcgctgtacgccgatttcggctacgaacaaatcgccatcagcgtcgacacccgttccggcccgtcgctgggcgcgctgcccgacgcggtcgcgcggatgcgcgcgcagaacatcgacgtgcgcctgctgttcctcgaagcccggacggaaaccctggtcaagcgcttctccgagacccgccgccgccacccgctgtccggcgccggcatcacggtggaggaaagcatacggctggagcaggaaatgctggccgaagtgcccgagctcggcacccgcatcgacaccagcgaactgtcggccaacgcgctgcgcagctgggtccgcgaactggtggacgccgacggcagccggctgatgctgatcttcgagtcgttcggcttcaagcacggcctgccgcaggacgccgacttcgtgttcgacgcgcgctgcctgcccaacccctattacgacccgcagctgcgcccgttcaccggccgcgaccaacccatcatcgacttcttcgccaaacacggcgaagtcgccgaaatgatcgccgacatcgaagcgatggtggccaaatggctgccctgctacggcaaggaaaaccgcagctacctgacggtggcggtcggctgcaccggcggccagcaccgctcggtctacatcatcgaaaacctggcgcgcgccttcgccgacaggcaagtgctggtgcgccaccgccagctgtaccgcgaaccctgatccgccggggcggccccgccgtcccgcgcttgcccgacgcgggccccgcgcgcccgctggagaacgctgccgatgtcccgtcccaaaaccatcaccgtcgccctcaccggcgcctccggcctgccctacggcctgcgcctgatcgaaaccctgctcgccgccggcatccgcacctgggtgctgtactcgcaggccgcccaggtggtggccaagcaggaaatgcagatcaccctgccctcgcgcccggccgaaatgaaggcctggctgctgcagcgccatgcggccgaccccaccctgctcgacgtgtacggccgcgaggaatggttcgcgccggcggcgtccggctccaacccgccggacgcgatggtggtgtgcccgtgctcgatgggcacgctggccgccatccgccacggcatgagcgacaatctgatcgaacgcgccgccgacgtctgcatcaaggagcagcgcaagctggtgctggtgccgcgcgagacgccgctgtcggtgatccacctggaaaacatgctggagctggcccggatgggcgcggtgatcctgccgccggcgccgggcttctatacgcacccccagagcgtggacgacatggtggacttcgtcgtcgcccgcatcctggatcaactgggcgtggcgcacgaactgacgccgcgctggggagaagccgcgccatgacctcgcagcccatcctgagcctggacgcgctgcgccggctggagcgcgccgccaacgccgccggcctgcagctgatgcggcgcgcggcgctggccgccgccgactggatgggccgccatgccgcgcccggctcgcggctgctggtctgcgccggccccggcaacaacggcggcgacgcgctgtacgcggcgctggaactgcgtcgccgcggctatctgatagacatcctgctgcccgtcgcgccaaccggcgccgacagcctggccgcgctgcgcgcggtacgggcggcgggcgtggcgctgctgtcggagttgccgggcggctacccgccgccggcatggctgatcgacgggctgttcggcatcggcctcagccggccgctggatgaggactggggccggcgcatggagcggctcaacgcgctgggctgccccacgctcgcgctggactgccccagcggcctggacgcctacaccggtcgggcggccggccccgccatccgcgccgaccatacgctgactttcctgtgccacaagccaggcctgttctgcggcgacggcgccgacctggccggcgtggtggagctggctgagctggactgcccgcggcagctgttccccgccgcggaaggcgcgctcaacgcccctagcgccgccggcctcgcgcgccggcgcgacagccacaagggcagcttcggctcggtggcggtgataggcggcgcgcccggcatgctaggcgccgcgctgctggccggccgcagcgcgctgcaaggcggcgccggcaaggtctatctgtgcccgctggacgacaggctgccggtggacccggtcgcgccggaactgatgatgcgcccgctggacgaaacgcccgagctgccggccgccgacgtgatcgccttcggcccgggcctaggccagcaggaactggccggcaaactgctgcggcaggtcgcggcgctgccgcagccgctggtgctggacgccgacgcgctcaacctgctcgccggcgatgcggatgccgccgaacgcctccgccgccgcgcatcccccgccgtgctgacgccgcatcctgccgaagccgcccgcctgctgcagaccgacaccgccgcggtgcagcgcgaccgcgtcggccatgccagggcgctggccgcgcgctaccgctgcgtggcggtgctcaagggcgccggcagcctgatcgcccgccccgacggccattaccagctcaacgccagcggcgggccggaactggccgccgccggacaaggcgatgtgctgaccggcctgatcgccgcgctgctggcccagggcctgccgcccttcgaggccgccgcgctggccgttcacgcgcacggcctcgccggcgacggctaccgccgggaaaacggcggcccgatcggcctgaccgcctccgccacccccgcccggatcagccaggcgctgaaccgcatgctggccggcggctaaaccgcgccgacgccgttttgccggcgccggcggtttatgtttaagatggatcgggcaccccatccgcggagacccgatttgtcgtcacagaaaaaagcctacgccttcggcctcgccgccgtcctggcctggtccaccgtcgccagcgccttcaagctcagcctgcaacacctcagcccgatgcagctggtgctgtacgccagcggcgcttcgctgctgtcgctgctgtccatcctcgcctggcaaggccggctgccggagctggccgcgacgctgcgccgccactggaaaagttcgctgctgttcggcgcgatcaaccctttcgcctactatctggtgctgttccaggcctattcgctgctgccggcgcaggaggcccaggccatcaactacacctgggcgctgaccatgacgctgctggcggtgccgctgctcaagcagaagctccacccgctggacgccatcgccgcgctgatctgctacctgggcgtgctggtcatcggcacccgcggccagttgctggcgctgcatttttccaatcaattgggggtggcgctggcgctggcctcgacgctgctgtgggccggctactggatcttcaacacccgcgacagccgcgagccggtgctgggcctggcgctcaacttcgccttcagcctgccgctgagcctggcctggtgcgcctggcatggccaactggcgccgccctcctggcaggggctggccggcgcggcctacgtcggcgcgctggagatgggcttcaccttcgtgctgtggctgtcggcgatgaagctgacccgcagcaccgccagcatcgccaatctgattttcctgtcgccgctgctgtcgctgctgctgatccacctgatattgggcgaagccatcctcgcctccaccctgctgggcctggccttgatcctgggcggcctggccgtgcagaagctgcccttgcggcgcgccccgccgctgccggtggccgacggtcccggctgatgccggcatccgcggcgggaacccggccacgcagaagaaaccgagtgtggatccatcatggcaattccgccccgctctgcctacgattgattctgagggcacgaataaacaggcaccatgaaaagcatcaagacaaggttaatgttatggctgatggcgtggatcaccaccattctgggcagcacgggtctgtatttctatcttcatgactacagcatagaccagagcgacttccagactcagcgcgccgcggtgcaatcccgtttgtccttgtcgctgccgcacggcatctggcagctggacgacgagaacgtgcgcttggcgctggacagcgaattgagctggccttcggtgatcgccatcaacgtcaagggcgaaagcggcctcaacctgggccggacccgcgacagcggcggcagcctgcgcgacatgctgcccaacgagcggcccaaggtggacgacatgctcagcatccccatcgtttaccagggcaaggagcatctgggcaccgccaccgtctacctgtcgcacgacgcgctgcgcgcgcgggaagaccagcacctgatcaccatcatcgcccagatcgtgctgctggacggcatgatcttcttcatcatgtcgttcaatctgcagcgcttcatcttccagccgctgtcgcggctgcagcaggcgctgaacaccgccatccgcgcgccggacgccaccggcgcgcagatcacccacctggccgacgacgagatcggcgccatcgtcaacggcttcaaccgcatcgtcgctcgcaccgccgccgacctggtcaagcgcaccgccgccgaagccgtggcgcgcgaggaaaaggaaaaggcgcagctggcctacagccaattgatggcgacgcaggaaacgttggtggaggcggaaaagatggcgtcgctgggcagcctggtggccggcgtcgcccacgaaatcaacaccccggtcggcatcacgctgaccgccgcctcgcacctgggcaccgccacctcgcacatcaccggcaagctcgacagcggcaacgtcaagaagagcgatttccagagctacctggaaaccgcgcaggaatgctgcgagctgatactggccaattccgaacgcgccgccaacctgatccacagcttcaagcaggtggcggtggaccagaccagcgaggccaggcgcagcttccatctgcacgactacctgaacgaggtgatcaccagcctgaagccgcgcttcaagcacaccaaggtgggaatagacatccagtgcgaagaggacatcctgctcgacagctatcccggcgcgctggcccaggtgctgaccaatctggtggtcaacgcgctggtgcacggctatgaaggcggggagattgctggcaatatcgtcatcgaggcccatcgcaacgacgcccagcacgtgtcgctgaacatcagcgacagcggcaagggcatcgcgccggaaaacctgagccggattttcgagcccttcttcaccacccggcgcggcagcggcggcagcggcctcggcctcaacatcgtctacaacatcgtaaggcaaaggctgggcgggaatatcgaggtacacagcgagccgggacaaggcacccgattcacgctggaaatgccctgcatcgcccccaccgtccagcacaaggagaatgtggcatgagcaccgagacattgcctcccgatgacgacaactggctgctggacgacaatgacaacgaagacaatgtccgcccttccgagatgcgcaagccgtggaaggtgctgatcgtcgacgatgaaaaagacgtgcacaccgccacccgcatcgcgctgcgcggcatcagctacaaggaaaggccgctggaactgatcagcgcctacagcggcgtcgaggccttccagcaactgcagcagcatccggacatcgcgctgatcatgctggacgtggtgatggagagcgaggatgccggcctcaagctggtgcatcgcatccgcggcgacctgggcaacggcgtggtgcgcatcgttctgcgcaccggccagcccggccaggccccggagcaggaagtcatcctcaattacgacatcaacgactacaagaccaagaccgagctcaccacccagaagctgttcaccaccaccatcgcctcgctgcgcgcctacgagaacatggtgtcgctggagaaaaaccgccagggtctggccaagatactggaaagcgcgtccgacctgtaccagttgcactcgctgcgcgaattcgcctccggcgtgctgcgccagatcagcgcgctgctggacatcggcaccgacggcatcctgtgcgtgcgcaatgagaaccacagcggccggccagagctggaaatactggcggtgtcgggctcctacgaatacctggccgaagccggcgacctctccagcgagcccaagctggccgaggtgatccagcgcgtgttccacgaaaagcgcagcatcttccagcatccttacgacgtgctgtacatctcctcgcgcaaccgccgcgaattcgcggtgcacttcatgccgcaatggccgctggaaagcgtggaatgcgatctgctggacgtgttctgccagcgcatctccgccgcctacgacaatctctacctgtacaaccagctgcgcagcgcccaggaagccaccgtggtggcgctggccgacctggcggaattccgcgacaccgacaccggcgaccacgtgctcagggtgcagaagctgaccgacgccatcgcccaggagatgctggagcacaaccactatccggagctgatgacgcgcgagttcatggacatggtgggcatggccagcatcctgcacgacatcggcaaggtggccatccccgaccacatcctgctcaagcccggcaagctggacccggaagagcgcgcggtgatggagcagcacgccaccataggcgcgcagatcctcgacaagtcggccagaatggtggaaggcaccagctatctgtcgctgggttcggaaatcgccggcggccaccacgaacacttcgacggcaagggctacccgcgccagatcgccggccaggacattccgctgtcggcccgcatcgtcgccgtgatcgacgtgttcgacgcgctgctcaacaagcgcccgtacaaggagccatggagcatggaagacacgatgaagtacatcggcagccgctccggcagccagttcgacccgctggtggtggaggcgctgacgcggctggtgaacgagaaccgcctgccggtggcgccgcagcaggaataagccgccgcgcccatgcaaaacggcagcccggaggctgccgttttcgctggcttcgccgccggctcaggcgacgtagttcagcacgcagacatattggcagatgctgccgcccagcacgaacaagtgccagatgccgtggccatggcggattttctcgtcattgagaaaccagtagataccgacgctgtacagcaggccgcccagccccagccagaacaggccgcccggcgccagcgcgtcgatcagcggcttgatggcaatcagcaccagccagcccatcaccacgtacagaatcatcgacagcaggcgcgtgcgccgccccagcgtcagctcctggacgatgccgaacagcgccaggccccagctcaggccgaacagcgtccagccccaggcgccgcgcagcgtcaccagcgcgaatggcgtgtagctgccggcgatcagcagatagatcgccgaatggtcgcacttctgcaaaatggctttcgccttgccggtgaagctgtggtacagcgtggagatcagatacagcgccaccagcgtgccgccgtacaggctgaagctgacgatcttccaggggtcgccctgcatcgccgcctccaccaccagcaccaccaatccggctaccgccagcaaagtgccggccaggtgggaatagccgttgaaacgttccccgtgatacatgattttatccttgggccggtccgtcttgccggcctgacatcagtgaacccattggagcccgcaatggctcgcgggttcaattgtccgcctgtttgcgccgcgccgccagcgtcttgcgcaaacaaaaaaagcgggcagcgcccgcttccggctatacgacggcggaatcaggcgcccagcgaggccagcacctcgtcgcgcacggtttccaccgcgcgggtgccgtcgatcttcacgtacttcggcgccttggcgtcgccggcggcggccagcttgccgtagaagcccaccagcacggcggtttgctcatgatatacggccaggcgcttcttcacggtgtcttcccggtcgtcatcgcgctgaaccagctcttcgccggtcgcatcgtccttgccggccactttcggcggattgaaggcgatgtgataggtgcggcccgaagccaggtgcacgcggcggccggccatgcgctcgacgatggcggcgtccggcacgtcgatttccaccacgtagtcgatgtccacgccggcggcgatcatcgcctcggcctgaggaatggtgcgcgggaaaccgtcaaacaggaagccgttggcacagtcggcctgggcgatgcgctccttgaccagaccgatgatgatgtcgtcgcgcaccaggccgccggcatccatgatcgccttggcttccaggcccagcggcgtgccggccttcaccgcggcgcgcagcatgtcgccggtggagatttgcggaatgccgaatttctcgcggatgtaattggcctgggtgcctttgccggcgcccggagcgcccaacaggatcaatcgcatgtgtatgactccagtctgtttgatttatgaattcttttagccctcaggcgtccagcagccggcgcacccgttccaggtcttccggcgtgtccaccccggcggcaggcgcctcgtccgccaccgccaccatgatggcataaccatgccagagcacgcgcaattgttccagcgcttcgtattgctccagcggcgccgcctccaggccggcataggcggcgaggaagccggcgcggtagccgtacatgccgatatggcggtataccggcagcccggccggcaggctgtcgcgaccggcggcgtaggcgtcgcgggcgtagggaatcggcgcgcggctgaaatagagcgcgcggccatgtttgtccagcgccactttcaccacattgggattgaaatggtcggcggcgtcgtggatggcgtgcgccagcgtcgccatcggcgcatcgcctgccagcatcaactcggccagctgatcgatcagctcgggctggatcagcggctcgtcgccctggacattgaccaccaccgcgtcgtcggccaggcccagctgggcggccacctcggccaggcggtcggtgccgctggcgtggtcggcgcgcgtcagcgccgcctcgatgccatgcgcggcgcaggcggccagaatgtcggcgtggtcggtggcgacgatgacgcggccggcgcggctcttcgccgcctgctcggccacccgcaccaccatcggcttgccggcgatgtcggccagcggcttgcccggcaggcggctggaagccatccgcgccgggatcaccacggtgaagccgctcatttgacttcttcttcgggcgccagctcgcgcgcttccgcttccagcatcatcgggatgccgtccttgatcgggaaggccagacggtcgcccttgcagaccagttcgtccttgctcttgtcgaacagcaacgggcccttgcacaacgggcacaccaggatttccagaaatttagcgtccatgttccatcttcaagcgggcgagtatccagtcgcacagcccaggcgccagcgtggcctgaaccggcaaaacccatagtctagcacgctgcgccgcatcatgaagcacgcgctcgagcttgaccgcgtccttgctggtgacgatcaccgcgtcggcgtcggccgggatgtcggcggcgcaaaacgcgtgatgatcgggaaaagacagccggcgctccaccgcgatgcccaaccccgccagcgtatcgaaaaagcgctcgggatggccgatgccggccagcgccaccaccttcaagccggcgaagccgtcggcctgccgcagccgcgccgcgtcgcccagcgcgtggcaggcgccggcgcgcagcgtcatgtcgaagcgcgcgaggccgggcggcaacgccagatcagcgccggagccgttcaccaccgccgcgtccaccgtccgcagccgcgacaatggctcgcgcagcggcccgttgggcagcaggcggccgttgccgacgccgcgccggccatccagcaccgcgatttccagatcgcgcgccagccgataatgctgcaggccgtcgtcgctcaatatcagttgcacatcggggtgccgctccagcaggcggcggccggcggccacccggtcgcgccccaccaccaccggcgcgccggaagcggccagcaacaagggttcgtcgccgacccgcgccgggtcgccgccctgcagcgcctccgtcggcccggcggcgctgccgccgtagccgcggctgatcacgcccgccttgacgccgcgcgcggcgaaatccgccagcagcgccagcgtcagcggcgtcttgccgacgccgcccacattgatgttgcctatcaccaccaccggaaccggcagtgtttcgctgcttttccagccgcggcggaaagccagccgccggccggcggccagcagcgcaaaaagcccttccagcggcgccagaagggcagtcagccagcctagcggccggtaccagtgtcgttctatcaaactcatgccgtttcgggcttcacttcaaattttgggtggcgaaagtcagctgcgacaggccggcctcgcgggccgcctccatcaccgtgatcaccgactggtgagtggagcgggcgtcggcgttgaccaccaccaccacgtcgctcttgccggcggcggcggccttcagcctggccagcaggccggacttgtccgcggcggcgatgcgggcgtcgttgaccgccatcgcgccgtcggcggccaccgcgacgcggatctcgacggtcttgttcttcagctgctcgccctgcgcgctcggcagattgatcttgagttcggagaagcgcgaataggtggtggtgaccatcaggaaaatcaggatcaccagcagcacgtctatcaacgggatgaagttgatctccggctcttcccggccgcggccgcgacgaaagttcatgctcagctcccgttccggcgctcgccgtgcaccacttccaccagcttgatcgcctgcgcctccatctcgaccagcaggccgtcgacgcgggagcggaagaagcggtagaacatcatgctgggaatggccacgatcaggccgaaagcggtgttgtagagcgcgacggagatgccgtgcgccagttgctgcggattggcgccgctgccgttttgcgagccgaagatctcgatcatgccgatcacggtgcccagcaggcccagcaagggcgccatcgcggcgatggtgcccagcgtggtcaacaggcgctccagctggtaggccacctggcggccctcgtcctcgatcgactccttcatcacctcgcggctgccgctgacattgcgcagtccggccgcgaacagtcggcccagcggagaatgccgcgccaggcggtgcatcagctcgtcgcgcaggtccacccggcgatattcctgcagggtctgcgccagcaggccttccggcaccaccacgccgcggcgcaagctgtacaaacgctccagaatgatggccagcgacacgacggaagccgccagaatggtccagatcggccagccggccgcttcaacgatagcccacacagaagctgtctccgtagtcgatacaaacgttagactttattacctcagtggcggcgaggcaacctccagccggcaaaaattacagccgattgccgcttttttgggcatggactgtcgaaagccgctgccaccggcccattccgcaacttatccacaaggttattccgcgattcttgtggataaatttccgccctcggcgccggcgcgcgcaagtcggcattgactttgctcaaagctttgtcgacgatacgactatccaaacaatcgtttgaattcctatcatgaacctgcctatctggctgatcaagctgctgctcaatctgtggccgcccttcctcggcgccggcatccgcgtccaccgcctgtctgccgacttccgccaggccgaagtcaggctgaaactgggcgtaggcaaccgcaactacgtcggcacccatttcggcggcagcctgtacgcgatgaccgatccgttctacatgctgatgctgctgcgccagctgggcggcgactactacgtctgggacaaggaaggccgcatcgaatacatcaagccgggccgcggcctggtgcgcgcccgcttcgaactgagcgacgccttgctgagagacatccgcgagcaaaccgccgatggcggcaaatacctgcccgaaatgaaggtggagatacgcgacggcgacgacgaactggtggccaccgtgcacaagacgctgtacatcaaacgcaaacccgaacgccgccaggcgaagcccatatagaaaaagccgcgtttcgcggctttttctatatggattctgggtgcttactccccgaagccgcagaagacctcacgcatcatccgcaggacttccagcgtgcggatatcccccacccggtagtagacgcggttggcatccttgcgcgtgcgcaaaactcccttgtcccgcataatggcgagatgctgggaaatattgctctgggaggtgccaacctgctcgacaatgtcttgcacgctcacttcccggtcttccagcaccgatatgatcttcagacgcagcgggtgcgacatggccttcatcgcccgcgatgtctgttcgatctggtcgtcgttgaacagcaaagcttttctcctaatgtagcgtcattttattgatttgactgcgggactatagtatcggcaaaatccgatactatcaaggttttctaatattctgaatgcgaatgccatgaaatcaatcacaccggtgttgctattaatcctcgacggcttcggccaccgcacggaaggcgacgacaacgccatcctgcacgccaacatgccaacctggaaccgactgcgccagcgctacgcctacggcacgatcaacgcctcggaaaactttgtcgggctgccttccggccagttcggcaactccgaggtgggccacctgaacatcggcgccggccgcatcgtgcagcaggacatcagccgcatcgattgcgacatcgaggacgggcatttcgcaaacaatgacacactgcagcaagccatgagcaaagctcaaggctcggcgctgcacatcctgggcctgttatccgatgggggtgtgcacagccatgaaaaccacatccacgcgctgatccgcgccgcccaggccgccggcgtggcgaaaatatacgtccacgccttcctcgacggccgcgacaccccgccgcgcagcgccgaaaccttcctcaagcgcctggacgcggtactggccgaatgcccgaacgcgcgcctggtttccgtgaccggccgctactgggcgatggaccgcgacaagcgctgggagcgcgtcgagccggcctaccggctgctggtggagggcgaaggcctgttccacgccgaaaccggcctggaagcgctggccgccgcctacgagcgcgacgagaacgacgaattcgtcaaggccaccggcatcggcgcgccggtgaagatgcaggacggcgacgcgctgatcttcatgaatttccgcgccgaccgcgcccgccagctgaccaccgcgctgaccgacccggctttcgacggcttccaggcccgccagcccaagttcggctgctacgccaccctcaccagctacggcgaagcctattccgcgctgcccaccgcctacgcgccgcagaagatccacaacggcatgggcgaatacctgtcgtcgcaaggcctgaagcagctacgcatcgccgaaaccgagaaatacccgcacgtcacctatttcttcaatggcggcgaagagcaggtctaccccggcgaagaccgcatcctggtgccgtcgcccaaggtggccacttacgatctgcagccggaaatgagcgccggagaagtcaccgacaaaatcgtcgccgcgatccagtccggccaataccaggccatcttctgcaactacgccaatggcgacatggtcggccacagcggcatcttcgacgccgcggtgaaggcggtggaagcgctggacggctgcatcgaacgctgcgtcgacgcgatgctggccgccggcggcgaggtgttgatcaccgccgaccacggcaactgcgagcagatgtacgatggcgcgcaccaccagccgcacacccagcacaccaccaaccaggtgcccttcctgtatatcggccgcccggcgaccatccgcggcggcggctcgctgcgcgacatctcgccgtcgctgctggcgatgatgggcctggaacaaccggccgagatgaccggtcaatcgctgatcgacttccaataatcgcctcaccacgcggcggccggaacatggccgccgccatcgccccaagcgaaagaacaccaagggaatgaaaccttacctgttgctggccctgctggccggcgccgcccaggcggccaacaccaacgcctcctccaccagcctgtccgccgccccgcaccagcaggacctgaaaaacgtgcgcaaggaaatcgacagcctgaaaaaagacctggcgcagaaacagacggtgcagaaggaagcgcagtcggcgatcaaggagtcggaacaggcgatcagccagacccggcaaacgctggccacgctggaacaaaagcagaatcgctccgcgcagcagctggccgacctgaacgcgcagatcgagaaaagccgcaagagcctggccgacgtgcgccagcgcgtcggccagatgctggtgcgccaatacaagaacggccagcacgacgcgatgaagctgatgttcaacgacagcgaccccaaccagagctcgcgcgacctcgcctactaccagcacatcgcccgcgccgaccagcaactggcgcagcaactggtggcccaacagcaacagctgcaggcgctgtccgcccagctggaggaagagctggcgcggctgaacagcctgtccagccgcaaaagccaggaaaagagcgagctggagaaagacaaaagccagcagcagcagcaactgaacaaggtgtccggcgagatcaagcagggccagagcaagctgacccagctgcaggaggacgagaagcacctgtccaacctgatcgcccagatcaaccgcgaaatccagcgccgccgcgccgaagcggcgcgcaaggcggccgaagcccgcaaggccaagctcgccgccgcccgcgaagccgcgcgcaaggaaaacgaacgccgccgccaactggccgcgcaagccaagaaacagggcaagccggtgccggaagaggcgaagaagccggtgatcgtcaaggaagagccggcggagaaagtggacgacgtcgccgacggcagcgcctcgggccgcgccttcgccagcttgcagggcaagatgaagctgccggtggccggccagatcgccggcgccttcggcaagatgcgccgcgaaggcaccacctggaaaggcatttttattcgcaccgccggcggccagccagtacacagcgtggccgacggcacggtagtatatgccgatgagttgcgcggattcggcaaggcggtgatcatcgaccacggcggcaattacatgaccgtctacaccggcctgtccgccatcgccaaatcgtccggcgccggcgtcaaagctggtgaaacactcggcaacactggaacactggacaatggggaagccggactgtactttgaaatccggcacctcggacgccccctcaacccgcaggcctggacacgctaaggtgccgggtacggagaatttgcacagcatgagcagccaaagaatgaagaaaatcgcctggttggtggcaggagccatggccggtggcgtactgaccatcagcatgcaggcgctggccgacaaggaagcgtcgccgctgccgctgggcgagctgcgcacctttgtcgaggtgttcagcctgatcaagcaaagctacgtcgagccggtgaccgacaagaaactgatagacgaagccatcaagggcatgctcaccggcctggatccgcattccgactacatggatcccgaggaattcaaggagctgcgcgaaggcacccagggcgagttcggcggcctcggcatcgagatcggcgccgaggacggcctggtcaaggtggtgtccccgatcgaggataccccggcgcagaaggccggcatcaagagcggcgacctgatcatcaagatcgacgaaaccccggtccgcggcctgtcgctgaacgacgcggtgaaaaagatgcgcggcaagccgggcagcaaggtcacgctgaccatcgcccgcaagagcgagaccaagccgctgatcttcacgctggcgcgcgcggtgatcaaaaccaagagcgtcaagtacaagatgctggagccggactacggctacgtccgcatcgcccagttccaggagcacaccgcggaagacttggccgccggcctgcagaagctgtacaaggacaacaagcagccgctgaagggcctggtgctggacctgcgcgacgacccgggcggcctgctcaacggcgccgtcggcgtcgccgccgccttcctgcccaaggacaagctggtggtgtacaccgagggccgcaccccggacgccaagatgcgcctgaccgccaccctgcaaaactacgccggcatcggcggcagcgacccgctggccaaattgccggccgacgcccgcaacgtgccgatggtggtgctggtcaacggcggctcggcctcggcgtcggaaatcgtcgccggcgcgctgcaggaccagaagcgcgcggtgctggtcggtactcaaaccttcggcaagggctcggtgcagtccatcctgccgctgggcagccagggcggcatcaagctgaccaccgcccgctacttcacccctagcggccgctcgatccaggccaagggcatcgtgccggacgtggtggtggaagacgccaccctcaccgccgccgaccaggcgctgcgcgtgcgcgaggctgatctggaaaaccacctggccaaccccaacggcgacgacaagccggccaaggccgccaaaccggcgcctaagctggtgccgcccccggccgcgccggaaaagggcaaggaagcgccggcgccggacgacgccagccagttcggcccgcgcgatcccagcccgaagaacgactaccagctgtcccagggcctgaacgtgctgaaagtgcagcagatcctgcaaaaacgcgccgactgatcctccgcgcgcccattgcgacgccgccagcccagctggcggcgttttcgcatccacgccccgccgcggcgaaaacttcgcgcagcggcgccgccattgctgatattcttatcggttattcccaatcgagtggccggagtccgcccatatgctcacccgcgagtttgttctcaccttccgcgaagccgcgccctacatcaattcctaccgcggcaagaccttcgtgctggccatgggcggcgagagcctgcttgacggcgatttctccagcatggcccaggacatcaatctcttggtcagcctcggcgtgcgcatcgtgctggtgcacggcatccgcccgcagatcgaggcgctgttgaaacgccacggcatcgcgcggatgttccaccgcgaccgccgcgtcaccgacgccggcaccatggacgtggtcaagcaggccgccggcgccacccgccacgacgtggaggccaggctgtcgatgggcatgccgcattcgccgatgcacggcgcccacctgcgggtggccggcggcaacttcgtcaccgcccagcccctgggcgtgctggacggcgtggacatgcagtacaccggccaggtgcgccgcgtcgacgccgccgccatccgccagcggctggacgccggcgagctggtgctgctgaccccggtgggctactcgctgaccggcgaaagcttcaacctggcgatggaagagctggccacccacgccgccattgcgctgaaggcggaaaagctgattttcgtggtggaggggcgcggcgcggtggagcaggacggccagctgatcagctcgctcaccgcgctgcaggccgaacaattgctggaagcgggcagcctgccggaagacgtggccgcctacctgccctacgcgatccgcgccacccgcgaaggcattccgcgcgcccacttgatcagccgccacgaggacggcgcgctgctgctggagcacttcacccgcggcggcaacggcaccatgatcgcgcgcgacccgctggtgcgggtgcgcaacgccagcatcgacgacgtcggcgacatcctggccttgatccgcccgctggaagagcaaggcgtgctggtgcgccgcagccgcgagcggctggaggtggagataggcgagtactcggtgctggagcacgacggcaagatctacggctgcgtggcgatgcacccgttcccggaggcggaaaccgccgaactggcctgcctggcggtgtcgccggccaagcgcgacggcggcttcggcgaaatgctgctgcgccatgtcgaataccaggcccgcacccgcggcctgcagtcgctgttcgtgctcaccacccagacctcgcactggttcgtcgagcgcggcttcgccgaggccgacagaagctcgctgccgctggcgcgccagcagttctacaattaccagcgccgctccaaggtgtttgtaaagaagctgtaaccggcaacggccatgatgccgccacggttggaaggacgcgggctatgtgacaaaatagcccgttgaccccaaccagaattcaaaagcaaggatagagccatgagcagaaccgtcaattgcgtcaagctgggccgcgaagccgaaggcctcgacttcccgccgctgccgggcgagctgggcaagcgcgtgtacgaaagcgtttccaaggaagcctggcaaggctggctgcgctaccagaccatgctgatcaacgaaaaccgcctcagcctggccgacgcccgcgcgcgccagtacctggccgcgcagctggacgcttatttcttcggccagggcgccgacgccccggcaggctacaccccgccgcagaactaaacccccgccaagccctccaagcgagggctttattgtttccattcaccgtaattggctcgcacaccgttatgtcacaaccgcaagacttgctgctgaatcgcgaactgggactgatagaattcaaccgccgcgtgctggcccaggccgaagacgccaacctgccgctgctggaacgcttgaaattcctctgcatcgtctcctccaacctggacgaattcttcgaagtgcgcgtagcctggctgcaggacgccgcccacgccacgccggagcgcatcctggccgacggcagcaccccggagcaggcgctggccaaggtggcgcgcgccagccatcaactggtgaaagaccaatacgcggtgatgagcgaggtgctgttcccggcgctgcgcgaacagggcatcgtcttcctgcgccgcggcgagtggacgcagcagcaaaaggactgggtggaggcctttttcttccgcgagctgatgcccatcctgacgccgataggcctggacccgtcccaccccttccccaaggtgctgaacaagtcgctgaacttcacggtggagctggaaggccgcgacgccttcggccgcgcctccggcaccgccatcgtgcaggcgccgcgcatcctgccgcgcgtgatcaagctgccggccgaagtatgcgaaggccggccgcactgcttcgtgttcctgtcctccatcctgcactcgcacgtgcatgagctgttccccggcatgacggtgaagggctgctaccagttccgcgtcacccgcgacagcgaactgtcggtcgacgacgacgacttcaagaacctgcgcaccgcgctgcagggcgaattgcgccagcgccagttcggcgacgcggtgcggctggaaatcgccgacacctgcccgcagcacatggaatccttcctgctcacccagttcaatctgcagccgcgcgacgtctaccgcgtcaacggcccggtgaacctggtgcggctgatgcaggtgcccgacctggtggaccgcgccgatctgaaattcgcgccgttcagccccaccctgccgccgccgctgcagaaaaaagcgcagctgttcgaagccatccgcaagggcgacatcctgctgcaccacccgtaccagagcttccagccggtgatcgacttcctgaccctggccgccaccgacccgcacgtggtggcgatcaagatgacggtgtaccgcaccggcaccgactcggtgctgatggagtcgctgatcgccgccgcccgcgccggcaagcaagtgacggtggtggtggagctgatggcgcgtttcgacgaagaagccaacatcagctgggccagccggctggaagatgccggcgcccacgtggtgtacggcgtgatcggctacaaggtgcacgccaagatgctgatggtggtgcggcgcgaggagcgcggcctgcaccgctacgtgcacctgggcaccggcaactaccacccgcgcaccgcccgcctgtacaccgacttcggcctgttgacctgcaacgaggaaatcgccagcgacgtcaacgacatcttcgtccagctgaccggcctcggccgcgccggcagcctgaagcagctgttccaaagcccgttcacgctgcacagcatgatcatgcaggcgatagagcgcgaaaccgagcatgcccaggccggcaagccggcgcagatcatcgccaagatgaactcgctgctggagccgcaggtgatccacgcgctgtaccgcgccagccaggcgggcgtgaagatccagctgatcgtgcgcggcgtctgcgcgctgcgccccggcgtgccgggcctgtcggacaacatctcggtccgctccatcgtcggccgcttcctggaacacccgcgcgtgttctacttctacaacgaccacaaggaagacctgctgatgtccagcgccgactggatgagccgcaacttcttccgccgcatcgaaacctgcgtgcccatcatcgacggcaagctcaagcgccgcatcatcaaggaagcgctgcggctgtatctggaagacaacgtcaacagctgggacatgcagcccgacggcagctacaagcgccgcggcagccgcggcaagccgcactgcgcgcagcgccaattgctggagtcctactccgcccagccgcaggaagacaaataatggcgatggtgggctatctgctggccgtcgtcatgatgctggccggcctggctggcaccgtgctgccggccattcccggcctgcccttgctgttcggcggcatgctgctggcctcgtggctggacaatttccagcacctcggcgccatcagtctgaccatactcgcggtgctggcggcgctgggcctgctgatagacttcgtcgccggcctgctgggcgccaaggccaccggcgccagccgccaggcgctgtggggcgccttcatcggcagcctggtgggcatgttcttcggcgtggccggcgtgatcctggggccgctgctgggcgccatcatcggcgaattcatcgcccgcaaggatgcgttccaggccggcaaggtcggcatcggcaccatcatcggcttcatcgtcggcgcggtggccaaagtggcctgcgccttcgcgatgctggccaccgccgcgctggcgctggcgttttaaaccctggccatgcggatggctggcgcggccatcccggcaacggacgccaagtttttgctatgctgttgcgatcgatagcgtccgcccattccgccgaggacattcgccatgccgctgcagcacctgatctacgtcagcaccgcccgccaggaactgagccacgcggagcaagaagcgctgctggaatcctgtgtgcgccacaacctgcagaacgacatcagcggcgtgctgctgtatggccccggcaacttcatccaggtgctggaaggcgaagccgcagccgtcgccgaaacctaccagcgcatactggacgacccccgccaccataacctgatagaaatcctgctcgaagacatcgagcagcgcagcttttccaactggcgcatgggtttcacccggctggacgacgacaccatcagcaagcatcccggcttcatcgacgtctacggtccggatttcctgccccaacggctggcgcagcggccgacgctggcgatgaacatcctgctgagcttccgcgccaactgccgctgatcccctccccgcgcatcccggccgcagcaggggcgcggatttcgttataatcggcgcttagtcccatccaaccaatgtgaacgaatccatggcccaatacgtgatgtcgatgctccgcgtgagcaagatcgtcccgcccaagcgacaaatcatcaaggacatttcgctgtccttcttccccggcgccaagatcggcctcctgggcctgaacggcgcgggcaaatccaccgtgctgcgcatcatggccaacgtggacaaggaatacgacggcgaagtgcagcacctggccggcgtcaagatcggctacctggagcaagagcccaagctggacaacgacaagaccgtgcgcgaggaagtggaaagcggcatgggcgacgtgatgggcgcgcagaagcgcctggaagaagtgtacgccgcctacgccgagccggacgccgacttcgacgcgctggccgaagagcaagccaagctggaggccatcatctccgccggcgccggcgacaacgtggcgctgcagctggagctggccgccgacgcgctgcgcctgccgccgtgggacgccaagatcggcccgctgtccggcggcgagaagcgccgcgtggcgctgtgcaagctgttgctgtccaaacccgacatgctgctgctggacgagccgaccaaccacctggacgccgagtccgtggaatggctggagcagttcctggtgcgcttccccggcaccgtggtggccgtcacccacgaccgctacttcctcgacaacgccgccgaatggattctggagctggaccgcggcgaaggcatcccgtggaagggcaactactcgtcctggctggaacagaaggaagagcgcctggcgcaggaagccaagagcgaaggcgcccgcatgaaggcgatgaagcaggagctggaatgggtgcgccagaacccgaagggccgccaggccaaatccaaggcgcgcatcgcccgctttgaagaactgtccagctacgaaacccagaagcgcaacgaaacccaggaaatcttcatcccggtggccgaacgcctgggcaatgaagtgatcgaattcgacggcgtgtccaagggcttcggcgaccgcctgctgatcgacaacctgtcgttcaaggctccgccgggcgccatcgtcggcatcatcggccccaacggcgccggcaaatcgacgctgttcaagatgatagccggcaaagagcagccggacagcggcagcgtgaagatcggccaaaccgtgcagatggccttcgtcgagcagagccgcgaaggcctggacggcgacaagaccgtgttcgaagacgtggccgccggcgccgacatcctcaccgtcggccgcttcgagatgtccagccgcgcctacctcggccgcttcaacttcaagggcgccgaccagcagaagaaggtgggcatgctgtccggcggcgaacgcggccgcctgcacctggccaaaacgctgctgaagggcggcaacgtgctgctgctggacgaaccgtccaacgacctcgacgtggaaaccctgcgcgcgctggaagacgcgctgctggaatacgccggcaccgtgttcgtgatctcgcacgaccgctggttcctggaccgcatcgccacccacattctggcggcggaaggcgaatcgcaatggactttcttcgacggcaactaccaggagtacgaggccgacaagaagaaacgcctgggcgaggaaggcgccaagcccaagcgcatccgctacaagccgatcagccgctgatcggctgcctgcacgccattcagcccccgctccgcgggggctttttgctgagagctcaatccagatagcgggacatcaccttggccgccaccccctcatcgcgcaattgcttgagcgccgcgcccagccgctgcgcctcctcctccggcatgtgcttgccgcaagcgaggtagatgccggtttcctgcagccgcagaatctcgcgtatcggcgtcgcgctcacgccctgcttcttcaccagatagcgcgccaccgggctgtgcaccgcccaggcgtcggccacgcccaggctcaattcccgataggcgtcttccgtcgtcgccaactcggaaaaccccacctgatgcaaacgcagccactccgccatcgacgagcccagcaaggtcaccacccgcaaacccttcaggtcggccagcgtgcggatctgcgccttgctgccggcggcgacgaacaaggactgactgctgtcgtcgatcagccccacccagcggtattgcccttcgcgcttgggcgagcgggtcagcggcatcaggcagccgctttcctcgttcgtcacctgcagctgcgcccgtttccacggcaaatcgacaaactgtccccgcagcccggcgcgcgccagcgcctgcgacaccagctccaccgcgatgccatgcggcggactctgcggcgtgtcgcggatcacgaacggcggatagtccagcgtgtacagattgacgacatcccctgccggcgcggcccaggcctggcaggaaccaaaccaggccagcgccagcccaacccatttcatcattgctttccccatccgcgttcatccgccgccggctcggtcgcggctagacggtgatagaattccggccatgtatttgcgaaccctcattctttgtagcagcttatggctggcggcctgcgccacgccccgcgcggccgacgcccccgcccccgccggctattaccgggtgcagtccggcgacaccctgtaccgcatcgcccgcaagcaccggcaaagcgtcggcaacctggcgcgctggaaccagctgtcggacagctccaacatccaggccggccaattgctgcgcgtgcagccgccatccgccggcaaaaccgccggcaacgccagccgcccgccggccaaaccggcggaaaagccggcgccgccgccggcccggctcgacatcaagctgcagtggcctgcctccggcgcgctgatcgccggcttcgacggcaaccgcaacaagggcatagacatcgccggcaacgccggcgacaaggtgcaggccgccgcggccggcaaggtggcgtatgccggcaagggcatccgcgcctacggcaacctgctgatcatcaagcacagcgacgacacgctgaccgcttacgcccacaatcagcagctgctggtgaacgagggcgatcaggtgagcgcgggacaaaccatcgccaccatgggcgacaccggcgccaaccgggtcaagctgcacttcgagctgcggctgcgcggccaggcggtggacccggcgccctatctgccgccgcgctgatccgcgccgccgacgatttcgccctgctcgaaaccataatgaaatgaaacgcacctcgctcctgttgctcgccgcgctgctgtccgcctgcgccggcccgcggccgcaacccgcgccggcgcccatcgcctcggcgcccgccgtacagctgccgcccgaaaccgcctcgcccaccccggcggcgcccgcctccaatccggtgccgcaagcgccgccagccaaggctgcgcccgcgtcccgcgagctcatcgcccgcgccgtgccgccgcaagcgcgcgaccgccagggctggatcgccgacatcgacgccgccttgcgccacctgcggattccggccagcgccgacaatgtctgcgcgctggccgcggtgatagaacaggaatccagctggcaggccgacccggtggtgcccggcctgcccggcatcgtctggggcaagatagaagaaaaggcgcaccgttacctggtgccgctgtcggtggtgaaaaccgcgctgctgaagggctcgcccaacggccagagctataaagcccggatagacaatctgcgcaccgagcgcgagatgaacctgttgttcgaggacatggcgcgcgaagccggcaagatgggcctgcccgacatgaaaaacccgatccgcaccggcgggccgatgcaggtcagtgtggagttcgccgaggcccacgccaaagtctggccctatccctacccgcacagcgacagcatccgccaccaggtattcagccgccgcggcggcgtctacttcggcgccgccatcctgctgcaatatccggcgccttaccaggacatgctgtaccgcttcgccgacttcaacgccggccgctacagcagccgcaacgccgccttccaggccgcgctgtcccgcctgtccggccgcaagctggcgctggacggcgacctgctgaactaccagggccaaaccgcctccggcagccagcaggcggcgctttcgctgtcggggcggctggccatgggcgccgccgccatccagcgcgatcttcggcaggaaaagagcgtcggcttcggccagacccagctttaccgccaggttttcgcgctggccgaccaacaggccggccgcccgctgccgcgcgcggccatgccgcagatcgacctgaaaagccccaagatcagccgcaaactcaccaccgaatggttcgccaatcgggtggacggccgctaccggcgctgcttggtactattgcggcaaaccccggccccgtgatgccaaacgcttgatcccgctttataattgccaatgcgaacggccggactttccggccgttctcgcattccagaacagcgggaaaaccgcaaaaataatcaggtaattgcacatgcgttcaactttttcctatttccgcggctcgctggccttcagcgtggccgtgctggccatcgtcgcctggtatggacacgcccagggcggcgtcgaacaggccggcgccttcctggtcaccgccgcggtgctggcggtgctggaaaccagcgtttccttcgacaacgcggtggtcaacgccaccgtgctcaaggcgatgagtccgcgctggcggcagatcttcatgaccgtcggcatcgcggtggcggtattcggcatgcgcatactgttcccgctgctgatcgtgtcgactgccggcggcgtgtcgctggcggaggccttcgcggtggctaccaagcagccggagcgctaccagcagatcatgcacgacagccacctgatgatcatgggcttcggcgccaccttcctgctgatggtggtgatcgaatacttcgtccagcatgagaaggatgagcactgggtgccgggcatcgagccgctgctggccaggctgggcagcgtggaaaacgcgcagtcgctggtcactatcctggtggtggccgccatcgccgcgctgctgcccgccggccagaaaatgccgttcatcagcagctgcttctggggctatgtggtgttcatggcgctgcatatgttcaagcagctgttcggcgggatggatatccagaccgccgccgccaagaacggcctgatcggcttcgtctacctggaagtgctggacgccagtttctcgatggacggcgtgatcgccgccttcgcgatcaccaacgatttctggctgatcgccgccggcctgggcatcggcgcgatgttcgtgcgctcgctgacgctttacctggtggagcgcaatgtgatgagccagttcaaatacctggaagtgtcggcgttctgggcgatcgccgcgctggtggccatcatgtatgccgccgcgctgcatgtcgaactgggggaagtgacgaccggcctgatcagcgtcgccatcatcgcgctgggcatcctgaccagcctgccctcgcgcggcaagccctgagcgccgcccgacaaacagcaaggccgggtttcgccggccttgtttttcccacgctccccaaagcctggcttcaggccgaggtgctcagcagcgcccccacgccggcgctgctgccaaattgattctgctgcagattattggtcaggttttgcaggaaggactgcagcgacgattgcgacgattgcccgctgccgccgattcccaaagcctgctgcagattctggaaggcgctgctcaaggtcgaggtggcgctgttctgggtgccgttggcgatgtcctgcaacaactgctgcagattgttctgcagattgccgtagccgccgctgccggatgccgccgtcgtggcgtcgccggactggtcgctgctgccggcctcgctgctgccgctctggctgccggatgccgctccctcctgctgcaaagcctggaacaaggaatggatgaaagcatgcacggcctgctgctgcgttcctcccgtcgcatccaccgcgccggtcgagccggaatctccatccgaggacgagtccgtcccgctgctggaggagccagactgcagcagccccgattgctgcaaggcctgcagcacgctttgggtcaactcgccgccgccgccatgatgatggtgtccgccgccgcccgttccctgaaccgcgccgccgccggaagattgcccctgatccgacgaaaagctttcctggatatccacctgcgtgtactgcaaagagattgagctgttgcccagagatccgaccgacatgatgctctccttaaagaactgatccatccgtctcagcatgcgctgatatcggtatatcggctttccggcgcctagacaaatggacaagctgtaaatttatgttaattaaggaaaattcagccaatctacccgccaaaaacgctacaaccggcccggattccggacgcgccgcgcggcgctggtttcagtatagcctgggtgtcggcggggttcaggcgctggtattgagcagcgagccgacgccgccggccgacagcgcctggtcgttctgcaaggtgagcaggttttgcagaaaagtatgcagcgacgcctgttgcgacccgccggtcccgttgccgctgcccaaggactgctgcaaatccttgaacgccgaggccaggctggtggtggcgccgttctggctgccgttgctcacatcctgcagcagcttctgcagattgctctggaaatcgccgtagccgctggacgccggcccctggccggcgccggcggtgctgctggacagcccttcggcctgcaccgcctggtacaccgcgtggacgaaagtatgcagcgcctgctggacattgctgccggcgctgcccgacagcgcgcctatcgcattgttttgcgggccggcgtcgcctgtgcgctcgccggcgttgttgtagttgccggcggcggcaagattaaggcctgactgctgcagcgccagcgccacttcctgcccgaaaccgccgtccggtccattgtcctggcggcgcgaggcggctgcctgcccctggttgccggacggcgccagcacgccgggagcggtggcgggaacatattgcggggcaatggaataactgccagtcacagacccaagcgacatcgcattctccttgcgcagcttgcaaacccgctaactgtggcttcgcccggcaagcggcatgccgctgggcgaaaaaatggcaaatgccagcacacatgcaaaatgatgggccgcgcatggaaatgacatggcggacaatccactataggcgggaaaaaaatgcgtcaaggccggaaaacagcgcagatgtcggacgggtgccgcaaaaagagcggcacccggggggatttaagtagaaaccacaagccggcgtcagcgccccaaacgcaatagcaggcccgccgccagcagcgtgcccagcatcgccacgccataggtcaaggctttggcggccggcccgccatgcacgccgatatcgtgcaggctgtggtagatgcggtgcgccgcgtgccacaacagcaagctgaccagcccccacagcgccgccttgcccaccagactctgcgccagggctagcgcgccctggtagctggccgccttggccggcagccagcccagcggcgcggcgaaaccggtgatccacaccagcatcggcccgaacaaggccgccagcatgccgccggcgccgaacagcccccagaagatgggcgcgtgggaacgcttcagttgtcgcttgctcattgcgagatcccccatgcgatgcccagcaaggccaggctggcgagcagcgcggcgatgaagccgccggcggtgatggcggcggcggagacgcgcttgccgccgatgatcagcggcggcaaggtgcgcggcatgatcttgaaccaggtgtagctgtggtagccgatcatcaagaacagaatcaggtggcacaacacagaccaggggctgcgcagcgccgcgatgaagccgttccatgccgcctcgccctggctcagccgccacaggccgaacagcagcgcaaaagcgtaagcggcgacgaacagcgccgtgccctcgtggaccatgtactcgatgaagtacgggctcttccgccaccagccgcccatgggccgtacataaggtcgacgcttgttcatttgcacgctcccttgggacgcgcgaaccgcaggaaataatccttggccaccgccgtcttgttcaggttcaccgcgttggccggatccaccgccttcggacagacttccgagcaataaccgaccgcggtgcagttgaacacgccctcctgcgccgccagcagctccatcctttgctcggatgcgccgtcgcggctgtcctggttgtagcggtgcagcagcgcgatggcgccggggccgaggaagtccggattcagaccgtactgcggacaggcggcgtagcacagcaggcagttgatgcagccgctgaactgggcgtaccagtccatctgcgccggcgtctgcttgtattccccctcggacaagggcttgttttccttgggcacgatatagggcgtgatgctttcgagtttctcgatgaaatcgtccagcaccaccactaggtcgcgctcgatgggaaaatgatgcaacgcctctattctcaccctgcccgggtagtcgcgcaggaaggtcttgcaggcgagcttgggcacgccgtccaccatcatgccgcagctgccgcagatggcctggcggcaggaccagcgaaacgccagcgtgccatcgaggtaatcgcggatgtattgcaggccctgcagcaccgacatgtcgtcgctgtacggcacctcgaagctttgcggccacggctcgccgtcctgttccggccggtagcgcatcacttcgatgatcatcgtcttgtccgtcatgccgtctctccccgctccgcggccgcgcccgccgcgccgtaagcgcgcacgccgggcggcgacgtggtgatcttgaccgcgccgtaagcgatgcgcggcgcggcgtcaggctgatggatggccaggctgtgcttgaggaagttggcgtcatcgcgttgctcatagccgtccagccgctggtgggcgccgcgcgattccttgcgctgcaacgccgaatgcgcgatcgcctcggccacgtccagctggtagcccagttcgatggccagcagccagtcgctgttccacacgctggatttgtcctcgacgttcaggtagtggaagcgctgcttcaaatcagccagcttgtcgcaggcggcttgcatgccggccgcggtgcggtaaatgccgcagccttgctccatcgcctgcgccatttcgccgcggatgtcggcgatgcgctccgagccctggcggtcgcgcagcgccagcagccgcgcctcggccgccctggcctgttcgagcaaaacgccgcgcccggccggcgggttgtcgcgggcgaaacgcgcggcggcctcccccgccgccttgccgaacaccgccagttcggccagcgagttggaacccagccgattggcgccgtggatgccgacgctggaacactcgccgacggcgtaaagccccggcagcggcgacgcgcagctgccgtccaccaggatgccgcccatggtgtagtggacggccggacgcaccgggataggcgcctgcgcgggatcgatgccgaggaactcctcggccagctcgcagatctgcggcaagcgctcgcgcagcttgtcatggcccaggtggcgcaggtccagatacaccgcctcgccccatggcccctgcgccgcgcggcccttctgctgctcatgccaaaaggcctggctcagccgatcgcgcgggcccagctccatgaacttgttgcgcggcttgtcttccgccggccccaggccgtagtcctgcaggtagcggtagccgtccttgttgatcaacacccctccctcgccgcggcaggcctcggtgaacagcaggccggtgcgcggcatgcaggtcgggtggtactggacgaattccatgtcgcgcaaaggcacgccgtggcggtaggccaaggccatgccgtcgccggtgacgatgccgccgttggtgttctcgcggaacacccggccggcgccgccggtggccatcaccaccgcgccggtctcgatcagcaagctttcgccgctggcgatctcgatggccagcacgccgcgcgcctggccgtcctcgacgatcaggtcggcgcagaagtattcgtcgaaacgctgaatctgcggaaactggatggaggtctggaacagcgtgtgcagcatgtggaagccggtcttgtcggcggcgaaccaggtgcgctctatcttcatgccgccgaaggcgcgcacgttgacgctgccgtcttccttgcggctccacggacagccccagtgctccagctgcaccatttcctgcggacactggcggacgaaatactccaccacgtcctgttcgcacagccagtcgccgccggccacggtgtcgtggaagtgggcgtcgaagctgtcgtgctcctgcttgaccgccgccgagcccccctccgccgccaccgtgtggctgcgcatcggatacaccttggacaccagcgcgatcttgagtccgggatcggcctgagccgcggcgatcgccgagcgcaatccggcgccgccggcgccgacgatcgcaatgtcggcctggtaggttttcatctgctgcctcctgctggaatcgaaacgtttccggcaggctaggcgaggatggcgaggaggttctagaccttggtcaagcggcggcgactcatctcctggcggcgagcccgcgccatgactccggtcaagcgcccgccaaacaaaacccgcgccaatggggcgcgggtttgaagtgagaaacggcggcggatcagatgcggtagctgctgccggtcatcaccttggccgacagcttcatcgccgccttcaagggcgccggcaattccgccgcgcccagctcatgcgccatctcggcatgctgcagctcgtcgtcgcgcatctggctgacgatggcgcggcttctggcgtcgtcgtcgggcagcgcactcaggtggctgtccaggtgcgcgccgacctggcgctcggtttcctgcaaaaagcccaggttccatttgtcgcccagcacgccggccgccacccccagcgccagcgagccggtataccacagcgggttgagcaggctgggacggccgcccaactcgcggatgcggcgctcggtccaggccaggtgctccacctcctcctgcgccgcctgccgcagcgcctcgcgcgcggacgggtcgcgcgcggtcagcgcctggccctggtacaaggcctgcgcgcacacttcgccgcaatggttgacccgcatcagccccagcgcgtggcgcttgtcggccgcgctcaagtcggcctcggaaatatcctggtccggatgcgcgcgcgcgctgtgcgccggcgcgcacaatgtgcgcaggcccttgtccagttccacgatcaatttgtccagcatcggcatgcttccttgcgcgtccatccttgaagaaggcgattataccttcgcggcacatccaggacagctgctgatataatcgccgggtcaagcaataccgttcaacaactctcaaggattccactccatgaatctcgccagcatcggcccgggcaaagacatgccgggcgacttcaacgtcgtcatcgaaatctccgccaacgccgctccgatcaaatacgaattcgacaaggactggaacacgctggtagtggaccgtttcatgggcacctccatgatgtacccggccaactacggcttcgtgccgcaaaccctggccggcgacggcgacccggtggacgtgctggtggtcaccccgttcccgctgccgccgggcgtggtggtgcgctgtcgcgcgctgggcctgatcaagatggaagacgacggcggcgtggacgccaagctggtcgccgtgccggtggaaaagctgtgcccgatgtacaagtccatccagaagctggaagacctgccggaactgctgcgccagcagatggtgcacttcttcgagcactacaaggatctggaaaagggcaaatgggtcaagatccagggctggggcacgctggaagacgccaagaccgaactggtggaaggcatcgctcgcttcggcaaataagccgccgctccgagcccaagccggccctatggccggtttttttgcgcccgccgaatgctgcattgcacaatccgcctgttgcgcgggataatggtttgccgtatttccccgcatctgccacgcttctaacaggaaccatgccgcgccaagcggccccaccggcatagacatggctgtttcgtatcgcatctcgggacatgctccccatcttccctggttcttgcgccggctagcggcgcgaggactgccggccgcgtccgccagcggcccggcggcgtggcctgccgactggatcggcatcgcgctggaagacggctggctggacctcggccgggacggcgacgccgcgctggcgcgccgccagcgacaatgcgaggacgccggcttcgccttcatcgaactgggcggcgactggcaggctccggccgccgaacatggcttcatgctgctggccggcagccggcagccgcctgcgggagagacgctgaccctgctggacgcgctggcgccgcaagccggctgctggctgcattgcggcccggcgcacagcgcccgcttctgccagcgggtgttcgccgcgctgttgcacgccggccgcgccgcgctgcccttgcccgacgcccagccgcgcgcgctgcaatgggaagaaatgctgtccagccagtggcaattggcggacaagctgcgccagctcgccgatgcttacctgatcgaacatctgggccagcgcccgccctacccgtcgccgctgccggacgaggcgcggcatttcgccgccaacctagcccgcgccatcgcgctggcgctgccggacagccaggactggccggccctgctggagaaactggccgccgccctggccgcctgccggccggccggcaaatgaaaacccgcccggcggcttgcgccgcgggcgggtttcgcgctcgagccagagcgaaaagcggaatcaggccgcgctggtggtggttttcttgcggctgacggcggcgctggcggccttggccgaattggtggcggcttcgacgccggcttcggcgatctcggcgctaaccttcttggcggtcttggacacgctttcgaaagcggcggtcgaggtgttcagcagggtcttcagcgcggcgacggcgatgtcggaaccagccggagcgctcttggacaggcgatccaggctggtttgcagcgccttgctgttttcggcgatctgctcttcgacgaagctggacagctcgttctgggtaagcagcgcggcgtcgtagacgttgcgggcggcggagaaagcctgatccagcgccggctgcgccaggccgctttgcaggtcgctcagcgacttggcgtccttgacttcgctcagcgccttgaacgcttcggcgttgtcggacagcagcttgcgggacaggtccagctgcaggctggcgaagcgttcggcgccggccagcacgatggaggacaaacggacagccttgtcgaactgtgactgaccgagggcagagaattcctgggtggtggtaaacatgtattcagctcctagaatgtcgggtagacaacgactcagtgatacagcaacaaaactgttgttccgcgcgatgttgcatcgcaacaatcatactgtagcgcgccgaggatggcccggtcaaggaaatgttgcgccgcacaataaactaagcggctattttgacacgagttttaccacagcaaaattccattatcattacacggaacgccagtgacgccacccgcccgtccggacagtccattttgcgccgcaacagtccgctgttgcttgggcgactcaccttccccgcccgcccgccgcgccaaagcctcatcggccccggccgccgtctcgccgccattgaaagcccgccgtcaagccagtacactcgcgccatagaagaaatctatctacatataaaagctaccccatgagccctgtggccaacgcctttgatatcaaatccgccagccttgacctgctggcgatcctgctgcgcaccgacaacctggatgagttgggccaggcgctggacgcgcgcttcggcaacaccagcggcgcgccggccgaagccttcgtgctcgatgtggaagcgctgcccaatccggccgagctggatctgggccgcctgctgccgctgctcagccgccgcggcatccgcgcggtggcgctgcgccacccggacaacgcgctggcggcggtggccagccagttcggcctggctttcgccagcagcgccgccttgccgcgttcggcgcaagcgccgcaggaacctgcggccaagcccgccgtcgaacctgctgctgcgcccgccggcgcgatgatcgtcgaccgcccggtgcgggccggccagcagatttacgccaagggctgcgacctgatcgtgctggcgatggtcagcgccggcgccgaagtcatcgccgacggcaacatccatgtatacgccccgctgcgcggccgggcgctggcgggcgcgcgcggcaacgccgccgcgcgcatcttcacccgcagcatggaggccgaactggtatccatcgccggggtgtaccgcaccatcgaacaggcgctgcccgacagcatcctaggcaagccctcccagatctatcttgagaacgagcgcctggtgatggccgcgctcggcgagtaacacatttttccaaaggaaagccccgtggcaaaaatcatcgttgtgacatccggcaagggtggcgtaggcaaaaccaccaccagcgcgagcttcgcctccggcctggcactgcgcggccacaagactgccgtgatcgacttcgacgtcggcctgcgcaacctcgacctgatcatgggttgcgagcggcgcgtggtctacgacctgatcaacgtcgtcaacggcgaggccagcctcaaccaggcgctgatcaaggacaagaactgcgacaacctgttcatcatcccggcctcgcaaacccgcgacaaggacgcgctgacgctggacggcgtggaaaaagtgctgaaagagctggccgacaacggcttcgaatacatcgtctgcgactccccggccggcatcgagaagggcgcgctgatggcgctgtacttcgccgacgaggcgctgatcgtcaccaacccggaagtgtcgtcggtgcgcgactccgaccgcatcctgggcatcctgtcgtccaagtccaagcgcgccgaggaaggccgcgaggcggtgaaggagcacctgctgatcacccgctacgcgccgggccgcgtcgacaagggcgagatgctgtcggtggacgacgtcaaggaaatcctgcgagtgccgctcctgggcgtcattccggaatcgccgagcgtgctgcaagcctccaactccggcacgccggccatccatctgaagggttctgacgtggccgacgcctattccgacgtggtggcgcgtttcctgggcgaacaacgcccgatgcgcttcctggacgcccccaaggtgggcatcctcaagcgcctgtttggaggttaagccatgtccttgatcgatatgattttcggcaagcgccagaagtccgccgccatcgcccgcgaacgcctgcagatcatcctggcccacgaacgcaacggccgcgatgcccccgactatctgcccgcgctgcagcgcgagctgatggaggtgatctccaaatatgtcgcggtcaacctggaagacatcaaggtgcaggtggagcgccaggacgactacgaagtcctggaagtcaacatcgtgctgccggaacaccaacgctaagccatgacgctgaccgaactgcgctacatcgtggcggtggcgcgcgagcgccacttcggccgcgcggcacagagctgcttcgtcagccagccgacgctgtcgatcgccatcaagaagctggaagacgagctgggcatcaccctgtttgaacgcggcggccaggaagtggcggtcaccgaaatcggcgaacgcatcatcgagcagtcgcagcgcgtgctggaagaggccgaggcggtgaagcggctggccggcgaacaccagaacgagctggccgggccgctgaagctgggggtgatcttcaccatcagtccctacctgctgcccaagctgattccggcgctgcgcatcctggcgccggacatgccgctgatcctggaggagaactacacctcccggctggcggaaatgctcaagcgcggcgaggtcgacgccatcatcgtcgccgatcctttcgaggaaaccggcatcgaagcctggccgctgtacgacgagcccttcgtcgtcgccacccccaagggccacccctgggaaaagcagccgcaggtcgacgcctgccagctggccgaggagagcgtactgctgctcacccagggcaactgcttccgcgaccaggtgctgcaagcctgcagcgaattgtccagccgccagcacttcggccacaatctggccagcacgctgcagggcagctcgctcaacaccatacgccacatggtggccagcggcatgggcgtcaccgtgatgccggccacctcggtcggccccggcgacgaaacgctgctgtcggtggtgccgttcagccagccggcgccgcagcggcgcgtgctgctggtgacgcgcaagcagttcttccgcaaaaaggcgatcgacaccctgcagcaggcggtgttccgctccggcctgcccggcgtcgtcatgctggagggcgagcccaagctgcagtgactggcgcagtcgccatcacgcccgctcccgcgccggttctgccgccgcgggatttttttcaccatcaggaaacggcagggcaaggctatgaacgaactggccagcatagaactgaaagccttcctctccgcccgcggcttcaagctgtcgcaggccttctaccgcgacatcggcttctaaatgaagccggacagccacggcgccgcctgcttcgtccccggccattgcggcttgctgctgcaggactatcaccatccggaattcgccgccaactgcatgatgcatctgctggtggaaaacgccgccgcctgacgcgccgcgacatcgccacacgttaccggaccgacatcggcgcattgacggagcagccgtgacggatgcgggacttcacgctgaccgccccgttccgcgcgctgtggcgcatcgcacagaatctgccacgcaacgcggaccgacatatgcggcgcgctctccgcctgccaaggagtttgtgagcccacgctcgggaaactatccttcagggaggacaaagcctaggcgcaaggactctccctcccatgcagaaaccggacaacccgagcaatgaaaccgagcgcatcgcggcgctgcatgcgctgaacatcctcgatacgccgcctgaagagcgctttgaccgcatcgcgcggctcgcccagcacatcatgcaggtccccatcgccctggtcagcttcgtcgacgcgggccgtcagtggttcaaatctcatcagggactggatgccaagcaaaccggccgcgacatttccttctgcgggcacgccattttgggcgacgacgttctttgcgtggccgacacccagctggacccgcgcttctccgacaacccgctcgtcaccggcaatcctcatatccgcttctatgcaggcgctccgctggacattggcggcggcgtgcgcctgggcacgctgtgcgcgatcgatcgcatgccgcacacacccagtccggagcagttggcggctctgcgggatctggccgccagcaccgtcgacatgatgctgatgcaacctgccgccgacctcatcaaacagctgcatgattccgacacgcgcctgcgcgccgtgctggacaccgtgatagacggcatcatcacgctggacgcccatggcgtcatggaaagcaccaacccggcggcatgccgcatttttggctatgccgccagcgagctggccggccggagtctagacatgctgatagcggacccctgccaaagcatggccggcggcatgcctggcatggcgggagccttgccgctccttgaacatggaaaagaagtcaccggcctgcaccgcaacggcgccacttttccgctggaactctccatcagcgaaatgcacctgcaaggaagctgcatgttcgtcgcggtggccagagacatttccgaacgcaaaaaagtggaacgcatcaagaacgaattcatttccaccatcagccacgaactgcgcaccccgctgacctcgattcatggcggcttggtcctggccctgaacggcggcgacgaaacgctctctcccaggaccaggcaactgctggaaatcgccagcagcaactgcgcccggctgaccgcgctggccaatgacatactggacctgaaaaaaatagaggccggccacctggagttcacctttgaaaaggtcgatttgtccgccttggtcaagcagtcgatcaaggccaacgaggcctatgcccatcaaagcggcgtcagtctccaagctttaaatgccttgagccaatcctacgtcataggcgacccgaaccggctgatgcaagccatttccaatctgctgtccaatgccgtcaaattctctccagtcgatggcatcgtggaaatctccatccataaaatccaggacagataccgggtggcgatacacgacgagggaagaggtattccagaaagtttccgcagtgaaatcttcaatcgcttcgcccaagcggataaatccgacaccagagaaaagagcggcgccgggctgggcctgaacattaccaaagccatcatagagcgccaccatggcctattggattacgagagcaccatgggcacaggcaccacattccatttcgatcttcccgccgccaccgcgctggttgccgccaagccatcccgtctgctgatatgcaagcgcgaggaaagcgaaaccgaagccttgcgcgcctcgcttgatgagcaaggcgtcgagagcgacggcgcctatcggggacacattgcgctcgatttgctgcggcacaccgcctaccaggccgtcttgatcgacctgccccaccatgaaagcctggccatgattgaggctatcctcagcatgcggggactgaatgcgccagcgctggttctgcccgatgaaagaaaaacggactatctggaatcgatccagacggagggcctggccattcactggtttccccggcatgcgactttggccgcattggaaaaaaccatattatccgcaataaaccatgcataaagccctcttccgcactcagcctttcagatgagcgcggcggatgcgccgccgggccgattgcctgttacaggagccgccatgtcatcaagaaaaatacagctgatgttcatcgacgacgaccaggatattcgaagcatcttcgcattcgcgttcgagcaggaacaggacatggaaatcaagctgtgcgcatcgagcatcgacgccatctcctgggccgaggcctcgccgcccgacattatcgtgttggacgtgatgatgccggaaatggatggtcccaacacgttcagccgtttgaaagccatcccggcgctcgcgctgacgcccatcatttttctgacggcgaaagtacagaaacaggaaatcgaaagactcaaagcgctgggcgcaacggccgtgatagaaaaaccgttcaatccgctggagctgcccggcctgatccgctcgctcgcgccggaaatcggctagaacaagctttgatcggcggcggcgacgccaggcgcgccgggcctgcagccggcgaaacagccagaaaatccgctcccacgcagagggaaaatgatgaatgacgattttgtcgccgtaatcgacgacgacgacgcgctgcgggaaatgctatgcctgatgctgggcagcataaaaattccggtgatcggctatcccgatgggcgatcgttcatggaggacgccaagcggcatcaatgcgcttgcgtcgtcctggacatgcgcatgccgggcatgagcgggctggacctgcagcggcagatccgcagtgaaacgctggacatgccggtgatcttcatgacggcgcatgcggatatccgggtggtggtggacgccatgcgggatggcgcgttggagttcctgcaaaaacccatccaagggcaggagttgctggactgcgttcaacaatgcttgcaaacgctgccgcagcggaaacagaaagtccgcgaaaaagaagtctttcaggccagattggcgaatctcacgccgcgcgaaaaacaagtcctcgatgaaatcgcctccggcatgagcagcaagcaaatcgccgataagctgggcgtgacgctcaataccgcagagcagtatcgcagcagcgtcttgaagaaaatgcgcgcgtcctccacggccaaattgctgagcagcatggagctgtggcagcgcaagaccgccggcaagcgagagtaagcgtatgccccacgcagaatcaggcgatgcgcggcgaaaggaaagacatggatgccgccgaaacgcaaaaacggatgcaggcattgcgcgcgcaatatcaggaccgcttgctccgccaactggacgagatgcaagctctggcagcccaactgaacggcgaggccgccgatcaagctgtgtattccgtcttgcgggaacgtctgcacaagctcgccggctccggcggcacctttggccaaccggagctggggcggcgctgccggagcctggaatgcctgctcgatggctggctggccgcggacgcgccgcccattgacgcgggcatgcggcggcagtttctggccgatctggcggccctggccgcgctaacataagccgcgcctgcttgctgggcaggaacgcgctcatgccgtcaacgccacagacgcgtttctttgtctttgctgcacgtcccgcgccaccacgccctgaatcaactggacgacgtctatgatcagggcgacctcgccgtcgccgagtatcgtcgaaccggtcacgcagggcacatgctggaacagggcacccagcggcttgatgacggtttggcacttgccgtaaatcctgtccaccaccaggccgatgcgcttgcccgcaaaactgacggtcaccacgcgcggccgcggatgagccgggccgcgctcgccaaacagctcacgcaagcgcacgaagggcaaggcggcgccgtctttgtccatataatccacatcgccttggcactgcggcagctccagacactccaccaccatgtccagcggcacgatgaactgcgcgccgcccactcccacatggaaaccgtcgatgatggccagcgtaagcggcaggcacagccgcatcgtggtgccacggcccggttcggactcgattaccaacgagccgcgcagcgcttcgatatggctcttcacgacgtccatgcccacgccgcggcccgacagattggtgacacgctccgccgtggagaagccgggcgccaggatcaactgatggatgtcgtggcgcgacagattcgcgccatccgccacgatgcccttctctatcgccttgcgcagaatcttctcgtgatccaagccgccgccgtcatccgccacctcgatcatgatggcaccggactcgtggtaggccttcagcgtgacggtgccttgcatgggcttgccgcgggcgatgcgcgtctccgccggttcgatgccgtgatccatggcattgcgcagcagatgcatcaacggatctgcgattttctccaccatggatttgtccagttccgcctccgcgccggagatgcgcagttctatctctttgcccagttctttcgccacgtcgcgcaccacgcgcggaaagcggtaaaagacctctcctacggccaccatgcgcagctgcagcgccatgtcgcgcacggcctccaccagcgtcaacaattgggaagccgcctccagcatggccggatgggcggctttggcggcctgcgcctgattgcccgcgccggcgatgaccagttcgcccactcggtcgatcaaggcatccagccggcaggccggcactttgacgctgccgccctcagccggccgccgctcctcttcgcgcttgggcttgggcttgggctgcgcctcctcgcccacgccccttggctcgaccggcaatgcttcgccgcccccgtgcggcagaaccagcaaccggtacaactcgtcggacgtcaaggttccgcaggccaccaggatttcgcccacgcggccggaggcttccggcaaggcttggatcaagcgctgaaacgcgggcagcgggctgtgcggcggcaggatgacgatgctcgcgctttcagcgcagaaggcgaatacgctggcgatctcctccgcgctggcggcgctgtccaaaaccacctcgaaacccagatagcactgctgcgggtctgccgcctccagcggcggcaggtggtcgcaaaccgtttccacatgctggacgcggccgtagcggttcagataattgatgaatttgagcggatccatgccatcgcagagaatggacggagaaaagcgcagagacagatgccagaacggcgacgccaccccttgctcatccccggtcgcctcctgctgcggaagcgcttcgctcgcggacgcggcgggcggtgcctcctgccccagccaacgcgacagctgcggaatcagcgcgtcgctgcgcgcgcggtccgcctcgcctccgtccgttgcggcggcgatcagcccggagatgtgatcctggcaatccagcagcacgctggccagatcggaatcaaacgcaaaagcgccgttacgcaactcatccagcacgctttccaccacgtgggtgaagcgcaccacctcctccagaccgaacatgccggccgagcccttgatggtatgcgcgcaacggaacagcgcgggcagatcgtcgccatccgcgctgccggcctccaagcgcagcaatatgtcttccatctggccgatcaggtcccgcgcctcgtctatgaaaacagcgaacgcggcggacagggtatcgttttccatatcgaactcaccttgtgtagtgacgaccagcggcgcggtcaagccagccctcgcccacagcgtcgggctgcttgagcaaagcttcctgattcaccagcctggccatttcccgcaccggctcagacgcgttgcagaagctcacgctcttggcggcgtggagcttcatctgcaacagcaactgcagcccggcggtatcgatttccgtgacgccggccaaatccatgcagatgccgtcggcagcctgcaacagattcagccaaaccgcctgcaccgcatgggcggtatagacgcccaattcgccccgaaacagatgccggccggtttcttcatcgaagtccaaggagaagtccatgctcagctcgccagcaactcaaccgcagccagcatttgcttgggctgaaacggcttgaccatccaggccttggcgccggcggactggcccgcctgtttcttgtcctccgccacctcggtcgtcagcatgatcaccggcgcgcacttgtatgctggatttttcttgagctcctggacaaaagtgagtccgtccatattgggcatgttcacatccgaaatcaccaggctgatgcgctgccccttcaatttcgacaaagcgtcggcgccgtcgcaggcctccatcacttcatagccggcatcggtcagcgtcatcgccaccaaggaccgcaaagacgcggagtcatccaccaccagtataagttttgccatggcattgccctcccaggcctgtcagcctcaagccggatcggcttgaggcagtttctcctcgcccatcctcgtcaccgcggatatttccgctatcgacaaggcgcgcgccatgttcagaatgatcaggaaacgattgtcatggcgcgccaggccggcgatgaagtccacgtcgatttgcgcgccaaaagccggcggcggctcaatgtccgcatcgtcgatttccaccaccgccgtcacgcgatccaccagcaaaccgatcacgtgcaatgcgcccccatgctccacctccacgatcacatagcagctgcgacggctcacgacgatagggtggtggccgaagcgcacagccagatcgaggaccggcaccaccgcgccgcgcagattgatgacgccgcacacggcgagcggcatcatgggcaccgccgttggcacgtcgtattcgatgatttcccggatccgctcgatctcgatggagtaggcattcccccccaggctgaaggcaagatagagcttgccgacgctggattcgtgttgcgcggcgccgattgccggattcgggttgctcgcttgattgtccgccatgcatttctccccggcaggcagggaccgcgctcggcaagcgcgtcctgcccgcctgatccattacgccgcggcggatgccgcgggctttcatgcgtaggagcgcccgccgcttctcatcagggccatggtgtcgcgcatggcgttgccgtgcgattcgcgcagctcgaactgactcatcagattgcgcagcagctcggcctgttcggccaccgtctgcgcggtcgccgccagttcttccgatgccgacgcggtttgctgcgtagtcaagttcagctggttcatcgcctcgttgatctggttcgtgcctatgctctgttcgttggacgccgccgtgatctcacgcaccagatccgccgtcctgttgatagacggcagcatttcggacaacagctggcccgcctgctcggccgtctgtacgctgttggcagccagaccgctgatctcctgcgccgcgatctggctacgttcggccagttttctaacttcagccgccaccacggcgaagcccttgccgtgttcgcccgcccgcgcggcttcgattgcagcgttcagcgccaacaggtccgtccggtaggcaatgtcgtcgataatgcctatcttgtccgcgatggcgcgcatcgccttcacggtctcgtccaccgcgtctccgccgcgcatcgcatccttggcggactgggtggcgatgccatcagtcactaccgcgttatcggtgttctgcgcgatggagactgacatttcctccatggaggacgtggtctgctccaggctggcggcctgctcggtcgcgttctgcgacagcgcctgcgacgcgctgttcacctgattcagtgcgctggatatctcctctatcgcctcgctcacctggcgtatggtctgggccaattggtccacgctggtattgacggagcgcttgagctgatcgaaatctcccgcatactgtccttccactaggcaagtcagattgccgaccgccagggactccattacccgcatcacttctttcaccggccccgccatgccgtccagcgtcttgttgatgccttcgacgattttgcggaaatcgccgcggtgcgcattcgcgttggcgcgctcgtccaggcgcccttccaccgacgcctggaccagcatgtcggtatctacgatcaaggccttgatattggcgcgcatttgctcaattgtgtcattgatgaaacgcttcttgcccggaaagagttccagcggcgcttccatattgccctcgccaaactccttgatgcaggccatggcttttttcttcacggcgatatggcccgccaccatgctattgacgccggccgccatggagcgatacgcgccctggaatttcgcctcatccatgcgcacatcgatatcgcccgcatcatgctcggccgacatatggttcatttcaccgatgaaggccttgatattggcacgcacctgctcaacgatgtcgttgatgaagcgcttcttgccggggaacacttccagctgggcatcgaaattgccttcgccaaactccttcacgcaggccatggcttttttcttcacggcgatatggcccgccgccatgctattgacgccggccgccatggaacgatacgcgccctggaatttcgcctcatccatgcgcacgtcgatatcgcccgcatcgtgttcggccgacatatggttcatttcgccgatgaaggccttgatattggcgcgcacctgctcaacggtatcgttgatgaagcgcttcttgccggggaacacttccagctgggcatcgaaattgccttcgccaaactccttcacgcaggccatggcttttttcttcacggcgatatggcccgccaccatctcattgatgccgctgaccatctcgcggtaagccccctcgaacttggtttcgtccatgcgcacgtcgatatcgcccgcctcgtgttcggccgacatgcgtttcatatcggccagcaacgtttgcaaaccggactggatttgcgtggccaagcgcgcgacgcggccggcctcgccatgggaggaaatttccagacgcgtattcagattgccgtttgccatctgttcgagcatggcgacaagcgccggcatgccattttcctggctgcgggaaagccatgcggccatcaataacagaggcaaagacaaggtgctgacccatatggcggcattcacccaaatcttttcaccctcataaacgccgccatgagcgattaacagggcgacatcggaaaaaaccgtcaacacgatcagaagcgtcaacgatgcgattacagcgcgctgccggttatcaaaaaaagccatgatgtactccctggtaaataacacttcagattgcgatcgaaccgatactcaagatcgagcgccatttttcccttatccgaaaatccattcgcctgatggcttgtttttcttgactcatccgatacctcgcactgctcaacatcggggccagcccctggagccgctaacaatctcgaaatacacttgagccaagattcgccgacacagatcgagggaggcgcaacgcgggatcagggcttgccgagcggctcttaaaacaaaatcatgctggattgcgcatcgacctgatgccgatggggcgcttgctccaaggtggtgtactggctttccgccttttccacccagctatcgacactgataggttgcggcacctcgccctgccggacctgctcctcgtcctgcgtcaaccgttcatccaaccgccccatatcggacagcacccatcccatgatctgggcggtgcgatcctgaaattgcagattcaccaacacttcctcgatgcgttggctgacctggagattttccgcccgcaggctggcgctggcagaggccagcccatcggccgcttgattgatgcgggcgagcgtcgccgcgatggcgctttcggaactgacaagcaggcgcttgtcctcgctagacagccgctcggcggcggccagggcgccgccgaccaattgattggcagtcgataccttgtcccggatgctggcgcccgtagtcgcggacaaattggatagcttcctaacctcgtcggcgacgacggcaaagccgcggccgctctcccccgcgcgcgccgcctcgatggcggcgttcagcgccagaagattggttcgcgcggcgatgtcgccaacctcgatggccattttttgaaggtcctcggtcaactgcaccagtgaggcgatatttcccatcatctgctgcttggccgcagtcgcggctttcagctcagacaagatggtttccagctcgtcgcgcgccccgcctatggtagacgccagatcttcctgcccttggctggcaaaagctcccaaggctctcttaagccggctgcggatatctcggaattccgccaccagcccatcgactgccgactcggattgcgcgcgcaccagctccacgtttgtgcgccagcgcggcagcatggcgcggcaagtgacgcgcaacgagtccagataagccgcctgatcgcgatgcaccgccgtctccgcgtcggatatcgtacggctccgctgcacagaagcgtctataaagcggcccacatcccggcccatccatgtccggccagcccatcctaaagccagcagcgccccgcccgccgacagcgcgatcggatgggcccccagcacgccaagcaaaaacgacgcgcatgccagcgccaaaaccagcggaaaaacagtaaggctgaaaggcaggcggatggaagatttcattgccgtgctccgagcgaggacaggatggcaagcagcgcagagggtcatgcgctgacatggctgaattctggccagccacgtctcggcccgccatcccagcttaccggtagtccgcactcaggaaactgagtatcccggcggcgcattccttcaccacgcgcaacatgctaaagtcatgtcgagactatccctcaaccgacagagaagagcgccatgaacgccaatcctttgctgcaagactggaataccccccaccagctcccgccgttcggcctgattcgccccgaacatttcgaaccggccctcgccgcgctgttcgccgagcacctggccgaaatcgacgcgctggccgcattggaagaagcgcccagcttcgccaacaccgccgccgccttcgaccgcagcggccgccggctggagcgcgcccagctgctgctggataatttgaccgcatcggaaacctcggccgagctgcaggaagtggaacgccgcaccgcgccgcagctggccgagcacaacagccgcatctacatgcacgccggcttcttcgcccggctggacgccgtccacgcccgccgcgccgagctgggcctcagcgaggaacaggatcggctgctggacctgatccaccgcaacttcgtccgcgccggcgccaagctgcagggcgaagaccgccgccgctacgccgaaatcgtttcccggctggccgagctgaccaccgccttcggccagaacgtgctggccgacgaggccgagtacgcgctgccgctgggcgagaacgacctcgctggcctgccgcccttcctgctggacgccgcccgcgccgccgccgaggcccgcggccttgagggctgggcgatcacgctgtcgcgttcgtccatcgtgcccttcctcaccttctccgcccgccgcgagctgcgcgaagccgcctggcgcgcctggaccgaacgcggcgaacatgccgagcgcgacaatcgcccgctggcgcgggagattctggcgctgcgcgtcgagcaatcgcggctgctgggtttcgacactttcgccgactacgcgatcgccaaccgcatggccggcaagcctgccgccgtgcatgcgctgctggaacaggtgtgggagccggccaaggcccgcttcgagtcggaaaaggccatgctgcgcgaagaggccgccaggctcggcgagccggccgacatccagccctgggactggttctacctggccgagaaggtgcgcatcgcccgctacgcgctggacgacgccgagatcaagccctatttcggcctggaaaacatggtgacggcgatgttcgacgtcgcccgccggctgttcggcctcagcttcgccgagcgccatgacctcacgctctaccatccggacgtgcgcgcctgggaagtcagccgcggcggcaaggtgatcggcctgttcctcggcgacaactacgcgcgccaaagcaagcgcggcggcgcctggatgcatgtctaccgctcgcaagcgcgcaacggcggcgaagcgctgcccatcgtcgtcaacaacaacaacttcgccaaagccggccacggccagacgctgctgagcttcgacgacgtgcgcacgctgttccacgagttcggccacggcctgcacggcctgctgtccaacgtcgaataccggctgctggccggccccaattcgccgtgggactacgtcgagctgccgtcgcagctgatggagaactgggcgctggtgccggaagtgctggccaagcatgccctccacgccgaaaccggcgcggccatcccggccgagctggtggccaagatcaaggcggcgcgccatttcaaccagggtttcgaaacggtgcgctacaccgcctccacgctgatcgacctggcgctgcaccagcgcgccgacgcggacggcgtcgacatcgccgccttcgaagccgccgaacgcgaacggctgggcgttccgcccgcggccggcatgaatcaccgcccgccgcacttccgccacatcttcaccggtccggaatacgccgccggctactacgtctacatgtgggcggaagtgctggaggcggaagccttcgccgcattcgaggaagccggcgatgccttcgacccggcgctggcggacaagctctatcgccatatctacagcgccggcgacgccgtcgagcagcgcgccgccttccgcgccttccgaggccgcgacccgcaagccgcggcgatgctgaagaaacgcggcctgcagtaaggccgcagcccaccgggcgggcctcccccgcccggtggcttttcccgcgcgcgcgaatcaagcgcgcccgaatggtccatacctgccgcgccccggaacggataaaatggccattccatgaaactaatcgtcacctcgcaagcatgacaaagaaaatcggcaaatccatcaagtggctgctcccgaccatcgtcctcctcgccatcggcgcgctgttctggaaatcgcagcagcctacgcacaaggcctcgcccccggcggaagcggcccgcatccactacctcaactacgccaacgtccgcttccccttttccataccttaccccaaaggtctgctgattccgggcgaagagcccgacaacggcgacggcctggccttcacctcgcccgatgggcaaaccgtcatgaccgcgtccggcatcaacaacgccaacgacgatacgctgcaaagcgaataccgcgacgacttgaaaagaccatccgaatccggccagccgcgcaaagtcgccttcaaaaccatcaagaaagactggttcgtgatttccggcaccgaaggcgacaagatcttctaccagaagacctatctggtggacgaccaattcatgaccttcgacatccgctacccggccagccagcgcgcgaaatgggacccgatcgtcgcccacatcagcaagcagttcaaggtgacgcccggcaacaccccgtacgaagtccagtcccagtgaacgcgatgtctccgtcgtccgtacctggacgaagcgatagaccgctgacggagacttctcccgcgcaaccatcatccctcaccatagagccatcatcatgagcaatccgctgctgcaacactgggacaccccgcaccaactgccgccgttcgacgccatccgcgccgagcacttcgcgctggccctgcagcagttgatggccgaacatcgcgccgccgtcgccgccatcgccaatcagccggagccggccagcttcgccaacaccgtggaggcgctggacgccgccgcgctgccgctcaagcgcgtatcgctggtattccacaatctgcgcagctcgcattccgatgccgaactgcgggccgccgagcgcgaactggcgccgcagctggccgcccaccacggcgccatctgcctggacgaagcgctgttcgcccggctggacgcggtgctgcggcaagcgccgcagctggagttgaacgaggagcagcgccgcctgctgcagcggctgcatcgcgacttcaccatggccggcgcctgtctgcgcggcgaagatcgccgcgagttcgccgacgccaacgaagagctggcccgcctgtccgcgcaattcggccagaacgtgctggccgacgaatccgaattcgtgctgcgcctgagcggcgaggacgatctcgccggcctccccgcctcgctgcgcgccgccgcggcgcaaaccgcccgcgagcgcggcctggacggccatgccgtcacgcttgcgcgttcgtccgtcaccgccttcctcgcccactccagccgcgccgacctgcgcgaaaccgcctggcgcgcctgggtcggacgcggcgaacagccgcaacgcgacaaccgccctctgatccgccgcatcatggcgctgcgccagcgccaggcccggctgctgggctacgccaactacgccgactacgcgctgaccgaccgcatggccggcgcgccggcagccgtccatcgcctgctggaacaggtgtgggcgcccgccaaggtgctgctggccagggaaaagctgcaattgcaggcactggcgcgcaaacagggcctgaaccccgacatccagccctgggactggcgctacctggcggagaaggcgcggctcgagcattacgcgctcgacgacgccgaagtgaagccctacttcagcctggaaaacatgcaggcggcgatgttcgacgtcgccggccggctgttcggcctgagcttcgccgaacgcgacgacctgccgcgctatcatcccgacgtgaagggctgggaggtataccggcacggcgagttgatcggcgtgttcctcagcgacaacttcgcccgccccggcaagtcgggcggcgcctgggccagcatctaccgcgcccagggccgcaacggcggccgctccctgcccatcaccgtcaacaacaccaatttcatcaagggcagcccgacgctgctgagcttcgacgacgtgcgcacgctgttccacgagttcggccacggcctgcaccacctgctgtccgatgtgcgctaccagcgcctgtccggcacccaggtgctgcgcgacttcgtcgaactgccgtcgcagctgctggagaactgggcgctggtgcccgaggtgctggagcggcacgcgcgccacgtcgaaaccggcgcggcgattcccgcggcgctgatcgcccggatcctggcggcgcgcaatttccagcaaggctacgccaccgtgcgctacgtcatttcggcgctgctggatctggagctgcaccaggccggcgacggcgtcgacgacatcgccgctttcgaggacgaagtctgccgccgccatggcctgccgccggaagccgggctggcccaccgcctgtctcacttcagccacctgttcaacggcggctacgcggccggctattacgtctacctgtgggccgaagtgctggaggccgaggccttcgccgccttcgaagcgcgcggcgacgccttcgacgccgaattggccgacagcctgcgccggcacattttcagcgtcggcaacagccgcgatccgcagcaagccttccaggccttctgcggccacgcccccagcgctggcgccatgctggaaaaacgcggtctggccggctgagccgcagcctggccgcaacaccccgctcccgcccatcggcgggagcatgaaaatgtcattgaaatattcgcttgctgccaggatactgacgcattctttacccatgccatggagtcaagcatgcgtcacctcgctgcagcctgcctcgccctcgccgcgctatccggcagcgcccgggcctttgacctgggctcggtgctcaattcggtcaaccaggccgtggacaccgccaagaatgtcggcaacagcgtctccggcggcaatccagccaccggcgacggctccctgacgccccggctgaagctcaaccgcccgtcaccggtgggctcgccgctgctggccaagctggacgaatacaaccatcattacaaggaactggacgaatacaccgtcttcctgtcgcggcccaaccagaacagcgacggctcgatccgggtggccaaggccgagctgctgcgcggccaggtctacaaggacctgtacaaccatcctgattcgcaaagcaccatgcaggtgtgggaagcgtacaaaagccagctgagccaggacggctacaaactggacttcatctgcgacaaaccttgcgccaaccatgtcaatctgtggcagaccgcgctgagttcgtccttcatcgtctacgacaaatccgaccgctacctggtggcgcacaaggacaacacctgggtcagcgtcgccatcggcgaaatcggatcgcacccgttgtccagcgtcaatgtcgtggttcgcggcaactagccgaacggccggcagtccccggaatccaagctcgcggcagggcgattccggttatgctagcaacgcagatcaaccaacagggaacatcatgagcacgaccgcagtgacaaaggaggcagaaagcagcctggacaccagggctgccgtggagattttcttctacgcctacaaggcgctcaccaccaagccggacgaaatgctggccaagcgcggcctggcccgcgtccaccatcgcatcctgttctttgtcgcccgctatcccaagctgtcggtcaaggatttgctgggttttctgggcgtgaccaagcaggcgatcaacatcccgctgcgccagctgctggaaatggagctgatctgcagccaggccgcgccgcacgacaagcgggtcaagcagctcagcctgagcgaggaaggcctgcggctggaggaaagcctgcaccgcgagcagcagcgcctgctgcagaccgccttcggcgattgcggcgacaaggccacccgcgactggtttctgatcaacggcaagctgtccgagcacatcctgccctgacgccgccgcatgcgaaacggcccggtcgtcgccgaccgggccgttttccttgcgcgggcggcatgcgcccgccgctcattccaccttgcagtagcagacttccagcacctcgatgtcttcgtcgccgtccgggccgcggaacagcacgctgtcgccttcgcgggccttcagcaaagcgcgcgcgatcggcgagatccagctgatgcggccgcgcggcaggtctatctcgtcgacgccgactatcgtcagccgctgctcggcgccgtcgccgcgctggatcagcaccgtggccgagaagaagatctgatcggtcgcctcgcgggtttccgggtccaccacctcggcgatttccagccgcttggtcaaaaagcggatgcggcggtcgatctcgcgcaagcgccgcttgccgtacaggtagtcgccgttttccgagcggtcgccgttgctggccgcccagttgaccacctgcaccatttccggacgctcgcggttgaccagatggtacagctcgtccttcaagcgctgccagccgccgggcgtgatgtagttcttgctcgccgccggcaagcgctgttccgatggcagatcgtcttccgcctggtcttcttccttggtgaacgccttgctcatgatggtttccgtcttgctgattgatgtcggcgcgcgccgccgccccattatgcctgatcgccgccctcaagcagcgccaggcagtaaggcagcaacgccttgggccgcaatttcaccgcgcagagcgccgccgcgtccagccaggccagctcgtaatggttgtcggcagacagcttggccaactccggcccgcccagccgcagcatgccgcggtgctcgcgcgccacgaacacatgctcggtgcggctgcggccttccagcacgcacagcttgtcgcccagccagacgttgaggccggtctcctcgcgcgtctcgcgcacgcaggcgatcgccggcgtctcgtttttcttgatgttgccgccgggcagcgagtaataatccttgcccggcttgattctgcgcatcagcagcagcttgccgccttcgatgatgacgatggcggcgcgctgtttgcgcggctccgccggcaaggccaggccggcgtcctgattctggccgaaatcttccacgcttccccccaaaacaaaacgggcaaccgccaatcggcggtcgcccatgcttgatcccgcggtcaagccgtccagcacggacggcgcgtcttactccggacgcggggtgcgcggcttgcgggccgatgccttgcgctgagccggcgccttcttgccgccggtgacggtcagattcgaccatttcatcaccgccgccacttccgccgggttcagctcgtagaactggccgcgcttgaggcgcggcggcaggccgatattgccgaaccgcacgcgcatcagccggctgacggtcaggccgaagtgctcgaacatccggcgcacttcgcggttgcggccttccttgatcaccacgttgaaccactggttggccgcttcttcctggccgccggtctggaaaatgcggtcgaaacgcgccgggccgtcttccagctccacgcccttgaccatttccttcatgatttccggcgtcagctcgcccatcacccgcaccgagtactcgcgctccacttcgaagctggggtgcatcatgcggttcgccagctcgccgctggtggtgatcagcaacaggcccgcagtgttgacgtccaggcggccgatggccacccagcggctggacttggcttgcggcaggcggtcgaacacggtgacgcggccttccggatcgtcgcgggtgacgatctcgccctcttccttgtgatacatgatcacgcgcggcaggcggtcaggccatttcagtttgatcgcgtcgcccttgaccatcacgcggtcgtgcgggccgaccttgtcgcccagattggccttcttgccgttgacggtgaccaggccggcttcgatccattcttccatttcgcggcgcgagccgacgccggacgaggacagcgccttctgcaggcggatgggctcgatctcgttcagatcgacgcgcacttccttcagcttttgcgacttgctcttgatgtcctggctggggctgcgcagacgcagcttcttggccttctgcacctgctgcggtcggccgcggccttcgccttcgggcttggggccgcgcggcggtttggcggcgttgccgtcaaccggcgccgccgcgttcttgttgccgaagcggcgctcgtggtccagcgccacgttgccgttgacgtcgccattgctgtcgcggccgtagaccggcttgccgcgggcggcggccagcgcctgttgctcctgttcgcggcggctcagcttgaacagcggcacgccattctgcgagggcaccgccgggttgccgtaagcatcgcgcggctggcgcgccggaccgttgcggcggccgttctgctggccagcgccggcttgctgctgttgcgggaaacggggctgggcgctcgggccggacttgccttggcgcgcttgctggccctggttgcggccggcattctgacgcggctgtgcggtttcacgacctttgacacgcgcaaccggttggcgcgcgttggtacgttgtccttttgtagacatgtgtttgctctttccatgggagcaactggcagaaagcttattctgcgacaggctctaaattgtccgcctcatcgtcgagggggagatcgtctgcgcccgcatcggggctgtcgtcttgcaattgggtgtccggcaccaccagtgtgccaagctccgccaatggcggcagatcgttgagcgagacaaagctcaaatcgtccagaaacttgcgcgtggtggcgtacaggccgggacggcccggcacgtccttgtgaccgatgacttcgatccagccccgctccagcagggtctgcatcacattggtggagacggatacgccgcgtatcgcctcgatgtcgccacgggtcacaggttgtttgtaggcgatgatcgccagggtttccatcaccgcccgcgaataccgcggcggcttttccggattgagccggttgagatagggcgtgaattcggccctggcgcgaaagcgccagccggaagccagctttaccagctcgatgccgcgtccgcgccagtcgccctgaatgtcatccagaatatcattgatcaaggcggccttgacgtcttcggtgaacagctttttcagctgggaaaccgacaacggctcctgggccgtcagcaaggctgtttccagcacgatcttcagatattttaaatcggtaatggtggacattaaaccggggtgccggagaattacagggggcttagcgcgggaagcctcggattctacacgtttttcgccgcgggtgaaacttaatccatcagtccggccagcgaagtcaggctgaaacgcctgagcacgcggccatccggctgcggcatgtcctccagccgctggccgccgcaagcctctatggtgcggatggcggccggatcgtcggcgtcgcacaccagcacccaattgccgcaggccgggctgctgcccaacgcctgcacgtactgcagcagcacccggccgtagccatggccgcgccactgcggcaacacctcgaagccgatatggccgatcacatcctgtatcacatcggtttcgccctggcgcaagcgggcggcgccgatgatctcgccctcgcccgtcagcagaaaccaggtctggcaaggcacccagcccgccggcagcgacttgccctgcgcatgcagcaccacctggcccagccagtggccggcgtcgtcctccaggccgcggtaatattcgaaatccgcttcgcggcaggcctggaagtaacggcgataagctgacagatggtgctcgctggcggcttcgattttcattggcggctcccggatcgatactcccatcgtaaacagctgcgcggcaaggtcaagccttttgcgcgcgcccgcgccggctatgcgacaatctctccctgaccgcagcgagcattctcatgagcgacaccccacaagccatcctgttgatgggccccaccgcctccggcaaaaccggcctggcgctggagctggcccgccgtttcccgctggagatcatcagcgtcgactcggcgctggtctaccgcgggatggatatcggcagcgccaagcccagcctggcagaaatggcggcctgcccccaccatctgatagacgtgatcaccccgctgcaaagctattcggcggcgcagttccatgccgacgccaatcgcctgataggcgaaatctccgcccgcggcaacatcccgctgctggtgggcggcaccatgctgtattacaaggcgctgctggagggcttgtccgatctgccccaggccgacgccgcgctgcgcgccgagctggacgccgacgccgcgcggctgggctggccggcgctgcacgcccggctggccggactggaccctgccaccgccgcccggctcaatcccaacgacgcccagcgcatccaccgcgcgctggaggtgtgcctgctgagcggcaggccgatgtcggaactgatcgcccaaggcaaggccgccgccgccgatttcagacacctgccgctggcgctggtgccgcgggagcgcggctggctgcaccaacgcatcgcgcagcgcttcgacatcatgctggagcaaggcttcctcgacgaagtcagccgcctgcgcgcccaatatccggacctgagcctggacctgccgtcgatgcgctgcgtcggctatcgccaggcctgggaacaccaggacggcctgtacgaccgccgcgaattcatcgaacgcggcatcgccgccacccgccagttggccaaacgccagctgacctggacccgcggcctggacgtgatgccggtggatgcccagcaacaagacctggccggcttgctgacggacgcggtggcggacttcctcgccggcaagccgccagccgacgcgctacgtttcagcgggccgttctgaacgccacgcaacgcgaaacggcaggcgcgcgcctgccgttttacatcttcgcccggcaaaaggttcagggactggcgttcatccgcagggtatgcgtccaatcatggtcgctggccgacaccacgctgctgtagctggcataggtcatgccctcgcccggccacgggttcatcatgtacaggtaattgccgccgctgccggtctggtaaccgcggccgacgatgaagtggccgccgccgctggtccagccatagcggatcacgaaggggcgattggcctggatgtcctgctgcacgtgggtccacgacagatagtcgtataccgtgtaattggacacgccccaattcgtcaggatgtcctgcaggctgccgttgccgccgaacatattgttggggctgttggcgtcgctgttccagttgaaattgctgttgccgcaggcgtagttgatgccgaaggcccagttgacgatggcgcattggctcggcgtctgcttgtaccacgccagcaccgccttgctggagcccgcccagcaccactggctatgctcctgcacggtcaaggggacgcccagcagcttgctgtcggcctgcgcggcgatgctggccgccagcagcgcggccgccagcgcggtgttgctcaatcgattgccggtcatggcattcctccggatcagcggaaacgggaaaggttgttgcgcaccgcggcgcgcagcggctcgatgaagtcggcgctatccatcaggccattgccgacggcgccggccgcctggggtttgagcgccagcgacgcgtaggccgaggccagcgcggcgaagcgcggtttgccgcccccggccggactcacctcgaggaagtcggattgcgcctgatacaccctgacaaagcgggtgttgctgcgttcggcgttgccataagccgcctgcagcgactccaggctcttggccaatccggcggcgccatacgataccgcctcccaatggccacccacctgctccaccgtcaccaggcccaccgcctgctgtcgcagatagacgacgaaacgccagctgccggtcggcgccatcagctggctgatgtcgccgttgcccgccagcaattgctgcgggtctacgctgtacaccggaaagccggggccgatgcgcagggcgggcagctcccgcccgtcggcgacatccagcgggaagcccgccggcaacctggcgccgaagtccagcagattttgccgggcgaattgcgccaggccgcggctggccgcggcggcggcctccgccgcggtttgcgacgagacggaaaacggcgcgggttgcgcgccggctggcccgccggccagggcggcaagactgaacaagactgccgcgatcaaggatttggactgcatgtgtcggctctcctgggttgggatgcggttgccgtgcatggctggatgcgggcggattatgtccggcgcatacattgctagtcatagcgaccgctaatcagcagagcaacaatgccaattaggtacaatgttttgatttttattttgaaactcaagaatttacatgaacttgcgcgcgaaaattaaagcgcccgcccaagtcattcctgcccggaaggccagtatcgaagccgccacgccgccaccgccgcaagccgaaatcccccttagccaaacgcgaaaagaaaaagcccgcggcctgacggcagcgggctttgaacgaacgatgcggcagctcagcgcgcggcgaccagcttgatctccaccttccaggccggattggccagcttggcttccaccgtggcgcgggcgggcacgtggccggccggcacccaggcgtcccaggcggcgttcatcgcgtcgtaatcggccaggctggccaggaagatggtgacgtcgacgatcttgctcttgtcggaatccagttccttcaacagggcgtcgatctgccccagcacgttttccgtctgcgcgcgggcgtcggcgtcggtgttttccggcacttggccggccaggaagatcagtccgttgctgaccacggcctcggccaggcgggcgccctgcttgtgacggtagatgctcatatcgttctccatatgcggtgggttgtcgccgtcgattctagcggcattgcgctcagctgtcccgccgcgcctgctccagatcggcgatcagcgccgcctcgccctcgacgccgaccgacagccggatcaggttgtcgtggatgcccagcgcggcgcggcgctcggccgggatggaggcgtgcgtcatcgccgccggcaggcacaccaggctttccacgccgcccaggctctccgccagcgcgaacagcttgagcttggccaggaaggccttgacgtcgcctttcaggtagaacgacacgatgccgccgtagccctgcatctggcggcgcgccagctcatgctgcggatggctctccaggcccggatacagcactttttccacccacggctgcgcttccagccagcgcgcgacggccaggccattgcggttgtgctgctcgatgcgcagcgccagcgtgcgcagcccgcgcaacaccaggaagctggggaaggcgtccaggatggcgcccaccgcgttgtgcaggaaggccagctgttcggccagctccggcttgtcgcggctgaccaccgccacgccggccaccacgtcggagtggccgttcagatacttggtggcggaatgcacgacgatgtcgaagccgaagtccagcggccgctggttgaccggcgaggcgaaggtgttgtcgaccacgccgatcaggccgtggcggcgggcgatggcggatacctgctgcaggtccaccagctggttcagcggattggacggcgtttccacccagatcatccgggtgttcggccggatggcagcttccagcgcggcgctgtcttcggaagcgacgtaggtcacttccagattggcgctggccttgcgcactttttcgaacaggcggtaggtgccgccgtacagatcgttgaccgcgatcaggtggctgccggccggcagcaattccagcacggtggaaatcgccgccaggccggaaccgaaagcgtagccgcgcgcgccgccttccagttcggccaccgcgcgctccagcgcttcgcgggtcgggttctgcgaacgcgagtactcgtagccggtgtgctcgcccggcgcgcgctggcgataagtggaggtggcgtagatcggcggcatcaccgcgccgaacgggtcttcgtgggcgccggcggtcacagccagggtgtggaaatcggtcatgtttctgtccttttctgaaaatcatgcgccccggcgcaagcggccggggcgggaaaacggttcaggcggcgcgcggctggcggcgccagaacgccagcaagtcggcctgggtgatcaggcccagatagcggcccttgtcgactatcagcgcgatgtggccggcgttgaatacctgcagcaagtcctgcagcgaggcctgcggcgacagcgtctgcacatggctgctcatcgcgctgtcgacgttctggcggaaattctccggctcgccgtgcaccgacagcagcaggtcccattcatccaggatgcccaccaccttgtcgtccttcagcaccggcagctgcgatacgtcgtgcaggcgcatgcgctggtaggcgacagacagcgcctcatccggatggcaagacacggtgctgccgtcctggtggcggcgcacgatcagatcggtcagaccgcccactaccggcaagctcagcatgccctggtccaccagccagtcgcggttgtacatcttggacagatacttgttgccgctgtcgcacaccagcgtgaccacccgtttgggttcggtttgctcgcggcaatagcgcagcgccgccgccagcagcgcgccggacgaagagcctgccagaatgccttcggcgcgcagcaattcctgcgcggtatcgaagctttcctgatcgctgatgcggaaggcgcgcttcaccatggacaggtcggtcagcggcggaatgaagtcctcgcctatgccctcgatcagccagctgccggcctggccgaagctgccggtttcgacataatcggccatcaccgaacccaccggatcggccagcacgaaggcggtgcccggcgccttggcgcggaaaaagcgggtcaggccggtcagggtgccgctggaaccgacgcctaccaccaccgcatccacctcgccgttcatctgccgccagatttccggcccggtggtggtttcgtgcgccagcggattggcgggattgttgaattggtcgatgtagcaggcgcccggcgtttccgcggcgatgcgcgcggccagatcctggtaatactccgggtggccctttcccacgtcggagcgggtcagccgcacctgcgcgcccaatgcctgcagatgcaggattttctcgcggctcatcttgtccggcaccaccaggatcagcggatagcctttctgcgccgccaccaacgccaggcccaggccggtattgccggcggtggcctcgatgatggtgccgccgggcttcagcaaaccatcgcgctcggccgcctctatcatcgtcagggcgatgcggtccttgatcgaaccgcccgggttatggctctccagcttcaggtacagctcgcacggcccggtgtccagatgggagacgcggaccaagggggtattgcctatcagcgacaggacggaatcgtctttcatgatcaaaactcccggctattataaaattactataagtaattttttgttatataaaaagcaaaaaaatttctactcgaaaaaccagccggcatcagtccccggccttgccgcggctcagaccacggcgctcgcctgcatgaagctatagaagaacaccagttccggatcgctgcgcaactgccgcaactcgcgcgtcatcgtttccaccagctggctgtccaccctgcccgcctcgatcagctggtcggctgccgacaacagcagctcggtccagtaatccagcaccagctggcggcggtgcggttcgcggctgtccagatgccaggtcttcacctgcgtctccacctggcggaagccaagccgctgcaggatgttgcccagcttggcgccgacgaaggggtcgccgcccaccgacagctgatggtcgttgaaagccagccagtattgctgcagattgggggaatacggcgccaggaagaaggaggcgttcatcgcctcggtcgcgtacagccgcgcgcccggcttgagcacccgccgcacctcggccagcacgcgctccggcgcatgcacgtgctccagtatccagcacaggaaagcggcgtcgaagctggccggcgcgaagtccaggtcctcggcgtccatatgctgcaggcgaacccgctcgtgataggggctgccctgcaaacgctggcgcgccaccgccagctgacgctggctgaagtctatgccggtgatggccagctccggatagcggcgcagcaggatctcggtttgcgcgccgacgccgcagcccacctccagcaagcgctccacgccggagaaatcgacatcgcgatacaccatcgcttcggaaaagcgcgcctggcgcaccagccgcgcctgctcggccgcggaaaacccatggatatagggcagatcggcctgcgtttccgccagttgcaatgcactcatcttccacctcgtcccagtaaacatcaggtggccattatatttccaatgagtattttgaaatcaaatttcatttgaaatttgaatatagaaaaaaactctaacaaccgtgcgcgcatgaaaaaacccgcatctgccgatgcgggtttgctttgcctgcgcgttaggatcaggcgagcgcggcctggcgcagactcaacgagaagcgctgcagcgcggcgattccggaagcctccgccctggcgcaccagtcctgcaactccttcagcaactgctcgcggctgaggttggagcgctcccacagccgggtcagctcctggcgcatattgtagatggtggccaaaacctggctttgctcgagcagacgggccagttgcaagcgctcgtcctccggcgtgtccttggcgtcctgcttcagccatattttcattttgcgcggcagattcacctgcggcagctccggcagactgagcttgcccagctcggcgtggtattcgtcgcgcagctcgcgggcatagcgcgcggcgatggcgtagcgattggcgacgatggcctgcagatgctccaggtccagctgcggacgggacggatcctgcgccaattgcggcgccaccttacggacggtggcgaggcccagcatttccaggatgcggatgtacatccagccgatgtcgaattcgtaccatttatacgacagcttggccgaagtgccgaaagtatggtgattattgtgcagctcttcgccaccgaccagaatgccccagggcaccagattggtggaggcgtcctcgttctcgaaattgcggtagccccagaagtggccgaggccgttgatcacgccggccgcccagaacgggatccacaccatctgcaccgcccagatcgacaggccgatcggcccgaacagcgccaggtcgatgatcagcatcagcacgatgcccttggcgttgtggcggctgtagacgttgcgctccagccaatcatccggcgtgccgtggccgaacttgtccatgatggactggtccttgcaggccgcgcggtacagctccgcgccttcccacagcaccttcttgatgcccagcacttgcgggctgtgcgggtcttccagcgtttcgcagcgcgcatggtgcttgcggtggatggccgcccactgcttggtcaccatgccggtggtcagccacagccagaagcggaagaaatggctgggggccgggtgcaggtccaacgcgcggtgggcctggtggcggtgcaggaaaatcgtgaccgaggcgatggtgatgtgggtcaggatcagggcggcgacgatattgccccaccatggcagatccaagagaccgttgagccagttcaggttcatgtattcgatgcgtccggtgtttagatacaaagctctattctatagcaagccccgccgccatgcagagtcaaatttggccgcgcaacgcgccaggcagcgcatccatcggtgcattggtgtaccatagggcatcatttcaccctagtgcagaaaaatactagtgttgccaaaacgtcgactgatcattgccggcgccaccctcggtggcctgtttgtcctgtatgcagcctctagctacttggcaggcgtcaaagccgaagacaccctgcaggaacagcaccggatgctggccagcctgccgctgttcaaggtcaaatcgcacagctacgaacgcggctggttctcgtccaccgagaccaccgagctggtgttcaaccgccatttgtccggcccgtatgaaaacatgctgccggacaatatgaagcccttgctgaacgccaccatcaagttcaccaatcatgtccagcacggcccgctgcccgggctgtccggcttccacttccgtccgggctgggcgctggtgaagactgaattcgcgatgagcgactccacccgcaagacgctgaagaccttcttcggcgacaaggagccgatcaccatcaccaaccacatcggtttcagcggcggcggcctgctcgacgtcaacgtgcccgccttcgactacgaagaggcgctgtccggcgtcaagatgaagtggaagggcttcgacctgaaggtcgactacgccaacggctacaaggaatacaagaccgaggcgctgtcgccgggcttcctgctggaagccgccagcaagggcacggtgtcgttcgagggcgtccgctacctgtccgacatgcgcccgggcaacaccgacatcaagctgggcaccagcgagctgaccataggcaacgtccagctcagttcgcgcgagagcgtgccgtacagcatcaagctgaacgagctgatctacctgatgacccgcgtccgcgtcggcgaattcgtcaacccgtccggcgagttcaagccctcctcggtggcgctgaagaacttcagctaccagatcgtcaccagcgagcaggacgacttcatcaacagccgcggcaaggtcaacttcgccgagctgagcttcaacgccaaccgctatggcccgctgcggctggatgtggcggtcaatcacctgcacggccgcacgctggcccagctggacaaggccatcggccagatcccgttcgaaggcgtggacccggcggtgttgcgccgccagtacgtcgacaccctcaagaggaatatcgggcccttgctggaaaacagccccaaggtgctgatcaacgagttctacctgaagatgccgaccggcgaagcgacgctgcaggccagcgccggcatccacggcttcacctcggccgacctgaacgacttcacccagttggcgaagcgcttcaccgtcgaagccaaggccagcctgccgcggcagacgctggagaacctggtgcagacccagttccgcaacctgttcaccgtcgaccacaccgcggaagaccagccgaacatgcaggaagtggacgacctggccaagagcctgctggacagccagctggcgcaatggaaggcgcaggactacatcgtcgaggaaaacgggcagatctccaccgagctcaactacagcgcccagggcctgaccatccacaagaagaaggtcgccctgccctgggaggaaagcgaggagccgacggacgcctcggcgccggcggcctcgccggccaagaagtaagcgacaaacgccggatgtgaaaagggctgtctgatgacagccctttttcatggcgcgccgattccgagcgaaatcaggacgcgtcgtccatctggctttgcaggtagttctggatgccgacgcgctcgatcaggtcgagctgggtctccagccagtccacatgctcttcctcgctctccagaatgtcttccagcaggtcgcgggtcacatagtccttggcggtttcacagtaggcgatcgcctcgcgcagcagcggcagcgcctccatctccagcttcaggtcgcactgcagcatctcatgcggggtttcgccgatgtgcagcttgcccagatcctgcagattcggcaggccttccagaaacagcacgcgctcgatcagcttgtcggcgtgcttcatttcatcgatggattcttcgtattcgtgctcgttgagcttcttcaggccccagttcttgaacatgcgcgcatgcagaaaatactggttgatcgcggtgagttcgttcctgagaatctgattcaggtatttgatgaccttcttgtcgccttgcatgccgtatcctccagggaaattatcaaggcattatggcacagcgagggcgagtctcaaggcggaaatgcggccggccggcgcgtggagccggcgcagaggaaggagaaaaacgctcaggcggcggtgcgggccaccgagcagacggccagttcggcctgggcgtccttgcgcacctggttggccatgcatgcgcacttgccgcaatcggaagcgacgcccagctcgcggcgcagatcgcacatgcggctggcgccggcatggacggcctggcggatctggctgtcggtcactgcattgcacaggcaaacgtacatgtgagcccccttcggcttacaatcaagaatagttatcatcatcatagagacaaacaagaatgattgtcaataacctgcaaagagagtggaagcccaacgctaccgtcgccgccattgtcgaacgcggcggccgcttcctgatggtggaggaagacaccgccgacggcctgcggctgaaccagccggccgggcatctggaacccggcgaaacgctgctgcaggcggtggagcgcgaagcccgcgaggaaaccggctggcgctttacgccgcagggactgaccggcatctacctggccgaccgccccggcagcgacatcacctatctgcgcttcgccttccacggcagcgcggcgccgccgcaacaacccgccgcgctcgatgccggcatcgtcgccgtgcactggctcagccaccaggagatccaggcccagcaagcccggctgcgcagcccggtggtgctgagctgcctggccgactacatcgccggcgtccgctaccctctcgatctgatacgcgacctgcgctgacccgcccccaaccggatgcccgcccatgccgccatgcctgacgccattgctgttgattctgctgtgcctgcttcccgccgccgcccgcgccgatggcttaaacatctgttatcattaccgttgttccagacaagcctactttgaaatttccgaagaggcccgcgactggctggccgcccgcctggcgcgcgccggctccgccgccgccgaacgcgaagtggtcagcgacgcagtcgtcgcgctataccgcatcgccgcgcgcgacactcccatctggcaggacaagggcggcaatttccatgacggcccggccgaaggccggatggattgcgtcgaccacagcagcaacgtcaccgcttttctcggctatctcgaccgacagggctggttgaaattccaccatgcggcgccacctgcatggagagcgccgtggatactggatctacattacaccggcgtgctgcacgacatcgccgccggccaggactgggcggtggacacctggttcagggatttcggggaaccgcccgtggtggttcccctttcgatttggatgaagggatacgagccgccggccgtgtccgcgcctgacgcgtcaggccagcaaaagtaaggaaggaaacgcccgtgacgggtaagaaacgcatagtcgtcggcatgtccggcggcgtggattcgtcggtgaccgcctggctcttgaagcagcaaggccatgaggtgatcggcgtgttcatgcaaaactgggaagacgacaacgacgacgagtactgctcgatcaagcaggacgcgctggacgcgatgagcgtggccgacatcgtcggcatcgacatggaaatcgtcaacttcgccaaggaatacaaggaccgcgtgttctcgtacttcctgaaggaatattcggccggccgcacgccgaaccccgacgtgctatgcaacgccgagatcaagttcaaggccttcctcgactacgcgatggaactgggcgccgactgcatcgccaccggccactacgcgcgcaagctggaaaaggacggcacccactacctgatgaaggcggtggaccacaccaaggaccagagctacttcctgtaccggctgcagcagcaccagctggccaaagccatgttcccgctgggcgacatccgcaagaccgaggtgcgcaagctggccgaggaagccggcctgcccaccgcggccaagaaagactccaccggcatctgcttcatcggcgagcgtcccttccgtgaattcctgaaacgctacctgcccacctcgcccggcgccatggtgacgccggacggcaagacggtgggcgagcacatcggcctgatgtactacacgctgggccagcgcaagggcctgaccataggcggttcgcgcgacggcaacggcgagccttggttcgtcgccggcaaggacatcccgggcaaccggctgatcgtggtgcaaggccatgaccacccgctgctgctcaagcccacgctgtcgatggccgacctcagctggacgttgccggacgcgcccaagcccggcgactacagcgcgaaaaaccgctaccggatggcagacgccggctgcagcctgtctcctatcgtcgacggccaggccagcctgaccttccgcgaaaagcaatgggcggtgacgccgggccagtcggccgtgctgtacgacggcgacatctgcctgggcggcggcatcatccagtaagccgccccaaacgacactgccccgcgtagcgcacgcggggctttttcatttcgcccggcctcagccctgcgacaacggctgcagccggcgcagccacaacgccgccgccagcagcgccgacaatcccgccgccaacgccgccgccacgcccagccagccgccgccgccccacatcaggccggaaaccgagccgtacacgctggagcccaggtaatagcagcacaggtacagggccgaagccaacgccttcgcctccctcgcccgcaagcccacccagctgctggccaccgaatggccggcgaagaagccgaaggtgaacaaggcgatgcccggcaccagcagccacagcgtgtcggccagcgtcagcgccaggccggccagcatcagcgccaccatcagccacagcacgttgcggcggcccagcctgtcggccagcctgcccacccaggccgatgcccagatgcccaccacgtacaaggaaaacaccagcgccagcgcgctctggctcaggccgaacggcgcggccagcagacggaagcccaggtagttgtacaggctgacgaaacagcccatcagcaggaaggcggccaggaacagccagggcagcccgccgtcgcgcgccaccgccgccagctcgcgccgcagccggccaaaatcctgccgccgcggctggaaatggcgcgacggcggcagccagcgccagaacagccaggcgccggcgcaacccagcagcgccaaggccagcagcgcgccgcgccagccgaaatggtcggccagcaccgcggccaggaagcggccgcacatgccgcccaaggcgttgccggcgatgtaaaggcccatcgagtggccgagcgacttgccatccacctcctcgctcagataggccatcgccaccgccggcaagcccgccagcgctacgccgaacaaggcgcgcaagaacagaaacggcccgaagccgtcgacgaagaccgacagcagcatcagcaaggcggccaagcccagcgcgccgttcatcagcgcacggcggccgaagcggtcggacagcaggctggcgggaatcaggctgatggccaacgcgccggtggccatcgacaccgcgccgctggccgcggccggcgtcaggccgaaatcatgagcgaacaccggcatcaacggctgggtgctgtacagcatggcgaaggtgcagaaaccgccgacgaacatcgcgcgggaggtggagcggaaagccggcgtgccggcctgcagcttgcccgccgcggatgcggcggcaagaacggcggaaggcagcgcggaggaagcgggggcggacacggcaaaatctcatcaggcttgcgatgctgtcagcttaggcttggcctttcctccagtccaatatatatttcaacagcaattaatacttttaaaatatcaaatatggaactcaggcatctgcgctatttcctggcggtggcggaagaactgcacttcacccgcgccgccgaacggctgcacatcggccagccgccgctgagccagcagatccaggcgctggaggcggaactgggggtggcgctgttcctccgccaccagcgcaaggtggaactgaccgccgccggccgccaattcctgccgcgcgcgcgacagatcctggccgacagcgccgccgccatcgcggccgcccgccgcgccgccaacggagaaaccggcgagctgcgcataggcttcacctcgtcgctgccgctgacgccgattctgcaccgcagcctgcaccgctaccgcgaggcctacccggatgtgcggctgaccttgcgcgaaatgttcaccgccggccagttcgaggcgctggaaaaaaagcagctggacctaggcttcgtccgtttcaacggcccgacgcccagcccgctgatccaggtggaagaattgcaccgcgaccggctgctggcggtattgccccttgcccatccgctctccggcgccgccagcctggcattggcggatctggcgcgcgagccgctgataggctatccgcgcgagtccggcgccggcctgcgcgacgtggtgctgcagctggcgcgacagaacgggctggagttgaacgtggtgcaggaggccggcgaagcgatcacccagatcggcctggcggcggccggcgtcggcatcgccatcctgccctcgccgctggaatgcgtgcagattccggcagtgcgctacgttccgctatcggacagcgacgcctacctggcgatgggcatcgccacccgccgcgacgaaacatcgccgctggtggcgcatttcctggccggcgtggccaaagactagcggccgccggacacgtccagcaggctgccggtgcagaatgaggccgcgtcggacagcagccagacgatggcctcggcgacctcctccgcccggccgccgcgccgcaacggcaccgacggcgccagccgcgccacccggcccgcttcgccgctggcggcgtggatgccggtctcgatcaagcccgggcgcaccgcgttgacgcggatgccctcctccgccacctcgcgcgccaggcccagagtcagcgtgtctatcgcgcccttgctggcggcataatcgatgtattcgccggcagagcccagccgcgacgcggccgacgacacgttgacgatggcgccgccatcgccgccgtggcgggtcgacatgcgccgcaccgcctcgcggcagcacagcagcggccccagcacattgacgcgcaacacccgctccacccgctcggcgctgtaatcctccagccggcacatcggcgcggtgacgccggcgttgttgaccaggccgtccagccggccgtaatggcacaacgcgtcgtcgaacaggcggacgatggcccgctcgtccgacgcgtcggcgcggaacaactccaccgcatcgcccagttccgttttcagcgcggcggcgctggcctcgtcggcgcgatagttcgccgccacccgccagccggcggcgaccagcagccgggtcgtcgccgcgccgatgccgcgcgagccgccggtcaccagggctaccttgccgtccaccctagcccctcctcaggaattgctgatgccagcgggtgcgcacgccgcgcgcctcgctgaaaagctgttggagcccggcggcgtcgccgcccgccagcatggcgctcagacgttccagcccggcgcggtagtcggccagttcggccagcagcgcgtcgcggttggccaagctgatgtcggtccacatttccgggtggctgccggcgatgcgggtgaaatcgcgaaagccggtggcggcgaaatcgaagcagcgctcggcgttgtccttggccgccacccggtcgacataagcgaaggccagcaagtgcggcaaatggctgacgctggcgaacaccgcgtcatgctcggcggcgctcatgctgtggatctccgcgccgcaggcgcgccacaacgccgctaccgtctccgccgcctcgggcgcggtttcggccagcggcgtcagcaccacgcggcggttttcgtacaagccgtactgggccgccaccgcgcccgacatgtcggaaccggcgataggatgcgccggcacgcaccacggcagatggtcgggcaggtgccggcggtacagcgcggccacatcgctcttggtgctgccgccgtcggtgacgatggcgccgggacgcaagccgggcgccagcgccgccatcaaggcgcccatctgccccaccggcgacgccagcagcaccaggtcggcgcgcggcgccgccgcggcgatgtcctggctgatctcgtccaccacccccagcgccagcgcccgctccaggttggccagcgtgcggcccacgcctatcacccgtcgcacccgtccggcccgcttcaaggccagcgcgaacgacccgccgatcaggccgacgcccgccaccaccagggtgtctatctgctgctgcactgcgctccccttgtcctggccgccccaacgacggcacgaaggtctatcataagcgattttgccgccatggccagcccatggccgggagacgcggatgaagccgacgctgtattgctatttcaaggttggagccgatcgcggcgcgctgctggaacagttgcgcgcgctgcacgcggaactggccgccgccggttggcccgggcagttgctgcgccgctgcgatgacgccgacacctggatggaggtgtatccggacattgacgaccgcgacgccttcctcgccgcctggctggctgcgcgccgccggcacgggctggagagcttggccgcgcatcaggaatggttccagccgctttaaaacgcgccggacaagaaaaaggccgggcgcatggcccggcctgtcaaacaaacacgatacgagagaaaccgaaaccttgcgcgccgggcggcaagtcatgcggccaggcagccaatatacgcaacgatggccgccggccaaaatcacttgttctgcttagcaaatcaccttcagccgcgctggggcgccgccgcggcgcagccctgcccggcccggccggccagccggtccacccacagcgcgatcacgccgtcgccggccacattgcaggcggtgccgaagctgtcctgcgccagatacagcgcgatcatcaacgccaggctggcctccgggaaacccagcacgctggacagaatgcccagcgccgccatcacgccgccgcccggcgcgcccggcgccgccaccatggtcacccccagcagcaggatgaaaggcagcatcacttcccagcccggcaccgccaggccgccggtcatcagcatcaccgcggtggcgcagctgaccagggtgatggtggagccgcacaggtggatggtggcgcacagcggcatcacgaaattccccaccggcgccgacactttcatggcgccggccgaacgcagcgccaccgggatggtggcggcggacgacatggtgcccaatgcggtgaaataggccggcagcatcgcccgcagcaacgcgaacgggttgcgccccaacaacaggccgctggcgccgtacagcagcgccagccacagcgcgtgcagaccgatcgccaacagcagcaccgcgccgaaggtcttcaaggtgtccagcgcgctgccggcggcggccatctcggcgaacacgcaggcgatgtaggccggcagcagcggcaccagcacgcgggccagcaccttctcgacgatgtccttgccctgctcggctatctcgcgcagccgcgccgcgccggtggcggcgatgcccaggccgaacacgaaggccagcatcagcgccgtcatcacgtcgaacagcggcttgatctccagcttgaacaacggcgcggcctgcgccgcggcggcgggcgcggcggcggcctcgcccacccattgcggcaggatggtcgacgccgcggcgaaagccagcgccccggacagcacggtggacgcgtaggcgaggcctacggtccagcctagcatccggcccgatccgctctccagcgcggcgatgccgctcatgatgtagaacacgatgatcagcgggatcatgaaaccgatgaattggccgaacaggcccttgaacgtcagcaacagcgacagcagcggcgcgggcgcgcacaggcccagcgcgatgcctagcgccatgccggccagcaacttcaggatcaacttcacaggcaacctcttgtcagcttgtccagcctgccgcccttccatgcggccatgccgaggcaaaaccatcccgccggcctgaatggccggtgcgggcggaagaagggggagcctgccgaagcggcaagcggaacatcgcgccggcagtccctccggcgcaacgcatcaggcttgttgtaataaggcttgccgcagcgtctgcagcaaaggggaaggcgtccaggcgcggtcgcccaggcgggccaccggccagaggcctatcaggctattggagagaaacaccgcgtcagcgtcaatcaaatcggcgggagaaagtctcgattctgtaaattcaagtccgaaacttgaaacattttctgtcaaccaatcccgcaccgcgccgtttactccgcagcaatccagcaagggggtgtggatcacgccgtcgcgcagcaggtacacattgctcatggtgccttccgccagccagccgtcctggtcgagcagcaggccttcctgaatggccggatcgctccattccgaacgcgccagcacgctctccagccggttcagatgcttgacgccggccagccggggctgcaaggacagcctgagttcgcaccagcgcgcgctcacgccccgctcgccgtattcctccgggtagccggcccatggcgccgccgacacgatgcgggtgggctcgcccgccgccgccatcgcgtagccgcgcgcgccgacgccgcgggtcagcgtgatcttgcccaccgccagcggatgctcgcgccccagcgccgccagctcatccagcagcagttgctcgtccggcagcggcaatgccagccgggcggcgtcgtcggccagccgcgcgtactgccagcgccacagccgcggccggccgtcgcgcagctgcagcgtgcggaacacgccgtcgccgtaagcgaggccgcggtccagcgccgacaccgcctcggccggcaggccgttgaccagcatcgccatcaggcctgctccacgcccagcgcgcgcagcaaaccgcgcgccttgtggcgggtttcctgcagctctcgctcggggtcggagtcggcgacgatgccgccgccggcgcggaagcgaagcttattgccttcctgcatgaaagtgcggatcaggatgttgaagtccatggtgccgtcgcggttcagatagccgaggctgccggtataggcccggcgcgcgctgttttccagctcgcggatgatctgcatggtgcgcaccttggggcagccggtgatggtgccgcccgggaacagcgcgcgcagcacatccgccggcgccacctcgtcgcgcagcttgccgcggacgttggattcgatatggtgcacgtaagcgtagctggccaccgccatcagttcgttcacctctaccgtgcccggccggctgatgcggcccaggtcgttgcgctccaggtcgatcagcatcacgtgctcggcgcgctccttgacgctgctgatcagccgttttttcaattcggcgtcctcggccgggtctttcgagcgcgggtgggtgccggcgatgggccgggtttccgcccagccatcccgcacccgtaccagccgctccggcgacgagctgacgatctgcgcatcgccgaagtcggccagcgccgaaaacggcgccggattggcgcggcgcagggcggcgaacaggtcgggcgcggcgatgccgtcggccaattcggcgcgccagccgcgcgagatgttcacctggaacacgtcgccttcgtagatgtagcgcttcaggcgcgccaccgcctcggtataccactcgggcgggtcctcctccagcgccgccagcgccaccagccgcggctggaaatcgggctgacgcgcgaccaagcgctccagcgcgtgccagtcgtcggcgctttcgccgaccagccaggcttcgtttttcgcgcggtccaccagcaccgccgccggcgtgcgcgcccataccgccagcgggaaactgtccggcaaggcggccggcacatgcggctcgaattcggatagcaggtcgtaggccaggtagacgaaccagccgccgacaaagggcagctcatgcgggttggacaccggctgcgggcggaacgcgcgcagggcgtcgaggaaggcctgcccctcgcctgccatgaacacgcgccgctcgctctgcatcagcagcaggtcccagccgctgtcgccggacgactgcatcagatagggaaagtgttcgcggtccgcggcatgcagggccagcaggtcgggaatgaagtcgagtttctgggtgaacatccaaagtcctgggccggcaaggcccggcactgatttgcgacctccggcggcagccttgcgcgcggcgccggaaaaaaagaaaaccgctgcgagtgtagcgcagcggttcgctctgtcaatcgccggcaggcgatcagacgcgtttgaacaccagggtgccgttggtgccgccgaaaccgaaggagttggagatgcccacctcgatcttcatgtcgcgcgcggtgttggccacgtaatccagatcgcagcccgactccacatcctgctcgaccaagttgatggtcggcggcgatacctgcttgtggatcgccaggatggtgtagatcgcctccacgccgccggcgccgcccaacaagtggccggtcatcgacttggtggagttgaccaccagcttcttggcgtggtcgccgaaagccatcttgatcgcctgggtttcgttggcgtcgcccagcggcgtggaagtaccgtgcgcgttcacgtactgcaccgcgtcggcgttgatgccggcgtcgcgcagcgcgttggccacgccgcgggccgggccctcggcgctcggcgcggtgatatggtgcgcgtcggagctcatgccgaagccgatcagctcggcgtagatcctggcgccgcgcttcaccgcgtgctcgtactcttccagcaccagcacgccggcgccctcgcccatcacgaagccgtcgcggcccttgtcccacggacgggaggcggcggccggatcatcgttgcgggtggacatcgccttcatcgcggcgaagccgccgatgcccaggcgcgataccgcgccttcggcgccgccagccaccatgatgtcggcgtcgccgtactggatcaggcgagcggcgtcgccgatgcagtgcgcgccggtggtgcaggcggacacgatgccgtagctgggaccctgatagcccttcaggatggatacctggccggcgatgaggttgatcagcgagcccgggatgaagaacgggccgatcttgcgcgggccgccttccatcagcgccacgccggtttcctcgatcagcggcaagccgccgatgccggaaccgatattgacgccgacccgggtcttgtccaagcccggaatgtcgtccagccccgcatccgtcaccgcctgcagcgccgcggcgatgccgtaatggatgaacaggtcgtttcgccgcgcttctttcggcgagatgtattgggcgatgtcgaaatccttgacctcgccggcaatctggcacgccatgtcgctggcgtcgaaacgggtgatcttggcgatgccgctcttgccggcgaccagattggcccagccggtggcgacatcattgccgaccggggacacatggcccaggccggttactacaactctgcgtttggacacgaagaatctccgtgagagatgggagggcagtctccccatgaaaccttgccgctcgtctgaatcatatgataattcaaacgcacgtttgggaaccttctagcaaaagaacctctgcaggcgagccgaagcagcaccgggcagaggtcctggtcccgaaaaaagggattatttgttcaggttcgcgttaacgtagtcaacagcgtgttgaacagtggtgatcttctcggcttcttcatccggaatttcgcactcgaactcttcttccagagccatcaccagctcaacggtgtcgagcgagtcggcgcccaggtcgtcaacgaaggaggattcgttcttcacttcggcttcgttcacgcccagttgttcggcaacgatcttcttgacgcgctgttcgatgttgttttccatttgtataaacccttgacctttctgattcgggatagcaaaaccccggtattctacaaaaaaaaattagagcagcctacctaaatctcgccccggcgcatgccgggccagattatggcatcagcatacccccgttaacgtgcaaggtttggcccgtaatgtaggccgcacggtccgacgccaaaaatacaacggcatcggcaatatccttggcgtcgcccaggcggcccagcgaaatctggccaaccagcgcttcgcgttgcgcttccggcagcgcgcgggtcatgtcggtatcgatgaagccaggcgccacgcaattgacggtgatattgcgactgccgacctcgcgcgccatcgacttggtgaagccgatgatgcccgccttggcggcggcgtagttggcctggccggcattgcccatcgcccccaccaccgaggcgatattgacgatgcggccggagcgggccttcatcatgccgcgcatcacggctttggaagccttgaacaccgacttcaggttggtatccatgatggcgtcccaatcctcatccttcatccgcatcagcaggccgtcgcgggtgatgccggcgttgttgaccagcacagcgacggcgccgaattccttttccaccgattcgatcagcgcttccaccgcgccgtcttcggtcacgttcagcacccggccggcgccgcccttggcggacagccgttcgtggatggcggccgcgcccgattccgaggtggcggtgccgatcaccaccgcgccctcggcgagcagcgcgtcggcgatcgccgcgccgatgccgcgcgaggcgccggtcaccagcgccactttgccttgcagactcatcaatgtgtctccttgttgtcggcgcccgcccttgttcgtacgggccgccacgggcagggccaggcctgtccggttttcatcctgtcaggccagctggtcgcgggcggcttccagcgcggcgcgatcggtcaacgccaggcacttgacgtcgccatcgatgcgcttggcgagtcccgccagcactttgcccgggccgcactcggccatcagcgaaatgccgtcggcggccagcttctggatggtttcggtccagcgcaccggcatgtacagctggcgcgtcagcgcgtcgcggatctgctcggcgtcgttgtagccggcgacatcggcattgtgcagcaccggaatcgccggcgcgttcaaatgcacatcccgcagcgcgtcggccagacggtccgccgccgggcgcatcagcgcgcaatgggacggcaccgaaaccggcaacggcagcgcgcgcttggcgccgcgcgccttgcacagctccatcgcgcgctcgacggcggctttgtggccggcgatcaccacctggcccggcgaattgaaattgaccgcctccaccacctcgccctgcgcggcttctgcgcaggcggcgcggatgtcgtcgtcggacaggctgaggatcgccgccatcgcgccgacgccgaccggcaccgccgcctgcatcgcctcggcgcgcaaacggaccagcttcaccgcctcggcgaacggcagcgcgcccgccgccaccagggcggtgtattcgcccaggctatggccggcaaccaccgacggctgcttgccgttcagctcctgccaagccagataagtggcatagccggcggccagcatgatgggctgggtattgacggtggcgttgatcgcatcggcgctgtcggcctgcagcatcgcccacaggtccagcgacagcgtgtcggacgcttcttcgaaagtgtgttgcaccacgggcaggtcggcgaagccgtccatcattttcaggctttgcgagccctgacccggaaacagaaaagcaaaagccatagtcgactccagagaattcgacgcaaagaatgacgcaaagcgatggtgattgccaagcacgccgatcaagaaaccctgtcattatcggcgatctggcggcaaaaccaccattattgcgtcacttttaaaatgtcagcagcactgcgccccaggcgaaaccgccgcctatgccttccagcagcacggtgtggccgcgctgaatgcggccatcacgcaccgccacgtccagcgccagcgggatcgacgcggccgaggtattgccctgggatggcagcgtcaccaccacccgcgccatgtccaggcccaaatgcttggcggtggattcgatgatgcgcagattggcctggtgcggcaccagccagtccaccgcggccttgtccacgccggcttccttcaaggtggaaacggcgatgtcggacaaggatttgacggcgaacttgaacaccgccggaccatccatgtgcaagtaggggatgccctggatcttgccgccggaaatctgcgccggggtgttgagcaggccctggtagcggccatcggcggccagcttggcgtgcaggatgccaggctcgtcggactcgcccagcaccaccgcgccggcgccgtcgccgaacagcacgcaggtgcgccggtcgtcccaatccagcactcgcgacatgatctcggcgccgatcaccagcgctttcttggccatgccgctcttgatgtaggcgttggccgtggagagcgcgtagatgaagccggcgcacaccgcctgcacatcgaaggcgggaatgcccggcagccccagtttttcctgcaagatgcaagcggtgctggggaaaatcatgtccggagtggtggtggccacgatgatcaggtcgatctcgtgcttgtctatgccagcgttttcgatggccgcgttggcggccatcagcgcgaggtcgctggtcttgtgctgatcgtcggcaatatggcgcgcgcggatgccagtgcgagaaacgatccactcgtcgctggtatccacgcgttcggccaattgcgcattggtgagcacctgggatggcagataactgccggtgccgagaatgcgggaatagcccatgtttgtcagttcgcttctgcctcggattgcttgaggttgtttaattgatttgcaacccgttcggcgatgtgaccaatcacgtcggagccggcctcctcgcatgcctgcgccaacgcgtaacggaatcctgtgacatcggcgccgccgtggcttttcaccacgatgccgcgcaggcccagcaagctggctccattatagcggcgcggatcgatgcgtttcttgaagagcgccagcaccggcagcgcggccagcgcgcacaagcgcgtccaccagctgcggccgaactcttccttcaggaagacggcgaacatgtgcgccagcccctcagctgtcttgagcgccacattgccggtaaaaccgtcgcagactaccacatccaccgtgcccttgcagatgtcgtcgccttccacgttgccgtagaaattcagctccgactggcgcagcagttcggcagtctttttaatattgtcgttgcccttgatgtcttcgctgccgatattcagcagcccgacgctgggatggctccgcccttgcaggcagctcatcagttcggaccccatgatgccgaactgcaacagttgttccggggtgcaatcgacgttcgcgcccagatccagcacgcaggatgtgcccttgacattgggcagcagcttggcgatggcgggacggtctatgccgggaatggtcttgaggacgaagcgggcggtcgccatcagcgcgccggtattgccggcggacacggcggcctgagccttgccttccttgaccagattgatcgccacccgcatcgacgaatcttttttattcttgagggcgagctgaggcgcctcgtccatgcccaccacctgggtggcgtgctggatcaggatgcgctcacgcacggcaccgtcgtgcagggccagttccgcctccagggctggctggtcgcctacgagaatcagatgggtgtcggggtggtcttgcaggaattggatcgatgccgggacggtaaccttgaggccaacgtcaccgcccatagcatcaaccgcgacggtgatagtcatcaacgattgcggtataaaagtgcctacctaagttcgggaaggaagagaagacgggagcgaattactcgcccttggtcttcacaaccttgcggccacggtagaagccgttcgggctgatgtggtgacgcaggtgggcctcgccggtgctggcttcaactgccagtgccggagcggtcagaaaatcgtgggcacgatgcataccgcgcttggacggggactttttgttctgttgaacagccatggtcgactcctaagaaattcaagtagattctaatgcgaatccgggttactcggacttgggtctcttaagcgccgccagcaccgcaaacgggttgggcttgtcagccttggcgagcgagagagtatccctgctgcattcgtcgtgtttgggcgaatgcggcaagcccattatgatttcgtcttcgatcagcgcaatcgcgttcagttcgggctcggcgagaatggcgtccagctcctcgtcctgctcgcaggcttcatccagcttttcctggctggcaaacagcgtgatcaccgaatcggtggccaagctgaacggcatgccgtccaggcagcgctggcaagtgacttgcagcttggcatccagctggatgcgcagcgcgaagcgctgcagctcgtcacgaaagcccgtgagctgatacgacacctcgccggaggtgtcggacaggtcgctgtgcacacgctcgtcgagttcgcaaaccggcaccaggccggactgcgaacgcccttcccgggcgaacttgagcgggtcgatcaaaatcggtttagacataaacctcgcatgttacaatccactcccctgatttgtcaaaagaaacaaggcaaggacggaagcgcccgccccggcgcccggccttgccgcaacccgaccccgaacccatgcaaatcgtactggcctccacttcgcgctatcgccaagagatcatcgcccgcctcggcctgccattcagcgccgaggcgcccatctgcgacgaaacgccgctggccggcgaaaccgcgctcgaaaccgccgtgcggctggctcgcaccaaggcgcaatcgctggcgggcaagcaccgcgacgccctgatcatcggctccgaccaggtcgccttgctggacggcaagcagatcggcaagcccggcagctttgaaaacggcgtggagatgctcaagtggatgagcggccgcaccgtggtgttccactccgcgctggcgttgcacaacagccacagcggccggctgcaggagtgcgtgggcatcacccgcgtgacgctgcgccagctgaccgaggcgcagatccgcaactatctgacccgcgaaccggacgcgctccattgcgccggcagcgccaagagcgaaggcctgggcggcgcgctgctggaaaaagtggaatccgacgaccccaacgcgctgatcggcgtgccgctgttccaactgatcagcatgctggcgaacgaaggcgtggaggtgctgaaatgagcggcaccttgtttttgatccccgcgccgctcggcgacgaaaacgtcgcctggctgccggaaggcgagcgcgccaaggtgatccacatcacccacttcgtggtcgaggcggaaaaaaccgcgcgcaagcatctaaaagcattgggcgtaaccgcgccgatccgcgagctggccatgagcacgctgaacgaacacaccaaggaagcggatgtcgccgcgctgctggcgccgctgcaagccggccacgacgtcggcctgatctccgaagccggctgcccggcggtggccgatcccggcgcgcagctggtggcgctggcccaccggcatggcatccgcgtcgagccgctgatcggcccctcgtccatcctgctggcgctgatggccagcggcgccaacggccaatgcttcgccttccacggctacctaccggtggatgcggcggaaaaggccaaattggtgaaagaactggagcagcgctcgcggcagcgcaacgaaacccagctgttcatcgaaacgccttaccgcaacaacgcgctgctgcagcaactgcgcgagacgctggcgccctccacccggctcgcggtagcctgcgacctgaccctgccgacgcagaccatcgtcagccatcgggtgcaggattggccgcaaaacccgcccgatctgcacaagcggccggccatcttcgtgatccacgccgcctgagaagcgccatgcccaagaacacgcccatcatccagtcgctgctggataccgatctttacaagttcaccatgctgcaagtggtgctgcaccagttcccggccgcgcacggcgaatacgagttcaagtgccgcaaccatccggacacgccgctgacccagctgaaacagcaattggaaacccagctcgaccacctgtgccagctgcgcttcagccaggatgaactggactatctgcgcggtctgcgcttcatcaagagcgacttcgtcgattatctggagctgttccatctgcagcgccgcttcatcgaagtggcggaggaaggcgagcagttggccatccgcatcaaggggccgatggtgcaggcgatgttcttcgagatcttcgtgctggccatcgtcaacgagctgtatttccgcccgctggacaaccagaaagtgcgcgaagaaggccgccgccggctggaggccaagctggcggaactggagcgcttccagcgcgaggaggcggcggaacagcgcttcccgctgctgatcgccgatttcggcacccgccgccgcttcagccgcgactggcaggagcacgtggtggaaaggctgaacgccgcgctgccggaaatcttccgcggcaccagcaatgtccatctggcgcgcaagctgggcatcacgccgatcggcaccatggcgcacgagttcttccaggccttccaggcgctgggcgtgcggctgcgcgacttccagaaggcggcgctggaatcctgggtgcaggaataccgcggcgacctcggcatcgcgctgaccgacgtggtgggaatggacgccttcctggcggacttcgacctttacttcgccaagctgttcgacggcctgcgccacgacagcggcgacccctacatctggggcgagaaagccatcgcccactaccgcaagctgcgcatcgacccggccagcaagatgctgaccttcagcgacggcctgtcggtggatagcgcgctgcagctgcaccgccacttcagcccgcacatccaggtgagcttcggcatcggcacccacttcaccaatgatatgggcctggagccgctgcagatcgtgctgaagctggtcagctgcaatggccagccggtggccaagctgtccgacagccccggcaagaccatgtgcagcgacgaaaccttcctcgcctacctgcgccaggtgttccgcatcgccgcgccgcagtagccctcaataaagcagcgccatcaactgctggcgcgcctgcgccggcaacctgtcgccggccagcgccaccgcctgccggcccagcgcccggtaggcggacgccagctccgcatcttccagcaccgacaagtgccgctccaccgtgccgacgtcgccgcgcacgatggggccggtcaacgccgcatgcggtcccagcagcagcgcgttctccagcgtttgccgcatcagcccgcccagcaaatccgcagccagcccatccggcacgccagcctggcgggtcaggccttccgccatttccagcagcgccaccagaaaattggacgccaccgacaagccggcgtggtaagccgccttgccgcccggccccagccggaacggcctgcctcccagcgccgcggcgaaaccctccaggcgcgagcaggcctcttcatcgccctccagcgcgcacaaagtgccggcaaaccccgccaccgcccgctccgggtcggcgaaggagaacgccgggtgcaggctggcgacatgcgcgccctgctccgccagcggccgcagcagcgcggactctcccgcgccgctagcgtggaacaccacgctcccggccggcaccaccccagcggcggccaacgccctggcgcagaatgcgatggccgcgtccggcaccgccagcaagtacagatccgccgccgccagctgatgcatatcgctcaccgcccgccccgcgccgatgaattcgcaagcccgcaacaacggcggcatccgcctggccatcacatccaccacctcaaactgcccagacagccgcgccaagcgcgccaggctgctgcccaaccgtccggggccgatcaccgtcagcgtccgcatccttatatatacctttcccgagccaagccccgcccgctcgatccaacatcgcccggattgtaggccatacacccctcgcgcgcccgatcaccgccgctcttgcctgatatgagcgcgcccatccgcatggaaacccgtggccaaaaagcctcacatcgccatatggataaaactacgaaaaacaaaagtaaaaataatattactgtttaaaaccaatatcttgcacgaacacttcacacatatcagcaacataatttgaacatttgcaccatttacatagctgatgctttcttttagtatgatcgcaagcgaattcaagcagatgcaatctgcgcccgcctggattcacttcaagtcacgttgatttttcagcccgcccgcattggcgggctatttttttgcctaaatcacctcaatccgccaagaaattccgcaaaaacaggtgttcctacgcactgacgtttttttgcaacaagacaatccgccgcgcaaatacaaagtaacagtcctgactattcaataacttacgacacaaaaaatcgaacatttactttgctaaaaagcaacaatcgttgcttgatcacaacactatccgccagccatagttgcattttcacaacccagccaatagcatttgctcacattcctaaaacctaaaaaggatgacttgaccatgaaaaaaagtctgattgccctgctggtagccaccctgccggctgcagcttttgctgacgtaaccatctacggtaagatcaaaggcggcgttgagtacaacgacaacggcgtaaccaagcaaaccaacatcgacgatctgggttcccgcatcggcttcaagggtgctgaagatctgggcagcggcctgaaggctatctggcaagttgagaccggcttcggcattgatggcaccggcaccggctcctccagcggcaccttcgccaaccgcaactccttcctgggcctgcaaagcaacctgggtaccctgcgcttcggcaacgtgtccaacttcctggacagcgacatgggcacggttgacacctgggaatacaacagcaacgcgctgggtctgggcatcttcacccgcgacgctacccgcctgaagaactccgtacgctacgacctgccggccgtggttccgggcctgaccgccgccctgcaatacggcgccaaggaaaccaagggccaagcatctgccgatcgcgaaacctacaacctgggcctgggctacgagaacagcggcttcttcggcaagtacaactacagccacgaaagcaaagcggttagcagcgttgccgttgtcgtagacaaagccactggcaaaatcgaatcggttggcgtagtagatgccaaccacactgcagttgccagcttcgcccagaatgacactgctaacgagaagcaccgcctggaagttggctacaatgccaacaacctgttcgttggcttcggctaccagcaagccaagggcggcctggatgtagttggcagcgcttggggcaaccaagttatcgctggcttcgcagtaccgaatggccaaaccatcagcgcgaacggcaaggttaagactcgcgaatacgctctgaccgctggctacaccttcggcgccatcaccccgaaattcacctacgctcacggcgacaaggttgaagtcggcggcgtgaagctggacaacacccaatacgaccagtacgtactgggcgctgactacgctgtatccaagcgcaccaccatcggcgctcaatacggccagatcgctgtcaagggcaccggcaacaacgacctgaagtccttcggcctgaacatggttcacgcattctaattaaccggttcgacgcaagaacctgtgaacagaatgaaaaagcccgcttcggcgggcttttttacgtccattcgctgccggcttggcgaaaacagctagttcaagcattgccgccggaccggaccagccaacggcaacagcatcgacaagccgcatcccggctttcacacagagtgacatccgccgacgccagcccaatcggccggccatcccattgccgttccgcagccagctactggcgccattttcgattcgcgagccgcccagtcccgcaagcgccgcgcaaaaacaaacaccccgccgcaagcgacggggtgggtgatggtgaacccgaaaacggatcagaacggcagctgatacaccgggttgcggctatccgcgccctccagccggatgcgctccagctcgctgcgcagcgcgttttgcaaccactgctcgcgcattttatcgccatccggatgctcggacagcgtgcggtacagcgccatgccgtgcatggtggtcatcatggtgagcaaggtggcgaaaaagccggtggaaatggcgtagcgcgggaatagcgaagccatcatcgcgacgaagcggtcgcggaaatagatgctggcgttgccgaggaagatttcgcgcagatcgggcgtggtgcgcgccgccatcagcagctccagcagcacgatatggcgcggcgccatcaccagcgccttcatcagcgccacgatgcgctcttcttccggcatgccgggcggcagcttgccggccagggccaagccggcctcgaagatatcgtcgaccaccttgcgccccaccggctgcatcaattcgttcttggtggcgaaatggcggaacagcgcgccctgcgacaccccggcgcggttgcagatcaactgcacgctggtgccgtggtagccgcactccatcaggcattcgatcgccgcctccaccagtttgcctatggtggactccctgcggctttgctgtgttcgtctggtttgcatctattgttttatcatttatcgtcccaagcccggccagataatacgcgaaacgacgtacgcaagcgagggtgggcacattctaataacaagcaagacacgccaacagcacggcgctcctctctcccctggtggccacatcgcaaccggccactacagcaatactaccaaaacccgcagtggaatatgcaacttgcttcgttaaccggaactggcccaaacaccaggcggcagcgccgcagcggcagtcatggccggcccttgcccaggcgccccgcgcggggcggaggtgcgcattgtccgccgccctgcgcgcgcccgccttgcggcggcgcaaatgcgcgataaaagatagaacctgctctatttcattaattgctgatggactgcttccgccagcgtcgtcacttcaggctgaccgcggagaaatcgactcggccataggggttggccgcatagccgctgacatccttgcgcgccaggctgaaggcggtgggatgcgccagcggcagccacaaggcctgctcgtggatgagcttttgcgccgcctgatacagcttggctctggccttgaagtcgctggttttcttgccgtcggctatcagcttgtcgagccgcggatcgcaatagcgggcgaaattggtgccggactgcaccgcagagcaggaaaactggggcgtgaggaagttgtccggatcgccgttgtcgccggcccagcccatgaacagcatttcgtgctcgccggccttgccgcgcttgatcagctcgccccactccagcaccttgatctgcagccggatgcccactttcgccagatcggcctgcagcatctcggcgccggccttgggattggggttcagggtgctgccgcccggacgcacccagatgccgacatcgaagccattggggtagccggcctgggccagcagcttcctggcctgcgccggatcgtacggataaggcttgatggccttgtcgtagctccaggtgttgggcggatacaccaggttggcggcgacggcggtattgccgaacaccgccttcagataactggccttgtcgaaagccagattgatcgcctgccgcaccaatgggctgttcagcggctttttctggctgttgaacgcgacgaaggcggtcatgaaggcaggcgcctgccatacccgcagcttgccatcgccctgcgccgcctgcacgtcctgcggcttcggcgacagcgcgatctgacactcgccggcgcgcagcttctgcaaacggaccgcggaatcgggcgtgatggcgtagatcaacgccgacaccttgggcttgccgccgaaataggccggattcggcaggtagcgcacctgcgcgtccttggcgaagctcttgaagacgaaaggcccggtgccgaccggcttactgttgagatcggccgttttgccggcggccagcagctggccggcgtattcggcggagtagatcgaggcgaaacccatggtcaggctggacaggaaggtggcttccgggtagttgagctcgaaacgcaccgtctgcgcgtccagcttgcgcaccgccttgatcagcttgggaaactgcatcgcctgcgcatgcggatagcccgtcggcgcggtcttgtaccagggattgtccggattcagcatccgctcgaaagtgaatgccacgtcgtcggcgttgaaagcgcggctgggcttgaagtattccgtggagtgaaagctcacgccgggacgcaagtggaaggtatagctcaggccatccgctcccgcttcccagctgcgcgccaggccgggcttgagcttgccgctggcggcgtcgtactccaccaagcgattcatcagcacatcggcggaggcgttggtggtgaccagcgagttgtattgcaccacgtcgaagccttccggattggcgtcggtgcaaacggtgagcggcttggcggcgacggccagggccggcagccacgccgccaacagcagggcgttgatggttttcatgatgttctcctgacggccgccggcaatgccggcagcatgaatcgcattagggtaagtcaatatggggcaaaaaccaacgacttaatctacatattgatataaggagagcatccgctcacaacaacagcttgtggaactcgccagccgccagcgccgggctgcacagatagccctggtactcctggcaacctcgctgccgcagccaggccagctgcttcggcgtctccaccccttccgccaccactttcagccccagcatcctgcacatggtgatgatcaattcggcgatggccggcgtgctgtccagatccgcgatgaaggaacggtctatcttcagcgaactgagcgggtaacgctgcaaataggccagattggaatagccggtgccgaaatcgtcgacggcgatgctcaccccctgcgcccgcagcgcctgcaaggtgcgcatggtctgatcgtcatggcccagcagcaccgactcggtgatctccagctccagcctgtccgcctggcagccgctgtccgccagcacggcggccaccatcgccggcagcgccgggtcgacgaactggcacggcgacagattgaccgacaccatcaagtccagtcccatctcgcgccacaagcgctgctgccgcgtcgcctgggccaggatctgccgtcccagttgcaggatcagcccgctgtcctcgcacacctggatgaaactgtcgggcttcagcaggccgcgttgcggatggttccagcgcgccagcgcctcggcgccgaccaccttgccgctggcgacatccacccgcggctgaaagccggcgacgaactcgccctgctccaggccgcggcggatatcgctctccagcgccagctgcgcctgggtgcgcgcctccagcgccggcgtgaagaacatcaggttgttgcggcccgcatccttggccgcatacatcgccaggtcggcgtggcgcatcatctgctcgaggtccagcgtcccgtcgcggcacacgctgatgccgatggacgccgacacgctgatgtccatgccgcccagacggatcggcatgccaagcgcctgcaggatgtcccgccccagcgcttccgcccgccccgcggcgtccggcgccgccagcatcaccaggaactcatcgccgcccagccgcgccgccttctcgtcatgccgcagcagccgggacagccgcgcggtcatgcccaccagcagctcgtcgccgcgggcgtggccgagtgaatcattgacgtttttgaagcggtccagatcgatgaacatcagcgccgcctggcggccattgcgcagggcctgctgcagatagggcaggaaatcgctgcggatgccgttgcggttgggcaagccggtcagcacgtcgtgattggccaggaagctggcgcgcgcttcggcatgcttgagatcggtgatgtccacctcgctgaccagcagcgcgtcctgcccggacaccgcgtcgcggcaagcgcgcacggcgatctcgtgccagcgctcgccccgccgggtatgcacgcgcgccagttggcgcgcctccccgaccgccgccacgccctgctgcagcgcctgccaatcgccgtcgtggaggaaatgctggcgccagcgctcgccggcatccgccacctgggcgcgggcggagggattgcggtacagcgccatcccggcggagtcgtacagcgtgatcggcaccgaggtgtgcatcaaggcctccgcgctgcgcaagctggccggatcggcgctcagcgggttctgcgcttcgcagaacatcatcacccgcccgtcggcgcggatgccgcggaacgccaccttcagcacgcaggggcggccattgggatacagggtccagctttcgacgaagctggcgttttcccgctcgaagtcctgctgatactggcccagccgttgcgccaccgaaaccgacatgtcaagcgacatgtcgcgctgctgcaactcggccaggctgcgcgccccccacacccgcagcgcggcctgattggcccagaacacgcgcttgtgatcgatatcgaaaatccatagcggcaggcccagggcctccagcaacgccagatcccctccctgccaggagagcatgcttcctatcggcatagatgccgcaaccttttatttattcattggaaaacgccacgcaactgccatcgcggacaggcgccattgtagcaaacacgtctcatgacctgaccattttttactcaccaccggtccacgtcgccgcaatgccgggcgccaatgaaaaacagggcgatttcgccctgtttttcgtcatcccgcgcctgccgttcaggcggcttgcttgcaggcgaacagcctggccatgctgtgatgatggggccggccgtggctgagatccagcgcgtactcctcctggtaagccagcggcgccagcgcggaaaactgttcgcgcaactcgcccggccggtagtaatggcggacataggcggcggtttcgctgacatcgccccccctgccgctgcagccagggtcatccaccatgaacaccgccgcgaacaagtagccgccgggctccagccccgccatcatggactgggccagccgttcgccggcggcggcgtcgaggtgatccagcgcggtataggcgacgatgatgcggtagctttgcggctcgatctccaggtcggccaggttcaccaccttgccgcacaccgacagccggcgctggtcggccagctcgcccatgcgggaaaccgcctccgaagattcatccacgccgtacatcgaaaaaccgaggctggccagatagaaggcgttgcgtccctggccgcaggccaagtccagtccctgcccgccgccccgcacatcgaatttgtccagaaaatacatcagcgacaaggctggccggtcgccatagaaagaaccattgctgcgatagaaagcgtcaaaattagcgattcccatttcactcaccccgctcatgccgacgatatttcccagcatccactgcgcgcagcgcgcgctccgtgctgttcattgagtgatagttcgtacaaaaacgtatgactacttagttattctttctaagtatttacacttaatttgccattgaacatgaaaaaccccgccagacatggcctggcggggcgacagggattcggcagcgccgaggtcacatgtagttttcgatgcccgggcagctgcagaccagattgcggtcgccgtagacatcgtcgatgcggttcacactgggccagaacttgttctccagcacgtaaggcagcgggaacaggccctgctcgcggctgtacggccggttccagtcgcccgcaatgtcggccttgctgtgcggcgcgttgaccagcggattgttgtccgccggccatgcgccgttctgcacctggtcgatctcggcgcggatggcggccatcgcggcgatgaagcggtccagctcggccttcggctccgattcggtcggctctatcatcagcgtgcccggcaccgggaagctcatggtcggcgcgtggaagccatagtccatcaggcgcttggccacgtccacttcggtcacgccggaagcggccttcagcgggcgcaagtcgatgatgcactcgtgggcgacgcggccgttggcgccggtgtacagcaccgggtagtgctcgcccaggcgggtagctaggtagttggccgacagcaacgcgttttccgttgcctgcttcatgccctcggcgcccatcatcgcgatgtacatatacgatatcggcaggatggaggcggagccgaacggcgcggcggataccgcggtttggcctgcctccgcgcccggcaccggcgccaccacgtggttggcgatgaacggcgccaggtgcgccttcaggccgatcgggcccatgcccgggccgccgccgccgtgcgggatgcagaaggtcttgtgcaggttcatatgcgacacgtcggcgccgatgtcggccggacgagtcaggcccacctgggcgttgaggttggcgccgtccatgtacacctggccgccgtgggcgtggacgatttcgcagatctgcttgatggcctgctcgaacacgccgtgggtggacggataggtgatcatcagcgcggccaggttggcggcgtgctgttctgccttggccttcaggtcggcgacgtcgacgttgccggcctcatcgcatttcaccaccaccacctgcatattcatcatctgcgcggtggccgggttggtgccgtgcgccgattgcggaatcaggcagatgttgcgatgggcttcgccgcgcgactcgtggtagcggctgatcgccaacaggccggcgtactcgccctgcgcgccggagttcggctgcatcgagatgatgtcgaaaccggtgatcgcgcgcagctgcttctccaggccggcgatcatttccagatagcccacggtctgctcgcgcggcgcgaacgggtgcatattggcgaattccggccaggtgatcggaatcatctcgctggtggcgttcagcttcatcgtgcagctgcccaggctgatcatcgaatgattcatcgccaggtcgcggttttccagcttcttcatatagcgcagcatctcgtgctcgctatggtgcacattgaacaccgggtggctcaggatcgcggattcgcgcttgagcgcggccgggatcgcatcctgggcggcggcgtccaaggcggcgatatctgcctgcttgccggtgaacagctcgatcagcttggccagatccgcctcggtggcggcctcgtggaaggccacgcccaacacggtcttgcccacgcggcgcaggttgtagccggccgccagcgcggcggcgtagatggcgtcggccttgggcgcgtccacctgcacggtgtcgaagaagcggtcgaacaccagcttgccgccggcggcctgcaccgcgtgggcgaagatggcggccaagcggtggatgcgggcggcgatgcgcttgacgccctcggcgccgtggtagaccgcgtacaagccggcgatattggccagcagcacctggctggtgcagatattggagttggccttctcgcggcggatgtgctgctcgcgggtctgcaacgccatgcgcagcgcggtcttgcccttggcgtcgatggagacgccgatgatgcggcccggcgccgagcgcttcatctcgtccttgaaggcgaaataggcggcatgcgggccgccgaagcccatcggcacgccgaagcgctgggtattgcccagcgcgatgtcggcgcccatctcgcccggcgacttcaaggccaccagcgccatcacgtcggcggcgacggcgacgacgccgcccttggccttgatggcggcgatatgcggggtcaggtcgatcagatcgccggcttcgcccggatactggaacagcgcgccgaagtaatcgccgttgccggcctcttccggatggccctgcaccagctcgaagccgaagtacttggcgcgggtcttcatcacgtccagcgtctgcggcagcacgcggctgtcgacgaagaagcgcgtggacttggatttggacacgcggccggccatcgccatcgcttcggcggcggcggtggcttcgtccagcagcgaggcgttggccatttccaggccggtcaggtcgatcaccatctgctggaagttcagcagcgcctccagccggccctgggcgatctcggcctggtacggggtataggcggtgtaccagcccgggttttccagcacgttgcgcaggatcacggacggcgtcttcaccgggtagtaaccgaggccgatgaaggatttgttgaccacgttcttggcggccaccgctttcagggcggccagcgcctcggcttccggctgcggcgccggcagatccagcgcgcggttcaggcggatgtcggccggcagggtttcgccgaccagcgcgtcgatggaggccgcgccgatggcggccagcatctcggcgcgctcgtcgtcggacgggccgatgtggcgggcgatgaattcgttgcgattgaagagtgcggagagcgacatgttcaggaccttccattgctgccgcgaagcccgccatcgccggcgggcggagagagcgcgtggctcatcgtccgccggccggtgcgcggcggctggcttcgcggccaaaaaaaacgccctgcgtctggcgactgcagggcgggttcagctatcaggcgccgatttccttggcgtaggcggcggcgtccatcaggccatccagatcggcggcgttggccggcttgatcttgaagaaccagccatcgccgtagggctcgctgttggccagttccggctcgccttccagctcttcgttcaccgccaggatttcgccggcgataggacagtagacgtcggaagcggccttcaccgactccaccacgccggcctgctcgtcgcgggccagggccgcgcccactttcggcagttcgacgaacacgatgtcgcccagcaattcctgcgcgtgcgcggtgatgcccacagtcacggagccgtcggcttccagacgcagccactcgtggctttccacatatttcagttcggcggggatattgctcatcttgaagttctccagcttaagatcagatcaatggcggcggcagttccaacactgcagccagattattcgaatactttcttgccgttgcgcacgaagggcatcttcaccacgcgcacatcggtcagcgcgccgcgcaggtccaccagggccgtggcgccggtggcggccggcacgcgggcgatggcgatggaatgcttcagcgtgggcgagaaggtgccgctagtgatcacgccttcgccgacgccctccaccactaccttcaagccttcgcgcagcacgccgcggccttccagcaccaggcccacctgcttcatcttcacgccggcggccttctgcgcctccagcgcctcgcggccgttgaacttgcgttcggccggctcccaggcgatggtccagcccatgcccgcctccagcggcgacacggtttcgtccatgtcgtggccgtacaggttcatgccggcttccaggcgcagcgtgtcgcgcgcgcccaggccgatgggggcgacgccggcggcttgcaattgatggaagaaggcgatggcctgatcggcaggcaccatgatttccaggccgtcttcgccggtatagccggtgcgggcgtagaaccactcgtcctgcggcaggccctggaacactttcagcgcgcggatggcatcggccagctccggcttgatggagcagactttttcaatggcctgcgggccttgcaccgccagcatcgccaaatcgcggcgcacttgcagcgccacgtcgaagccggccttctggctttccatccaggccaggtctttttcggtggtgccggcattgaccaccatgcggtagccataggaagtgagatagacgatcagatcgtcgacgacggtgccttcggcggtgagcatgccggaatacagcgccttgccctcgaaaccgagcttggcgacatcgttggcgatcagtttttgcagccaggatttggcgtcggcgccggtgatgtcgatcaccgtcatgtgggaaacgtcgaacatgccggcgtccgagcggacgatctcgtgctctttcagctgggagccgtagtggatgggcatttcccaaccggcgaaatcaaccattttcgcgccggcggcgacgtgggcgtcaaacagcggggtacgtttcggggccgtcatgcgcggttccttcgagaaaagtgtggatagcctgtgtcaaccacacccctctgtccctgcacctgagattttccggctggatcagccgttagccccttcggtggacgccacgcaggcgccgctctccagattgcgcaagccggcagccgccgaccccgtgatacagtccttttgcctgagcgattgcgggtgcacttgcgccttcggcggcggccgcggggccgctctctcctgtatgacccggcgattatggtggcagtcgcggcggcttggcaagccgagtttatttcgaagtaaaacagtttatttttctgtgtttatcagaaaaatatcgcaaattttttgtgtttattattattcgaatatgaaaatttcctgagccatagccgccatccgccgcgggcggccatgaaaaaagcgcagcggtcgacgctgcgctttcgggctctggcggcgctggctcaagccgccgcgtgccgctccttcaactgccagacgtagaccggcaggcccagcatcagcaacagcatgccccacatcacggtatcggcgccggaaccgtacaatgcccacagcgaatagacgaagccgatgccggcgaagaagccgggggcgacgtagtccttgggggcgaacgccttgccgcgcatcagcatgatggcgatcagcgccatcgagcagaaagcgtacggcagcagcgtggtggcggtggccagcaggatgatgaattcgaagatcttcacgccgctgtcgccgccggcgtatttcatcgccatcaggatggtgaccagcgcgctggacagcaccaggccgaagatgggcacgccggcggcgttgcgctgggcgaagcggctggggaacagcttgtccttggcggcggcggccggcacatgcgcctgcatcaggctccagccgttgagcgcgccgaagcaggacaccaccgcgccgaagcccaccgcccaatagccccagtcgccccacatcagccgggcggcgtcggcgaacggcgcttgcgacgcggccagcgtgtcggccggcatcagccccatcagcgagatggtggacaaaatgtagagcacggtcgccagcaaggtgccgatcaccgtcgcgcgcggaatggtcttttccggctccacgacatcgcccgccggcaccgatgccgactccaggcccaagaaggcccacagcgtcagcgccatggtggccgacagcgacgacagcagcggcttgccgtgcggattgaaggccaggttttccggatgcatgtggaaaaagccgatgaacgtcaccgcggccagcggcagcagcttcaacagcgtggtgaccaccgccaccatgccggagctgcgcgcgccgcggctgttgatccaggtgacgatccagatcaggctgatggcgaaagcgccggccagcggctcgttatggccgaggatggggaaaaacacctgcatatagctggtggccgccaccgccagcgcggcattgccggcccacagcgcgatccagtagccccaggcgatccagaaaccggcgaaatcgccgaagccggcatgaatataggcatacggcccgccttcgcgcggcaggatggccgacaggcgcgcgaacaccagcgccaggcagatcgcgccgccggaggtcagcaaccagcccagcatcgagatgccgccgaacggcgccagcgaggccggcagcagaaacacgccggaacctatcatattgcccaccaccagggcggtgcacatccagaccccgagcgagcctttcttttggatggaactgttttcgctcaaacctgattctccgtctagggcgaaagcatccagcgccgggcgctggccggcccggcgtcaaacatgcggaataatgggaaacaacggcatcagctggctcgcctcacaggcttcaagatagcccagcctgggcttcttggccgatctctcggcatcgccgcgccgcgggcgccagccgccgcgccggaaaaaaagggcgcattaaaacacagatttgacgtaaaaacatgtcgcattggcgatttttttacaaaaaaaccgttacgcgacagatgcttatgtcaattgaataagcggacgcttatgcatgaggcaggatcagcgggccgcgcggcgcgcggctcagcgaccaattggcgatggcccaacgccacagttcgtccagcctgccgcactcggccggcggcggatggcccagccagcccagcgccgcgcgcagctggcgcgcggcgtcgccgccgcttatcgccggcgccagcgtctgcttggacaatttctcgccggcggcgttggtcagcaccggcaggtggcaatagccgggcggcggcaggcccaggctgtcgtaaacctgcagctggcgcggcgtcgacaccaggaggtcggcgccgcgcacgatgtcattgacgccctgctcggcgtcgtccaccaccaccgccaactggtaggcccaaaagccgtcggcgcgcagcagcacgaaatcgccgatgtcgccggccaggttctgccggcattcgccctgcagacgatccatcaccgacacatcccggtcgggcgcgcgcaagcgccaggcccggccttccctgccgccgggacagccgttgcggcaggtgccgggatagacatagccgtccagaccgcgccgggcggccgcggcgatttccttgcgggtgcagcagcaggcgtaggcatggccgctggcggccaactgcagcagggcggcgcgatagcgctcgtggcgccggctctggtaaaccacctcgccatcccattcgaaaccgaaggcctccagcgtgcgcaggatgtcgtcggccgcgccgggcatttcccgcggcgggtcgaggtcttccattctgagcagccattcgccgccgcggctgcgggcctccagataactgccgaccgcggtgctgagggagccggcatgcagcaggccggtggggctgggggcgaaacggccccggtatgatgacttggacatcgggattggaggactgaaatctacaaggggacgaattatcgctaaaataccattatcccgatctacgattcagcctcgatgaggacaccagaatgacgtacgttgtaaccgatgcctgtatcaaatgcaaatacaccgactgcgtggacgtgtgcccggtggactgcttccatgaagggcccaacttcctggccatcgacccggaagaatgcatagactgctcgctgtgcgtggcggagtgcccgattagcgccatttatgccgaggacgacttgcccaagggccaggaaaacttcctggccctcaacgcggaattggccaagaactggccggtgatcaccgaaaagatcgatccgctgcccgaccatgccgactgggccgaggtgaaggacaagctgcaatacctggaacgctgaacgctccgcctgtcacaggaacagatcgatgtcgccggtcttggcgccttcgccctgttccaggatgcggccgcggtagggctgctcggccttgaccgccacgccgctgcgcttcagcttcttgatcagcaccctgccggtttcggtgaagaaatacaccttgcgcgcgcactcgcccagcaagtcttcggccagcaccggaatctgctcgttggcgaggtagctgcggatgaactggctgttgcgctcgccgacgttcaccacggtcatgccctccagcacattggccgcgccgaagatcttagcctccagccggtgccgcatcgcccccagcttctgcatgtcggtgatcagcaactccatcgcgttgacgccgaagcgcgccgcggaagcgccggcgcccagatccagcgagccttccggcagcaggaagtggttcatgccgcagacgccggcggtgcgatcgctcaagcacaccgccacgcaggagcccaatagcgtcaccagcatcagccgctgattggtggcgtggaattcgccggggaacaccttcaccgccatcgtctggaaatgcttgtcgtaatagcggttgccatccatcgcgccggggaagttcatgtcatctacctttcgccatgcagttgcagacactcgacaacccggaacgccagcgaagccagcgggcagacgtgcatcaccgcccccgccttgaccgcttccttcggcatgccgtacaccacgcagctggcctcgtcctggccgaaagtgacggcgccggcctggcgcatccgcaacaggccggcggcgccgtcccgccccatccctgtgagcagcacgccgatggcgttgccgcgcagatgccgcgcggcggaatcgaacagcgcgtccaccgccgggcgatgacggttgaccggttcgccttggtccagcgcgatctgatagccggtcggcccgcccggcctcacccgcatgtgcgagtggcccggcgcgatgtaagccgcgccgatttgcgccggctcgccatccctggcctctgtcacccgcatcgcgcacaaccggtccaggcgggcggcgaaggtgaaagtgaaatgttccggcatgtgctggacgatcaggatgggcggacaattggccggcatgcccagcaaaaactccttgatcgcctcggtgccgccggtcgaggcgccgacgaaaatcagcgcgcgcccggcgtccgggccagccagcatgccaaccggaaccggcgggaaacgcatcggctggcgcagacgcgcggccgccgccatcctcagcttggcgcggatttcctccgcatagtccggcattctgcgcgcgacatcctctgccggcttgtgcacgaaatccaccgcgcccagctccagcgccgccagcgcggtttcggagcctgccgccgtcagcgacgagatcatcaataccggcgtcggccgcagccgcatcagccggcgcaagaactccagcccgtccatgcgcggcatttccacatccagcgtcaccacgtccgggctggtttcccgtatccgctcgcgggcgaggatggggtcggaggcggtcgccaccacctccatgtccggcgccccgttgatgatggcggtgagcaggctgcggatcagcgccgaatcgtcgaccaccaccaccctgatcttgctccggatgaccgccatgcccgcctcctagccgccgtccgggcgcgccagccgataggccgtcctgccgcagccggcgaaggcctcggtcagatgcgagatgttttccgagtgccccaggaacagcaggccatccggcttcaggcacggcgccatccgcgacaggatgtccgcctgggtggccttgtcgaagtagatcagcacattgcggcagaaaatcacgtcgaaacgcccgatatcgggccatgtcgacgccgccaggttgaactggaaaaacagcgcggcctcccgcgcctgccgcttgagcctggccatgccctcattggctcccgcccctttgtcgaaatagcgtttcagcagatgcggcgcaagctggacgactcgctccagcggataaacgccgcgcgccgcctgcgccagcgcctgggtgtcgatatccgacgccagcagctcgaaagcgccgccgccggactcgcgccacgactccagcaaggtgatggctatcgaatacggctcctctccggtggaggaggccgcgctccacacccgaaacgtctcccccgccggccggcgtcggcggacatgctcgcgcagcatctcgaaatgatgcggctcgcgaaagaaggacgtgaggttggtggtgagcgcattgatgaaaccctgccactcgccctcctcctggtcttgctgcagcaggtccaggtattcgccgaaactgcgcagtccgcgcgagcgcacccgcctcgccaggcgcgcgtagaccatgtgttttttggagtcgtgcagcgcgatgccggccttttggtagagcatgtcccgcgcccgccggaaatcgctgccggtgaatttcagctcggtctcgtccatcatgccgtccccgcccgctccttagccagcgcgccgccgggcctgccgcggatgccgccgctcaaaactcctcccatgtcccgtcgtccgcgtcccgcggcggacggataggctccagcgcccgcgccggaccccgtcccttggcggcgaatgtccacgccgccggctgccggctggcgagcggcctcgtctgcggcggctggccgcttcgccccgattcatccagccgaaacaccgccaccgcgccggacaaatagcgcgcctgctcttccagcgactccgccgccgcggccgcctgctccaccagcgcggcgttcttctgggtgttttcgtccatctgggtgaccgccaggttgacctgctcgatgcccgaactttgctcggccgaggccgccgagatatcgctcatgatgtcggccacccggcggatggacaccacgatctcgtccatggtccgccccgcctcgtccaccagccggctgccggactccaccttgtccaccgagtcgccgatcagcgacttgatttccttggccgccgccgccgagcgctgcgccaggctgcgcacctcgctggccaccaccgcgaagccccggccctgctcgcccgcgcgcgccgcctccaccgccgcgttcagggccaggatattggtctggaaggcgatgccgtcgatcacgctgatgatgtcgactatcttcttggcgctgtcgttgatctcgttcatcgtcgacaccacgtcgcccaccaccttgccgccccgcgccgcgatgtcggacgcgcctatcgccagcgaattggcctttctggcgttttcggcgttctgccgcaccgtgctggtgatctcctccatgctggacgcggtttcctccaggctggccgcctgctgctcggtgcggctggacaggttggcgttgccggcggcgatctcccgcgccgcggtgttgatcgtgtcggtggagtccttgatattggcgacgatctccttcagcttgtcgacggtggcgttgctgtcggccttcagctggccgaacaggccctggtagtcggccgatatgctgcgggtgaggtcgccaccggccagcgcgcccagcacgccggcgatatcggccagtccctggctggtcacccccatcagctgattgacgccttcgctcagcaagcggaaaaagccctgcttgccctccacatcgatgcgtttgccgaactcgccggcggaagcggcgctgacgatgccggccacctcgcgctcgatctccacttcagcggtgcggtccttccactccaccaccgaacccagccgcgcgccgtcggcgccgaacaccggattggacaccagcgaaaacgtgcggccggcgacgacgatctcggcgcggtaagtggcgcgcatattggccagcagctcgcgctggtgggcgggattcttgtggaactcgtctatgctggtgcccaacagccggcgcacgtcgaaatggggcagcgccttgcgcagatcggcctccacgctgcgcagcatgtcggtgacgctgtggttcatgtagatgatgcggcgctcgttgtcggcgatcatcacattggtggtgcaattgtccagcgcgttgcggatgcgggcgttttcggcggcctgcgcgcgctcctggtccatccgttgctgcgcctcctgctgcagccgcagcatctcggtgttgtcctgccattccaccaccgaacccagccgctcgcccttggcgccgaccaccggagacaggatcaggccgaaggtgcgcccgcccaccgcgatggacgagcggtgcgtgtcccgcgcctgcgccagcaggccgcgctggtagccgggattcttgtggaattcgtcgatgctggagcccagcagccggctggccgaaaagctgggaatatccttgcgtatgtccggctccgcgttgcggaacatcgccagcgccgaaccgttggcatagatgatcttatgctccgcgtcggcgatcatcacgttggtggtgcagacgtccagcgcgctgcggatgcgggcgttctccgccgccgccaggcggtcggcggccaggcgcgcatcctcttccgccttccgctccagctcgcgcgtggcgtccacccactccaccaccgcgcccagcttgcggttctgtccatccaggataggcgtcaacaccagatggaaggtgcgtccgcccaccttgatggtgccgcgatgggtgcctcgcaaatcctgcagcaagccgcgctggaacgagggattgcggtggaagctgtctatgctgcagcccaggatcgcccgggcggaaaactgcggcagctcctgccggatgtccgcctccgcctgctggaacatgtccagcgccgcccggttggcgtacaccacctgatgctcgccgtcggcgatcatcacattagtggtgcacacatccagcgcgctgcgcagccgcatgttctccagcgagcgcgacaccgcggcgcgcagaaaggcgaacggactgctgtcgtcgccgtcgcgcacattgaacgccgtgcgcacctcgccgccggccaattcgcgcagcaccatcgccagtacccgcggatcgccgcccaactgcctctccagagcccgcgccaacagccagtacagcgcgacggccagcgccgccagcgccgcgccggcgaccgcgactccgtccgcggcgcggccggacgatgcgcccgcctccgccgcggccagccgcagcgactgctcgccctcgaagcgggcatagcggccaaccgcctcctggtatttttgcgctgccggccacagcgaggcgcgcagatagatccgcgcctcgtcgccatgggccgcagccgccagccggcggtagtcggcgatctggccgcgcacggcgagtccggcctcgcgcgcggcctccagcagcggtttgccgtcgccggcggcatgggccgtcaacgcgctcagccccgtcatcgccgcctccagcgcggcgtcgacccgcggctgctctgcccgccattgcgcgccgtcgccgccggccagcaggccggccacgcgcagaaccaattgggcgccggcatcctgcgcccgccccgccagcgccaattgcccggcctggatcagccggccggcggcggcatcgtcgtcgcgcgcctgctggccgcgcaattgcgcctgcgccaggaacaaagccgccgctagcgccgccagcagcagcccgaagccaagggccagctgatgcttcagcttcatgtcgctcatgtttgcttctcccttaggatgccgccgtcaggaccgggccgccgcgtcggtcagcgccatctcttcgctgttcatcaggcgctcgatgtcgacgatgatgatcatctgctcgtccaccatgcccaggccttcgatataggcggtatcgacgctggcgccgaactccggcggcgcgcgcagcgcctcctggcccagctggaccacgtcggacacgccgtccaccaccatgcccaccgtccgcttgccgagattcaggatgatcaccacggtgaaggcgttgtactgcgggtcgcccaggccgaatttcaagcgcaggtcgacgatgggcacgatgctgccgcgcagattgatcacgcccttgatgaagtccggcgcgttggcgatccgcgtcaccgcgtcgtagccgcgaatctcctgcaccttcagtatgtcaatcgcatattcttcgtcgcccagcgtgaacaccagcagttcgcgcgcctgggcgtcgttaggcttgtccatcggcatgggccgctcccccccgcctaccctgcgcccgtctcggccggcgcgacggcgctggccggcccgcgctggccgccgtggctgcggactatggttgcgatatccaggatcagcgccacccggccgtcccccaggatggtggcgccggccaggccgtccaccttgcggtaatgggtttccagatttttcaccacgaactgctgctgtccgatcaggtcgtccaccagcagcgccgcccgcccgcccgatgcctcgacgaccaccagaatcccgccggtggcggcgcagccggcgtccgccacgccgaaatgccggcccagcatgacgatgggcaggtattcgccgcggatgcgcaccacttcgccgcggccggcgatggtcttgatctcgcccggcgccggctgcagcgactccagcacgcaacccagcggcagcacataaatctcccggcccacccgcaccgacatgccgtccatgatcgccagcgtcagcggcaggcggatgctgatggtggtgccgacatccagcatcgagtcgatttcgatgcggccgcccatgctctggatattgcgcttgaccacatccatgccgactccgcggccggagatgtcggtgacttccgccgcggtggagaaaccggcctcgaagatcaggttccagacctcctggtcggacgcggcgtcgtgaacctccatgccgcgctcgcgcgccttggccaggatgcgctcgcggtcgaggccggcgccgtcgtcgcaaacgtcgatgacgatgctgccgccctgatggaaggcgcgcagcgtcagcttgccggccggctgcttgcccttttcgctgcggactgcaggagattcgatgccgtggtccaggctgttgcgcaccaagtgggtcagggggtcggacagcttctcgacgaagcttttgtccagttcggtgttctcccccgccattttcagctccacctgcttgccaagcttgccggccaagtcgcgcaccactcgcggaaatcgcttgaagacgaaggcgatcggcgtcatccggatcgacatcaccgcctcctgcagttcgcgggaattgcgctgcaaggcaccgatgccgctgagcaggcgctcatgctcggccggatcgagcgcgctgccggactgcaccagcatcgactgggtgatcaccagctcgcccaccagattgagcagcaggtccactttttcgatattgacccggatcgagctctcgccggccgccggccccttgtccgcctgcgcaacggcggctggcgcgggtttgaccacgccgggcgcttcggcgaacaagccgaagccctcgccctcgatatcggcgccgcgggctggcggcggcggctcgaacaaaccgaagccggagccggctccctccgctgcggcggccgcggcgtcgcccgacaggaacaagccgaaaccgccgccttcctcgcagccatgatcgacgctgatgcggaactgctcgggggccagcatgaaagccagcgactcggccacctcgccggcgtccagcgcagacgtgaataccgccacccagggcagcccggcctgcgccgcgccctgctgcaccacggtcaggtcgccatgggcggccagcgagtccagcagccggcgcatatcaaggccctccgccggcgacaattcgagaaacagcgtccagatccgctcctgcccaggcgccatcgccgccccgaccagcgccggcgccgccgccggctcgccgccggcgctgtcttcgatgtcccgcagccgccgccgcaccgcctcggcgcgttccgggtcggcgcgcgcgccgcccttgtgggcggccagcatgccgtgcagcacatccttggcttgcaggaaaacgtccaccatctgcgcagtcagcttcacgccgcccttgcgcacccggtccagcaggctttccagcacgtgggtcaggtccgccatgtcggaaaaaccgaaagtggccgcgccgcccttgatcgaatgcgcggcgcggaacaccgcatgcaggtcttccgcctgcggctcgccgacatcgatcgccaacagcagcgattccatgccggccaggtgctcatccgcctcgtcgaagaaaacctggtgaaactgcgacatatcgatggccacgggccctccttccggacgccgcgctaaccgaccaggcgcttgacgacatccagcagccgttgggggtcgaagggcttgaccagccagccggaagcgccggcggctcgccccagcgtcttcatttcatcgctggactcggtggtcagcatcaggatcggcgtggccgcgtaggcgggctgcttgcgcagcgagcggatcagcgtcagcccgtccatgcccggcatgttctggtcggtgagcaccagatcgaactgcgcgcccagcgccttgcccagcccggctttgccgtccgccgcctcggctacctcatatccggcgctcttcagcgtgaagctgaccatctggcggatcgacgccgaatcatcgacggtaaggattttcttcgacatgggatttccgctagcaaatgattccgatcgatgcgatcgccgccgccaggcctgctggccgggaccggcggatggcgtcatcggcaaacacggcagccgcgccgtcgccgtctttcgccgctcggccaatcccgctcatcattttatgtgatcaaccataatcggaagcgaatcaagcagattctgcgcgaagcacgcgggagacggggcaaggactctgtgcgaagccgggcagctcgctgcccggctgaggacgtgccacgatgatgcgccggacgcggcttaggcgaactggaagttgaaatgggtggacatattggcgatctcaaacacctgcttcaccgccggctggcagttgactatctccatagtcatccggttcatggccgctctctcccgcaacagcagcagcatgcccagcgccgagctgtctatttgcggcacctgttccatatcgatgcggatgattttcaccgcgttattgtccagcaactcctggcctgcctggcgaaattctcggtgcagattgaaatcgaactgcccgatcaggatgatccggccaatgccgccttccactttgactatcggtctcatttcagatcctcggctttccttcaggtttgcctccaaaatttgacggacagccgaatgcttcgcccgcggcctgccagttgcaagggagaagccttcgccatccgccaccttgctgcaacaacgcagattgccactttcaaaatcatggccgggcaggccgacagttcgctccccctggcccggcatcccaaacagaaaacgaatgcgtccgccggccggcggacgcgcggcgccgaccgcggctcaggacgcggggcggatggtgaacatcttgttgaagcaggcgatttcaaacacctgcatcactgcctcccggcaattgatcaagatcatcgatttcttctgcccggcggcgcgctccttcaacagcagcagcatccccagcgcggaactgtcgagaaagggcacctggtcgaaatcgacatgaatctcctgcaccgccggattgtccagcaactcctggctggcctggcggaaatccttgtgcaagttgaagtcgaactgcccaatcagccgcatggttccgatactcccctctacgctcacaatcggtttcatcactgatcctcggctttccttagattccagatacattgaacggactgcgtcgcccatcgcggacattactcccggcagaccggcagcttcaactcgaaacaggcgccgcccgacgtcctgttgtaacaacgtacattgccgcccagttcttccgccaccttcttcacgatggccagccccaggccggtgccgcccgggcgcatggtgaagaacggctcgaaaatcttgtcggccaccgcggcgtctacccccggaccgccatcgtcgacgcggaaaaccacgccgtcccgcagcttctccaccgccagcgccaccatcgcgcccggcggcgtgaactgcagcgcgttttccagcagattgagcaaggcgccctgcaacgctttgcggtctatcaagaccgttatggcagactccgccggcagatggcaatcaaaaatcacacctttgtcatggcattgcggcgccattaccgaacagacatcctccaacagcgcggccacctccaccatctccagcgacgaaatctggccgcgcacatagctcagcatattctggatcaagccctccagcgcccgcatcctggccaggctcttgtcgacgaagcgggcgcggtcctctggccgcggaatatcctgcttcagattggcggtatacagcatcgcgctggccagcggcgtgcgcagctggtgcgccagcgccgcggccatgctgcccatcgaggccagtttctgctgctgcgccagctcgctggtcagctgatgcagccgggtgacatcgtgaataagcacaatccgcccgcccgaagccggcagatcctggtattgcagcgtcagccggcgcgactcgccgccctgttccaaggcataggtatcgtccaattccgaacgctgcaggccggtcatgaaatccgaccacatttcacctatataacagccatttaacagcatctccgccgccaggttctccgcgatgacccgtccttccggcgacagctccaccacgccggccggcagcactttaagcaacagtgccaaacgttccgccaacgcggcattctcgtcgcgctgtttgcgcaactgattgttcgcctcgtccaattgggcgttcaaaacgttgacctgaacctcaagttgcctatatgcatcaatgagttggctggaaaccgcattgaactgctcaaatgccgcctccagttgctgctgatccttcaggcttgaaaccatagtcgccatcgcttcactgtcatttgtaaaaaccacttaaacagtatgataatgatccatctacggtcagccaacttgcgtccgacatggccgcgagcaaaaaaaaccgggaaaaactcatatctggcgtataaagggaagtagtacgccattccaaaagatgctgcggaggtttctgtgtcagagcttctcaaaaaaatcgacgccagaaccaaactggcaggcaccaacaagctggaaatcctgctgttttccctagggcatgatcagcgtaccggccgcaaggaagtttttggtatcaacgtgttcaaggtgcgcgaagtcatgcgcacgccggaaatcacgtcggcgccggaaatgccgtcctcggtcgaagggatggtcagcctgcgcggcgcgctggtgccggtgatcgacctggcgaaatacgctggcattgtgaccagcaaccgcccggaaatcatgatagtcactgagtacaacggccacactcaaggcttcctcgtcgaggcggtcgacacaattctgcggctggactggtccgccatgcgcgtgccgcccgacatgatcaccaaccgcatggccggcctggtgaccgcggtcaccgagctggacaacggcacgctggtgatgatgatggacgtggaaaaagtgcttgccgaaaccagcatcgtcgatgacgggcacagcttcatcaatatcgaaccggtaaaggaagagcgccgcatcttcttcgccgacgacagcgcggtggcgcgcaagcagatcgagcgcacgctggaagcgatgaacatcaagtacacctcggccatcaacggcatgcgcggctgggaagacctgcagaaaatggccagccaggccgaggccgccggccgccagctgtgcgacgaactgcatctggtgctgaccgacgtggaaatgccggaaatggacggctacatgctgaccaagatgatcaagagcgatccgcgcttctccggcatcccggtgctgatgcactcgtcgctgtccggatcgtccaaccagaagctcggcgagtcggtcggcgtcgactcctacgtcgccaaattcgagccgcagaagctggccagcaagctgcgtcagatgctgaaactggaaccgagcaactaagtacggccttacttcaagattctcaagggatagggataagacatgcctagcaccgacgcctccttgcttgccactgttgacgccaggaccaagcttgccggctccaacaagatggagattctgctgttctctctgggaacccgcgagacattcggcatcaacgtgttcaaggtgcgcgaagtctcgcagacgccggccatcaccaagacccccaacatgcccttcggcgtggagggggtgctgtcgttgcgcggcaacatcattccggtcatttctctggccaagttcatcggccatgacaacaacggcagcaagttcgacaccatgatcgtcaccgaattcaacaagagcacccaggccttcctggtggactcggtggaccgcatcatccgggtggattgggacaaggtgcgcgcgccggaaaacatcatggcggcggcgggcaccaatcaaaacctgatcaccgccgtcaccgagctggaaaacggcaagctggtctccatcctcgacgtcgagcagattctcgccagcgtcgtcggcgagccgcgcctgccggacgtgccgaccgcccagctggaaatcgaccagtacatcttcttcgtcgacgactcggtggttgcccgcaaggaaatcaccggcgtgctggaaaaaatgggcatcaagttccagcaggccaccaacggccgcgaggcctgggaccgcctgcaggtgctggccggccgcaactggggcgaaggcgaatgcctgcacgactacctgaagatcattctggtggatgccgaaatgccggaaatggacggctacgtgctgaccaagctgatcaaatccgaccagcgtttcaagggcattccggtgatcatgcactcgtcgctgtcgtccaacgccaaccgggcgatgggctccagcgtcggcgtggattcctatgtggcgaagtttgacccgggcgtgttggcagaaactttgattccattcctgcaaaggtagtcgctacaatgtgcgccttgatggaacatagataattcaggatatacctcgatgtcagacaagaatatgaaatttctggtcgtggacgacttctccaccatgcgaaggatcgtccgcaacctgctgaaagagttgggtttcaccaacgtcgacgaggctgaagacggccaggtggcgttgcacaagctgaaaacccaaagcttcgacttcgtcgtttccgactggaacatgcccaatatgacgggcattgagctactcaaggcagtccgggccgatcctcagctcaagcatctcccgttcatgatgatcaccgccgaggccaaaagggaaaacatcatcgaggcagccatggcgggcgccagcggctacatagtgaagcctttcaccgcggccaccatggaagagaaaatgaacaaaatcttccagaacatgaacaagccagcctgagcatcgcacaagactgcccgcattcgcattgaggaggattgaaagtgccggaccatatgttggagaatggagactcgccagagctcgaagccctgtttgaaagcgttgcgcgccagcagcaggatcaggagccgccggccgccgcgccggcaggcgaagagaccgcttccaagatgttctcaagtgaaaccaatccctccacgatgtacgaacacatcgggcagatgacccgcaagatgcatgacgcgctgcgcgatcttggatatgacaaatcgctggaaagggtagccgaaaccattccggatgccaaggaccggctggcctatatcgcgacgctgaccgaaaactcggccgagcgcgtgctgaacgccaccgacatcgccaaaccgttccaggacaatctcgaacgccaggcgcaagcgctcagcgaacgctgggaaaagctgttcgccaacctgctgagcgtggaagaattcaagaacctggcggccgaaacccgacaatacctgaaggacgtgcccagccagacccaggcgaccaatacccagttgctcgaaatcgtcatggcgcaggacttccaggacctgaccgggcaggtcatcaagaagatgatgggcatggtcaagattctggaaaccgagctggtcagcttcctgatcgagttctctcccgacgagaaaaagggcgagctcaacagcagcctgctgaacggccccgtcatcaatccggaaggccggaccgacgtggtcaacagccagcagcaggtagacgatctgctggaaagcctgggcttctgagcaacgcaagcaagagcagacaacgtacgacgcgtggggtggaaaaatgagcgaatttggcggcatggaagagttgttaggggacttcctgatggagtccaccgaccttctgtccgatgtggacaacaaactggtcgaactggaaaagcgtccggaagacaaggcgctgctcaatgatatcttccgcggtttccataccatcaagggcggggcgggctttctcaacgtcatccccatggtcaacctgtgccaccgcacggaaaacctgttcgacaagctgcgcaacggcgagctgcacatcacctcggaagtgatggacgtgattctggacgcgaccggcatcgtgcgcgacatgttcggcaccctgggccagggcctgatgcccggcgacgccgacccccgcatcttggccgcgctggatgccgcgctggcgggcgagccgctgaccgaagccgcgcccgccgcgccggagccggccgtccagcaagccgctccggccgcagtccctgccgccggcagcccggactggaatcagttgtaccaggcagtcgctcccgcagccgccgctgcggcccccgcggcagcgcctgccgcgccagtcgccgccgcggcaccggcgccggcgcgagtggatgccccgcctccggccgccaagccgccggcgccgaagcctgcgcagcaagccaagcccagcggcaacgctcccgccgccagcggcccgcaggaaaacaccatccgcatcgatacggtgcggctcgacatggtgctcaacctgtccggcgaaatcggcttgaccaagaaccgcctgaccacgctgcgcaccgaaattctgcaaggcaaccgcgacaccaacacgctgcgctcgctggacgaagccatcagccagctggacctgctggtgggggatctgcagaacgcggtgatgaaaacccgcatgcaacctatcggccgcctgttccagaaatatccgcgcttggcgcgcgacctggcgcgccaattgggcaaggaagtggaactggtgctgtccggcgaggaaaccgagctcgacaagaccatgatcgaggatctgaacgatccgctggtccacctggtccgcaacgccgtcgaccatggcatcgagtcgcctgaggaccgagtcgccagcggcaagaagccgcaagcgctggtgcaattgaccgcagaacaggtcggcgaccacatcctgatcgagatcaccgacgacggcaagggcatgaacccggacgccctgcgccgcaaggcgatcgaaaagggcctgatcgatcaggaaaccgccaactcgctggacgagaagcagtgcctgcagctgatcttcctgcccggcttttccaccaaggaccagatttccagcgtgtccggccgcggcgtcggcatggacgtggtgcgcaccaacatccagaaactgaacggccgcatcgacatcaactcggtaggcggcgaaggcacccgcatcagcatctcgctgccgctgaccctcgccatcctgccagtgctggtggtgcgcgcctgcaatcaaccgttcgccgttccgctcgccatggtgcgcgaaatcatcaccatcgacagcggcgccatccaggaggtctcgggcaagcccaccatcgtggtgcgcgatgaaatcctgccgctgaagacgctggccggcctgctgggctgggcgccgacgcagaagccatacttcggcgtgctgatgcagtccgcggaaaagtccttcatcctggcgatcgactccttcgtcggccgcgacgacgtggtgatcaagccgctgcagaacatccgccccaaaggcgtcgccggcgcgacgctgtccggcgatggctcagtcgtgctggtgctcgatatggaagacctgctcgcctccagcgaaagcaacaacaccacggtgcggacgacggatgtgattgccacctaagctcacagtaaggtgcaagaatgacctcaaacactgccttcatcggacggcagccggttctgaaccgcaatcagcagctcataggttatgagctgctttttcgtcccagcggcgacgcagtgggcgtcggcaagcacaccgagctgcaggccgacaccgacgtattggtgaacacgctcaacaatatgggcaccagctggctgataggcaacaagctggccttcatcaatatcggcgagacgatgctcaacagcgagttccttgagctgctgccgccgcgccgcatcatcctcgacatctcgccgcgcatcgtgcccagcaacgagttgctgtcgcgcgcgcgccatctgcgcgcgatgggtttcggcatcgcgctggacgacttcagcttcgaatcgccggccgccgccttcctcgaactcgccaactacgtcaagctggacatccaaaaccaggacaccacccgcttccagatgctggcggcgcggctgcgcagctacccgctgatccgcattgccgaacgggtggaaacccacgcccaattccacctgtgcaaggagctgggcatggacggcttccagggctattacttcgccaagccggaaacgctggccgccaaggtgatccaccccaccttcagcaacaccctggagctgctcaacctgctgcggctggatgccgacatccgcgacatcgaacaggtgctcaagcgcgacgtggcgctgtcctacaagctgctgcgctacgtgaactcggcggcggcggggctcaacacctcgatcagctcgttctcgcacgccgtcaccgtgctgggttaccagaagctttaccgctggctgaccctgctgctggtcaccgcctccgacgacaaccatgcgccgccggcgctgcagaaaaccgcggtcacccgcggccgcttcatggagctgctgggcatcacgctgggcgaacgccacgacgtcaacgacaatctgttcatcgtcggcctgttcagcctgctggacgtgctgttcgacatgccgatggacaagatcatcgaacatctgcaactgcccactcccatcaccgacgcgctgctgcacgagcgcggcgccatgagccactacctgcggctggccaaggcctgcgaggacggtgggctagatggcgtgccgcaattgtgcgaccaactggggctctccagcgaacagctgaaccaggcccacatctccgcgctcgcctgggtggaggaactgggcttataatccacagccttgcaaggttgcctcaagcccaatgaaactgttagccctagacacctccaccacctatctctccctggcgctgagcctggaaacggaaacgctggtcttccacgaatgcgtcgcgcagaagcacgccgagcgcacgctgccggaggtgtcgcgcctgctcgccgaggccggcgtcgcgctgtcgtcgctggacggcatcgtcttcggccagggcccgggctccttcaccggcctgcgcatcgcctgcggcctggcccagggcctggcctactcagccgacctgcccgtcaccggcatcccgacgctggacaatctggcctggcaagctggagaaggccaggtgctggtctgcttcgacgcccgcatgcaacaggtctacaccgcgctctaccagaccggcgccgactggcggcgcctgtcgccgatcagcgtgatgtcccctgaagacatccgcctccccgccggcaccaccctgctcgccggcgatggcttcgacagctatccgcagctattggccgacagccgcgcgcaattgccgctgtcgcccttcccgcgcccccatgccgaagcctacatccgcctggccgaaagcggccgctatccggccggccacccgcgcgaggcggaactgctctacgtacgcaacaaagtggcgctgacctcggtcgagcagcagcaggtccgcagccgatgagcgtggtccgcccgttcagcccggacgatccgcaacgactggccgatatcgagcggcaagccgccgggcacgcctggagcgctggccagtaccgcgacgccatcgccgccggctacccatgctacggcgtattcgacgacagcgacgcgctgcaaggcttcatgctggtgatgcgcgcgctggatgaagctgagatcctcaacatcgtcatcgccaaatcgaatcaggggcaagggctgggtcgccagttgctgcggcacgcgatgctggacctcgccgcctccggctgccgccgcctgtttctcgaagtgcgcgaaagcaacgcccccgccctgcgcctgtaccagcattgccagttccgccagtgcggcatgcgcaaacactattacccgacccaggatggccgcgagcacgccatcctgatggaggccgccctgtgagccgcaacagcctgctgcagcaaaccatgggcctgggcccggcttggcagccgcgcgacggctggttcgaacaacacccggcgctgctgctgcgcgcccaggccgccgccctgcccgatgccgaaccggaaacctcggccccagccatcgacgtcgcgccgcaagtcgccatcgcctccatcccggcggaaacgcccaaggcggaaacgctgcgcgagcccgcccagccgcagccggcgcccgaaatggcgcccgcccctgccgcccgcagcgaaatgcccctgctcgactggccgcagctggagcgccaggttgccgactgccagcgctgccgcctgtgcgaaacccgcatccagacggtattcggccgcggcaatcccaaggcgcgctggctgctgataggcgaagcgccgggagaacaggaggacaggcagggcctgcctttcgtcggcaaggcaggacagctgctcgacaatatgctggccgccaccggactcgatcgcgagcaggacgtctacatcgccaacgtgctcaaatgccggcctccgggcaaccgcaatccggccccggatgaaatcgccgcctgccacggctatctgcagcagcagatccgccacatccagccgacgctgatcctggcgctgggccgcttcgccgcccaaaccctgctgcagaccgaggaatcgatcggccggctgcgcggccgcgtccaccgttaccaggacgtgccgatggtggtcagctaccatcccgcctacctgctgcgcaaccagccggacaaggccaaggcttggcaggacctgctcttggccaggcgcatcttccagcagaccgccggccgcggctgatccgccccgccgccagccatgaacgcgaaaaagccagtccgtggactggctttttcgcatgcactcgccggcggacgggccgcaggcaataaaaaacccttctccgtgcaccagagaagggctcttcaaccaaccggaaacaaggcttacttcagcttggtttctttgtacagaacgtgcttgcgggcaacgggatcaaacttcttgatctccattttttccggcatggtgcgcttgttcttggtggtggtgtagaagtggccggtgccagcagtggattccagcttgattttatcgcgcatgatgtgtacctcagtgctttatctggttgaccgctcagatctcgccgcgagcgcgcagatcagccagcactacatcgatgccaactttatcgatggtacgcagtgcagcgttggatacgcgcaggcgcacccagcggttttcgctctccacccagaacttgcgatattgcaggttcggcaggaaacgacgtttagtcttgttgttggcgtgggaaacgttgttcccggtcatcggacgcttgccggtgactttgcaaacacgcgccatggttaaactcccaaaaccggtaaaagctggatttataacataaataaagccagacattcaagcataaaacgcacccttggtgctgccgggtgcgattctcgttcaaacattcggcggggattgtaacggattcaccacagcgacgcgagcactatctccacagccggcgtccagtgttgcattctttcccgcaacaagatggccacaggtgatttaacttgcgacaaattcagggtaaaatcccggattcccatagagccgtaatctcatgaccaagtacatcttcgtaaccggcggtgtggtgtcctccctgggtaagggcattgccgccgcgtccatcgccgccatcctcgaatcccgcgggctgaaagtcaccatgctgaagctcgacccgtacatcaacgtcgacccgggcaccatgagcccattccagcatggcgaagtcttcgtgaccgaagacggcgcggaaaccgacctggacctcggccactacgaacgcttcatccaggccaagatgaagaagagcaacaacttcaccaccggccaggtgtacgaatcggtcatcaccaaggaacgccgcggcgactacctgggcggcaccgtgcaggtgattccgcacatcaccgacgaaatcaagctgaagatgaaggaaggcgccgctgacgccgacatcgccatcgtcgaaatcggcggcacggtcggcgacatcgaatcgctgcccttcctggaagccatccgccagatgcgctccaaccacggccgcaagaacacgctgtacgtgcacctgtcctacgtgccctacatcgccaccgccggcgaaatcaagaccaagccgacccagcactcggtgaaggaactgcgcgaaatcggcattcagccggacatcctgctgtgccggatggaccgcgagctgccggaagacgaaaaacgcaagatcgcgctgttctgcaacgtcgaagagaacgcggtgatcggctgttacgactccgactccatctacaaggtgccgggcatgctgcacgcccagggcatcgacgacatcatcgccgaacagctgcaactggacctgcccaaggccgatctcgccgtatgggacggcatcatcgacgccatccagcatccggaccacgccatcaacatcgcgatggtgggcaagtacgtcgatctgaccgaatcgtacaagtcgctgaccgaagcactgaagcacgccggcatccacacccgcaccagcgtcaacatcatctatgtcgactccgaagagatcgatcgcgacggcgccgactcgctgaaggacatggacgccatcctggtgccgggcggcttcggcaagcgcggcgtggaaggcaagatcaaggcggtgaagttcgcccgcgagaacaacatcccctacctgggcatctgcctgggcatgcagatcgcgctgatcgaatacgcgcgcgacgtggcgggcctcgccggcgccaactccaccgaattcgacctcgacaccaactacccggtggtggcgctgatcgacgagtgggtgaaccacgacggcaaggtggaaaagcgcgacgagaactccaacctgggcggcaccatgcgcctgggcggccagcaatgcgacctggtcgacggctcgctggcggcgcgcgtctacggcaacaccgagatcgtcgagcgccaccgccaccgctacgaagtgaacaactactacatccagcgcctggagcaagccggcctgaccatcagcggccgttcttccggccacgaaaagctggtggaaaccgtcgagctggccaaccaccgctggttctttgcctgccagttccaccccgagttcacctccactccgcgcgacggccacccgctgttcatcgcctacgtgaaggccgctctggcataccaggctgacaagcaaggaaactgaagtagatgaaattgtgcggatttgaagtcggcctgcagcagccgctgttcctgatcgccggtcccagcgtgatcgaaagcgaacagatggcgctggacaccgccggccagctgaaggagatcgcccacgcgctgggcatccacttcatctacaagtcgagctacgacaaggccagctacacctacggcggctcgttccgcggcttcggcatcgacgaaggcctgcgcatcctgtccgaggtgaagcgccagatcgaagtgccggtgctgaccgacgtccacaccgaaaacgaagtggtccaggtggccagcgtggtggacgtgctgcagacgccggccttcctcagcagccaggccgacttcatccgcgcagtcgcccaatgcggcaaaccggcaaacatcaagaagggccagttcatggcccctggcgacatgagccaggtcatcctcaaggcccgcgaagcggcgcgcgaagccggcctggaggaagacagcttcatggtctgcgagcgcggcgcctcgttcggctacaacaacatggtatccgacatgcgctcgctcagcatgttgcgcgaaaccggctgtccggtggtgtacgacgccacccactcggtccaattgcccggcaacgccgccgccagccagcgccatttcgtgccggtgctggcgcgcgccgcggtggccgccggcatcgccggcatcttcctggaaacccatccggcccccgcccgcgcgatgtccgacggcctcaacgcctggccgctggctcgcatcaaggaattgctgaccacgctcaaggcgatggacgagctggtcaagcaaactccctggcctgagcactcgctgtaatacacagccggtagagtccgccgggcaggcccggcgaaccgcctctgcaagttcaaccgaaagctatgaagggaaagacaatgagttcgatcgttgacgtggtagctcgcgaaatcctggactcccgcggcaatccgaccgtggaagcggacgtattgctggaatccggcgtgatgggccgcgcggcggtgccgtccggcgcctccaccggcacccgggaagccctggaactgcgcgatggcgacaagagccgctacctgggcaagggcgtgctgaaggccgtagacaacatcaataccgagatctgcgaagcgatcatcggcctggacgcctccgaccagaccttcatcgacaagaccctgatcgaactcgacggcaccgagaccaagtcccgcctgggcgccaacgccatgctggccgtttcgatggccgtggcccgcgccgccgccgaagacgccggcctgccgctataccgctacctgggcggcgccggcccgatggcgctgccggtgccgatgatgaacgtcatcaacggcggcgaacacgcgaacaacaccctggacatacaggaattcatgatcatcccggtgggcgcgcaaaccttccgcgaagcgttgcgcatgggcgccgagatcttccacaacctgaagaagatctgcgacaagaagggctacgccactaccgtcggcgacgaaggcggcttcgcccccaatctggaaagccacgaagacgcgatcaagctgatcctggaagccgtcgacaccgccggctacgtcgccggccaggacgtgatgatcgcgctggactgcgccgcctccgaattcttccgcgacggcaagtaccacctgaccgccgagaagctgtcgctgagctcggaagagttcgccgactacctggaaaacctggccgacaagtacccgatcatctcgatcgaggacggcatgtccgagcaggactgggacggctggaagctgctgaccgagcgtctgggccagaaggtgcagatcgtcggcgacgacgtgttcgtcaccaatccgaagatcctggcagaaggcatcgccaagggcgtggccaactcgctgctggtgaaggtgaatcagatcggcacgctgtcggaaaccctgaaagcagttgatctggccaagcgttcccgctatacctgcgttatgagccaccgctcgggcgagaccgaagacagcaccatcgccgatctggcagtcgccaccaactgcatgcagatcaagaccggctccctgtcgcgctccgaccgcatggccaagtacaaccaactgctgcgcatcgaggaagagctgggcgacgccgcccactacccgggccgcgcggctttctaccatctgaagtgattgcatgcgctggctgaccgtgaccctggtaaccgtgatccttgccttgcaatggccgctgtggttcggcaagggcagttggctcagggtctggcagctggacaaacagctgcaggaacagcgggcgaccacccaaaagctggtcgcccgcaatgccgcccttgacgccgaagtgcgcgacctcaagcaaggcagcgatgcgatagaggaaagagctcgtaacgaacttggcatgattcgcaacggcgaagtgttcttccaactgctggatcccagcaagaacaccccgctgccgagtcacccgataacggacactcactcccactgacaacccatgatggcaggccgccttaaaagcaccaaggtttgggcaatgacgacacaaaaccctatcgaagtggcacgtgaaaccctgaagcagctgtccacgcggaaactgctgccgacgccggaaaacttcgagcgggtttaccacgagttgacgcaaaccccgatggtgcgcgacaacaagctggccgtattgctattgcgggcgctggaaaccttgccgcaggacaacgtccaggccaaggtcaccctgtcgcgcctgcgccaggccctggacgaaagccgctgggagcaggcgccgcagctcgtcatcgatttcctgcgcggcagcttcgccacccagcagctgtcgcaaagctggggcctgctgatccagaacctgatgcgcagctgggaaacccgccagcccgacctgccgcaacaccacaagcaaagcgcgctggaacgcgtgctgatcaattacggcaatcagccggaagaactcaaccagaaactgaccgcgctgctgcaaaactggaacgccgcgccctccctccgggaaaccaccccgcagccggatggcgccgcggatgcggcggataccggcacgcccgccgccgtttccgacaactggttgtcgtggcagcgcacgctggctttcgcgctcaagcacggactggagccgcggctggccagctaccccgacctggtggactgcctggaaggcctgctcaaggagctggacggcgtcgccgacgacgccagcctcaacgccttcatgcccaagctcagggccttcatgatcaagctggagctgcagtcgcagcaggaaggccgcctcgcctccgggctcaccaacctgttgcggctgatgctggacaatgtggcggagctgaaccgctccgacgaatacctgctgggccaggtcagctcgctgcaggagctgctcacccacgaaccgctgtcgatgcagcaggtctaccagctggaaaccagcctgaaggaagtgatacgcaagcaaggcatgcagaaaagctcgctggacgaggccgccagctcgctgcgcgccttgctcgaccgcttcgtcagccggctggcgctgatgaccgacagcaccgacgagttccacgccaagatccagacccacagcgaaaagctgaagcaaaccagcaatgtcgacgacctgggcggcatcatcagcgcgctgatggaagacacctcgatgatgcagctcgacctcacccgctcgcgcgacgagctgatttccgccaaggagcaggtggaagccgccgagcaccgcatccacgaactggaaaacgcgctggaggccgccagcgccaaggtgaaggaagaccagctgaccggcgcctacaaccgccgcggcctggccgaatatttccagcgcgagatcggccgcgccgagcgcaccgcggcgccgctgtcggtggcgctgatagatgtcgacaacttcaagcagctgaacgaccgctacggccacctggccggcgacgacgcgctgaaatacctggtggacaccatcaagcacagcctgcgcccggccgacatcgtcgcccgcttcggcggcgaggaattcgtgatcctgatgccggacacgccggagaacgaagccatcctgacggtgcaaaggctgcaacgcgaactgaccaaaaccttcttcctggccaacaacgacaagctgttgatcaccttcagcgccggcgtcgcccgctggcatctgggcgaacaggaaaccgacgtgctggagcgcgccgaccacgcgatgtaccaggccaagatcaacggcaagaaccgcgtctgttccgccgaggaagcgctggagtaagcagacgcggccatgcggaagcggacaggcggctcagccgccttttttcatgcccttgccggcggcggcgcgctggcgccgcacttccttggggtcggccagcagcgcgcggtagatctccacccggtcatgctggcgcagcggcgcgtccggcttgaccgccttgccgaacacgcccagcttcagcgtggccatgtccagttccggacactgcgccagaatgccggactcggccgcagcctgcgccgcggtggcgcctgccggcagccgcagcggcaccagccactgccggtccggccgcgcgtacgccacttccacctccagcgtctcaatcattgccgtacttcctgtccgcttcctggatgaaggcgtccaccaacgaacccgaaatatggccgaacaccgggccgatcagcttctccaggatgcggctggaaaactggtagcgcaggctgaattctatcttgcagccgaaatcgcccagcggcttgaagcgccacaaaccctccagcgactcgaaaggcccgtcgaccagctccatgtggatggactcgttctcgacattgcggtttcgggtggtgaagtgctggcgcaccttcaggtagtcgatgtgcaggctggccaccacctgcccctcaccgcgcgacaacacctcggtcttgccgcaccagggcaggaaacggctgtagtgttcgatatcgtccaccagcgcatacatctgcgccggcgtgtgcgccaccaggacgcttttttcgacatgctgcatcggcaaaaacccggcgcggccggggtctcggatctgacaatcaagccgcaattctagcaaaaaccgccccgctccgccttggcggcggctgccaagacgatatcttcacgtcaaaccactgaaaaggcacgactttggttgcgcgccggcttctgctacaatggcggattcaaaggaacccgccacacatgagcatcatccagaaccgcaaggctttccacgactacttcatcgaggaagaactcgaggccgggcttgtgctggaagggtgggaggtcaaggcgatccgcgccggccgcgtgcagctgaaggaaagctacgtcgactggaaaaacggcgccttctggctgataggctgccacatcacccctctgcaatccgcttccacccacgtcaatcccgacccggtgcgtccgcgcaagctgctgctgtcgcaggccgagatcaaccgtttcatcggcaaggtggaacgcgccggctacaccatgatggcgctggacctccactactccaagggcaacgtcaaggccaatgtcggcctggccaagggcaagaagctgcacgacaagcgcgataccgaaaaagaccgcgaatggcagcgcgagaaacagcgcgtgatgaagagccaccggggcgcggcatgaaacgcggcgccgccctgcccatcgcgctgatctgcctgggatgcgtctggctgctgaaaagcaccgccctgctgcccaacaccaccaccctgctcgccctgctgctgttcgcggcgggcgtgctgctattggcgctggatggattcaacaaatccacgctggtgaccagcccgatgctggcctacaccggcgccgccgtctacgcggtcgatcagctgggcctgcgcgtcagccacttcgcggcggtgggcatggtgctgatgggcgtgctgatgctggtggcgcgcagcgacggcataccggaacgccgcgaaccgccgcgccggctaccgccgggcgacgactgagcgcacgccgccgccagtctgaaagacaagttttttttcaagcattgacgataatggctgtaacggcctgcattacttttcaaggataggcatggacaagatcctcattctcgacttcggctcccaggtcacccagctgatcgcccgccgcgtacgcgaagctcacgtttactgtgagcttcattctttcgacatgcccatcgaagagatcaaggccttcgcgcccaaggccatcatcctgtccggcggccccaactcggtgtacgaatccgactaccaggccgaccccaagctgttcgagctgggcgtgccggtgctgggcatctgctacggcatgcagttcatggcccagaccctgggcggcaaggtggaaggcggcgacaagcgcgagttcggctacgcccagatcaaggcccgccatcactccaagctgctggaaggcctgcaagaccagatcgatgacgccggcaacggcttcctcgacgtgtggatgagccacggcgacaaagtcacctcgctgccggccggcttccaggtgatcgccgaaaccccgtcctgcccgtacgcggcgatggccgacgagacccgcggcttctacggcgtgcagttccacccggaagtcacccacaccaagcgcggcaccgagatgatccaccgcttcgtgctgcacgtggccggctgcaaacccagttggaccatgcccaactacatcgacgaagcggtgaagaagatccgcgaccaagtcggcgatgaagaagtcatcctcggcctgtccggcggcgtggactcctcggtggccgccgcgctgatacaccgcgccatcggcgaccaactgacctgcgtcttcgtcgaccacggcctgctgcgtctgaacgaaggcaagatggtgatggaaatgttcgcgcagaacctgggcgtcaaggtggtccatgtgcaggccgaagccgacttcatggccaagctggccggcgaaagcgacccggagaagaagcgcaagatcatcggcgcggaattcatcgaagtgttcgaccgcgaatccggcaagctgaccaacgccaagtggctggcccagggcaccatctacccggacgtgatcgaatcggccggcgccaagaccaaaaaggcgcacaccatcaagagccaccacaatgtgggcggcctgccggaagacatgaacctgaagctgctggagccgctgcgcgagctgttcaaggacgaagtgcgccagctgggcgtagccttgggcctgccgcacgacatggtctaccgccaccccttcccgggcccaggcctgggcgtgcgcatcctcggcgaagtgaagaaggaatacgccgacctgttgcgccaggccgacgccatcttcatcgaagagctgcgcaacaccgtcgacgagaagaccggcaagaactggtacgagctgaccagccaggccttcgccgtgttcctgccggtgaagtcggtcggcgtgatgggcgacggccggacctacgactacgtcgtcgcattgcgcgccgtggtgaccagcgacttcatgaccgcgcactgggccgagctgccgtacagcctgctgggccgcgcgtccaaccgcatcatcaacgaagtgcgcggcatcaaccgcgtggtctacgacgtgtccggcaagccgccggcgaccatcgagtgggagtgattccgcgtctcgcaatcgctagcgcggactagcgccaagccccccccctgaaacccgcattcgtgcgggttttttcatgccttcgtctggcaatgactggcaagaattggcaatgccaagcgcttgcttgtcgtggcatcgcagtcggcatgcttgtttcgtgacgccacgtccgtcgttaatgccatgccaggccaaaccggccacgcaagaaacacattgctgcggagaaatctccagccctcgggcagcccaatgaggagcttggggtgtctaggaaaggacaagcgattcagttattctccaccaccaatggtattttcatggtattggctggaggcgctgccgcttgactggccaacaccaccaagagcgcctgtagcgacttcatgacatcggcgttgcgcgcctgtcgggcctgggcgattgccgctgagcgggctactgaaacatcaaaccaaggaaacgagtcatgtggaaatcgacggccgccgcccttgccctgctgatcctcgctggcgctgccagcgctggcgaacagagcgcctgcgatcgcctgctgcggaaattgggcccgcaactcgccgacgccagttgcgtcgaaagccccgacctgacgacccgcaaccccaacaccacgccagccaacgactcgctgcccggcctgccgccttcggcgttcatgccgcaagccgaccgcgacatactcgtggcggatcccgcccacaggccctccatcaagaaggcggtccccggcttgcagattcaggcccgcttcgccaaggatcctctggggcaggcgcgcttcctgctgcggctgcccaaggactggaatggccgactcgtggttgccggcgcctccggcgcccgcagcgaattcaacggcgacttcgtctggagcgattacgtgctgcagcagggctatgcctatgcttcgcagaacaagggggtgctcagcgcgcatgcgagcacggcggcggatccgctggcctgccgcaccgggacgccggacaatccccactatgtccactactacgacgatgatccaggccaggaattcacccgctggcgcgacttcatggtgatggcttccgacttggcgcgccgcggcgtagaggcgcagtatggccgcaagccgcgctatacctatgcggtcggcgcgtcgaacggcggctatcaggtgcgccgcgcgatcgaaaccgcgccggaatccttcgacggcggcgtggagtgggccggcaccttcgtcgatccccgcgggccgaatctgctgactggcctgcctccggccctcctcaactaccccgactatctcgcctccggccgctcgcccaccagcaccgccgccttgaacatcctggcggccggctatccgcccgatctcgtagccgatacagcaaatggccgggtctcgctatggggcaatcaccatgactcattctgggagcccacgcaatgccaatggcaaaagcgcctggatcctggctacaacacctatggcgccgggccggacaggtacaactacttggcgcggctgtccgcctcgaaggtgggcgccaatgtggcggccatcgccaccgacggcaagatcaagcgtccgctgatcacggtcgccggcacgatggatgcgttgctgcccatcgacctccatgcgcgtgcctatgcgcggcaggttgccgcggagggcggcgagcacgcccaaacctatcgcctctacgagatccagaacggcaatcacgtcgagcgctacgcgagcctgttcccgcagcttgagctggtcgagccgcacgcgcagcgcgccttcgacttgctggtccgctttgtcgaacagaaaacgccgctaccgcccggccaatgcgtcgctcgcggcggcaccatcggcgatgcgcccgctcagccggggcactgcccaaatttgctggcgccttgaggcgtccgccatcagggtttgcgggtcaatgtcgcgaggcatgatcgctagtgtgtttaaaggaatacgggaatgttgaatgccaccgtcggaaagaagcgaaccgcttctttccggacgttcatcggcgtagggatggcgctgtgccatctgacgatgagcgccaacgctcgggccgacgacaacaccatcagatggcaaatgccgggcaatccgccggtcaccatcaccgatggccccgacaagggccagggctacgctgacgtgttcctgcgatatttcattgagcgcgcgcccgagtacaacagcgtgatagaacgcgccagcctggcgcgcgtctccggcctgatgaagcagggagagcacgtttgccagcccagcctgctcaagacagtagagcgcgaagcgtatatggaattcagcgacccggtcgaattcgtgctgccgtattacatcgtaatgcgatcggatcggacggcccgcctgaaggcctaccgcgatgccgacggcgccatagacatcgcccggctgatgcatgacctatcgttgaccacggtccgccaagagatgcggggctacccgcccgtcgttctgtcagccttcaccgcggcggccgggcagaagaacatcctccagacgagcgccgacgacgtggggcctttcagccagctggccagcggatgggtggactacatcatcgcctatccggacgaggtctattggttcgccaggcacttgaaactgccgacatcaatcaagtttgtttactttcccatcgccggccaccccaaatatacgatcggctatgcggcttgcaccaagggcgcttggggacggaagatcgtcaagcgggtcaatgaaatcgttgccaaagccggcagacgtcccccgtggatcgacgccgaagcccgcttgcttgatccggaagcggccaaacgctacgaggaggtctacgcccgctattctccgttccgcaggcaggccgactaaacatggatgccaatcgccaggcaaaggataacgcccaatcgcgcaactcccctttgattttcatgccgcagcgcggcctcgcgcggcgcatgctggtctggatcatctgcatcagcacgacggcggcgctgatcgcgacctcggtgcaattgttcttcgactaccgcagcgatgtgtccgaactcgagcagggcatgcgctacatcgagcagagccagctgcctggcctggccgacgcggcctggaacttcaacgtcgccggcatgcaggtgcagctcgacggcatcggccattccccctgggtcgccggcgccacgatccactacggccccagccagtcggccgcgctgacaaccgggcagctggatgctgacgcggggaggctcttcaagtacgtcttgcggcgcaacggggtggtcgttggcaagatctacatcgagcccaatctgcacacgctctatagccgcaccctggatcgcattggcatcgtattggcgacgcagggcggcaagtcgctggtgacttcgatcagcatcctcttgctgatttcctggatgatcacgcggcatttgacccagatggcggagttcgccagatccttcgagccgggcaagagtttcacgccttttgtgctgcgccggcgcccgcaagggctgcgcgatgagctgagcgtgctggtcgatggactcaacgatgcctatgcccgactccaaaaagcgcacgaattccaggtgcgccacaacgagatcctgagccagcaagtcgaactgcgaacggccgaactactcgaagcccaccagcagctggccctgctggccgtaaccgacaagctgaccggcacggtcaaccgccggggcctggacgaggtgttcaaaaacgccatggcgctggccgaccctgacagccgtccgcttgcgatcatcctgaccgacatcgacagcttcaagtccgtcaacgacagccgcgggcatctggcgggagacgccctgcttcaggaattcaccggcatcttgaatcgcgtggtgcgggcgaccgacaccgtgggtcgctggggcggcgaagaattcctgattctttgtcctcagaccactctggaacaggccttgcgcctggccgagcacatgcgcgccagtgtgcaggcgcatgcctttgccgggataggcagcaagaccagcagcttcggcgtcgcggttctgcgccagggagaaactgcggacgatctggtgaggcgggcagatgaagccctgtatcaggccaagaagagcgggcgcaacagagtctgctcggaagccccggatatcgtgagctgaacgtgaaagagattcgggttcgcatgcgacgcagagcgtcgcgctcctagcgcccaagcctggacttcatgcaggccgcctttcatcgcgccgcctgagtccaaatgaaaatccgggtgccgcgcgcaagaccaatcatcaaacgggaatccatcccttcgctccgccacctcaccgccccgctcccgcggggcgtttttcattgccggctccgccaggcttggctggcttgttcgccgccgcgcctcagcaagatcaacaccatcagcgccgacagcaaggccagcgctccggccagcagcgcctgcaccggcaggctgcgccatcccagctgcggcccctgcggcaaggccgtcgtgaacagggccggcatgatggtgaagcagatggcggccggccagccgccatctgccgcctaaatcccaggtgctcatcgattttctggcggagcggctattgtccatggctgacgccgcgccgcctatcgatgccaagggaatattattattcccgcgggatgcgattcccgcgctaaactggcggccatgcaaaccaaccgccccggctcgcggcgccgcgctttcgcagcgatgcgccgacggggctttttacagcggccggccgatatcggcggccccagcactccgtgattgcccatgactgactcccgctcgacaaccctcacccgcgccgactaccagaccctgggcctggcggcgctgggcggcgcgctggaaatctacgatttcatcatcttcgccttcttcgccaccaccctcagcaagctgttcttcccgccgcacatgccggaatggctgcgcctgctgcagaccttcggcatcttcgccaccggctacctggcgcggccgctgggcggcatcctgatggcccatttcgccgaccggctgggccgcaagcgcatcttcagcctgaccatcctgctgatggccggcccttgcctgatcatcggcctgatgcccacctacaccgacatcggcatcgccgccccgctgctgctactggccctgcgcatcctgcagggcgcggcggtgggcggggaggtgcccagcgcctggtccttcgtcgccgagcatgcgccgctacaacaccgcggctacgcgctgggggtgctgcaggccggcctgaccttcggctacctgctgggcgcgctcaccgccaccatcctcgcccgcgtgttcacgccgcaggaaatgctggaatacggctggcgcatccccttcctcctgggcgggcccttcggccttctcggcgtgtggctgcgccgctggctggccgaaacgcctatcttcctggccatgcgcagccgccaggcggaacaggtcagctaccccttgctgacgatcctgaaggaacaccgcgctaccctgctgcctgcggcgctgctaacctgcgtgctcacctccgccgtggtggtgctggtggtggtgacgcccacattgctgcagcagcgcttcggcatgagcgccgaccatgccttcggcctcagcagcataggcatcgtatttctcaacctgggctgcatcgtcgccggccacgcctgcgaccgcatcggccaccgccgcagcctgctgctgtacagcctgttgctgccgctaggcgtggggctgctctacgcctgcctgatagatggctggggctggccgggcctggcttacgccgccgcagggctatgttgcggcatcgtcggcgtggtgccatccatcatggtggccatgttcccggccaaggtgcgcgtatccggcatttccttcacctacaacatcgcctattcgatctgggccagcgtcacgccgctgctgttgatcgccgccatgccctggagtccgtggatctgcgtcgcgtattgcgcggcagtggcgctggcgggcatgtcctgcgcccgcgccgcgcggcctgcgcgggaaccttcgctggacgaagcgctctaccaacgcggatgaaccgcttgaccaggcggtttgacgcggccgcaccagcctgttagcttggtttgacgcggccggtccacgccgcgtctgcgttttgagttgtcttctttcatcattgccaggaggtcgccatgtcgaatgccgccatcgccaaggaaaaagaacagctgctggatgacgtacgccaggttttggccagcaccgaagaactgatcgacgccgccgccgacgacggcagcgcgcacagcaaggaattgcgcaaacgcctcagcgaaaagctgggcaccgccaaggccaagctgcgcgacgccgaagtcgccgtggtcggcagggccaaggaagccgccaaggccaccgacgaatacgtgcacgaaaacccgtggaaatccataggcatcgccgccggcgtgggcttcctgctgggcatgctggtctcgcgccgctgaccggcatgtcggaaccgacccgcccgccccgtcccggcaccctgcgctccttcgccaacggggcggcggcgctgctgctcacccgcgccgaactgatggcgctggaggcgcaggaatggaaggacgacatcgtcggcaatctgctgcaaggcatgctgggggtggtgttgctgggctgcggcctgatcgccgcggtgctggcgctgtgggcgctgacgccggtcgaatggcggctggcggtgatggcctgcctggccctgctgctgggcggcgccggcgccgcgctgctgcttggcctgcggcgcaagctgcgcgagcagccggcgccgttcgccgtcaccctggaagaggcccgcaaggattgggcggcgctggggcccggcggagaacggccatgacgccgcaggaccgcgcgctgaaaaaacagctgctggtgatgaagggcgaagccctgcgcgtcaagctgaagctggaaaaacagaaactgctggagccgctgcgctgggccggcgagggtttcgcgctgtggcgcgcccctggccagctaggcgccgcgctcgatattctgggcaagctgctgccgaacgaaaagctgggccgctggctcaaaggcggcggccggctgctggccgcctggcgtctgttcggccgctggctcaagcgctgagcgcgcggcccgtctcccgatcaggcgttcgccgtgccggcatccgccgacacattgatattcacatccatctggccgttgagcgccgccatcgcctccggaccgcccttcaggatcttgtcgacatcctccagatccttgtccgcccgcttcatatcgtctttcaggtcgcgcgaattcgggtctttctgagtttgcagctgctgcgccatctgcttgatgaaggcctgcaccatcttcagcacctgtcggatctgctcgatgtccggatcgccggccaccgggttgccgttggccagcatgttgcgcagcgccgcctgcgggtcgacattgccggaatctccctgcgcgtcggtctgcccgggggcttgcgcgttcgcattcgcgtcggccgccgacgcctcctgcgcggtgttctggccggacgcggcttgctgcgcgtcggctccgtcagcggcggcaggcgccgcctgggccgacgaagccgcggcggccgcctccgcgcttgccgcctccgcgtccgagtcgcctccagagcccgcatccgaacctgcggaagcctcggcggcggaagatgccgcggccccgccggacgcctgatccccgcccacattgaccgccatctgctggtcggccgcgttctgggtcatgctgctgaccaggtctttcaactcgcgcgccaggcgcgccagctgggtggcaagcgcccgcaaactcgccttgtcgcgggtgaccatcatcatctggcgcagcgcatccgcctgctgcttgagcatttttttctggatgtcgtcggcctgcgggctctggcgctgggccgggcggttcaggtccacccgcagcttttgcatgtagtcctgccagccgcggttcagcgcctgctgcaaatcgttgggggcagtggacagccgggcggcctgtgactgggcctgggcgtcggcggaggaagacgacggcgcggcatcggtggacggcttggcggcgatgctcgtcctctgccacagatccagcctggacacggaggattggggagtgatcacggacatgattcggctttctgctatttttcaactcatatcggcaacaatttggttttcttgatgccaatcggcatgttggcggcaacagcctgctcggccgccgggcgcgccggcttggtcgccgccgccaaaccggcgataatggcaagatcccgcaaccgcatccgcccgatcccgtgacgctgacctcccccccgcttcctccctcggccctcgcctggctggccgaacaggacatccattcccagccgcagctgcaagcgcgcggcgcggtcaccgctttcctgctgctgaaggcggccggccataccgtgacccgccgcctgctgttcgcgctggaggccgcggcgcgcggcatccactggcagcagctggaagaaagcgacaaggcggcgttgctgcgccgcctggccgagcacccgccggtgtccctgccccctccgctggcggcaagcctggactacctgcggcaggcgcgagagctggcggcgcaggccgcggccgagggcgaggtgccggtcggcgcgctggtggtgaagaacggggaaatcatcggccgcggctacaaccagcctatcggccgccacgacccgtccgcccacgccgaaatgcaggcgctgcgcgacgccgcggcgcgcttgggcaactaccggctggacggctgcgacctgtacgtcacgctggagccctgtccgatgtgcagcggcgccatcctgcacgcgcgcatcgcgcgggtggtctacggcgcgcgcgacgccaagaccggcgcggccggcagcaccgtcgacctgttcgccgatccgcggctcaaccaccacgcggcagtgttcggcggcgtggacgccgacgcctgcgccgagcagctgtccgccttcttccgccagcgccgccaagatgcggcgggaggctgagatgcgttgcctcctcgtcctgctgctggccggcctcgcccattcgtgcctggcggccgacgacgccgccgcgctgattctgcaggcgcagacggcggcgccgctgcaagccacccaccccaatgcccgccattacggcgagccgtggatctgggtaggagtgcgatcgcagacgctgcggctgctggacggctggggccgggtagaaaaggaatacgcggtatcgaccgcgaaaaacggcgtcggcgaaatgagcggcagctaccagacgccgcgcggctggcacacggtctgcgacaagatcggcgccggcgcggcggaaaacaccatcatcttccgccgccaggtgacgccgtggaagtacacgccggaactgcacgcccagtatccgaacaaggactggatcctgacccgcatcctgtggctgtgcggccaggagcccggcatcaaccaaggcggggatgtcgacagctacgaccgcgccatctacatccacggcgccggcgatcatgtaccatggggcaggcccagctcgctgggctgcgtccgcatgaagaaccacgatgtgattgaactgttcgatgccgcgccgaccggcatcgatgtatggatagacgagaacgcctgatgcactccgcactgaccctgagcacccccgcgctgctgttccccgccatttccctgctgctgctggcctacaccaaccgctttctgggcctggccggcatcatccgcaacctgtacgaagagtaccgcgacagccaggacccgaaaatcctgcgccagatcggcaatctgcgcacccgcatcacgctgatcaagtggatgcagtttctcggcatcggcagcctgtttctctgcacggtggcgatgttccaggtctacaccggctggcaggcatggggggagatcaccttcggcgtcagcctgctatgcatgataggctcgctggcggtgtcgctgctggaattggtgcgctcgtccgacgcgctcaacatcctgctatccgacctgcaggcggaatacgagcgccggcgctgactcagccgtagccggggaaatcctgcggcgcgtccttgcgcgccaccatcaggtgcagcggcagctccacccgccgcgtctggctgggcgagccccaggcgcgcgcgatgcgcaggctggcgtcgtccaggatgttttcccccagcgcctgcttgcacagcttgctggccgaagtggtattgagaaagccgaggaaatgctccagcgtccagtcgttgacgatggaaaagctgggcgctttcaatagcggcagcggacagccgctgctgcgaaaatcatcccacaacagctggcagcggctggaccagaacggctcgatgatcgaccacagcacgctgcaggcgcggtctatctccggcgtcaccacgcagtggtgatagccccaggcggcgaagatgccgcccggcttcaacacccgccgcacctccggccagaacgaaggatggtggaaccaatgcaaggcctgcgacacgcagaccaggtcgaagcagtcgtcgtcgaacggcgtcacctccgccgggcattcgcggtaatacacctgggtgtgcggttcggccgcagacagctggttggagctgatatcggtggcgtccacccgggcgaaactctgccccaagcgcaccgcggtctggccgctgccggtcgcgcaatcccatgcccgcgcatagccggggcacagcggcagcagccagccatacagcgcctccgggtaggaaggacgataacgcgcgtacagatcggcgtacaggctgaaggtggcgacggaggcgggagacatattcattactcgttaggtaaaaacactgaaacaatgccgtgaacattttcagtatgtatgacgcaagcgtcagatttgcaagacaaaaatcaatatttcctctccggctgcaagtggttgcagccaagcagcaacaccaagccctccaatcggcttcccctgcccagcggcccgctcctcgagcgcccgcgccttcgctttcagcgcgcaactttctcttttccgcatatcggcacgcgctgacagccaataccgcaaatgacataataagaacaatcacataattaaaacgattttttactccaaattcaaagtttggagccttccgtgaaacatgataatgaaagtgcacagcatgccgacctttacgcgcaagcttcttccccttttgaccctcagcgttctcgcagcctgcggcggcggcggctccggcagctctggcagcgcgccctcccaaaacaacaatgcctcggctcgctaccatgtcgccggccaggtgcaaaaagggccattcattttcggctcgcaaatctggatttccgagctggacgacaagctgtcgccgaccggcaaagtctatatgacgcaaaccaaggatgacctgggcaatttcggcattcccggctccgtcaacacgaaactggtggagctgaccggcagcggctattacatgaacgagttgaccggcacgctatccaccgcgccggtcactctgaatgcggtggcagacctgagcgtgtccaagtcgctgaccatcaatctgctgaccaccttgcaagcgccgcgcttgaaggcattgatggctggcggcagcgactatcaaaccgcatacaaccagtcgcgcaacgaagtgctggcggtattcggcatagatcccgccaaagtcgacagtctcggctcattgttcgatatgcgcatcaacggcaatgcggatcaagactccatcttgctggcaacctctgtcattctatctcaggcagcgaaaaatcaggctttgcaagccaataccgatactgccgaactgtcccacctgatcagcaccatcgccagcgacctagccaataacggcaaactgtcctcccaatcgctgcaagatcaactctccgttgccgccacccagatcgacttggacgcggtaaggaggaacgtcgaaacctattacaccaagcggggtatccaactggtcgcgcccaagtttgaagaatggatcgacaaagacaacagccagaccattccgcgcaggcttgttcccactagcggcttgtctttccaggacagcgccgacgccaatccggagcagatctactccagcaacgcagtgaaaatatctggtttgaaagatggccaggctgccatcctgaggttgaatggaaccggcacgcttctgaagaatgacaaggccgtcacgacggactcgtttgttaaaaacaatgatgtcattcaactgaaagatgccgcgccatcgttcaacgaagaaaaaagcaatacggtccaaataggctccagcaccgccacttggaaaataaagagcgcatccacccacctcaggattgatgatcagaacggtggcctgttccccgcccccggcgtcgagcaagcctatatatttcttcaccaaagccagttcattgccttccgatttactccaagcgcggatttcatcgccaaatactcgggggtcgatgtcaatgccgtaggcggcgccgtagtctccaacctcagcatctactccgataacaataacaaccctgaccaagcattgatcacttcgaatgagaaaaccagcctgtacaagaagttgattaccggaggctcggtcagagagttcatccccaactcggttcaatatcgtcttggctctagcggagttcaactcaaagccaataagaattactggatagtgctagcgatgacagtcccggactttcccatggcgggacttcaagggggaaaaggaaaaacatcgcaatatgatggaacactgaaactcagcaagaatggaacgacgtggtgctcgcaaccctctgaaagagacacgccctgcttcaacaattacatatcgccagcatcattctggctggccgattaagcccaacaaaaaagccgcctttccaaggcggctttttttcatccataccatgctgacgcatggctcaggatggtcttcccggcatgcgaatcacaacgccgcgctcaccggaatcttgccgatcttcacccgccattccgccggaccggtattgtggacagacgtgccacaggaatccaccgccaccgtcaccggcatgtccttgacctcgaattcgtagatcgcctccatgcccagatcggcgaagcccaccaccttggacgccttgatcgccttggacaccaggtaggcggagccgccgacggccatcaggtacacagccttgttgtccttgatcgcctcgatcgccgccgggccgcgctcggccttgcctatcatgcccaagagccccgtctgctccagcatctggcgggtgaacttgtccatgcgggtggcggtggtcgggccggccgggccgacgacttcctcgcgcaccggatccaccgggccgacgtagtagatgaaacggttggtgaagtccaccggcagcttctcgcccttgttcagcatgtccaccatgcgcttgtgggcggcatcgcggccggtcaggattttgccgttcaagagcagcacgtcgcccggctgccagctggccacttcttcgcgggtgatcttgtccaagtcgacgcgcttgccgttggacgggtcgtaagtgatgtccggccagtcttccaggctaggcggctccagatgcgccgggccgttgccgtccaggtggaaatggatgtggcgggtggcggcgcagttcgggatcatcgccaccggcaaggacgccgcatgagtcgggtagtccaggatcttgacgtccagcaccgtggtcaggccgcccaggccctgcgcgccgatgcccagcgcgttgaccttctcgaacagctccaggcgcagcgcttcgacgcgggacaattcctcgccggcggcggccttggccttcagttcgtggatgtcgacgtggtccatcaacgactctttcgccagcagcatcgccttttccggcgtgccgccgatgcccaggccgaggatgcccggcggacaccagccggcgcccatggtcggcacggttttcagcacccagtcgacgatggagtcggacggattcagcatcaccatcttcgacttgttttccgaaccgccgcccttggccgcgcagatcacctccacctggtcgccttcgacgatctcgaagtgcaccaccgccggggtgttgtccttggagttctggcgcttgccggccgggtccagcagcaccgaggcgcgcagcttgttgtccggatggttgtaggcgcggcgcacgccttcgttgaccatctcctgcacgctgagctgggcgtcccactgcactttcatgcccactttcaggaacaccacggcaatgccggtatcctggcagatcgggcgctgcccttccgcgcacatgcggctgttgaccaggatctgcgccatcgcgtccttggcggcggcgctctcctcgttcaggtaggcctggtacagcgcgtcgatatagtctttcgggtggtagcaactgatgtactggaaggcatcggcgatgctctggatgaagtcgtcctgccggatgatggtcataaggctgtctcgagaaaccgggcgccgaggcggccgcccgtgaattaccccgccgccggcgcctcgctctgcctgcgcccagcggcaactaaaaacctggttctgattgtaacactctccgtcatgaactttgaccccggacaaggcgcgacgccggccattctgcgcggcgcgccatgaaaaaagccgcccggctctcgccgcggcggctgcatattggcgaaggccggcgctcactcgctggtgctggtgttccagtacgcctggctgatgtagggatgggcggccagcgcggcggcgatgcggtccagctcgtcggaatccaccgatgtcgccagcaaggtggccgtcatctccacctcgtcgtcgctgaacgattccacgtccaggtcgcccaccgggtagttggcctgctccagcagctcgcccacctgcgccagcgcccgcttctgctcgtcgcggctggcgatcacgcacaactgataggtgacttcgctggtttcatcgtcgatcggccggcggttgatggaattcaccaccggccgcagcagcgtattcaccgccagcacgaacagcgtggtgagcagcgcctggcccagcatgcccgccccggcgcaggcgccggtggcggccgagccccacagcgtggcggcggtgttcaggccgcgcacgttcagcccttccttcatgatggtgccggcgccgaggaagcccaccccggacaccacgtaggccaccacgcgggaagcgctgccggctccatccagttgcaaggccatgttgacgaaggccgccgcgctcaccgccaccagcgcgttggtgcgcaagccggcggtgcgctggcggtattgccgctccaggccgatcacggtgccggagacgaaggccgtcgccaggcagatcaaggtatgcaacatgccgaacagatcaagatcgaacagattgtgcaggttgtaatgcatgcgccctcctgcttgttgaatgttgttgtctaaggtacgtgcatcgtggcattcgatgaaaaccaccatgcccaggccctaatgcgaaaaccgcccataaggggcggcttcgcaccgccggcgcgcggaatccgcgtcgccggccacaccttaacccgcctgtcagtgggcgagcaaggcgacctccgccaccttgtacaccaccatgatgaccgccaccaccagatagccgcgcagcacgcccatccacagacggttgctgcgcgacagcaccatgggcttcagttgcgccagcggcggcattcgccagttgtgcatgtacagcttgctcggcttggcttcttcggccaggtcggcgccggtttcggcgtcgcggcgcagcttgacggtgtgcgcggcgatcaccacgatgccgccgacgatgccgccgcccaccaggatgttgatgatggtctggctgctgatgtccggccacagcacggaagcggtcaggatcaccgacagcagcaccagcaccgcggcgacggcgccggtgaacagattggtccagcggccgttcacccacgggcccagcacttccttgtcgttgcacagcagcagcaggaacaccgatgcggacggcagcagcacgccggccagggtttgcaccgcgttggtcagcaggcccagcggcacgcccggaatcagcaccagcgcggcggcgccggcgatcagcaggaagtaaaccaggtagaaagcgcgcgcgtcgctcggcttgcggtgcagcgagtgcttcatgttcagcacgtcggccagcgcataggcggtggacagcgataccgcgctggcgccgatcaggctggcgtcgatcaaggccaccgagaacagcacgccggccagatggctgtggtacttgcccaggcccgcggccacggcgccggcgtcctggaaattgccgaattccggcttgccggcgaacagcgcggcggccatggcgatgatggcgatggcgccgatcagcaccatcacgatgcccagccacaggtcggcgcgctcgtacttgatgaagcgcggcgtgatgcgcttgtcgatcacgtagctttgctgaaagaacagctgccacggcgccacggtggtgccgacgatgccgatgatcagcaacatcacgtcggacagcttgccgccggccggcatgccgggcacgaacaggtcatggccgatctgcgccatcggcgggtgcaccatcatgaacaccggcaccagcagcaggctgaacaccaccaatatcatcgagaagcgctcgaaacggcggaaatcgccggtactggccgcggccatcaccagcagcgcggccgccaccaccccccactccttgggcaagcccaggtactgcagcgccagcgtgatgccgatgaattcggtgacgatggtcagcgcgttcagcaggaacaggtcgatggcgctgaaagcgccccagaatttgccgaagcgctccaggatcagccgggcgtggccgacgccggtgaccgcgcccaggcgcagcaccatttcctggttcacgtacagcaccgggatcagcaggatcagcgtccacagcagggaagtgccgtagttctggccggcctgcgaataggtgctgaaggcgccggcgtcgttgtcgcccaccatcacgatcaggccggggcccaggatggccagcagcgtgcgcagacgctgccagatgcccttgcgagccgccacatcgccgtggcggatggtgccgaacgcaccgcggatgtcgccgatgtgggcgctatccagtacagcttcgtttttgattggattggtcattgtcatctcccgaccggcggccaagggagggccgcccgtcgttttgcaagcaaacgaaggcatgcgggcatggcgcggcctcgccatcggaacggggcaccagccgccgtccgcggcaaacgcggcatgcgcaaacctgactcggcgctccgtgcatggcggagcgcagtaatcaagcagtaactagcaacaatggtatgggtagatacgcggcggcagcccgtatggctgcccaagatgcgcaccgtctcgcctcgcggcaagacagcggccattcagaatggaagctatgcctttgccggtcggcacgaccctgtcgttaaccaactactactgcaactttccaaggcatcagcccccagtaacgaaaacgccgcgatgttaatcccgcggcggaaaacacgtcaaccacctgatgacatcgcgattttgcggcgcaacaggccggccggcagcaaactgccacaagccgccgcgccgcctctctcagcaaaaaatttcatcccgcaactgcactatgcgcgcaataaaaagccaaatcgccacggtaaatttttgtgaacaaaatgtattatttatttacaaaagcctccctgcgcgccggccgcaaccgcaaaaccccctgccccatcgccacgcccagcaggatcaggccgccgccgacccagtggtaatggtggatggtctcgcccagcatcgcgctggccatcaaggcggtgaacaaaggcaacaggttcatgaagatggcggtgcggtcgctgcccagcttctggatgccgtgcatccacagataggcggcaaacagcgaggagccgatgccggcgaacagcaccagccccgcgccctcggccggaatggccatgctgcgcgcggtcagcgtgagcggcagcaacagcagcaccgccaggctggcctgcagatagaggttgacccaggagccgaacggcggcgcccagcgccgcagcaaaatgccgtacagcgcgtaggacgccgcgccggccaggatcagcccgtcgccgatattgatgccgttggacaacaggccgagcggatcgcccttgcccagcagatacaccacgccggacagcgacaccgccacgcccagccaggccggcgcggataccttctggcggaacaccgcggcgttcagcagcaggcccagcagcggcaccatcgcggtgatcacccccatattggtggcgctggtgctgtgcgccgcgtaataggccaggcactggaacatcaccatgcccaacgccgacagcgccagaaacttgcccagccagggcttcagctcgcgcgcgcggcggcgcaccgtcggcaggcagaacggcgtcagcaccaacgccgccaccagccagcggtaaatggagatcgccgccgggtccagcacgttcgcggcggctttggagacaatcacgttggcggcccagatcagcaccgccagcaggggaaacagcatggccatcacagcctccttctattcgatgccatccattctaaagtcgtccgttatggacgatataatgcaaaacagacaatccgctcaggcaaaccggacaagatgctccccgaccaggacgactacttcgccagcgacgccgcgctgccggaacccgcgccgctgaccttccgctaccaccgcttcacgccgaaaagcgaattcgcccgccaccgccaccgctggggccagctcagccgcatcaatctgggcctggtggagctgctgctggacgacggcaaggtggtggcaccggcgcaatacctgctgtggacgccgccggaagtgccacacgccgcttatgtgcggcaagccatgcactacatctcgatctacgtcagcggcgacatcgccgcgcggctgccggcccacacctgcctgatcgaacagacgccgctggtgcgcgcgctgctcgacgatttcgcccagcgccgcatcgtctctcccgtcgatccatgggacatccgccaggccgagctgctatgccagcggctgctggaatcgggccgcgaggccagctatctgccggacagcggccagaaactgctgcggccgatactggacgccatccgccacgacccgagcgacgcgacgccgctgaaagcatgggcggaacgggtgttcagcaccgaacgcacgctggcacggctgttccagcgcgagctgggcatgagcttcggccagtggcgcggccgggcgcggctgctggaggcgctgtcgcggctgaagcagggcgacagcgtgcaggacatctcggcgcggctgggctacgccacgccgtcggccttcatcgccatgttccagaaacagctgggcgcgtcgccggaacgctatcgccggcagctgctggaaggcggccagtgggacgagctcagcgcttgaacaaggccagcgccagctcgcgctgcgcggcgtggtcgacgatggggtgcgggtagtcgcgccccaactggatgccggcgtcgcgcagctgctccggcttcgcctgccacggcgcgtggatcagcttgtccggcagccgcgccagctccggcgcgtagcggcggatgaagcggccgtcggggtcgaacttctcgctctggctgaccgggttgaaaatgcggaaataaggctgggcgtcgcagccggtgctggccgcccactgccagccgccgttattggccgctaggtcgaagtccagcagtttctcggcgaaatagcgctcgccccagcgccagtctatcaacaggtctttcaccagaaagctggccgccaccatgcgcagccggttatgcatgtagccgctgcggttcagctgccgcatcgccgcgtccaccagcggatagccggtgcgcccttcccgccaggccgcgaaccaatccgcatcattgggaaacggcagcgcgtcgtattccggcttgaacgcgtggcccaccacatccggccgatgccacagcacctgctggtagaaatcgcgccagatcagctcgctcagccaggtcatcgcgccctcgccgccgtcatgccaggcataggccgccagccggcggatggagatggtgccgaaacgcaggtggacgctgagataggacacgcccttgacgccggggaagtcgcgctgcgtcttgtatcggccgatccggctggtgaagtcggcgaacaaggcctccgcgccgtccgcgcccgcccgcaccggcagcgcggacagatcgctgggcagaaagccgatgtcggccaggctcggcatcgcctcggcctggcgcggcaagagcgcgtccagatagcgccgcaccggataggcctgcagatgaaacggcgtcagcgttttcagccaggcgttcttgtacggcgtgaacaccgagaacggcttgccggcgccggtcagcacctcgtcggtgtcgaagatcgcctggtccttcgccgcatggaaagcgatgccgcgctcggacaagcgccgcgccacctcggcgtcgcgttcgcgcgccgccggctcgtagtcgcggttgcagaacaccgcgtcggcgcccagttgcgccgccaacttcgggatttcgtcggccggcaggccatggcgcaccagcagatcgccgcccagcgcgttcagctccgccttcagcgccgccacgctctggtggatgaaatcgacgcggcggtcgtcgcgcggcagcgcgtccagaatcgcggcgtcgaacacgaacaccggcgccgccgcctcgctgagcttcagcgcgtggtagaaggcggcgtggtcgtccagccgcaagtcgcggcgcagccacaccagcgccatccgatagcgtttgctcatattgggtctctttcggcggatggggacgcggtcaggccggcatcccacggcggcgcgtcgccgcccagtttttcgtccagaaaatcgatgaaggcgcgcgccttggccggcaggccgcgctgcggatacaccgcgtggacggcgtgcgcgggcagcgggtaagcgctcagcacctccaccagccggccggccgccaggtccgcgccgacgatgaaagtgggcatttcgcaaatgcccagtccggccagcagcgcgtcgcgcctggcctcgctgttgttgacctggtaattgccgcgcggcggcacgcggatttcgccgtccggcccgctgaaaacccagctggcgccgccgcggtaataggaataatggatgcagttgtgcccgaccagctccgccggatgcgccggcgcgccatgcgcggccagataggctggcgacgcgcacaccaccacccggcacggcgccagacggcgcgccaccatgcggttatccggcaaattgccgatgcgcaccgccaggtcgtaaccgccctccaccaggtccaccatccggtcgtccatcgccagatccagctggatgtccgggtagcggcgcaggaattcggccaccagcggcgacaggtgcaggcggccgaaagccatcggcgcggcgacgcgcagcaagccttgcggccgcccctgcaggccggcggccgcctcttccgcctcattcgccagcgccagggcggcgcgggcgcggtcgtaatagcgctcgccggcttcggtcaggctcaggctgcgggtggtgcgctgcagcaggcgcacgttcagcccggcctccagttgctggacgcgcttgctgaccgcggatttggtcagccccagccgttcggcggcggcagagaaactgccggcctcgaccacggcgacgaagatcggcatcgcggtgaaatgctccattcaattgtccactttttatccgaaattagtttccacaaatacggattatcagtcaatgggacacaatgtacagttccggcatcccgcctctccaaccgtcaagccagccggccgcgcggcgcgcggattcaaaaaaaggatttcgccatgccctcccatcccctgcccgcccggccgctcagcgattacgcgctggccgcgctggccttgtccgccggcgcgctgctggccctgatgatccactgcaacagccggctggccgccgccagcgatccgttgaccgcctcctggatcgcccacgccgcaggcgccttcgccgcctggctgctatgggcggcctggcggcgtcccgggcctgccgccggaccggcgccgcgctgggcgtatctgggcggcgtgcctggcgcgctgacggtggcgctggccgccatcgccgtcaacagcccgctgggcctggccggcacgctggctctggccatggtcgggcaggtgctcttcggcctgctggcggaccatttcggctggctcggcatgccgcggcgccggctgggccgcagcgatgcgctggcggcgctgctggtgttggccggttgcgcgatactgattttcggagcctgagtcatgctgatcgtcatcgccgccgccatcgccaacggcctgtgcataggcggcagccgcgccgtcaacggcaaactgggccaacatcgcggcgcgctggccgcgtcgttctggaaccatctgggcggcctgctgtttctcagcctgctgctggccgcgtcgggggcaatgccgcgcctgccggcgcacgccccctggcacgcctggtgcggcggcgtcatcggcgcgctgttcgtcgcgctcaacagcttcgcgctgccgcggctgggcacgatgaaaaccgcgctgctggtgatcgccggccagatgctggctggcgtgctgatcgaccacctggctgcgggcggcggcaaatccgcgcctatccagctggccggcgccgcattgatcgcgctgggcctgttcgcgtcccggcgcgccgcggctcaggcttcccaaccgccgacagcggcgcggcaggcctgaaacccgtccatcagccgcgcggcgccagcatgatcaccgccatcccggccagcgccagcccgcagcccaacgcgtcccagcggtccggccggatgccgtccaccagccacagccagcccagcgccaccgtgatgtaaaccccgccgtaagccgcgtagacgcggccggcggcggccgggtgcagcgtcagcaaccaggcgaacagcgccagcgatgccgccgccggcgccaacagccaaaccggcttgccttggcgcaacaccagccagggcagatagcagccgacgatttccgccagcgcggtcaaggcgaacaagccgcccatccgcaataaattcgatatcagttccacgcgctctttcttctttgcgccgccctcccggcggccggccattgtaccgtttcgctatcggcgcgatttgaaaaggcaaattcccaggcggcgcccgccggcctaacatccagctacgcatatgacatgcaaaggagcaagccatgacgccattcgctatcagagggatagaccatatcgtgctgcgggtacgcgacccggaagactcggcgcggttttaccgcgaagtgctgggctgcggggtggtgaagcggcaggaaagcctgggcctggtgcatctggacgccggcagcgcgttgatcgacctgttgaacgccgaggcggccgacggcggcaccgccaatgtcgaccatttctgcctgcgcgtcgaaccgttcgacgaaatcgccatcctggcgcatctggccagccatggcatcgaggcggagccggccaggcagcgcttcggcgccgaaggccgcgggccgtcggtctatctgcccgatccggacggcaatgtgatagagctcaaaggcccgccctctgcctgagcgccggacaagccgcggtgcatgcggatgatggcctcgccggtggggctggcgatgatgtcgcgcagcgtgtagccgtccagcgtctggaaaaaggcctgcagcgctgcatccagcgcccctttcagccggcaaccgccgaacagcgcgcacggcggctcggcgcagtcgatcaactgcgacaagccttccagcgtgcgcaccacctcgcccagccggtagtgctccggcggtttcgccagcgccaggccgccgcccttgccgcggctggtcgccagccagccctgctgcgccatgaagtgcaccaccttaaccaggtggttgcgcgaaatgacgaagcgctcggcgatctccgggatggtggccagttggccgggctccagcccggtcaggtacatcagcacgcgcaggccgaggtcggtgaaacgggtcagttgcatgatgagtgccgcatcgatggttttcacaggaatcaatggccggcagcataccccggatcggcgctccgcctcaatcggcccgggcccggctcagtccgccgacgggttggagccgaacacctcgtaatggatgcgcgccggcgccacgccctgccgcagcaggctgccgcgctggacatccatgaagccgagcgggccgcacagatagtaatcggcatccggcagcagcgccaattcgcgcagcgcgtccagttgtagccgccccgccgcgtggtaatccaccccggccagatcctgcgcccgcggctgctcgtagcagatgtgcagcttgagccgcgcatggcgctccgccaattggcgcagcttgtgcttcatcgcatgcgcgccgccatggcgcgcggcgtgcaggaaacggatttcgcgctggccgccctggcgcagcaattggcccagcatcgccagcatcggcgtctggccgacgccggcgctgatcagcaccaccggcccggcgccgtcttcgttcaggcagaaatcgccctgcggcgcgctcagttccagcacgtcgcccaccgccacttcgcggtgcagcagattggacatccgcccggccggcttgcccgggccggcatcctcgcgtttgacggaaatgcgcaggtgctcgccgttgggcgcatcggacaggctgtactggcgcggctggctcagtccccattccggcacgaagcgcttcaccgacacgtactggccgggccggaagccgggcaaggcgccgccgtcgctcggctccaggtagaacgaagcgatttcctcgctctccgcctccttgcgcaccacccggaacggccgccagccgctccagccgccatcggcgttgaccgtgtcccggtacaaatcgttttccagcccagccatcaacgccgccaactggccataggcctcggcccaagcctggatcaggtcgtcgccggcggcatcgcccagcacttcgcgaatggaagccagcaaatgcttgccgacgataggatagtgctcggcgcggatgcccaggctgacatgcttgtgcgcgacgcgggtcagcaccggcaacagcggcgacggatcatcgatatgctgcgcgtaggccagcaccgccatcgccagcgcctgctgctgctggccggaatgctgatgaccctggttgaacaggtgtttcagctccggattgtgctcgaacatgcggcggtagaaatggctggtcaacgccacgccgtgttgttgcaataccggcacggtagccttgaccagggcacgagtggatgcgctcagcatattgactcctttaagatttatattaaatacatctttaatcgccggaaaaagcctctctgcgagaggcctccgatttaagatgtaaaaataatacatcttattttgatccctgtcagcaccaccatcgcgatttagtggccgctataggctgcggccgggttttcactcggcgcggctcaagagaaatcgaagtcgatcacctgatagaaggcgttgccggtatcggccacctcccacaccgccagcaccacgtgatagccctgccgttgcggcatccgcatcatgtggatggtcggctccggcggcatcagttcggcgctgtgctcccaatagggctgggcgctcatctccaccttgtagaaaggctcggactcgaactgcgcgcggctcaacggctggttcggattccagtccgccttggtgatgaagtagttccagcgccgggtcaggtggcgggcgtggtagctccactgaaactccatctcctggccggacttggccggatgcttggcccagcgctcggcgctttgctcgtccagcaccgccgagtgcgcctggccggcgctggcgatcttgccatcggccggcggcgccgcgttgggggtatcggtcggcgccagaggatccatcaggccggccaccgccgccgggaaaaacttgccgctttccaggccattgacgtgccagctttgcagcgggcactgcgcgttgacgccgtccacgcagagctggccgcgcgactccggcttgaacacctggccatgtctgggttgcatgccggctttcgattccatcttggtttggctcatgaaaatccccttggttaatgtcaggaaatacagccggcgccgccaagcggcggcgaagcggctgcccgcagcgtagccattccgccacgactgctggctggcctttttgactggcgcgccagggccaagcggctgctgctgaccgttctgccggccccgctgcgccattcacggccgctctcacgccagcatcgccagtcatgccttttaattggaacatgccatttgagatttatttgatatatttagtagtaaaactacattgacatcaggcaaaacctgtagtcgagggcagacaaaactacaaatggagactacctcatgcgccaccccttacctgcgcgtcccgccctgctgggcttgttgatcgccagcctgttcagtcctctcgcccatgccgccgaagccttcggcagccccggcgacacgccggtgcgcggccccgccgccaaatcctttgtcggcaccgccgtcggcagtccatccaaggtttacttcaccggctatcgcggcgtggtgtccgaggtgtactacccggtgctggacacgccggaatcggtggacttgcagtttctggtgggcgacgccggcaagactttcgtcgatgaggaaaagcgccaggcctactccgccgggcaaaccgacgcccgcaccatgagctggatcgccagcaccggcaatggcggccacaactggcagatcagcaagcgcatcttcgccgaccccaatcacgacacgctgatccagcgcgtgaccttcaccgcgctcaacggccacaccgtcggcgacttcaatctctacgtcctgttcaagccttatctcgacaacgccggcagcggcaacagcgcgcagaccgtggcggccgccggcggctacgcgctggcagccagccacaacagccgcgcctccgcgctgatggccagccagccgtggaaagtcgtcaacggccagcccatgctgtccaacggcttcgtcggccagagcgacggctggaccgatctgataggcagcggcgacaacaagatggactggacttatagctcggccaccaacggcaacgtcgcccaaaccggctggctggacctgggcgatcccaccgccaccagcgtgtccttcgacgcggcgctgggcttcggcgccagccagagcgacgccgtcaacagcgccgccgcctcgctgggctccgacctcaccgccgcccagcaacagtacgacaaggcctggcacgcctacaccgccggcctgtccacccagggcggcctggccgacgaccgctactaccaggcggcgatgacgctgaaaaccatgcaggacaagagcaacggcgcgatgatcgccggcatcggcacgccgtggggcgagacccagggcgacgccaaccagggcggctaccacctggtgtggccgcgcgacctgttcaagttcgccaacgccttgaccaccgccggcgacaccgccaccgccaccacggtggtcaattacctgttcaacaccctgcagcaggccagcaactgcggcgcggccgaatacaacgccgccggctgcgcggccggctacagccgcgtcggccgcttcccgcaaaacgcctggatcagcggctggccttactggcaaggcacccagatggacgagcaggcgatgcccatcctgctggcctggcggctagggtcggccgtgtccaatccgctatggcccaaaatcaagctgaccgccgactacatcgtcgccaccggcccgtggagctatcaggaacgctgggaagagaattccggctattcgccgtccaccctcgccgccgagatcgccggcctggtggccgccgccgacatcgcccgcaacaatggcgacgacgccagcgccggccgctatttgtccgcggcggactattggcagcaaagcgtcgccgcctggacctacaccaccagcggcagcttcggcaacggcagctactatctccgcatcaacccggccgcgcgcgccggcagcggcgccgaccgcgccagcttcaacccgtccgccgggccggacacgccgcaaacgctgatggtgaaaaacggcggcggcagccacgacgcccgccgcgtggtggacggcggcttcctggagctggtgcgcatgggcgtcaagcgcgccaacgaccccaccatcgtcaacaccatcaatgtgttcgacagcgtgctgggacagaatctggcgctgcccggcgcgcccgccctgccgtataacgcctggttccgctacaacttcgacggctacggcgaacacaacgacggcagcgatttcaacggcacgggcgccggccgcctgtggccgatcttcaccgccgagcgcggcatgtacgagatcgcccgccaaggcagcgctgccgccggccagccctacttcgccacgctgaagctgctggccacgccggaaggcatgctgccggaacaagtgtggtccaacagcgccatgttgccggacggctgggcggtgagcacgccggccggctatctgcctggcgcgccgaccaagtcgatggcgccgctgaactgggcgatgggcgaatacatcagcctgctggcctctatccacgccggacgggtggtcgacatcccgcaagtggtgtgcgcgcgctacaacaactgccgcgccgcgcccaaggccggcgaggtgccggttgacatcaacgtgaccgccagcacccaatggggccagcagatctacgtcaccggcaacgcgcgcgctttgggcaactggaacaccgatctgggcattccgctggacgcggccgcttacccggcttggcaaaacggcgtcaacctgccggccggccagcagatcgcctacaagtactaccgcaagaacgccgacggcagcgtgacttgggaaagcctgtccggcaaccgcagcctgcagacgccggccagcggcagcctcagcctgaacgaccaggtgagctggtgaccccgcgccgcgcctggactgccgccctgctattgaccgcggcggtggccggcggcgcggtctggcggctatggccggcgcaggcgccctcgccgccgccggctgtcgccaagccgcctgccgccattttgccgacccggcccatcgtccatcaggccacgccggcccagccctggcggccgcccgcgcgcccggccctgccgccggtgaagaaaggcggcaacagctggcggccggaggcggcgccggtggcggccaaggtggaagtccagcggggcgcgccggacatgccggacgcgcagcctctgcccaggccgcccgatccttgatcccgccggcgctggcccgctccggcgggcctttttcttgcttgatctgcgtcgttcccgcgaccgaaccccatcgtcaaatcaagacacaaggagaatcaagatgccgcaccgggaagtcttcgcgctcgacgccgcgcaaaccgaagcctggctgccggaaatggccgaactgctgcacgcctgcgtgcatggcggcgccagcatccatttcgtgcagcctttcactctggagcaagccaccgccttctggcgcgacagcaccctgcccggcgtcgccggcggcggccgcgtgctgctggccgcgctggtggatggagaactggccggcagcgcgcagctggactgcggcaccccgcccaaccagccgcaccgcgccgaggtatgcaagcttttggtgcatccggactaccgccgccagggcgtcgcccgcgccttgatggcagagctggaggcgcaggcgcgcctgcgcaagcgcagcctgctgacgctggacaccgccagcggcgaccatgccgaaccgctctatctgtcattgggctatcaggaggccggacggattcccggctacgcctgggacggccgcggcgaaaaactgcaggccaccacgctgatgtacaagacgctgtagacgcgaaaaagccgggcaagcccggcttttgctgtttgtaaaagtcctccgctcacacgcgttgctcggccagcgctttcttgccgccccagcccagcaggcgcagagcgaagcatcccagatacagcacgcccagcgcgaacgcgatgtcgcccggcacccgcagccacaccaggttctgcatcagcgccgagtgcaccacctccggcgaacgcgcgtaccacaggccatgctcgacgctggcccaggcctggtagatgccggatggcaggatggacagaaacaccatcaggaacaagccgatattgagcagccagaacgccggcttcagcaggcggttgtcccatcgctgcgcatcagacaccccgcgcaggcaaaacagcatcagccctatgcccagcatgccgtagacgccgaacagcgccgcgtggccgtgggccggcgtcatgttcaggccctgcacgtagtacagcgagatcggcggattgatggcgaagcccagcaggcccgcgcccaccgtgttccaccccccgacggcgacgaagcacaggatcgcccacttgtagcgctccacccatggcgcggcgccggcccggcggtaagtctgccagccctcgaaacccaccagagccagcggcaccacctcgaacgccgagaataccgcgccgacggagatcaccgcggtggaagcgccggtgaaatacaggtggtgcagcgtgcccaggatgccgccgaacaggaaaaccatggtttccagcacgatggcgcggttggcgctgctcatgcggatcaggcccagccgcgcgaagatcagcgccaccaccgcggtggcgaaaacctcgaagaagccctccacccacaggtgcaccagccaccagcgccagtactcgatcatcgaataatgggtgcgctggccccaggccagcgaggtggcgtaaaacaggccgatgcaggccgcggacagcagcagcatcgcgatcaggctgcggccttcggtttccttatcgcgcagcgcaggcagcagcgcgcgcgccaccagaaacagccagaacaacaagccgacgaacagcaggatttgccacacccgccccatgctggtgtaggccagcccctggttgccgatccagaagctgaaatcggtgcccagacgctgcaaggtacccacccagccggtgacggtggaaccgacgacgatgaagaccagagcccagaacagcgcgtccacgcccagcttctgatgcttgggctcatggccggacaatagcggcgcgatgtagaggccggtggccagccaggcggtggcgatccacagcacgccgaactgggtgtggatggtgcggctcaccacccagggcagcacctcggccaacgggatgccgaagaagctgtggccttccaccgcgtagtgagcggtgatggcgcccatgcccacctgggtcagcaacaggccgatcaccacataaaaatacttgcgggtggcgcgcatcgacggcgtggccttgagccggcccagcgggtcggcatccggcacctgcgcgggctcctcgccttcgccggcggccatgtggtaccacaccatcgcggcgatgcccgccagcatcaggatcacgctggcgatcgaccacatgccgttggcggcggtgggcgcgttgccgaccagcggctcatgcggccagttattggtgtaggacacgccagcttcgccgggacggtcggcggcggcggaccaggcggaccagaagaagaacgccgataccgccacgcggtcgtcggccgacggcagcgcgtcggcagtcatcgcgtactgctcgcgcagcgtgtcgaaggccggatcggcgctgtacaggccctggtaatgccgggccgtttcgcgcgcggcggctgcgcgggccgcgcttagcgtcagcgtgccgctggccgcgtcatagccgttggcgcgcatctcgcggcgcagttcggcgtccagcatgccttgccggccgatatccaactgcgcgtaagccatgccgaaacgctgccgcgcccaatcctcccgcagcgccagcgcctcgcggtgcagccagtcggccgaccagtccggcgccacatagctgccatgtccccacaccgtgcccaattgctggccgccggacgccagccaggcttgctggccgcggcggatctgctcgccggtgaacaaagccttgccgccggcatcccgcaccatggcgggaatcggcggcgcagcctggtaaatctccctgcccatgtaaagcagggccgaaaacgacagcaggcacaccagtgccagccatccccataaacgccgtgtcgatcgcatacgctccccctttcgcagggccgggacatgaaattaaaaatgcatgatacatacacctttaaaagatgtatagtttgcacatttttaaatttcaaataccccgcgccaagagcaaaccgccttgccggcagcctgtcggctcaagccgctttggcactcgcatgcgcaacgccgtgcggacaagttcccgaccgcggcggccgcatcgaagtcattcgtactttaggacaggtccagccatcgcagaccaatcatgcatcacccaagcagcaggccggtggtcaagccagacggcatggcatcgaatacctgaaagaaaactgcaaaaatcctgccatctgccaacctatcgccatcgccgccgcagccgcttggcgccgcggcaatttctgaatatccgccatcgccgcccggatcgccacccgtagcaatacgcattggccaagcggctccggacgccgccgcctcgccgcatccccctgtgctatatgcaagaacaggccgggagccatgcaaaaggcatgtcccgttgtgacgataaaaacaggaaccaaggtgatggccatgtcgacaagataccccgctctgctgctagtgctgctgagcctggccggctgcaaggagtcgcagcccaagcccggcaccgtgctggatgaggccaaacaggccaaacgcaccgtggaatcgttccccgccgccgacgaggactatttccacgcgatggacagcggcgtgaagctggatgccgacgaagtgaaaggccgcaacacctggctggtctggaccggcggcaacgataggctgtgggacaccctggccaccgtcagcgtcggcaacctcgacctgctcaagaccctgtcctcccatcccggcctcaaattcggccgggacagccgctgggactacctgggcctggtcaacgaaccctgttttgaaaaggccaccggccccgacccgcagcgtttcggcctgtggctggaccaccgcagcgccaactgcccgaaggaccccttcgagaacgagcagaaatatcccggcgtggcgctgggcgcccgcggcaagaacctgcctgccggctcttactacggctacgccaccggggtggtgggactgcggcttttccccaaccccgccttcgacgaagccgcggcgaaaaaatgggaccccaagcgctattacgaagaccccagctattacaacgacaaggacctgatccggccctaccgggtggggatgtcgtgcgcgttctgccacgtcggccccaatccagtgaatccgccggctaatccggagcatccgaagtgggaaaacctcagctccaatgtcggcgcgcagtacttctgggtggaccggatcttctcctggcaggccgatcccggcaatttcgccttccaacttttccataccgcgcgtccgggcacgctcgacacctcgctgatctcgaccgactccatcaataacccgcgcaccatgaacgccgtctacgacctggtcccgcggctggagctggccaagcgctggggcaaggaaaccctggccggcggcggcctcgacaacaaacagttcaacgacttcgtcaaggatgggccgctgacccagttctacaaagcgccaaacaccgtctggacgccgcgcgtgctgaaggatggctcggactcggtcggggcgcttggcgcattgaaccgggtgtatctgaacatcggcctgttcagcgaagaatggctattgcacttccgtccgctgatcggcggcaaaaccatcacgccgatagagatcaaggtcgccaacaaaaactcggtctactggcaggccacggaaaaccagacgcccgacatggccctgttcttcctgaaaagcaccgacccgcacaagctcaaggacgcgcccggcggcgaacaataccttagcaaggacgccgcccagctgacccgcggcaaggtggtgttcgccgaaaactgcgcgcgctgccactccagcaagctgccgcccgaagtaccggcgctggacccgacccagggttgcgccgggcccgactacctgagctgcttcaacaagtactgggagtcgaccaagaccgagcgcttcaaatccgagatgcggaaaatcgtgctggccgacgacttcctgaaagacaactacctgtccaccgagctgcgcgtgccggtgacgctgctggaaaccaacgcctgcagcccgctggcccgcaatgcgctgaaggacaatatctgggacaacttctcgtcgcaaacctacaaggacctgccgtcggtgggcagcatcaccgtccacaacccgttcaccggccagccctggcagtacaagatgccggccggcggacgcggctacacccggcccgcctcgctgatcagcgtctggtcgaccgcgcccttcctgctcaacaacaccgtgggcaagttcaaccccagcccctcggtggccggacgcatggactcgttcaacgactccatccgccagatgctgtggccggaaacccggcagaaggattcggtgctgggcgacaaggtgccgggcgtgatagaccgcaccaccgcgcgcagctacctgcgagtgccgataggctatctgcctgactccctgcaggaactgcaaggcccgctgcaacgctatctgccctggctgttcggcgacgactcgctggaaatcggcccgatcccggccggcaccccggtcaacctgatcgccaacctggagctggtgctggaaaaccccagcctgggcgagcggctgaaacacgacaaaaagctggtatcggtattgctcaagctgatccacgacctgaaggcgctgcccaaggacgccagcgacgaggaagcgcgcaaggtattcgccaacctggcccagccgctgctggagctgagcacctgccccgacttcgtcgtcaaccgcggccattatttcggcacccgctacatgaagggcgaagccgggctgagcgatagcgacaagctggcgctgatcgaattcctgaaaaccttctgaggatggcgggcatgagcgcggacagcaatcgttccaccgattacgaatacatcgtcgtcggctccggcgcgggcggcggcaccctggccgcccggctggccgaggaagggcatagcgtgctgctgctggaagcaggcggcgacccgtaccggctgcaagggggggatgcctggcagccggacgccgaccggctgccggacgactacaatgtgccggtgttccacgcgctggcgtcggaaaacaaggcgatgaagctggattacttcgtccgccactatcgcaacgacgaacaacagcggcgcgaccccaagtaccgggccgagtgggatggccagcgggtggacggcgtgctctacccgcgctccggcacgctgggcggctgcaccgcccacaacgccatgatcaccgtctacccgcacaacgccgactgggacaacatcgcccagctgaccggcgacgccagttgggcgtccggcctgatgcgccgctatttccaaaaactggaaaactgccaccaccgcccgctgtaccgctggctgggcaagttctgcatcaaccccacccgccacggctggaaaggctggctgcagacggaaaaagcgataccggagtccgcgctgggcgacgccggcctggtggacaccctgctggtctcgctggacaaggccttcaacgaggtggacgtgccgcacagcagctggcgctggttgctgcaggggcaggccgatcccaacgactggcggctggtgcgcgacaacgccgtcggcgtctgctacccgccgctggccacccgcaaccaccagcgcaacggcagccgcgagcgggtaatcgatgtggcgcaacgcttccctaaccgcctgcacatagagctggacgcgctggccacccaggtgctgttcgacgagcgcaaccgcgccaccggcgtcgaatacctgaagggagaaaagctctatcgcgccttccaccagccgggcagcggcggcgaaaaacgcgcagcccgcgccagccgcgaagtcatcctgtgcggcggcgcgttcaacaccccgcaattgctgatgctgtccggcatcggcccggccgcgcacctgcaacagcacggcatcccggtgcgggtggacctgcccggcgtggggcagaacctgcaggaccgctacgaagtaggcgtggtcaatcggatgaacttcaagcactgggaagtgctgaaaggcgcggaattcgccaagggcgacccgcaataccagcaatgggagcaaggccgcaagggcgtctacaccaccaatggcgcggtgctggccgtgatcaagcgctcagccaaggaaaggccgcttcccgacctgttctgcttcgcgctgctgggcctgttcaaaggctacttccccggttactcccggctgtttcccgaacacctgaactacctgacctgggcgattctcaaggcccacaccaacaaccgcgccggcaccgtgacgctgcgctcggccgacccgcacgacccgccgcaaatcgacttccactacttcgaggagggcagcgccggcggcgaacaagacctggactcggtggtggacgggatcaagttcgtgcgcaccctgaccgccgatctgaaaaaacaaaagctgatcgcggaagaagagctgccaggggatgcggtgcaaaccgacgatgaactgcgtcagtttgtccgcgacaacgcctggggccaccatgcctcctgcagctgcgcgataggcccgcgcgaacagaacggcgtgctggacagcgatttcagggtatacggggtgcacggcctgcgggtggtcgacgcctcggtgtttccgcgcatccccggtttcttcatcgtttccgccgtgtacatgatcgcggaaaaggcggcggacgccatcctggccgacgccggatgaccactcctccaacccggacaagccaggtcaacggaaagcgcaagcatggactcccaagctgagacatctctctccaaatggcaagacgtattgcgggcagaacgggccagcatcgccgcggccaggcaggccgaggacataccacgcccagccggccccgacggcgccgacatcccccaggacgccatgatagggctggccttctccggcggcggcatacgcagcgccaccttcaatctgggcgtgctgcaggcgctggccaaaaccggctggctgcagcaaatggactatctgtccaccgtgtccggcggcggctatataggcagctggctatccgcgctgaagcgccggctgcggcccaaggaaaccataaaccagacgctgaccgatctgcagggccgggcgccggccattcagttcctgcgcgagtacagcaactacctgacgccgaaaaccggcctgttcagcctggacaccctgtccgcggtcgtcacctacggccgcaacctggttctcaaccagttcgtgctgctgtgcttcctgaccgcgctgttgctatgccctcacatgctggtggcgttcgccggctacgccgccacctaccccggcggcgacatgatgtcgctggcggtggccgtgctggccgccattttctccgcgcggcaggcccgcgacacagtgaacgacggtttgcaggccgccaaacccgccgccgcgtccaccagcgtggcgttgctgctgatcttcgtctacgcggtgtccatcctggcgctgtcccggctgaagcaaggcaatctggcgtggcatgaactgtccctgacgccattcctgctgatctgcagcccggcttacgcgctctactgggcgattctggcgcacggcttcacccagctgaacaatcgcggctaccggcgcagcgtgtgctgggcgctgctggccggcttgatcggcggcggcgggttgtggctgatgctgcaggcgctggactatctgctgccggtgcggcaagagccgttcctggcctggcatgtgatcggcttcggcttcgtgctgctgccggcagccttcatcatgaccgcaaccgcgcatatcggcctggtcaaacgcagcttttcggaactgcagcgcgaatggtggtcgcggctgggcgcgctgctgctggtgagcgacctggcgctgctgctggttttcgccatggtggcgctggcgctgcccttggtcgaggtggccgacgactggatacgcaacgcggtattgccggcctggctgctgtccacgctggccgcggtatggcaaggccagtccgccgccaccagcggcaaggaaaagggggattggcgcgaatgggtggccaagatcgggccctatgtgttcatcgccggcctgctgctgctggtcagcgcgctgctgagctggctgctgacctatttcaagaccaccggcgcccagtgggcgctaagcgacaatccctgtcccgactaccgctgcgacctcaccgagtgggccagcctgcacttccaggcctcgcacgacgccggccacggcggcctgttgtacctgctgctgctggcggccagcctggcggtcggcattttcgcctcgtcgcggatagacatcaacgtcttctccttgcacaacttctaccgcaaccggctgacccgttgctacctgggcgccagcaaccgcctgcgatcggagcgcgtcaatcgcttcaccggcttttgcgccgaagacgacctggcgatgtccgagctggccagggcgaatccggtgcagcgcccctaccacctgatcaacaccgctctcaacctggtatccggctccgacctggcttggcagcaacgcaaggccgcgtccttcactttctcgccgctgtattgcggctacaaattcccggacaccgctccgcacccggtagacgtgtttgtccgcaccgccgactacctgcaggacgacccctcggcgctggaggcgggcccgatgctgggctcgctggtggccacctccggcgcggcggtcagccccaaccagggctaccacagctcgccggcggtgagcttcctgctgacggtgttcaatgtcaggctgggccgctggtgccccaaccccaaccgggccagcgccgcccaactgcgggaaatgtcgccgccggtcagctggcgctacctgctggacgaattgttcggccggaccaacgccgaatcgggcttcgtctacctgagcgacggcggccattttgaaaacctgggcatctacgaactggcgcggcgcgaatgcgcgctgatcatcgcctgcgacgccggccaggacgaaaacatgaccttcgaagacctgggcaacgcgatacgcaaatgccggatagacctgggcgcggaaatccgcatcgatgtggacagcatccgcatcgatgccaccaccggctacagtccgtcgtgctgccaaatgggcgacatcttctacgcgtcaggcaagcgcggccggctgctgtacctgaaaccctgcctgcgcggccacggcgccgagccggtggacgtgctgcagtacaaggcggcgaacccgtccttcccgcaccaatccacgttgaaccaatggttcgacgagtcgcaattcgaaagctatcgcaagctgggcctgtgcataggagaaaccgcgctggccgaattgagccgccccgccagggcgcctgatgcagcagatccggcctagcccgcctgccgccgccggggtccgggcccctgagcccggacccgctcgcgctcgcgctcggcatcgaaccgcgcgcaggctgacgaaatccagccggcgaaggcctgggtttcccgccgcgatgggtcgcggccaagcagcgcatagcgcgccggcgacgccacccagcggccgaacacatccaccagcctgccgctttgcagctcgtcccacaccagcgcggtgcgggccatcgccacgccctcgtggttcaacgccatgcccagcgccaggctggacaggttgaactgcgcgccgcccagcagcggcagccaatcgggccgcgccgcctgcagccatagccgccattcggcgaaagcttcggccccgtcccagggtgaggcgtcatgcagcatcgcgatgccatccatggattcgccggcggcgaaggccggatggcgcgccaggtaagccggcgtggcgaccggcagcaggtattcgtccagcaacggtaccgcctgcggcgggacatggctcgcggcgtcgtaccggatggcgatgtccgccccggccatgccgccatccggcggctgaaactccgccagcagccgcaacggcacctcaggcgccaggcgttggaattcggtcaagcgcggcatcagccagcgcagcgcgaaggaaggcacgcagctcagttgcagcggggccgcgtccgcacccaatcgcgccagggtctgctcgatttcgcccagcgcggcggaaaccgtccgcagcagcgcaccgcccttgtcggtcagccccaacgcgctgccgcgcgcgaacagccggtagcccagccgctcctccagcttgcggacctgctgactgaccgcgctttgcgtcagatgcaattcctgcgccgcccgggtgaaactgagcaggcgtccggcggcctcgaaactcctgagcgcgcccaacatggatgaatccagcatcggcattagcctggctaatgatgtaaacagcaattatcgcttccggcccgcggcttgtctcgctacgattgacaggtcaatcacttcacgccgcctctttgccatgcccccttccctccccgcctcgctatcagcccagctgctgtcgaaacgcgccatgctatggctaaacgatcaggccggcgtcgcgccgatgccgccgcgtccgcaagccgccgatatcgaatccgcccgaacgcggctgcagcgctgccaaggcctgctggcgcgcttgtttcccgacttgtccgcctgcggcggcgtcatcgcgtcgccgctgctgccgttggccaagctgcaacaagcgcaaggcggcgacgccgcgcgggaaggcgcatggctgctgaaagccgaccatgcgctgccggtggccggctcgatcaaggccaggggcggttttcacgaggtgctggcgctggcggaggaattagccctgcgccacggcctgctggatgcggccggcgaccgcgccgcgctggcggaacccgctgcgcgcgcctgcttctcccaatacaccgtgatggtcggcagcaccggcaatctgggcatgagcatcgggctgatcgccgccgcgctgggattccgcgccgtggtccacatgtcggtggaagccaaagcctggaagaaggacaggctgcgccgccacggcgtgcaggtaatcgagcacgccggcgattacgcgcaagccgtcgccgccggccgcgccgccgccgcggccgatccggccacgcatttcgtcgacgacgagcaatcgctggcgctgtttctcggctacgccgccgccgcccgcgaattggcggagcaattgcgcgccgccggccgcgcggtggacgccgagcgcccgctgttcgtctacctaccttgcggcgtcggcggcgcgcccggcggcatcgccttcggcctgaaggcgctgtacggcgagcatgtccactgcttcttcgccgaaccggccgcctcgccctgcatgctggtgcaactggccgccggcgccgccgccccggtatcggtttacgatatcggcctggacaaccgcaccgaggccgacggcctggcggtgggcctggcatcgccgctggccagcccgctgatggccaggctgctgtccggcgtgttcaccgtggaggacgcgcagctgttcaccgggctgctccagttgttcgaaaccgagggcatcgcgctggaaccatccgccgccgccggcctgcccggcccggactggatctgccgctcggcggccggccgcgcctatctcgacctccacggcctggccggccggctgggcagcgccactcacgtgatctggtctaccggcggctcgctggtgccggaagccgaacatgagcgcttccgcgccgaaggccgccgcctgcgggatcgccaagcccaataacaccgggcctcgcgccggaaaatggccgcgcgcggacagcctgactgtctgttgcgcgccacaaccacgactggagaattcgcctccggcttgaaactagacgactggtctagtagtatcaagccatgtcacgagccaaccacaccgccgatacccgcgaacacctgcttgccacaggagagaaaatcatcctgggcaaaggcttcgccgctgtcggcctggcggaaatcctgtccagcgccggcgtgcccaaggggtcgttctaccattacttccagtccaaggaaggatatggcgtggagttgctgcgtcgttatttcctcaattacgacgagcagctggtgctgcggctgcggccggaagccggccccgcccgcgactcgctgctcaagtatttcaacggctgggtcagccagcaccgctgcgatgcgcaaagccatacctgcctggcggtgaagctggcggcggaagtgtccgatctgtccgagccgatgcgcgaagcgctggcggaaggcatgggccgggtgatttcccgcctggccgacgccatccgccgcggccagcaagaaggcagcctgtgcgtgcatctgccggcggacgaacttgccgccagcctgtacagcctgtgggtgggaagcgcgctcttgtacaaggtgcaacgctccgcccagcccatgctcaatgcgctgaagctgaccgaaaccatgttgaaggttccctccgccgccaactgcggcgcctgagccgcttgaaccgcccgctgcttgcagcgggctttgttgacacagaatctagacgaccggtctattaaatggagttgtcatgaacgaaaccttgcaactgatgcagcaacaccgcagcgtgcgcagctatcaggacaagcccatttcccagcaaacgctggacgcggtgctggacgccgcctggaagggccccacctcgatcaacggccagcaagtctcgctggtggtggtgcaggacgccgaacagcgccagcgcatcgccgaaatcgccggcggccagccctggatcgcccaggcgccggtcttcatcgccgtggtgatcgatttccacaaaacccggctgggcgtggagatggccggcgcccagcagacgatacacaacagcgtggaagccttcgccgtgggcgcggtggatgccggcatcgcgctgggcaatctgatgaccgccgcgcgctccgccgggctcggcgtggtgccgatcggcggcatccgccgcgatccgcaggcaatgatagaactgttgcaattgccggaactgaccttcccgctggtgggcctggcgctgggccaccccgatcaggaaggcagcgtgaagccgcgcctgccgcgcgacagcttcgtccacaacggccagtaccaggcggaagccctgcccggccacatcgccgcctacgacgaaaccctgcgccagtactggcaagacatcggccgcggcgacggcgagccctggagccgcaataccgccggctactaccgcaacgtttacttccccaaggttgcccccgtcgcgcgcagccagggttttggcttcgatcaataagccgctttttcatcctcgaggatcccgacatgcaagccgataaactgttcaccccgctgatcatgggcgccgtcactctggccaaccgcgtggcgatggcgccgctgacccgcctgcgcaacatcgagccgggcgacgtgcccggcccgctggccaaggaatactaccgccagcgcgccagcgccggcctgatcgtggccgaaggcacccacatctcgcccaccgccaagggctacgccggcgcgcccggcatctatagcgaagagcaggtgaaagcctggagcgaagtgaccggcgccgtgcacgaggccggcggcaagatcgcgctgcagctgtggcacaccggccgcatctcgcaccgctcgctgcaacctaacggcgacgcgccggtcggcccgtccgccatccaggccgacagccgcaccaatatccgcgccgccgacggcagcttggtgcgcgagcaatgcgacacgccgcgcgcgctggaaatcgaggaaatcgacgacatcctcgaagactaccgccgcgccaccgacaacgcgcgccgcgccggcttcgatctggtggaaatccacggcgcccacggctatctgctggaccagttcctgtcgccgcaggccaatgtccgcgccgaccagtacggcggcagcgtggaaaaccgcgcccgcttcctgttgcaggtcgtcgacgccgtggtcggcgaatgggacgccgcccacgtcggcatccgcatctcgccgctgggcatcttcaatggcgtcagcaacaccgaccaactggagatggcgctgtacctggccgagcagctggccaagcgcaagctcgccttcctccacatctccgaacccgactgggccggcggccccaagctggacgaaactttccgcgccgagctgcgcaaacgctacccgggcgtgatcgtcggcgccggcggctacaccgcggagaaagccgaaaccctgatcaagcaaggttatatcgacgccgccgccttcggccgcagctacatcgccaacccggacctggtggagcggctgaaacgcaacgcgccgctgaacccgccgcaagcggaaaccttctacggcggcggcgcggaaggctataccgactaccccgcgctgtaagctcccaagcaagccccgcctgccggcggggcttttccacggctgctcagcctatcgacgcctgcgcctggcgttcgacgatggcgctggcgatccgcagcgccagcgcgccggcatcggcgatggactggttctgcgcggcgacctgcgcgccttcgaacaccagcatcagttcgctcgccgtatcctccggcgacgcgaggccggcggcccggcacaagcccgccagccgccgccactggccttgcttgtattccgctatcagcttgcggccgacgtgctctctgtccggcagctccgcgatcgaattgatgaacggacagccgcggtgcgaccaggcgccggcgtcgtcggcgaaaaaggccgcccaccccagaatctgcgcgcgcggatcgccggcgtgctcggccgctatggcgtcgaacgcgcgccagtagccggctatcacctggcgcagccattccgccaacagcgcgtctttcgactggaagtgtcgatacagcgccatcttggtggtattcgcccgggcggcgatcgcctcgacgccggtcgcgcggatgccatcgttgtaaaacagttcgcctgccgcctcgaggagacgctcccgcggcgggaccgaagaatcggccgcttttcgcttgttcattttgccatccgtcttgacgatgataccgatcggtatcatcattcccatgcagtgataccgaacggtatcacccctctccggctcatgtcgagccggagcatccgccatgggaatcagcgatgaaactttcggaatatgcgcaatacgacgcgatcggcctgggccagcttgtcgcgcggggcgaagtcagcccgcaagaactggcggaaacggcgctgcgggcgtgcgcggcggtcaatcctcacatcaacgcggtcatcgaaacctggcagcccgagctggccgacgccgccgcggcgctggagcgcggatcgccgctcgccggcgtgcccttcctgataaaggacgtcggcgtcgccatggcgggcagaaagatagaattcggcagccggctggcgcagggcttcaccgccgccgccgactccatcctgatgcggcgcttccgccaagcggggctggccacgctggggcggaccaccacgcccgaattcgcctggagcggcaccaccgaatccgcgctcagcggcccgacccgcaacccctggaacgcggcgcgcggcgcgggcggctccagcggcggcgccgcggcggcggtggccgccggtatcgtgccgatcgcgcatgcgaccgacgccgccggctccatccgcattccggccgccgccagcggcgtgttcggcctcaagcccacgcgcggccgcgtatccaacggcccgattctcgacgaggccatccacggcctggccgcgcagctgggcgtcagccgctcggtgcgcgacagcgccgcgctgctcgacgccgcgcgcggcgcggacggcggccagcccttctccatcgcggaacccgccggcagttatttcgcgcaagtcggcgccgagcctggccggctgcggataggcgtgatggcgcaagcctggggcggccagcgcaccgccgccgccgtcctcgagcggctggccgaagcgacgcggctgtgcgaatcgctcggccacatcgtagaggaagcggcgcttcccctgggttgcagctgggacgccttcgtccatgccagctccgtgctatgggccgccaacatcgccgtgtggatcgacgacatggcggcagccaccggacggcagatcgacctgtccacgctggagcagcagacgctggccgtctaccggaccggacatgggatgcgcggcgtcgagatcgtgcgggcgctggacttgcgcaacgccgtcacccgcagcgtcgcggctttcttcacgcgctacgatctgctgctgacgcctacgctgcccgagctggcgccgcccatcggcagttatgccgccgacacggcaagcatggacggccatcaatggaccgcgcatgtgatgggcggttcgccgttcacgccggcattcaacgccgcaggcgtgccggccatgtcggcgcccttgttccaggatgcggcgtcggcgttgccggtcggcatgcagttcgtcgcgccggccggacgcgaggacaggctgttccggctggccggccagctggagcgcagcctgccgtgggcggaccgcaagcccgccatctgggctggccgcgatccacgcgcggaacccgcttgccgccatgatgacaacaggatttgaaacgcgctacagtctgggattggccgccgccgcgagcggcgcgccgccacaacagaaagccctgcacgccgccggcggcaagggctccgcccccaggagaacatcatgaagaccagactgctcgcatccgcggccctgctgttggccacgcaggctcacgcggcggcagatccctacctatggctggagaacatccagggcaaggatgcgctgcaatgggtgaagcagcagaacgagcacaccagccgggaagtggagaactggcaagatttctccgcgctgaagcaaggcatcctgtccgttctcgactccggcgcccgcattcccgccatcgaaaagataggcggccgctactacaacttctggcgcgacgcccagcatccgcgcggactgtggcgcagcgccacgctggacgaataccgcaaggccgaccccgcctgggaaaccgtgctggacctggaccagctggccaaggatgaaaaagaaaactgggtatggcagggcgccgactgcgtcaagcccaggcaagaccgctgcctgatccgcctgagccgcggcggcggcgacgccgcggtggtgcgcgagttcgacctgccggccaagcgcttcctcgccgacggcttcgtggtgccggaagccaagagcgaagtcaactgggccgaccgcgacacgctgtacgtcgccaccgatttcggcaagggcacgctgaccgactccggctacccgcgcatcgtcaaggagtggaagcgcggccagcctctggccgacgccgccacgctgttcgagggcaggcagaccgacatctcggtcaacgccgacggcatcgacaccgccggccagcactacgacgtgatcagccagggcaccagcttcttcaccaacgacacctatctgaagcgcgacggcaaatggctgaagctggacaagcccggccatgtcgaggcgtctttccacggcgcctggctgctgttgcggccgcgccagaactggcaggtcggcggccatgactggaaggccggcagcctgctggcggtgaaggtggacgactacctgcaaggcaagcgcgatttcgccgcgctgttccagccgaccgccaccacctcgctgggcggcagcgctggcacccgcgacgcgctgatcctgaccgtactcgacaacgtcaagagccggctggtggaatggaaggtggcggacggcaagtggcggtcgcgcccggtggccgcgcccggctacggcagcatagacgtcagcccagtggacggcgacagctccaatgactacttcttcaccttcaccgacttcctgacgccgacctcgctgtcgctggcccacatcggcagcgacgcgcgcgagccgctgaagcagcagccggccttcttcgacgccaagccctaccgcatccagcagttcttcgcccgctccaacgacggcacccgggtgccttacttcgtggtggcgcgcaaagacttgaagctcaacggcaagaacccgacgctgctatacggctacggcggcttcgaggtttcgctgacgccctattacagcggcaccttgggcaaggcctggctggagcgaggcggcgtctacgtgctgggcaacatccgcggcggcggcgaatacggcccggcctggcatgaggcggcgctgaaacacaagcgccagaaagcctacgacgatttctcgtccatcgccaaagacctgtcgcgccgcggcatcgccgacgcgcgccacctgggcatcaagggcggcagcaacggcggcctgctgatgggcgtgatgctgaccaagtatccgcaactgttccacgccatcgtctgccaggtgccgctcttggacatgaagcgcttcaacaagctgctggccggcgccagctggatggacgaatacggcaacccggaccagccgtccgactgggcctacatcaagcgctactcgccgtaccagaacattcgccccggcacccgctacccggccacgctgttcgtcacctccacgctggacgaccgcgttcatcccggccatgcccgcaagatgttcgccgcgatgaagcagatcggcgccgacgtccgctactacgagcgcaccgagggcggccacggctccgccgccaatcacgacgaagaggcgcgcatcgccgcgatggaatacgcgttcttgtggaagcaactgcgctgaatccgctccaggccccgctccggcggggcttttttcatccgcgccgccggccggcgaatgcaatttgaatgagtcgcgccgcttcctataatggtcaatgaggcccgctgccggccccaacatccccggtttttttcaggagcggcaacttgtccaccttccgttcccgcatctggtcgcggcccgaactgcgcgttgccgtcgttttcgtctgcacgatgatcgcggtcaccgcggcggtggtgttccagaccggcctgcaccagcgccagcagctgctgtccgcctaccagatccgcctgggctacgtcacccacacccgcgacgccatcctgcgcaaccaattcgaccaactggcgcgcgacgtgcgtttcctcagcgccaccccgccggtctccggcatcgtccgcgccagcgcgcacggcggcgtcgacccgcaggaaaactccacgatggcggcctggcacagccgcctcgcctccatcttcagcgccttcctcgccgccaatcccgaattttcctctgtccgcttcatcggcatcgccaacgatggcaaagaactggcgcgggtggagcgcaatgcccaagaccaggtggaagtcacccccgcggcgaaactgcaggcgcacggcgaccgcgactacatgcaggaaaccatccgcctggaaaccgggcaggtgtacttctccgacatcaacctaggctcccgccaccgcgacgccggcggcaacaccgcggtgccgaccatccgggtggccacgccgatacgcgacgccggcggcaaaaccttcggcatcgtcatcatcaatttcgacgcccgcaatctgctggcctcgctgttccagagcatcccggtggaactgaagctttacgtcaccaatcagggcggcgactacctggcccaacccgaccccagccgcgtcttcggcttcgaaaagaacctgcaatggcgctggagcgacgacttccagccgaccaccccgttgctggggcagccggaaggcctgcaggcctactcgtcgccgcacggcaccgcctatgtgcgctcgatcaacatcccgttcaacccggccttccccaaccactactgcaccgtgtacgcggtgctgcctgacgaggcggtggccggcatggtggccaccacccggcgcgccacgctggccacctcgctgggcatcttcctgctgatcggcgccgtcgcctcgctctacctgaggaaataccggcaggccagcgcgcggcaggccgaactggccgccatcgtggaaagctcgcacgacgccatcatcggctgcacgcccgacggcaccgtcagcagctggaacgccggcgccgaaaaaatgttcctctacccggccgcggaaacgctttcccgcaaattgaccgagctgatcgtgccgcccgagatcgaaccgctgctgcgggaactgcgccaggatggcgtgcagaacagcttcaacagctcgctccacacccgcgaaggcctgctgctggacgtcgccatcaccatgtcgccgatccaaagccgcgacaaccggctaagcggcttcgcgctgaccatccgcgacatcaccgaccagaaagccactgaaaagcgcatccgcgagttgaacgcctcgctggagcaacaggtggaggcgcgcaccgcgcaaatccgcatttactcggcgctgcagaacgccatcctggccaatgccggctacgccatcatcgccaccgatctctccggcatgatcacgctgttcaatccagcggcggaacgcatgttgggataccgcgccgacgagatgataggccggcagccgctgacgcggctgcaccgccagagcgagctggccgcgcaggcggccagcttgtcgcaggaactgagcgaggacatccaggccggcttcgacgccatcgtcgcccgctcccgccacggcctgagcaatgaaagccagtggacctacgctcgccgcgacggccgcctgttcccggtgcagctgaccgtctcgacgctggaaaacgaggctggcgaggccagcggctatctcggcatcgcggccgacatcaccgagcgcgaacaggaccggcgcgcgctggagtcggcgcgcgaccaactggaaaaagccgccgaggtggccgaactgggcatctggcgttgggagatcaacagcgacaccctggaatggaatgaccggatgttcgagatttacgacatccccaaatccttcagggtgttcggcctgtactacaaccactggcgctcgcgcgtccacccggacgatatcgcgatggccgaacacaagctgcagggcgcgctggaaggcagcgacgtctacaaccccaccttccgcatcgtccgccaggacggcgaaatccgctacctgcaggccgcggcgctgatcgaatacgaagccgacggcaagcccggccgcgtgctgggcatcaaccgcgacatcaccagccagcgggagcaggaggactggctgctggaggccaaggccgccgccgacagcgccaaccgcgccaaatcggaattcctggccaatatgagccatgaaatccgcacgccgatgaacgccattctcggcatgctgcagctgctgcagcagaccgggctggacaaccgccaggcggactacaccgacaaggccgccacggcggcgcgcaccttgctggccatcctcaacgacatcctggacttctcgcgggtcgaggccggcaagctcacgctggaccctcaccccttcagcatcgacaagctgctgcgcgacatcggcgtgatcctgtccgccaatgtcggcgacaaggatgtcgagatcctgttcgacatcgatccggcgctgccggacgaaatcgtcgccgacgccctgcgtctgcaacagatcctgatcaacctgtccggcaacgccatcaagttcaccgagcgcggggaagtggtgctgtcggcccggctgcaacaacaggacgagaaccggctgaccatcgccttcgccatccgcgacaccggcatcgggatttctgccgaacaatgccagcgcatcttcgaaggcttttcgcaagccgaaacctccaccgcccgccgctacggcggctccggcctgggcctggcgatcagccagcgcctggtcagcctgatgggcggccagctgagcgtggcaagcgagcaaggccagggcagcaccttcagcttcaccatcgaatgcgagacggcgcagccccccccgctggctccgcccgccggcatcgtctcgctgcataatctgagctgcctggtgatagaggacaacgacaccgccaggcaaacgcaaagcgccatcctgcgctccttcggctggcaggtggatgtcgccggcagcggcgaggaagcgctggccatggtggccgaagggcgggactacaacatcgtcctgatagactggaagatgcccggcatggatggctgggaaacctgcagccggctgcgcgcgatgcaaagcggccggcacacccctgtcatcatgatggtgaccgcctacggacgcgaactgttcgcccagcggcaacagcgcgatcccgacctgttcgacagcatgctggtgaaaccggtcactgcctcgatgctgttcgacgccgtcgccgacgcccaggccagccatggcgagcccgcgccgacgccgatccgcccggcgaacctagccccccggctgagcgggctgcgcctgctgctggtggaggacaacccgaccaaccagcaggtcgcccgcgaactactgggccacgaaggcgcggaagtggcggtggcagattgcggccaggcggcgctgcaggcagtgcatgacgccgcgccgctatacgatctggtgctgatggacatccagatgccggacatggacggctacaccgtcacccggcgcatacgcgccgaccatcccgccgaccaactgcccatcatcgccatgaccgccaatgtgatgccggccgaccgcgaggccgcgctagaggccggaatgaacgaccacgtcggcaagcccttcgatctggcgcagctggtggaagtgatccagcgccataccggcaggcccgccgcgccgccgccggcccctcccccgcaaccgcggcccgcggacggcaagcaaacgctgaacagccagtccgccatcccgcgcttcggcggcaatctgcagatctaccgccataccctgctcagtttctgcgatgaaatccattcgctgctgcgcgacctggaggatgcccgcgccagccagcgccgggacaaggccgtccaggccttgcacaccctgaagggcctggccgccaccgtcggcgccgaagaattggcggcgctggccgcggcggaggaaaaaaccatgcgcgccccggaacagcgctggcccgacaatccggagccgctgcgccaggccgcgcagcgggcggaagccgccgcccaggaagaggcggaacggcttccccatggcgcggcgcccgccgcgcgggccgatacggacgccgaagacctgcacatcggcctcgccagcctgcggcacatgctcaatacggctaatcttgaagcgatgcatgtcttcgagcagttgcgccagcagcattaccacgccatgccgggcgagttcgaccagctcagcgacgccatcatgaagatgaacttcgctgcggcggcccgcctgtgcgcggacatcctgcaacgagccaaggtggatcagccatgagcgccaatctatccgcagaagccccggccccggcctttcaccgcggccggatactggtcgtggacgatcagcccagcaatatcatggtcgcccaccagatattgcagtccgaacacgaggtattcatggccaccagcggcgaacaagcgctggctttctgccagaatgccccgcccgacctgctgctgctggatgtggaaatgccgggcatgaacggcatggaggtgtgccggcgcctgaaacaggagcccgccacccagggcataccggtcatcttcgtgaccggccatcaaagccaggaacaggaggcggcctgttgggaggccggcgcggtagatttcgtcaccaagccggtgacaccggccaccttgcgcaaccgggtcaacgtccacctcaccttgaaacaccaggccgaccagttgcgcgcgctggccttcaccgacgggctgaccggcatcgccaaccggcgctacttcgacgcgcaattcgacaaggtctggcgtcattgcctgcgccacggctcgtccttggccttgatcatgtccgatgtcgatcatttcaagaaatacaatgatcgctacgggcacacgatgggcgacgaatgcctgcgccagatcgcccgcaccctgcagctgcagctgaaccggccttacgacctggccgcgcgcttcggcggcgaggaattcgtctgcctgatgccggaaaccagcctggccggcgcggtgtcggtggccatcaagatggaggcggcgatccgcgcgctgcagatcgaacacgccgattcgcaaccggaccacaccgtcaccctcagcctgggcgtggccgccatggcgccggatgcggacagcgatggccggcatctgatgaaaatggccgacgaccagctctatctggccaagaataccggccgcggccgcatctgcgccgtctagccgcggcgccgctcaatgcgggggcgggtggcgaatcaccagcaaggaaatgtcgtcgctggccgcgccgccttgcatatgggccgtcaccgcctccagcacgctttctcctatccgcgccggccagcccttgcccgcggccgccaccacgcccggcaggccaaacatctctccggcgccgtttttcgcctcggtgatgccgtcggagctgaccaccagcacttgggaaggccgccattccagcgactgcatcgaatcgtcgaacgcctccgacggcagaatgcctaacgggggatgggaggatttgcagctgcctatcacctgggcctggtcgttgaacagcaacacgcagggcacgcccccgttccagatgttcagccgccgcccttccggttcgatggcgatcagcgccgcggcgacgaaacgcccgcccggcagcaggcggtgcagcttctgattgacccccctggcgatctcggccatgccgcagccggcctgggtcatttcatagaagcaatcgatagccggcagcgcgctgatggccgccgtcaggccatggccggtgcagtcggccaacatgatgtgttcgccgccggatggcggctggcagatgatgatcaggtcgccgttgaagctggcggcagggctcaggtattgccagacatactccggctgggatgtgcgctggccgatcagccgctcgatcagttccagcgccagctgctgctcgacctcgttctcgcggaagtacttttccagccgcaccgcgtcctggttgatctggttctgcatctcggcgatgcgcaggaagacatggatcttggccgacagcaaatcgaagctcaccggcttggccaggtagtcgtcgccgcccgatttcaacccgccgaccacgctttccagttcgttcaggctggtcaggaaaatgatgggcacccagtgttcgccgaacatccgccgcagctcggccgtcgcctgcaggccgtccatttcgggcatgatgacatccatcaggatcaggtccggcagatgatcccgacaataggccaccgcctccaggccattcttggccgacacgcaccgatatcccagttccatgatgaactgttcgatgaaataccggttggtggcgctatcctctaccagcaagatggtcgtcgacgacatcgctccctctagccttgtccgctgccggtcggcatgacatcgcgtcccggctgcacgccggaccgcctcctgtcgatagcatagcccactatccgcccgcactgcggcacatctatcgcaccagtcccgcaggccatgccgcggcgcaaccaaaatgcaaacatccccgccggcggcatcgcgcgcggcggggatgggcgtgctcagacaatcgtccgcttactgctgcgccggggtgttctcggcgaagtattcatggttgtcggcattgtccaaggcctgggccgggttgctcttggccaggctcttggcgccggcctggccatagacatggtcctgggtgcccgccaccacggtgaagtgcgacaactcatgcaccagggtgccgcccttggagtcggtgcccttggtcggcgcggtccagaaagcgccgcacagatagacggtgtacggctgccccggatagacgtaggcataagtgccgccgtcggtgcagctgcaatccagcttgatcggcttgctgtccagcgcatccttgatgttgacgtaatgcgacttggcggtggtccagttggcctggctgtacttgccgaaccaagtggtgaagcgcggcgtgccggacggcgtgccggccaggtaggccgccgtttcgctggccatggcgctggcggccagcacgccgtcgcgcgattgcgactgctggctgaccgagcaattgccggcgtagctgacgccgctgaccgcgctgcggctgagcacctgccactcctgcttggccgccttggacttggtcagcaaggggctgacgctgccggcgctgtaggcgcccaccacattggaggaaatggcctcgtcggcctgcggcgcggccgcctgcttggcattgacgccggccggcaggctgcggttgagcaccttgttgctgctgctttcaaaacggacgctcagctggcccggcttggacaggtcgtaatactcggacaccctcaccttggcgttcagcgtggcgccgggcgccagcgccacggtgtcgcgcagcgacggcaccacgcgcttgtagcgcgggcccaggtactcggccggcttgccgttcacattcaccgccagaaactgctcctgcagttccttgccgggcacgaaccagcggtacacgtgcaaggtctccttgccggtattgcggtaagtcaaagcgacgtcaacgtcctgacccgcgctgaccaccggctgccccaggctgacctgcaggtcgccggcgtgagcggcggaagccgccaacagcaaagccgcggccacggctggcaatctcttgtccattgttttccccttattggatgggtattttctaaatcacggaaagttataaagcacgcattcatcatgcgcagataattaattgcatgaacaagtcatgatcgcaatcaataaaattaccgacgttgcaatatttccacatgtcataaaaatggcgccatttcgccgccaacatcgccgggctatagtggggtaaaatttaaggtttcctgcgccgggtgagaccgatcccggcgcgctgtcgcaaccctcgactgtttttcgacggactatgaatcaagcatctgaaaaagccctggtagtgctctccggcggccaggactccaccacctgcctgtactgggcgctgcggcgcttcggcgacggcaatgtagaagcggtgaccttcgactacggccagcgccaccgcgtggaattggccgccgcgaagaaaatcgccgccctcgccggcgtgcgccagaccgtgctgccgatcgataccttcgccgccatcggcggcaatgcgcttaccgacgacggcatcgcgccggaaaccggcgcgcgcgacgacgacgcgctgcccaataccttcgtgccgggccgcaatctggtatttctcaccttcgccgccgccttcggctatacccgcggcgcccgccatctggtgaccggcgtggcccagaccgactactccggctacccggactgccgcgaaaacaccctgaaagcgctggaagtggcgctgcgcctcggcatggacagccgggtcgagctgcacacgccgttgatgtacctgtccaaggccgaaaccgtgacgctggcgcaacaggtgggggccatggaagccctggcctggagccatacctgttacaacggcgaggtgccgccctgcggccgctgcgcctcctgcgaactgcgcgccaaaggcttcgccgaggccggcgtggccgacccgctggtatcccgctgccaggccgaagcgcaaggaaactgacatgcacgcctgttacatgatggccggcgccggcttcgaagctgcgcggcagctgcatgccgcccccggccgcgaagcgcgcccgcacggccacagcttccgtctcggcgtccgcgccgaagcccaatacaccgatcagacgacgctgcaagccgcggttgaagccgcggcggcggcgctcgactatgccgacttgaacaccgcgctggccgcctgcgacgatctggcgctagcccgccacctggccgacgccctgccccatccggcggccatccggctgcaaagcgcgccggaccgcggcgtgatgctggacggcgtccaagcgctggtctggctgaatacttcgttcgaggccgcccaccatctgccgcacgtgccgcccggccacaaatgcggccgcctgcacggccacggcttcggcgtgcgcatcgtcgccgacgccgcgcgctgcagccaggacgacttggcgcgcgcctgggagccgctgcgcggccgcctcaaccaccgctacctgaacgatatcgccggcctcgacaatcccaccagcgaagtgctggcgcaatggctgcaccagcaattgcgggacgcgctgcccggcctcgcctgggtggaagtgcgggagacccacagcgccggcagccagttcgacggcaagcgcttccgcatctggaaggaacagcgcttcgaaagcgcgatgccgttcgacgccgccggcaattacaccggccacagctacctggtgcgcctgatgctgtccggcggcatcgaccgcaccatgggctggctgctggacttcggcgacgtcaaggaccgcttcaagccgatctaccgccagctggaccacaatccgctggacaagctggccgggctgcgcagccgggacaacgccgcggtggcggaatgggtccacgcccagctgtcgccgctggtgccggagctggctcgcgtcgacctgatggaaaacgaaaacgccggcgtctcgctgcatttccatcaggatatgcgctggccgctgctgtaagccattcacatcgggaaccgcagtgactacctataccgtcaaggaaattttctacacgctgcaaggcgagggccgccaggcaggccgcgccgcggtgttctgccgcttcgccggctgcaatctgtggtcgggccgcgaggaagaccgcgccaaggccgtttgccgattctgcgacaccgacttcgtcggcgccggccctgacggcggcaagttcgacggcgccgaggccctggccaagcgcatcgccgccgaatggccgcaagacgccggcggctcgccctacgtggtgtgcaccggcggcgagccgctgctgcaattggatgcggagttggtcgacgccttgcacaccgaaggcttcgagatcgccgtcgaaaccaacggcaccgtcgccgcgcccgccgggctggactggatctgcgtcagtcccaaggccggttcggagctgaaacagctggcgggcgacgagctgaagctggtctatccgcaagccgcccagatgccggaaagcgtcgcccatctggacttcggcaccttctatctgcagcctatggacggccccgacctggccgccaacacccgcgccgccatcgcctactgcatggcgcatccgcagtggcggctatcggtgcagacccacaaggtggtgaatatccgctgatcgacaacaggccccctccggggcctgtttttttaccgcgccgcgcgcggctcatcaggcctccgcctccccgcccccgccagctcgcatcaagcgcggcccgccgccctatcgggcacaaggtccggccgcggctatgtatcgatcatgaagccgactataacgacagcagcgtccgcaaccgatgccgcgcggcaaattttttccgccgccgcgtaagaaagccggaagcgccccgactcaaccattgtcaggcgatgtttcagagcgacaaggctgtaagcatccgccgcttccggcgaccaatcgccatcacccgaaacgggtgaactacccaggagaaagccatgaaccgcaacaagactctgatcgccaccgccttcggcgccgtcatcgccatgggcgctctcgccagcgcgccggctgccgccgccgacaaggaccagtgcttcggcatcgccaaagccggccagaacgactgcaagaacgccagccacgcctgcgcaggccaggccaagaccgacaacgaccccgccgacttcaagctggtgccggccggcacttgccagcagatgggcggtcaaaccaagccgatgtgattttccagagtggcaaggccattcgctttgagtaccatacgcccacccgatggcagccgcgctgccgggcaatcaaccccaaggagtcagacatgaaacagagcaaagccctcatcgcctccgcgctcggcgccgtcatcgccatgggcgctctcgccagcgcgccggccgccgccgccgacaaggaaaagtgttacggcatcgcccaggccggcaagaatgactgcgcctcggcgaccggcgcccactcctgcgccggccaggccaagatggacaaggacccgggcgactggaaatacgtagccaagggcagctgcgagaaaatgggcggcagcaccaccgtcaagaaataagtcccccgcccaggcccgccgcgcggcgggcctcccctctcaggaaagcatcgatgccccccctgcccaatgtctgcggcataggcctgcgcgccccgcattaccgcgaagcactggaaaccctgccgccccttggctgggtagaggtgcacagcgaaaatttcttcgacggcggcaccccgctcgccatgctgcggcgcgtggccaaaaactggccgctgtccctgcacggcgtaggcctgggcctgggctcctgtccgcgccccgacgccggtcatctggcctcgttgaagcgcttggtggacgagctgtccccggcctccgtttccgaacatctgtctttcaatcattcgccgtcgcgctatgtgaacgatttgctgccggtaccctacacccgggccgccctcgacgccgtcgccggccacgtcatggaaacccaggacgcgctgcgccgccccatcctgctggaaaacctgtccagctacgtcgaatttcccggcaatgaaatgaacgagggcgaattcctggccgagctggtgcgtctcaccggctgcggcatccttctggacgtcaacaacctctacgtcaaccgcatcaatctgggcacagacacccgcgcggtgctgtccgcgctgccggccgaagcgataggcgaaatccatctcgccggctacagcgagcgcgaaggcatgctggtggacacccacagccagccggtgcacgaaggcgtctggcagctgttccgcgaagtgatccgccagatcggcccgcggccgacgctgatagagtgggatctggacataccgccgctggcggtgttgcaggccgaggccgccaaggcccaggcgctgctggaggcccgacatgaactggcatgactggcaaagcgcgctgctggaagccatcgccgatccggcccagcccgcgcctgccgccgaactgggcctgcgcgccgacgggctggcggtctaccgcaacaactaccgtgtcggcctgatcgacacgctggcccacagccacccggtctgccggcaactggtgggcgaggagtttttcaccgccctggcgcgggagtacgtcaagactcacgcctcgcacagcggcaatctgcatctgtacggcgcgtcgttttccgatttcatcgccggcttcgagcactgccgcgagctgccctatctggctgacgtcgcccgcctggaatgggccgcgcaccgcagctattacgccgccgacgccgaggcgctggacagcggcgcgctggcggccttcgcgccggaacaatgggagcagctgattttcacgccgctgcccggcgtggcgctatgcgccgctgacagcccggcgctcagcatctggctcgcccaccgcgacggcggctcgctggaaggcatattgcaacgcccggccgaaaacgcactggtgttccgcctgcgcggcgaagtccaggcgcaagcgctggaccccgcccgctacgccttctacgccgcgctgttcgccggggcggcgttggaacgcgccatccccccggcgctgcagaccgacgaaaacttcgacctgcaagcggccttgttcggcctgttccaacccgccctgctctcgtccatccatctacaaggcgcacccgcatgaataaacttatccaggcgccggtttgcggctaccagctgctgatccgctgcgccaacctgctgcaacccctggtgctgctgctgttgcggctatggatcgccaatgtgttcttcagctccggcctgaccaagatcgccgactgggacgtgacgctggctctgttcagcgacgaataccacgtgccgctgctgccgcccgccgtcgccgcggtgatggccacctgcggcgagctgggcctgtcctcgctgctggcggcgggactgggcggccgcttcgccgccgccggactgttcattctcaacgccgtcgccgtcatcagctaccctgacctgaccgaggccacgcgccagttccactatttctggggcgcgcagatcctggtgctgctggctttcggccccggactgctgtccttggaccggttggtgcaatggcggctgcaaaaacgcggcggcgcagaaggctgacaaaacccgccggccaggcggtaaacggcgcaagacgtggcataataaagccaatccttcccatgccgaccgcaccatgagcgcacagaaaaccctggtagtcctcgccccgcaaccggacccgcaacatctcgccgacatcgcccgcctggccggcggccagcctaccgtcggcgagggagccgcgcgcatccgcgcagtcctgccggaacaccgccggcaagcgatcgaacagtgccggcgccacggctacgacgctgcctacgtcgacagcgacaagcgcttgggcgacttcggcctgctggtgtccgacatggactccacactgatcaacatcgaatgcatcgatgaaatcgccgacatcaagggcctcaaaccgcaagtggcggaaatcaccgagcgggcgatgcgcggcgaactcgacttcggcgccgcgctgaaggaaagggtggcgctgctggcgggcctgccggagtcggcgctggaacaggtataccgcgagcggctgcggctgaatcccggcgccgaggcgctgctggccgcctgccgcggcctggggatcaagaccctgctggtgtcgggcggcttcacctatttcaccgacaggctgaaggccgactacggcctcgactacgcctacgccaaccagctggagatcgtcgacggccgcctgaccggccgcttgaccggcgacatcatcgacgccgccgccaagcagcggctgctgatggcgacccgcgacgcgctgcagctgcgggccgaccaggtgctggcggtcggcgacggcgccaacgacctgcctatgctgcgggaggccggcgtcggcatcgcctatcacgccaaacccatggtcagcgccgaggccgacatcgcgatcgaacgcggcggcctggacgccattctgcagctatttctctgagcgacggacatgcaagacgccaaagcgccggaccttccgcaactggacaccgtcagtttcgacgccgacctgccgtttcaagtccaggagcgcgaaggcgactattcgccgcgactgcaaagagaaacccggctggcgctgcgcgtgctggccgcgccgggagaaacgcccgatgacagcaaccccgtgctgctgcggctggaggccaagctggacctggcgctggaagtctccctgctggagcgccaccccgaccgccccgcctgcacgccctgccgcctgggcctgagcgcggtggcctggtgcgacagccgggcctgggcgccgggccaagcgctgctgatctcgctctaccccaacccggactcggcgctcagcctatgcctgaacggccgcgtgatccagtgcgatagccaatcgccgcagcgccatctgctggtggccgacatcagcggatcgttcgacctggacacccacctgatgtgggaaaagtgggtgttccgccgccaccgccgcgccatactggagcgctgagacggcagcccctcagccgccggtcatcgacatgaagcgcaccagcttctgtggctgctcgcgaaactcatggcgctccggcttcagctctatcgcctgccgaatcgccgcctccaggccggcatcgtctatgccggcgcgcaacagtggccgcagctccattttttcctcctgccccaaacacatgtacaacgtgccgtccaccgacaggcgcacgcggttgcaggtggcgcagaagtgttgcgagatcggggtgatcacgcccagcgagaaagcgccgtcggcgctgctccagtagcgggccggaccgccgcccaaggagacggcctgcgccgataagccaaactgccggctcagccgttgcagcaccggctgcagatccagatattgcgcggcgcggccggtatcgcccatcggcatcgcctcgatcagccgcaataccaggccatgctcgatgcagaaggccaccatagactcgatgtcctgctcgttgaccccgcgcatcgccaccatattgatcttgatcggcgcgaaaccggcctccttggccgccatcaggccatccagcacgcgcggcaggctgtcgctgccggtaatccgttcgacgcagtcgcggcgcagggaatccaggctgaggttcagccggcgcacgccggcctgcttcaactccagagcgtggcgccgcagctgggtgccattggtggtcagcgacaaatcctccagcccgggcagggcagacagcctggccgccagttgcggcagattgcgtctgagcagcggttcgccgccggtcaggcgcacgcggcgggtgcccagccgggcgaatacggcgaccactcgctcgatctcgtcgaaagtcagccagttggccggctcctcgaaacccttgaaacccttgggcagacaatagttgcagcgcaagtcgcagcggtcggtcaccgacagccgcaggtactcgatggctcgaccaaaacggtcaatcagcatgcctcctccaaccccttcttccacttgattccttcttagtcgccatttcagacgcgatctgtcgcgattccggttcttatacgccgccggacatcgcaacagctaacaagctctatctgaattgtactgcagtcgccatgacttcaccgtccaacatcatcggtagccaacaaaacccaatcgcataaaacgccagcaaggctggaccagccttgcaagccctttcatcaggcaaaatgcatcaaaccaaccgcaaaatagaatgaaagcacaatcaatttaatattgagatcaacaacttagcaataatttactgacaaatttgtcacacagaatgttacaaaaacactcaacttgtcacaattcgccgttcttatactggtcccgccagtttattcaaactggatatccggcactcatcaaaacaagccgcgcaaacggcgaaagccgccggatagggccgccatccgccgcgccggcggcaagcggtccggaccctcaaaggagaactagaaacatggcaaatgccttcaaaataaaaatggtggtcgccgccctggcggcagcggtttcttccagcgcgatggccgccgccgccctcgatctgggcaaggtggagcaagccgcgccatccaaaaccttgaccgtgaccgtagcgctcaacctgcgcgaccgtgatgccgccacccgttatctgcaggccgttcacagcccggcggacgccaactaccacaaattcctgaccccggccgaatttcgctcccgcttcgcgcccaacgacgccaccgtcaaccgcgtcagcgcccgcctgcaagccgccggcctgaccgtgaagcgcataggcagcaccctgctgcaagtcagcggcccggccgccaccgtgcagcaagccttcggcgcagaagtccacgtattccagaacaagaccgccgtgcagggcaccgcccgctacatcgccccggtgcgcgccggcacgcccaaggtcgacctgagcgacgtgcaggccgtcatcggcctggacagccgcccgcacttccgcccgcacctgcgccaggttcccaaccacctgcaaccgtcgctgagcaagggcgccagcgccgtcaccagcggcaacgcccccggccagtggaccgtgaccgacctggcgcgccactacgacatcaccccgctctacaacaagggcatccatggcaagggcagcaccatcggcatcgtcaccctggccagcttcaccccatccgacgccttccagtactggagcgcagtcggcctcagcaccgaccccaaccgcctgagcgtagtcaacatcgacggcggcccgggcgcgcccagcgatgccggcggctccgacgagaccacgctggacgtcgaacaatccggcggcatcgcgccggacgccaagatcatcgtctaccaggcgcccaacaccacccaaggcttcgtcgacgctttcgcgcaggcgattgaaagcaacgccgccgacaccgtatcggtaagctggggcgaatgggaatggttcgaccagcaaagccaagcggtggacccggtgaacggcaagaccaccaatgtgctgcaggcctaccacgacctgttcctgcaggccgcgctgcaaggccaaaccctgttcgcggcgtccggcgactccggcgcctacgatgtcaaccgcgccgcgccgctgccgcaatacaacaaggtattgtcggtggacagcccggccaaccagcaattcatcaccgccgccggcgccaccaccgtgcccaccaccctcaccttccaccccaacggcaaggaaatgaaggtgaagatctccagcgagcgcgcctggggatgggactacctgagcggcctgtgcaaggcgctgggcaaagaccaagtagcgtgcggcatcttcccggtgggcgatggcggcggcgtcagcggcttcatcagccgcccgttctaccagaactggattcctggcatgcagaacaccccggccggccagcaactggtggataccagccagaccccgccgcaggtgataggcagcatcccggccaacttcaagggccgcaacctgcctgacatctcgatgaacggcgacccggagaccggctacgtggtgtactacacctccgacaagaccggcttctccatccagagcaacagcggcggcaccagcttcgtcgcgccgcagctggccggcatcaccgcgctgctcaaccagtcgatgggcggccgcctgggcctgctcaacttctcgctgtacagcctgctggcgactggccacgcctaccatggctccggccaccacggcgcgccgctgcgcgacatcaccgccggcggcaactggggctacaacgcgcatcgcggctacgatcaggccaccggcgtcggcgcgcccgacgtcgccaacctcgatgcggcgctgcatcgctacttctggttctgatccggccctcgtgtcggcaatgcaaacggccttcgctcgcgaaggccgtttttccattgggcgcgaagcgcatctgccgccgcaggatctctgaccgcttctttgctgccatgccggcgatcaggcggcaaatcggcgggacgggataagcgttgcccccacggcaacatgcgcggatgcgcatgattgcacccctgccgccgcgcgccgcggctgtaacaggccgcagtggtttaagcggcagcgcgccgctttgcgcccataaaaaaagcgcccgcgcagcggacgctttctgccggataaggacttagcggcaacgatgatggcgatgcttgtgccggcagcgatagcggccgtcgccgcgcgcttcgcggctgcccgacttgccataaccgttgccgatggccgctccggcgccgccgcctatcgccccgccaatgatggcgccgtcgcgcccacccaccgaatggccgattgcagcgccagccgcgccgcccagggcgccgccgacgatggtattggtcgcggtgtcggcaaacgccgcggaggcggacaaggccagaccggcggccagtatcagaatgcttggcttcatttcatacacccgcttgaaaattgaagcccgagcataaggcttgcgccggcagtcgtctgtatctaaatgttagcgattgttcgcattttgtttagcagcccgctccttcactgctgcaaatagtcatacaccaccgatcccaggtccagcgtcagatcgcagatgaaatgccgcgccgacagcacctccaataccggcaagtccgccaccggcgccagcgcgtggggatgcagctccagggaagccggcgcgctccaagcgccttttatcaccacattgctggtatggtagcgcaccaattcgcagatccgcggcgtgccgtcgacatgcggaatgatcttcaacaggaaattgggttcagccaggctggcctccagcgccacctggtcgagctgctggtatttgtagcccatggtgccggtggcgatgcgcagggggccgaaatccaggctgccgatcagggtgtcgccgcaaacctccagcttcggccggcccgctttcttgggaaacccccataactcgcgtcctccagccagcggcggctgatcatcaagaaacatcgcatgggaataactgccgcgcacgccgcggaacgtgaccggaatcacctgtccgctttccgaataatcgccgaagccggtggagtccggcatccggatgaactcatatttgacgatatcgccatccgcctgcaacggctccggcaataccgcctggatcgcatcgggatcggtgcggtaagtgatgaccatatactcgcggttgtaaaaccggtacggtcccggcgggtaggccgggctggtaaggggcatggcgaaggcacggctacgcacttcatgcggcttcatagagaggactccttggaaaacacacagaatggcaaaatatgccgaacgggtgattcaagctggatgattcaacatattccgcggctgactccatctcaatacgcaaaactgctaggcttccccccgccaacgcgcccgcatagcttgccgtgttgactccggccctcgccccgcctcatcatggccatggcgcgaacatccacgccacatcaaccacaggacaaaacatgaacgccgccaagaaaatccgccgcttcctggaggaagggcacgatcctcagcaaatgcaggtgctcaaggaattggcggccgccctggaaatgggccgctccttcgatttgagccagctgtacgatatcgatatgcgctacttcgaagtcgctatcgacctgttgaaagactggcgtttcgatcatcacatcagcgcgcgcagcaagttgctggagcaactgctgaccgaaatcgccccctcgcaacaagccgcacccgcaacggaagagcgcggcagggaaaaacgcaaaggctaagccagggaaggcgcgacggccttccagcactgttgggcagcgctgtcgcagccaagttccagcaacaccatcacccgccatgcctcccaagcgtcaaccggattggcagccccaagcagaatggcgtcgcgcaccccggcgtaataccgcatgtagtcgccggcgccagccggcctttcgacagcctcgctccccgcgagcagcaagcgccccggccgcgggtcccctccccatcccgcctgtccaggccgatcgccggccttcaacgcatcctcctgcgtatccaaaccatatttggcatagctgcccgcggtgccgtggatgatgaaacgcggcccggcatccgccgccaaggcgctggcatgcaaaatcacccgcttgtcggcataacgcaactgggcatggaaccagtcatccgcctgggccccatcgcgcaaagcggccagctccagagaaatcgcctctggcaagccccacagctgcaccgcctggtccagcaagtgcggccccaggtcataccacaagcccgcgcccgcctgcgccgactctcgccagcgttgccgcacatgcggccgataacggtcaaaatgggactcaaaatgcgttaccctccccagcaccccatcagccaacagctgccgcaccgcgagaaaatccgcgtcccaacgccgattgtggaataccgacaataacaacccggcctgctcggcctggagcgccaacccgcgagcctccaccgccctcaccgtaaacggtttgtccaccacgacatgctttcccgccgccagcgcggcgctggccagggcgaaatgactatcgttcggggtggcgatcaccaccagatccacctcgctccctgtcaacaacgcctcaggagatggaaaaacctgcgcggccggcaatgcgctgcgaaccagctcggccctgctggatgccaccgcggccagcttgatgccaggcgtcgccgacaggagcggcgcatgaaacgtcgcacccgcatagccaaaacccatcagacccactctcaattgatcaggcatatttttctccggcaatgaacgcatgatacggctagctggcaatgtaaaaaaccccagccgaacggatggggttgagaacaaagtgagacatgcataggcactgacagggccattccatcgaaccaggctctctccccctcgtcccgccaaagcggtgaggcacatgaccgggccggaaacggcaaagccccgcgtggcggggcagaaacgcagaaaccccagctcatcgagctggggttctgtatggggcgtctggcggtgtcctactttcacatggcgaatgccacactatcatcggcgctaaggcgtttcacggtcctgttcgggatgggaaggcgtgggaccacctcgctatggccaccagacataaactgtacaaacttaaagaagcccgaacccgtctctcagacagattcgcatatattcggtatttgacgtacgtcgcacatccactctcttgtgtctcagtttcccaagccactcaaatgataggatcaagcctcacgagcaattagtatcggttagcttcacgcctcacagcgcttccacacccgacctatcaacgtcctggtctcgaacgactcttcagggaggtcaagcctccagggaagtctcatcttcaggcaagtttcccgcttagatgcgggaaacttgcctgaagatgagacttccctggaggcttgacctccctgaagagtcgttcgagaccaggacgttgataggtcgggtgtggaagcgctgtgaggcgtgaagctaaccgatactaattgctcgtgaggcttgatcctatcatttgagtggcttgggaaactgagacacaagagagtggatgtgcgacgtacatcaaacactctcttgtgtctcagtttcccaagccactcaaatgataggatcaagcctcacgagcaattagtatcggttagcttcangagcagcaggcttcgcttgagcagcaggcttcgcttgagcagcaggcttcgcttgagcagcaggcttcgcttgagcagcaggcttcgcttgagcagcaggcttcgcttgagcagcaggcttcgcttgagcagcaggcttcgcttgagcagcaggcttcgcttgagcagcaggcttcgcttgagcagcaggcttcgcttgagcagcaggcttcgcttgagcagcaggcttcgcttgagcaacaggcttcgcttgagcaacaggcttcgcttgagcagcaggcttaccctgctcgacggcctgagcggctggcgcagcgacagcttcagccgcacggttccgccccgcagtttggcggctacgtccctttggcgccgccggcaagcctgccggcttgctttcccgcgcctccggcgcttccgccgcgggcgctgctcggtttccgcgactgcgccgcgacgacctgggcgcatcgccttcggtcttgccagaggcagccgacgtctctgaaacgactggcgtttcgcgcaccagcgcgaaatccacctgggcgctttccagattggcgcccatcactttaacggtcaacgcgtcgcccagccggtactgcatgccgctcttctcgccgactatcgcctggatgtccttcttgaagtggaagtagtccttgcccaactcggagatatgcaccaaaccttcgacatacacgtcgtccagcaacacaaatacgccgaagcttgtgaccgcgctgatcttgccctggaaaacctcgcccaccttgtcgcgcatatagtaggttttcagccaagactcgacgtcgcggctggcatcgtcggcgcggcgctcggtcatcgaacaatgcacgcccaaggcagcccacttgcccggcttgtacttttcgttcttcagcaccgccttgatcgcgcggtgcaccagcaagtcggggtaacggcggataggcgaggtgaaatgggtatatgcctcgtacgccaagccgaagtggccgttgttctcctgggtgtacaccgcctgctgcatcgagcgcagcagcatggtctgcagcaccggcgcgtcggggcggccgtggatttgctccgccaaaacggcgtaatccttggcgctgggcttgtccgcgccgcccagcgtcaggccgaccaggcgcagataggcgcgcaggttttccagtttttccggcgtcggcccctcgtgcacccggtacagcgccttgtggccgctcttcagcaggaaatccgccgagcaaacgttggccgccagcatgcactcttcgatcaggcgatgcgcgtcgttgcgcaccaccggcacgatgcggtcaatcttgccgctatcgttgaagatcatctgggtttcgaccgaatcgaactcgatggcgccgcgcttggcgcgcgccgccagcagaatcttgaacagcgcgtacaaatctttcacgtgcggcagcatcggatgatcgctgccgttctgcagccaatcccacacctggttgtaggtcaaccgggccttggagcgcatcaccgccggatagaactggtacttcttcacttcgcccttggcgttgatctgcatgtcgcagaccatgcacatgcgctccacatccggattgagcgagcagatgccattggacaacgcctccggcagcatcgggatcacccggcgcgggaagtaaaccgaggtgccgcgattgagcgcctccttatccaatgcgtctgccggctgcacatagaagctgacgtcggcgatggccaccaccaggcggaagcccttgcctttcttttccgcgtacaccgcgtcgtcgaaatcgcgcgcggtttcgccatcgatggtgaccagcggcagctcgcgcaaatcgacgcgatccttgctccaatccttcttgcgcactttcttcggcgtttccttcgcctgcagcagcgcgtcgtcggggaagcggtgcggaagatcgtgcttgcgcagcgcgatctcgatctccatgcccggatcggcgtaattgcccagcacctccgtcacctggccgaccggctggtggtgggcatccggctgctgcaggatctccaccatcaccacctggccctccttggcgccggcctcgccgcccggttcgatcagaatactatggttgatgcgcttgtcttccggcagcaccacccacacgccgcgctcgcgctggatgcggccgaccaggcgggtgaccgcgtgctccagcacctccacgatgcggccctcctgccggccgcgcctgtccacgcccgacggccgcaccatcacgcgatcgccgtgcatcacttttttcatttcgcgttcaggcaggaagatatccgcgccggaaccttcgccctcatccggcatcgcgaagccgaagccatcgcggtggccggacaccttgcagcggaccagatccagtttctgggcgacgcagaccgcgcccttgcgattgatgatgacctcgccgtcacgctccatcgcgcgcaggcggcgttcaaagtagagaatctcggccggagcgatcgacagcatctgcgccaattcgtccggaaacagcggcaccccctgctcggcgagaatctgcatcaagaactcgcggctgggcaagggattggaatatttgagtttttcccgctccaggaaaggatcctggtcacgcagggaaagctttttttgttttttttgcgattcagccattgacaccctcaatattatgtctataattcgcatctcgttgcagctatgcaacagatgatacagcaaagcgatgcccaggtggcggaattggtagacgcactaggttcaggtcctagcgcccgcaagggtgtggaagttcgagtcttctcttgggcaccaacatgatttatagtatgtaaggccttacagccagcagtattttgttgcccaggtggcggaattggtagacgcactaggttcaggtcctagcgcccgcaagggtgtggaagttcgagtcttctcttgggcaccatcttactattgtaagcttgttgttttgctggcatcataaaatctggttggcccaggtggcggaattggtagacgcactaggttcaggtcctagcgcccgcaagggtgtggaagttcgagtcttctcttgggcaccaacaaaattcagtaaggtcagcgcttagtcgctggctggaagtagacaatttgctttgcccaggtggcggaattggtagacgcactaggttcaggtcctagcgcccgcaagggtgtggaagttcgagtcttctcttgggcaccaaatgaaaaaagccgcagatctctgatctgcggcttttttgcgtttgtcgtccccgcgagggaagccggcgtcgccggccccctgcttctgtttacttttcctctccgccctcatggcccgccgatacctgctggccggcgtcccgctccaggctgaggaacagcaggctggacaaggcggtcaggctgcccatgaacaggaaggcgtggccgaaatcgccggccgtcagctgctgatggccctgcagccaggacgcggcctgcaaggcaaacgcccccaccgtcacgccaaagcccgccgccagctgttgcgcgacgctggacaggctggtggcttggctcagtctatccttgtccacatcggcgaatgtgatggcgttgaggctggtgaactgcagcgagcgcagacaaccgcccagcacgaacaccatcagcaacacccaatgcggcgtgtccgcctggaacagcgcgtacaccgccaccgagcaaccagccagaatgctgttcaacaccagcacccggcggaaaccgaagcgctgcagcaccttggccactatcgttttcattcctatcgcgcccatcgcggtggagcaagtgagcaggccggattcaaacggcgaaaaaccgaagcccaactgcaacatcagcggcaacaggaagggaatggtgccgatcccgacgcggaacatgaagcccccgaccaccccggcattgaaagtgggcagcctcagcagcgacaagtccagcagcggatgctgctggcggcggtaatgccacaggtagatcagcagcagcgcgccccccagcaggctgagccagatcgacgccgtcaccgacaacatgtgcttgccctcggtggccagccccaacatcagcatcgacaggccggcgccggtcagcaggaagccccaccaatccagccgcggcacctcgtcctctttcagattggcgatgaaacggccggccagagccagccccagcagaccaatggggatgttgatcagaaaaatccagcgccaatggaaataggtgctgatgaagccgcccagcggcggcccaatcaccggccccagcagcgccggcaccgtcagatagctgagcgcccgcactaggtccgccttgtctatggtgcgcagaatcaccagccgtccgaccggcaccatcatcgcgccgcctatgccttgcagaaagcgcgccatcacgaagccgtgcaggctgctggtgacggcgcacagcagcgatcccagcatgaacaccagaatggcggaacggaaaatgcggcgcgcgccgaagcggtcggccatccagccgctgatcgggatgaacaccgccaggctgaccagataagacgtcagcgccagtttcagcgagatcggatcgacgccgagctccagcgcgatgacgggcaaagaagtggagatcacggtggcgtccatgttttccatgaacagggccgtggcgacaatcaacggcgtcagcatgccgggggcgattttcaactgcatgacgaagggatgagggtgactagtcatccagtttaccatctggaaccgcgcaaagccgtacggacaaaaacaaaagccacccggacaccgggtggctgatctcggtctatgcgccttatttgcggtcgaaagccaacgcgctggtgaagtcgcccatcggacggccgccgttgcgcaccagggcggcatcgcgccccgccacgcccggcaacgccttcagcccgaaacgtcgggtcaggaagcgcaggatggagccggtatcgtactgggtatggtcgacatagcctttcttggcgaaaggcgaaatcaggatggccggaatgcgggtgcccggcccccagcggtcgcccttcggcacttgcgcgtgatcgtagaaaccgccgttttcgtcataggtcaccaccaccagcatattgctccactgcgggctttgctgcagcttggcgatcaccgaagcgatatgggcgtcgccgtcggccacgctggcatagccggaatgctggttcaagttgccctgcggcttgtagaaggccacttgcggcaacttgccggccgcggcgtccgccaggaagctctggtcgaaatcctttagatgcgcattgcggtaatccgcctgcgcggcgggatcgaaagcggcgaaatagttgaatggctggtggtgcggctggaagttgggttggctgccgttatagatattgccgcgatcggccagcgaagccgcccagccgcccgaataccaggcccagctgattttcttggcgtccagacgatcggcgatcgtcgcctggctttgcgccggcaacgtggtcgacttgcttggatcggcatactgggccttgtccgccggcgcattgccgctgggctggaacggcggctgcatggtgttcaccgcatagtatttgccggcgctgtccttcggcgtcaggttgccgtcattcaggtatttggcagtgccggacaacaccgaagccggcgcattggcggccggcgtcagacgcaggaaattgcctttcgcatcggtgtctatcgccgagatgctgcccttggccggcgaagtatccgcattcggatattccggcgcacaggcgcaaaccagatattggtgattgaggaaggagccgccgaaagcgcccatgaagaaattgtcggccagcgtgtactgctgcgccagcttccacatcgccatctggctgccgtcgtaatagcccatagacaagccgccggcgtcggaataggcggcgaatttgtcattggcgccgccattgatctgcatctggttgttatagaagcggtgcaccaagtcgcgcgtcaccaccgattgcggcaccaccacgccggtgccgttcaggcccttggggtcgtcgatctggaacggcttgttggcgaaattcatggtctgcgcctgggtcagcgtcaccgtctggccggcggcggtcaggcctccccaggtgggcggcaataccggcagcgcggaattgtcgaaatccttctgcggcgagtactggcccctggatgccggattcacgcccggaatgccgtcggcgccggggaacaggccgtacagattgtcgaagccgcggttttcggcgtagatcaccaccacgttcttgatgtcgctcagcgccatgcgcttgtgcaggctggccttgatgtcgccgccgttgcccgcctccttcaccgcgtccgcgatcgcgtcgatgttctggttgatggccgccttcagcgtcgccttgatgtcgggatcgctttccttgttatggtctgccatcaccttgtccgcaggcacgcccaggcggtcggccaccgcattgcgcgccgcgttcagatcgccgccgttgctgtccatcagatccgccacttccgtcgtcagcgaactgaccacaccgccgctgttcgccggcgcgcggaataccagcggctgggtcaccgccgccgctgtgccggtatcgggatcgtagcgggtggcgtcggtgcccacctccaccaccagcgcgccgccgccgttcaagctgaacgcgccgttgtcgtcggtataggcgctgggctctcccgcgtcgcaacggccgttgccattgctatcgagacacactttggcatggcggaaatagctgccggtgaccacgccgctggtggcgttggcggaagggctggaagagctgccgcaggcgctcagcacggcggcgctgatcagggtcagcgccagtccacaggtcaggcgattcatcgcgcatttcctaaatttaagaagggaagcgcggattatcaccatggaatgttacactccatttacattctgttaattttcttcgtagtggaacaatcgccgcagccatcgcgcgatttcatatttttgtcatttttttgccttacagtcgccgccaactcatcctccgcccatgccatgcacgcttccaccccctggttattgaccctcagcttgattgtcggcggcgccctggccgtctccgcggcagcctcgcacgccaccccggccgccaaaccggcatacgccgacgccagctacacgcccggcgcccatccgccatccgccaaacaactggaagcactgggcaagcaattgttcttcgatcgcggcctgtcggcatcgggccggatgtcctgcgccagctgccacagccccgaccacgcctacggcccgcccaacggcctcgccgcgcagcttggcggcctggatggcaagcagccgggcacccgcgccgtgccgtccttgcgttatctgcagaacgtgccagccttcagcgaacactttcacgacaacgacggcaacgacagcgaagacgccggccccaccggcggcttcacctgggacggccgcgcagattccacccatagccaagccgcgctgcctctgctggccgccaacgaaatggccaacggtacggcggaaaacgtcgccaggaaactgcaggcatcgcccgtggccgccactttccgccaactattcggcaaggatgtcttccagcgcccgaagcaagccttcgacaaggccgtgctggcgctggaagtattccagcagaatcccgccgagttttatccctatagcagcaagtacgatgcctatttgcgcggccaggcccagctctccgccgcggaaatgcgcggcctgagggttttcaatgacccggccaagggcaattgcgcgtcctgccacctgagccagcgcagcgagagcggcgccttcccctccttcagcgacttcggccacatcgcggtcggcgcgccgcgcaatccggacatcgccgccaaccgcgacggccactattacgacctggggctgtgcggcccggcccgcaccgacttccgcaaccgcgccgactactgcggcctgttccgcacgccgggcctgcgcaacgtcgccacccgcaaagtgtttttccacaacggcgtcttccacgacttgcgccaggtgctgcgcttctacgccgaacgcgacgtgaagccggaaaaatggtacccggccggccagaatggcaaactggccaagttcgacgacctgccggcgcgctaccagggcaacgtcaatatggaagcgccgttcggcggcaagaaaggcggcaagccggcctatggcgaacgcgacatcgacgacatgctggctttcctgaaaacgctgaacgacggctatcagccgggcaagcgcggctgagcgcggaggcagccccgcactgcccatctccacctatgatgaacagatacacaggcgccataggagaatcgccatgactgtgcagcgcatcgtcgccaacctcgccgccgccgaccccgcccgcgccgacgcgttctaccgcggcctgctgggcctggacctcatcatggaccacggctggatccgcacctatggagccgacagccgaatgcaaacccagctcagcttcgccagcgaaggcggctccggcgcgccgctgcctgcgctgtcgatcgaagtcgacaacctggaccaggttctagcgcgcgcgcgtgaagccggtgtcgccatcgaatacggcccggccagcgagccgtggggcgtgcggcgcttcttcgtccgcgatccgttcggcaccctcgtcaacatcctgcagcacgaatagcgcgccgccggccgcgccgggcaaacaaaaagcccaccgcgtcgcggtgggcttattcatgcggcaaccgtagggcttacaggccgtaggggtgatccagcacgatggtctcttcgcggtccggaccggtggagacgatggcaaccggcgcgccgcatacttcggcgatgcgggtcaggtaggcctgggcgttgaccggcaggtcttcccagcgcttggcgccgaaagtggattcggtccagcccggcatgctctcgtagatcggttcgcacttggtcaccgcgtcggagccgaacggcaggatgtccacgcgctggccgtccagcatgtagccgacgcacagcttgatctcttccaggccatccatcacgtccagcttggtcacgcacaggccggtcacgccgttgatctggatggagcgcttcagcgcggcggcatcgaaccagccgcagcggcgcgggcggccggtgaccgagccgaactcgttgccgcgcttggccaggaacatgccgatctcgttgtcctgctcagtcgggaacgggccggagccgacgcgggtggtgtagcccttgacgatgcccagcacgtagttgagcatctgcggcgccacgccggcgcccggcgcggccgcgccggccacgcagttggacgaggtgacgaaggggtaggtgccgtggtcgatgtccagcagcgtgccttgcgcgccttcgaacaacagcggcacgccggcctggttcatgtcgtacagcgtgcgcgacacatccgccaccatcggcttgatgcgctcggccagcagcatggtctgcgccaggatgtcgtcgaagcttaccggctcggcctggaacagctgggtcagcaggaagttgtagtaatcgacgttttcgcgcagcttgacggcgaagccggccgagtcgaacaggtcgatcaccttcagcgcgcggcgcgccaccttgtcttcgtagcaggggccgataccgcggccggtggtgccgatcttggcttcgcccttggcggcttcgcgcgcctggtccagcgctacgtgatacggcaggatcagcgggcagccttcggcgatcttcaggcgggcggtcacgttgacgccggcctcttccagttcgccgatttccttcagcagcgcctcgggcgacagcactacgccattgccgatgtagcattccacgtcgggacgcaggatgccggacgggatcaggcgcagcacggttttcttgccgccgaccaccagggtgtggccagcgttgtggccgccctggaagcgcacgaccgcgcgcgcgtggtcggtcagccagtcaacgatcttgcccttgccttcgtcaccccactgggtgccaatcacgacaacgttcttggacattggaaaaaacctcttcttcagtcagattcaaacaaaaatcagttaaaaggagccagttgccatccatcggcagcaggcaccagctcgcggtcgcaattaagcgccaccgcggactctcccaggtagtcgaccaccaccatttcgccggcggcgcgcaggcgcgccacctcttccgccgcggccggcagatggcgggccgccacccgcacgccgcgggacgagtcccgctccggcaggatgcgcaccagatcgcgcagatccaggctgaagccggtggcgggacgggcgcggccgaaacggcggcccacattgtcgtagcggccgccgcgggcgatggcgtcggaccagcccggcgcataggcggcgaacatcaagccggtatggtagaaatcgccgcgcagctccgccagatcgaagctcagctccacccggccttgcaccgcgcgggcgatggcagccagctgcatcaggcccagctcgacctccggcagcgaaggcaggcgggtgcgcgccttgtccagcacgctggccgggccatacagctccggcagcgcgaggaaggcgctcttgtacggctcggccacgccggccaccagctcggcgatgctcgcgacgtccttgttctgcagcaggctgaacagctcgcgcgtcacccccggcgccaggccggcggcggcggccaggccgcggaagatggcgatatggccgacatccagccttagcttcttcacgccggctttttccagcgtcgacagcatcaggtcgatgatttccaggtcggcctcgatgccggcgtagccatacagctcggcccccacctgcagcggctcgcgcgagctggtcaggccggacggacggctgtgcaccacgctgccggcgtagcacaggcgggtgacgccggtgcggccgcccagcaagtgggcgtcgatgcgcgccacctgcggcgtgatgtcggcgcgcaggccgagctggcgtccggacagctggtcatccagcttgaaggttttcaggtccagcgtgacgtcgccttcgctgaccagggaatcgatgtactcgatcagcggcggcagcaccagctcgtagccggccacgcggaagccttccagcatcgcggccttggccgactcaacctgccgggcggtggccggcaggatgtcggcgatatattcgggtaacagccagttgcgcatttcgtttcaacagaataaaaggcggggtggtcgcccgccttgttatcagcaaactggccaggtcgccccggccagtcttcttaaaaacctcagattgtcagtccgctacttgcctttgctctgccccgcctgcggattcttcaggtacttgaagaagtcgctgctcgggtccagcaccagcacatcgctcttgttcttgaacgattccttgtaggcgtccatgctgcgccagaacgcgtagaactccgggttcttgccgtaagcctcggcgtaaatcgccgccgccttggcgtcgccctgccccttcagcgcctgcgccttgctgtaagcctccgccaggatcacctcgcgctgcttgtcggcttcggcccgcacccgctctgcgtcggcagcgccttcgctgcgcagctggctggccacggtacgacgctcggactgcatgcggtcgtagacggaactgcttattttatccggaaaatcgacgcgttttaagcgcacgtcgagaatttccacacctattttacgcgcatccgcgtccgcgcgcttgcgaaccgtctccatcacctggtcgcgctggccggaaatgacgtcggcaaccgttttctggccgaactcggcgcgcaggccgtcattgatggtttgcttcaggcgcgccaccgcggcggcctcggaaccaacgctcttgtagaactgtgacacatctaccacacgccacttcacgaagctgtccaccagcacgttcttcttctcgcgggtgttgaacagctcgggcgcttcggcgtcgatggtctgcacgcggcgatcgaaataacggacgttctgcagcaacggaatcttgaactggatgcccggctgggagatcaccttcacgacctcgccgaactggaataccagcgcgaactggcgctgatcgacggtaaacagcgacaggctggcgacaaacaacgcgcccacgactgccaccacggcgggaatcattctttccatcatcgctccgctccaaagaaatcgcgaccgcgcgaaatttcgcgcccgttcttagccgccggcggcgtggccgtggcgggagcggaggctgcgggagcctgcggcgcggcgggggatgcgggagccgacatctgcatcagcttgtccagcggcaggtagagcaggttattgccgcccttttgatcgaccagcaccttgctgctgctgttcatgatttgctgcatcatgtccaggtacatgcgctcgcgcatgaccttgggcgccttgttgtattcggacaacacttgtttgaaacgctcggcgtcgccctgggcgcgcgccaccacctgctgctggtagccttcggcttcctgctgcagccgcgccgccatgcccttggccttgggcaccacctcgttggcgtaggccatgccctcgttcagcagcttgtccttgtcctggccggccttcaccgcgtcgtcgaacgccgccagcaccgcttgcggcggctgcacgtcgttgatgttgaccttggcgatgcggatgcccaccgcgtagcggtcgagcacgtcctggatcaccttgcgcgcctcggcggcgatctgggcgcggccctcgttcagcacgaagtccaccttgttgcgtcccaccacctcgcggatcgcggtttccgccgcctgcttgacgatgtccttggcgtcgcgctcgcgcgcggcgttgttgaacaggaaggcgcgcgcgtccttgatgtcgtactgcaccgacagctgcacatcgatgatgttctggtcggcggtcagcatcagcgactcttccggcacgcggttctgcgcgctgccgcgatagccgacttccacgctgcgcagctcggtcaggttgacgatttccaccttttcgaacggatacggcgcatgccattgcagaccgggttcagtcaggcgattgaagctgcccaggcgcagcaccacgccctcttcgcgggcgtccaccacgtaaaagccgctggccagccacaaggctgccagcacgccgaccacagcgagggcgccgcctttgtaggatggcggcgcgccggcgccgcccgggcggccggcggtaggcttcgcccccaataggcgggccagtttctggttcaggttacggaacacttcatcgaggtccggcggcccattctggccgttccggccacggttcgggtcattctgcgacatgctcgtatggttctttatggttatttgcggaaggttgcaccctttcggcaatcgcctcgcgcaagagttccagcccgatgcccttcagcgccgacacccgcaccgcggcgatttcgccgttttcgccgcgttcgatttccggcggcagatccttcaagtcgcacttgttccacacgatcagctgcgggatgccgtcggcgtcgatctcggccagcaccttgttcacctcgtcgatctgcgcgtcgcgcgtctcgttggcgcaatcgaccacgtgcagcagcagatcggcctgcaccgtttcctccagcgtggcgcggaaggccgccaccaaggtgtggggcaggtcgcggatgaagccgacggtgtcggacagcaccaccgagcaatcgtgatggaggaacagcttgcggctggtggtgtccagagtggcgaacagctggtcggcggcgtagatgttggccttggtcagcgcgttgaacagcgtggacttgccggcgttggtgtagccgacgatggacaccgaggcgatgccggcgcgggtgcggctcttgcgctgggtgctgcgctggcgctgcacctgggccagccggtccttcagcgatttcacccggatgccgagcaggcggcggtcggtctccagctgcgtttcgccgggaccgcgcaggccgatgccgcccttttgccgctccaggtgggtccagccgcgcaccaggcgggtggacaggtgcgacagctgcgccagctccacctgcagcttgccttcgtggctgcgcgcgcgctgggcgaagatgtcgagaatcaggctgttgcggtctatcacccggcattgcagcgcgcgctccagattgcgctcctggccgggggacaaggcgtgattgaagatcaccacattggcgccggtggcgcgcaccacggcggcaatctcctccaccttgcccttgccggcgaacaaggcggcatccgggcgctggcgcttgccctccaccttgcccagaatctccacattgctgctgcgcaccagctcggcaaactccgcaacgctttcctggtaatcggcatcaccaaaatccaggctgaccagaacggcctggtcgcctaagtcgggacgatcaaacacggtttgctacaccatattgagtacggcgataaatgacaaaggccgagtgaccgcatcttgcgatgcggccaatcggcccggtctgtgcggcggcgccttaagcgtcctgcgcctgttcctgcttttgcgccggatgttcgtgcgggatgctgaccgggcgggccggcaccacggtggagatggcgtgcttatagaccatctgggtcacagtgttcttcagcagcaccacgtactggtcgaaggattcgacctgaccctgcagcttgatgccgttgaccagatagatggagaccggcacgtgttccttgcgcaggatattcaggaacgggtcttgtaacatttgccctttagagctcattcgtttttctccgaatcgttgattgttgtattgactatgcagcgaacagcggcggcctgcttatttttagcagaaaacattccgccgtactattttttgctgcttttgccgtagcgaacttctttttccctgccccgcatcttggacatcggcttgggcttggcgcgagacttttccttgccttcctcggtgtcgaacgggttttccgacgacttgtactgcaccctcagcggggtaccctgcagtttgaacactttccggaaagtatgttccagatagcgggtgtagctggccggtatattgtccagcgcgttgccgtgcacgacgatgatcggcgggttctggccgccctggtgcgcatagcgcatcttgggacggatcaggcccgaacgcggcggctgctggcgctccagcgccacctgcaacacccgcgtcagcttcggcgtcgccagcttcaccatcgccgcgcgataggcttcgtcgatggatttgaacaagtctgccacaccgcggccctcgatggccgagatgtaatgaaacttcgcaaaatcgaggaagttcagcttgcgggcgatctcgcggcgaacattgtccttctgctcgctgtccaggttgtcccacttgttgaccgccaccaccagcgcgcgccccgcctccagcgcgaagccggcgatggtggcgtcctgctcggagatgtccagctgcgcgtccagcaccagcaccgcgacgttggcgtcttcgatcgccttcatggtcttgatgacggaaaacttctccagcatctcgttgaccttggcgcggcggcgcacgcctgcggtgtcgatgatggtataggtatggccttcgcgctcaaaatcaatatagatgctgtcgcgcgtggtgccggcctggtcgaatgcgatcacccgctcttcgcccaggatggcgttcaccagcgtggatttgccgacattgggccggccgatgacggcaaacttcggatggcggctttcttcttcctccacttcgtcggggaaggtttccagcaccagttccatcagttcgcgcacgccgtcgccgtgggcggcggaaatcaccagcggctcgcccagcgccagttcgtggaactcggcgccggcgatggcgtggcgcatgccctcggccttgttgaccgccaggtagaccggccggtcaagctggcgcaggcggttggcgatgatcttgtcttgcggcgtcaggccggagcggccgtccaccaggaacaccacggcgtccgcctcgtcgacggcctgcaacgtctgcttggccatttcgaacaggatgccttcgtcgaccaccggctcgaaaccgccggtgtcgaccaccaggtacggcttctcgcccacgcggccttggccgtagtggcggtcgcgcgtcaggcccggctggtcggcgaccaaggcgtcgcggctgcgggtcagccggttgaagagggtcgacttgcccacattggggcggccgaccagagctacggtaggtttcatgtaatactgctttttatcccagattcagcatcgccaggcggccgtcctgcccctggatcagggcggaggaaccgagcgataccggttgattgaccggcccggaggtgccgatcttgctgcgtccgacaatgctgccgctctcgttggatagcagatgggcatagccttcgccatccacaaccagcacgaagcgcccgatcatggccgggccggaaacattgcggtacttgagttcatcgtttttccagagattgcgcccgctctggcggtcgtaagcccagatcgagccgtcctcggccgtcacgtagacattgcgcgcgtccatggccaaaccgcggctggacgacacctcgcggccccacaacaggctgccgttgcgcgcctcgaagcaggcgacgcggccctggtaggccaccgcgcacacctggccgccgtcgtaagccgggcggctggtcacgtcggtgacgcgctccagctcggtggcgccgcgcggcgtggccaccgcgccttgccacagcgtgttgccggtctgcggattgacgatgtccaggcggccgccggcctgccccaccatcaccgcctccttgcccaccgcgcgcatcgaaccgttgttgcgcacggtcagttgcggcagcacattgcccaccgaccactgctgcttgccgtccgccaggctgaagccggtcaggcgggcgtcgttggtgcgcaccaccacgatgtcgccggcgatctgcggcgcctccagcatcaggctggtcagcggctgctgccagacgatcttgccgctcttgcggtccaccgccagcagcttggcgtcggcgctgccgaccagcaccacgtcgccgctgacggcgacgccgctggcgagcgcgcgcttgagcgccacatcggcctgcacccggccgctgagcgcgtcgacgctgcggatgcggccttcggcgtcggcgctcaccacattgccgctatcgtagaccggcaggaagctggacgccgggcccgcctgctgcagcgaccatttcacatccagcgcctgcagcggcttgatgttggccagcggcgtcggctggaactgggaagagccttcgaaccagctggcgcagccggccagcagcatcgaggacagaacggtggtaagcaacagttggcggcgcatgcggtcaggctcccagcgcgtcgagtttggtctggaccagctggcggaccgggctttcttccaccagcttggccagggcggccttgtaagcgtcgcgggcggcggcgttgtcgcccttggcgacgaacacatcgcccttcagctccaggtactgcgcgtcgaaagcggccgggtgctcctgattcagctcggagatggcggcgtcgtactgcttctgatccaggtgcagcgaggccaggcgcatgcgggcgatggcctggatcgcctcatccttgccgtttttcgccgcccattccagctggctggtcgccagcgccgggtcgttcttgtcgaacgcggccttggccagcaccagcgcgctgcggctggcgtagatggtgccggcgtattcgccctgcagcagctgggccgcggacttcagcttggcgatgtccttggcggccaccgcgctgtccaccgcctcataggctgcggcggctttctcggactgctccttctggtgccactggtagcccttgaagccgaaggtgcccaggcaaaccgccagcaccgcgccgccgatcagcttgccccattgctgccagaatgccttcagcgaatcgatctgttcctgttcctgcaagtcgaacgccattgcgttcccctttctatcaagctttcagagtggcgagggtggccagaaccgcatcggccgccacggtctgctgggcgatgtcggcgcgcagcgccttgatcaccacctgaccggcctggatttcgttttcaccgacgatcagcgcgaactcggcgccgctgccgtcagcctttttcatttgcgacttgaagctggcttcgcccagatgctgcaccaccgagtagccggcggcgcgcagggtttgcgccagtttcatcgagtacaggcctgcgccctcgccctggttgaccagatagacatcgacgctgcgctgcgccggcaacaggttcttgtcctgcaacagcaggagcacgcgctccatgcccatgccgaagccgatgccgggcgcggccttgccgcccagttgctccaccagtccgtcgtagcggccgccggcgcagacggtgccctgggcgcccagctcgctggtcacccactcgaacaccgagcggttatagtaatcgagaccgcgcaccaagcgcggattttcgacgaattctatgcccagcgcggcgatcatcgccttccagccggcatagtgggcgcgcgactcctcgcccaggtagtcggataacttgggcgcgttgtcggccatctcctgcagcgccgggttcttggtgtccagcacgcgcagcgggttggtgtacaggcggcgcttgccgtcctcgtccaggatgtcgacgtggccctccagatacgcgatcagcgcctcgcggtgggcggcgcgctcttcggcgttgcccagcgagttgatctccagccgcacgtactggctgatgcccaggcggcgccacagatcggcggtcatcgcgatgatttcggcgtcgatgtccggaccggccaggcccagcgcctccacgcccacctggtggaactggcggtagcggcccttctgcggacgctcatggcggtacatcgggcccatgtaccacagcttgggcgcggcgttgtagagcagattgtgctcgaccaccgcgcgcagggtgccggcggtgccttccgggcgcagcgtcaggctgtcgccgttcaggctgtctacgaaggtgtacatttccttctcgacgatgtcggtcacctcgccgatggagcgcacgaacagcggcgtgccctcgacgatgggggtgcggatgttctggtagccgtaatcggccagcagcttgcgcagcaccccttcaaaatattcccactggtacgactcggccggcagcacatcgttcatgcccttgaccgcttggtatttctgactcattgctgtcttcttgtatccgcttgatctgaattatctggcgtccaccggacggatgggaatggtgcgaggcgccggcgcctcgcggcgcttggcgccgccctcgccgtaacgggttcgcacatagtcgtcgacgatggctgtgaactcggctgggatgttgtcgcccttcagcgtcacatccttctggccatcgacatacaccggcgccaccggcacttcgccggtgccgggcaagctgatgccgatgtcggcgagcttggattcgcccggaccgttcaccacgcagcccatcaccgccaccttcatgtcctcgacgcccgggtactgcaagcgccataccggcatctgctcgcgcagatagccctggatatggtcggccagttcctggaagaaggtgctggtggtgcggccgcagccgggacaggcggtgaccagcggcgtgaagctgcgcaggcccatggtctgcagcagctcctgcgccaccaccacttccttggtgcgcgcctcgcccggttgcggcgtcagcgagatgcggatggtgtcgccgatgccttcctgcagcaataccgccagcgcggcgctggaggcgacgatgcccttgctgcccatgccggcctcggttagccccaggtgcaaggggtaatcgcagcggccgcccaactcgcggtagacgctgatcagatcctgcacattgctgaccttgcacgacagaatgatgttgttcggcgacaggccgagctccaccgctttctcggccgactccagcgccgacacgatcagcgcctcctgcatcagcttgggcagcggcagcggctgggcggcgcggctgttggcgtccatcatccgcgccagcagcgcctggtccaggctgccccagttgacgccgatgcgcaccgccttgtcatgctccatcgcggtgcggatcatgaaggcgaacttgtcgtcgcccttggcgcccttgccgacattgcccgggttgatccggtacttggccaacgccttcgcgcagtccgggaattccttcagcaggcggtcgccgttgaagtggaaatcgccgaccagcggcgcgtcgcagcccatatcgtcgagccggcggcgaatttccgccacctgggccgcggcctccagcgagttgacggtgatgcgcacgacttcggagccggcctgagccagttggtacacctgttccacagtggcggccgcgtcggcggtgtcggtattggtcatcgactgcaccaccaccggcgcgtccgagcccaccaaaacatgccccacccgcacctggcgggtcaggcggcgcgcgatgttcacgctatccattcgctaccctacgcattacttgagttgaatcttggcggtggtgccgcggatcttgccgctcaaatccaccggcttgccgttgtagttcagttccacctggctggcgttgcccaccaccaccttgaacggcgcgaggccggtcacttcggtggcgttgcccggctgcatcacctgatagatcaggcggcggccattggcgtcctgcaccgacacccaggccgcgtccttgacattgacgctgacgcggtcgcttccttctgcctgcggcgcgctggcggctgcaggcttggcgacttttaccgcggccgcggcgctggccacgggcttcgccactggcttggcggcggcctgcggagccgacgcctgcggcttgccctgcgcagcgggcgccggagccgcggcaaccggcgcggaagcggccttgtccgctgcgggcgcaacggcctgcgcggccgaggcctcatgttgctgggtcagcatcggcgccagctggttgtcggcgctgccggcctgcttggcggcggagtcggcgtcgcggttggcgtaccaggcgccgccgccggccaatgcggccgccaccaccagcaaggccagccatttgccggcgccgccgccggccggcgccggttccggctcttcggcttcatgagcggtttcgcgcgccgcggtacccttgaccagattggccacttcattgaccgcggatgggaaatgctgctccagcgcctgcatcagcggctcgggatccacttccagaaagcgcgcgtaattgcggacaaagccgcggacgaaggtcgcgcccggcagcgcgtcgaaatcgtcgcgttctattgcgtccaattgcctgagcgacagtttcagcctgtcagccacttcccccaggccaaggccggccgcttcgcgggcggctttcaagcgggcgccgataccgctgggcataggcgagtcgtgatgttcgatttttttttccatcctcagcttccactcaacagcagttgtgtttccctggagtccggataccggtttttcagcgcattggcgcattcgccttccaaagcgccgtcaccggtcttgcgggcgattctggctcccagccacaggtcggccgcggtcaaaccgttttggccgccgttgcgcagccgtccgaaatagaaggcggccagcttggcgttgcccaggcccaggtgcatttcggccagttcgcgcagcgccggcgcatagtccggcgccagccgcagcgcgcccagcaggtaatcgttggcctgctcggtttgccccagcttggcgctacagcgccccagattgaggtaagccgcttgcggcgcgtcgtacagcggattggccagcgccttctggaacagcgccagcgaatcctgtgcccggccgtgctcgcacaggaacaggccgtaattgttgttggcttccgaattggccggatccagccgcagcgcctgccggaagtcgtcttcggccagaccgttctgctgcaataggcccagcacgtaggcgcgggtcacgtaggcggtgatgaaggacggatccgccttcaccgcctggttggcgttgtccagcgccgatttcagattgccgatgcgggcatactccaccgccagctggctgcggatctgcgccagctcgcggacgttgcccgcggccatggcgaaagtggaaacgccaaatgccaacagccatccagcccaccactttcgccatgtcatcatagtttcttgtcctcgactatctgcatccacttggcctggcgccgcgtcttgtcctgcacctggccggccagctggccgcaggcggcgtcgatgtcgtcgccgcgcgtcttgcgcaccgtgaccacatatcctcgttcttgcagaatttcacggaaaatgcgaatcgcgttgttgctggagcgatcataacccgagttagggaacgggttgaacgggatcaggttgaacttgcacggcacctcccgcaccaattccagcaattggcgagcatgttccggtctatcgttgaccccgtcaagcatcacatattcgaaggtgatgaaatcgcgcggcgccttttccagatagcgacggcaggccgccatcagctccgccagcggatatttcttgttgatgggcacgatttcgtcgcggatcacgtcgttcggcgcatgcagcgacaccgccagcgccaccgggcactcctcgcgcagccggtccatctgcggcaccaggccggaggtggacagcgtcacgcggcggcggctcaatccgtagccatggtcgtcgagcatgatctgcatcgcgctgaccacgttgtcgaagttggccagcggctcgcccatgcccatcatcaccacgttggacaccacgcgctcgttcttcggcgtcacgcccatcgccttgttcgcccaccacagctggccgatgatctcggcggtgctgaggttgcggttgaatccctggcggccggtggagcagaacgtgcactccagcgcgcaacccacctgggatgacacgcacaaggtgccgcggtcgtcttccggaatgaacacggtttccacaccgttgccggtgccgacgtcgagcagccacttgcgggtgccatcactggactcctgcccggtcatcagcgaaggcacgcccaccacggcgcgctcgtgcagcttggcgcgcaggctcttggcaaggtcggtcatcgcgtcgaaatcggcttcggccatctggtgcatccagcgcatcacttgcttggcgcggaacggcttctcgcccatttctgcgaaatgctgggtgagttggtccagattgaagtcgagcaggttggttttcatgcaatcctcaagagggaaaagaggccgcctcagacgacggcagcctccggtcgatcaactacctatatctgagattagcgcgagctgatctcggaagcggcgaagaagtaggccacttcgatggcagcgttttccacgctgtcggaaccgtgaacggcgttggcgtcgatcgattcggcgaaatcggcgcggatggtgccggcgtcagccttcttcgggtcggtggcgcccatcagttcgcggttcttcagcacggcgttttcgccctccagcgcctggatcatcaccgggccggaaaccatgaagtcaaccaggtccttgaagaaaggacgctctttgtgcacggcgtagaagccctcggcttcggcgcgcgacagctgcttcatcttggcggccacgaccttcaggccggcggactcgaagcggtcgtagattttgccgatgacgttcttggctacggcgtccggcttaacgatggacaaggtacgttcaattgccatataaattctccctaacgacaagacaagtggctaaacttgagtattattacgccactcgggttacccaattctgacgaacccgctattttagcagtgttttcaaacacgtgctgcacattccatccaggcaccatgcgcgaacaaaaccaacagcaaccgccggccgacggcgacaatgaatccgacctcaacagcaagctgaaaaaacggctatggatcgccggcggactggttgccgtcgcgctggccgcgattccgctgatggacgcgctgaccaaacccaagatggacatgagcagcgacgcgcaaagccccagctccggcaagatcgtcaaaccggcggcatccagcccgtcagccggcgccatcgcgctgcccaaagccgccagcgccgccgcggagcaaagcagcgcccccgccgccgaacccgccaaccgcgcgccggcgacgccggccgaaaccagcccggccagcccggacctcagcaagaccccggccgtcgccaaccagcaggccagccgccacgccggcgccccccaccccgcggcgcagaacaagccggccgcgccggaaaaaacgccgccagccgcaaccgcccgccagccggcccctcccacccgcaacgccgcggccgccccgcagcccgccgccccgcagcccgccgcccagcaagaggcgccgccggccaaaatcgccgccgaagcccccgccaaggcgcagcccgccggcagctcggtcggctaccaggtgcaactgggcctgttcgccagcatgggcaacgcgcaaaagctggtcaaagacctgcaaaaacacggcatcgccgcccacaccgtcacccgcgtgcaactgggccccttcaaaacccgcgccgaagccgacgacgcgatgagcaagctgcgcagcctgggctattcgccactgcttgccgccgaaggccaataagccggacagcaaaaaggcccgcttagcgggccttattttatttatgctgccgatttcattcggatattcaaacaagcgcattcgccggcgcgccatgcgaaaagcccccaagctttcgcctgggggcttttcatgtttctggcaggcgatacagggctcgaacctgtgaccctcggaatcaaaatccgatgctctaccaactgagctaaccgccaacactatctcgcttcgtttccgtcgcgagagaagacaatattacctgcgctcttttattcatgcaagcgtttttttgattctttttgaatttcaatcaaaatcgcttgccgcagataaattcggaaaacagaactggcttttccgtttgtcggaatggtgccggtaagaggagtcgaacccccgaccttcgcattacgaatgcgctgctctaccaactgagctataccggcaaaccaacttgttaaaaaagccctgattctcgttttggaaaatcaaggctttttttgaatcctggtcggagtgagaggattcgaacctccggcctctacgtcccgaacgtagcgctctaccaggctaagctacactccgattcacttcatttccgacttgcgtcgagagaaggtaatttacagcagatttaacttttgcacaagctattttgtttaactggtcggagtgagaggattcgaacctccggcctctacgtcccgaacgtagcgctctaccaggctaagctacactccgacgaccggctaaactgcttgcctccgaaaaactgctgctgcatcgcttgctgcggtacaatcagcggcttcagaggacgcgcattatggaacaaatatgtggtttaggcaactatctttttatcgtttgaacgcagaaagcctggtcgacgctgacaagctgttgcaggcattggaaaaacgtccgttccagccctgcatgggactggattggttcagcgaaggctgggtggcgccggccggccatctggacgctccggtctatgccgcgcgcggcagcttgatggtgtcgatgcggcgcgaagacaaggtgctgcccgcctccgtcatccgcgacttcgtcgacatgaaagtgcaggagatagaagacaaggagctgcggaaggttggccgcaaggagaaactggcgctgaaggaacaggtcaccgacgacctgctgccgcgcgccttcgtgcgcagcggccgcaccagcgcctatctggacatccagcgcggctggctgatggtggactccggcaccgccagcaaggccgaggcgctggtttccaagctgcgcgaggcgctgccgcccttccccgccgccctgccgcgcaccaagctggcgccgcacgcggcgatgaccgactggctggcggccggcgaagcgccgggcggcttcgagctggacgccgattgcgaactgaaggacagcagcgaaaacggcgcggtggtgcgctgcagccgcatcgacctcaccagcgacgaaatccgccagcacatcgccaccggcaagcaggccaccaagctgggcctgatctggaatgaaaagatccgcttccagctgaccgacacgctgcaactgaagcgcatccagttcttggacgtgctgcaggaggaagccagccaggctggcgacgaccgcgaaagcctgttcgccgccaccttcctcttgatgagcgaagagctgggcgaactggtcagcgcgctggtggaggcgctgggcggcctggaggacagccaggcgctgccggcgctggaccagccgcaggccgaagccgcgcccgcctccggcagcgtcgacgtcccctgggactgagcccgccgccatcctctccgaacccggccatgccgggtttttttacgtccggcgtcggcgcgagattgaacaaaagccggccatagcttaaatctaactatcaaacagaaacaattaatttaacaaagctatgaaacttgcggatactgcagccatccactatcgggagcgtgtcatgaagcaaagttggcgcaacgccttgctggaaatgtggtccggcttcgcctggctgcaatgagttcccttccgtagattcgcccactcaaggagaaagcaggatgagcaagcacaacctcaccaccgccgccggcgcgccggtcgtcgacaaccagaacgtgcagactgccggcccgcgcggtccgatgctgctgcaggatgtctggtacctggagaaactggcccacttcgaccgcgaagtgattcctgagcggcggatgcacgccaagggatccggcgccttcggcactttcaccgtcacccatgacatcagccgctacacccgcgccgcgctgttttccgacatcggcaagcagaccgacctgttcctgcgcttctccaccgtggcaggcgagcgcggcgcggccgacgccgaacgcgacatccgcggcttcgccgtcaagttctacaccgaggaaggcaactgggacctggtgggcaacaacacgccggtattcttcctgcgcgacccgctgaaattccccgacctcaaccgcgcggtgaagcgcaatccgtacaccaatatgcgcgacgccaacgccaactgggacttctggaccctgttgccggaggcgctgcaccaggtcaccatcgtgatgagcgaccgcggcatcccggccagctaccgccacatgcacggcttcggcagccacaccttcagcctgatcagcgccaagggcgagcgccactgggtgaagttccacttccacacccagcaaggcatccagaacctcagcgacgccgaggccgaggcgctggtgggccgcgatcgcgaaagcgcgcagcgcgatctgctggaaagcatagagcgcggcgatttcccgcgctggaccctgtacatccaggtgatgaccgaagcccaggccgacgcttgtcccttcaaccccttcgacctgaccaaggtgtggtcgcacaaggcctatccgctgatcgaagtgggcgtgctggagctgaaccgcaatccgcagaactacttcgccgaggtggagcaagcggcgttcaacccggccaacgtggtgccgggcatcagcttctcgcccgaccgcatgctgcaaggccgcttgttcgcctacggcgacgccgagcgctaccggctgggcgtcaatcaccacctgatcccggtcaacgcgccgcgctgccccttccacaacagctatcaccgcgacggcgcgatgcgggtggacagcaatgccggcgccaccatcggctacgaacccaacagccagggcaagtggcagcagcagccggcgttcgacgagccgccgctggcgctgcaaggcaacgcctaccactacgacttccgcgccgacgacgacgattactacagccagcccggcgcgctgttccggctgatgacgccggcccagcaacaagtgctgttcgacaacaccgcccgcgcgatgggcggcgtcgacgaggcgatccagcgccgccacatcgccaactgcgccaaggccgatcccgcctacggcgccggcgtggccaaggcgctgggcctgaagatctgacgcagagctgaatggccggccgggcgaaagctccgccggctttttcttctctcttgatttaaatgataatcattatcattattatggaaagccattcacgtgagagccaccatgcaaaccgtcagccccttcccttcccgccacaaggcgggcaaaaccgccccctcgccgcgccgccgctggcggcgttggctgggtctggccatcttctgcgccggctgcctgctgtggctgcaacacggcgtagcgcccgcgccgcgccccgtggcggcatcggccgcgcgttgagccgatatttattgaaccaaagtaaacaattaagtgagaaaaccagcatttttttaaccgccatgccggcgtaagctgttgccataccctcattgcaggcaacagatcatgactacccgacaaccctcgctgttcatttcccacggcgcgccgacgctgccgatagaagacagccccacccgccacttcctggagcaactgggccgcgactggccgcgaccgcgcgccatcgtcatcgtatccgcccactgggaggaccgcgcgctcaccgtcaatctgcagcccaggcccgatacgatgtacgacttcggcggcttcccgccggtgctgcgcacgctgcgctaccccgccgccaccgacgcggcgctggccgaacgcgtggtcggcctgctggaccaagccggcctgccggtggccgccaccgccgagcggccgctggaccacggcatgtggacgccgctgctgctgatgttcccccaggccgacatcccgctggtgatgatctcgctgcaccaccaggccggcaccgccgagcactacgcgctgggccaggccttgcgcccgctgcgcgacgacaacgtgctggtgataggcagcggcagctacacccataatctgtgggagctgagcccggaaggcagcgagcgcgcgccttgggcggcgggcttcgccgactggatggaccaggcgctgcaggacaaccgccgcgacgacatcatccactggcaacagcgcgcgccctatccgaacgaaaaccatcccagcgacgaacacttccagccgctgctggtggcgctgggcgcatcgaacgacgaagcggcgccggtcaagctgcacgacgactggcggatgggttcgctgtcgatggcgtgctggcgcttcgattgagcgaaccgcccctacaaggtgcgcagcctgccgcggaagtcatcgaggcggcggtagcccttggcccgcatcagcgccgccagctcggcggcgatgcgggcgaaagcgcccggcccttcctggtgcaggcaagtgcccacctgcaccgcgcgcgcgccggccaggatgtgcatgaaagcttcgcggccgcttttcaccccgccgcagccgaccacgtccttgcccggcagcagccggtaaaactcgcgcacattggccagcgcggtcggcagcacgtaatcgccgcccagtccgcccaggccatccttgggcttgatcaccaccgcttcgctgtcgacatccaccaccaggccgttgccgattgaattgatgcaggtgacgaaggccagccgccggtggcggttcaatatctccgccatcgcggcgaaatgggcgggatcgaagtaaggcggcagcttgacgccgtacagtccgggataagcggcgtcgaacgcgtccagcgcttcggccgtcgccccgaagtcgtagcccagttgcggcttgcccggcacattggggcaggacagattgatctccggcagcgccggcaggcctgcctccgccaaacggcgcaacatcgcgcagttgtcgtccagcgtcagaccggacaaggacaggaacagcggcttgccgccgccgtcgccatagcgccgggcgaaatccaggtaatagtcgaagccgcgattgggcaagcccatcgaattgatgctgcccagcggcgtcggatggtagcgcggctcggggttgccgtcgcgcggcgccagcgtcgcgctcttggtgatcagcgcggcggcggcggaagcgcgcagcgccgccaactcgtcctcctcgcggcaccagacgccggaggcgttgtacaggcagccgggcatggcgcggcccagccaggtgacggacaggtctaccgcatggtcgtcggacatcgggatctttcaattgagaatggaatgccctggattgtgcggaaaaacgccggccgcggcgctgagcgcggtcaagacctgcgcgcgcggcaaagaaaatgcccggcttggccgggcatgtggtcgatggcggcgaacgcttacatctgcgcctgctggtaattcgccaggccggtcatctcgatcagcttcagctgctgctccagccagtgggcgtgatcgttctcggtttcctccagcagcaccatcagcgcgtcgcgggtgacgtagtcgcgcacgctctcgcaatgggcgaccacttccttcagcaaggcgccgacgcggtattccacctccagatcggccttcagcatcgtcggcacgtcttcgcccacctggatcggcacgcggcgcgccacattgggcttgccttgcaggaacagggtgcgggcgatcagcgcgcgggcatgctccagttcgtcctcgcgctcatggtcgatgcgttcgaacagcttgttcagccccatgtccttgtacatctcggcatggatgaaatactggtcggcggcggacagctcttcggccagcaggtcgttgagcagcgctatggtcttgggatcgccttgcatattgttaccttgttgttctggtgactcaagccgtcattctaggcgctcagcgcgccagatgcaccccctggtagaaggcgaacgacagcagccaggccaacagcaccgaccagccggccgacatcgcggcgaagccccagctcttggattcgcgctgcatcgccgccaccgtggacaggcagggcacgtacaccagcgtgaagatcaggaagctcatcgccgacgcccagtccagatgctggaccagcgccccgcccaggccagcctccgacacgccgtagatcaccgccaggctgcccagcaggatctccttggcgatgaagccgaacagcagcgccaccgccagctcggcgcggatgcctatcgggtccagcagcggcgacatcgcctcgcccagcgcataggccagcgtcttgccgccgccggccggaatgtgggtcagcagccacaccatcaccacgccggccaggatgaaagtggaggccaggcgcaaaaaggcgctgacctcgcccgtcgcccgcgccagcatgtggcgcgcgccgggcaaccggtacggcggcacctccagcaagaaagcctcgtcgccgcgatagcgatgcttgaacacccaggcggtgacgatggcggcgacgaaagtcatcagatacaggctggacaccacccatggcgcctggcttttgctgaacaggatgccggcgaagaacaccactacctgcagccgcgccgagcacaaggaaaacgggatcaccagcatggtcagcagccgctgcttgcgctcgcgcatgacccgggtgcccaggatggccggcacattacagccgaagcccatcagctgcatcacgaagccgcggccgtccagccccagcctggccatcatcgcgtcggtcaggaatgccgcgcgcgccagatagccgctatcctccaccatcgccatcagcacgaagaacacgaacagaatgggcgcgaaagtcagcaccgtggccaccccctgccacacgccgtccagcaacaggctctgcagaatggccggcacggaagaaagcgccggcgccagcgcgtggtccttgacccagtccaggccgccgccgaccgcgtcctgcagcggcgtgccgatctggtaagtgagattgaacagcagcgccatgaaggcgaaaaacaagggcaggcccagccacgggtgcagcagccagcggtcgaccttttccgtcagcagcgtcggcagcaccggcggcagccgccagcagccgtccagctggcggcgggccaggtctatcgcctgctgcgattccggcacgctctccagttgcgcgtgaacagccggctcagcgcgggaggccagccggttcagcccctccatcagcctgggccagccttccatccgcttggccgagatcaggacaaccggcgtccgcagccgctcggacagcgcgtccgcgtcgatggacacccccagcagcctggcctcgtcggccatgttcaacgccagcaggcaaggcaggccgctggctatcatttgcaaggccagcggcaactggcgatccagctggctggcgttgagcaccagcaccgcgccgtcgaatggcgcggccagcagcacgtcgcgcaccaccgcctcgtcgtcggaatagccggtcaggtcgttgatgccgggcaggtcgaccagctccaccatcttgccgccaagcagcaagcgggcgctgatcaggtccacggtgaggccgggccagttgcccacccgctgcgacatgccagtcagacggttgaacagggtggacttgccggtattgggcaggcctatcagggcgaagcgcttcatgccgcggccctcacctggatgcggcgcgccaggctgcggcgcaacaggaagcgggtggcccccacctccagcaatagcgggccgccccagggcgcggccttgagcagatggaagcggccgcccggcaccaggccgaaggccgccacgcggcggaacacctcgtcggccagatccaggctggccaccacgccggcttggccggcgggaaaaacatccagagaaggcatgggttgagaatcctgacaataacgcgaataatttgcattagtatatccgcctcgccgcgcccgccctgcggcaaatcgtcgcaatccgcgccgcgcttgaccctggtcaagcccgcctcgccgccgcgccaaaggcaatgccttgccatttccatagcctggcgatgcgctaagcggttaaaatcgcagccattgcgaaatcgacacacaggcccaaaaccatgagcatcaaatcggacaagtggatccgccgcatggcggacgagcacggcatgatagagccgttcgaagccaaccaggtgaaaatggccgccgacggccagaagctgatctcctacggcacctccagctacggctacgatatccgctgcgccgacgaattcaaggtgttcaccaatatcaacagcaccatcgtcgatccgaagagcttcgacccgaactccttcgtcgaagtgtcgggcaaaggctattgcatcatcccgcccaacagcttcgcgctggcgcgcacggtggaatacttccgcattccgcgcagcgtgctgaccgtttgcctcggcaagtccacctacgcgcgctgcggcatcatcgtcaatgtcaccccgttcgaaccggaatgggaaggctatgtgacgctggagttttccaacaccacgccgctgccggccaagatctacgccaacgagggcgtggcgcaagtgctgttcttcgaatcggacgaagtctgcgacgtgtcgtacaaggaccgcgccggcaaataccagggccaggtgggcgtcaccctgccccgcccctgaacgcgactcgtcgcacgggaaaaggatggcctcggccatccttttttgtttgcgccgcatgcaaaagccgctcgcattttccggcatctgttctaggctaaacaaagggttagccgacatcccggttgtgccaaccctttgcacagcaagctgtttcttcttggggcgtcgcggttcccccttgccgctgcgccccctttttatgcctcgcgcccccgtcttctctcgccagagccgccgatttcgcggcacaatccggccatgaacctatacgacttctccttccgccgcctggacggcgtcgaacagcctctggccggctatcgcggcaaggtcatgctgctggtcaacaccgccagccaatgcggcttcacgccgcagtacgccgggctggaacaactgcaccagcgcttcgcggaccaggggctggtggtgatcggctttccctgcaaccagttcggccgccaggagccgggcgacgccgcccaaatcggcgcgttctgccagaagaactacggcgtggatttcacgatggcggacaaggtggaggtcaacggcgacggcgcccacccgctgtgggcctatctgaaacagcagaagcgcggcctgctgggccggccggtgcgctggaacttcagcaaattcctggtggaccgccagggccgggtggtggcgcgcttcgcgccgttcacccgcccggacaagctggccgccaacatagaggcgctgctgaaatgacggaaaccaggcggctcgcgccggcctggtttcgctatcccgccgcgacggcggggatggggcggcgccgccccgttcaagaatctatgcaacgcctggcgtgcgccgccagcaggtcgagatcgtcatccagatgctcctggatgtccgccagcgccgcgcgcagcaccgcagcggccagttccgcctgatcgccgttgaacacatgcgccaggactctcagctcgcggcaagcggtgatgtccagcggcacttccaaggtgcgcaccgccaccagctccaactcggccatcgcgtcaggatccccggcgcgctgagtttccaactccgccagcaaggtcttcaaggccaatcccattccgccctccctgtcagttcgccattccgccgggcacccgcccggccccacggtcaaccgcacccgcccatgcgcccgcgccggccggcaaacgcggactctttgaacataggccaagccggcgagaaaagcagcgcctagcagcgggcctcgaagccggccagaacattgaccacattggtgcctatcggctccaccgcgtagccgccttccaggcagaacaaggtcggcagcttcagaccggccagcctggcgcccagagtgacgaagtcgggcgaatccagccggaaacgcgagatcggatcgccctgataggtgtcgacgcccagcgacaccaccagcgcctcggcgccgaagcgggcgatctgctccagcgcgcagtccagcgcgacaaaccaggtgctgacgcaggcgccggccggcagcggaaagttgaagttgtagcccagcccctcgcccgcgcccttttcgtcggcgaaaccgagaaaaaacgggtactcggtggccgggtcgccgtgtatcgacagaaacagcacatcggaacgcgcataaaagatgtcctgggtgccgttgccgtggtgatagtcgacatccagcaccgccaccttgcgcaggccgtgctcgcgcagcgcctgcgcggcgatggcggcgttgttgaagaaacaatagccgccgcaatagtcgcgcgcggcatgatggccgggcggccgggtcagcgcgaacgccgcccgctcgccgccgatcagccgctccaccccggtgagcgcgcaatcggcggcggcagtgatggccggccaggtgccggcggtgagcggcgtgccgcaatccatcgagtaatagcagagctggccttccacctgctccggcaccctttcgcgcagccggcggatctgccacatcttgggcagcgcgtcgtggtagcgtcccagcgcgctccagcgctgccaggcgctttccaggaagcggacatagccgtcgtcatgcacggcgaggatcggcgccaggccatggcggcgcgggtggatcacgtcgcccagctcgcgctcgcgcacggcggccagcaccatgtcggcgcgggatggggtttcaaagcagggcttgagggtgccatcgatcagctcggcgcggccgtgctgcaggcgatgggattcggaatagatggtgagcatgatttttccaggcttggaaaacttcatgctcccgccgcggccgcgccgcggtcaatcgctgatgccgtcaaacttgcgccagcgcaagcgccgttcaggacacctcgcccgccacgtaataccagcggccgtcctcgcagacgaagcggctgacctcgcgcagtttttccgccttgccgcccaccttgtagcgggcgacgaattcgacgatgccggcggcgtcgccggccagtcccgcctcgcagcgcaacacctccagcgcgatccacttgaccaccccggcgtcctcggccagatccagcgcggccggccgcgtcgacgcgtgccaggtcgccagcaggtaatcttcccggcccagcgcgtaggcgctgaagcgcgaacgcatcaaggcctgggcgctgggcgccggcggcgcgtcggccgccagataccggccgcagcaggcggacagctcgccgccgccgcagggacaggcggccttggcttgtttcttcgacttcatcagtaacccagcggcggcaaaccgtacagtttcagcagaaaattggtgaaagccggatcggcaggcttggacgaatacttcggccagcgccgcatccactcgcgcaggtgctgctcgagccgggagcggaaggcgtcggaatcgatgcggcctgcctcgcggtctaccgtcaactggcggtagaccgcgaagttgtcgttgtcgaccgggttggcgccggctatccgcagccgggcggcgcccagctggtcggcggcggcggtgcgggtgagcgcgccgctcttcacctggtcggccaggcggttggcctcggccagcaattgatcgaccttgtcggcggcgcgcgacggcgccggccgggacgaagcccccgtgccggaatggaccggcgcccccagttgctgcagcgcgctgcacgcggtcagcgaaccgagcagggagaaagcgataagctgtcttttcatgccggccattgtagcccgccctgcccgcgcgccgtcaacggcaaagacatggcgatggatggcgcggacatgaaaaagcccggcgcgggccgggctggatggcggcggatggctcaggccagatgttcgaacagcgccgtggacagatagcgctcgccgaacgacggaatcaccaccacgatcagcttgccggcgttttccggccgtttggccagttgcagcgccgaccacaccgccgcgccggacgagatgccgaccaggatgccttccttggtggccacttcgcgcgcggtctgcatcgcgtcgtcgttcttgacgcggatgatctcgtcgtaaatgccggtattcaggatggccggcacgaagcccgcgcctatgccctggatcgggtgcggccccttggcgccgccggacagcaccggcgaggcgtccggctccaccgcgacgatctgcacgccgggcttcctcgccttcaacacctcgccgacgccggtgatggtgccgccggtgcccacgccggccacgaaaatgtcgacctggccgtcggtgtcgttccacacttcttcggcggtggtatggcggtggatttccggattggccgggttctcgaactgctgtggcatgaaataggtgtcgggaaactcgtcgaccagcgccttggccttggcgatggcgccgcccatgccgtccggccccggggtcaggatcagctcggcgccgtaggccttcagcagttgccggcgttccttgccatggtttccggcatggtgatcgccagcttgtagccgcgcgccgcgcacaccatcgccaggccgatgccggtattgccggaggtgggctcgacgatgacggtgttcgggccgatcttgccggccttctccgccgcgtccagcatcgccaccgcgatgcggtccttgacgctgtgcgccgggttgaagaactccagcttggccaccacggtggcgccgacgccgtcggtgacgcggttgagcctgaccagcggcgtgttgccgatcaggtcggtaatggtatgggcgatgcgcatagtcttattcctcatttgccgacaatatctgcaatgatattccccagcatcataatcaatcgctagaatcccacctaatattgtttgcttatatccagcaaaccaacaaaacacatcccgcatggccgcgccgcgcggctttgttatagtcaatggaaacacaggccagacacccatgcccacccaggaaaccctgattccgctagccggctggcgccgcaagctttacatcgtcatctacgaggccgatacccgcgccggccgcctgttcgacctgacgctgacgctggccatcctgatttccgtcgcctgcgtgatgctggaaagcgtggccggcgtgcggcagcgctacggcacgctgctgagcgtattggactgggctttcacgatactgttcaccgtcgagtacgcgttgcggctgatctgcgtgcacaagccgctgcgctacgtgaaaagctttttcggcgtgatcgacctcttgtccatcctgccgctgtacctgggcctgttcatcccggaaagccgcttcctggccgacgtgcgcatcctgcgcctgctcaggatgttccgcatactcaaactcagccgccacctgagcgaggcgctggagctgcggcgcgcactggccgccagccggcgcaagatcacggtgttcctcgccaccgtcatcttgctggtgatcatcctgggcacgctgatgtacgtgatcgaggggccggagcacggcttcaccagcatcccgatcagcatctactgggccatcgtcaccctgaccacggtgggcttcggcgacatcacgcccaaaacgccgctgggccaggcgctggccagcctggtgatgatcaccggctacggcatcatcgcggtgcccaccggcatcgtcaccgccgaaatcgcccgcagcaagcccgccgccaacgccgacaaccaatcggccacccggctgtgcccgcattgcttcagcgagggccatgactgggacgcccgcttctgcaagcactgcggcggccagctgccgcgccccgcccgcgaccaggtcagctgagcgcccgccgataggcggccagcgcccgcgcgtcgaacgccaccagccgcaccaggcgcaggctatgcggcccgcgccgcagccagtcgcgcagcgccgcagccgccaccctgcaggcatggtcgagcggatagccgtaagcgccgcagctgatagctggaaacgcgatgctggctatgccctgctgctccgccaacgccaggcagctgcggtagcaggcggccagcagggccgcctcgccgcaagcgcctccccgccaaaccggaccgacggtatggatcacataacgcgccggcagcagatagccttgggtcaagcgcgcctcgccggtcggacaaccgcccaagccgcggcactcggccagcaagcctggtccggcggcgcgatggatggcgccgtccacgccgccgccgcccagcaggctgctgttggcagcattgacgatggcgtccacctgctgcgcggtgatatcgccctgacagcactgcaaccagtcgctttgcatgaatccgtcctccctcacccatgaacgggatgatgcgctgccaagcgccctggctcttggtatcatgtcgcactggcccgccgccgccgcgcgacaacctgttgcataccagtcagcgcccgaaagccggtttgctgctgcgcaaatagcaagcgtttactcgagcctgcggcggaaaaacatcatgccattggcaataccgcgccgccgcgccaagcggatgcaggcccctcgggcaacgcccctcgtttccgccccgagctgtggataactttgttgataagccggtgcatagctggcgcggatgcccgtcggcacaggcttgcggcgatttttcactcggggattgatttttgcaagccattgattcgattatgttttaactccgatatcaaacactacgcaagcgttgcccccgaggtggacattgaataattactccagcgagccattgtggatcacttgacaagacagaatttttttgatcgcagccaggatgtgatcagcgtctcctctctcaaccgcatggcgcgcgacttgctggaagccggcattccgccggtatggataggcggagaaatctccaatctgacgctggccgcttccggccacgcctacttctcgctgaaggacggcggcgcgcaggtgcgttgcgtgatgttccgccacaaggtgtcggcgctgcctttccgtccccgcgaaggcatgcaggtggagctgcgcggccaggtgacgctgtacgaggcgcgcggcgattttcagatcaatgtcggcgagatgcgctcggctggcctggggcggctattcgaagccttcgagcggctgaaggccaaactgcaagcggaagggctgttcgataacggccgcaagcgcgagctgcccgcccaccccgccgccatcggcatcgtcacttcgccggcagccgccgcgctgcgcgacgtggtcagcacgctgcgccgccgcatgcccggcattccgctgatcctctacccggcccaggtgcagggcgaaggatcggcgcagcaaatcgccaaggccatccagaccgcgggagaacggcgcgaggtggaggtgctgatcgtctgccgcggcggcggcagcatagaggacttgtggtcgttcaacgaggaagtcgtcgcccgcgccgtggccgcttgcccgattcccaccgtcagcggcgtcggccatgaaaccgatttcaccatctgcgacttcgtcgccgaccgccgcgcgccgacccccaccgccgccgcggaactagtgtcgcccaaccgcgagcacctcgccatgcagctggaacagacccgccgcggactggagcgcgcgctgagccggctgctgatggacaagacccagcaactggacttcctgggccgccgcctgctgcatccgggcgccaagctgcaggcgcggcgcgaacggctggctgcgctgtcgcaagggctgcgccggcgcgtcgacgccgccttcgaacaaggccgctggcggctgcagctggctggcagccgcatggcccgccatcagcccgatttcggcgccctgtcgcaatcgctgcggcaacggcaagaccggctgcagcgcgcgcgcgacaggctgctggacaaccgccgccagcagctggcgcagctgtccgccacgctgaccgccctcaacccggacgcggtgctggcgcgcggctacgccatcgtgcaaaagcgcgacggcaaggcggtgaagcatccgtccgagctgctcaaccacgagaaagtgacattgcggctggccgagggcagcaccgaggcccgcatcgagcatccgcagggggcgcagccggaactgcctttctgagcgcagcaatcagcagcgggacgcgcttgcgtccttcccagcctcagggcttgccgaacgaggtaaccgggctgccgcgatgaatctggtcggccaagtcctgcatcgcctggtccgtcaacacctcggtcttcccgccgcggtgcggaatattgctgccggtgagatacttcggctcttcgcgcccggagtcatcgcctgccacggcgctggcgccgggcgttgtggcgcaagcggccagcaacagggcgcaggatagcaagggcatcagtttggcaaggttcatcgcggctttatccatggttgagtcatcggcgggagcctgccctggcgcggtggccaggccgcaggctgacgttttatgcaaacatgctattcaagcccgcgccggatgtaaatgccgagcaccatccccgacaaaaaaagcctgcgaccatcgcaggcttttttcttgtcggcagcgccaaagcgccatcaagcttgccgcagcgccggcggcagagcgaacaccgtgctctcctccacgccgggcaattcggcaacctggccgatgccgaaagtcttgatgcggtctatcaccgcctgcaccagcacttccggcgcgctggccccggcggtgaggcccacccgctgcttgccgacaaaccattgcggctccagcaggctggcattgtccaccatataggcgtccacgcccttcaacgccgccacttcgcgcaagcggttggagttggagctgttgggcgagcccaccacgatcacgatgtcgcagtcctccgccagctgcttgaccgcatcctggcggttttgcgtggcgtagcagatatcgtccttcttcggactgtgtatcgccgggaagcgggctttcagcgcttcgatgatgtcgcgggtctcatccaccgacaaggtagtctggctgacataggacagcgcgtccggccgcgccacctggagcgtggcgacatcggcgacggtctgcaccaggtacatgccgccatccacctggcccatggtgccctccacctccggatggccggcgtggcctatcatgatgatttccatgccggccttgtgcatgcgcttcacttccacgtgcaccttggtcaccagcggacaggtggcgtcgaacacctgcagccccagcgcctcggcctcggcgcgcaccgacagcggcacgccgtgcgcggaatagatcaaggtgctgcctgccggcacgtccttcaactcctcgatgaacaccgcgcccttgccgcgcaggtcatccaccacgaaacggttgtgcaccacttcgtggcgcacgtagatgggcgcgccgtacagctcgatggcgcgctcgacgatggcgatggctcggtcaacgccagcgcagaagccgcgcggattggcgagcatgatggtcttcgtcatccgtatttcctcgatccggccgcgcgaaagcgttgccggcgtagccgcgcatggcccgcccgcgggccatcgcgatgtttcccgccatcgcgctcagcgcgacggttttttaaagctgtccagcaccatcaaggcggcgccgacgcagatgaaggagtccgccagattgaacgccgggtagtaccactggttgtagtagtggaccatgatgaaatcgatcacatggccataggccagacggtcgatcacattgcccagcgccccgccgatgatgaaggcggcggccaggttcatcaggccggagaagcggcccttgacgatattccagcccagccagcccgacaccgcgaacgcgagcacggtgaacagatacttctgccagccgccggcatcgtgcaggaagctgaaggccgcgcccggattgtaaaccagcgtgaagctgaaaaagccttccactaccgagcggacttcgccgtactggaaatggccgttgaaataaagcttgctgaactggtcgagcacgatgaccagcgccgccagcacgaaccatttggaccagcggcgggccccaggcatagtcattgcagaatccatcaatcagtttccatgggctggcggggccgccatggcggccccgcgtcagacggtcaggcgtggcggcgatgctcgccctggccgtccagattgtcgacgcagcggccgcagaccgcgccgtggccagcctggcggcccacgtcggcgcggtagtgccagcaacgctcgcacttgtcgtgcgtcgaggcgtgaactcgcaccgcgacttccgccgcctccttgacgctggccttggagacgatcagcacgaacttcagctcgtcgcccaggctcagcaactgctgcgccagcgcgaccggcgcgtcgatctcgatttcggcctgcagcgaggagcccagcttgtcggcgctgcgcagttcttcgatttgcttgttgacctgcgcgcgcagctcgcggatggcctgccacttgccggccagcgcctgttcgcgctccggcgcctggctcgggaactcatgccagatgtggtacagcgtcgattcttcctcgctgtccaccagcacgttccacgcctcgtcggcggtgaagcacagtatgggtgccaccatcagcaacaggctgcgggtgatgtggtacaaggcggtctgcgcgctgcggcgggcgtggctgtcggcctgggtggtgtacaggcggtccttgatcacgtccaggtagaatgcgcccaggtcttccgaacagtagccgaccacgtcctgcaccacgtggtggaaggcgtagcgggagtacagctcgcccaccactttttcctgtacctcgcgggcgcgcagcagcgcgtactggtcgagttccaccatgtccgccagcggcaccgtgttctccagcgggctgaaatcggacaggttggccagcaggaagcggatggtgttgcgcaggcggcggtagctttcggtggtgcgcttcaggatttcctgcgacagcgacatgtcgccggagtagtcggcgctggccacccacaagcgcaggatgtccgcgcccagcgtgccgcatatttcctcgggcgcgatgccgttgcccttggacttcgacatcttgtagcccttgtcatcgacagtgaagccgtgggtcaacagctgcttgtacggcgcgcggccgatggtggcgcagccggtcttcagcgacgactggaaccagccgcggtgctggtcggagccttccaggtacaggtcggccggccaggccagctccgggcgctgcttcagcaccgcgaagtgggtagcgccggagtcgaaccacacgtccagcgtgtcggtcagcttgcggtattgctcggcctcgtcgcccagcaattccttggcgtccaggctgaaccaggcttcgatgccctgctgctcgatgcgcagcgccacttcttccagcagctgggcggagcgcggatgcagctcgcccgattccttgtggatgaagaaggtcatcggcacgccccagttgcgctggcgcgatacgcaccagtcggggctgttcttgatcatcgcgtccaggcgggcgcgaccccaggacgggaagaattcggtggcgtccaccgcgcgctggctgacttcgcgcagcgtctcgccgccattggcctggcggtccatgctgatgaaccactgcggcgtggcgcggaagatgataggcgtcttgtggcgccagcaatgcgggtagctgtgctccagcttggccttgtgcaccagcgcgccgtgcgattccagcgtttcgatcacgcgcggattggcgtcccataccagcatgccggcgaagatttcggtggtgctcttgtagcggccgtcgtcggccaccggattggcgatcggcagcttgtactgcagaccggcctggaagtcttccaggccgtgggccggcgcggtgtgcaccaggccggtgccggcgtcggtggtgacgtgatcgcccaggatcaccggcacctggcgggcatagaacgggtgctgcagctggatcagctccagcgcctcgcccttggcttcgcccagcacgcggtactcgtccacgccgtagcgcttcatcgccgactcgaccagatccttgcccagaatcagcttgcccttgggcgtgtccaccagctggtaatccagattggcgccggcggcgaccgcctggttggccggcagcgtccacggcgtggtggtccagatcaccgccatcgcgccattggcgtcggcgccgaaagcggcgccggccttgtcggcgtcgactaccttgaagccgacgtcgatcgccggcgacaccttgtcttcgtattccacttcggcttcggccagcgacgagccgcactcgatgcaccagtgcaccggcttctcgcccttggtcaggtagccgttttcatggatcttgccgagggtgcggacgatgtcggcctcggtcttgaagtccatggtcagatagggattgtcccagtcgcccagcacgcccaggcggatgaagcccttcttctggcgcgccacctgctccttggcgtattcgcggcacagctcgcggaacttggcggctggaatgtccttgccgtgcagcttttccaccatcagctcgatcggcaggccgtggcagtcccagcccggcacgtaaggcgcgtcgaaaccggccagcgtcttggagcggacgatgatgtccttcagcaccttgttgaccgcgtggcccaggtgaatgtcgttgttggcgtacggcgggccgtcatgcaggatgaacttgggacggccggcggacagcttgcgcagcttttcatagcgcttctcttcctgccagcgcttgacccaggccggttcgcgtttggccagatccccgcgcatggcgaagggtgtatccagcaggtttacggttttacgataatcgatgctcatgcctgctctcgctgcaaacttgtcaaataggtcttggcactggccgcgtcgcgctctatctgcgccaccagtgtcgccaaatcatcatagcgcgcttcatcgcgcagcttcttcaggaatcgtacggtcagacgcttgccgtagagatcgccggcaaaatcgaacaggtgcacttccagcttgtagtcaggcgtgtcgctgaccgtggggttcagccccaggctggccacgccgcccaggcggccgaacggcgtatccgcctccaccacgaacaccccctgcaatgccggcttcaggtgcggcagatggatgttggcggtcggaaagcctatggtacgccccagtttcttgccatgcatcaccttgcccgatatccggtagcagctgcccagcagcgaagtcgcggaatccaggtcgccggcggccagcctctcccgcaccagggtgctggaagcgcgctcgccctgcaccagcaccgacggcatcgcttcggtggcgaaatgcggacaggacgccagcaagtcgaaattccccttgcgggcaaagccaaactggaaatcatcgccgatcagcaggtaacgggttttcagctcctcaaccagcactttgtcgacaaattcgccggccggcatattcgagaagctgtggttgaagcggtagacgaacacatagtcgaccaggcccaactcctccagcatcacgaacttgtcgcgcagcgtcgacaggcgcgccggcgggttgccgcggctgaagaactcgcgcgggtgcggctcgaaagtcagcaaggcagtcggcatgccgcgcgcgcgcgcctcaaggcgcaaccgttccagcatgcgtcggtgcccctggtgcacgccatcgaagttgccgatggtcaaggcgcagcccggcagggcgaagcgacgcggatctcccagaaatacctgcattggcggtctttacatacatcctgaaaccttcgattgtatccgccagcggtcaatagcgtccagccgttatcggctgcgcaagaaaacaaaaaaccccgcgcaaagcacggggtttttttgattcaaaccggaacgattagttagccggcttttcgactacggattctttaaccgcgtcgatcacaacttctacgcgacgatcagactcgatgcaagccttgatctcggcgttttgcttcttgttcttcacgtagcgcgggaacttggccttgcactcttcggtcatcttggcttcagccttgcccttgcctacggcagtgatcttctcggccggaacgccagcgttctcgaagtaagccttgacagcgtcagcgcgcttctgggacagagcgttgttcagcttgtcggaacccatgaagtcggtgtaaccgtcgatttcaacaccgttcaggtggccttggccggcgtgagccttcagcttggcgaccagcgggtccagttcgttcttggcgtccggacgcagggtgttcttgttgaagtcgaacagaaccttagcggacagggtaactttttccttcacggaaaccataaccggcttcggcgcttcttttacgactaccggcttggccgcttcgcgatcgccgcactcaaccaggccgtccttggccttgtcgaagtaggtggtcttccagcattcgccgtagctgttgcgggtcactgcgtcggtggattggtctacggcgtaacccggtttagcagcaaaagcgctagcagaaaccaacagggcggcaaccagtgcgctcagtttcagctgtttagtcatgttattccctctttaatctataaaatgggtagcaatgcgggctgacgcaaagaccacgcgaacaagttgactgcaaacatcagagatggctacatgctgtgttaatgcagttaacccgcactataggaatgcagcaacaccatgtcaacacggggcacggcgcaaagtcattatagcgttgcataaatacatcacatttcgctaatgatttgcgcaacctgtctcccctatgcgacacattactgttatgtgacgcgtctgcgaaacagtggcaatggctgtcgatatgttacttgatagctatcgctgaaagtattgtaataatcaccatcccccagcgctttgccatccttgatctggaaagcatcgaaccccacctgccacaagggtcggatcaaatccgcccacacatcgcccaccgctctcagctcgccggcataatcatagcgttcgcgcagcagcctggcgaggctgtatccacggccgtcggtgaatgccggaaagtcaatggcaatcaggacaaggtcggccaggtacggctccagcagcgccggatcgtcgtccggcgccaggcacaccccgacccggccgccgcgcgcctgccatttgccggcatccgccagccaagcgaccagcgggacgatcacgtcgctatcggcgggagatgccggcaaggcgccctgctcgtccggcagcaagcgcgtccagccgtccgcgcggatgcgtccatccttaatgtactggggcatacaccctctccttgaaaggctccacgccgacgcggcgcagcgtatcgataaagggctcgcccacctggcggcgctccaggtagacctgcatgattttcgagaacgcgcgcggcacatcggcctgggcgaacgaggggccgatcaccttgcctatggtggtatcccgcccctggctgccgcccagcgtgatctggtaccactcctcgccgttcttgtcgacgccgagaatgccgatattgccgatatggtggtggccgcaggcattcatgcagccggagaagttgcaggcgatgtcgcccaggtcgtacaggtagtccaggtcgtcgaaggtctgctggatggcgttggccaccgggatggaacgggcattggccagcgagcagaagtcgccgccggggcagctgatgatgtcggtcaagaggccgatattgggcgtggccatccgcgcctggcgcgcctccagccacaaggcgtgcagatccttctgcgccacgtccggcaacaccaggttctgctcgtgcgccacccgcaattcgccgaagccgaagcggtcggcccagtcggcggcggcgtccatctgcgcgtcggtgatgtctccgggcggcgcgccggtttccttcaacgacaggatcaccgagcggtagcccgtctggcggtggggccgggtattgcgctcataccagcgggcgaaagccttgtcttcggccagcgccgatcgcagcgcttccggcatgtccgccagcggctggtagtccggatcgacgaagaagctggcgtaatgggcgacgtcctcatcgcgcaaggtggacgggccgtccttcaggtgcagccattcgtcctcgaccttggcggcgaagccttcgcgcgtcatcgccttgaccaggatcttgatgcgcgccttgtatttgttgtcgcggcggccgaagcggttgtacacccgcagcaccgcgtccagataggtcaagagatgctggcgcggcaggaattcgcgcaccacctcgcccaccatgggcgtgcggcccaggccgccgcccaccatcacgcggaagcccacttcgccggcttcgttgcggctgacatgcaggccgatgtcgtggaccatggtggcggcgcggtcttcctcgctgcccgataccgcgatcttgaacttgcgcggcaggaagctgaactccgggtgcatggtgctccactggcggatgatctcgcagtaggggcgcgggtcgaacagctggtcggccgccacgccggcgaaggcgtcggtggtggtgttgcgcacgcagttgccggaagtctggatcgcgtgcatctccactgtcgacagttcttccaggatgtccggcacgctggagagcgccggccagttgaactggatgttctgccgggtggtgaggtggccgtagcccttgtcgtagcggcgggcgatgtcggccagcttgcgcagctgctcgctgcgcagatggccgtagggaatggccacccgcaacatcggcgcgtggcgctggatatagagaccattcatcagccgcagcggccggaattcgtcttcggacagctcgcctgccaggaaacggcgggtctggtcgcggaactgggcgacgcgttccttcaccaggcgatggtctacttcgtcatatcgatacatgtttggattccagcgggaatgccgacggctgcgggccggcaggatcagacggggcgttgcagcgggctggctttcacatgcagcccgcattccttggtttccgggttttcccaccaccagcggccggcgcggatatcctcgccgacgctgatcgcgcgggtacagggcgcgcagcctatcgacgggtaatggcggtcgtgcagcgcgttgtacggcacctggcgttcgcgcaggtactgccatacctcggcctcggtccagtccagcagcgggctgaacttctgcaagccgttgtcggcgtcgtattcctggctggccagatcctgccgggtcggggactgttcgcgccgcaggccggtgatccaggccgagcggcccgccagcgcgcgcctgagcggctcgatcttgcgcacctggcaacaggacttgcgcagatcgacgctttggtagaaaccattgatgccgtgcaggttgacgtattgctcggtggcggcggtgtcggggaaatagaccctgaccgggtgcccggggtagcgttcagccacctgctgcatcaacgcgtaggtttccgccggcagccggccggtatctaggctgaagctctgcagcggcaggcccaggctggcgatcaggtcggtcagcaccatgtcttcggcgccgtagctgttggccagcgccgcgtcgggatgcgcttgggctatggttttcagcagggccgtggtggcggcgagtttggactccaggctcatcgagcgctccggggttggttcgagggtatcctaaccaaagcgcttataaacctaaaagaatattgtgttagtatttaattactacaggttttatagagggcaggccgacaaaatgaagctacaacaacttcgctacctggtggaagtggccaagcaggggctgaacgtttccgaagccgctgagaagctgcacacctcgcagcccggcatatccaagcagatccgcctgctggaggacgagctgggcatccaggtgttcatccgcaacggcaagcgggtggtgtcggtgtccgagccgggcaaggaagtgctgcgcatttccgagcgcatcctgcgcgaagcgcaaaatctcaagcgggtcggcgacgaattctcccgcgagtcggaaggcgcgctgaccatcgccaccacccacacccaggcgcgctacgcgctgccgcaggccatcgccgaattcgtgcgccgctatcccaaggtgcggctgtcgctgaaacagggcagcccgacgcagatctgcgaaatggtggtgtccggcgaagccgacctcgccatcgccaccgagggcatctcgctgtacaaggaactggcgatgctgccctgttatgagtggaaccgctcggtggtagtgccgcgcggccacccgctcagccagctggaccgcaagatgacgctggccgacatcgccgactacccgatcgtcacctacgatttcgccttcgccggccgctccaagatcaacaaatcgttcgccgaccagggcctgacgcccaatgtggtgctgaccgccatcgacaccgacgtgatcaagacctacgtctcgctcggcctcggcatcggcatcatcgccagtatggccttcgagccggaacgcgaccagaacctggtggcgatcgacgccggccacctgttcgagccgtcgaccaccaagatcggcatccgcaaggacgcctatctgcgcggtttcgcctacactttcgtcgagctgttcgcgccgcacctgcaccgccgcgaggtggattccgcgctgctggcccacgagggcgagctggacgactagccgcatccgcgccgccaacgacaacgccccggcaagccggggcgtttttcatggacggaccgggcgcttacagcgtcaggccgcctgtcacctcgatcgcggcgccgttgatgtagctggcctcgtccgacgccaggaaggcgtaaacgttggcgatctccgccggatcggccatgcggcgcatcggcaccttgtcttccatagcctgcagcaccttctccggcatcgccttcagaatgggggtggcgacgaagcccgggcacaccgcattggcgcggatgcccttcttgcccagctccttggcccaggtcttgacgaagccgatcacgccaaacttggccgcagcgtagttggtttggccgaagttgccgtagacgcccaccaccgacgaggcgttcagaatcacgccgccgccctgctccaccatggtgtccaccacggcgcgggcacagttgtagacgcccttcaggttgatgtcgatcaccttgtcgaactggtcttcgctcatcttgatcaactgcgcgtcctggacgatgccggcgttgttgaccaatacgtcgatgcggccgcagcgggttttcaagtcggccaccatgtcggcgatctgggccttgtcggtcacatccacccgatagccgtaggcctcgccgcccagcgccttcagttcatcgacgacggtcttgaccgcgtccgggttcaggtcgcacaccgcgacgatggcgccttccttgacgaatttctcggcggtggccttgccgatgccgctggccgaaccggtgatgatggacactttcccttttaaacgcatggtattcccttctttcactttgcagatctcaccaggtcaccaggacggatgagcacgtgatgtctccagcatcggccttcctggccgggtccctgattattgttgtcgcgccggggacggcgcccatgaaaaagcgggagtttgtgcaccgcaatatagcgcacgccctcccgccggtaaagctacggcctgtgacagaccgtatccaaatttactccagacccttgctggccaggtaatcttcgtaattgccggtgtagtagtcgtagccgcccttgccgtccagctccagcacatgggtggccaggctgctgacgaactggcggtcgtgcgaaacgaagatcagcgtgcccttgtacttttccagcgccatgttcagggattcgatcgactccatgtccatgtggttggtcggctcgtccatgatcatcacgttcggcttctgcaggatcagcttgccgtacagcatgcggcccttctcgccgcccgacagcacgcgcaccgccttgcccacttcgtcgccgccgaacaagagccggcccagcgtgccgcggatcacctgctcgtcgtcgccttcctggccccactcgcgcatccactcggtcagcgtcatgtcggagtcgaaatcggcttcatggtcctgggcgaagtagccgatctgcgccttttccgcccacttgatgctgccgtagtcggcgctcaggccttcggcgaacttggcttcgaaggcgccggccaacagcttgaccagcgaggtcttgccggcgccgttcggcccgatgacggccaggcgcgcgccggcttccagaatcaggttcaaatccttgaagagcaccttgttctcataagccttgttcaggctctccacctccaccgcctgacggtgcagcttgaacttgtcgtccatttcgaagcggatgaacgggttctggcggctggatggcttcacttccaccatctcggacttcagcttgtccacctgcttcagacggctggttgcctggcgggccttggacttgttggcggagaagcgggccacaaactcctgcagctcctggatccgctccttggccttgctgttggacgacagctggcgctcgcgcgcctgagccgacgcgatcatgtagtcgtcgtagttgcccgggtagatgcggatggtgttgtagtccaggtccgccatgtgggtgcacaccgagttcaggaagtggcggtcgtgcgaaatgatgatcatggtggagttgcgctcgttcagcacatgctccagccagcggatggtgttgatgtccaggttgttggtcggttcgtccagcaacaggatgtccggattggagaacagcgcctgcgccagcagcacccgcagcttccagcccggggccacttcgctcatcgggccgaaatgctgctccaccggaatgccgacgcccatcaggagctcgccggcgcgcgcctcggcggtgtagccgtcgtactcggcgaacttggcttccagttcggccgcgtgcatgtaatcgtcttcggtggcttccagattggcgtagatggcgtcgcgttcgctcatcgccgcccacatctcggtatggcccatcatcaccacgtcgatcacgcgctgatcttcgtagccgaactggtcctggcgcagtttgccgaggcgcaggccgttttcgatggccacttcgccggcggtctgttccaggtcgccgcccagaatcttcatgaaagtggatttgccggaaccgttggcgccgatcaggccgtaacggttgccttcgccgaatttgacggaaaccttctcgaacaagggtttcacgccaaactgcatggtaatgttgcttgtggtaatcacgctgtgggatccttcagccagctcgccgtaagtatcggaaaaacgtaggattctagcacaatcgcccggcattcccgaagcccccgccgccgcttcgccacgaacttttgccagccagacgaattccgctacaatcgtaaaccttgtaaatccttatcccagataggcagaactatgcttaccggcagcttggtagctctggtcacaccgatgtcgcaggatggcgcggtggacttcgcagcgttgcaacgattggttgagttccacatcgaaaacggcactgccggcatcgtcgccgtcggcaccaccggcgaatcggccacgttgtctgtggaagaacacatcgaagtggtcgccgccgtagtcaaatacgccgccggacgcgtcaaggtcatcgccggagccggcggcaacgccaccgccgaagccatcgaactgggacagcgctcggccgacgccggcgccgacatggtgctgtcggtggtgccctactacaacaagcccacccaggaaggcatctaccagcacttcaaggccatcgccgacgcgagcccgctgccggtcatcctttataatgtccccggccgcaccgtcgccgacatgagcaacgacaccgcgctgcgcctggccgagcacccgaacatcgtcggcctgaaggacgccaccggcgacatcggccgcgcctgcgacctggcgctgcgcgcgccgaaggatttcgcgctgtactccggcgacgacgccaccggcatggcgttcatgctgtgcggcggccatggcgtgatctctgtcaccgccaatatcgcgcccaagcaaatgagcgcgctgtgcgtggccgccacctccggcgacgcgcgccaggcccgcgcgatcaacgacaagctgcaaggcctgcacaagcagctgttcatcgaacccaaccctatcccggccaagtgggccctcgtccggatgcaacacatccgcgaaggcatccgcctgccgctcaccccgctcagccaagctgccgaggcagccgtcgaagcggccctgaaacaagcagaaatcctttgatcatcccctgcacgatgggagtccgcatgaaacacagcgcgtccgtcgcgattctgttggcaactggcatgatggccgcttgcagcaccccgcaaccgcttagcaagcctctggattatcagtccgacgccccgaaagccacggctaacagcctggaggtgccgccggatctgaccaccccgcagatccagaacaagtacaacctgcccggcggcgtcacgaccgccagcgccgatcccgccgtcgccgccgccacgtccccgatcgccatcaatcaactggacaaggtgcgcatggagcgcgccggcacccagcgctggctgctggtcggcgacaaaaaggccgccgaactgtggccggtgctgaaggccttctggcaagaaaacggcttcgtcatcaaaaccgaagacccgagcgtcggcatcatggaaaccgactgggcggaaaaccgcgccaaactgcccaacgacggcctgcgcaaactgctggaaaccgtcggcctgggcagcgtctactccaccggcgaacgcgacaagttccgcatccgcctggaaaacacgccgcaaggcaccgaggtttacttctcacaccgcggcatggaagaggtctacgccgacaacagcaagaccaacaccatctggcaggctcgcccgaccgaccccaatctggaagccgagctgctgggccgcttcatgatccgcctgggcatgaccgaagagaaagccaaggcgcaggttcagcaaacgctggccaagccggccaagccgcaagaccctatcgtagacggccaactgcagctggccgacggcttcgaccgcgcctggcgccgcgtaggcctggcgctggaccgcgtcggcctgatcgtcaccgaccgcgaccgctcgcaaggcctgtactacgtgaagccggccaagggcgagaccgacagcaaggaagactccggcagcggcttctggtccagcctggctttctggaagagcggcgacggcaaggcggtgaaaccgaccgagcaggaataccgcatcaagctgctggaacagaccggcggcagcaccacgctgcaaattcaggacaagcagggcaagccgctgtccgacgacttcgtcaaagccgcgctgggcaagctgcaaaccgagctgcaataacgcaacaaccggcaggcgaaaaaacaacagcccgcgatagcgggctgttttttatgctggacacatctgtttatcaggcagaatggggctgaggccctaattacaaccactccgcgccatgcgggccgcaatatgtaacgttttgtattcggcggcaatatctgtggcttttccaccaaatttacaactatcgctaacaagccgccggaagacagacgcaaaaaaaccggccgaagccggttttttcgatgttgctcgccgcgaattacttagcagcggaagcagccggagcggaagcgtcagcagccggagcggaagcagccggagcggaagcttcagcggccggagcggaagcggccggagcggaagcttcaactgcgggagcggaagcttcagccggagcttctttcttaccgcaagcggacagggctacggccagcagggcagcaacgaggagcgactgtttcattttttctttacctttgaggataagttgaacaagacgtcagttatcgcacggtctcgacaataagccgggcgactgaaaatccatcagtgagcaaattgtatcacgaaaaaaatagctgtatagagggcaaaaatctaaaaaaaccacattgccaatctaagccgggcaatggatggcgcggacacaaaaacgggcgtttaccccccaaatgcagccgtccatcgcgttgccgattcgatacaagcgcaaaaactgttgctattgtgctacatcagtcagcaaatgccaataacctgacagatagccatcgtacaaagaagccagcatatcggccgagaatgtccccggcgccagcttgcgctggttggcgaattgccgccaatgcgcgaaatcgccggcgtccgccgccagtttctcgccgttgcagtagacgcagtcgtcgcagaacaggatctggctcttgcgatccagcgccagcccctggctcgccagcgcctcggcgaactcgtcctcgtccagttcctcctccggcgcatcgtagaacacatgcgccttgggttcggtcagatagtggccgagaaagtcgcataccgtgtccttgtcccagcggatgcgcgacagcaggccggacacctgttcaatcatttccgcgctgatgcgcgcaggatcggcttgcagcttcaggttcgggtcggcgtacacgccgtccaggcacatccggtcctgcagatagaccaggaactgggtcgccagctcctgcgcgggcggcgcgcggaaacctatcgaataggtcatgcccggctccagcgccacgccgtggtgcgcatagtgcggcggcaggtacagcatgtcgccgtgctccagcacgaactcctcctccacccggaagtctttcaatacgcggatgggggcatcctcgatgaaatcgtcgtcgtgctgcgccgagatctgccagcgcttgcgcccgcccacctgcagcaggaacacgtcataggcgtcgaagtgcggccccaccgtgccgccgggcggcgcatagctgatcatcagatcgtccagcctggcataagggatgaaattgaagcgccacagaatctcgtcgatatgcggcagatggtggttcaccccctgcaccaacagggtccagtcggtttccgccagccggcggaaacgggaagcgcggaacgggccccgctccagatgccagcgcccccgcttgaattcgatgagcctggactccgcgtcgtcgcgctgcgccagctcggacaaaacggagaaatcgacgtgcgggccgacatcggtcaaggcgccgcggatcagcagcggcttcttgtgccagtattcggccaggaattgttcgggcgacatgccgcccagtagagttgtcgtgttcattgcggtgtcacgggacctaagatgcccgtctatggtttacaatacggccaggcgcgcgagcgcgctatcttgcggtggaaggaacaccctcgggaccgtccctgtcaagtttttttcaccatccctcacggatatccaactcatgcaaatcgccaaaaacaccatcgtcaccctccactacgagatgttcgatgtcgacaacaacctcctcgacaagaccgaagagccgatcagctacctgcacggcggctacgacggcatcttcccgctggtggaagaagcgctggaaggcaagaacgttggcgaatccgtcgacgtgaagctgactgccgacgacgctttcggcgatccggaagaagagctggtccgcgtggaagacctggaagtgttcccggccgatgtcgaaatcggcatggtgttcgaagctgacgatccggaaaccggcgaactgctgctgttccgcgtcaccgacatcgccgacggcaaggccatcgtcgacgccaaccacccgctggccggccagagcatccgcttcgccgccaaggtggtggaagtccgcgccgcctccgccgaagaaatcagccatggccacgcccacggcgaacacggccatcatcattgatgcgccgcgggcggcatgaaacgccatagccgccccagggcgggcccggaggcccgcccttgtcttttctagtggcccgagcggcccagcctgacaaatccccacagcagcacggcggccccgatcgccacccgcagccagtactcggcgaacactccgtgatgtcccaattgccaggccagcgagccggccaacagcaccagcaggatcatccaggcggtccgggtgatgtcgcgcgcccagccgccgggccaagcgtggcgcagcgccagccgcatcgtcgcccagcccagcaaggcgccggccaacaggtccagcggccaatgcacgccgatggcgatgcgcgacagcagcaccgccgccgccaatagacaccaggccgcggcccagccccacctcgcgccatgccgggcgaaggtggccagcgccgccgccgccatcgcgtggccggatgggaaagagccgttgcccggcagacggtccagcaaatccaccgcccccggcggcagcaccagcggcggcctgggcaccgcgaagccggccttgagcgccaccgccagcacgatggcggcgacgctgcccgccagcagcgccggcagccgttgcggcgcgcgccagctcagcgcgagcagcaaggccagcaccgtcggccaatcgccgaacacgctggcgaaacgccaaaacggcgcgggcagctgctgcagccagggatggagcgccagaaacaattgccggttggcctccggccacagcgcgaggcaggcgatcggcggcgtcagcagccacgcgggccagcaggatttccatcgcggcgacatcgctcagcccgctttgcgcccgatggtgacgcggtcctggccggccaggtcgcggatggtttccacctggctcaaaccagagtcggcaaacagcgccctcaccgcctcgccctgatcgtagccgtgctcgaccatcagccagccgccgtcggccagccgcgccggcgcgccggcggcgatctcgcgcaggcaggccaggccgtcggcctcgtcggtcagcgcgccgcgcggttcgaagcgcaggtcgccttcggccagatgatggtcgccgcgctcgatatacggcggattggacacgatcaaatcgaagcgagcgtcggcgtccagcggggcgaaccagctgcccagccggaaatcgacgcgggcagccagcgcatcggcattgccgcgcgcgacagccagcgcgtcggcggagacatcgaccgcccccaccgaccagcccggcgcttccagcgccagcgtgacggcgatgatgccgctgccggtgcccagatccaccgcccgcgccggagcggctggatcgacgcgggccagcgccagctcgatcaaatgttcggtttccggccgcgggatcagcaccgccggactcacctggaaatcgcggccgtagaattcgcgcgcgccaatcagataggccataggctcgccggccagccggcgcgcggccagcgcgtcgaaagccgcggcgatatcggcggccagctcgcgttccgggtggccgacgatggcggcatgcgtcaggccgggccagacgcgcatcagcagcatgcggctttccagccgcggcagggagtggcggcgcagcgcctgttcgatagtcagcatcatgtatctacaataggaatagcgtggcgaggccgaggaaaatcaggaagccgccggaatcggtgcaggcggtgatcagcacgctggaacccagcgccgggtccttgcccagcttctgcatcagcgtcggaatcatcacccccatggtggcggccaacatcaggttcaacgtcatcgccgccagcatcaccagtcccagcgaggcgctgccgtacagcagccaggcgatggcgccgatcacgctgccccacaccatgccgttgatcacgctgacgcccagctccttgcgccacagccggccggtctggcccatccgcatctggcccatcgccagcgcgcgcacgatcatggtgatggtctggttgccggagttgccgccgatgccggcgacgatgggcatcaaggccgccagcgccaccaactgcgcgatggagtgctcgaacgcgcctatcacccgcgaggcgaagaaggcggtgcaaagattgatcgccagccacgaccagcggttcttcaccgaatccatcaccggcgcgaacaggtcttcctcttccttcaggccggccaggttccgcacttcgctgtcggactcctcgcggatcacgtccaccatcgcgtccaccgtcagccggcccagcagcacgccgcgctcgtccaccaccggcgcggtcaccaagtcgtagcgctcgaacgccagagcggcgtccagcgccgcctcgtcggggtggaagctcaccacctcggtggccattgcctgcgccacttcggcgtcggggtcggacaccagcagcttgcggatggacagcacgcccttcagccggccggcttcgtcggtgacgaagatcttgtcggtctggcccggcaattcgtcgaagcgccgcaggtagcgcagcaccacttcgcagctgacatcggcgcggatggtcaccagctcgaaatccatcagcgcgccgacgcggtcgtcgtcgtaggacagcaccgcctgcaactggccgcgctcttcctcgtccaaccgtcccatcacctcgtacaccacctggcgcggcaggtccggcgccagttcggccagctcgtcggcctccaggccgctcaccgccgccaccagccgttcctggtccatcacttcgaccagcgattcgcgcaccgcgtcggacacctccagcaggatggcgccgccgcgggcggcctcggccatgtcccaggccagcaggcggtcctccagcggcagcgcctccaggatgtgggcgatgtcggccggatgcagctgcgccagcttctggcgcaattcggtcagattatgttgcggcgccaggccgtcggcggccgcggattcggccgcgtcctggcgcgatacaagatgttccagctggcgttggcgctcgatcaggctttgcaccaggcccaggctttcttgcagacgatcggcggattgttgcttgtaggcaaccgtcatgcacgtctccttccgcccacagggcgcacaaggtgcagacggtgtgaggcgggcttattcgctaagggtgtaacgggattggattacgggataactgggtaagtccattgcgctcaccgcggcttgcgcgcggcaaccggaaagaaagtcgcgattgtaacatatcgtcaaaatcggctccagccggcccctgccggggccggccgcggcgcggctcagggcaattcgacgtaagccatgcgccgctggatgatgcgggtcttccgcgccaggcccggcgcgttgcggtgggcgtcgtaatagcgcggattgggcaccatcgccgccagcttggcggcctgggacgaggacagcctggccgcgctggtatggtagtagtagcgcgcggcggcctcggcgccgaacacgccgtcgccccactcgatcacgttgaggtagatctcatagatgcggcgcttgtccagcaccgcttccagcatcatggtgatcagcgcctcctccagcttgcgccacggcgtcttgccgctggacaggaacaggttcttggccagttgctggctgatggtagagccgccggcgacgatcttgcccttcttcaggtttttctcgaacgccgcctcgatgccgtcccagtcgaagccttcgtggtcgacgaacctggcgtcctccgacgcgatcagcgcccgcttcagattcggcgagattttcgcgtacggcacccagcgctggctcaattcggcgtccggatcgtcggcctgcatcttggccagccgctcgttcatgaaggagctggcgctgggattgtggtcgcgccaatagacgacatggccgaacacccacaggttatacagcacaaaagcggccaccagggccgccaggatcttcaacaggatgcgcgacatgctcaggctaacacttccctcagcatattggtcaccttgcgggtgtcgggctggatcccgcgccagatggagaaggactcggccgcctgctccaccagcatgcccaggccgtcggccagcatgccggcgttttcgccctgtgcccgctgcagaaaaggcgtcaggccgctgctgtacaccatgtcgtatgccagggtgcgggcggtgaacacgccatgcggcagcggcggcatctcgttgctcaggctggtggaggtggcgttgatgatgatgtcgaagctgcggcccgccagcgcgtcgtagccgaccgcctccaccttgccgtagcgggcgaaatggtgcgccagcgcctcggccttgatcacggtgcggttggcgatggtcaggctggccggcttttgctgcaggatgggctccagcacgccgcgcaccgcgccgccggcgcccaggatcagcacgcgctggccggcgatcgggtagtccaggttttccacgatgtcgcgcaccaggccgacgccgtcggtgttgtcgccgtagaccttgccatcgcggaaggtcagcgtgttcaccgcctcggcggcgcgggcgcgctcggtcacttcctgcgcgaagcggaaggcgtcgcccttgaacggcagcgtgatattgagacccttgccgcccgcggcgacgaaggcctccacctgcgggcggaaggcgcccagttcggcgaacagcttttcatagctgatgtcctggcccaaggcccgggcgaactcctgatggatgaacggagactggctgtgcgaaatcgggttgccgataacggcgtaacggtcggtcatggtcggctttccaaaatgtgcgccgcgcgcggcggcgggttcaggccacactttgccgcgttacgccgcaaacttcaaccgccgccgtcaatcctgtcagccctgcatccagggcaggccgcgctggcgccagccgccgacagagttgcgatggccgctggcgtccagatcgccctcgaagccttccagcacgttgtacacctcgctgtagccgttggccgccgccagccgcgccacttggtcggagcgcgcgccggagcggcacatcaccagcagcaccgcctctggatccacctgatgcgtcagctgcgccaggaaattggggttggccgccatgcccgggtagcttttccattcgatgttcaccgcgccgggcaccgtgccgacgaactgccattcggcatggctgcgcacgtccagcagcaccgtcttgggcaaggactgcagcaattcataggcttcatccggcagcagcgcgccgctgtagggcagaccggagcgctcggcgcgctgatgggcggtttgcagaatctgcttcactttgctcatgctgttttcctcctgcaataaggatggcgtatgttgccgattatctgcccactcgccgcgactggcaattcgcaccaagttagtgcatggcaaaacagccagcaccaggatggttcacaattcggcattccagccggctggctaaggctatccgcctatgacacaatgcaacagcagcgattttggagctggcacgcttcctgcttaaagccgggcgtaccgattttttcgcacttgcccttgggtgcacgttgcctttcaggagataaaccatggcagtagccgacgtagtcaagctgatccaagaaaacgacgtcaaatttgtcgatctgcgctttaccgatacccgcggcaaagagcagcacgtctccatcccggcccatgtgctgctggaagacgccgacgcctggttcgaacgcggccacgccttcgacggctcctccatcgccggctggaaaggcatccaggcatccgacatgctgctgatggccgacccggccaccgcccgcatcgacccgttcttcgacgagccgaccgtattcatgtcctgcgacgtgatcgacccggccgacggcaagggctacgaccgcgacccgcgctccatcgccaagcgcgccgaagcctatctgaaggcctccggcgtcggcgacaccgcctacttcggcccggagccggaattcttcatcttcgacagcatcacctggggcaccgacatgtccggctgcttcgtcaagatcaaggccgaagaagcggcctgggcctcggctgaagaattcgaaggcggcaacatgggccaccgtccgggcgtcaagggcggctacttcccggtgccgccggtggattcgtcgcaagacatccgctccgcgatggtgctgctgctggaagagctgggcgtgccggtggaagtgcaccaccacgaagtggccaccgctggccagaacgaaatcggcaccaagttcagcacgctgacccagcgcgccgactggacccagatcctgaaatacgtggtgcacaacgtcgcccacagctacggcaagaccgccaccttcatgcccaagcccatcgtcggcgacaatggctccggcatgcacgtgcaccaatcgatctggaaagacggcgtcaacctgttcgccggcgacggctacgccggcctgtccgataccgcgctgtactacatcggcggcatcatcaagcacgccaaggcgctgaacgccatcaccaacccgggcaccaactcctacaaacgcctggtgccgcactacgaagcgccggtgaagctggcctattcggccaagaaccgctccgcctcggtgcgcatcccgcacgtggccagcccgaaaggccgccgcatcgaaacccgcttcccggatccgctggccaacccgtacctgtgcttctccgcgctgctgatggccggcctcgacggcatccagaacaagatccacccgggcgacgcggccgacaagaacctgtacgacctgccgccggaagaagacaagctgatcccgaccgtatgcgccagcctggacgaagccctggcggcgctggacaaggaccgcgagttcctgacccgcggcggcgtgttctccaacgattggatcgactcctacatcgagctgaagatgcaggaagtcaacctgacccgcatgaccacccacccggtggaattcgcgatgtactactcgctgtaagcgccaagcgcccatgcgggaaaaacggcagcctcggctgccgtttttttgcgccccggcctcaagcatatatgacgcagaccgccgatttgcttatcatggaagcgcactctaaccagcctccgacgatgaaaacattagcccttctcctgctgctggcctgcggcggcgtccaggcggccaccatctacaagtacgtggacgccaacggcaacgtcacctacaccaatgtgccgatccgcggcgcgcagccgatcaagctgaatccgctttcatcctaccccggcggcaagagcggcggcgcctccgccggcaagccggccgcgtccggcggctaccccagcgtggacgccaatatccagaagcagcgcgacaatggccgcaagaaaatcctggaacaggaattggccaacgaggcgaaggcgctggatgccgccaagaaggcgctggccgacggcaaggccacccgcctgggcgacgaggcgcgcaactaccagaaatacctggaccgggtgcagaaactgcaggacgaggtcaccgaccgccagaagaatgtcgaggcgctgcgccgcgagctgggcatgtgatggcttaacgcaccagtttagtgcaaacttaagccgccgcgccgcgtccgcgcgccattccgtcccgctccggggctggcccgcttattgctgggcaagatggccgcggccgcgcccaccacccgaaaccggaaccccatgcccctacccagctttgccggactggaactgctagacaccccggtgctcatctgcgacgccgcagcctcgctgcgcttcgtcaaccccgcctgcgaaaacctgctggcgctgggcagccgcgaaatgctgcgccacagcctgctggagctgttccagccctgccccgcgctgcgccaggcgctcaccaccgcgctgctgcaaggcgccagctacatcgagcacgacctggaactgaagccgcagcacaacgacgccgtgctgcacgtggcgctgaccatcaccccggtagacgccgacggcagcctggcgctgatcgaactgcggccgctggaccagcagctgaaaatcgccaatgaggagcgctctctgctgcagcaccaggccaaccgcgagctgatccgcaacctggcgcacgaaatcaaaaacccgctgggcggcatccgcggcgcggcccagctgttggagcacgagctggccgaccgccccgagctgaaggaatacaccgcggtcatcaccgaagaggcgctgcgcctgcaggcgctggtggaccggctgctggcgccgcaccgcagccacagccgcgcgccgatcaacatccacgaggtgctggagcgggtgcgcagcatcgcgctggcccagcatccgcaaggcctggcggtgatccgcgactacgacaccagcctgccgctgctgtcggccgacaaggaacagctgatccaggtggtgctcaacatcgtcaacaacgcggtgcaggcgctgcgcggccagggccgcatcgtgctgcgcacccgggtggcccgccagatcacgctggcgcgcaaacgccaccagctggcactgaaattgcaaatcgaggacaacggccccggcgtgcccgacgacatccgcgaccacatcttctacccgctggtcaccggccgcgccgaaggcaccggcctggggctgacgctggcgcaggccttcgtccaccagcacggcggcagcatagagttcgaatcgcgcccaggccagacctgcttcaccgtgctgctgcccttcgccgccgacgcggcgagctgacacctaaaagaacgctcaggagacacgcaatatgaccaagccggtctggatcatcgacgacgacaaggcgatacgctgggtgctggaaaaggcgctgacccgcgccgagatcggcttcgacagtttctccagcgccgacgacgcgctgaacgcgctgtacgacgccaccccgcaggccatcatttccgacatccgcatgcccggcaccgacggcctgaaattcctggccaaggtgaagaacgagcatccgcagctgccggtgatcatcatgaccgcccactccgacctggactccgcggtatcggcgttccagggcggcgccttcgaatatctgcccaagcccttcgacatcgaccaggcggtgctgctgatcgagcgcgcgctggcggaaagccaggcgcaggccgccggcccggacagcccggaggcgatgccggtgctgctgggccaggcgccggcgatgcaggacgtgttccgcgccatcggccggctggcccagtccagcgtcacggtgctgatcaccggcgaatccggcaccggcaaggaaagggtggcggaagcgctgcatcgccattcggtgcgctcaggcaagcccttcatcgcgctcaataccgcggcgatcccgaaggacctgctggagtcggaactgttcggccacgaaaaaggcgccttcaccggcgcgctggccgcccgccgcggccgtttcgaggaggcagagggcggcacgctgttcctcgacgaaatcggcgacatgccgaccgagctgcagacgcggctgctgcgcgtgttgtccgacggccatttctaccgcgtcggcggccacaccccgatcaaggccaatgtgcgggtgatcgccgccacccaccagaacctggagcagcgggtgcgcgacggccagttccgcgaagacctgtaccaccgcctcaacgtgatccggctgcggctgccgccgctgcgcgagcggcgcgaggacatcccgctcctgacccgccacttcctggccaagagcgcgtcccagctgggcgtggaggccaagcgcctgtccgaggcggcgatggcgctgatccagcgcagcgccttcagcggcaatgtgcgcgaactggaaaacctgtgccagtggatctgcgtgatggcgccgggccagacggtggaggtggcggacctgccgccggaattgcgcgacccgcagggccagccggccgctgcggcggcatccggctgggatcagcaattggccgaggaaatccgccagcgcctgctagccggcgaaaccggcatcgtcgacgagctcacccaccgcttcgaaagctgctgcatccgcgccggcctcgcccacaccggcggccggcgggtggaggcggctcacctgctgggctggggccgcaatacgctgacgcggaaaatccaggagctgggcctggaccatggcgatccgagctgacaattattaatcatacaattccaagcagccggcatcatctttaagcaatactgatagaatcgggccaaatccctcttgcccgattcatccgatgccacgccttgtcctcgctctggcctgcctgacgcccctggccgcgccggccgcgccgctgcagatcgcgatcagcgacgcgctcaccagcccgtacgtgatcgaagatccgtccgccgccgcgccgccgcgcggccgcgccatcgagctggcccaggccgcgctggagcattgccggctggagggcggcttcaaccgccaacccggcgagcgcatcgtgcagaatctggcgctgaaccgcatcgacagcgcgctgctgctgtcctacaagagcgagcgcgccggccagatggcctttccgatgcgcgccggccaggccgacccggaacgccggatggccaccttccactacgcgttctatgtccgcagcgacagccgcctgcgctggaacgggcgcgcgctggtcggcctcgccggcgcggtcggcatcaaccagggctggtcgataggccgcgacctgctgtcgcaaggcatcccggtggaggaaagccacggcatcgccgacaacttcgccaagctgcaggccggccgcaccgacgcctacgcattgcatcagctggccggcgacctctacctgcgccaccacccggagctgaaaatccgccgcctgtcgccaccgctgcaaagcaagacctattactgggtgttcagccgcggctacgccagccggcatccacagcaggtggactgcctgtggcggcaaatgccggccctgcgcgcgcgctatctgccggaaagcgtcgccgcgcgctgactcagccgtagcgcgccagctcgcgggcccaatccagcctgccgtcctcggccggcgccggcgccgcgtccagcaactgcggcggcacgaaccagcacacctcgaacagcagcccgtccggatcgtggccgtagacgcttttgtgcacgccgtggtcttcctccatgcccagcttgccaagcgcggccagctcgtcgcggatgcgcttcaattccgccagggtgtccacctcccaggccaggtggtacaggccggccttgggctgatgcgggtccggcgcctcgccgcgcgggctgaacgggccggagcgttgctggcccagattgcggctgaacagcgccagatcgtggtcgttgtccgaatgcgcggcctgggtgaacaccgcgcggctggagccggcgtcgcccttggggcggaagcccagcacatcgcggtagaaagcggtgctgccggccacgtcgctgacgtaaagcacggcgtggttgagtcgtttgatgcccatatcgattcctgtgatgcccattgaaatggccagccctgatcggccggccgcagccggctgttcagatatgcctggcccaggccgcgcaagggcggcggcgcgcaggccagccagcggttgaaatgcgggcaggcgcttgccgccgacgcgcgcggcgatgccgcccagcgcccccccgtccattcccgccttcgtttccgcggcccgcaccggcattctgaatgaataaaccgcccggactcaagccggcaaaggcgatagtcccggcaggctggcgaagctgcagtcccgcaccgtctgcagaaagtcctgcatgtaggcctggccggcgtcgtcgccgcgcagcgccgcgtacagctcgctctgcaggcccgcctcccctacctggcgcgccaccacgtagccgcgctccaggtagggctgcaccgtccagtacggcagcaccgccaccccgcgccggctggccaccagctggatgatggcgatggtcagctcggcggtgcgccgcgccgggttgacgccggccggcagcagcaccttgcgcagcagatccagcatatcgtccggcaccgggtagtggatcagcgtttcgccgacgaaatcctcggcccgccagcaggccttgccggccagcgggtgttcgcgcgcggcgatcgccaccatttcgtaggcaaacagcggttggtggacgatgccggcctgcgcctcggcctcggacacgatggcgagatcggcgcggccgctcagcagcaggcccaccgggtccgcgtggaagcccgacacgatgtccagctccaccgccggccagtgctggcggaactggtccatcgccggcatcagccagtcgaagcaagtgtggcactccaccgccacccggatttcgccggcctcgccctggcggatgcgcgccaggtcgcgctcggccgccgccacccgcgccagcagatcgcgggccaaacccagcagccgctcgccggccggcgtgaagcgcaagggctgggtcttgcgttcgaacaaggccaggccgtacgccgtctccagctgtttcaactgatgcgacagcgccgactgggtcaggtacacccgttgcgcggcctgcgacacgctgccgctttccgccagcgccagcaggcttttcaaatgcctaagctccagcacgctcatcatcgattccattcatgctgaacaacaaaataatgagtttgaatcatacatcacaatgacagatgcttgttccatcacgacacaaggagcaagcgatgaccaccacccacctgccgggcttcccccgcatcggcgccaagcgcgaactgaaaatcctgctggaaagctactggaagcgcgacatcggcgaagccgagctgctcgccggcgcgcgcgaactgcgccaacgccactggctgctgcaaaaaggcgccggcgtcgatctgccgccggtcggcgatttctcgctgtacgaccatgtgctggacgcgcagctgctggtgggcgccgcgccggcgcgcttcggtttcgccgccgacgccatcgacactgagcgctacttccagctggcgcgcggcaatgccagccagccggcgctggaaatgaccaagtggttcgacaccaattatcactacctggtgccggaatggcaggcagacaccgcgttccgcgcccagccggagcggctgctcggccaggtccgcgaagccctggcgctgggcgtgcgcgccaagccggtgctgctcggcccgctcagcctgctgtggctgggcaagtgcaagggccggacgttcgaacggctgcaattgctgcccggcctgctggccgcctatcggcaaatcctggccgcgctgcgcgaagccggcgtggaatgggtgcagatcgacgaacccattctggcgctggacctgccgcccgcctggctggacgccttcccggccagctaccggcagctgcaagccgacgcgccggccatcctgctggccagctacttcggcggcgtggccgagcatgccgatctgctcaaggcgctgccggtggccggcctgcacctggacctggcgcgcgcgccgcaacagctgtccgccttcttggccggcttcccggccgacaaggtgctgtcggccggcgtcatcgatggccgcaacgtctggcgcgccgacctgtccgccatcctgcggcagttgcaggccgcccacgcccagctgggcgaccggctatggctcgcgcccagctgctcgctgctgcacagccccttcgacctggccgccgaaatcgcgctggctcccgatatcaaagcctggctggccttcgcggtgcagaaactgaacgaactgagaaccctgcagcgcggcttgcggctgggccgcgacgccatcgccggcgaattggccggcagcgacttcgcccaacaacaaaaacagcacagcccgctgatccaccttcccggggtgcgccagcgcatcgccgcgctgcccaccggcgccgaccgccgcgccagcccctacccggtccgcgccccgctgcagcaggcctggctgcgcttgccgccgctgcccaccaccaccataggatccttcccgcagaccgcggccatccgcgccagccgggccgcctacaaacgcggcgaactggccgccgccgactatcaaaaagcgatggaaggcgaaatcgagctggcgatccgccgccaggaagcgctggggctggatgtgctggtgcatggcgaggccgagcgcaacgacatggtggaatatttcggcgagcagctgtccggcttcgccttcaccgccggcggctgggtgcaaagctacggcagccgctgcgtgaagccgcccattctctacggcgatgtcagccgccccgcggcgatgaccgtggactgggcgcgctacgcgcaaagcctgaccgccaagccggtgaagggcatgctgaccgggccggtcaccatcctgcagtggagctttgtccgcgacgacctgccgcgcagcgaagtctgccgccagatcgcgctggcgctgaacgacgaggtgcggggtcttgaggccgccggcatccgcgtgatccagatcgacgagccggccatccgcgagggcctgccgctgaagcgcgccgaccgcgacggctacctggcctgggccggccaggccttccgcctgtcctgccacggcgtcgacgacgccacccagatccatacccatatgtgctattcggaattcggcgacatcctgccggccatcgccgcgctggacgccgacgtgatcaccatcgaaacctcgcgttcggacatggcgctgctggcggacttcggccgcttccgctaccccaacgccatcggccccggcgtctacgacatccacagcccgcgcgtgccggcgccggcggaaatccgccagttgctggaaaaagccttgcaagtgattcccgccgcgcagctatgggtgaacccggactgcggcctgaaaacccgcgactggccggaggtggaggcggcgctggccgccatggttcaggtcggccgggagttgcgggaggagatcgcgccagcggtttgagcagcgcaaaagcagacgccccggacaagccggggcgtcttggtagggggagggggctgttcgtccatcacggctccagcattcccggcgtcagcatcaacttcagcctgatctgttccatgccgtggcgctcgcggcggttcagccaccacaccgagcccttcttcacgctccacagctgctgctgttcagccagcaggcgcgccgccagccagccgatatacggctgatggccgaccagcaccaccgcgcgctccgcatccggccaccccaccgccgccagcacctcgtccacatcggaaccgggattcagctccggcagcacggtatagctcttggccaggtagttggcggtctgctgcgaacgcttggcttccgaagccagcagcaggtaattgtcgggcaggcgctggcgcagccaggacgccatctggctggcctgctgctggccgcgccgggtcagcgcgcgcgacagatcgtcggcgccctcttccgcttcggcatggcgccacaagatcaaatccatatcgttctccttttctcgccggcggcttgtcttcacgccaagccaaccgcgccctgcatgctaaccgacctgcagccagcgcaccagccatggcaacagcatcgcagtgaacacgccgttcaggcccatcgccagcccggcgaaggcgcccgcggcctcggagagatggaatacccgggcggtgccgataccatgggcggtgacgccggtggccacgcccatcagcatgtcgtcgtcccagcccagcagccggcacagcggcggcgccagcaccgcgccgacgatgccggacacgatcacgaacattgccgccagctccggcgcgccgcccagcttgccggccaggctcatcgcgatcggcgtggtcaccgcccgggtggccagcgacaccagcaccgcgtggtccaggcccagccaccagcccaggccggccgcgcttgccatgccggccaggccgccgacgcagacgctgagcagcaaggggacggcggcgcgcttgagccgcggcagattgccgtacagcggcaccgccagcgccacggtggccggccccagcaacagctggatgaagcgcgcgccgcccatgtactgctgataactgctgccgctcagccacagccatagcagcaccatcaacacgcccagcagcaccgggttggccagcgggtggccatggctgcgccggctggcggccagcgccagccggtaggccagcagggtgacgaaaatgccggtcagcggcgaatccagcacggcggagggcaaaatcgggatcatctgcgcctcccccgcaacaacagcttgagcatgccggcgctgaccagcgcggtgagcagcgtggacgccagcagaatcagcagcagctgccagccatggctgcgcagcaagggcgcgtaggccagcaaggcgccgcccgccgggatgaacagcaaggacatgtggccaagaaaacgcggcgcctcgcgctgcagcgtggccggcaccgcccggcgcagccacagggtggcgaacagcagcagcatgcccagcaccgggccgggcagcggccagccgaaatgccgcgccagcgcttctcccaatagttgatacgccagcagccacagcaacaggtccagcatctcgcctccctcggttcacgcggctttcatgataacggcaagccggccgcgccgggtagcgacaagcccgctcggcttttggcataatgcgcgccatggttaacgatgcccaatggcgctgcgcgccgcccgtcctgcccgcccccttactggattgtctgaccgagcccgcctcgctcagcctgcgcctgcaggccggcggccgccgtttcgccgtgcgggtgctggaccagggcgacagccgcgcgctgcccgacgaggccgaggcgctggatctgccgtccggcgcgccgctgtacgcgcgccatgtgctgctgacgctggacgagacgccggtggtgtacgcccgcagcgccacccgccacgactgccccgcctggatgccggtgctgatgcgcggcagccgctcgctgggcctgaccttgttcggcgaattgcccgcgctgcggcgcgagccgctgcattaccaattgctggacagccgccatccgctggcggtagaagccgccgccgccgaagccgccgagacctacccggcgcggcgctgccgcttcctgctggacggctcgccgctgctgctgaccgaactgttcctgcccgccctgaaggatttactgtgatctcgtccgccaccctccgcgaccgctacgacaactacaagcagctgatgcgctgggacaagcccattggcaccctgctgttgctatggccgacgctgtggggcctgtggatcgccgccgacggcaaacccgacgcgctgatcgcggccatcttctgcctgggcaccttcctgatgcgctcggccggctgcgtgatcaacgactacgccgaccgcgatttcgacgcccatgtggcgcgcaccagccagcggccattcgcccgcggcgcggtcagcaagaaagaggcgctgctgctggccgccttcctcgccctgctgtccttcctgctggtgctgccgctcaaccatctcacctggctgctcagcgtgccggcggtgctgatcgccgccagctacccgttcaccaagcgctttttcccgatgccgcaagcctacctgggcatcgccttttccttcggcatcccgatggctttcgccgcccagaccaaccaggtgcccgcattggcctggatcctgctgctggctaacgtattctgggtgttggcctacgataccgcctacgccatcgccgacaagccggacgatctgaagatcggcatcaaaacctcggccatcacgctcggcgactacgacgtcgccgcggtgatggccttccacctgctgttcctggcggtgatggccggcgtggggctgcgcctcggcctgctgtggccctactatctgggactggcgcttgccgccgcgctgatggcgctgcaataccgcgacatccgccaccgcgaccgcgcgctgtgcttcaaggccttcctcgacaacaaccgcgtcggcgccgccattttcgccggcctgctgctcagctactggctgcgctaagccggcgccgatatgccatttacaataaattacatctaaatggcgccgatttcatgaacttccccgcctccccgccgatctgagcatggccgggtcctgtcccggcacagggcatacacgccgataccaataagtcacacaggaaggtgaacatcatgaaaaaactgctgaccgctctgatcgctgctgctttcgctggttccgctttcgccgccccggccgcatccgccccggccgccgaaaagaagatggaacacaaggccgagcacaagaagtcgcaccacaagaaagcgcacaagaaacacgcctccggcgccgcgcatgaaaagcacaaaaaggctgagcacaaggcagcctccgccaccaagtaagccaggcgtaaaaaaagctcccgcaagggagcttttttcatggccgcaccacctagcgcacagtgaacggcagccggtaggcggccttgccgtccttcagctccgccacccagttgcggctgccgctgacgcacatcggcagcgtcaccgtcgctttccagccggcgccgtcgcggacgaagacgtagcggttgaaacccatgtccatgtccggcatcgaaaagtccaccgccggcggcgtctcccccgccaatccgctcagccgcagctcgaacggccggccgtgctcgggcggcgcggagaacgccagccgccccccgcccggcaaggcgcagccgccgcggccgatgtcgcaggacagcgtcagcggtttggccgccgccggtttgttgtgcagataccagtagatcagccccgccttcagcgcgccgaaaacaatcagcgccacgcccagccacagcagcttgcgctgcttggccgtcatcgccaggccccgcgcatcagcgccacgccgtgcgcgccatgctcgcgcgccggcggcagatcttcggcagtcagtccgcccagcgcgtacaccggcaccggcacgccgccggccaggcaggcggcaaagccgtcccaacccaacaacgccgcgtcgggatggctggcggtgggcgccaccgggctcaacaacgcgtagtccagccccagctcgccggcgcgcgccaattcgtccgcgccgtgtatcgacgcgcccacccagtcgaacgcaggccgcgcggtcagcgcggccagccgcgcgcctgtcagatgcacgccatccaccggccagccttccagccaggccggatcggcgttgaccaccagcttgccgccgcgtggacggacgatggcggcggcgcgggcgacgaaatcggccagctcctcatgccccatcccatgctcgcgcacctgcaccatgccccagtcgcgctcgaccagccgcgccagctgcgcctcgacgccgatctcggcggcgcaggtgatcgcatagcaggccggcagctccagcgatttcagtatcggtccgttggccggcagcatcggcgccaccgtgtagcggcccggccgctgccaggcgaaagactgcgcctcgcgcggctgcggctcgccctgccagtcccagatgcggaaaaagcgcaggtggaccgacgcgtgctcgtaatggtggatcttggtcagccacggcgtggcggcggtgacgatgatgcccatttcctcgtgaaactcgcgcttcaacgcctccagcggcgtctcgcccggctccaccttgccgccgggaaactcccagtaaccggcgtagggcttgccctccgggcggctgcccagcatgaaaccgccatccggccgcatcagcgcgccggccaccacctctatgatcttgttgctcgtcatcttttcaatctgtcgactatgggcgcgtgccgcccggattcatttcttgccggcctgcttggccagcctctggctgccggcccaatggctggcgaactgccaggccacccggccggagcggctgccgcgcgtcaggctccattgcagcgccgcgcgctcggccttgtcgccgtatttcaggccgaaatggcccagccactccttcaccgccgccagataggcgtcctggtcgaacgggtagaacgacagccacaggccgaagcggtcggacagcgacaccttctcctccaccgcctcgcccgggtggatctcgccgtccttcagccaaccctcgcggttgtcggccatctgctcggccagcaggtggcggcggtttgacgtcgcgtacaccagcaggttgtcgcagcggcgcgagaggccgccatccagcgcgctcttcagcgccttgtagccggcgtcgccgtgttcgaacgacagatcgtcgcaatacaggatgaagcgctccggccggccggccaccagctccaccagctgcggcaggtcggccaagtgttcgcggtctatctcgatcagccgcaggccatcggcgccgaacaagggcagcagcgccttcaccagcgacgacttgccggtgccgcgcgcgccggtcagcagcgcgttgttggccggcaggccggcgacgaactggcgggtgttggccagcagctgctcgcgctggctgtccacctgggtcagccgcgccagctccaccgtatgcggatcgcacaccgcctccagccagccggccaggccctggcggtgccagcggaaggcttgcgcgctccagtccggctcgcgccgcggcggcggcagcatcggttccagccgggtcagcaccgcttcggcgcggcgcaggaaatcctgcaaggcgtccatcgtttccctttctgcacagcggatgacaaaacagcctgcgacgcgagcggcaggctgtcaaaacgcaacgccggcggcaaagccggcgcccggggcaagcgggccgcgcccggaattcaatcgcgcagcgagatcaccggccagccgtgcgcttcggcatgggcgcgcagcttgtcgtccgggtccaccgccaccggcttgtccaccagcttcatcagcggcaggtcgttgtgcgagtcgctgtagaagaagctggtgccgtagctgtcccagctttcgccgcgctcggccagccattgctcgatgcgggtgatcttgccttccttgaagctcaacacgccggtcgggcggccggtgaagttgccgtcggcgtcctcttccagctcgatggcgatcaggtgctcgacgcccaggtcgcgggcgatcgggccggtgatgaagcggttggtggcggtgatgatgacgatctggtcgccctcagccgcgtgcgccgccagacgttgccgcgccttgttcgggatcagcggcttgatatggttttccagatagtcggcgtgcaattcgtccagctgggcgcggctgaagcgggtcagcggcgccaggatgaaagccaggtactcctgcatgtccagcgtgccgttctggtactggcggtagaaatagctgttgcgctcgtcgtactgggcggcgtccaggatgccgcgcttgatcaggaagcgcggccattcgaagtcggaatcgccggccagcagcgtgtggtcgagatcgaacagggcgagattgcgttgggtgggggtggctgtcgtcatgattccggggtggcggtttgcaaaacgtttttcaccagcggcacggtgatcggccgcctcatcgccagcgagtagcggtccagcatgtctatcatgccgatcaggctggacaggtcgcgccgccagtgggtgagcaggtagcggtagacatcgtccggaatcgacagctggcgcgtggcggcgtggctgcgcaaggcggccagcttgtcgtcgtcggacagcgccttcacttccagcaccagtccccagcccagccgggtgcgcagatcgtcgcgcaccgacaaggccatcggcgggttgcgcccggccatcagcagccgcgattcgccgctttccttcagcgagttgtagaaggagaacagcgtgatctggtcgtccggcgccaggtcgtcgacgtggtccaccgcgatgaagctggcctcgcgcgcgaagtccggcagatggtcgcccttgccgtccagatagatggcggcgcgccccagccgctcggcgtgggcgatccaggcctgcagcagatgggtcttgccgcaaccgggctcgccccatagataaatgaagcgttcgccttcggtggcggtcagggccgtgatcacctcgcggttgcgctcggccaggaaattgtcgaaggccggcagcggcgtgggcgtgagatcgagtacgagctggtccaaagttactgtgctgcgctgtgttttgacatcaattgttcgattttacgccgatacggcccttcggtggaaccgccttttgccgcggcggcggcgacggacgcggcgatgccgccgcccgcgaaaaaccgcccgccgcttttgccagcctgtttgccatttttcagttaaaatacagtgctttcgcaccggcgaaagcttgatgtaaaaatatttcaagtttgcagaaagcgagtttatcttgaataccacgtccctcagttaccgtgatgccggcgtagacatcgacgccggcgacgcgctggtcgaaaacatcaagccttttgccaagcgcaccatgcgcccggaagtgctcggcggcatcggcggtttcggcgcactggtggagatttccaagaagtacaaggaaccggtgctggtatccggcaccgacggcgtcggcaccaagctgaaactggccttcgactggaaccgccacgacaccgtcggcatcgacctggtggcgatgagcgtcaacgacatcctggtgcaaggcgccgagccgctgttcttcctcgactacttcgcctgcggcaagctggacgtggcgcaggccaccgaggtgatcaagggcatcgccgccggctgcgagatggccggctgcgcgctgaccggcggcgaaaccgccgagatgcctggcatgtacgtgcccggcgaatacgacctggctggcttcgccgtcggcgtggtggaaaagagcaaggtgatttccggccgcgacatcgccgccggcgacgtggtgctgggcctggcctccaacggcgtgcactccaacggctacagcctggtgcgcaagatcatcgaccgcgcgcagccggaactggacgcgccgttcgacggcggcaagacgctgcgcgacgcggtgatcgccccgacccgcatctacgtgaagccgctgctcaagctgatggaaaccctgccggtcaagggcatggcccacatcaccggcggcggcatcaccgagaacaccccgcgcgtgctgccggacaacgccgtcgcccagatcgacgccaagagctgggaactgcccaagctgttccagtggctgcagcgcgaaggcaaggtggacacccaggagatgtaccgcaccttcaactgcggcatcggcatggtggtggtggtggcggccgaacacgccgagcaggcgatggcgctgctgcgcgaagccggcgaaaccgtctatcgcatcggcaccgtccgcgagcgccagggcgacgagcaccagacgcagatcgcttaaggcttagcacacgcagccttttgcgcgccgctggccccgccggcggcgcttgtcatttggcggacgccaatccgaacactgatagacaacggcacatgaaaaacatcgtcatcctgatttccggccgcggctccaatatgcaggccatcgtcaacgccggcatcgccggcgcccgcgtcgccgcggtgatcgccaaccgcccggacgcggccggcctcgcctgggcggccgagcgcggcatcgccaccgcggcgctggaccacaaggcctaccccagtcgggaagccttcgacgccgcgctggccgaggcgatagacgcccacgcgcccgatctggtggtgctggccggcttcatgcgcatcctgaccgcaggcttcacccgccgctacgaaggccggatgctgaacatccatccgtcgctgctgccggccttccccggcctgcacacccacgagcgcgcgctggaaatgggctgcaaactggccggatgcacggtacacttcgtcaccgccgagctggaccacggccccatcgtcgcccagggcgcggtgagcgtgcaggacggcgacacgccggacagcctggccgcgcgcgtgctgaagctggaacaccagctgtatccggaggcggtgcgccgcttcgccgccggcgagctctccatcgtgaacggcaaggtggccagcggtccggccgccgcctgcgatctgatgtccccgccgccatcctataaggtttaaatgtcccgccgccgtctgctattgatcgcgctgtttctgtcgctggccctgcacttcgcgctgctgggctccggcatgctgcccgccatcagcctgccgccggccgaagacaccaagctggaaaagatagacatcaagatgcaggcgatggggctggaagaagcggcgcgcccggcgccgccagctggcgccggcgtcaacctggccccggccggcggcgcggccaaacccgcgccgaaacccaaaccaaagccgaaaccgcagcgcaaagcggccgcctcgcaagcggcggacgaaccgaaagccgcggcgtcggcgcccgcggccgaaaccgccgccggccaaggcgagcgcgccgccagcgcgccacacgccgagaccgcccccgcgccgtccgccagcgcgccacacgcggaaacccggcatgcggcggcgcagaccgcgtccgaagacgcggccaaaccgcaagacccggccggcttcctgcacccgccgcagccgctgcgcaagttcccggccgcggccaagctcagctaccagctgtactggaacggcgtctacgccggaaccggtgagctaaactggcagcaaggccatggccgctacctgctggaaaccgtggcgacgccggcgttcgcctaccgcatgttcacccgcggctatcgctaccgggtggaaggcggcatagacgccggcgggctgcgcccggacagcatgctgtcgttcgagggcgacaaggccaaggaagaggcccgcttcgactacgccgccggccagttgcgctacggcatgggcgccggacagcaagtggcgctgcgcgccggcgcgcaagacatttacagcctggccttccagctggggctgaagggcggacatctgggcgacaaggcgctgcagatcaccaccgccaagaaagtctacgattacccgatggcgccgactggagccttcgactacgacaccaacgccggcaagatgcgggtcgcggtgttccaggccaaaggaggcggcgacaccaccgaattctggctggcgacggatttcgccaacctgccggtgcgcatcacgcgcatcgacgacaagaagcggatcgagctgcgcgcggtccgcatagaagtgaatggcgcgctgcagtgggaactgccgccgcaaccgacgagactgaacaagaatgcacattagccatagccaactgaaacacctggaaaccgtcatcggacagatgacccgcttcgaccgcccggccgacgccgtgctgtccgcctatttccgcgagcacaacaagctgggcggcgccgaccgccacctgatcgccgaaaccgccttcggcgcgttgcgccgcctgatccagctgcgcgcgctgatcgcgccggagaaagccacgccgcgccgcctggcgctggtggcgctgatgaaattcaacaagctgaacgtcaaggaattgaccgaagccaccagcgccggcgagcgcgagtggctcggcacggtcaaaggcaagacgctggaagacagcctggaaatccgcgcagagctgccgcaatgggtgatcgagcgcctgggcgagcaggagccgtccgcggtggaggcgctgggccagggcctgatgtcgatggcgccgctggacctgcgcgtcaacacgctgaagatgaagcgcgaagagctgctggaccgcctgaacgccgaaggcatccattgcgaagccacgccgtactcgccgttgggcatccgcctgaaagacaagccggcgctgtccaaacacgagctcttcaaggccggcgcgttcgaggtgcaggacgagggcagccagctcttgggcctgatcaccggcgcgcgccgcggcgaaatggtggtggacttctgcgccggcgccggcggcaaaacgctgctgttgggcgcgcagatgtcatccagcggccgcctgtatgcgttcgacgtgtcggaaaagcgcctggccaacttcaaaccgcgccaagcccgctccggcctgtccaatgtgcacccgcaactgctggcgcacgaaaacgacgccaaggtgaaacgcctggccggcaaggccgaccgcgtgctggtggacgccccctgctccggcctgggcaccctgcgccgcaatccggacctgaaattccgccagagcccggacagcgtcgccgaactgaacgccaagcaggcgtccatcctcgcctccgcctcgcggctggtgaagagcggcggccgcctggtctacgccacctgcagcctgctgccgcaggaaaaccaggccatcgtcgaggccttcctggccgagcacgccgacttccgcctgctgaagatggacgaggtgctggccgagcagaaaatcccgctgcaatgcggcgattacctggagctgaaaccccatctgcataacaccgacggcttcttcgccgcggtactggaacgcagcgccggctaagcctctcaatccgcttcagacacagcccgccagcgccccgcccgcgggctgttctcgtattggatcggcattcgtagtacattagcgcctgataattctatctcgcccggcccccggccctggagcaccgacccgatgcaggactacctcagccgccgcaacagccggcagaaaatgaaccgccagctgcgttatctctacctgtccgcggcccaatggcggcggcaactgccggtatggatcgcggccatcctgatcggcgtggtggcttacgtgttcgcgctgggcagccatctgtctcacgacctgttctaccaggcctattcctattcgccatactggagcctcttgatcaccccggcgggcctggcgctggcgatctggatcatgcaccgcttcttccccggctcggccggcggcggcatcccgcaatccatcgccgcgctggagcccggcatggaaaagctgcgcgagacctgtttcacgctgcgcgccgccttcggcaaggtgctgctgacgctgataggcatcagctccggcgccaccttcggctacgaaggccccatcgtccaggtcggcgccgccatcaagtactcgctgaaccgcaaggccgcgctgcgccacgagggcgccgcgcgcagcttcatcctggccggcgccgccgccgcggtggccgccgccttcaacgcgccgctggccggcatcgtgttcgccatcgaggaaatgggccgcaccttcgacatgcgcgccagttccaccattctgctgtcggtgatcgtggccggcctcaccaccttcgccatcaacggcaactacaactatttcggcgtggtgcaggtggcgatggacagcaaccagacctggctggccatcccggtatgcggcgtgatcggcggcctggtcggcggcctggcctgccgggtgctgctggcgctgtctcagcggttgcccggcccgctgcacggctggcgcgtccgctacccgatacgcttcgccgccggctgcggcctggcgctggcggtgataggcatcgccagccacggcagcaccttcggcaccggctacttccgcgcccgcgacatcatcgaaggccacggcgcggcgctacaggattacggcgcgctgaagctgatcagcatgttcgtcagccacatcagcgcggtgcctggcggcatgttcgcgccgtcgctggcggtgggcgccggcttcggcctcaatatgtcacagcttctgccgttcttgccgcagaccatggtggtgctgctgggcatggtcggctttttcgccggcatgacccgagcgccgatgaccggtttcgtcatcgtgatggaaatgaccgacacctcgggcatgatcattccgctgatggccaccgcgctggtcgcggcgtcggtttcgcggctggtcagccgccgcgcgctgtacgagggccaagtgcggctgttcctgccgcaatggcacgccaggcttaggcaaattgaccagcccggtggccgcacgtagaataacttattgaaaagatcgggtatttgccgggcggcgtcatccccccggcgcaacgctaaggattgcacacatgtcgattcaacaagatattcaacaaaccgtcgccgccaacaccgtggtgctgttcatgaagggctcggcccagttcccgcagtgcggcttctcctcgcgcgcggtgcagatcctcaaagcctgcggcgtcgaggactttctcaccgtcgacgtgctgcgcgacccggacatccgccagggcatcaaggacttctccaactggccgaccattccgcagctgtacgtgaagggcgagttcgtcggcggctccgacatcatgtacgagatgttccagaacggcgaactgcaggaaatgctgaaagacctgtaatcgcggtcttcgcgcgctccccgacccggccttggccgggtttgtcgtttgcgccgcggcaaatttgtccgcaaacggactttatcctgtggatttcccggcgcgagaagcgttaaaatacgcacccataccacccacggcagccctgcggctgccgctgtcatatgtattcgaaagctgtttgccgcgcgaaacctccgcggcaagcagctttttgccaaggtagggagccagaattgaacatcaccatcgtcgatcacccgctggtccagcacaagctgggcctgttgcgcgaagcggacaccagcaccatgaaattccgccagctgacccaggagctggcgcgcctgctcgcttacgaagccacccgcgacttcgagctggaaaccgtctccatcgacggctggtgcggcaagatagacgtcaagcagatcaagggtaagaaagtgaccgtggtgcctatcctgcgcgccggcatcggcatgctggacggcgtgctggacctggtgccgtcggccaagatcagcgtggtgggcctggcccgcaacgaagagacgctggagccggtatcctactttgaaaaattcgtcggcaatctggacgagcgcatcgccatcatcatcgacccgatgctggccaccggcggctcgctggtcgccaccatcgacctcctgaagcgcaacggctgcaaaaccatcaaggcggtggtgatggtggcggcgccggaaggcgtgaagatcgtcaacgacgcccacccggacgtgcaaatctatgccgcttcgctcgacagccatctgaacgagcacggctacatcatccccggcctcggcgatgccggcgacaagatcttcggcaccaagcagcaggcctgatcggccatgcttttccatcagccgcccgttgcctccgcagccggcggcttttttgcaagcccgcaacgaggaacgccatggaccgctacgccgcgatagacgccgactttctcgcccgcttccccggcggcttccaggacccggactggcaaacgctcgcccgccggcacaaaagctacgccaaggccgaggcgctgtgccagagcgagctgacccgcgccaagctggacgcggcgctcgccagcggcaagctggccgacgccacccacgcctgccgccagatcatctcgctggccaccacggtcagcactttcgagaagatcgccttccgcaactacctggacaaccgcgacctgaacctgcccttcgtccaggcgctgcgcgatgtgttgcatgatttcagcccggacagcttcgccgcctatgtggacacgctggcgatggcgcggaccgaccccaaggccaacgccgccaaatggccgatcgtcagctgcttcctggcctgcttcgatccgcaggtccatgtctgcgtcaagccgaccacggtgaagaaagtggcggcgcgcctgggcgtggacattcgctaccaagccaagccgaactatgaatgctacgaggcggtgcagcgtatggtgcaggatttcaagcgccgcagcatggtggctgccgatgtcgacaatgtgctggcgcaggcggtgatgtattgcgccgtctgagcccgacaagattacaaaaccaaaacaaggaagaatgatgatgcaacaactgaagctggcggtgtccggcgcccagatcctgttcgtcgccttcggcgcgctggtgctggtgccgctgctcaccggcctgaatccggcgatggcgctgctgggcgccggcctcggcaccctgctgttccaggcctgcactggccgccaggtgccgattttcctcggctcctccttcgccttcatcggccccatcatctactcgatccacacctggggccagggcgcgaccatgttcggcctgttcgccgccggcttcatgtacttcgtgttcgccgccatcgtgcgctggcgcggcatggcgctggtcaacaagttgctgccgtcggtggtgatcggcccagtgatcatgatcatcggcctgtcggtcgccaccgccgcttccggcatggcgatgggccaggccggcggcaagcaggtgctgccgtatgaaacctcgctgctgctggcggccatttcgctggccaccaccatcgtcgtctccatctacgcccgcggcatgttcaagctggtgcccatcctggccggcgtcgtcgtcggctacatcgcggccgccttcctcggcgcggtggacttcgccaaactggccgccgcgccgtggttcgcggcgcccgccttccacagcccggaagtcaactgggcggcagctgccttcatgctgccggtggccatcgccccggccatcgagcacatcggcggcgtgatggcgataggcggcgtcaccggcaaggattacaccaaagcccccggcctgcaccgcacgctggccggcgacggcctgggcgtgtgcgtggccggcctgatcggcggcccgccggtgaccacctacgccgaagtgaccggcgcggtgatgatcacccgcaacttcaacccggtgaccatgacctgggcggccatcttcgccatctgcatggccttcttcggcaagttcaacgcgctactgcaatcgattccgatgccggtgatgggcggcatcatggtgctgctgttcggcaccatcgcctccatcggcctgaagacgctgatcgaggccaaggtggacctgatggagccgcgcaacctggtgatcatctcggtggtgctgaccgccggcatcggcggcctgacgctgaagctgggcgacttcgcgctggccggcgtcggcctgtgctccttgctggccatcctgctgaacctgatcttgccgcgccaggcggccagccacgacggcatcgtcgaaggccaggacatctagcctccggcggcggctccgccatggagccgccgcgcctaaggcgctgattctataaacatgtttacaattgggcacatgtcaaagacgctgacgctgcctacactgcaatcagcgcctcggcacgaggccgcggcgccgttgaccggagccaaactgctgcccaacccagcttcacttgcccacagcggcttgacacggcctgacctcctacagcaaaaaggataaagccatgttgaagaccatactcgccagttccctgtctctcctgctgctttccgcatcggccatggccggcagcgacggcctgtccgtgatgtgggcgatgcgcggccggatggacgcccagttgcacaaccagccggcgccgatggtgccgcagttcaattccatcccgtccgaccgctaagcgcaagcagccccaaccgcctgccgccggcaggcggtttcacgtctcagatcgtcagctcgccgtccgccaccgcccgctccagccgctgcacgaaccattgcagcgcccgccccggctgctccagtttccaggcgaagcacatcggcgggaaggtgccgttctcctcttcctctttctccaccagatggccgctgtccagccagcgctgcacatgcgagcgcggcaggtggccgctgcccagcccggccagaatcgccttcaatttggcctggctgctgtgcacggtcagcacctgctgcccttccagcaagccgccggtgcgcgccggcaggcggcgcgaggtatcgccgaccgccaccgcgcgatggcggcgcagcagatgcggcggcagcggattgggcgcgtcggccagcgggtggccggccgccacaaccagcgcgaagtcgtagtcgccgatattgcgggtgaaataatcgccgggcggcggctggttgggcgcgcctatcaccaggtcggcgcggtcgtcgtacaaggcgtcccagatgccgccgaagctttcgcggatgaattgcagccgggtgtcggactgcagttggtcgaaatcggcgatggatggcaacagctgctcgaaaccgaccaggtctcccaccacgatgcgcagcttgtcctcccagccctgagcctgcttgctgaccctcagctccagctggcgcgcggcgtccagcagatggcggccgtcgcgcagcagccgctcgccggccggcgtcagccgcgcgcgatggccgctgcggtcgtagatcgccactcccagtccctgctccagcttctgaatggtgtaggtcaaggccgacggcactttgtacaaagcctccgccgccgcggcgaaactgccgtgctgctcgatcgcatccaatacctgcagagcttccaaagtcagtttcatctgcgccactcattcattttttttgaacactttgttcggttcttttcgattttatcgcgttcaaagccgcaatagaatgaattccgtaacaagacaccagcaaaaaccgaacaaggcatcaatatttttgatccataaccacttgctggcaccacacacaaataaaggaaaccgccatgctgaagcaaaccactcttgccgccctgtccctgatcctgctgtccggcgccgccatggccggcagcgacggctacgccaacatgaaggcgatgcgcgaccgcatggccagcgagcaaacccagcaagtgcagcaacaagcgccggcgcaaaagtaagccgccgctcccgctggccaaaagacaacgccgcgaaccttccggttcgcggcgttgttttgcgttaagcgctcctcagtcaggagtcgggacgcaaacgccccatcagcaaggcatcatggtaagcgccgttgcggaacgaatgcgcgcgcatccgcgcctcctcgacaaagccaaacttgcggtacaaggcctgcgccgcctggttgtcgggataaaccgtcaactcgatccgttcgaagcctatccagctgtcggccaggtccagcatggccgccatcagcagcgtgccgacgccgcggcgctgccagtcgcggtggacattgatgcccaaaccggcgatatgctccagcctggcttcgtccagccgccacaagccggcgctgccgaccaccttgcccgccgcgttctgggaaaccagctgataccgcccggcgcacagcaacttgcccatgcgcgaggccatggtggcggaagacgggaaaggcagctgcagagtattgccgtataccgacgggtccgaggctaactcttgcaaatcggccgcgtcggccggctccagatggcggatgcgcaattcgctcatttccactccccctcgcgcagccgcgccatcgccagcacatcgtggtaaacgccgtcgcgcagcgcataggcgcgcagccgcgcttcttcgacgaaaccgaatttgcggtatagggcttgcgcgcgcagattatcggcgaacaccgtcagctcgatgcggcgcagtccctgccagttgtcggccaaatccagcgtcgccgccatcagcagcgagccgacgccgcggccatgctgcgcggaagcgacgccgatgccgatttcggcgccgcgcagcaggcgctcgcggcgggccgggatcagcgcggcccagccgattgccaggccagccgcgtccaccgccaccagcacggttcgtcctggctcgtgcttctgcagccattcgcggcgcttgctcaaggcggggcaaggcaggcccagcatggaaccgaataccgccgggtcgctgaacagcgcgttcaaggcctcggcgtcggatggctcggcatggcggatgcgataatcgttcatgcttgcgccctccccggccagttcagccggcccatcaccagcacgtcttcaagcttgcctgcgcgcagctgctcctgccgcatccgcccctcgtactcgaagccgcacttttcatacaacgcgatggcgcgggcattgtcatgcaccaccttcagctcgatgcggatcagccccagccagttgtcggccaggtcgacgatggcgcgcatcaaggccccacccacccctttgccctgccagtcgtcgcgcacgatcaggaacaggctggcgctgtggcgcacccgcatgccctcgttgacgatcaggccgacggtgccgaccacctcgccgtcgccgctacaggccaccagttggtaaaggttggcgggccgctcgctcagccgcttttcggtggcggacaaaggctgatacggcaattgcagggtgtcgggatacacgctgggagcggtcgtgatgcgatggatggcggcggcgtcggaaggttcgacggaacgaatcgacaaggactgggacatggcggtctccgaagttggtgggcgccggcgggatcgccgcgtggcccggcagaccatcatgccaaatatttattgtgcatagcaatataattttcagcccgacaaaaaccggcccggcgtcgcgccgaaacagcggcggaaggcggcgatgaaggcgctgctgtcgcaatagcccagctccagcgcgcagaaacccaccgctctcccctccgccagcagcgcctgcgcccgcatcatccgcagccgctcgcgccattcgcccagccccaggccggtttcggcgcggaaatggcggatcaggctgcggcgcgacatgccgatatggccggcccagcgttgcagatcccaatccaatgccggctcccgcagcagatcttgcgccagccggcgcagcgccggatgcttcggccacggcaggcaggacgggtgcggcgcggcccagcccagttcatccaccagcacctgcagcaggcgcgccgcggccgccgcgccgcccgcttccggccaggcggccaggcgctggaagatgccgtccagcagggggctgccgctccatgcctgcagctgcgccggcagccgatccagcgccgccccgcgcccctccaggctccagccctccaggtcgccgtgataatgcgcgccatgcggcaagccggccggcagccagcccaggcaccccgccggcagcagcatgcgccgctccgcggcgaccagctccagcgcgccgcggcggaccagcgtcagctggccgccttcatgggcatgcatggcggtgtggtcgccggcccgccgcttcagcggcgtcagcctgacgccgccagccattaacgcatccgctgccatattggccctttttcaatatccattggcactctatacaaagcgcgccgatcgcgccagcgcgatactggcctcaccccaacccaacaggagccaaaccatgaaaccatccatccagaccgtcgcccacaccaacgaactggccgccatcaacagcaaggtgatcgccgacggcgaaaccctgccggcggtgaagctgcgcgacggcagcacggtgcagaccggcaccgtcgccgccatgctggtcaatatcgccgcctataaccgcggcgaacgcggcgaggtggagcgccagctggaattggccgtgccgaccctgttcaaggtcgggctgttcgatctgttcccggttgaggaatggctgcgcggcgataatcccggccgcgccttgctgggcgcgatggccgccctccacctggccgaccaggcaaacaacacataggcatattccggccatggcaaggatgccggcggccggcattggcgctaagctggcggttcgattccaccggagctgaacatgctgatgcaaagacaggacgccgcgctgctggtcgtcgacatccaggacaagctgctgccggcggtgcacgacgccgacggcctgctcaaacgcagccgctggctggtggccgccgcgcgcgatcaccagctgcccatcgtgttttccgagcaatacccgcgcgggctgggcggcacggcggcggcgctgcgcgaggcggcgccggaagcgccaacggtggacaagctgcatttctcctgcgtggcggcggactgtctgccgccgctgctgaccgacaagcgccagatcatcgtctgcggcatggaggcgcatgtctgcgtgctgcagaccgcgttggaactgctgcaggccggcaagcaggtattcgtggtggcggacgcggtgtccagccgcaaggcctccgacgtggagctggcgctggcgcggatgcgcgcggccggcgcgcagatcgtcagccgcgagatggtgctgttcgagctgctgcgccaatccggcagcgatcacttcaaacagatgagccaacgctacctgatgggcgagcagccctgagcaggccgcgaaaatgaagcggggttgtcgaagcttacctcttcgacaaccccgttccaatggcggctgagccgctctcgtcctcccctttgcagactggcgctgcggaccttgcggccccgctcactagcttgccctttactaagcaagcgccgtgccagccaaccatgctcaggcaagtcagggttttggcgctgcgctgataatcaaaccagccagaaatgcaccaaactggtgcaaaaatcagttagccagcaccaaactgaaacacaaattaacattacccgtcacataaaagacagagacgtactggaactgtcatgttttgcccttattctcataggctgaagccgcaaacataacaaggagaacggatatgaccaccttccaggaacagctgtccaccctgcccgccaccgacggcgtcgccgccatcgtgctgctgaacccggccggcgaagccgtgcaccggctggaaaaccagcccggcaccgccggctcgctgcgcgtctaccacgcgctggtgaaacgccacggccacatcgaccgcaaggccgcgcgcgagggactggaattgttcgccgagcacaccgccgccgcccgcgcgcagccgggcagccatcccaatatcgaccgcctgctggccatcgccgagcaggacgcgcccggcctgcgcgcccgcctggttttggctagcgaggactaaacgccgcgcagcgccatcagcgcgaaaccggcggcgatcgacgccgccgtcgtcgccagccccggcaggatgaagctgtggttgaacacccagcggccgatgcgggtgctgccggtgtaatccatctccaccgccgcgatcaggctgggatagctcggcaacacgtacacccccaccaccgctggaaagatggctatcagcgtcggcgcagccagccccagcgacacccccagcggcatcatcaccttggtggtggcgccctggctgaacaggatcaccgccatggtgaacaccgcgaaggcgaacagccacggcgcctggtggatgatgctgacgatattgtgctggaacaacggcagattggcctggatgaaggtatcgctcatccacgccgcgcccaggatggtgacggccgccaccgcgccggagcggaacatgctgccggacaccatcgcctgcaggtcggccttgcacaacagcaccgccaacgccgaatagctgagcatgcacatctggatcacgtccaccatcgccaccggctccaggcccttcgcgccttgccatgcgggacgcagctgcggcatggccgccagcagcacgatcagcgccaccgtgaacagaaacccatacaccgaccaggccgcggtgcgcggcagcgcttgcacgccggcagcctgcggccgcgcgatgccgcccgatgccagccggtgccgatacaccggatcatcggccagctcgcggccatagcgcaacatcaccaggctgccggccagcgcgccgatcagagtggccggaatgctgatcatgatgatgtcggtcagcgccacgccgtgcggcgccagcaccgtggccagcgccaccgtggccgccgaaaccgggcaggcgacgatggcgttttgcgatgccaccgtcaggcccgccaacggccgctccggccggatgccggttttctccgccacttccaccacgatgggcatcagcgccagcgcgatgaagccggtgccggcgagaaaagtggacagccagcccaccagcggcgccagcagcacgatatggcgcgggttgcgccgcaagaagcgcgccgcgatgcccaccatgtagtccagcccccgggccgactgcaacgccgccgaggcggtgatgaccgagatgatgatcaggatcacgtctatcggcgcgtggccgggcttgaggccgaagacgaaagtcaggatgaacagaccggcgccgccggtgacgcccaggccgatgccgcccatgcgcacgccgaggaaaatggcgcccagcaccaccagaagttgcaggtaaaccatgatgcggctcccaagatatccgagcctgattgtcccagcatcctggcgccgcgtacttgtcgaaaatcagtacttgcttatgcaaaatccggcgacgagcgcaaagccgctcagcgctgcagcgccagcgccatgcgaatttcgcagccgccatggccggtatcgccccagcgctcgtccagcagggcgaagccttccgcccggtacagcgccgtcgcctcggccagcgcagcggtggtttccagatagcactggcggtagcccagcgccctggccttggccagcagcagccgcagcaggcgccgccccagcccgcggccgcgcaaggccgggtcgaaatacatcttctgcaattcgcacacgccctgggcgccgccggccagcggcgcgatgccgccgccgcccaacagccgcccgtccggcgccaccaccaccaggtagcgcgaatccagccggttgtacgccgggaacaacgcgtccaactgcggatccaggaagctgcagccatcgcccagcccgtactcggccgacacccggcggatcagcgccgccagcgggccgttgtcggccgccgccagcggccggatcgcgaagccctgctggctgtcggcgtcgcgcagcgcgcgccggtacaacctcaggccatcctccagccgggcgcgctccgcctcgtccagttgcgccagcacccgcgccatgtcggcgtccatcgccgcgtgcagccgcgccagccagtcgcggccggagccggtcaattcggcctgcttgctgcggccgtcggccggatcggcgcgccaggcgatcagcccgcgctcggacaaacgctgcagcggccggctgctattggatttatccacccgcaaacggtccgccagctgctgattgctggccggaccgctttccagctcgatcagcagatgcgcctccaccggcgtcagcgccacttcgccgcaatggctggacaacatgcccagcgcgcgcaccacatcgcgcgacaatgcgcgcagctccctctcccgcatggcggccccctcactcagttgcgacacgcaaccatatcgtcattcgttgcgtatcgcaaccactgtggcgataggcgtgaaaaaacccgctcgaaagcgggtttttcttcaagccgtcctgaatcaggaattaggcttcagcaactacgacaaccttgatcgggctcacaacgtcgtggtgcagggcgatttcgatgtcgtactcgccgatggccttgaacgggccgttcggcaggcgaacttcgaaacgcttcacttccacgccgaacgcggtcacggcttcagccacgtccacattggtcacggagccgaacagacgaccgtcaacaccggctttttgagcgatggtgataacagcgtcaaccagcttttcagcgcgaaccttggcgtcggccaggatttcggcttgcttggcttccagttcggcgcggcgagcttcgaactctttcaggttgttttcggtcgcgcgcttggctttgccttgcgggatcaggaagttgcgggcgaagccgttcttcacgttgaccacgtcacccagttgacccaggttggcaactttttcgagcagaatgatttgcatcttttaagttcctttcccggtcttagtgctggtcggtgtacggcaggaaagccaggaagcgagcacgcttgatagcggtggtcagctgacgctggtagcgagccttggtaccggtgatgcgagccgggatgattttgccgttttcggcgatgaaatccttcaggagatcaacggatttgtagtcgatttccttgatgccttctgccgtgaagcggcagaacttcttgcgcttgaagagttgacgagccattttgactaaccttttacaaattcaacatattcgatattgagtaccaaccgcggattgcgcagactgcgctggccaaggaacccggtgacgttgatcacctgccccgccagtttcccggaatgcttccgggcgtcgtcgcctatccacacggcctgtatatcgcaggccacatcacgctcgaatccgccagctgtctgtctagactgatgcttgagccacatttccactaccggcaagccggcgggcgtgtatctcagcgcatcctcgcgttcaaccgtgacggtcaataccagacggttctgcaagtccgctacctctgccgattaggcagaagcttcggcctcggctgccggctgctgggcgtccagcaggtttttagccttttcgtccttcatcatcggggacgcgtcggtgatggcgcggtccagcttgatgctgaggtgacgcagaacagcgtcgttgaacttgaaggcgtgctcgatctcggccagggtttccgactggcactcaacgttcatcagaacgtagtgagctttgtgcagcttctggatcgggtaagccagttggcgacggccccagtcttccagacggtggatcttgccttcggcggccagaaccatacccttgtagcgttcgatcatggccgggacctgttcggactggtccgggtgcacgatgaacacgatttcgtaatggcgcatgtgaactccttttggctattcgtagccttttgccatgcggttgcaaaaggcaaggtagtaaaccgcagcattctacgcactttgccgcggccaggcaaactttaagcgcgatttttcagcgacttcgcggcgcggcgccggcaaaacgcggcgcttttacaacttcttgctgcgcttgatgttgaccaccacgccgtcgcgcaaggtgacgatggtggtgtagggaatgttgccgttggccagccaggacagctggcgggtagtggagacggtggcgatgccgctggccagcccgccctggttgctgtcgctgccgtagtcgggcttgccagccaccgacaccagctcggcctccagcatgccgttgtgcagcttgatgaaggtttcgaacggaatcgggtcggcgctggcggcgccggtcaacaatagcgccgcgatggcgagtgtggttttcattgcatgtctccggtaagcgtgaacagcattagaggcgatagggatgcagcaagcggagttgtttttctgtcatgcgaggaaagtggtaattcccacccgactcccaagacttggtcccggcaatgatccccaactccatcatttgcctcaacaactcgtcatggggataaaggtaaaactgctcgccatcacgaaaagcgatatggaaattcttgccgcagtacttgcggtcaaacaacagtcgacaacctttcagctgcaccttgagaaaagtctcgccgtcgatatggcaggctatgaaatcggctccctgccagtcatccgtcaagcgcaggcagttgaagccgtaatccgccaacaccgccgccagcttctggaaattgtagttttccttctgcctggcattcagttggtcatactcgacacgcgcccaagccgccatcgccacgcgccctagcgcaccttcttcaccacgtcgatcagctcggtcaccatgccggtggcgtcgccctgctgcaaggcgcgcgccacgcagcctttcatgtggttttccagcaactgcagcgccaccgcgtccatcgccgacttcaccgccgccacctgcgtcagcacgtcgacgcagtagcggtcggcctctatcatgccgccgataccgcgcacctggccctctatccgcgccagccgcttcagcagcgcggccttgcccggctgcaccaccacccgctcggcggcgggggcgtcgtggcagcattcctcatgcgggtgacgggtatcggtcatggctcatcctgaattgtcgatgtcggcattatcgcgcatccggcgccggcgcgcccggcctaggcgctgacatccagcatgcccatcatgccggcgtcctcgtgctccagaatgtggcagtggaacatgcgcggcccaggcaggtcctggcggaagcgcagcctcaccttctgctccggcggcacattgaccacgtcgcgccaggcaaggtagggttcgcgccgccagcccttgccgtcatgccgctcggtcacctggaactgggtgccgtgcaggtggaaggggtggtccatatcggcctgattgtcgatttcccactcctccaccacgccgaccttgccggtgaagtccatccggtccatatcgaaggtcttgccgttgatcaggaacatcgccgccggattggccatgtcctcgctgaacgccacgcggcgcctcaccgccggcttcggcagcggcgcgatcgtccgcagcctggacggcagcgccgccgtcgcgaccgccggtccggcctcaacatccagcagcggcaaaaccttgtcctgctccggccccatcatcttgccgcgcgcgtacggcaaggccaacaagccggccggcttgccggcggcgaagcggccggtgacggccagctcggcgcgcgctcccggcggcagcaatagcgaatcgatgcggagcggcttttcgatcagcccgccgtcggtgcccaccagccagacctcgtgcgcaggcagcgccagcttcagcacccgggcgctggtggcgttccagacgcgccagcgctggcgctcgccgacgcccagcgtcagcttcggctgccaggcgccgttgaccagcacgaactggccctcgcggccgtccatttggtccgcctcgctattggcggcgatttgcccctgctcgtccagcttcaggtcggacagcaccagccaccgttcgggcagatgcgccagcggatcgtcgcggcgcttcaccacaaacaccccggccagaccgcggtatacctgctcggcggtatggccgtgcggatgcgggtggtaccaataagtcccggcgcagcctggcggcagcgcgaagcggtagtcgcgcgtttgcccgggcgccactggatcgtgcggattgccgtcctgatcggccggaatcggcagaccgtgccaatgcacggtggtggcctgcggcaggcggttgtcgaagcgcagatgcagcgcatcgccttcgtacaattcgatggcgggccccggcacgctgtcgttgtaggcccagaaagcggtggccgccttgccgggcagcaagggcagattcaacgcggcggcggtcaagcagccgctgagcgcgccctccttgccctccagcggcaagcgcggcaacgccggcaacggctggccgcgcgccaactccaggccggccgctgccggcaacgcggccgcgatatcctggccgccgtgtccggcatggctggaagcggccagggccgggcggcccagccaggacgagagggccagcgcgcctccccactgcatcacttgtcgacgttgcatctcacactccatcagataccccacatgggtatattgaaacctagagcgcgccaactggcaaccgttccgcgcggccataaaaaaacggcaagcctgaggcttgccgtttttggggatgaagactggcgcttacttgccgacgtgcggcgccagagtgtgcagcagctgcgccagcactttcgggttggcggcgacgatgtcgcccgattccagccaaccctgctcgccggtgaagtcggtgacgatgccgccggcttcctgcacgatcagactgccggccgcgatgtcccacggcttcaggttcagctcgaagaagccttcgacgcggccgcaggccacattgcacaggtcgagcgaggccgcgccttcgcggcgcacgccggcggccttgccgatcacgtccttcagcatgcccatatactggtccagataactctggtccgacaccgggaagccggtggcgatcacgcactcgttcatcatgaagcgcttggacacgcggatgcggcggtcgttgaggaaggaacccacgccgcgcgaggcggtgaacaggtcgttgcggctggggtcgtacaccaccgcctgctggatctggcccttgtgcgccagcgcgatggaaatcgcgaactgctggtggccgcgcaggaagttggtggtgccgtcgatggggtcgatgatccactcgtattcggaggagccgacgcctttggcgcccgactcttctgctagaatcgcgtgtttcgggtaggcctcgaggatggtttggatgatagcctcttcggctgcgcggtccacctcggtaacgaagtcattgtgtttcttcttctctacgcgaatggtatcgaggttaagcgacgcgcgctggataacactgccagcgcggcgagcggctttaaccgcgacattgagcatcggatgcattgacggcctctacacttgaacaatgggcaggcgcggcgttcgatgacgcgacgcctgccggtaacaatctgggttaaggaacaaaaaaacccgacgcctgggcgcgggcttttgatatatgcccgctattttaatgtgaaaccgccaatgaataaaccccaagtacctgattttctgaaaaacatccgcatcgtgctggccaggcccaaccatccgggcaacatcggctcggccgctcgcgcgatgaaaaccatggggctgacccgcctctacctggtggaacccaaggtgtttcccagcgacgaagccaacgcgctggcctccggcgcggtggacgtgctggagagcgccaccgtggtcggctcgctgcaagaggcgctggccgacgtcaccgtcgcctgcgcgctgaccagccgccgccgcgagctgaccaccccgctgtccaccccgcgcgaaaccacgcccgagctggtggcgcgcgcgcgcgacggcgagcaggtggcgctggttttcggcaacgaaaccttcggcctgtcgatcgaggaagtggagcagtgcaaccgcctggtcaccatccccggcaaccccgactacttctcgctgaacctggcgatggcggtgcaggtgatgacctacgagctgttcagccacaccggcgtgaacgtggaatacctgcgcgccgacggcgaagccgccacccagggcgaggtggaaggcatgtgcggccacctggagcaggcgatggacgacatcggctacttccgccgccgcaacagcgagcggctgatgcgccgcatgcgcgcgctgttcaaccgttccggcgtgctgcgcgacgaaatcgacatcctgcgcggcttcttcaagcaggtgcagcgcgccgccgacggcagcctgaaacgggatgaagactgaacagccgttctctctgccctacgcacacccggcggtgcgcgatctcgccttcctgctgacctccccctccccctggccatccggcgccgacctgccgcccgagcggctgctgggcgccgacggcgcggcgctgctgggccggctggagcgcgagccggcgccgctgctggactggctggcggcgtcccatcccaagcggctgggaaaatatgccgaaagactgttttctttctggttccgcaccgcgccgcacattcgcctggcggcggaaaatctcaccgtcatcaacgaaacgcgccgcaccctgggcgaattcgacttcctgctgtggctggacggcgaaccctggcacctggaaaccgccagcaaattctacctgcaactgggcaacgggccggacacgctggtcggccccagcctgcgcgatgcctggcggctgaaagcgaccaaactcgcaacacaattgcaactgagccgccatcccgcggccgccgcgcaactgcccgatggcttcgccgcctgccagaccggcgcgcgcctgagcggctggctgttctaccccgccggccaggcctggccgccaccctccggcgcattgcgcggctggcacgcgccgctgctgccggcctggccgcaaacgctgcccggctcgcgctgggcctggctgccacgcctgtcctggctggcgccggccttgctcgacgcatcccgcgtccacagccaggccgcgctgcgcgaacaactgctggcctgcgccgcgccgcagctggtggcggagctgcagccggccggcggcggcctgtggcgggagacagcgcgcggcttcgtcaccccggacggctggcccgatccggcccggttggcggagctgcaaagcaaactgccgcagccatgaaaaaaggcaggtccgaagacctgccttttttgcccagcggcgggctcagtggccgttggcgtgcacgcagccggcgatcaggtttttcaactcctccaccttcaccagctggatgtgcttgtgatcgacagtgatccagccctgctgctggaacttggacagcgtgcggctgaccgtctccagcttcaggccgaggaagctgccgatttcctcgcggctcatccgcaggatgaagtcgttggcggcgaagccgcgggtggacagccgttgcgacaggttcagcaggaaggcggcgatgcgctcctccgccttcatattgccgagcagcagcatcacgttctggtcgcgcacgatctcgcggctcatcagccgataaaagtgatgctgcaggctgggaatgtcgcggctcagcgactccatccggttgaacggcagctcgcacacctcgctgtcctccagcgcgatggcgtcgcagctgtggttgttggtggagatgccgtccaggcccatcagctcgccggacatcaagaagccggtcacctgctcgcggccatcctggctggcgacgcaggtcttgaagaagccggtgcgcaccgcgtacagcgacttgaagccctcgccgctgcggaacaggtactcgccgcgcttcaggcggcggctctggcggatcaccgtatccagctggctcatctcctcgcggttgaggccgaccggcaggcacagctcgcgcaggctgcagctggagcaggaaattttcagtgtgtgtaacgctgtatggttttgttcagacatgctgtgtttgctgcaagctggtgaagcttgacccttgtcaatgcggaattcgcaggttttgcgcaaatttaccagtccaccagaagttttaccatccgaatacgacatgaaaaccacccatccgttttcccccgcccatttcgagttcgaccgagagctgatcgaacgcctggatggatcgggaccaagatacacgtcatacccgactgcggatcgctttacgccgggtttctcagcacatgactaccagcacggcctgcagcagcgccgcatcggcgccaaccgcaaacctttatcattgtacgctcatataccattttgcaacacagtttgttattactgcgcctgcaacaagatcatcaccaaaaacaagagcaaggccgaccaatacctgggctacctggaaaaggaaatcctgctggtggccgaacagctgggctgccgggaaaaggtgatacagctgcacttcggcggcggcacccccaccttcctcgacgacggccagttggcgcggctgatgaccatgctcggcacgcatttcgagttcctgagcgacggagaatattccattgagatcgatccgcgcaaggtaaaacgcgaaaccatgttccgcctggcagaatatggcttcaaccggatcagcgtcggcgtgcaggatttcgaccccgcggtgcagcgcgccgtcaaccgcgtgcagagcgaacaggaaacccgccaggtgatagcagccgggcgcgaggccggcatgaagtcggtcagcctggacctgatctacggcctgccgctgcaaagccgcgactcgatgctgcgcacgctggaaaaggccatcgccctcgatcccgaccggctggcgctgtacaactacgcccacctgccgacggtgttcatgccgcagcgccgcatcaacgaagccgacctgcccagcgcagccgccaagctggacatcctgcaggacgcggtcaagatgctgagcgacgccggctacgtgttcatcggcatggaccacttcgccaagccggacgacgagctggcggtggcgctgcgccagggccggctgcaacgcaatttccagggctactccacccacgccgactgcgacatgctggctttcggcgtgtcgtccatcggcaaggtgggctccagctacagccagaacgacaagacgctggaaggctattacgccgcgctggacgaggggcgcctgccggtggtgcgcgggctgacgctggacaaggacgacgtgctgcgccgcaccatcatccaggggctgatgtgccgcttctcgctgtcgatcgaggcgatagaagacatctacgccatcaatttcgcccaatattttgcggcggaaatgccacagatacgcgaattccagcagcaggggctgctgtctttcgatggcgacttcctgatggtggagcccaagggccgcttcctgatccgcaatatcgccatgattttcgaccgccacctgcgcgaacgccgcacccacgcccgctactcgaagaccatctgagcgcccccgccggccaccgcgccggcggccctggccgcatcctccctgaatcccgccttgcgctaagcggattcacttatacagtgaagagcgaagcacgccgttcgcatgtccggtgcgggagcgttgtaatcatggtcgatatcgaaggagccccgccatgtccacccccatcgtcaggctgatgcagcgcctgagctatccccagcgcttcgccgtgatcggcctggtcttcgccatcgccctgctctatctggtatacggcttgtaccgcagcaatcaggacaatatcgactccaccgccaaggaaagagtgggcgtggtctacatgcaaccgctggccgcgatgctggcgcaagcccagcaggcccaggagctggcagtgcgcgcggccctgggcgacgcccaggccggcaacgagctgcccgccgccgcccagcagctgcaggccagatggcaggcgttgcaggacagcaacagccggctgggggcggaactggccagcgacgccgcctggaaagacgccgccgcggcctgggacaagctgaaaaccgcgccgtccggctcggccgaacaatggatagccgcctacggcaatctcagcgacaagctgaacaatctgatcggcgccatcagcgacaactccaacctgacgctggaccccgacatcgacacctattacctgatggacgccgccaccgccaagctgaccacgctggtcagccatctgggcgaggccaacgccgtcgccgcgctggcagcggccaaccatccgctcgcccccgcccagcgcgaccggctggtggagctgcggccgctgatcgccgaggtcaacgacggcctggccggcgacatcgccaaggcagtcgcctacaaccccagcctgaagccggacatggcaacccaggcggacaagctggcggcggtgctgaaaaaccagctgccggcgatagacgacgcggtcggcggcaagaccggcgccgccggcctcaaagtggccggccacagcgccgacgccgcccaggccgtctccgcctacatcgccgccggcttgcggcagctggaccagctgctgcaagcgcggatagaccgcaccgccaatcagcgcaacacctatatcgccatcggcgtggcgtcgatgctgctggccattttcctgttccagcagctctatctgtcgatcacgctgcagctgggcggcgagccgctttacgtgcaacaggtggtagagcagctggcggcgggccggctggacacccgcatccaattgcgcgaccgcgatgaaatcagcctgctggcggcgatccgccagatgcgcaaccagctgcgggaaaccgtggcccagctgctggacaccgcgcgcgaaacccaccgcgcggccgacgcgatggcgctgagcgcgcaaagcatcaccgccggcagcgcccagcagaacgaggccgccgccagcatggccgcggcgatagagcagctgagcaccagcctgtcggtatgcgccgagcagtcggaacaggccgaccgcctgtccagcgacgccgccagccgctcatccgacggcaaccgggtgatcgccgccaccgccagcagcatggacggcatcgtccgcgacgtgtcgtcggtgtccgacaccatctccgacctgggccgccaatcccaatccatcgccgggatcgtcgacgtgatccgcgacgtcgccgatcagaccaatctcttggccttgaacgcggcgatcgaggcggcgcgcgccggcgaaatgggccgcggcttcgctgtggtggccgacgaagtgagaaagctggccgagcgcaccgcgctgtccaccaccgagatcagcactatcgtcggccagatccagaacaccgcgcaaaagggcaacgacagcatgcagctgggcatgaaagccatcatgaccggccaggagcgcgctcgcgaggccggctccagcatggacaacatccgccactgcgtcggcgacgtactggacagcatccaccagatcacgtcctcgctgcgcgaacaaagcagcgccagccagacgctggcgctgagcgtggagcaggtggcgcggatgtccgagcaaaacagcctggcgatgcgcgacagcgcgcaaaccgccggcgaactgcaggcgatctcgcagcggctgatggggctggccgagcgcttcaccgtctgagccggccagcaaaaagcccgccggatgcggcgggctgggtcatcgcaaacaaaccgccgcgcttaccagatgcccttctccaccttggcggccagctccggatactggtccgccttgaattccggcgcggcgacgccggccttcagctggcgctggtaatcgcccagcacgatgaagaaatagcgcgacagcagcgcgatggccgccagattgatcagcgccatcagccccatcgccaggtcggccatgtcccacaccagcggcaagctggccagcgagccgaacagcaccatcgccagcaccaccaggcggaaggccagcaatgctttcttgctgttgcggatgaactcgacgttgccctcggcgtaagcgtaattgccgagaatggacgagaaggcgaacaggaacatcgccaccgctaggaaggacacgcctatcgggccgaactgcgactcgatggccttctgcgtcagcgccaccccgctcaggccctggtcgtgcgcgccggacagcaggatgatggcggcggttgcggtgcagatcaccatggtgtcgatgaacacgccgaacatctggatcgcgccctggctggccggatgtttggaagtggccgtcgccgcggcattcggcgccgagcccatgccggcctcgttggaaaacaggccgcgcttgatgcccagcatcatcgcctggctcaccgcgtagccggccacgccgccggcggcctgctccagccccagcgcgctcttgacgatcagcagcaccaggcccggcagctccgccgcgtggatggccagcacgtagaaggccatcgccagatagatcagcgccatcaccggcaccagccactccgccacccgcgccaccgcgcgcacgccgccgaagatcaccggcgcggtcagcgccaccagcgccagccccaccgcccacggctgccagccccaggcgccctgggtggcggcgacgatggagttggcctgcaccgcgttgaacaccaggccgaaagccaggatcaggcacagcgcgaacaacacccccagccagcgctggcccaggcctttctggatgtagtaggccgggccgccgcggaaggtgtcgtcgtggtggctggtcttgaacagctgcgccagcgtcgattcgacaaaggcgctggacatgccgagcaaggcggtcagccacatccagaacaccgcgccggggccgccagcggcgatggcgatggccaccccggcgatattgccggtaccgacccggctggccagcccggtggcgaaggcctggaacggcgagatgtcgtccttgctgacatggccgccgcggccgcccaccatctcgcgccagccgcgggaaaacagccgcagctgcagcaggccggaacgcaggctgaaatacaggccgaccgccagcagcagggcgatcaggatcttgccccacagcacgtcgttgatcgcgccgatcaaagaatgaaacaactgcatgattctccttaggacatctgagcgaagccctccccgttccggcggcgcaggccgcggaagcgaaggagggaaagtttggaacagtcccggtctgacgccgggatgggaacgatgccgtgagagccggcatggcattcggtgtgagcccctgccgaatatcgcccgcgcgcaagcgcgatcgggtcgaatctagcaaaagaaagcgattgatggcaattcaacgttggccatgccggataaacggcgaaatcattgccagccactcagcgctatataagaaaaaagaagtccggcccagcccggcttagcaacggatagacccgcgcgcgcatgcggatggcaaggcgaacctccggcgcaacaaatattcccgtccgccgcgtcgggcatcgcgatgctaagctgaagcgaatggcggcgcgcgcggcggccattcccagtccgaaggcgaaatgatgaaatacggcagcgtcctgttcctgctctggagcctgttctgcatggcggccgcccccgctccctggcggctggtcgccgacgccagcttcgaaccctacagttatctggggcaggacgagcgcacgccgcaagggctggatgtggaactggtgcgggcggtgatgctagaaatcggcgcgccgtttcgcatcagcctgctgccgtgggaaagagtgaaactgcagttggcgcagaaggaagcggatgcaggcttcgtcttcaccggcaccgccgagcggcgcgcgcaatacgatctggtggggccgctgcgcaagggccaaaccgtgttcatcaccctgagccagggcccgctgcaatactggcgcgtgctggacgacctcaagccctacctgataggccaggtgcacggctacgcctacgacaccgatttcgacaaggcggatctggagcgcgatctgcacgccacctcgccgcgccagctggtggcgatgctgctggccggcagggtggatgtcatcgtcggcgacaagctgcagctgctgtatttcatccagcaactacagggggaaagccaggtgcgggtgctgtccaagccgctggtggaaatgccgcgctacgtggccttcgccaagggagatccgcgcgcgcggcagttcgaggcggcgctgaagcggctgcagcagaacggcgcgctgcagccgatattccagcgctggtcgcagcgctgatctagccgcgcgccggcagcagatccagcctgtcggtgcacaggctgtccacgccccaggccagcagccggcgggcatcggccgggtcgttgaccgtgtagcacagcaattggtagccggcggccttgatgccgcgcgccagcggctcggtcagggttttatggtcgcaatgcagcgccacgcaatccagctccgccagaatggcgcgccagtcggccgggatctcctcgcacaggaaggcgcgcggcagcgccggctcggcggcctgggccgcgcgcagcgcctcgatctcgaacgaggacagcaaaggcggcaccgccgcgccggcccacagccgcgcggcttcttgcgccaccagccggccggtttcctcgaaacggcccgggcaaggcttgatctcgatattcagcagcatatcctgcgccaggcaataggccgccacattggccagcgtaggcaacgcctcgccggcgaaagcgccgcccttccagccgccggcgtccagctgcgacagctcggccatggtcttgccctgggccgcgcccttgccgttgctggtgcggtccaccgtgtcgtcgtgcagcaggaagcagacgttgtcggccgatagcttcacatcgcactcggcggcgcggtagccgtagcgaatgccttcgcggaagccggcgacggtgttttccggcgccagcgtgccgccgccgcggtgggcgacgaattcaggatacggccaggcttgcttgttctgctgcggcatgcgcgattctccgttgattctctgcgtcgaacaggtgcagcgcctcggcgcgcaccgtcacttccagccggctgcccggctcgggccggtggccatgggccagccgcgccaccacgttgtggccggccatcaggccgtaaacgtaattgtcggcgcccagcatctccacgctgtccacccgcaggctgagcgcctcgccgccctcgtccgccgcgcgcaaatgctcgggccggatgccgaccttcagcttgcggccggccagcgccggcgcggccgccggcagcgccagcgacacgccgtcgcccagcagcagccgctcgccgcgctcgtccgcctgcgcgtcgaacagattcattcccggcgagcccatgaagccggcgacgaaggcgctggccggccggtcgtagatttcgtccggcgcgccgatctgctcgatatggcccttgttcaatacgatcacgcggtcggccagcgtcatcgcctccacctggtcgtgggtgacgtacaggctggtggtggccagccggcgatgcaggcgctggatttccagccgcatctggccgcgcagcttggcgtcgaggttggacagcggctcgtcgaacaggaacaccgccggctcgcgcacgatggcgcggcccatcgccacgcgctggcgctggccgccggacagctcgcgcggcttgcgctgcaacagctgctccagctccagcaccgccgccaccttcagcactcgctccatcacctcggcctttttcaggcccttgagcttgagcgcgtagcccatgttctccgccaccgtcatgtgcggatacagcgcgtagttctggaacaccatcgcaatgtcgcggtccttgggctccagctgattcaccagccgctcgccgatgcggatctcgccgtcctcggtgctctccagcccggccaccatccgcagcagcgtggacttgccgcagccggacgggccgacgatgaccacgaactcgccgtcggcgatctccaccgaaatctcttccagcacccggcgctcagcgccgggatagcgcttggcgatgttcttcagacttagttttgccatttggcgctctttctcatttctcgttgtccaccaggcccttgacgaaccagcgctgcatgccgatcaccaccagcagcggcggcagcagggtcaagagcgcggacgccatcaccaggtgccactgcaccgcgccctcgcccagcatgcccttgatcgcgatcaccgaagtggacatcgccggatcgtgggtgaccaagagcggccacagatactggttccagccgtagatgaaggtgatcacgaacaaggccgcgatattggtgcgcgacaagggcagcaccacgtcaatcaggaagcggatcggccccgcgccgtccacccgcgacgcctccatcaattccttgggcagcgtcatgaagaactgccgcagcaggaaggtggcggtggcggacgcgatcaagggcagcgtcaggccggtatagctgttgatcagccccatcttggtcaccacttccaccgtcgggaagatgcgcacctccaccggcagcatcagcgtggcgaagatcagtgcgaagccggtcttgcgcaaggggaagcggaaatagacgatggcgtaagccgacaggaaggaaatcacgatcttgccgacggcgatcagcatcgccatcacgaagctgttccacagcgtgcgcgccaacggcaccgccaacccgccgctgccgctccacagcacggtggagaggttggtccacagctggctgccgggcagcagcgacagcggcacccgcgtcacctgatcggcgtcctggctggcggcggcgaacatcagatacaaggggaaggccaccaccagcatgcccgcgatcagcatcgcgtggcagaacaggtccagccctttgcggttctccaccatcagtactgcacctttctttccacgtaacggaactggaccagcgtcaacaggccgaccaccgccatcagcaccaccgactgcgcggccgagctgcccagatccaggcccttgaagccttccaggtataccttgaggatcatggtctcggtggacttgcccggcccgccgccggtggccgcgtctatcaccgcgaaggtatcgaagaaggcgtacaccaggttgaccaccagcaggaagaaactggtcggcgacaacagcggaaacaccaggtcgcggaagcggcgcagagggccggcgccgtctatcgcggcggcttcaatcaaggacgccggtatcgcctgcaggccggcgtagaagaacaggaagttgtagctgatctgcttccaggccgaagccagcaccaccaagagcagcgcctggccgccgttgagcgcgtggttccactcgtagccggcctcgcgcagcagatagctgatccagccgagactggggttgaacaggaacagccacagcaccgccaccaccgacggcgcgatcgcgtacggagcgatcagcaccgtctggtagatgcggcggccgcgcgtgatctggttggccatcaccgccaggatcagcgcgctgccggtgcccagcaaggtcaccagcgcgctgaacagcagcgtggtctggatggtgcccagatacagcgggtcatggaacagcaggctgaaattggccaggccgacgaactggctgtccaggccgaacgggtcctgctgctgcaccgactgccacaaggcctccagcgccggccacaggaagaagatcaaggtgatcgccagctgcggcgccatcaaggcgaagcccagccagcgattggaaaaatgaatgcgattctgcatgcgtggactctatcgagaaaaacgggcggcctcgcggcgcgcccgtttccggagggatcagttggcggttttctcgaaacggcgcagcagctcgttgccgcgcagcacggcgctgtccagcgcctgcttggcggtcttcttgccggtccacacctcttccagctcctcgtccatcacggtgcggatctgcggcatatagcccaggcgcaggccgcgggtgtaggacttgggcggcttgttctgcatctggcgggtggcgatgtcggcgcccgggttcttgtcgtagaagccctgcttgcgcgacaaatcataggcggcgttcaccaccggcagatagccggtgtcctggtgccatttggccatcacttccggcgacaccagcatcttgaagaagcgggccacgcccttgtactcggccggggacttgccggccatcacccacaggctggcgccgccgatcaaggcgttttgcggcgcgcccttcaccgccggatcgtacggcatcatgcccatgccgaagttgaacttggcgttcttgcggatattggccagcgagccggagctgccggtcatgatgccgcactcgccgctgtagaacttcagcgtggcctcgtccttgcggccggcgtagctgaaggcaccgtccttggccatcttggccaggaattcgatgtgcttgacctgcaccgggccgttgaactgcagcgtcgcgccggcgccgccgaagccgttgtccaggctggcgaacggcaggctgtgccaggcgctgaagttctccagttgcacccagccctgccagccggtgctgtagccgcagcgcatgccggaagccttcagcttggcggcggcggcggccagttccggccaggtcttgggcggcgcctccggcaggccggctttcttgaacgcgtccttgttgtagtacagcaccggggtggacgcattaaacggcaaggacagcaggtggccggtcttggcgtcgctgtaatagctggccaccgccggaatgaaggccttctcgtccagtttctcgccggcgtcggccatcacctggtacaccggcttgaccgccttcttggcctggatcatggtggcggtgcccacttcgaacacctgcacgatggccggcgcgttgccgctgcggtaggcggcgatggcggccgccagcgattcgtcgtactggcccttgtacaccggcaccaccttgtagtctttctggctggcgttgaactgcgcggcgatggcgttgacccggtcgccgagcgagccttccatcgaatgccagaactggatttcggtggcggcgtgagccggcagcgacaaggccagcgtcagcggcgcgagcgcggcggcgcggcgtaaagtgcgggaaagggctagggacatcggcttctccatttatcattatggcggctggcattcacgcggcggattgtggccgggcaaaatgacagtatcgttacaataatatgacattaagtttacatcaaggcgcaaaaatggaatgaagacgcaaaaaaagcgcgccatgcaggcgcgctttttggttttcctccgctcattactgatagctgagcttgtcggccttgccccagaacacccgataggcgaaggctgtgtagccgatgatgcagggcagcaccacgatggcgccccacaatatcacccacagcgcctccggatcggccgccgcctgccagatggtcatctgccccagcaccacttccgggaacacgctgtaagccagcccccagaacgacagcagcacgatgccgacgctggcggcgaacggcagccagcagaaggcatcgttgcccgccgcctggcgccgcgccagccgcggcaggctgagcatcaacaggccgaacagcgccagcgagcccagcggcagcggcaacaacagcaggaactgcggcagcgcgaaccatttggcggcgatggccggattggccagcggcgtcaccagcgacaccgccgccaccgcggcgccggcgccgtataggctcagttgcgcccaacgtatcgccttggcctgcagcgtgccgtgggttttcatcaccagccagcaggcgcccagcagcgcgtaggccaaggccaggccgacgccgaccaccagcgagaacagccaggacgtggagctatcggcgaagccggtcaggtagcggcccagcatcaccccctgcgccagcgccgccagcagcgagccgccggcgaacgcggcgttccaccacggcttgtgcgggtcctgcgccttgacgcggaaatcgaaggcgacgccgcgcaggatcagccccaccagcatcgccagcaccggtagatagagcgcgccgaacaccacgccgtgcgccagcgggaaggccaccagcagcaagcccgcgcccaacaccagccaggtctcgttggcgtcccagaacggcccgatcgacgcgatcatcagatctttctcttcgtcgtccgccagcggcagcaggatgccgacgcccaggtcgaagccatccagcaccacgtacaccagcatggacagcgccatcagtccggcgaaaatcgccggcaggaaatatgcctcgttcatgccagttgctccttcagttgcttggcgtcggccgtctcatgcgcgccggccttgcgcgccaggtggaacaataccgagatgtaggccagcagcagcagcgcgtacagcgcgaggtaggtgcccagggaagtgaacagcatcggcgcggtggccttgcccgccgcctgggcggtggtcagcaccccggtcaccagccagggctggcggccgatctcggtgacgaaccagccggccagcgtggcgatccagccggcgaaggtcatgcccaccagcaggcgcgccagcggcttggccagctcgccgcgcttcttcaactgccaggccgccagccaggaggccaacagcatcaggccgcccatcgccaccatcacgcggaagctccagaacaccttggccaccggcgggtgctgctcgaactcgttcaggcccttgatctcgccgccccacttatgggtgaggatcaggctgcccaattcgggcacgccgaccgcataatcgttgctgcgggtttcggcgttgggcagcgcgaacaacagcagcggcacattcttctcggtatgccagatgccttctatcgccgccagcttggccggctggtgcttcagcgtattgaggccgtgcatgtcgccgacgaacatctgcagcggaatcagcaacgccgccaggaacaccccgctcttcagcgccagcatcacgccgcggccgcggtcgccgcgcaggtagcggtaagcggacaggcctgcgatcaggaaagccacagtcaggccggaggccagcagcatatgggtcagccggtacggcatcgacggattgaagatgacttcaatccagctgagcacatgggcgcggccgtcgcgcatcacgaagccggccggggtctgcatccaggaattgagcgcgatgatccagaacgccgacagcgtgttgccgcccgccaccagcagcgtggccagcgtgtgcaccttctccggcacccgggagcggccgaacagcatgatgccgaggaaaccggcctccaggaagaaagccgtcaggatctcgtaagccaatagcgggccggcgatattgcccaccgtctgcatatagccgggccagttggtgccgaactggaagctcatggtcaccccggacaccacgcccagcgcgaacgacagcgcgaagatcttcacccagaaggcgtaggcgtccatccagccctggtcgccggtctggcggaagcgcaccttgaagaacagcaacacccaggccatcgcgatattgatggtgggaaacaggatatgaaaggagatgttggtggcgaactggatgcgcgccagcgtgacggggtcgagttccatggtctactccttttcttcttcgcgatggcccagccgcgatagcgactgagtgaactgcagcaccttctgcacctgcgagcccagcttcatcagccgctgcagcgtctccacgtccatgtgctggatgtcggaaaaccaggtggtgaccaattcgatcagctggtacatctccttcatcctggcctgcgcgtgctgctcggcctcgctggccggatgctccatcatcgcgccgcgcagcatggtcagcgtcggctccacctcgcgcttcttgcgctcctcggccagggtcttgaagatcagccacacgtcttccggcgtggagaagtattcgcggcggtcgccgggaaaatgctgcagcttgaccagccgccacgactgcagctccttcagccccatgctgacgttggagcgggaacagcctatcgcctcgccgatctcgtcggcgttcagcggtttttccgatacgtacagcaaggcgtagatctggccgacggtgcggttgatgccccagcggctgcccatctcgccgaagtgcagcacgaaggcctgcaccagaggtggtgtgttcatgattttctcaattttcagtaatttctgaaactttgatatgaatcataattgccgggaatagttcgggtcaagatgaacaaggtatgatctgtaggcttgaccctatttccacgtcatgaatcaggacgcgaaaaaggccatgcgcggcatggcccggatgcggcacctcgccgcctcacaacagcaggatggcgcggaaatcgttgacgttggtgtgggtgggcccggtgaccagcagatcgcccagcgccgcgaagaaaccgtagccgtcgttgtcggccaaccgcgcgccggcatccacgcccagcgccgccgcccgcgccagcgtgtccggcgaaataaaagcgccggcgttgtcctcgctgccgtctatgccgtcggtgtccgccgccagcgcgtatacgcccggcaagccgttcagcgcgatggccagcgccaacagaaactcgctgttgcgcccgcccctgcccttgcccttcaaggtcaccgtggtctcgccgccggacaggatcagcgccggcctggccaccggcgagccgtgcgcggcgatctggcgcgcgataccggcgtggaccttggccgcctcgcgcgcctcgccttctatgctgtcgcccagcaacagcacgttcagccccagccgcttcgcctcggccgccgccgcccgcaaggccagctgcggcgtcgcgatcagccggtattcggcatgcgccagcctggcgtcgccgggcgcgggcgtctcgtccggctccgccgccagcaatgcccttgcggcgggcggcaaggtcaaaccatatttggcgaccaccgcgcgggcatcggcataggtgcttgggtccgccgccgtcgggccggaggcgatcaccgccggatcgtcgcccaccacgtcggaaatcgccagcgtcaccagtttggccggcgcgcaggccagcgccagccgtccgcccttgatggcggagagatgcttgcgcaccgcgttcatttcatcgatgccggcgccgcaggccagcaactgccggctgacctcctgcttgtccgccaggctgacgccatcggctggcagggtcagcaaggctgatccgccgccggacaacaggcagatcaccagatcgtcggcggtcaatccgctcacggcctccagtatccgctgcgcggccgcgcagcccgccttatccggcaccgggtgcgcggcctccagcactgctatccgctcggtcgccaccgcatggccgtaacgcgtcgccaccacgccggacaattcgcccggccaggcccgctccaactcccgcgccatcgccgcggcggccttgccggcgccgacaaccacggtgcggcctttagtcggcggcggcagatgatcgaccagccgtttcggcagcgcgctggcgacggccgcgtcgaacagacggcgcagcgtggattgcgagtcaagatcggacatgacgggttctccaatggcgatgacgccattttgccgcagccggccgcggctgacacccccgccgccgcgcgttagaatggcggcgattccaacgccccgccttcattcggggcgttacgcattttcccagaccgacacaagagcagagcccgacacccgatgagcacgccccagcacaccccgatgatggcccaatatttctccctgaagcgcgaccacgcagacaagctgctgttctaccgcatgggcgacttctacgagctgttctacgaggatgcggaaaaggcggcgcggctgttggacatcacgctgaccgcgcgcggcgccagcgccggcgtgccgatcaagatggccggcattccctaccacgccgccgagggctatctggcgcggctggtgaagatgggcgaatcggtggccatcgccgagcagatcggcgacccggccctggccaagggcccggtggagcgcaaggtggtgcgcatcgtcacgccgggcacgctgaccgacgccgcgctcttggacgacaagcgagacaacctggtgctggcggtcaatatggtcaagggcgtgctgggcctggcctggctgtctctcgccagcggcgagttcaaggtgatgcaggccgatgtggaagacctctccagcgagctggagcggctgaagccggccgagctggtgatcccggacgacaccggcctggccgccttcgaaggcatctcgacgccgaagaaaaagctgccgccgtggcagttcgacatcgaatcgtcgaagctggcgctgacccgccacttcggcacccgcgacctggccggcttcggcgccgacacgctgccagtggccgtcggcgctgcaggcgccttgctggaatacgtgaagtccacccagggcgtgaacccggcccacatcgccgcgctgtcggtggaggaagccggcgagctgatccgcatggacgccgccacccgccgcaatctggaattgaccgaaaccatacgcggcgaggcctcgccgacgctggcgtccttgctcgacacctgcgccaccagcatgggcagccgcctgctcggccactggctgcaccatccgatgcgcaaccacggcaagctggcccgccgccacggcgcggtgcgcgcgctgctggcgcgctaccaggacatccacgccgagctggaccaggtatcggacatcgaacgcatcacctcgcgggtggcgctccgctccgcccgcccgcgcgacctgtcggcgctgcgcgactccttgaccgcgctctccggcgtcaaggcgctggcggcctcgctggactccgagctgctgaaggaactggccggcgtgctgccggtcgattcgccggtgcaaaagatgctggtcgcgtccatcctgccggaacctgccaccttcctgcgcgacggcggcgtgatcaacaacggtttcagcccgacgctggacgaactgcgcgccatccagaccgattgcggcgacttcctcttgaaactggaagcgcgcgagaaagaacgcaccggcatcaccacgctgaaagtggagttcaaccgcgtgcacggcttctacatcgaggtgtccaaggcgcagtcggacaaggtgccggacgactaccgccgccgccagacgctgaagaacgccgaacgctacatcacgccggaactgaaggaattcgaggacaaggcgctgaccgcgcaggaccgcgcgctggcgctggaaaagcagctgtacgaggcgctgctggacgagttggccccgcacatcgccgagctgaagctgatcgcccaggcggtggcggcgctcgacgtgctgtccgccttcgcccagcgcgccgccatcggcaattacgccgagccgcaattcgtgccggaacccaagctcgacatcgtcgccggccgccacccggtggtggaggcggaagtggagcgcttcatcgccaacgacaccaggctatccgccgagcgcaagctgctcttgatcaccggcccgaacatgggcggtaaatccacctatatgcggcagaacgcgctgatcacgctcttggcccacgtcggcagcttcgtgcccgccgattccgcggtgatcggcccgatagaccgcatcttcacccgcatcggcgccagcgacgacctggccggcggccgctccaccttcatggtggagatgaccgaaaccgccaacatcctcaacaacgccagcgagcactcgctggtgctgatggacgaagtgggccgcgggacgtccacttttgatggcttggcgctggcctgggccatcgcccgcgcattgattgaaaagaaccgcgcctatactttgttcgccacccactatttcgaactgaccacgctggccggcgaatacccggcggtggccaacgtgcacctgtcggcggtggagcacaaggaccgcatcgtattcctgcaccacgtggaggacggcccggccagccagagctacggcctggcggtggcgcagttggccggcgtgccgggcaaggtgatccgcgacgcgcgccgccacctggccgacctggaaaaccagtcggccgcgcgtgtgcagccggacctgttcgccgcgccagcgccagccgccgaaccggagccgcatccggcgctggaaaagctgcaggaactaaacccggacaatctcagtccacgacaggcaatggaaatattgtacgaactcaagaaactgaccgattgaacagctatcaggctggacgttatctattattactaaatagtagtattgataaaggagcaatatgatgtcgtttgaaaccgcctccgccgtatccagtctgagccagcttctcggccagatcgaggacgacggaaccatcgccctatccgatatccgggagaaggccaaccaggaactctcctacttcgccaatctggcgcagcaggagttgcaccagttcgacatcagcatgccgccggcgatcagcctggtcagcaatgatcaatgtcagctggtattggaaaatcagcatccgcatgaagccgagatccatgagtggctggatggcaacctgatcctggcccgcaagttcaaggaaattgaggttctgttcgagctggtccgcgccgcggaaagcgccggcgagctgttttcggaaaactcgaacttccacgtcggcctgaccagcgcgggcccgatcgcctacttcgaggatcatcattcccactagcggcatcttccgtgaacgccattacagcgcgccgcaaagcgcgcaaacaaaacggggaagccacgcttccccgtttgtcatgatggcgcggaaattcgacgcgcccactggctatcagggcttcttgccgcgggcgaaacggaaagtcggcgccttgccgcccctgtccgccgcctgagcctggcgcggcggcgtcctgtcgccgggcttgccgccgcggccggcggacccgctccgcggcaacgccgccaaatccacctccagcgcgcgcatctcgcccggctgcaggccgtccagtttccacgggccgatggccacccgcaccaggcgcagggtcggcagtccggccttggcggtcatccgccgcacctggcggttcttgccttcgctgatgatgatttccagccagcaatccggcaccgtcttgcgaaaacgcaccggcggattgcgcggccacaactccggattatcgatgcgccgcacttcggccggccgggtgacgaagtcgcccaggtccacgccgcggcgcagcagctccagctgttcctctttcggctcgccctccacctgcacccaataagtcttcggcagcttccagcgcgggtcagcgatgcggtgctgcagcgcgccgtcgcctgtcagcagcaacaggccttcgctgtcggtatccagccggccggctggatagacgccgggctgctgcacgcaggacttcagcgtcggatgcgtggggtggtcggaaaactggcagatcacgccatacggcttgttgagcagaatcagctggggcatgcggcgaaaacggtgaaatgaagtaggcgaatgataacaggccaggccgccgcgcggccggctatcccgcgcggttctccttcaccgccgaatctgacggcgctcgaacaggtgttttattcgcatccgaacgccagccggccagttatcaggcataaaagtttcagttgcgccgccaaccaagccgatgagaaggggtataattcgcttttgaaaattgccctagagccgccgaatgcgcgcatccggccggccgcgcgctccgacacgcccggcgctgtcgtccgagcgctaaactcttcgcgcaatcgttctgtcatcacaagatcaacatggagatagagtcatgcctgcagaacaatcgaaaatcatctataccctcaccgacgaagcgccggcgctggcgaccagctccttcctgcccatcgtccaggccttcgcgggttccgccggcgttcaggtagacaccgccgacatctccgtggcctcccgcgtgctggccgaattccccgactatctgaccgacgcgcagaaagtccccaataccctggccgagctcggcaagctgacgctgcagccggaagccaacatcatcaagctgcccaacatcagcgcctcggtggcccagttggccgcctgcgtcaaggaactgcagtccaagggctacaatgtgccggactacccggaaaatccggccaacgacgccgaaaaggcgatcaaggaccgctactccaagtgtctgggctcggcggtgaacccggtgctgcgcgaaggcaactccgaccgccgcgcgccgctggcggtgaagaactacgccaagaaacacccgcactcgatgggcgaatggaagcagtggtcgcagacccatgtctcccacatgcaccacggcgacttctaccacggcgagaagtccatcacgctggacaaggcgcgcgaagtcaagatggagctgacgaccaagagcggccagaccgtggtgctgaagcccaaggtcgcgctgcaggccggcgagatcatcgactcgatgttcatgagcaagaaggcgctgtgcgacttctacgaacgcgagatggaagactgccgcgaatccggcatcctgttttccttgcacgtgaaggccaccatgatgaaggtgtcccaccccatcgtgttcggccactgcgtcaagatctactacaaggacgcgttcgagaagcacggcaagctgttcgacgagctgggcgtcaacgtcaacaacggcatggccacgctgtacgaaaaaatcgaaaccctgccggcctccaagcgcgaagaaatcatccgcgacctgcacgcctgccaggaacaccgtccgcgcctggcgatggtggactccgccaagggcatcaccaacttccactcgccgaacgacatcatcgtcgacgcgtcgatgccggccatgatccgcgccggcggcaagatgtggggcgccgacggcaagccttacgacgccaaggccgtgatgccggaatcgaccttcgcccgcatttaccaggagatgatcaacttctgcaaatggcacggcaacttcgacccgcgcaccatgggcaccgtgcccaacgtcggcctgatggcgcaaaaagccgaggaatacggctcccacgacaagacctttgaaatccagcaagacggcgtcgccaacatcgtcgacctcgccaccggcgaagtgctgctctcccagaacgtggaagccggcgacatctggcgcatgtgccaggtgaaggatgcgccgatccgcgactgggtgaagctggccgtgacccgcgcccgcaactccggcatgccggcggtgttctggctggacccgtaccgcccgcacgagaacgagctgatcaagaaggtgcacgcctacctgaaggatcacgacaccaacggcctcgacattcacatcatgtcgcaggtgcgcgcgatgcgcttcacgctggagcgcgtggcccgcggcctcgacaccatctcggtcaccggcaacatcctgcgcgactacctgaccgacctgttccctatcatggagctgggcacctcggccaagatgctgtccatcgtgccgctgatggccggcggcggcatgtacgaaaccggcgccggcggttcggcgccgaagcacgtgcagcagctcttggaagagaaccacctgcgctgggacagcctgggcgaattcctggcgctggcggtatcgctggaagacctgggcatcaagaccggcaacgccaaggccaagatcctggccaaaacgctggatctggccaccggcaagctcctggacgagaacaagtccccgtcgcgccgcaccggcgagctggacaaccgcggcagccagttctacctgtccatgtactgggcgcaggcgctggccgagcaggcggaagacaaggatctgcaagcccgcttcgcaccggtagccaagcaactggccgacaacgagcaaacgatcctggccgaactgaaggccgtgcaaggcaagagcgccgacatcggcggctactacctgccggacgccgccaagtgcagcgcggtgatgcgcccgagcgccaccttcaacgccgccatcgcggcggtgcaaggctaagcgtctccgcccgcgtcaaccaggcccccggatgtccgggggcttttttcatgccggctgccggcgcctgcgcatcggcaaatgaaaagcccgccagaggcgggcttttttgaatacgacttacagcccaccgcgcggcggggctgcggcagaaccgcccttaggcagcgttctggatgttcgacgcttgcttgcccttcgggccggacaccacttcaaagcttacgcgctgaccctctttcagggtcttgaagccttgcatgttgatggccgaaaagtgagcgaacagatcttcgccgccttcgtccggggtaataaagccgaagccttttgcgtcattgaaccacttcacggtaccaaatgccatttcacatccttgggaaaaaaggctggtgaagccgaccaacttagagcttaatagactttgacaagatgctgtgacgcaaaatgccaaacagttaagccaagcaccagctgcatttctacgcaacccgggcagtgccgtcaagtgattgccggcttgagtccccccttgaaaaaaagtcagagggaaccaaaattgaagtaaggcaccgtttccatgaaagtcgacatgtccacctcggtcaaagacgatgcccagcttgaggcgtcacgggttagggaaaacccgcccccgatgtataaggtgttgttattgaacgatgattttaccccgatggacttcgtggtgcaggttctccagcagttcttccacatgaaccgcgagaaagccacacacatcatgctgcaagtccacacgcaaggtcacggcgtgtgtggcgtttataccaaagacgtggctgcaacgaaggtcgagcaggtgttgcaatatgcgaaagcgcatcagcatccgcttcagtgcgtaatggaggaaaactgatgattgcccaggagcttgaagtaagcctgcacatggcgttcatggacgcacggcgcaagcgccacgagttcatcagcgtggagcatctgctgctcgcgatgaccgacaacccgtcggccgcagaagttttgcgagcttgcggcgccaatatcgaccaactgaagaagcaactatccgacttcatcgacgagcacacgcccaccgtgcccggcgaaaccgaggtcgagacccaaccgacgctgggattccaacgcgtgatccagcgcgcgatcctgcacgtgcaatcgtccggcaagaaggaagtgtcgggcgccaacatcctggtcgccatcttcggcgaaaaggattcgcacgcggtctactacctgcaccagcaaggcatttcgcggctggacgtcgtcaacttcatctcgcacggcatcaccaagcagcggtcgcagcagccgccgcaggaaccgcgcgacaacagcggcaacgatgtcgagaacgaagagcagagcaccggtccgggcggggcgctggagaattacacccagaacctcaaccagatggcgcgcgacggcaagatcgacccattgatcggccgcgagcacgaactggagcgcacggtgcagatcctttgccgccgccgcaagaacaacccgctgctggtcggcgaggccggtgtcggcaagaccgccatcgccgaagggctggcgcggcgcatcgtcggcggcgaagtgccggaaatcctggccaagtcgaccgtctacgcgctggacatgggcgcgctcttggccggcaccaagtatcgcggcgatttcgagcagcggctgaaggcggtgatcaagcagctgaccgacgacagcaacgcgatcctgttcatcgacgagatccacacgctgatcggcgccggcgcggcttccggcggcacgctggacgcctccaacctgctcaagcccgccctgtccaacggcagcctgcgctgcataggggcgaccacctacaacgagtaccgcggcatcttcgagaaggacaacgcgctgtcgcgccgcttccagaagatagacgtctccgagcccaccgtgcagcagacggtggaaatcctcaagggactgaaatcgcgcttcgaggcgcaccacggcgtcaagtacacgcagtcggcgctgtccaccgcggccgagctggcggcccgctacatcaacgaccgccatctgccggacaaggccatcgacgtgatcgacgaggccggcgccgcgcagaagatcctccccaaatcgcggcagaagaaggtgatcaacaagtcggagatcgaagagatcgtcgccaagatcgcccgcattccgccgaagacggtctccagcgacgacaagaacgtgctgaagaacctggagcgcgatctgaagaacgtggtgttcggccaggagaaggcgatcgaaggcctggccagcgcgatcaagatgacgcgctccggcctcggcaatccgcaaaagccgatcggatcgttcctgttctccggccccaccggcgtcggcaaaaccgagctggcgcgccagttggcctacatcctcggcgtcgagctgatccgcttcgacatgtccgagtacatggagcgccacgcggtgtcgcggctgatcggcgcgccgccgggctatgtcggcttcgaacagggcggccagttgaccgaggccatcaacaagcatccgtacgcggtggtgctgctggacgagatcgaaaaagcgcatccggacatctacaacgtgttgctgcaggtgatggaccacggcacgctgaccgacaacaacggccgcaaggcggacttccgcaacgtggtgctgatcatgaccaccaacgcgggcgcggagtcgctgtccaaaccggcgctgggcttcacccagaccaaggtggccggcgacgagatgggcgacatcaagcggatgttcagtccggaattccgcaaccgcctggacgccatcatcccgttcggcgtgctggacgagcagatcatcctgcaggtggtggacaagttcctgatgcagctggagcagcaactggcggagaagcacgtcgacatccacttcaccgacgagctgcgccgcttcctggccaagaacggcttcgacccgctgatgggcgcgcggccgatggcgcgcctgatccaggacacgctgcgcaaggcgctggcagacgagctgctgttcggccgcctggtcggcggcggcgaagtgaccgtcaccgaagcggacggcaaggtggagctgctgttcgaccagcccgcgctggccgccgagcccgcctgagtccggcaagcctggaaacgatgcctgaacgcccgcgcaagcgggcgtttttcatggcgctagccgcgcggatgatggcgcgcgtgcaactgctttaaccgttcgcgcgcgacgtgggtgtagatctgggtagtcgaaatgtcggcatggcccaatagcaactgcaccacccgcaggtcggcgccatggttgaccaggtgggtggcgaaggcgtggcgcagcacgtgcggactgaccttggccagcccttggcgcgcggcgtattgcgaaatcaaatgccaggccatctgccgcgtcatgccggctttgcgctgggtgacgaacaccgcgtcgcacggcaggccggccagcagcagcggccgcgcttcgcgcatatagcgcagcagccagtcctgggcgatttcgcccagcggcaccagccgctccttgctgcccttgcccatcgttttcaccacgccgtccagcaggttcagctgggtcagcgtcatgcccaccaactccgacacccgcaggccgctggcgtatagcacctccagcatcgcccggtcgcgcaggcccagcggcgtcgccacgtccggcgccagcagcagcgcctccaccgcctgctccgacatcgacttgggcaaccgcagtccctgtttgggcgtggccagtccggcgctgggatcgtcggccctttgcccgctttgcgccaagtgctggtaatagcggcgcagcgccgatgtcagccgcgcccgcgtcgccggcttttcgctgtcgacgccggccagcagcgcttgccgcagctgctcggcatcggcctgcgccagcgtggcgcccgctgcctgcaaacggcctgacaatttggccagatcgcgccggtacgccgccagcgtgttctgcgacaggccgtcgctcagccacagttggtcgagaaaagcgtcgatgccgtccttatccgagttcatgccgcaacagccatcgcttgatgtccagcgtctcgtcgccgcgggactggttgaaaccgcccagccccgcgctcgccaccacccggtggcaaggcacgatgatgggaatgggattgcggccgcaggccccgccgaccgcgcgcggcgacgacgccagatcgcgggacaggtccaaatagcggcgggtctcgccgcgcggtatcgccgcgatctgctgccacacccgcagctggtacggcgtgccaagcagccgccacggcacgctgaacgcatggtccgcgtcggcgtagtaggcgtccagctgccgctccacctcagcctccaggctgcccggcgcgggcggccgcaaaaccgcgccggccggcagaaagcgcagcccgcgcaattcgccgtcttcgcagcgcacgcccaagcgcccgaacggcgcggcgatcaccaccggatactccatccccgtctcccaataaaaaaagcgcaaggccgagccttgcgctttgatcataacggctgtcgccgacaggattagccctgtttgcgagccggcagcttttccttgatgcgtgcggacttgccggtacgaccacgcaggtagtacagcttggcgcgacgcacgtcgccgcggcgcttcacttcaacggaagccaccagcggggagtaggtctggaaggtacgctcaacgccttcgccggcggacatcttgcgcacggtgaacgcgctgttcaggccgcggttacgcttggcgatgacaacgccttcgtaagcctgcagacgctcgcggttgccttcctttaccttgacttgaaccactacggtatcgccaggagcgaattccggcagggttttgcccaggcgtgcgatttcttcttgctcgagtttctggatcagatccatgttttactccggttttttgcggatatcttgttcctgctggtactccgccagcagccgagattcctgttttgtcaaaacgcggtcttgcagcagctcgggccgacgcttccacgtcctgcccagcgactgcttgagccgccatttggcgatcagggcatgattaccggacaacagcacgtccggcacccgcatgcctcgatactcttcgggtcgggtatagtgcgggcagtccaaaagaccgtccacaaatgagtcttcataggccgactgcgcatcgttgagcgcgccaggcaacaagcgcaccaccgcgtcggtcagcaccatcgccggcaactcgccgccggacagcacgtagtcgccgatggagatttcctcgtcgaccgcggtttctatcaggcgctcgtctatgccttcgtagcgtccgcacagcaggatcaatcccggccgctgcgacagctccaccgccttggcgtggctgagcctagcgccttgcggcgacaggtagatcacatggctgcgttcgacgccggccgcctgttggcggttgcgggcggaagcgatggcctgctccagcggctcgatctgcatcaccatgcccggaccgccgccatatggccggtcatccacccgacgataattgtcgtgggtgaaatcccgcggattccaagccttgaagccccagagattcaagtcaagcgcccgctggctgacgccaaagcgggcgatagagtcgaacatctccggaaacagcgtaaccgcgtcgatctgcatcagtagtccaggccccagtccaccaggatgcggccttcggccggcatcacttccagcacgtactggtcgacgaaggggatcagcctttggccgtgctcgcccttcaccaccaacacgtcgttggcgccggtttccatcagactgtccaccgcgcccagcgtttcgccctgctggttgaccaccgccagaccgatcagatcgctccagtagtattcgccttcgccagcctcgggcagttcgctgcggggcacggcgatctgcatgccgcgcagggcttccgccccgtcgcggtcctcgacgccttccagcttggcggcaagcgccttgggctggatggtgccgttctcaaatgcatgcggcttccagctgccgtccttgcccagccaccagactgggtagtcgaacaggccgtcagcgtgttcggtatcggcgtggattttcacccagcccttgataccgaaggcgccgcgcacaaagcccattaccaccagatcttcgtcgcgcatgcgcccaattccgtcttgatgtcggatagccggattaagcggctacgactttctgctctttcagcagcttggcaacggagtcggacagctgagcgccgacgccaacccagtagttcagacggtccatggtgaagcgaacgcgctcttgcttttcgttggctaccggattgtagaagccaacgcgctcgatgaagcgaccgtcacgacggttgcgggagtcggtcaccacgatgttgtagaacggacggttcttggcgccgccgcgtgccagacgaatcactaccattgtcgattgtccttgaaaaaaactgtgtatagaaaagcccacgattttagggcagatttcccttatcttgcaagcgcttaatgcaagtccctgttccgccagcctattgcagcgtcttcagcaccaggctcagcgcccggtcttcggggtgggcctcgatgctaaatcccagtttatgcatcagtttcagcatgcccttgttgcccgccagcacctcgccgcgcatgatcttcagcccctgctcgcgcgccgcgtcgaacaaggcctgcatcaacagattgcctatgccgcgcccctgccagtcgtcggccacttccagcgcgaactcgcaggcttcgttgtccggatcggtgatgaagcgcgccaccgccagcatctgctcggcaccctggtcgtcgcgcgtcatcgccagcgccatctcgcggtcgtaatccagctgggtgaagcggaccagcatgctctgcgacagctgcttgatgctcgacaggtagcggttgtagcggctttcctccgacaaattgcgcacgaaggcctgctgcatgtcggcgtcctccggccggatcggccgtatcatcaccggcgtgccgtcggacagtttggcgcagatcaccatgtgcgaagggtaaggcatgatggccatatggccgtagcgcttgaggtcggcgcgcgccggctcgacgaagatgcgcgcatccagcgcgatcacgcctttctcgtcggccaccagcgggttgatgtccatttcccgcagctgcggcagctcgcacaccatttccgacacctgcagcagcacgtggcgcaattcgtccaggtccaccggcggcaggttcttgaacggccccagcagctcgccgatgcgagtctgcgccaccatattgtcgaccaggtagtcgttgagcggcggcagcgccaacgccagatcgcgcatcacctccaccgcgatgccgccggcgccgaaggcgatcaccgggccgaaggcgatgtcgtgcgccacgcccaccatcacttcgcgggcgaagcggcgctttcgcatcggctgcaccgagatgccgtcgatgcgcgcgtccggccgcgcctggcgggtccgcgacaggatggcgtcgaacgccgcccgcagcgtggcctcgttgctgatgttgagctccaccccgccgacgtcggacttatagatgatgtccggcgaatcgatcttcagcaccaccggatagcctatcttgtcggcctgcttcaccgcctcgtcggcgttgcgcgccagcgtggtgggattgaccgggatgcggaaggccgccagcacctgcttggattcgcgctcggacaggatgttgcggccttcggccagcgctctgtctatcaccttgcgcgccgccgccgcgtccggtccggagcgcttgccctccagcggccccggcgtctgcagcagcaactgctggttgtgctggtaggccgccaggtggcggaacacctcgatgccgtattccggcgcgcgaaaatgcgcgcacttggccttggagaacagttcgcggctttccgacaccttggcgtcgcccagccaggacaggaacagcggcttggtggtctcgcgctgcaggcctatcatcagctgcgcggtggtcaggtggtcggtgccggcctgcggcgtgaagatcaccatcacgccgtcgacgccggagtcgtcgacgcaggccttgaccgcggtgcgaaaacgcatcgggctggcgtcgccgatgatgtccagcggattgccgcgcgaccagttgcgcggcagcacgctgtccagcagcttgacggtgccctcgcccagcttcgccagctccacgccgtaatcgacggcgctgtcggccgccagcatgccggggccgaagccgttggtgacgatggccagccgcttgccgccgacgcggtaattggcggccagcaccttggcggcggtgaacagctgggcgatcgacgacaccctgagcacgccggcgcgggccagcgccgcgtcgaagacttcgccgctggccaccagattgctggaatgagtcaggccgcgggcatcgctctcgaagcggcccgacttgatcaccaccaccggtttggtgcgggcggcggcgcgcagcgccgacatgaagcggcgcgcgtcgtgaatgtggtgcacatgcaacaaaatcccctgggtggcgttgtcggccaccaggtaatcgagaatttcgccgaaaccgacatccagcgcgccgcccagcgaaatcacgctggaaaagccgatttccttgctatcggcccagtccagcatcgccgcgcacagcgccgacgactccgacaccagcgccagattgcccggccgcaccttgccgctgtaattgctggcgttgaaacccgccaccggccgcatcaggcccagcacattcggccccaggatgcggatgccgaaatggcgggcgatggacagcgcctcgttgatcagctcctgctccagctgctcgctgtcggaaaactccttggccagcagcaccgccttgacgcccttcttgccgcagtccttgacgatggcgggcaaggagcggatggcggtcaccaccaccgccagctccaccggctcgtctatctgccgcaccgaagccaccgccggaatgccccccaccaccttatgattgaggttgaccggaaacagcttgccctggaaggaactggccagcagattggcgaacaccgcctggccgatcgagccgggacggtcgctggcgcccaccacggccacggtgcgcggagaaaacagcggggtcagataatgtggcctcatgcgcgttcatcctcggaaacaatgtctatcggcgccggcgcgctcgggcagccgctccgagcgccagcttacgcgatcccgggcccgcgcggcgcggcagcgcggccggccttgatcatgcgggctaaatcttttcgtcatattgactttgggcaagcggcggacaaatgcatttcatgtcacaggcagcgacgattttccccgccgccgcgcccagccagtagcgcagactttacaatattgctaatctttactattccgcaacaaaccttgttgcgttgcaccattcagccgccgcggcccgcgcgcccggtcaggcaggagccgactcaaccatgacgaaacgcgtcgtcaccctcgctcattattacacccagcccgaaatccagcagatggcggacaaggtgggagacagcctggaattatcgttgtacgccaaggaagcccaagccgacatcatcgtgttcgccggcgtgcgcttcatggccgaaaccgccaagatcctgaatccgcaagccacggtgatcctgccggacgccggctccacctgctcgctggtcacccagaccgacgtggcggagctgacgcagtggcgcaagcgctacccggaccacgtccacgtgtcctacatcaactccagcgccgaacacaaagccgtgtccgactggatcgtcaccagccgcaacgtcgacgacatcatcgcccacctgtacgccgaaggtaagaaagtcatcttctcgcccgaccgcaacatgggcggctacctgaacgaccagtacggctacgacatgccgctgtggtcggcggtgtgcgaggtccacgacaagttcaacgaagccgcgctgaacgaggccttcgaggccgtgcccggcgagaaatacctgatcgcccacccggaaagcccgctgccggtgctgaagaaagccgactacgtcggctccacctccggcatgctcaactgggtgaaggcctaccagggcgacgccaaggcggtgatcttcgtcgccaccgaagacggcatcctgtacaacatgggcctggcccgccccgacctcgacctgcgccaggcgccgatctacgccggctgccagtgcaactcctgtccgtacatgaagatgaacaccatcgaggcggtcaagcgcgcgcagcagggccagggtctggagatcgactatctgacgccggcgcagatggacgccgcccgggtgcccatcgagcgcatgctggaattcagccagcgctactacgcctgacacaggccaagaagcccgcgcgcagcgggcttttttacggcccgacgccgcggcggccctattcgctgtcatcccggcggcgctacaatcatgcgatatcaacggaaagacagtatgaagtttctgctcagcaacgatgacggttattccgctcccggcctggccatgctggccgccacgctctcgcgttacggcgaagtggtggtggtggcccccgagcgcgaccgcagcggcgccagcaactcgctgacgctggaccggccgctgaccgtccgcaccgccgccaacggcttccactacgtcaatggcacccccaccgactgcgtccacctggccgtgaccggcatgctcgacttcaagccggacatggtgttcagcggcatcaacaacggccccaatatgggcgacgacacgctgtactccggcaccgtcgccgccgccaccgaaggcttcatgctgggcattccctccatcgccgtctcgctggccggctatagcggccggcatttttccaccgccggcaaagtggtggcgcaactggtggagcgctgcctggaacagcccttccagcaaccggtgctgctcaacgtcaatgtgccggatgtgccggaggacgcgttgggtcccttgtccgtgacgcgtctgggccgccgccatgccgcgcagccggcaatcaaatctcagaatccgcgcggagagacgatatactgggtgggaccggtgggcgcggtgcaggatgccgccgcgggcaccgatttcggctgcgtcgcggcctcccaggcttcgatcaccccgctgatgctcgatttgaccgccttcgggcaactggacaggatttccacatggcttcaccgctgacacagaacggccaggcatacggcatgctttccgagcgcacccgccggcgcatgaccgaccgcctgcgccagaatggcatcagcgacgaaagagtactcaaggccatgcacgaggtgccgcgccacctgttcgtcgaccaggcgctggccacccgcgcctacgacgacgtgtcgctgcccatcggccatggccagaccatctcccagccgctgaccgtggccaggatgacggagttgctgctgcaagggcgccagccggggaaaatcctggaaatcggcaccggttgcggctaccaggccgcggtgctgctgaaaaccggcgccgaggtgtattcgatggaacgactggccgcgattcttgaccaagccagacgcaatcttcgcgcctccaagctggtcaacgcccgcctggtgcatggcgacggcaacgccggcctgcccgaagccgcgccgttcgacggcatcatcgtcgcggccgcggcgcggagcatacccggcgcgctggtcgaccaactggccgaaggcggccggatggtactgccgctgggcgaaaccgagcagcatttgtggctgctggaaaaaacctcgcagggcgtgcagaaaaccaagctcgacccggtgaaattcgttccgctgctgaatgggcgtagttgaaactgcaaaaacgcaacactatcgctgtcagacaatcaagcaaaactcttattcaacgtttcaacaaaaaaaacatgctaaaaatgcattgcaggtatgcgtatatattagttgccgcgctgggggccggattggccggttgcagcagcatggtgcaacaggccgcgccggtggaaagcgccgcgcccgccccagtgggccagagcaaaccggcgcaaaccgcgccggcggttccggccgcgacgacgggcaatactgtcgccaccccgtaccgggaccagggcagcctggccgtgcagccggtggacagcggcgcggcagccgccggcgagcagacttatgtggtgaaacccggcgacaacctgttccgcatatcgctgaaccatggcttgaagtacaaggacgtggccgcctggaacaatctgccggacaccggcatcaaggtcggccaggtgctgcggctgacgccgccgggcggctcgatgccaagcgccgcagccggcacggcgccggtcacggtcgcgacgagtccggccgccgggcagtccgctgccggcgcaggcgcggtcaaggcctatcccaaagccttgaagctgccatacggcagcgacgcggcgaaagaactggcggctcagagcgagggacgccaggtcggcaagaacaacgctcaggcgtccggctccgccgcggcgccggcgcccggcaaaaagccggaagccagcgcggcggtcatcgcgccggctcccgccaaggatgccagcgcgccggccgccaaggccgacgaagacgcggtggcttgggggtggcctaccgagggcaaggtgtcgaaaggctactcggacagcaataaaggcgtggaaatcgccggccgcatgggccagccggtgctcgccgcaggtgatggcaaggtggtgtacagcggcgccgggcttcgcggctatggcaagctgatcatcatcaaacacaataagaccttcctgtcagcgtatgcgcataacagccagctgctggtaaaggaaggacagtctgtcaagaaagggcagaagattgccgaaatgggcaattccgatgccgaccaagtcaagctgcacttcgagatccgccgtttcggcaagccggtggacccgatgcagtaccttgaacacaagtcctgaacgggtaggctccgcccccgtcgggacaagacagcgacgggggtagagagatgagcaacgaaatggatatcctggacgagaacgaacttctcgacgaggaaggcggcgaggaagccgccgccgaaacggaagcggaagaagccgcggaaagcaccgcggtcttcgaagacgtggtcgccgacgtcacccagatttatctgaacgacatcggcaacaacgcgctgctgaccccgcaggaagaactggcgctggcgcgcagggtggtggccggcgagttcgaagcccgacagaagatgatcgagcacaacctgcggctggtggtgaacatcgccaagcattacatcaaccgcgggctggccctgctcgacctgatcgaggaaggcaatatcggcctgatgcacgcgctggagaaattcgaccccgagcgcggcttccgcttctccacctacgccacctggtggatacgccagagcatcgaacgcgcgatcatgaaccagtcgcgcaccatccgcctgccggtgcacgtgatcaaggagctgaacgtctatctgcgcgcttcgcgccatctggaaagccagatcggccgcgagcccagcatagaggagatcgcccacctggtcggcaagccggtggaggatgtgcgcaaggtgatgaacctcaacgagcgcatggcttcgctggacgcgccgctggacatcgatccgatgctgtcgatcggcgaatccatcccggacgagcagcacgaagagccggagctgcagctgcacaacaaccagctggaaatgttcgtccacgactggctgagccagctcaacgagaaacagcggctggtgatagagcggcgctacgggctcaacggctacgagatctgcacgctggaggaactggccgcctcgctcagcctgacccgcgagcgcgtccggcaaatccagatcgaaggcctggagcaactgcgccgcatcctgcgccgcaagggcatctcgcgcgacttcctgctctgagccgcacccgctccatccgcttaagcccggccctgccgggctttgtcatttccagcgccgcgcccgccgcagccagcgccgctcctccgccgcatccggctcgctgcggcgatagcgcagcgccatgtagtcgtcgaccagccgcttcagcccgcggtaatcgtccagcggcagtccccgcgccgccttcagcacctccaacggtccctgcgcggccgtggtcggaatttgccgccgcgccaacccagcccgtatcagacgccagccctccgccatcggcgcctgcgccggacgcctgcgccaccacagcagcaagggcagcgtcgccagcagcatgcccgcggacaccccccgcgccacgctgccggcatccacccgcgcgcccaggcccaagcgctggaacagccgctgctgccggctggcgtcgtaacccaccacccactgctgccaggcgaaattgacagccgtccattgcaggcgccagctgcgcagccagcccggcggcaagatggccgaaactcccgctccgccgctcagcccgggcagcgcctgctccgcggcctgctccacccgcgccggcgacaccgcggcggtgggatccacccgctgccattcgccagtatctgacagccagatttccacccaggcgtgggcgtcggacgaacgcacctgccagaagcgccccaccgggttgtattcgccgccctgatagccgaccaccacccgggccgggatgccggccacgcgggcgagaaaggcgaacgccgaggcatagtgctcgcaaaaaccttgccgggtatcgaacaggaactggtccaccgcctgctctcccaacagcggcggcctcaaggtgtaacggaagccgcccagccgcagatattgcagcgcctcgccggcgaaagcccgctcgccgccggcctggcgcgccagccgctgcgccaatgcccggctgcgcggattgcccggcggcaagcgccggtagaacgcctggctggcggccgacaaggcagccggataacgccctcccaggctgctggccagcgcgtagcgggccaactcgtcccgtttctcgtcctggcgcaacagcccgccggcctccagatgactgtcgccgccggcctgctgcggcagatcaagcgccggcagccggccccggtccggtttcagcgtcaggctgtacgccacccggcggcccagcgctggcggcaaggattcgccgcgctcgccgccgacattcagccagcgccggccgtcgaaatcatccagcagcatcacccgccaatacagctggtcctgcggcggcgcggcgccggcgaacaccgccgaaaacgccggctcgcgattgaggatgagctggctgatgctgccgggcgccatgctgtcgcccaagccgctggcggccgcgccctcctggcccggcatgctccacaacggctccggcagcctgggcatcaccacgaacagcaccagcatcatcggcagcgacaacagcagcgcctgcgcggcgctgcgccagctgccgcgcggcaattggccggccagcgccgcggtggcccaggtcagcagcaacaggcaggccaccagccagccagccatcagcggcgactggtcgaacaacagcggcatcgccgccaggaagaagcccagcgccagcagcacccgccagtcgcgcaggctggcggtttcgaaagccttgaacgcgatcagcaaggccagcagcgcgacgcccccctcccgccccaccagcgtgcgcaggctgagccacaacaccgcgacagcagccagcagaaccggcagcaacagccagcgcgacggcaagccgcgccctcccgcctccagccaggcccggccggccagcgccagccagaatagcgccagtagccacggcggcaagtgccaggccagcggcagcgcgcaccaggccagcgccagcagcgccggccagcggcgctcgcccgccgcctccggcgtcatggccgctctccatacagcgccagcgcgctcagcgcctgctcgcgctggcgcggctgcgggccgatctcgccgcccggcaggcacagccggtaaggctggcggcggcgctcgcaacgctccacccgccaggccagccgcgacaagcgccgctcggcatcgggctccagggcgtaatcgctccatcgcagcagcatcaattcgcccccgccctcgccggcgaagcgcttgctggccagcacatcccgctgggccagaactttccaggcgatccggcgcggcgtgtcgccatggcggtatgcgtccagatgggagaaatcgtcgccgtcgggcaggctttccctgccttccccgccctcgccttcgctgacgccgctcgccgcgtccggcagcggcgccggatacaccagcagccgcgcctgcagccgcagcaccgcccaggcgcggatcaggccgaaaggcgcctcgctcgccaccacgcaggccggcagcgccagccagccgcggctgtcggcgcgcagttccagctccacgcagccgctcgccatcgcatccagcgtgcagggcaatcttggcgcgccaggctgctggacataagcctgcaattgccgctgcagcggcgacgggttgtccagcaacaggcggaagcgggcggcgtcgccggcgaacaccgcggcgcccggctccgcccgcagcctcaggccggacagctggcgataggccatcagcaccgccaccaacaccaggctgacgatccagaacgccagcgcgtaagcgaggcttacctggtagttgagcgcccccacccacaccgccagcgccaccgccagcagcagcaggccgaagcgggtgggcaataggtagatgcggcgctgggacagctcgcagcgctcctccagcggcagcctggccagcagccagcgccgcaggcgctcacggaatggcgacatgggtcagcagccgctccagttcccgctccacgccgccggccgcggcctgcagccgatgcgccgccaccggcaggaacaccgccttcacgtcttccggcagcagatggtcgcgccccgccagcagcgcccagccgcgcgcggcggccgccagcgcctggccggcgcgcggactgagtccggtggcgaacacgccggactgccgcgtggcctccaacagcgccagcagatactccgccagcgccggactcaccaccaccgccgcggccttgcgctgcagcgccagcaattcgtcgggcttcatcaccgcctggaagcgttccagcaggctgcgcctgtcctcgcccatcagcagcgcgcgctcggcctcccgcggcgggtaacccagcgaaatgcgcatcaggaaacggtccagctgcgattcgggcagcggaaaggtacccatctgctcgcccgggttctgggtggcgatgacgaagaacggcgacggcaacgcgtgggtgtcgccgtctatcgacgcctggcgctcctccatcgcctccagcagcgccgactgcaccttgggcgaagcgcggttgatttcgtcggccagcagcacctgggtgaacaccggccccttgtgcagttcgaagcggccgctgtcgcgctggtaaatgctgacgcccaggatatcggccggcagcaggtcgctggtgaactgcacccggcggtagtcgaggcccagcaccgtggccagcccgtgcgccagcgtggtcttgccgacgcctggcacatcctcgatcagcaggtggccgcgggcgatcaaacaggcgaaagccagcctcagcgcctgcggcttgcccagaatcagtgtgttcagttgccgataggcctgggagagtgattgcatttgcccccgcttgcgcgcagtatttatcaaaaatagataaacgatatttcattgtaagcacgcagggagcgttcgtgttcacttggctgaaaaaccgcttgcagcgcaatggcctgaccgcctacgtcacccatgccgactgcctgcagcacaatatgggggcgggccaccccgaatgtccggaaaggctgaccgccatccgcgaccagctgatggcctcgcagatctacgacagcctgcaggaagtggaggcgccggaagccacctacgagcaactggcccgcgtgcacccgccgcgctatgtcgaatacctggaggcctgcgcccccagcgtcggcaccttccgcatggacccggacaccgcgatgtcgcccggcacgctgcaagcggcccgccgcgccgccggcgccgtggtcaaggcggtggagctggtggccgaggacaaggcggccaacgccttctgcgcggtgcgcccgcccggccaccacgccgaaagcgacaaggcgatgggtttctgcttcttcaacaacatcgccgtcggcgtcacccacgcgctgacgcactacaagttcgagcgggtggcggtggtggatttcgacgtccaccacggcaacggcaccgaggaaatcctgcacgacgatccgcgcgtgctgatggtgtccatcttccagcacccgttctacccctattgcggcgacgagcccagcgggccgaacatgcacaacgtgccgctgaaagccggcagcggcggccgcgagttccgcgaggcggtggaaaacgtctggctgccgctgctgcacgacttccagcctcagatgctgttcatttccgccggtttcgacgcccaccgcgaggacgacatgggttcgctcggcctggtcgaatccgactacgaatgggtgacccggcatctgatgcagatcgccgaccagtactgcgccggccgcgtggtgtcggtgctggagggcggctatgacttgtcggcgctgggacgcagcgtcgccgcccatatccgcgcgctgtccgacggctaactccctttccctacacaaggactgtcatgaagaactggctgcgcaacaatcgtggtttcctggtgttcctgctggtattcggcctgttccgcaccgcggtggccgactggaatccgattccctcggcctcgatgcgccccacgctgctggaaggcgacgtggtgctggtcaaccgcctggcctacgacctcaagctgccgctctccaacatcgtcatccacccgctgggcgagccgcggcgcggcgacatcgtcaccttctcgtctcccaaggacggcacccggctgatcaagcggctggtcgcgctgcccggcgacgtggtcgagatgcgcgacgaggaactgtggatcaacggccgcagcgcccattaccagccgctgcagcggctgatggaaaacgtcgccgccgacaccgcgctgccggcgctgcgcgccgaagaaagcggcgtgctgccggcgcaccgcgtgcaatggctgtccggcgtcgacgcccgcagcagcttcggccccattaccgtgccggccggccaatacctgatgctgggcgacaaccgcgacgacagcgccgactcgcgctacttcggcatggtgccgcgccatctgctgatcggccgcgccgtcggcgtgatcgcctccgccgacatcaccgccaactggatgccgcgctgggagcgcttcgccagcggcttccgctgagccgcgccggacaaacaaaaagccgtcctggaggacggcttttttcatgcacgacgcgcggctcagccggcgtcgcccttgttgccgatcttgtcttcctgaccggtcatcagcttgatcaggttggatttgtggcggtggaccaccacgatggcgatgatgatgcaggtgccgaagaacacgctgtgcggccccaggatgaaaaaggcgtacaccggcaccagcacgcaggcgatgatggccgacaatgaagaaatcttcaccacgaaggccatgaacagccaggtggccagcgccgccagcgccagccagacattgatgcccagcaggatgcccaccgcggtggccacgcccttgccgcccttgaagccgaagaacaccggccacatgtggccgaacagcaccgccagcgcgcacagcgcaatgccctgctcgcccaggccgtagcgcggccccagccagttggccagcgccaccgccagccagcccttggcgccgtcgcccagcagcgtcagcgcggccgccagttttttgccggtgcgcagcacattggtggcgcccgggttgcccgagccgtagctgcgcgggtcggccatgcccatagccttgctgacgatcacggcgaaagacagcgaaccgatcagataggccgcaatgacaaaagcaaatgctgtcgtggtcatggtggaggagtatccgttagattagaataggaggcttcggattttacggtatcgggcgacaaagcccaaccacctgacagacagatggacatcatattcctgcgcgaagtgcgcgccgacaccgtgatcggcgtgtacgactgggagcgcaaagccgcacagaccatcgagatcgacctggaaatcggcattcccagcgacacaccctgccatagcgacaatatcggcgataccatccattacggcgtagtggtggagcggctgcgcaaatcgctggcagaacagcacttcctgctgatcgaggcgctggcggagcatatcgccaagctggtgcgcgaggaattcggcgcgccctgggtccgggttgccgtcaccaagctcggcatccttcccggcgtgaagcgtgtgggcgtggagatcgaacgcggccaccggccgcattgagtcggcggcggctcagtcggtattgaatttcagcctcaggccgacatccttgtggtgcatgcgcaccgacagatgggtgtgcttgcccaagtccatcgccggcgtcagccgcagcgtctggctggccggatcgctctcgaagcggatcgggccaagctgaaagcccttggggtcgagatcctgcttctggacggcggcgtcgcgcggcgacgcgcacatcagcgcctgcggcaaacacgccccccaggcgctctggcatcccaaggcaagcagcaacaacagacggcgccccatgtccagactccgcgtacggatactttaatcatggacaaggccgcgccgacttcaagcctatcttgaatcttactgattacgcatgaaatcggcggtattgtagaacgcctccagcagcttttgcttcagccaatcctccgccaccagctcatccaccgcccggctcatgcaccacatccattggtcgcgcgccgcctcatccacggcgaacggcatgtggcgcatgcgcaaacgcggatggccgaaggcctccatgtagagcgcggggccgcccagccagccggacaggaacatgaacagcttctggctggagccggccagatcggccggatgcatggcgcgcagcggcgccaccgccggctcgctgtccatgatctggtagaaacggtcgcacagccaacgcaccaccccctcgccgcccagcaactggtacggcgtcatttcctgcacttcgctcattcacgctccacaggccggcgcatagaccggctctcattcattcaaagctttccgcctgccgcggatcttacaggccgcaaaaggcgaaatccagccgcggccgcttgccgctgatgatttccgccagcgcccggcccgagcccgcgccctcggtccagcccagcgtgccatggccggtgttcagatacagcccgtccagcgcgctcttgcctatcagcggcacattgcccggcgtcgccggcctgaggccgctccagaagcgcgcggcgtcccagtcgcaggcatcgggaaacagcgcgcggccgcggcggatcagcgcctggcagcgcaccggattgaggctgctggaatagccggccagttcggcggtgccggcgatgcgcaactcattgcccagccggctgaacaccagcttgcaggcttcgtcggtgatgctgaccatcggcgccgccaccaggcttttcaccggcacggtcgccgaataacccttggccgggtagatcggcagcctcaggcccgccggcgccgccagcagcggcgaatggctgcccagcgccagcacataggcgtcggccttcacttgctggtagctgccgtccggccccgtcaccgacaccgcggccaccgcgccgtcggcggtctccagcgcgttgatccgggtattgtagcgaaactccactcccaggccggcggcggcctcggccaggccgcgggtgaacagatgcacgtcgcccgactcgtcgtccgggcaccagctggcgccggccagctgcggcagcaccggctccagcgccggctccaacgccagcaactggcctggggacagcacccgcttgtcgacgcccagcgcctgcaaatgcgcggcgctgcgctcggcgcggcgcaattggctggcatcgtagtgcaggctgagaatgccgcgcgacaggcggcggtaggaaatatcggtctcgtcgcgcaactggcgcatggcgtcgcggctgtagaggcccagcgccaccatctgccgcatattggccagatggcgtccgggcaggcattcgcgcaggaagtcggcggcccagcgccattgcgacgggtccagccgcggccggaacaatagcggcgcatcatcgcgccacagccagcgcagcacctgccagggcgcgcgcgggttggcccacggctccgactggctgaccgacaactggccgccgttggcgaaactggtctcccgggccgcgccgcaggcgcgctccagcaccaccacctcatgccccatcctggccaggaaccaggcggtggacacccccaccacgccggccccgagtaccgccactcgcattctgcctccatccgacaagacaacgggcaagactggcttgcccgttcaagacgtgatgttaatggcaatcgccggcggcggcgactgttttgtcggacaaatgcctactttttcgcgtgctcgtaaaccgtcttgccgcgcagatggaaatagtcggaagcgaaataaaagttttccgagtggccgacaaacagcaggccgtccggcttcaacagcggcgcgaagcgcttgagcacgccgaactgggtgtcgcggtcgaagtagatcatcacgttgcggcagaagatggcgtcgaactgcttcttcaccgaccagttgccctccaccaggttcagccgctggaaggtgatcatattgcgcagcgccggcttggcctgatagctgccgtccggcagcttgtcgaaatacttgaccgcgtgcccggccggcaggcgagcgatcttgtcggccggataaatgcccttgcggccggtttccagcacgctggtatccaggtcggtggccagcacgctgatattgggcttggtcatgcccgggaaagcctccagcgcggtgatggccagcgagtatggctcttccccggtggaagccgccgcgcaccagatcgacaattcgccgctggccgccgcctttttcttcagatgctcggacaggatggggaaatggtgctcctcgcggaagaagaaggtcaggttggtggtcagcgcgttgacgaactgctcgaactcgcgcttgccgccggccgattccagaaaatcgacgtaggcggcgaaacccggcagtttcagttcgcggatgcggcgcaccagccggccgtagaccatgtccttcttggacggattgagggcgatgcccgcttccttgtaaatcagcttgcgtatgcgttcgaagtcggcgtcgctgaaggcgaactcgcggttgaattcgatcttgggcaataccaccggcggcagcttgttcatgtacgggattccagcaaaaaggcccgggcaagtgcccgggcctggttcttaccatgggtccagtatcacaccgagaacgaagaaccacaaccacaagtggtggtggcgttcgggttgcggatcacgaattgagagccttccaggctttcctggtagtcgatctcggcgccgaccaggtactggtagctcatcggatccaccaggaaggtcacgccctggcgctcgatggcggtatcgtcctcgttggcgatctcatcgaatgtgaacccgtactggaagcctgagcagccgccgccggtgacgaaaacgcgcagcttcaggtcgggattgccctcttcggcgatcaggtcctgcaccttggcgcaggcgctgtcggtgaagttgatcgggcacggcatttcggtagcagcttctgtcatgtgtaacctcgcaattcaatcaggccggtcgcggccattcgcccactattttagtcggatatcggggcggatggcgagccttcaagccctgggccgcgattgttgtcggatggatgcctcgcggcgtcccccgctcaactcccgcgactggccatcatgaatggcgaatgccccgctagcggaatctccgccttacggcatcaagggcaccacgtccaggccgtcctgctccggcaggccgaacatcaggttcatgttctgcaccgcctggccggccgcgcccttgaccagattgtctatcaccgacagcacgactacggtatcgccgccctgcggcctgtgcacggcgatgcggcacagattggcgccgcgcaccgagcgcgtctccgggtggctgccggccggcagcacgtcgacgaaggcttcgccggcgtagcggttttcgaacagttgctgcagatccacatccttgctcaggcgcgcgtacagcgtggcgtggatgccgcgtatcatcggcgtcaggtgcggaacgaaggtcagtccggccggcttgcccgtcgcccgggccaagccctggcggatttccggcaggtgacggtggccggccacgccataggccttgaaggaatcgccggcctccgccagcaaggcgccgatctcgcccttgcgcccggcgccggacacgcccgacttgcaatcggcgatcaggctggacgcgtccaccgctccggcctccagcaagggcaggaagcccagctgcaccgcggtcgggtagcagcccggattggccaccaagcgggccgagcggattgcggcgcggttgacttccggcaggccgtaaaccgcctgctccaccagttgcggcgcggcatgcggcatgccgtaccatttttcccactcggacacgttctggatgcggaaatcggccgccaggtctatcacccgcacgccggcgtccagcagcgccgccgcctcctgcatcgcgatgccgttgggcgtggcgaagaacaccacgtcgcattcgctcaggcgagcctcgtccggcgtggagaaggccaggtcgattcggccgcgcaggctggggaacatctcgtcgacgcggatgcccgcgtccttgcgcgaggtgaccgccgtcaccctggcctgcggatgcttggccagcaagcgcagcaactccaccccggtgtaaccggtgcctccaacgataccaaccttgaccatggccagccctttacataaaaaaatgtcgcaaaggcgacagtttaggcagcgcggaccgcggccgcaagcattgcgcgccgcaaaaacgaaaaaaccgccgggccgaagccaggcggttttttgcggaagcagtatccggcgaattaacgcttggagaactgcttggcgcggcgtgctttgcgcaggccgaccttcttacgctcaacttcacgagcgtcgcgggtcacgtagccagcggccgacagagccggcttcagaactgcgtcgaagtcgatcagggcgcgggtgatgccgtggcggatcgcgccggcttggccggtttcaccaccgccaaccacgttcaccttgatgtcgaaggattcgaggttttcggtcaggaccagcggctggcggataaccatgcgaccggtttcgcgggcaaaatactcgtcaaccggcttgccgttaacgatgatctggccggaacccttttgcatgaacacgcgagcaacggagctcttgcgacggccggtgccgtagtagtatttaccgttcattgttatgccttaaaatcagatttccagcactttgggctgttgggcggagtgcggatgctcggaaccagagtacaccttgagcttcttgatcatggcgtaacccagcggacccttcggcagcatgcccttaacggctttttccagaacgcgctccgggaactggttttgcagttcggtgaaggtgcgctcgtagataccgcccgggtaaccggagtgacggtagtactttttgtccagagctttggtaccggtaacgcgcagcttctcgacgttcaccacgacgatgaaatcgccggtgtcaacgtgaggagtgaattccggcttgtgtttgccacgcaggcggcgggcgatttcggcagcaaggcgacccagcaccttatcggcggcgtcgaccacgtaccattcgcgctttacctcatgcggcttggcagaaaaggtcttcatggaactcttccatcgtaattcttgaaagttacggattctagtgcagtggccgggtagctgtcaaacccttgtgacacaacagatttccagcaggcgggaaacgacggaatccaggcgggaaaagcggcaaaaaaaaagcgcaacgctgctgcgtgttgcgccaagttccaccttggaaggaggatggaggagacaacaccaggagcgccacagtgcgtaacgccctgatgcaataccgattatcggtatcccatcgggattaggcaagcagtttttgtgcagtgcacgataaatcgtgtgcggtaatgagacaccctgtcgcgccaagcgcgaacaggcgcgggaccggcaagcttaccgcgcctgtttcactgcaaaatcagcgacttacagcttgatggcggcatccagcgccacttccatcatgtcgcggaacgaggtctggcgctcctccgcgctggtagcctcgccggtcgggataatgtcggacacggtcagaatgccgaccgcgcgcgcgccgtactgggcggccacgctgtagatgccggccagctccatttcgatcacgttgacctgcatcttggacagcacgtccagcatgttgggctgcacgccgtagaacaggtcggcggagaacacgttgccgacggtgatcttcttgccctgctcggcggcggtgtccaccacggtgcgcagcagcgtgtagtcggcgatggcggcgtagtcatggtcgttgaagcgcatgcggttgaccttgctgtcggtggacgcgcccatggcgacgaacagctcgcgcagcttgatgtccggcgtcaccgcgccgcaggagccgatgcggatgatgttcttgacgccgtagtccttcaccagctcggtggtgtagatgctggcggacgggatgcccatgccgtgcgccatcaccgacaggcgcttgcccttgtaggtgccggtgtagccgaacacgttgcgcacgttggtgaccagctccgcgccttccaggaaggtttcggcgatcagctgggcgcgcagcgggtcgcccggcatcagtacggtttcggcgaaagcgccgtctttggcgttgatatgcggggttgccatggaaggtctcctcttttttcgatgtgtcaggtccgcccggcatcgcgggcggaaaaatgggacgccgggccgcctgggcggcccggatgcaggcgatcagtccaggaaggacgcgccgtagtccatcctgggcaggcccaggtgggcggcgacgctctggccgatgtcggcgaaggtagcgcgctcgccgatggcgcccgccttcaccttcttgccgtagcacagcaccgggatatgctcgcgggtgtggtcggtgcccggccaggtggggtcgcagccgtggtcggcggacaggatcaggatgtcgtcgtcgcccatcgcggccatcacttcgggcaggcgcgcgtcgaactcctccaatgccgcggcgtagccggcggtattgcggcgatggccgtagctggagtcgaaatcgacgaagttggccatgatgatggccggcttgtcctgatgctggtccatcgccgtcagcgtggcgtcccacaattggtcaaagccggtggccttgtgcttgtgggtgatgccgacgtgggcgtagatgtcggcgatcttgccgatcgacaccacatcgccgccggcgtcggccagcttctgcagcaccgtggccgccggcggctcgaccgccagatccttgcggttgccggtgcgggcgaacttgcccttgccttcgccgacgaagggccgggcgatcacgcggccgatattgtaaggctccaacagctcgcgggtgatcttgcacagctcgtacaagcgctcgaggccataggtttcttcgtggcaggcgatctggaacaccgaatcggccgaggtatagaagatcggcttgccggtcttcatgtgctcctcgcccaggcggtccaggatctcggtgccggaggcgtggcaattgcccagatagcccggcaggccggccttctcgacgatggcgtccagcagttgctgcgggaagctgtcgtcgtggtcggagaaatagccccagtcgaacaacaccggcacgccggcgatctcccagtggccggacggggtgtccttgccgctggagatttcgcgggcgtagccgtaggccgccagcggcgccgccgggtccatcccttccgggaaatagccggacgacagctggcaggcgtggcccaggcccatcttggacagattgggcagattcagcggaccgcagcggccgatgtcggcgcggccggcggccgcctccatcgcgatatgccccagcgtgttgctgcctgcatcgccgaacttcggcgcgtcggccgccgcgcctatgcccagcgagtcgaggattaatatgattgcgcgtttcatgatgcctccctggccttattcgccacggatgatctggtaaacctgcggcagcgcggccggcgcgatttcatcgatgcggatggcggccttgactcggcgcgccgcgtcttcgaagctcgcctcgtcggcggcgtggatcatcatcagcggggtgtctttgccgatattctggcccagttcggcgaactgcgacagtcccacgcggaagtccagcacatcgctggccaggcggcggccgccgcccagcgcgcacaccgccatgccgatgccgcgggtgtccatcgcgccgacgtagccggccttgtcggcgtacaccgggcgcacgatgggcgccggcgccagatggcggtcgtagttttccaggaaatcggccgggccgcccagcgcggtgaccatgcggccgaagatctcggcggcgcggccggaatccaggcccgcctgcagcttagcgcgggcgtcggcctcgtcgctggccagcttgccgccgatcagcatctgcgcgcacagcgccatcgtcacttcgtgcaggcgcggattgcgctcgtcgcccttcaggtagcgcaccgcttcgcgggtttcgatgctgttgccggcggtggaggccaggggctggctcatttcggtgatcagcgcggtggtggccacgccggcgccgttgcccaccttgacgatgcggctggccagctcgatcgatttctccatcgtcggcatgaaagcgccgctgccggccttcacgtccatcaccagcacatccaggcccgccgccagcttcttcgacaggatggaggcggtgatcagcgcgatcgactccacagtggcggtgacgtcgcgggtggcgtagaagcggcgatcggccggcgccaagtcggaagtctggccgatgatggccacgccgactcccttcaccaccttgcggaacagctccggatccgggaacgggttataaccgggcaccgccgacagcttgtccagcgtgccgccggtatggcccaggccgcggccggaaatcatcggcacgaagccgccgcaggcggccaccatcggcccgagcatcagcgacaccacgtcgccgacgccgccggtggagtgcttgtcgacgatggggcccggcaggttcaggtctttccagtgcatgcggcggccggaatcgcgcatcgccagcgccagatgcacgttttcttccagctccatgccgttgaagtagatcgccatcgccagcgcggcgatctggctgtcggccacgctgtcatcggtgatgccggcgacgaattgttggatgtcctgctgcgacagcatcaggccgtcgcgtttcttgcggatgatttcctgcggcaaaaacatggcattctccctgcctgaaacccattgcgcggcaaagcgaaaacggcaatgggcggtgcggccgggaaatcgcccggccagagtgcggtagtcccgcgaattcgtgggtggatcagtagccggcagtcggcttggccacgccgccggcgatctcggcctgcagattggccaagaggctggacgcgccgaagcggaaatggtcggcattgacccaggcgtcgcccagcaggccgccggccagttccaggtattgcttggcctcggccgcgctcttcacgccgccggcggccttgaagccgcacttgccgccctgctcgcggatcacgttcagcatcacgtccgcggcttccagcgtggcgttgaccggcaccttgccagtggaggtcttgatgaagtcggcgccggcgcggatggagatttcgctggccgcgcggatcagcgccgcgtctttcagctcgccgctttcgatgatcactttcaacagcttgccgccgcaggcttccttgcaggccttcaccagctcgaagccgatgtcgcggtcgccggccatcagcgcgcggtacgggaacaccacgtccacttcgtcggcgccgtaggcgatggcggcgcgggtttcggccaccgcgatggcgatgtcgtcattgccgtgcgggaagttggtgacggtggccaccagcacttccgggcagccggcttcgcgcagcgtcttcttggtgatgggcacgaagcgcgggtagacgcagacggcggccacggtgccgtcctggctcttggccttcttgcacagcgcgatcaccttggcgtcggtatcgtcgtcgttaagggtggtcaggtccatcagcgacagcgcgcggcgcgcggcttcaatcagtgcagacatggtctatctctctcgaaatgcggccaatggataaaaaccgcggccggcatgacggcggtttgccaaaggcaatgacatggattatgaaaatttcttcacgtgaaagcaaatcgcaaacaactgcggcttgcttaaacgcaaaccgcccggcatcgccgcggcggcccctggaaagccaaaccggccgaaacgcccgacagacggacatttcagccggcttggccgcatcaagcgtcacacccggcgcgcttcctgcacgccggacaattccatcaagcgcgacaacacccggctgatgtcctgcacattgcgcacctccaccgtcaggcgcagcttgctgcgcaaatcgcgcgacagcgtgttgacgcctatcaggttgagcttttcgcgcgacaaggtgtcggacaggtcgcgcagcaggcccggccggtcctgcgagatcacctcgatgtcgatcgggaacacgctgttcttcagcttgccccattccgcggcgatcagccgctccggcacctcctgcgacagcttcttcaaggtgatgcagctgctgcggtggatggagatgccgcggcccttggtgacgaagcccatcacctggtcgggcggcgccggcttgcagcacttggccagcaccgtcatcaggttgtcgacgccctcgatcagcacgccgccggtttccggcccgcccttgctggccttgaccaggctctccggcagcacttccaccgtcggcggcggcgcgaagctgccgatggcgttggccaccgcgcgggtggtcaattcgccgtggcccagcgcgccgtgcacttcctccagcttgtcgtagccgagcttctccgccaattgctgcagattgggctggatgtgcggccggcgcgccagttcgcgctcgaacagcgccttgccggtttcgcgcacggtgtcggcgttttgtagccggatgtactggcggatgcgggagatggcgcgatggctcttcacccagccgtcgtgcagccagttgaccgacgggccgccttccttggcagtgagaatctccacccgctggccgttttgcagcggcgtcgacaagggcacgatctggccctccaccttggcgccgcggcagcggttgccaaggccggagtggatcgcgtaggcgaaatcgatcggcgtggcgccctgcggcagcgccagcacccggccttgcggcgtcagcacgtagatggtgtcggcgaacagctcggtcttgaacgcctcggccaggccttcgcggtcggacatctcctcgcgccaatccaagagctggcgcagccaggaaatcttttcctcgtaggcggcgtcgcccttgccgccctccttgtagcgccagtgcgcggccacgccgaattcggcgtgctcgtgcatgtcgaaagtgcggatctgcacttccagcgccttttcctccgggccgatcaccgcggtgtgcaggctgcggtagttgttggccttggggtgggagatgtagtcgtcgaactcgccgcgtatcggctgccacatgccgtggatgatgcccagcgcggtgtagcagtccggcagcttgtccaccagaatgcgcaccgcgcggatgtcgtaaagctcggtgaaatcgagctttttcttcttcatcttcttccagatggaatagatgtgcttgggccggccggccacttcggccttgacgccggccttgcgcagttcctcgcgcaggatgtccagcaccctctcgatgtagtcgatgcgctccagccgccgctcgtccagcagtttggcgatcttcttgtaggtgtccggctcggtgtgcctgaggcccagatcctccagctcccacttgatctgccacacgcccagccggttggccaaaggcgcgaacagctccagcgtctcgccggcgatgcggcggcgcagcgcctcgtccggcacctgcgccaggtagtgcatggtctgggtgcgccaggccagcttgatcagcaccacgcggatgtcggccaccatcgccagcagcatcttgcgcatggtttcggcctggcgcgcgccgtcttccggcgtggccatcttgtcgatgcgcgccagctcggtgatgcggcgcacgccgccgacgccgtccaccagcatcgccaccgtggggttgaaggtttcggtcagccacgcctgccactccggcttgaagtcgggcgcggcgaacatcagcgtggcgacgatggcgtcgggcagcaggttgaggtcggcgacgaccgcggcggcggccaccgcgtgggtgaacaggtcttcgccggtggcggcgacggtcttgccggcgtacagctcgcgcgcggcgtcgaaggcgcgcgccagcaacgcgccatcctcggcgggaaaggcggcggacatatgttccagccagcgcgccggatcggcggcgtcggccagggtatcggcaacggtgcggactacggaaaccatatctgtctatctggacggacctgccgtcttagccacggccgggcgggcccggccatcggatttgccacatgggcgggatgcgccccgccctcttcaaacttgcgccagcctcaacagcaagcggcgaaccggcgccggcacgccggcatcgacagcctgatccaacgccagccactggccgtcggcctcggcggcgccatgcgcccgcagctggtcgatgcgcaccggctgcggcgtgatgatcaggcgaaaatgggtgaatacatgttccagctccggccaggcgggcagcatgtcgccatcgccgcgcgcgttcagccagtcttctatttcgagcgtcgcgccgaattccggcagcgacagcaggccgccccagatgccggtgggcggccgccgctcaagccacacccggttgccgtggcgcgccagcagcatcaccgtctgccgggtcggcaccgtttttttcggcctgggcgtcggcagctcgccggtgcgcccttcccgcgccgccacgcagccatcaaccatcggacaggcggcgcaggccggcttgccgcggcagcaaacggtggcgcccaggtccatcaggccctgcacatacggctggatggccgccgcgtcggccggcaggatgtcctccgccagcgcccacatccgtttttcgatcgccttgtcgccgggaaagccatcgatcccgaagcagcgcgccagcacccgtttgacattgccgtccagaatggtttcccggcggccgaaggcgaaggcggaaatcgccgcggcggtggagcgtccgacgccgggcagctgctccagccgctcgcgctcgggcgggaagctgccgccgaactcggccatcaccatctgcgcggccttgtgcagattgcgcgccctgctgtagtagcccagcccgctccattgcgccagcacgtcgtctaccggcgccgcggccaggctcgccacatcgggaaaacgggcgagaaagcgcggataataatccagcacgctcttcacctgcgtctgctgcagcatgatctcggacagccagacgcggtaagggtcgctgacctgccagggcaaatcgtggcggccatgccgccgctgccagtccaccaggcgggtggcaaaactgctgtgcaacattgcaatccagtatcgaatcgaaccggtcatgttagcggaaagcctgagcatcaccaagcaggcggcggccaaatacgttaaaattaaaggattacttacaagtttgatcatgtcgaggtcgtttcaatgtccagtttccgttcccgccagcgcaataaccagcgccgcgatctaaccagccgtgaacgctcggccaactcgccggctggcggaaaccaaagcccgccggcggcaagcggcaaaccgccgcgcgccgacaagcgccaggacgccggccagccgcgcgcgccctactccggccagcgcccaggcccgggcaagccggactggaaacaaacgccgcgccagggcgagcgcagcttcgacaagcgcggcccggccgcgcgcgcgccgcaggaaggcggcttccaggacaagcgttacgaccgcgaccgcggcccctccggccgcaagcctatgcccgccgacgacgcccgcgcgccggccttccgccgcgaagaccagccgcaggacaagcgctacagccgcgaccgcggcccgtccggccgcaagccgctgcacaccgaagacgccccgccgcgccagttcaagccgcgcgccgaaggagaaccgcgccgcgacgacaagccgcaatggcaaaaccgcgaagacagcgcgccgcgcgacgacaacggcccgcgcaagctgttcggcaagggcggcgacaaccgcccgccgcgcgacgacaagccgtggcagccgcgcgaagaacgcgcgccgcgccagttcgataaccgcgacggcgagcgcgacaaccgcttccgccgcgacgacaagccgcaatggcagaaccgcgaggagcgtgccccacgtcagtcccacgaccgcgatggcgagcgcgacaaccgcttccgccgcgacgacaagccgcaatggcagaaccgcgaggagcgtgccccacgtcagtcccacgaccgcgatggcgagcgcgacaaccgcttccgccgcgacgacaaaccgcaatggcagaaccgcgaggagcgcgcgccgcgcgacgacaacggcccgcgcaagctgttcggcaaaggcggagacaaccgcccgccgcgcgaggacaagccgtggcagccgcgcgaagagcgcgcgccgcgccaattcgataaccgcgacggcgaacgcgataaccgcttccgccgcgacgacaagccgcaatggcaaaaccgcgagcagcgagccccgcgcgaagaccagcctgcgcgcaagccgctgttcggcaagccgtccgccgaccgcgacgccgtggagcgcgacaaccgcttccgccgcgaaaaccatcacgacgagcgcccgcgccagcatccgtcgcaaggcctgcaaccgttcggcgacagccatcgcgtcgacagcccggagcgccgccagcagttcgagcagcgccgccatgacaagccgcaatggcaggccagcggcagcaagccggaaatcaccctgaccggccgcctggacagcaagctggcgctgttcgccccctgcccgcgcggcctggaggcgctgctggccgacgaactgaaggcgctgggcgccgacgacatcgccccggccgacggcggcgtggccttcggcggcgacgcccgcctgatgatggcggtcaacctgcactcgcgcaccgccagccgcgtgctgctgcgcctggctcacggcccctaccacgccgagcaggacatctaccggctggcgctgagcgtggactggccgcgctggttcgacgtgtcgcgcaccatcaagctgaaggcggacggcatcgccgcccgcgtcaagagcctggactacatcgcgctgacggtgaaggacgcgatctgcgaccgcttccgccaggcgcagctgggccgcccgaatgtcgacacccgcgcgccggacgtgcgcgtcaacgtgttcctcaccgccgataccgccaccatctacctggacaccagcggcgagcctctgttcaagcgcggctggcgcgaagaggccggcgaggcgccgctgcgcgaaaacctggccgccggcatcctgatgctggccggctacgacggcagccagccgctgatcgacccgatgtgcggcagcggcaccttcctggtggaggccgccgacatcgcgctgaaccgcgcgccgggccgcaaccgccgcttcggcttcgaagcgctggccagcttcgaccaggtcggctgggaaacgctgcgcctagccgcgagccaggctgagaaagcgcccgccgcgctggacatccgcggctccgaccgcgacaagaagatgatcgccatcgcccgcgccaacctgcagcgcgccggcctggccggcctggtggaagccatgcccgccgacatcctggacgtgcgccccggcgcgcaagccggcctgatcgtcagcaacccgccctacggcatccgcctggacgaactggatcagctggccgcctggtatccgctgctgggcgactggctgaaggcccacttctccggctggaccgcctgcctgttcagcggcgacctgcgcctgggcaagctgatccgcctgtctcccaagcgccgcacgccgctgtacaacggttcgctggcctgccgcctgttcgtcatcaatatggtggaaggcagcgcgcgcaagcaaaaggacggcggcgaagcggccgacgacgacgcggccgaagaataatcggccgcctcagccgccatccgctcgcactgcggccggatggcgcgaaaagggccgggaaggcgtcatgccctcccggccctttttatgcccgcccgccgccagcggcgcgcgtcagttcttcgccaaggccttgcggaagtcctcgtccgccagcaactggctcaccagcttgcgatacaggccctcgtactggctggccgccagcggaatggccaccgcgccgatgaaggacgactcccactgcgacttcgcctccaccttgcggtcgtagcgcacggcgccgtcgcgcgtcaccacgaagcgcgcggccaaggccgccgtgccggtcgacatcgccgggtccagcgcgttttccagcaactcgccgctcacttgcgcgcccgacttgtcgtcgagcaggcccgccgcctgcaattcggccttcagcgtcgcgcccagatactgggagaaagagccgtcggtcggcgccgtcaggctgttcgcgccgcgcacgctgaggctcttgtcagcgtcggcgctcaggctggccgccggcttgaacgcgcctaccgccaccggcgtcagattgctctcgcggatcttggcgatgttttccatcgacggcttggccggagacatcaccatctgcgcgcagccggtcagcagcagggaagacgcgccgagcagcgccacgatagccagtttgatgattttttgcatgatgtgccttttgcttgattaattgccgaatccgctgtcctgcgacaaatcgcgcagcgcgttgctcaagacttcatgagtcatctgcagcaccgcctcgccgacattggccgactttttcgcccccgccggcggctcggcgttgcctatcgtggtgtggatggcgtgccgcgccgtcttgactatcggtttgctgctgcccgccggcaggtagctgacggtgcagacatagccgtcggtcaccgcggtgccgaccgcgccgaaggtcagtccggtgacgaagccgccggcattgccctggttcagcgggatgttgttcaggctgatgttcagaatcggcgcgccagcggtcggctgggttgccaccgcggagaacaggcccgattccgccacctgggtcttgaccgcggcctgcaggaattcggtggcgcgcggcaccggcatgccctggttctggaattcgaacaccagttgcaccggctgcggcgacgccggttttttcagctccgacaccggcacattcttggtggcggtgtcgacatagacgctggcgcagccggtcagcagggagctgcctgccagcagacatgctgcgaaccagcgatttgcgccggaaaaaagcttataatttttgaatatcatgtaaatatctctgcgagtcagcacgctaaaagaaaataaaacacaaagcggacaatccgccatcgtatcttcacggactggcagtctaacaaaagccgccgctgaaaatacattgtcatcgaaataatttttaacacaatcaccatgacggccgggacgcttgccccggcgtcaaccgagccgccgccacgacatgcaaacttccttcctgtccgccaccatcctgctgatcctgattaccgatccgctgggcaatatcccgctgttcatcgccgcgctcaagcaggtgaagccggaacgccgccgccgcgtggtctaccgcgaatgcctgatcgccttcctggtgctgaccatcttcatgctgttcggccgcaacttcctcgaactgatgcacctgaccgacgagtcgatgcgcatcgccggcggcgtgatcctgttcctgatcgccatcaagatgatcttccccggcgaaggcagcgtgttcggcggcgacaagctgcacggcgagcccttcatcgtgcctatcgccattccgctgatcgccggcccgtcggcgatggccaccgtgctgctgctgtccacgcgcgagccgggccggatgctggagtggatgggcgcgctgaccatctgcatgctggtcaccaccgtcaccttcctgttctccagccggctgcaaaaactgctgggcgaacaggcgatcaccgcgctggagcggctgatgggcctggtgctgacagccatctcggtggagatgctgctcagcggcttcgcctcctatctgaagcagctgcactgagcctggccattgcggataagtcgtcagggttatccccgatagggatatcgacaatgctcccgacttgagtcagttgttagcatcggatgcaaatgggccaacaagagcccgcattccatgcaacgcaacgccagtcgggacaaacatgcaaaccaagactccgttctattcgcgcctttacgtacaggtgttgatcgccatcgccgccggcgtgctgctgggcagcttcatgcccgatttcgccgccaagatgaaaccgctgggcgacgccttcatcaagctgatcaagatgctgatcgcccccatcatcttttccaccgtggtggtcggcatcgccaagatgggcgatatgaaggaagtcggccgcgtcggcgtcaagtcgctgctgtacttcgaagccgtcaccacgctggcgctggtgatcggcctgatcgtggtcaacctgctgcagcctggcgccggcctcaacatcgacccgcacacgctgcacgccaaggacatcgccaagttcaccgctggcgccaaggacatgaacaccgtggacttcctgctgcacatcattccggacagcgtggtgggtgccttcgccagcggcgagatcctgcaggtgctgaccttctcggtgctgctgggcctggcgctgaccaaaatgggcgacaacggcaagaacatcgtccacatcctggacgagttctcgcacgcgctgttcggcgtgatcaacatgctgatgaagctggccccgatcggcgccttcggcgcgatggccttcaccatcggcaagtacggcatcggctcgctgaaacagctgggcttcctgatggcctgcgtgtatctcacctgcttcgccttcgtcttcatcgtgctgggcgccatcgcccgcttctccggcttcagcctgtggaagttcctggtctacatcaaggaagaaatcctgctggtgctgggcacctcgtcgtcggaatcggcgctgccgggcatcatgaaaaagctggaaaacctgggctgcgcgaaaccggtggtcggcatggtggtgcccaccggctactcgttcaatctggacggcacttccatctacctgaccatggcggccatcttcatcgcccaggccaccaatgtgaacctgacgctgggcgaggagctggccatcatcggcgtgctgctgctcacctccaagggcgcggcggcggtgaccggcggcggcttcatcacgctggccgccacgctggccacgctgggcggcaagctgccggtggagggcctggcgctgctgatcggcatcgaccgcttcatgtccgaagcgcgcgccatcaccaatctgatcggcaacggcgtcgccaccgtggtgatcgccaagtgggaaaaggcgctggacgtggagaagatgcgcctggtgctggaaggcggcgagccgccggccccgcccaaggagcggcgggaagccatgccggagccggcgctgcaaacgcgctgagcctcgcttcagctagctgtcgaacccgttgcgaagcgggtttttcgtttcatttaggacgaaatccttgatttcgccgtctgctcgtccacgatgaaaattcgaggaggagcgcatatggaagacttttggatacagtatggcgatgacatgctgcccgtcatcggcgatttcccgcgcaagggaaactacctgcccagcttcatgctggtggacgaccagaaacacgacgccgcgctggagagcttctcccacacgcccaaactgatcgtcaccctgctgtcggtggacgaggacgaacacgccggcctgctgctgctgcgcgaaacccggcgcttcctcgacagctggccgcacctgaagctgatcgtgatcaccgtcgactcgccgtcgtcgctggaacgcgcgcgccacgagcacggcctgcccaatatcgcgctgctgtccacgctgcgcggccgcgatttccacaagcgctacggcgtgctgatcaccgaatacccgctcagcggctacaccgcgccgtccatcatcctggccgacaccgccaacgtggtgcactactcggagcggctggccaatacccgcgacttctttgacttcgacgccatcgagaaactgctgcaagaaggcgaacagcaggcgatggccgccgagcgcgaggccgaggaggcgcggcagcaacaggatgcggagcgggagaaaggcaccgagcggctgttggagaaggccaagcagatccaggaccagctgggcaggaatatcgaccccggccgctgacgcgatgccggcgccggacaaacaaaaaccgcccgttgccgggcggtttgtttgactttactgatggattatcgacagccttagctgttcagttccttggccaggtagagccaggtttccaccacggtgtccggattcagcgacaccgtctcgatgccctcttccaccagccacttggcgaagtccggatggtcggacgggccctggccgcagatgcccacgtacttgcccatcttgcggcaagcctggatcgacatgtgcagcatcgccttcaccgcctcgttgcgctcgtcgaaggtgctggcgatcgggccgccggagtcgcggtccacgcccagcgtcagctgggtcatgtcgttggagccgatcgagaagccatcgaagtgctgcaggaactgctcggccagcacggcgttggccggcagctcgcacatcatgatcaggcgcaggccgttgtcgccgcgcttcaggccgttgtcggccaggatctcgaccaccttctccgcttcggccagcgtgcggacgaacgggatcatcacttccacgttggtcaggcccatcacgtcgcgcaccttcttgatcgcgcggcattccagctcgaaacagtcgcggaacgattccgccacgtagcgcgccgcgccgcggaaaccgatcatcgggttttcttcatgcggctcgtacagctggccgccgatcaggttggcgtactcgttggacttgaagtccgacatccgcacgatgacctttttcggatagaaagccgcggccagcgtcgacacgccttcggcgatcttgtcgacgtagaagtccaccgggctggcgtagccggcgatgcggtcggcgatggtcgccttcagttccggagtctgcttgtcgaattccagcagcgccttcgggtggatgccgatctggcggttgatgacaaactccatccgcgccaggcctacgccttcgttcggcagctgggcgaaatcgaacgccagttccggattgccgacgttcatcatgatcttgaccggcgccttcggcatcttgtccagttccagatcgatgatttccacgtccagcaggccgtcgtagatattgccggtgtcgccctcggcgcaggacacggtcacttccatgccggccttcagcacgcgggtggcgtcgccgcagcccactaccgccggaatgcccagctcgcgcgcgatgatggcggcgtggcaggtgcggccgccgcggttggtgacgatggcggcggcgcgcttcatcactggttcccaatccgggtcggtcatgtcggtcaccagcacgtcgcccggcttgacctgatccatctcggacgcgtcgcggatggtgcgcacggtgccctggccgatcttctggccgatggcgcggccttcgcacaggatttcggacttgccgttcaggcggtagcggcgcagggtgtccttgcggtcttcctgcgacttaacggtttccggacgcgcctgcaggatgtacagcttgccgtccaggccgtcgcggccccactcgatgtccatcgggcggccgtagtgtttttcgatgatcagcgcgtactgggccagttcggccacttcggcgtcggtgatcgagaactgcttgcgcagctcgggcgccacatccacggtcttgaccgagcgaccggcttgcgaagcgtcggtgaactccatcttgatcagcttggagcccatggtcttgcgcagcaccgccgggcggccggcgcgcagcgtcggcttgtgcacgtagaactcgtccgggttcacggcaccctgcaccacggtttcacccaggccgtaagaggcggtgatgaacaccacgtcttcaaagccggattcggtgtcgatggtgaacatcacgccggccgcgccggtatcggagcgcaccatgcgctgcacgccggcggacagggccaccacgtcgtgggcgaagcccttgtgcacgcggtaggagatggcgcggtcgttgtacagggaggcgaatacgtgcttcatcgcatccttgacgttgtcaaggccgcggatattcaggaaggtttcttgctggcctgcgaacgaggcatcggggaggtcttcggcggtggcggaggagcgcacggctaccgagatgtcggcgccgccggcatcggcgaccatctggacccaggcttccttgatgtcggcatccagcttggcagggaacggggtgtcgatgatccactggcggatttccttgccgacgcgggccagctcgctgacgtcgtcgatatccagcttggccagcgcggcgctgatcttgtccgccaggccgttgtgctgaagaaaatcgcgataagcctgggcggtggtggcgaagccacctggtacccgcacgccggaaccggccagctgactgatcatttcaccgagggaggcgttcttgccgcctacctcttccacatcggtcatgcgcagcttctcgaaccagatgacgtagttctctgccatcacttcacttcctgtgttggattgggacgatagggccgcattctagccgaattacgcgccgattgcgtagcaacttttgcagcgcacaagacttaattgcgacaagagaacggtttaagccaatacaatcaaacggttgatctcaaaaccgccgcgcaatcaatgatattgtcatgtagtttgaagattacatgtcaaaaacgggaggccagcggcaggtatcgccatggcttgcatcggtatacactttgccgcaaccgaatacactttgccaaggtgcatcatgtcccatcgtcgttccgccttcttcatctccgaccgcaccggcatcaccgccgaatcgctgggccacacgctgctgacccagttcgacgccctggacttcaagcgcgaaaccgtgcccttcgtcgataccgtcgacaaggccaagacgttggcgcagcgcatcagcgacatcgccgagcgcgaccacctgcgtccgctggtgttcaccagcatcgtcaatccggaagtgcgcgaggcgctgcggctggaaaacgtggtgctgatcgatttcttcgaaaccttcatcggccatctggaggcggaaatcggccagaaagcgtcgctgtcggtcggcaaggcgcacggcatggtcaacgaggagaagtacgaccaccgcatggaggcggtcaacttctcgctgaaccacgacgacggcgtcaagctgaaggacctggacgaagccgacgtgatcctggtcggcgtgtcgcgctccggcaaaaccccgacctgcctgtacctggcgctgcagtacggcatccgcgccgccaactatccgctgacgccggaggacctgggcagcccgaccctgcccaagctcttgctgccgttcaaggacaagatcttcggcctgaccatcgacccggcgcggctgcacaatatccgctcggaacgccgccccgactccaaatacgccagcatggacaactgccggcgcgaagtgaacgaagcggaatcgatgttccgccaccacggcgtcaccttcatcagcaccacccacaagtcgatcgaggagatcgcctccaccatcatgcacaaggcggcgctgggacgtaagttttaagcggcttgccgccgaccgcgcgcgcatgcaagatgtctttttcataacaagaaagagtccgcgtgcgccctgctcccgacatcgtcgccagacaagtggccagcagccgtttccccgatgccggctgcgcgttgatgaccggctccatcgtgcgcggccaggccacggcaagtccgacatcgacctggtgctcatccatcgccagctgcccgccgccaggcgcgagtcgctgcgggaacagggttggccggtcgaggccttcatccatgacctgcacacgctgcagtatttcttcgaccatgtagaccggcccagcggcgtgccttcgctggcgtccatggtcaacgacggccggctgctctgcggcgacgaagcgctggccgcccaagccaaggccatggcgcaagccgcgctgcgccgcggcccgccgccatgggacgccgccgcccgcgacgcgtcgcgctacgccctcaccgacctcgtcgacgacatccgcgcgccattctccgatttcgccttgcgcgcggcgctggcccagcttctgccgctgctggccaatcactatctgcgcgggcgcggcctgtggtcggccaagggcaaggccattgccagacgcctggcccaggtcgaccccggctacgccgcccgtttcgacgccgccttccggcttgcgtttcatagcggggaaaccgcgccgctgatacagctggcggcagacaccctgcaagcggacggcggctggctgttccagtcctatcaattcaccgcgcccgccgattggcgctgcgagccggtctacggctagccgcccgcccgcttgctcttgaagcccagcttttccagttcggcgatcaccgtatccacgtgatcgccctggatttccagcacgccgtccttgaccgtgccgccgctgccgcagcgcgtgcgcagctgcttgcccacccgggccagcgcatcggcggccagcggcaagcccttcaccaccgtcacttccttgccgcccctgcccttggtctggcgcgccacccgggcgatgccgtcgcccgccggcgccgccggcttgccgcactcgcactgcgccagcggctgccggcattgcggacacatccggccatgctcggtggaatacaccagcccgcccgcctcgttttgtttcgacttcatcttgattgatctcttttcgccatcgccgccatggttgcggggaatccgcgcgccgacaagccccgcgccttgatatgccaatgacaaaatcagcaataaaactctatctctttgtttatttgtaaattttttattaagacaggaacaataaaaaccactcgctttcaaaaacaacaagagccacgtctgcgagaaccaccgatgaacatccccgatttcaatctgccccccatcgccgccgcgcgccgctggccgcagcagctggccggcgtgcaggcgggtcggcaactcacatcggaacagcagcacgaattcgccgagatgctgttccgcaccgtgctgcaaaaccccccgcacggcgcatcgccgttcaccctagccggcggccccgtcgaccatcccgcgcggccgcccgcgcgcccggcgcggcaacgctccgccgcccgcgcctacggcaaggatctgccgcaagccggcttcctgctgcaaacccaggcttgacgccctgccctgccgcatggtttgatgaaaccatgaataccgcacccgctttcgcaatccgtttttggtggtggcgcctctcttaggcggcaccggcgaacgcgcacgcaaaaaacccggaggctgccgacaaggcgcaccgggtttgtttttagccgcacctcccccccagtccgccctgccggtctcctcattccaacagtggagatcgaaatgaatctggacaacatcagctcgcaagacatcatcctcaccggcgaccgcaccaccggccaactgcacctgggccattacgtcggctcgctgcgcaaccgcgtgatcctgcaggagcgctgcgcgcaattcctgctgctggccgacgcccaagcgctgaccgacaatatgggcaattacttgaaagtgcgcgacaacgtgctgcaggtggcgctggactacctggccgtcggcatcgacccggccaagagcaccatcttcatccagagcctggtgccggaactgaccgagctggcctcctactacctgaacctagtgacggtggcgcggctggagcgcaaccccaccatcaaggacgagatcaagcagcgcggctatgaacgcgacatcccggccggctttctcacctaccccgccgcccaggccgccgacatcaccgcgttcaaggccaccatcgtgccggtcggcgacgaccagatcccgatgatcgagcagaccaacgaaatcgtgcgccgcttcaacgccagcgtcgatcagaccgtgctggtggaagccagggcggtggtgccggaagtgggttcgcggctgcccggcatcgacggcaaggccaaaatgtccaaatcgctgggcaacacgctgacgctgtccgccagcccggatgaaatccgccaggcggtgaagatgatgtacaccgatcccaatcacctgcgcgtggccgaccccggccaggtggaaggcaatgtggtgttcacctatctggacgccttccatcccgaccaggcgctggtggcgcaactgaaagcgcactaccaacgcggcggcctgggcgataccgtgatcaagaagcatctggaagactgcctgcaggagatgctggcgccgatccgcgaacgccgcgagcgctacgcgcaggacccagccgcggtgctggaaatgctgaagagcggcacccgccgcgcccgcgacgtcgccgcccgcacgctggctgaagtgaaggccgcgatgggcctcaactactactgagccggagcgggaatatggaacatctctatcaatgccagagcctggacgaagtacgcgggcagatcgaccgcatcgaccgcgagctggtggcgctgatcgccgagcgcggcatctacgtgcgccaggcggcgcgcttcaaggaaagccgcgccgaagtggaaggcggcaaacgggtggatcaggtgatgcggcgggtggagcggctggcgggcgaaatgggcgccgacgcggcgctgacggcggcgatctatcgcgccatgatcacccatttcgtcgccgacgagctgcaagcctaccggcagcggttcgcaaacagcgattgagcggcgcggccggcttccctacaattccggcatcatggccgtcttgatggcggcctctttgctcccccaaggaaaccgcgatgaagaaaaccgcgctgctgctggcctgcctgctggccgccccgttcgcccgcgccgaggaaatcggcgaagtctccaccaccttcaagctgctcagccccaacgacaaggtggtggtggaagccttcgacgatccggcggtgcaaggcgtggcctgctatgtgtcgcgcgccaagaccggcggctacaagggcgcgatcgggctggccaaggatccgtcgcgcttttccgtcgcctgccgccaggtgggacagatccgcttcggccggccgctgccgccgcaggaacaggtgttcaaggagagcgcgtccttcgtgttcaagcacgtgcgggtggtgcgcatcgtcgacgccaaacgcaatgtgctgacctatctcacctattccgacaagctggtggacggcagcccggacaacgccatcagcgcggtggcggtgctggatcagaaaattccgctgaaaaaatagctatcgcaagctattgatattcatcattattattaagatgacaggcatcatcccatagccagcttcgcctgccagccatcgaaccccacctcgacgcccggcgggcacagcgcgcccagcgcatggtattccagccggtgagtcatgtggatcagcaccgtgcggcgggcgcctatcctcgccgcccagtcgaatgcctgccccacccccagatgcgacgggtaggggtcgtggttcaggcaatccaggaacagcagctccagcccctgcaacaagggcaggctgctctccgggatgtcggacagatcggtcagccaagccatattgccgatgcgccagcccaggcaaggccagctgccgtgccgcagcgggatgggcgtcaacttgacgccctggtgctcgaacgggccatgcaccgtttccggcagcagcaccggcttgtcccacatcttcgacggcgcctgcagcgcatagccgaagcgctcgcggatgttggacatggtgaaatcgttgccgtacagcgagatcggcccctgcttcaagtagcagaaggcgcgcagatcgtcgatgccgttcaggtggtcggcatggggatgggtgtacagcaccgcgtccagccgcgacaaaccctcgcgcagcgcctgctggcgcagatccggtccggtgtcgatcaagaaacccagctcgccgacgcggacataggcgctggcgcgagtgcgctggttgcgcggctcgtcggacaggcaggtggcgcagcggcagcctatcgccggcgtgccggaactggagccgcagcccaggatggtgacttctaacgtattcacggcgctccttgcacaatcattggcacaacagcgggcgcaccgccggcgccgccaccgtgccgccgtcgcattgtatctgcccgtcggcggccacctggcagctgccgcctgggcgcgcggcgcaacgcggcgagccgtccggccccagcaggcacatgcccgggccggcgtagaaagcgccgccggcgcggatggcgccgccgccggggtacggcgagcagaacaggttgccgaattcgtcggccacgcaggcgccggcgccgcaataggcgttgccctggtgcagcaccgcctggccgccgggcggcgcgcagaagctgcggccgcccagattgacgcaattggccgccgcggccagcgaagccagcccgatcagcatgcccgcggcgaaatggcgcaaatgcattccggctctccctcagcgttccgccttggcgaacaggcggaagaagttttccgtggtggcggccgccacctgctccaccggcacaccgcgcagctcggcgatgaattccgccacatggcggacgtaggccggctcgttctgcttgccgcggtgcggcaccggcgccaggtacggcgaatcggtttcgatcagcatccgctccagcggcactttctgcgccacttcctgcacctgcttggcgttcttgaaggtcaccacgccggagaaggagatgtagaagcccagcgccagcgccgcctcggccacttcccaggtttcggtgaagcagtgcatcacgccgccgcattgctcggcatgctcttcctgcatgatgcggatggtgtcggcggccgactcgcgggtatggatcaccagcggcagattcacgcgccgggcggcgcggatatgggtgcgaaagcgctggtgctgccaggccaggtcgcccttgcaccagtggtagtcgaggccggtttcgcctatgccgaccacgcgcggatggccggccagctcgaccaactcgtcctcgctgtactcctccgcctcggggtcgtcagggtgcacgccgacagtggcgtaaagattggcgtgcgcctcggccagcgccagcacctgcggatacttgggccggctgacgcctatcaccagcgcgtgcgtgacccggttctcgcgcatattgcccagcacctcgggcaggcgggcggccaggtcgggaaaattgatgtggcagtgggaatcgataagcatgatggggcggccgcaaaactctgacagtaaccgcgcaagcataccacggcggcggccggcgcttcagccgcgcgccggctacatggtgtgggtggggcggctggagttgagcaccccgcccaacagcgcctctatcttgtccttggcctgcttgcccgcctcgccggaaacgaactcgacgccgacgccttgcacgcggctgttgttggcgccgcccggcgtgatccacaccaccttggcctgcaccgcgatgcgctgcgggtcttccatcagcgtcagcagcaggaacacttcctcgcccagctgcatttccttgttggtgggaatgaagatgccgccgttgcggacgaagggcatgtaggcggcaaacagcgcgctgcgctccttgatgtgcagcgacagcacgccggggcggttgggattgttcaggtccggcctggtgttggcggcatccatgcaaatgtcccctctgcgcgctcaagcgggcttggcgccggcgaaaatcttcaggtagtccatcaagaccgcctccagctgcaggcggatgttcaaggtatgttgcgagaacggcgccagcgccgccaacgcctgctggcaggccatcagctgcgccaggtcgcagcgcggcgccagcgccgacagcgcgcgttcctgatctggataatagcggacccgcccggcgaggcacagcgccgccaggtcgtgcagccacttctgcagccagttcagcggctgcagcagcgacagctgcttgttcttgtcggccagttccgccagctgcagcatgccggcgaagctgggctggcccagcgccttgacgaactggccgcgcagcgcggccagctccggatcgtggtcgaacagcggcgcgccgccattgtgcgccaactcgatctcggcgttggccacgccctgctcccgcagccaggccagcgcggcggccgcgcccggccgggtcagcgcgaactggcggcagcggctgcggatggtcggcagcaggcgctgctgcgcgtgcgacaccagcaggaacagcaccgcttccggcggctcctccaggattttcagcaaggcgttggccgcggccgggttcaggttttcggccggctccaccaggatcacccggcggccggcgcggtgggcggacaggtgggcgaagtcgatgacgtcgcgcaccgcctcgatcttgatctgcggcagcttgcgcaccgccttggcttccttgccctcttcctcttcgtcggcgaacggcgacagcaggcggaagtcgggatgggtgccgctggcgaaccagcggcagccctggcactggccgcagggctgatgctccgcttgcggcgcctcgcacagcagcgactgcgccaggtggcgggcgaaagccagcttgccgatgccggcgccgccggtgaacagccaggcgccgggcatccgttgccgctcggcgttcagccgccgccagtcatggttctgccacgggtacaacatcagccgcgctccagcaggcgctgcagatgcagcgcgatgtcggcctggatctcggcgatgccgcggctggagtccagcacggcgaagcggcccggctccgccgccgcgcgcgccagataggcgtcgcgcacgcgctggtggaagccggcggcctcctgctcgaaacggtccagctggcgcgtgcccgacatccgctgcgccgccacttccagcggcaggtcgaacaacaaggtcaagtccggctgcaggccccgctgcacccagtcttccagcacgcggatgcgctcgaagggaatgccgcggccgccgccctggaacgcgtaggtggagtcagtgaagcggtcggacaccagccagcggccggctgccagcgccggttcgatcacctcagcgatatgctgctggcgcgcggcgaaagccagcagcgcctcggcgtccagcgacaccaccgtctccggcgccagcagcagctcgcgtatcttctcggacagcggggtgccgcccggctcgcggctgaacgcggcgtcgatgtcgcgcccggccagccagtcgcggataaagcccagatgcgtgctcttgccggcgccgtctatcccctccagggtgatgaagcggccgcggcgggcggactgctctataggcattactggcctttcttcaggatgtatttgcgcaccgcctggttgtgttgctccagggtgctggaaaattgcgagctgccgtcgccgcgggcgacgaaatacagcgcgtccgactcggccggctgggcggcggcgtacagcgccgccttgcccggcagcgaaatcggcgtcggcgtcaggccggcgcgggtataggtattgtacggcgtatcgcgccgcaagtcggccttgccgatattgccctggtagctggcgcccatgccgtagatcaccgacgggtcggtctgcagccgcatgcccttcttcagccggttgacgaacaccgaggccaccatgccgcggtcggcgtcgctggaggtttccttctcgatcaggctggccatggtcagcagctcatacggcgtgcggtagggcaagtcggccttgcgcgccgcccaggccgcgttcaattgctgctgcatcacattgaaggcctggcggtagatgtcgaggtcggacgcgcccggcgtgaacagataggtgctggggaagaacagcccctcgggactggcgccgggcatgcccagctgcgccatcacctcggcgtcgctcagcggcttcgcctcgtgctgcacgtcggggttgcggtccagcgcctggcgcagctggcggaaggtccagccctctatcgcggtgacgctggcttcgtccggatggccctgcaccagccgctgcagcacgtccagcatgctctgcggaccctggaagcggtacaggccggccttgaccttgcggtcggcgccggacagccgcgccaacgccgtcatcagctggcggttgcggatggcgccgtcctgttccagcgtgcgggcgatctgcttcatcgtgcggttcgggcccaccagcagcttgtagccgccttcgggcagcgcgaccggcagcagcgcggcccaggccagccagcccgccgcgcacagcaggacaatcaacagaaagccggatagttttttcatcttgaatgcgtcgagaattcggtatctatagccgctcgggcggcaaaggcggaatcataccagcaagccgtcctgtacgacatgacaggtcagactgtccttcagccggagagtttgtcccacatcaactgcggacagcgcgcttttaccttatgtttcggtatgcaatccgcccttgcggacccaactcatccacgctacggacggcgatgaaacctttcttcaattttggctgcgcgctggtcgcctggagcgagctgtgccgggtggcgcgaaccccaggcgccctggccggcgccgacccgctgccgccgcaggccttgtgccagggcagccagagccaccagttcgtctacgccggctcgccgcagtcgctcgcctcctaccaggcggtgctgctcgagccgctatggctgcttgaccagcgccgcgacggccgctggcaactggtgtccaccgcgctgggcaacagcatgaatctgcggctgcaggcgctgttgcgcgcctggatgccggcgctgccgctggcggaggaggccggcccgcgtgtggccaggctgcgcctggctttgcgcagtttccagggcgagatcggcagcctgccggcggcgcgccagtccgatgaccgcgcgccgctgacacgcggcatcgccccgtatctagagcaggtgtccagcatcgtgcagctggaggacgccggcgacggcaggctgctgggcggcggcgtcaatctgcgcggcggccgcgccggccaggccgcggccgccggcaaaggctggccggatctgctggcctgcaattggcagcaagtgctgcaagtcgagcaggcgccgctggcagctggctaggatggcgattttggctgcataatgacggccacctcacccctccggagcgccgccatgccccgcctgcgtcttgccctgctttgcctctgcctgtctccgctggccctcgccgacaccgtcaatgtggcggtggccagcaatttccagcaaacgctggacaaaatcgccgccgccttcaaggccgccaccgggcatgagatcaaagccagcgccggcgcatccggcaagctggccgcgcagatccgccagggcgcgccgttcgacgtattcctgtccgccgacgacgagcgtccgaccgaactggtccgcgccggcgtcggccagcccgccagccagttcacctacgcctacggccagttggcgctgtggagcaaaaaacgcgacgacgccggcgaagccgctctgcgccagggcaagttcaacaagctggcggtggccaatcccgccaccgctccctacggccgcgccgcgatggaaacgctggcggcgctgaagctggaggcggcggtgaaagccaagctgctgaccggcgacaatatcggccaaaccatgcaattcgccgaagtcggcggcgccgacttcgccttcgtcgcctactcccaactgctggagcagggcatacgcagccgctactggctggtgccggagaagctgcaccagcctatccgccaggacgcgctgctgatcaagccctcgcccgccgcgaccgccctgatggccttcctcaagggcgagcaggcgcgcgcgctgatggcccaggctggctaccgcttcaagccgtgactccgcaagactggggcgccatcggcctcaccctgaagctggccggcatcagcaccctgctgctgctgctcttgtgcgtgccctgctcctggtggctggcgcgcagccgctcgccgctgcggccgatgctggaagcggcggcgatgctgcccttggtgctgccgcccaccgtgctgggcttttacctgctgctggctttcggcccgcgcgggccgctgggcaagctgacctcggccctggatcttcccggactcgccttcacctttcacggcgtggtgatcgcctcggtgctgtattcgctgcccttcgtgctgcagccgctgctggccagcttccgcgcggtgcggcaggaagagctggagagcgcgctgctgctgggcgcgggacgctggcagcgcatgcgccacgtgattctgccctcctgccgcaacggcgtgctgagcgcggcctgcctgggcttcgcccataccgtcggcgagttcggcgtggtgctgatgataggcggcaatatcgacggcgaaacccgggtgatttcgatcgcgctgtacaatcaggtggagcaggccaattatggcgccgcccaccagctggcgctgatgctgctgctgttcgcgctggcggcgctgaccgccgtctactggctgaacgccaggcgcgacaaagacgcatgaccccttttcaacggcctgtccgcaggcctttcctcagccatggagaccaaccgtgatgcgcaaaacgctattgctcgccctgtttgccctgttcagcgccaatctggcgctggccgacgccgcctgcgacgccaaggccgccgacaagaaactggccggcgccgccaagcaaagcttcctgaaaaaatgcgagaaggacaccgccgcggcccaggccagctgcgacgccaaggcggccgacaagaagctggccggcgccgccaagcagagtttcgccaagaagtgcgtgaaggacgcgctggccaaataaaccgcgccagtccatcgcgaaacggcggggagcccggcttcccgccgttttttttgcgccgcttgccgcagcgcaaaaaaataaacaatccagacgccgaaaaaacgcccaatcaacaatgacttggacgcaatagtctacacttgaacaaggtatggcttgtgagtgttggcaatgaactcgctgtctggatacaactcctctctctcgtctttcgacagtcttttgccgaacttgagcagtttgttgtccagcggtttgctgctgggcgccaacagcagcaccggcagcgcctcggccagctccaccgccgaccccatccaagtggaactgtccggcctcggccagctgatgtccatcctcaataccttccaaagcagcttgcagcaactgtacgctccggagttgcaatacaacaacagcagcgccagcagcagcaatcccggcgtggccagcgtcagcgccgccagcggcgcgcagaacgccaactacctgctgaccgtgtcgcagctggcgcaggcgcaaagcgccagcaccagcttcaccctgccggataccagttccacctcggtgggcaccggcagcctgaccatcaccaccggcagctacacctacaccagctcgacctcggccagcagcttcaccgccaatgacacgccggtaacggtcagcatcaccaacggcacgctgtccggcatcgccagcgccatcaacggcgccaatgccggcgtggtcgccaacgtgatccagaacgcctccggcgcctatcaattgcaggtcagcgcggccagcaccggcagcagcaacaatttccgcatcgccgtcagcgacaacgacggcaccaacaccgaccagagcggcttgtcgcgcctcgccttcgatcagaccctggcagtgggcagcggccagaacctcactcagacccagagcgcgctcaacgccgcctataccgtcaacggcgcatcggcttccagcagcagcaatttcggcatccagctgggcagcggcgtatcggccaacctgctggccaccggcagcagcaccatctcggtcaacatcgacttcggccaactcaataccaacgcccaatcgctggccaccgccttcaataccgcgcagggcagcatcaacagcctgctgggcaaccaggtcagcttcagcaacgatcccatcgccagccagctgccccagctgctgaatcaacaggcgcaaaccacctacagcaacggcagctcgctgctgacctcgctgagccagatcggcctgagctatcaaagcccggcgcaatacggcctgggcggcacgctgaacctgaacgtcagctcgctccaggccgcctacaacagcgactccaccggcaccgccaatctgttgtacgcggtggagcaggcgctgaactcgctggccaacagctataccacctacggcaacggctcgctggtcaacgagaccaacgccttgctgaaacagcaacgcaccaaccagctggccagcaacaccccgctgacgccgaacaccttcccattcaacctgaacgacctgctgcagaccaacagcaatctgtcggcccagcagatcagcggcctggccacctacgcgctggtctactcgctgggcgcgccctacgcgctggactcgctgctggtaggacagggcctgggcctgtctcccaacggcaccttctccgccaccgcctgatcgcccgcttttgaccctgcccgtgttttgcgcgtaaaattcatcggatgattggatgaattagaagacccagatgaatccgaaccccgcaatcaaacgctcgctggtggatatcgcgctcgacagcctgggccggcaattggccgacggccggtggccggtgggcagccgcatccccaccgagcccgaattggccgacgagctgggcatcagccgcaacaccgtgcgcgaagccgtgcgcgtgctgctgtacgccggcctgctggaagtgcgccagggcgatggcacctatgtccgcgccaccgtcaatcccggcgaggcgatgcgcgccatcagccgcgccagcctgcgcgagcacctggaagtgcgctgcctgctggaggaaagcgcggcgcgcctggccgccctgcgcgccggcgccgatgacctggtccgcatcgaggcgacgctgcataccctggcccgccaggccgacgatacgcccgaaagctacgccgagcgcgacatcgccttccatctggccatcgccgacgccagcggcaaccaggcgctggccggcctgtaccgctatttctcgcgcgcggtgcagcaaagcgtgcaggacgccatccgcgacgaagcgctgccggatcccggcctcgccgagcacgccgccatcttcgaagccatacggcaaaagcggccggacgccgccggcgacgccgccgccgccatcacccgcccgttgctggccaccttggaccagttgctggccgcgcaaaaccaataaccaggaaacgccatgcccgaccgcgatatccaaaatccgcccatcgccgacgaattgctgatcgacgacgacgcgccgcccgccaccagcctgcctgccagccgcggcagcgcgttgttgctgttgctggggctggtgctggtcggcctcaacctgcgtccggcgctatccagcctggccccggtgctggccatggtcagccgcgacaccgggctgaccccggcgctggccggcctgctcaccacgctgcctgtggcctgcttagggctgttcggcccgctggcgccgcatctggcgcgccgcctgggcagcgaaaaaaccatcgcgctggtgctggcgctgctggcggccggcatcgcgctgcgcactcaactgggcgtgttcggcctgttcgccggctcggcgctggccggcgccggcatcggcgtgatcggcgtgctgctgcccggcatcgtcaaacgcgacttcgccagccgcgccggcctgatgaccggcgtctacaccatggcgctgtgcctgggcgcggcgctggcggcgggcttcaccgtgccggtcgccgagcatttcggccgcgactggcgtccggcgctggcgctgtgggcgctgccggcgttgctggccatcgccgtgtggtggccgcagctgaaaacccgccacgccgccgccgccggccaatggcaggtgcgcgggctgctgcgcgacccgctggcctggcaggtgacgctgttcatgggcctgcaatcgtcgctggcctacatcgtgttcggctggctgccgtccatcctgatggaccgcggcctcagcgcgatggaaggcggactgatgctgtcgctgtccaccatggtgcaggtgccggcctccttgctggtgccgatgctggcgcaccgctgccgcaaccagcgcccgcctatcgccatcaccttgctggcggtgatcgccggcttgctgggcatgctgtacgcgccgaccggcagtctgctgctgtgggcgattttgctgggcttcggccaaggcggcctgttcagcaccgcgctgagcctgctggcgcaccgctcgccggaccagcacgtggcggcccacctgtcgggcatggcccagggcatcggctatatgctggcctcgctcggcccgttcgcggtgggcgtgatccgcggccacagccacgcggcctggccgctggcgatgctgttctgcctgatcgccgccgccgcgctcaccgtcggcatgctggccggccgcaagcagctggtgggcgtgcgcgcggtcgccgtctgaatccgctgccgaatgcgaaaagcccgccgtgaaggcgggctttttcatgccgaaagcggccggactcagcgcggcttggcgacgatgccgtagcggcgccacagcgccgccagctcttcgcgcgccagcggcagctccgcctcgccaagacgcaggctggcgggcaggctgtccgccgcgccgtcccagtccggcagcgcctcgtccagcagggcaggcagatcgcggtcgtccaccaccgccaattcgccgcctatctccagcagcagcatgccgtccggcgtcagccaggcggtgcgcgcggcgacatcgtcgtcgtaaggcaaggtgctccagcccctgggcgtgcgccgggccgccagcggcgccgcgtccagcgtcacgtacaccttctgcggcccgttctgcacataacagcgcccctggccgtcgcggccgtagttgcggttgaagaactccaccatcgcctcgtgctgcagccgttcgtccttgatccaccactgcccgcgcgcgtccagccgcagccagccgaacaccgccggcacattgggccatttggccatcgcggccaataccattgcgtccatcctgcttctcccgcgggcgccgcccgcctgtttgttcttgcccgctcaagccgccgcgcgcagcgcggccagcggcggcgcgcgcgtcaccctgcccaccagcggccagcccgtcagcgtcaccaccagcacgccgccgcccatgcccagcggcaacagccaccaattgatcagcaccggcagcgaaaacagcttcaccgccgccagcacgcctatgcccatcgctcccaatgccgccagcaagccggacaccgcgcccagccacaccagctcggccagcaccacgctgcgcagctggcggcgcgaggcccccagcgcgcgcatcaggccgatgtcggccagccgctcgtcgcgggtggccgtcagcgacgcccacagcaccagcacgccggcggccagcgccagcaggaacatcgcctcgatgccgcgcgtcagcttgtccaccatcgccctcacctccgccagtatgctgccgacgtctatcaccgtgatattggggaaacgctccaccagcgcgctggcgaaggattcgtccgccgcctccagccggaagctggtgatccagctggccggctgctggcggaattgccccggcgtgccgatcacgaagaaattgacgcggaagctgtcccacggcacttcgcgcaggctggtgaccttggcccggtaggtggtgccggccaggtcgaaggccagcgtgtcgcccaggcggatgcccagcttgtcggccaggccgcgctccaccgagaactgcggcttcacccgcttctcgtccggccaccatttgccggccgtcacctggttgcccggcggcaggtcgcggcgccaggacagattgaactcgcgctcggccagccggcgcgcctgctcgctgtcgtaagcggccggccgcaccggctgctcgttgatggcgatcagccgcgcccgcgccatcggcgacagctccggctgcggcctgccggcgacggcgaaggcatcgcgcagcgcgtccagctggccgggctggatattgatcacgaacttgttgggcgcgtcggccggcacgctgcgctgccaggcgccgatcaggtcgtcgcgcacgacggtcagcgtcagcagcgccatcagcccgaccgacagcgaggcgatctgcagcaccgccagccagcgccgccgcgccagattggcgatgccgaagcgccagcccaccttgccgccgcgcggcagccgccgcaacagcatcaccatgcccagcgccagcgcgccggccacgccgagaaagcccagcatcgccgccaggagccagccggccagcgcgaactcccccacctgccaggatgccagccccagcagcgtggccagcgccagcaccggcgcgatcacgccctgccgcgtcggcggcagctcattgcgcagcaccgccgccggcgacacgtcgcggatgcccatcaagggcggcagcgccaggccggagagcagcagcagcgccgccagcgggccgatcagccacggcagccagccgggatcgggcagcatctcgccgacgtagccgctgaacagctgcatcagccccagctggatcaggaagccggccagcgtgcccagcaggccggccagcaggcccagcagcaggaacaggctgacgaacagcccccacacctcgcccgagcccaagcccaggcagcgcagcaccgccacctgctgccaatggcgctgcaggtagcggcgcaccaccagcgccaccgccgacgccgccagcgccaccgtcagcatcgcggtcaggccgaggaagcgccgcgcccgctccaggccggtgcggatttccggccgcatctcttccacatcctccagccggctgcccggcggcttgcgcgcgctcagccagccgcggaaagcggccaccttgcggtcctctccggcgaacagcagccgccagcggatgcggctgccttcctgcaccaggccggtggcggccaggtcggcgctgttgaacatcagccgcggaatgaagttgtagacgtccatgctgccgtccggctcacgcacgatcaggccggacagcttcagctgcagattgccgacgccgatctcgtcgcccagcttcagcttgagccggctcatcagccgggcatccatccaggcctggccaggctgcagctgcaggcggccgctctgttcgctgccgtcggccagccgcaccgtggtttcgccgcgcagcgggtagccggcgctgaccgccttgtactgggccaaggcggcctggccgccggcgaaggccatagacgggaacacgatgttgtcggccatcgcgaggccgcgcctgcgcgcctcggcgcggatggcttccggcgccggcgcgttgccgctaagcaccagatcggcggccagcaactgggtggcctgggtggtcagcgccttctccacccggtcggaaaagaaggcgacgctgctcatcgccgccaccgccaccagcagcgccaggccgagtatggtcaactcgcccgacaccagttcgcggcggatgaagcgcagcagcagggtcagccgtcctcgcagcgtcatccggcgcgcgctccgttcagcttgccgtccaccaagcggtggatggcgtcgcagcggctggccagctcgttgtcgtgggtgaccagcaccagcgcggtgccttgctcggcgttcagctggaacagcaggtctatgatctggcggccggtgtgcggatcgagattgccggtgggctcgtcggcgaacagcaggccgggatgaatgacgaaggcgcgcgccaaggccacccgctgctgctcgccgccggacagatggcgcggatagtggccgaggcgcgccgccagccccacccgctctagcatctgccgcgccgcctcgcgcgcgtcgttgcgtccggccagctccagtggcagcatgacgttttccagcgcggtcagctgcggcagcagctggaagttctggaacacgaagcccacccggtcgcgccggagcagcgcgcgcgcgtcctcgctcagcctggagagcggcttgccgaacagcgccacctcgccatcgctgggatggtccagccccgccagcagcgacagcagcgtggacttgccggaacccgaggtgccgacgatggccacgctctcgccgggatacagggtcagcgaggcgctgcgcaggatgtgcagcacgtcgccgcggaaatgcacctgtttggccaactccctggcggccagcaccgcctttttctctggattgctcatgcgctctatcgtttgcaagatactgttccccttgttgctgctgtggcagctgccggcgcacgccgccaccatcctggtgtacggcgacagcctgtcggccggctacggcctggcgcccggccagggttgggcggcgctgctggcccgcgagctggcgccgcgccacaaggtcgtcaacgccagcgtgtccggcgaaaccagcgccggcggcctgtcgcgcctgcccgacgcgctcgcccgccacaaaccggacgtgctgatcctggagctgggcgccaacgacggcctgcgcggcctgccgctggccgacatgcggcgcaatctgcagcaaatggtggacctggccagccagcgcggcgcccgggtgctgctggtgggcatggcgctgccaccgaactatggcccccgttacggcgccgagttccgcgccgcctacgacgaaatcgccaaacgcaaccatctggcctatgtgccgttgctggtggcgggattcgccggcgacctggccagcttccagcccgacggcctgcatccgcgcgccgagaagcagagcaccatgatgcgcacggtgaaggcgaaactgccagtgaaataatccagcaacaagattgacttgttcgcatcagcacgaacaaaataggccaatcgcataataacatccgccggccgcgccccggagcttcgccccgcgaaatttcccgccctgccggcccacccacatgcccgatcatcccccctcgctctggcggcgctggctgcggccgtaccgcggcctgccggccggcgtctacatccagacgctgtgcagcttcatcaacaacgtcggcggcatctccaagctgttcctgccgctctacctgcgcgaaagctaccacctgccctacagccagatcggcgcgctgatggccttttacggcgccggcatgctggccggctcgctgaagggcggcagcctgagcgaccgcttcgacagccgggcgctggcggtgctggcgctatcgctgtccggcctgtgcatgctgttgctggcgctgcggattccggtgtggctgttcatgccggtgctggtgctgtccggcatggccgacggcggcttccgcccggtcaaccagcggctggcgctggagccgtgcacgccgcaacagcgtccggtggcgcagggcatgatgcgggtggcgttcaatctgggcgtcgccatcgccggcatcagcagcggctttctcgccgcctacggctaccagtgggtctacgccgccaacgccggcggcacgctgctggccgcctgctggctggcctggtcgtacagccgccgccgcgcgctcaccctccccgtccgccgcgatgaggaaagcggcggcgcgctggcgggcccttggcgcgacgtcagcttcctgcgcagcatcgccgcgctgatcctggtgacgctggctttcgaccagatgtacgtgaccctggcgctgttcctgcgcgaacactaccagctgggcgcgcagtgggtcggctacctgttcaccgtcaacggcctgatggtggtggcgctgcagatcccgatcagccgccgcatcctgcgctgggggctggggcgcagcacccagctgggcatcctgctgaccggctgttccttcctgtggctgaacgccggccacggcgcgccgtgggcggtgctgatgatggtgacgctgacttgcggcgagctgctgctgtcgccgtgctacgcgctgctggtgatgcaccgctccgaaggccggctgcgcggcagctatctgggcctctacaacgccgcctggaacggccgcaccctggtggcgccggcgctgggcaccgcgctgtacggccatttaggcggcgcggcgctgtggtggctgtgcgcgctggccgcctgcctgggcgtggccatccagcacggcgcgctgaagaggatgctgagcccggccgccgcctgagcgcgcgccggcggccaaataaaacaccccgccggcttgcgcgggcggggtgcgggacggaatccggatcagccgcggattacaggtccttggcgttttcggccaggtaggaagccacgccttcggcggacggcttcatgcccttcttgcccttgttccagccagccgggcacacttcgccgtgctcttcggtgaattgcagcgcgtcaaccatgcgcagcatttcgtcgacgttgcggcccagcggcaggttgttcaccacttggtgctgcaccacgccggacttgtcgatcaggaaggagccgcggaaagcgacgccgccatcggcttccacgtcgaaggccttgcacaggtcgtgctggatgtcggcgaccagggtgtagccgacttggccgatgccgcccttttccaccggggtgttgcgccatgcggcgtgggtgaactggctgtcgatggacacgccgatcacctccacgttcttggccttgaagtcggccaggcggtggtcgaaggcgatcagttcggacgggcacacgaaggtgaagtccagcgggtagaagaacaccacggcgtacttgccggcggtggcttgcttgaaggagtagttgtcaacgatctgaccatcgccgagcacggcggagaaggttttttcaccagcgaagaacggggcttgcttgccaacgagtacggccatttggatctccttaaaggtcttggtatgacaacgcttccctgatcgggcatcggaaaacgtcgcggaatgcgaggctttataaatcagcctggccaggcccggcaaattgtaaatcgatatcgttgcgataaagttttgcaatcggcgccgggcgcgcggccggccggcgaaacgccgctgatctatccgaccaagatgggggtgccgagttcagctttcaagcccgctgccgtctgcgcggccgccgccggacgcaaaaaaaacggacagagaactgtccgtttcatcttggctccggccgggctcaggcgctcggctcggccttctggcgcaggcgcaggttcagttcgcgcaactgcttgtcgtccaccgcgttcggcgcgttggtcagcaggcactgggcgcgctgggtcttggggaaggcgatcacatcgcggatcgattccgcgccgcacatcagcgtcaccagacgatccaggccgaaagccaggccgccgtgcggcggcgcgccgaacttcaggttgtccagcaggaagccgaacttgttctgctgttcttccgggctgatcttcagcgcgccgaacaccttctcctggatgtcggcgcggtggatacggatggagccgccgccgatttcccagccgttcagcaccatgtcgtaggcgcgggccaagcacttgcccggatcggtagccatcagatcttcgtggcccggcttggggctggtgaacggatggtggcaggcggtccagcggtcggcttcctcgtcgtgttcgaacatcgggaagtccaccacccacagcggacgccattcgcgcacgaagtagccgtccttctcgccgcgctcgtggccgatcttgatgcgcagcgcgccgatcgcctcgttcaccaccttggccttgtcggcgccgaagaagatgatgtcgccgttttgcgcgccggtgcgctcgatgatggccttgatgccgtcggcggacaggaacttcacgataggcgactgcaggccctcttcgttcagcttggtgatgtcattgaccttgatgtaggcgaggcccttggcgccgtagatggcgacgaactgggtgtagtcgtcgatttccttgcggctgatgccggcgccgttcggcacgcgcagggccaccacgcggccattggccatatcggcggcgccgcggaacaccttgaattcttccgacttcatcacgtcggtcagttcggtgaacttcagcgaaacgcgcatgtccggcttgtcggagccgtagtagaacatggcgtcgccgtaggtcatgcgcgggaaggtcggcagcgtcacgcccagcacgtcgctgaagatctccttcgtcatggtctcggtgatgtccatgatctggtcctcgttcaggaacgaggtttcgatatcgatctgggtgaattcaggctggcggtcggcgcgcaggtcttcgtcgcggaagcacttggtgatctggtagtagcggtcgaagccggccaccatcagcagctgcttgaacagctgcggcgattgcggcagcgcgaagaactcgcccggatgcacgcgggacggcaccaggtagtcgcgggcgccttccggggtggagcgggtcagcatcggcgtttcgatgtcgatgaagccctgcttgtccaggtggttgcgcacgcccatcgccaccttgtagcgcaggcgcaggttcttctgcatcgcagggcggcgcaggtcgatcacgcggttggtcaggcggacgttttccgacaggttctcgtcgtcgatctggaacggcggcgtggccgcggcgttgaggatctcgatttccttggccaggatttcgatctcgccggagatcatcttgctgttggcggtgccggccgggcgctcgcgcacgatgccgctgatcgacagcacgtactcgccgcggctgctgtcagccagcttgaatgcttccggggtgtccggatcgatcactacctgcaccaggccttcgcggtcgcgcagatcgatgaagatcacgccgccgtggtcgcggcggcggtgcgcccagcccttcacggttacggtctggccgaggtattttttatcgataagtccacagtaatcggtacgcattgggtaaacctttttattgaatccggtgaatctcccgcgagggaggaaggcgtttaggggctagacagggtgacggcctagccctgccgattatgttcgtcattcaggcgcggacgctgggcgcccggcggcggattgggcaccaccacgcccatcgagatgacgtacttgagcgcgtcgtcgacgctcatgtccagttggcgagtgtcgctgcgcggcaccacgatgaaatagccggaagtcgggttcggcgtggtcggcacgtacacgctgaccagttcctcgccgttctccgcgtggcggaggatttcctgggccggcgtgccggtctgaaaggccacggtccaggcgttctggtgcggccagcgcaccaagagcgcgttcttgaacgcgttgccggaatcggagaacagcgtgtcgctgacctgcttgacgctgttgtagatcgagcgcaccaccggggtgcgcgacagcaggccgtgccagaaggccaccagcttgcggcccagcacattggcggccagcatgccggtgcccatcaccaccagcaccgcgaacaccacgcccaggcccggcacatggcggccgaacagcgcctcgggccgccactccaccggcagcagcgtcagcgtctggtccagcgagccgatgatcaggttcagcacccacagggtcaccgccagcggcagccagatcagcaggccggcgatcagatacccccgcagggtcatttttatctttggcgataccgacatcaatcgcaaccgcagccggtgccgcagctatggccgccggaactggcggcgccgcccgcggcgctggaggaggagccgcccttgaagtcggtggcgtaccagcccgagcccttcagctggaagccggcggccgacagctgcttgtgatagtcggcgctgccgcaatcgggacaggccgcgagcggagcgtcgctcagtttttgcagatgctctttggcgacgccgcaggcgccgcaacgatattcatagatcggcatagttttatttccccgccaattgaccacaatggcataatacaaccggatgctgcactgcaccacagctggaactaaactgcgcgcaaggctgactgtacaggtgcggccacctgctttcaaactcaagtgcgccgcctcgcaaacctgcgattatatccgactgaaacggcaatacaaaaaccacttttacatcatcgcatcgcaacaccgtcctgcaacgctatcccggaggtctacatggtttaccaagagggtcagatggaaagcattcgcaacattctcgccggcaagaagggactgatcgtcggcatcgccaacgagaacagcatagcctacggctgcgccagcgtgctgcgccagctgggcgcggaatgcgcggtcacctatctgaacgagaaggccgagaaacacgtgcggccgctggccgaggccttgcaggcgccgctgttgctgccgctggacgtggagcagccggagcagatgcgcgcggtgttcgaacgcatcgccggccactggggtgaactcgacttcatcatccactccatcgcctactgtccggccgacgacctgcacggccgcgtggccgattgctcgctggccggcttccagcaggcgatgcgggtatcctgctactcgttcatcgaaatggcgcggctggccgagccgctgatgaaaaagggcggcagcctgatcaccatgagctactacggcgccgacaaggtggtggagaactacaacatcatggggccggtcaaggcggcgctggagagcgtgtcgcgctacctggccaacgagctcggccccaagcgcatccgcgtgcacgcggtatcgcccggcccgctgaaaacccgcgccgcctccggcatcgcccatttcgaccaactgatcgaagacgccatcgcccgcgcgccgcaaaaccgcctggtcgacatcgaagaagtcggcatgacctgcgccttcctgatttccgacgccgccagcggcctgaccggccagaccatttatgtagacggcggccaccacatcaaggcttgaggagctcagcatgacccacgacgaccacgctttcgacgacatcctgcagcaagcccgccagctgggcgccctgccaatggcggtggcccacccctgcagccgcgaatcgctgctgggcgcggtggaggccgccgaaaacggcatcgccacccccatcctggtggcgccgctcgccaagctgaaaaaactggccggcgaactggaaatcgacctcaagcgcttcgaatgcatcgatgtcgagcacagccacgccgccgccgaacgggcggttcaactggtgcgcgacggctacgccgacatcctgatgaagggcagcctgcacaccgacgagttcatgagcgcggcgctcgcccgcgataccggcatccgcaccgaccggcgcatcagccatgtctgggtgatgaaggtggaaagctaccctcgctacctgttcatcaccgacgccgcgatcaatatcgaaccggacctggtcaccaagcgcgacatctgccagaacgccatcgacctgacccacgcgctgggcattccctgccccaaagtggcgatactggcggcggtggaaaccatcaatccggacatgcgctcgacgctggacgccgccgcgctgtgcaaaatggccgaccgcggccagatcaccggcgcggtgctggacggtccgctggccttcgacaacgccatctccaaggaagccgcccagagcaagggcatcgtctcggcggtggccggcgatccggacatcctgctggtgccggacctggaggccggcaatatgctgggcaagcagctgacctatctggccaatgccgcctccgccggcatcgtgatgggcgcgcgcgtgccgatggtgctgaccagccgcgccgacgacgccagcggccgcctcgcctccagcgccatcgccaatctgctggcccacactcgccggcaggacggagaacggccatgagcgcctgcctgctggccatcaacgccggctcgtccacgctgaagttccgcgcgttcagcgccgacggacaaacgctgctggcgcgcggcatggtggaccgcttcggcgccaaggacgccaggctgagcctggccgacgccaaaggccagcaactggacgagcgcggtctcggcgatgccgctcacgacaccgcgctggcggcggtgctgcacggcctggccgaccaaggcctggaagcgcgggcgctggcgcaccgggtggtgcacggcggcagccgcttcctgcaagcggtgaagatagacgccgacgtccgcgccgcgctggacgactacatcgcgctggcgccgctgcatcagccggtcagcctggaagtgatcgacgccttcgccggcctggacagccgcctgccgcaaatcgcctgcttcgacaccgccttccacgccggccagcccgccatcgccacccgcttcggcatcgcccgccactggcacgacgaaggcgtgcgccgctacggctttcacggcctctcttacgccgccatcgcccgccgcctgccggaggtgggcctcgcccacgccaaggtggtggtgtgccacctgggcagcggcgccagcgcctgcgcgatcgaatccggccagagcgtggcgtccagcatggggttttccgcggtggacggcctgatgatgggcacccgccccggctatatcgaccccgaggtgatcctgtactggcaggagcacgagggcatgggggtgaaggacgtgcgacgcgagctgtacaagaactccggcctcttgggggtatcgggcatctccgccgacatgcgcgaactgctggccagcgagcagccggccgcgcgcgaagcggtggagctgttctgctaccgcgccgcgcgcgaggcggccagcctggcggcggcgctgcgcgggctggacgcgctggttttcaccgccggcatcggcgagcattccgccgaggtgcgcgccaggatactgcagcagctgtcctggctgggcttcgagctggaccacgccgccaacctggcgcacgcgcgccggctcaccactgccggcagccgcctgccggcctatgtgctgcccaccgacgaagaaggcgaaatggcccgccaggcggcgcggctgctgtaggcgacgaaaagcccccgcggcgcgaagccggcgggggcagttccaaacacaaaaggccccgcgttgcggagcctttgcgtattcttttcagcctgggctgaagatcaggccattgccttgacctgagcggacagacggctcttgtgacgagcggccttgttcttgtggaacacgcccttgtctgcaatgcggtcgatcactttttcggaagcgtggaatactaccttagcggcagccttgtcaccggcttcgattgccttgagcactttcttaactgcggtacggaacgcagtacgcaggctggcgttgtgcgcgcgctgcttaagggctgtgcgtgcacgcttgcgagcttgtgcgctgttagccatgaatctatctcctgatgagcggaatctgaaactcgcgattctaagccctaaactcaggttttgcaacaataaacgggccggcgtaaactagcgcccttgctcaacccgccctgtgttgcctaattcccaatgaacctgctcaaggctctggctgcagtcagcagcatgaccatggtgtcccgcgtcctcggcctggtccgcgataccctggttgcacgaactttcggcgccggcctgtccgccgacgctttcaacgccgctttcaagattcccaacatgctgcgccggctgttcgccgaaggcgcgttttcccaggccttcgtgccgatactgggcgaatacaagcagaacaagacccacgaggaaacccgcgagttcgtcgccaaggtgaccggcgtgctgggatcggtgctgctgctggtgaccgcgataggcatgctgttcgcgccgctgatcatgtggatctcggcgccgggcttctaccgcgagccggccaaggcggcgctgttcgccgacatcctcagggtgtcctttccttatatctttttcatttcgctgtcgtcgatgaccggcagcatcctcaacagctggggcaagttctcgatcccggctttcacccccaccttcctgaacctcagcttcatcgtgttcacgctggccttcacccactacttccatccgccgatcatggcgctggcctgggcggtgttcctcggcggcttggtgcagctggtatggcagctgcccttcctgaaacagataggcatgctggcgcgtccggtgttcgccttccgcgatcccgaagtctggcgggtgatccgccagatgggcccggccatcttcggcgtgtcggtagcgcagatctcgctgctgatcaactccaccttcgcctccttcctgcccaccggcagcgtgtcgtggatgtattacgccgaccggctgatggaattcccgtccggcgtgctgggcgtggcgctcggcaccatcctgctgccgtccctgtccaagcacgccgccagcaagtccgacgccgagttcagcgtgctgctggactggggcatccgcctgtcgctgctgttggcggtgccggccaccgtcggcctgggcctcttgtccggcccgctgctctacaccatgttcatgtacggcaagttcagcgcccatgacgcgctgatgtcgcagcaggcggtgatcgcctactccttcggcctcctggggctgatcctggtgaaagtgctggcgcccggcttctacgcgcgccaggacatcaagacgccggtgcgcatcgcggtgaccacgctgatcgccacccaggcgatgaacctggccttcgtgtttccgctcaagcacgccggcctggcgctatccatcggcctggcctcctgcctgaacgccggcctgttgatgcacacgctgcaaaaacgcggcatctaccgcccagaggccggctggaaaagcttcctcgccaaattggccaccgccatcgcggcgatggccgccgcgctgctggcggcgcaatggctgctgccgatagactggcacggccacgcctggctgcgcgcgctgtggctgctgctgctggtcgtgatcggcgcggtggtctacttcgccgtgctgttcgcgctgggcttccgcccgcgccaattcatgcgccgcgagcattgagcatgcgccggacgcttgacttgctgccgcgcgccgagcgccaggcggcggcggtgctgctggtcagcagcctgtgcatggtctggctgcagtatccggccaaccgctactggatgctggaaaccctggcgctggcgcagccccgggcggcggacgccttccgcgccgccgtgatcgccaatccgcataccgagctgttccgcgccgcctactgggcgctggccagcatcgccggctatgcgctgctgccgctgctgcacatcaagttgaaaggcgagcggctggccgactacggcgtagcctggccggaccgcgccgcgctgaaaaccgacctcaagctgtttccgctgttttacgcgctgatgctgccgctggtgtggtgggcgtcggcgcagcccggctttctggcgatctacccgttcttccgcctgagcccgggcgagacgctgtggccgcactggctgctgtgggagctgctgtatttcgcccaattcgccgcgctggagttcttcttccgcggctatatggtgcacggcctgaagccgcgcctcggctggctggcgattttcgtgatgatcattccttattgcatgatccatttcgaaaagccggcgctggaaagcctggccgccattctcgccggcgcggcgctgggctggctcagctaccgctataaatcaatctggctgggcgtcgcgctgcattgcagcgtggcgctgaccatggacctgatggcgctatggcgcaagggcctgctgtaaaggaaaccgatatgagcacacacgccactcccgaacattcgccgctgggcaaaaccgtcagctatcaggatcagtacgattccagcctgctgttcccgatcgcgcgccagaccaagcgcgacgagatcggcgtggcggaagccgcgctgccgtttgccggcgtcgacatctggaccggtttcgagctgtcctggctgaacgcgcgcggcaagccgcaagtcggcatcgccaccttccgcatccccgccgccagcccccggctgatcgagtccaaatcgttcaagctgtacctgaacagctacaaccagacgcggatggacagcgtcaacgccctcgccgcccaactggcgcgcgacctgaccgacgccgccggcgcggaagtcgccgtctccatcgcgctgccgcaagccttcgccgccgaacaggtacgcgaactggcaggcgagtacatcgacgacctggacatagaggtcgaccactacgcgccctgccccgagattctcaaagccgacgccgccgacatcgtcagcgaaaccctgtgcagcaatctgttgaaatccaactgcctggtcaccggccagccggactggggcagcgtctccatccgctacaccgggccgaagatagaccgcgaggcgctgctgcgctacctgatcggcttccgccagcacaatgagttccacgagcaatgcgtggagcgcatcttcgtcgacgtgctgcgcgcctgcgcgccgaccgagctcaccgtctacgcccgctacacccgccgcggcggcctggacatcaacccctggcgcagcaacgccgacgccgcgccgacggacaatatccgcaccgcgcggcagtaagcgcccgcgttggccaaaacaaaagggatgcctgccggcatcccttttttatgcgcctggcccggcgtcagaacggcgccggcgcctcgaattccatttcctcgaaagtcaccgggtggcgcaacaccagccgggacgcgtgcagcagcaggcggtcggccttggccagcgcctccggcggcgcgtagatgtcgtcgcccaggatcgggtggcccatgtccaggtgcagcatgtgcatgcgcagctggtgggcgcggccggtttgcgggtccagctccacccgggtgatgtcgcggccggtgtcgcgcgaaatcacgcggaaatgggtaatggcttccttgccgtgctccaggtctactttctgccgcggccggttcggccaatcgatgagcagcggcaggtcgatggtgccgctattgttctcgacgatgccgtccaccaccgcgatgtagcgcttcttgaccttgcgctccatgaaggcgatcgacagcgcgcgctgcatctcggggccgcgccccatcaccaccaggccggaggtggccatgtccagccggtgcacggtcagcgcgtccggatacgccttctgcgcgcggctgatcaggcagtcggccttgtcctcgccgcgccccggcaccgatagcaggccgctcggcttatccagcaccaggaggcagctatcggcgtagatcacggaaaggccggtgtccggcggcggattgtagtgttccagattatgtctttgcatggctaacggctttgaaaatcgattggcggcgattatcggcgctaaagcctttcgccacaagctgttaccgtcttttctccgcggcgctgtcacttgaaatcccggcgagctgccgtcaccctgtcctgacaagacgacaaaggacgcatcatgacggaacgcttctatcaagacccctaccagacccgcctgtccacccgcgtgctgtcccacgacgacgcgggcttgatcctggaagacacgctgtgctacccgctgggcggcggccagcctggagacagcgccatgctgacgctggccgacggcgccgcgctgcgcgtcgccgacacccgccgcgaccgcgacacccgcgccatccggcaccagaccgagggcgacgtccgcctcgcgccgggaaccgaggtgacgctggagctggactgggaccgccgccatcgccacatgcgcatccatacctgtttgcacctgttgtcggtcgtgatcaaggccggcgtcaccggcggcaatctcaccgccgaatccggccggctcgatttcgatctgccggagggcatggagctggacaaggaccagatagaggccgagctgaaccggctggtggccgccgacctgccgctcgcggtgaaaatgaccagcggcgaggcgctgaaggcgcagccggagctgatcaagaccatgtcggtgacgccgccccttcacctgccggaaatccggctgatcgaagtggaaggcgtggacctgcagccctgcggcggcacccatgtggcgcgcaccggcgaaatcggccgggtgcgggtgaaaaagatagagagcaagggcgcgcgcaacaagcgggtggtggtggaactggcggattaagcgaaaacgggagccttggctcccgtttgcgcatgcggccggcggctcagcgcgcgtccagcgccatttcgtgttccggctgctccggcttctcgtccagcgtcatccggtgcagccacggcgcgatgatgatggtgagcagcgcgatcgccccggtcaccacgccgatctgggtgaacacgcggctgtagatctccagcgtggccagcgggctggtgacgttgtccggcgcggcggtcaggcccgccacccagccggcgatcaccgacgacgctgccgaggtcaggaaccatgcgcccatgatgaagcccatcagacgctgcggcaccaattgcgccaccatcgccaggcccaggccggaaatcagcaattcgcccacgctctgcaacagatagctcaacaccatccagttggacgataccaggccttgcgcgttggcgtacttggcgcccagcggcagcaccaggaaggcgccggcgcacagcaccatgccgatcgcgaacttgtgcggcatcggcagccggttgcccagcttgttgtagcagacggcgagcaaagggctggccagcatgatccagaacggattcagcgattggaactgctccggctgcaccgggatgccgaacagcgtgtgctcggtattgtggatggcgaagaagttcagcgacagcggcatctggttgtacagcacgaagaataccgtcgcctgcagcatcaggatggcggccacaatcatcttcttgcgctcggcgcccttcagcagcagcgtttccttcacgtacagacccaccacgccgatcgacagcgcggccagcaccacgttggcgatgatctcgtgcttcagcagcagcgcggcggcgccacaggcgaccaccaccccggccagcaccgccagccaggtggacagcttgggttggcggaagtcggcgtcggaaccgtaatgcttcacccagccctgcatcagcaggaagttggcgacagtgatcagcatgcccaccaccgacaacgcgaaggcgtgggcgtagccgaacttgtcggccagccacggcgtggccagcatcgacagcagcgagccgatgttgatcgccatgtagtacatggtgaaggcgccatccagccgcggatcgttttcctcgtagcacttggacagcagcgacgacgggttggccttgaacaggccgttgcccaccgcgatggtgcccatgcccaggtagagcaggccgatatgctcggccgacgcggtcaccatcccgtagccggcggccagcaccagcgcgcccagcagtatggtccgcttggtgcccagcaccttgtcgcccagccagccgccgacggcgatcaggccgtacaccagcgcgatgaaggacgagaacagcgtgaacgagtcagcctcgcgcagacccagcgccttgacgaggtagacggccagaatgccctgcaggccgtagaaaccgaaacgttcccagaattcgatcgagaagatcaggtaaaacggcttgggctgccgcagggggttgagcgcggtcgacgtcatgaataagttcctcgcgatgccacggctgcgatgccctgaagggcctccacggcggcaacgacgacgacggacgctcagcgcgccggccgttgccggtcgcgccaagatgggacagacagtggtcactactgaaaaattaagcaaacttccgccatcaatcagaaaaacaccgaaattgcaggcatcaatcgatgaaagatagcattcaggaactattgatgaagcatatggaccttgctgtcaatgcgggatgccgccaacagcccaaaatatcccaacagcactggcaacatatagttaagcattagataatttaacgtggaaattattatttttcacagcaaatacgatttatatttctttttgtaagaaatttaagcatttaattgcaattttaagcggcgcattgaaatcacccccttgccgcccctggcgggtccggcatcgcacaacctggccaaaagaacaggacagccggcatccccacggactattcctccaagtacatgccagaagaaaggacgcccgccatgccgctgccccgcctcagcctcgcgctgctgtgcctgctcgccttgccagtccgcgccgcgccgaatccgactttcgatcccaccccgctgccctggcaggaactggcggcccgcctgcgccacacctattacaccggcggcgtccacaatgaaaaatggtgcctgccaccgttcaactgcacctatccgcgcagccccggccagcccagcaacccgctgttccccaaatggtgggtcagcgactggaccatgtaccgggtgttcaagaactacgagcaatacccgccgccgtacagctctccaccggccggcctgagccccgacgattatgaagtgtcctacggcgccagctactacgacgccagctacgtaccggccgacggcgacggcaagggcgcgatgatggaacactacgagaagcgctgcttgcccatttttcccggcagcaaccactacagctgcagcttcgtctcgctgggcaacaaggcctatttcctgacctacgccgaccgcctgccgggcatgccgcaatgctgccagttctcgctgaacaaccatccgccgcggcaggacttcatccgccacctgccgtacaacaaggcggaaagcagccaccttgacaacagcctgcaagcctattcgcggctggtcggtccgcagaagatcctgttcggctacgccttctacaagcaggccgcccccgacgccgacggcggcaagccttatcgccatccgcaatcgttctacttctccggcgaccccagcccggagccggacgcgcccatcgtcagccagaactacagccacttccgcgccgaaaagcccgatccggcgcaaacctgggaccaggtggcgcaaatgtgcccggccaagccgcagtggtgctgcctgttcgccagcgactgtccggacaagccggctacgccggacgaaaacaatcccaagtcctgggccaccgcccggccctaggccagcaaggcggccagcagccgctcttgcgcggccgcttgccgccgcagcgaatcggcgaagcgtcccggcagcggcgacgccggccgatattgcggcagggccagttgcacgctgaaggggatggatgcggccagcggcctagccaccaggccatcgccggcctcggccaacgcggtcagcgggttgacgatggccacgcccagccccagcctcaccatcgcgcacaccgaggccgcgctgtggctggacagctgcatgcgccgcgacaccctctcgcgcgcgaaccaggcatccacctgctggcggtagctgtcgctggcggccaggctgatgaaggacagcccggcgaagtcggccgcctccagcctgcgcttggccgccagcggatggccagccggcagcacgcacacttcatcgccctgccacagcgtctgcgtctggcaaccggccggcgcctgctgctgctcggtcagccccagatcgaagcgctgcgccgccagccaatcctccagccatggcgactcctgcgggctgatgtctatgccgacatcgggaaatccggcgacaaagtcggcgcacgctgccggcagcagcgtctgggcgaacaccggcaggcaggcgatggcgagctggcctccggcgaactggcggatcgccgccgcgctgccgacgatgcgctccaggccgatgaagctgcgctccacttcggcaaacagctgcaaggcttgctgggtgggccgcagccgtccccggctgcgttcgaacagcgccagccccagcaattgctcgcaacgcgccagctcgcggctgaccgtgggttgcgaggtatgcagcagccgcgcggcgccgctgacgctgccgctggtcatcaccgcgcggaacacttcgatatgacgcagattgacggacacagccgctccccctggaaatcagcccatatcataaatgaaagatatggccacaaattgctattttatttttatggaaaagcggctgatgatgggaaaaacccatccggaagccccagcatgcacgcattcgacacccgccagctcgccgccatcgcccagcaatacggcgcgccgctgtggatctaccacgccgacaccatacgccggcgcatcgccgaactctcgcacttcgataccatacgctatgcgcagaaagccaactccaacacccacatcctgcgcctgatgcgcgaacagggcgtgaaagtggacgcggtgtcgctgggcgagatcgaacgcgcgctggccgccggctatcagggcggcgcgcaagccgacatcatcttcaccgccgatgtgctggaccgcgccacgctggcgcgggtggcggagcttggcattccggtcaacgccggctcgatagacatgctgagccagctgggcgcggcctcccccggccacccggtatggctgcgcatcaatcccggcttcggccacggccacagccagaaaaccaataccggcggcgaaaacagcaagcacggcatctggcacgccgatctggagctggcgctggcggagattcgccgccaccggctgcaactggtcggcatccacatgcacatcggctccggcgtcgactacggccacctgcagcgggtatgcggcgcgatggtggagctggtgcagcggctggattgcgacatcgaggccatttcggccggcggcggcctgtccatcccctaccgcgacggcgacgcccgcatcgacgccgatcattacttcgagctgtgggacgaggcgcgccgccagatagccgaccggctcggccatccgctgcggctggaaatcgaacccggccgttttctggtagcagaatccggggtgttgctcagcgaggtacgcgcggtaaaaaacatgggcagccgccgcttcgtgctggtggatgccggcttcaacgacctgatgcggccgtcgctttatggcagctaccaccacatcaccgtcctcgatgcgcagggcgcggcgaaatccggcagcgtcgacaccgtggtcgccggcccgctgtgcgaatcgggcgatgtgttcacccagcgcgagggcggcaccgtggaagcccggccgctgccgccggccgcggtcggcgacctgctgctgttccatgacgccggcgcctacggcgcgacgatgtcctccaactacaacagtcggccgctgctggccgaagtgctggtggatggcggcgcggtgcgccagatccgccgccgccagaccatggccgagctgctggcgctggaagcctgagccgccgccggcaaacgtgaaaaagccgggcaatgcccggcttttcgcgcatcccgcctggatggaagactcagttcttcagttccatcttgttgatcacgaacttgacgcccggaatctgctcggcgatctggccggcgcggaacatctgctggtcgtcgctcatttggccttcgatcgtcacttcgctcttgttgctgctcactttcaggcccagcgccttcagttcggcatcgctatccagcgcctgcttgacggaggcggccagctcggcgtcggtcggcgcggcaaccgcaacggcgccttcggcataagcctgagtggcgaaggcgcccgaaaaggccagtgcggccaacagcagggtttggcttgcaaaacgtttcatcattttctccagatttctcgcgacaaatgccggctggcgcaattcccatccggcgcaccacacggaacggctccatgttagcgatgaaacttttccgttttgttgcagctcaatgacactgagctgactgcggcattccagcgacacgctgcgcgacccgcaggttacaatccatcccattcatcaagagaaggccgcccggccagtaggcatgacccatatcctgtccccgaaacgctggccgctatggctggccttgctgcttctcgccggttgcggcaccactacgccgaccggcagcctcccctccctccctagcgccggcggcggcgacgccagcagcctggccgccctgcccgcctggaacacccagacgctgggcgacacgctgcaaggcctgcggcaaagctgcaagagcctgcagaaaaaaccggcttggcgcggcgtgtgccgcgaagccggccagttggccgacaacgatggcgatgcggtgcgccgcttcttcgaaaaccgcttcaccgcctggaagctgcgcgacggcaaccgcgacagcggcctgatcaccggctattacgagccgctgctcagcggcagccgcacccgctccgagcgcacgccgtggccggtatacggcgtgccgcgcgacatggtcagcgtcgacgtgccgataagccagcgcaatcgcggcgcgctgcgggccaggcaaatcggcccgaaccgcctggcgctggccgccggcggcgatatcgaagtcaacccggctgatttcccggccgatccgcgcggcatccgcctgaagggccgcttgtccggctcgcgcctgctgccctacttcacccgcggccagatcaatcagggcagcatcgccggcagcgcgccggtgctggcctgggtggaagacccggtggagctgttcttcctgcaagtgcaaggctccggccgcatccagctggacgacggcagcttcatccacgtcggcttcgccgaccaaaacggctatccctaccagtcgataggcaaatggctggtcgaccagcgccagctgacgctctccgacgcgtcgatgcaaggcatcaaggactggctcgcgcgcaatccgcaacgccgcgacgagctgttcgcggtgaatcccagctacatcttcttcaagaccaccccgggcgacaacggcgggccggtcggcgcgctgggcgtgccgctgaccggcggctacagcatcgcggtcgacccccgctacatcccgctgggcgcgccgatctatctgtccaccacctggccgcactccgccgaaccgctggtgcggctggtccacgctcaggacaccggcagcgccatcaagggcgcgttgcgcgccgacctgttctggggctacggcaccgaggctggcatgtacgccgggcggatgaagcagcaaggcagcttgtggctgctgctgcccaagggcctgtcgccgtcggcgacgctgtaaacgagcgcgggggccgcccgcccccgcgttttccttccggccccaagcgcaagccgcccagccggatccgcacgcattcgatgctgggcatccgccgcgctcagccctccacctgttcgccgatgcggcccagccgctgcagcctggcattgatcgcgccgcggctgcggccatggtcggccgcgatctgcttcagcggcaagccggaatcgaaagcctgcagcaactgggtctcctccagctccgaccagggatggccggcatggtctggcggcgcgcgccgcgcccgaccatccatcatttccagcgcccgcgccgccagaaacaaggcccggatcacttcgggctgatcaaacaccgccagcggcggcaagggttggcccccatccggatcgactccattggcgagggcttcgattatgctgcgggcttcggttggcgacatgcgcgggctcccggaaaacgcgatggcgaggcgaatgctggcgaaacaaccgcaaaatcatagcagcgcgaagccacccggccgcctgtcagttcagccactcctcagcgccggcaagcggccaccaccgcctggctcaccgcgccgctgtccacgtcttccagccaagccgccacgccgctgaactccggcctctggcccgcggcgaacgccaaatgcctgctgagcgcggcatggccgccgccatccagcgcgaacggcccccacaggccgcgcaccactgcatcatgccgcagcaggctgccgcggttctcccccgcctccacccagctttgcaggccattctcaaacagtgccagcatcagcctctgccccgttttcaccggcgtttgcgcgcgcagcgtcacatccaccccatccgcgaacgtccggctatccagctgcagcgtcgcgccagacgcgctctgcggcaaggcctgcgccagctcgccatcgccgccgggccgccaatcgcggccgttgagcaagaactgcggcgtgtaaaccaccgcgccgcccgcctgggcggcatgccggcgctgacgctcggaataagcggcgctggcgaagcggtcgcgccagcccaagccgtcccagtaatcgacatgaaaggccagcgccagcgcctgccgcccatcgacaaaggccggcggcagggccgacagccagcgctcggccggcgggcagctgctgcagccttccgaggtatacagctccaacagggaaacctggcgcgcggggccggactcgccatgcgcccggcacggcggcgaagcggccggcgcggcccacgctgcggcggacaggcagcaggcgatgaatatgcggatcatgcggcgctcccggcgacaatacgcttgttagtcgggcggacttgcgcggccttacaggcaaagcggcatccgctccgctcgcggccggcctcctcgccggcgcgcaacgcagcgccggaagcccgccgcatggaatgcgggaaacgcaagcgcggagcttcgccgaaatccgcaggcggcaggatgcaatgccattccatcaagacagcggcagactaatctagataagacaaaatccgcttcatgctttttgaaaagccgcacgcatccacaggccgggaatgaaaaaacaatcggaaccgtcgcttgccgcgagaatagggaacggaaaagaaactaaagaaaatcgcagcgggaaaacaaattggaaaggaaaaaacgacccgcgccattcaaaaattgatgtccacgccagcggctggcggataaacccgacatgacggctcaattgatagcgcccgcatgccgcaaacagcggccagggtcattcggcggcgggtttcggccctcattagctgcgcaaagcccgcaaaccaggaaaatcacccgctttgaagccacagccgccgctattcgccgcctaggcttaccgccggaaatgcgaaacggcttacggaataaaccgtaagccgccgtattatttggtgggccccccgagagtcgaactcggcaccaacggattatgagtccgctgctctaaccaggcatgagctagaggcccagagcgcgccattataacagtaaaaaacaaaaatccccaagcgctttattcaagatgcttggggattccttagccgtcaaatgccgctttactggccgcccggctcgttgtcgaggaagctgcgcaggcgttccgaacgggtcggatgacgcagtttgcgcagcgccttggcttcgatctggcgaatccgctcgcgcgtcacgtcaaactgcttgcccacctcttccagcgtgtggtcggtgttcatatcgatgccgaaacgcatgcgcagaaccttggcctcgcgcggggtcagggtgtccagcacttccttggtggcgtccttcaggctggaatacatcgccgcgtcggacggagccaggttgttctggtcctcgatgaagtcgccaagatgggaatcgtcgtcgtcgccgatcggggtttccatggagatgggctccttggaaatcttcatgatcttgcgaatcttctcttccggcatctccatcttctcggccagctccgccggatccggctcgcggccgctttcctgcaggatttgccgcgagatgcgattcatcttgttgatggtctcgatcatgtgcaccggaatgcggatggtgcgcgcctggtccgcgatggagcgggtgatcgcctggcgaatccaccaggtggcgtaagtcgagaacttgtagccgcggcggtattcgaacttgtccacagccttcatcaagccgatgttgccttcctggatcaggtcgaggaactgcaggccgcggttggtgtacttcttggcgatggaaatcaccagacgcaggttggcctcgatcatttccttcttggcgcggcgcgccttggactcgccggccgacatctggcggttgatttccttcagcgccttgatcgacagcatcgcgcggtcctgcaggtccgacaagcgggtctgcttctcgatgatcgcgtgcttgaagcgggtcagcgcctcgctccaggccttgccggacgagatttcgctctccacccagtcaagattgatctcgttgcccgggaacaccttgatgaagtgggcgcgctccatgcgcacgcggctgacgcagatgtcctggatgtcgcgctcgtaagtgcggatctcgttgacgcggccgcgcagcgactcgcagaggctttccacctggcgggtggcgaagcgcaccagcatgaactcggtggtgatcgcgtcctgcagctccaggtattccttgctctgatggcccttgctgttcagcaccttgaccatcttgtcgaacagcaggcgcacgccggcgaagtgctccagcgcttcttgcttcagctcttccagattggcggcggcgtcggcgtcggcgtcgacttcctcggcgtcctcctcctcgtcctcgtcctcttccagcagctcgtcttcggcttccggctcggcgtaggcggcttcgtcgccgctgggcgcgttgaggtcgatgaagccatccaccacctcgtcgacgcggatttcatcgcgcgccacgcgttccatcagctccagcacctcggcgatggtgccggggcaggcggagatggcctggatcatgtacttgaggccgtcttcgatccgcttggcgatttcgatttcgccttcgcgggtcaacagctcgaccgaacccatttcgcgcatatacatgcgcaccgggtcggtggtgcggccgaattcggaatccaccgacgacagcgccgcctcggcttcttccaccgcgtcctcgtcggcgaccgccggcgtggcgtcggacatcagcagggtttcggcgtcaggcgcttcttcgcatacctggatgcccagaccggaaatcatcgtcacgatgttttcgatctgctccgcgtcggatacgtcttccggcaggtggtcgttgatttcggcgtaggtcagatacccacgctccttgcccagggcgatcagctggcgcaagcgtttccgctgctcttccaggctcatcacctcctgttggctgtcctgcacatctttctggttttcgggagaggccgccatttcgcttcctgcttgaaaaaaagccgaaaaaaacagttgattataacacaactacctgggtttttccgccgaacctgttagttcggcgacgagaacatttcccgcaacaactggccgagcagggctttctcctcggaggtcagcccttcgtgccggtccttctgttttagccgctccagctgggccgcatgcagcattttcagcagcctggcgttgccgtcctggaactgctgccggtcgtccgcgccggggtcggcgaactcgtccgggtcctgcatcgcctgctgcagcacgctgtcgatcaagccctcgtagggcgtgccgcgcaagccttccaccagctgcgcggtattgggctcttcgccgtgctcctgcacgcgctcggccagcatcgcgaagcaggccagctcgtccgacagcgccaggctgtccggcagccgcacgtccggcgcccagccggggttcatcaacagccacttgatcagcttcctgaccattgaggtattcatcacccgctgcgactcggccggcagcttgtaatctcgcctgccgctcttgccgcttgcctgccgcggcttgccgccggtcagcatgtcgaactcgtcgacctccacgccggccagttcggccaggcgcttcttgatgatgaagcccagcgccggcgcgctgatctgcgccagcagcggcgccgcccgccgtatcaggtcggccttgccttccggcgtgctgagattgacctccttgcacagctcgcgggtgaaatacaccgacaagggcaggctttgctgctccaacacttcctcaaacgcatcggtgccgaattcgcgcacatagctgtctggatcgtgctcggccggcaggaacaggaagctcagcgccttgccgtccaccagctgcggcaggctgttctccagcgcgcgccaggccgccttctgcccggccttgtcgccatcgaagcagaagtacacctggtcggcgtgcttgagcagcttgcgcacatgctcgccggtggtggcggtgcccagcgtggccaccgcgtagccgacgccgtactgcgccagcgccaccacgtccatatagccttcgaccaccaaaacccggttcttatcccgtatcgcctggcgcgcctcgtacaggccgtacagctcgcggcccttttcgaacagcggcgtttccggcgagttcagatacttcggctcgcccttgcccagcacccgcccgccaaagccgacgatggcgccgcgctgattgcggatcgggaacatcagccggtcgcggaagcggtcgtagcggcggccgctgtcctccgccacgatcaccaagccggcctccaccagtttttcgtcctggtagttggcggtgatcgcctccaggttctgccagccgtccggcgcgtaacccagcccgaaacgggcggcgatctcgccggacaggccgcggcccttgcagtaggccaccgcgttgggcccgcctttcagctcgcggcggtagtagtcgctggccatttgcatcagttgctccagcgacacctgcttctcgcgcgccttgcggctggcctcgggattgaccgcccgctcgtcgggcacctgcatgcctatgccttcggccagcagcttgacggcgtcgacgaagccgacgccctggtactccatcacgaagccgatggcggaaccgtgggcgccgcaaccgaagcagtgataaaactgcttgctgggacttaccgtaaatgagggcgatttttccttgtggaaggggcagcaggccatatagttctgcccgcccttcttcaaggggacgtagcggtccaccacgtcgacgatgtcgacgcgggacagcagttgatcgatgaagtcctgcggaatcaagacagcgcggcccggctacgctcaggcgctgagcgcggccttgatccaaccggacacctgcgccatgtcggcgcggccggccaattgagggcgcagcgcgcccatcaccttgcccatgtcctgcatgccggcggcgccggtgtcggccacggccttggcgatcagcgcctcgatctcggcctggctcagctgctgaggcatgtacaccatcaacacatccatctcggcctgctccttggccaccaggtccaggcgctgcgcgctctggtattgggcgatggagtcacgacgctgcttgagcatcttgtcgatgacggcggtgatgccggcgtcgtccagctcgatgcgctcgtccacttccttttgcttgacggcggccagcagcaggcggatcgcgcccagcttgtcggcttccttcgccttcatggcggacttcatgtcgtcggtgattcgaactttgaggctcatggtcgtgctcgcttgggattcaggcgctgcggcggcagcgaggaaaaggcgggagtacaaatggcaaaaccgcaggcatggcctgcggtcctgcttggtgccgggaaaactcttagtagagtttcggcggcagcatttggctgcggatgcgcttgtagtggcgcttaaccgcggcggcgtgcttgcgcttgcgctcggtggtcggcttctcgtagaactcgcgggcgcgcagttcggtcagcagaccagtcttttccacagcgcgcttgaagcgacgcagagcaacttcaaacggttcgttctctttaacgcgaatattcggcatttacttaagggtccttagatttctttagggcgcggccagggccgctgcctgtaaaaacagcattttagcaatgttactgcatttgtaaaagtctgaaacgacaacgtcaggtcatcttgtggtgttttgcgcgttcgggcgcggccagcctgggccatgaacatcacgacttgacggaagaaatcaccccctcactaggagaacttggcgttgcactataaaaacgtttcggcatccggccggcctgataggcggcgcggccagcttccacggccagtttcattgcgcgcgccatcaacaccggattgcgggcgccggcaatcgcggtattcatcagcacgccgtcgcagcccagctccatcgcgatcgccgcgtcggaagcggtgccgacgcctgcgtccacgataacggggaccttggactgctcgataatcagttgcaggttccacggattcaggatgcccatgccggagccgatcaggctggccagcggcatgatcgcgcagcagcctatctgctccagctcgcgcgcgatgatgggatcgtccgaggtataaaccagaacatcgaagccctccgccaccagcacctcggcggccttgagggtttccttcacattggggtacagattgttgggatcgcccaacacttccagcttgacgaaacggtggtcgtcgagcaattcccgcgccagccgcaaggtgcggatggcatcctcggcggaatagcagcccgccgtgttgggtagcaggttataccggcttttcggcaaaaagtccaacaaattcggctcgttagcgttttgccccaggttcacccggcggatcgccgcggtgacgatctcggtgccggacgcgtccagcgccgccgcggtctgctcgaaatccttgtatttgccggtccccaccagcaagcgagaaccgaactccctgccggctatcaccagtttatcgtccacctgcgttccttttcttccgttgacgtcgacatggcgcgggcggatggtctcagccgccgccgaccgccaccacgatctccagcacatccccgtccgccagcagctccgccgcatgctggctgcgcgggacgatctcgccgttgcgctcgatggcgatgcgcttgccgcccagctgcagcgcgtcgaccagctcggcgaaggtggcgatgccggcgaaactgcggtcttcgccgttgatgcgcaaattcaattgactcatcttctctccacgcgttgcaccaccgccagctggcggacggcgttcagcacgcgctccaggtgctcgacgccttccacctgcaggcggaagtggatgttgaacaggccgtcgccgtcgcggctgctgtcctgggtgtcggcgctttcgatattggccgacgcctgcgagatggcggtggcgatgtcggccagcgcgccgcgctcgttgcgcgacagcacgccgacagtgacgccgaacatccggtcgcgctgcgcctcccagttcacttccagcaatttgtcgtggtcggcgcggcgggcgttcgggcaatcgacgcggtgtatcaccaggccctggcccttggtgatgacgcccagtatctcgtcgcccggcagcgggttgcagcacggcgacagctgcaccatgccggcctcgttgccgcggatggtgatcgggccgacgcgcacgccctcgcccaggcgctcgccggccagctccagcatccggcgcgccaccacgatgggcagcagcttgccggtgccgatctcggccagcacgtcgtcgaaactgctcattttctcgccgtaggcggcgaaatactcgacccgcaggtcgtcgctgaccgccagcggcgtggtggccagcgcgcccaccgcctggcgcagcagcttctcgcccagcgccaccgcctcttcgcgctgcaggctcttcaggtagttgcggatgccggagcgggcgcggccgctttgcacgaaggccagccacgacggattgggcttggcctgggtggaggtgatgatctcgacggtgtcgccgttgcgcagcacggtgcgcagcggcaccagcgcgtggttgacgcgcgccgcgatgcagcggtggccgacatcggtgtgcaccgcgtaggcgaaatccaccggggtggcgccttgcggcatcaccatgatcttgcccttgggggtgaacacatagacctcgtccgggaacaggtcgatcttgatgtgctcgaggaattcgacggcgtcgtcgctctcctcctgcatgtccagcagcttctgcagccactggtgggtgcgctgctgcgcggtgttgacgccgccgccgctcttgtacatccagtgcgaggcgacgccggcctcggccacgctgtgcatctcgcgggtgcggatctgcatctccaccggcgtgccgtaggggccgaacagcgtggtgtgcaggctctggtagccattgcccttggggatggcgatgtaatccttgaacttgccgggaatcggcttgtacaggctgtgcaaggcgcccagcgccaggtagcaggccgggatgtcgttgaccaccacgcggaagccgtagatgtccagcacctcggagaaggacaggtgcttctcctgcattttcttgtagatgctgtagaggttcttctcgcggcccttgatggtggcttcgatattgctttgcaccagccgctggctgaccgcctgcaggatcttgttcaccacttcgcggcggttgccgcgcgcggcgcgcaccgccttcgacaatacgccgtagcggtgcgggtgcagatgtttgaacgccaggtcctgcagttcgcggtagaccttgttcaggccgatgcggttggcgatcggcgcgtagatttccagcgtttccagcgcgatgcggcggcgcttgtcctcgcgcatcgagtccagcgtgcgcatattgtgcagccggtcggccagcttgacgatgatcacgcggatatcgcgcgccatcgccagcaccatcttgcggaagctttccgcctgcgcggcttccttggtctggtattccagccgctccagcttggagaggccgtcgaccagatcggcgacgatcttgccgaatttctcgatcaacgtcggcttggtgacgccggtgtcctccagcacgtcatgcagcaaggcggccgccaggccctgcacgtccagccgccactcggccagcatcgtggccaccgccagcggatgggtgatgtagggctcgccgctcttgcgggtctggccttcgtgcgcctcgcggctgaccgcgaaggccagcttgagcagctcgatgtcttccggcttgaggtaacgcccggcattctcgaagaatgccgccgcgtcggaatcgatcagggcgttgtaatcaatgcctgtctctatgccggtgcccatcgtccgctccgtcagctatcaggccttgccgcggttgaggatttccttgccgacgtggccggcggcgatctcgcgcagggcgaccacggtcggcttgtggcggcccggctcgacaaaggcgctggcgccggaagccacctggcgcgcgcggtaggcggcggccagagtcaggtcaaagcggttctggatgcggtccaggcagtcgtcaacagtaatgcgggccatggtttctctcggatggattaaaggttgcagggttcactatatcgaattttcgcctttgcaatacagcgtcggcggactatttttactgcgcgccggcggtgcccatgcggcggaacatctcggccaggcgacggcactgcggcccgctcttcaggcgctgcgcgcggacgatgctgatcaggtcctggcgggcgcgctcgaagtcgtcgttgaccacgatgtagtcgtactcggcgatcttgtcgatctcggcgcgggcagaggccagccggcgcaggatcacttcctcggcgtcggtgtcgcggccgcgcaggcggcgctccagctcctcgatcgagggcggcgcgatgaagatgccgatggcgtcgggaaacaccgcgcgcacctgttcggcgccctgccagtcgatttccagcaggatgtcctggccggcctccaggcggccgcggatccacggcgcgctggtgccgtagcagttgccgtacacctcggcgtgctcgaggaaatcgccgcgctccaccatggcgtcgaacaccgagcgctcgacgaagtggtaatgcttgccgtcgatctcgcccttgcgcgccgcgcgggtgctgtaggacaccgacagctcgacgctgggctcggcctgcagcaaggcggccaccagcgaagtcttgccggcgccggacggcgcgaccacgatgtaaatgttcccgataagctggctcataaatacaaacgtttgccggagagtaatttttcaggatagcacagcggcccggcaattgttaagcaaagacatattttcacgtcaagatttaggcgtttgaacgcttgctggccgataatgccgccgttttcatacccctgtaactcgcccggagtaccgcttcatgcaactgctggaaagcttgttcaagctcaaggaacacggcaccacggtgaagaccgaagtcatcgctggcttcaccaccttcctgaccatggcctacatcatcctggtcaacccgctgatcctgtcgagcaccggcatggacctcaacgcggtattcgtcgccacctgcctcgccgccgcgctcggcaccgccatcatgggcctggtggccaactacccgatcgcgctggcgccgggcatgggcctgaacgcctacttcaccttcagcgtggtcaagggcatgggcctgtcgtgggaaaccgcgctgggcgcggtgttcatctccggcctggtcttcctggcggtcagcctgttcaaggtgcgcgaggccatcgtcaacgccatcccgcaatcgctgaagttcgccatctcggccggcgtcggcatgttcctcgccatcatcgcgctgaagaacgccggcgtgatcgccgcccatccggccacctatctgacgctgggcaacatccacagcccgaccacgctgctggccatcctgggcttcttcctgatcgtggcgctggaataccgcaaggtgccgggctccatcatcatcggcatcctggtggtgaccgtgctgtcgatcgcgctcggcctgtcgccgttcaagggcatcgtcgccccggtgcccagcatggcgcccaccttcatggcgatggacatcaagggcgcgctcaacgccggcctgatcggcgtgatcttcgtgttcttcttcgtcgacctgttcgacaccaccggcaccctggtcggcgtgtcgcaccgcgccggccttttggacaaggacggcaagctgccgcgcctgaagcgcgcgctgatggccgactccatcgccatcaccgccggcgccgtgatgggcacctcgtccaccaccgcctacatcgaatccgccgccggcaccgcggtgggcggccgcaccggcctcaccgccatggtggtggcgctgctgttcctggccgcgctgtggctgtcgccgctggccgccaccgtgcccgcctacgccaccgcgccggcgctgtgctacgtcgccgtgctgatggcgcgcggcctcgccgaaatcgaatggaacgacctgaccgaatccgcgccggcggtgatgaccgcgctggcgatgccgttcaccttctccatcgccgacggcatcgccttcggcttcatcagctacgcggtgatcaagatcctggccggccgcttcgccgacctgaagccggcggtgctggtgatcgccgcgctgtgggtgttcaagctggctttcttcgcctaaaagcacaataatcggcttgcaaatctggcctgccgcctttgcggcaggcctttttgctgagcgccgcccgtcggcaaaccacgcagtctcttgatttcgaagtacaatagcgccatggaaaacctcagcaatctcgactactccagctacctgaagggctggatccgcaccgtgcccaactggccgcaacaaggcgtgatgttccgcgacatcaccccgctgctgcaaaacccgaaaaccttccgcatgctgatcgacatctacgtccatcgctacatgaccgagaaggtggacctggtggccggcctggacgcgcgcggcttcatcatcggctcggtgctggcctacgagctgaacgtcggcttcgtgccgatccgcaagaagggcaagctgccgttcaccacggtggaagaggaatacgaactggaatacggcaacgccgcggtggaaatccacaccgacgcctgcaagcccggcgaccgcgtggtcctgatcgatgacctggtggccaccggcggcaccatgctggccggctacaagctgctcaagcgcatgggcgccgacgtgctggaagccgcggccatcatcgaattgccggaactgggcggcggccagctggtgcgcgacggcggcctggacctgttcaccgtctgcagctacaagggccactgagcccgcgcacgcgaaccaggagcctccgggctccttttttgcgcgcgcaaaaaagcccggcgcaaggccgggcaagggacacggagtcataccgttgctcaattctgttccagcgacaccttcaccgcctggcccttgacccgcagcttcagcggcgcgccgggagtattggcccagtcgccgctgaccttgctggcctgcccgctgacctggtagtccagcttggcggccttgctgccggtgaattccagcttcaccatctggccgttgacatccacgctggctgccggctgcgcgccctgcagcgcgatgtccgccttgatcgcctggccatccagcgccaccgcgcggctggcgccgtcgaagtccagattcaccgcgttgcccttcagccgcagttcgccgacctggcccttgacgtcgctcttgaccgcctcgccggacaacctcaccgcgccgtattcgccgttcaaatcgacatgcagcgcctggccccgcatctgcacctggtcgaagcggccggacacgtcgccgtccaccgccttcaagtcgacatccagcttcttgcccggcttgacgttgccgcgtatcaccagccggcagcgctccgccgccaccgcgcccaggtcgatccggaaggtcaggtcgccgccctggcgggtggccgccaccttgcagtcggcgtcggaccaattgcgcttctccaggctcaatttatacggtttggcggcgtcggcggtcagctccagccgggcggcgtcgccgcggaaaatcagccggtcgatgttgccggcctcctcggcccgggccgcgccgctgccgatcagcagcaggcaggcggcggtcttggcgatatccatcatgcgtctcctcgtcatggttcagtgcaggtacagccagtagctggcgacattgaccgccaccgcggcggcggcggccagcgcgtggatcgccagctggccgcggctgtggcgcaggatgcggcggcgggcgaaggcggcggcggccagctgccgggtttcggtcaggatcgccagcaggcggttttcgctgccgcggtcggataccgcgtcgcggatgtagcaacggtagtcgttgagaatcttgcgcagctcggcttccggcaacccgaccagggtcagttgcaattgctgcaggcaggcatcgtttttcatgatcaacactcccaatggatggcgaagctctggttcaagccgcggcgttttcgcggtccttgccggaaaccaactcgatttgatacttcacataggacaccagcacgcgccaagtcagccgggtcagccacacgcagaacaccagtcccagcgcgccggccagcagcaggcccagtccgacgatggccgcgctcatccccaccgacatccccggcagcgcgtccagatggacaaagctgatgccgtccttcaccgtgatcttcttctcgctgatctccagcacgctgttgccgtctttcagcaccgtcaatccatgcgggccgctggcctcgatcttcacctcctggccgccggccgacgcctgcagactggtcagccggccgttgtcgtcgacccggaacgcggcctggtcgccgccgctgccgctgtaggccagcgccgccaccgcatggctgttgatgctgacttcgtcgtcgtccgtctgctgcagcagcaggcgcgccggctggctggcgtccaccttcaggctgtcgccgttgcggctcactacgatgggatcgccctggcgggtagtcagccggatcgtgctgccggagtccggctccagcaccaggcggccatgctcgatgcggaactcgcccgaggccgagccgtcgtccgccttgacgtccaccaagcccggcgcgccgcgatggccgatatccaggctgtcgacgctgaactccggccagccgaacaagctatggctgccccagcccagcaccaccgccaggccggccaccaggaagctgaccgacaccacgtagccgatggtcaggaacatcaggtagaccatgaaggggatggcgaggaagaaattcagcacgcccagcccggcgatcgacgccaccacccgcgacagattgccgaaggagcggtgctgctcccattgccggtagtggttctgcgccttcagttcgcgcgccagcttctgcgggctgcccagcgccgccaccacgtcggcctcgtcgcggccgtcggccagcgcgtcgttgaaatactcttcgtaatcggagaggatttcgcgcaccatttccggcctctgcccggacagcgccctctccagctgctgtaaaaagtccttgcgagtcattgcgatgtcccttcagtcgaggccgccggttcgtcccgcagcacgttttccacttccgtcacaaactcctgccattcctggcgcatcaccgccaactcccgccgcccgatatccgtcagcttgtaatacttgcgcgacgggcccgacgacgactccaccaggtaggtgctgacccaggactcgttctgcagcctgcgcatcagcgggtaaatggtgccttcgctgatctccattccctgcgacagcttgctgaccagttcgtaggcgtagctgtccgcctgcgacagcaccgccagcacgcacatgtccagcgtgcccttcttcaattgcgttttcatctttaaccttcctagccgactggcaatacacgataccttgcattacaaggaaccaaggtggactgctgcatccgcatctgtgactgaactgtatgacaagataccttgcatcgcaaggtatctttcattgcagaatggcatgccgatggcaatgacgtttttccgccacaacattgtcatccctgctgcattgcaaaaaccggatcagcaaccatacttcagccatgcttttgtcttcgccaacgacatgaaacgggagaaacgcgtaatggctgaatccgcaaaaccctccatcgccctggtgttgggcggcggcgcccccaacgccacgctgatggccggcgcgctggtggcgctcaccgaagccggcgtcagcttcgacatcatctccgcctccggcgccggcgccatcgtcggcctgctctacgccgcgccgcggcagggcgatgccatctcggcgctgagcaagctggccgatctgggcgtgtccgatcccatctacaatctatttccggtcaactacaaggtgttcaacaagccgggcagcctggccgacgcctggcgccggctgcaatcgagcaatccgctgctgcaggccatccagagccaggccgaccaggggccggcgcaaaggctgctggccgattggacctcgctgctgctggccagcttctgccccagcagcctggccagcgacagccagggcctgtgcgcgcacgtgcccttcatcgagcaggtggtggacttcgccaagctcaaggacatccgtcccgagttctacctgaacgcctacaacatcagccacggcgccatgcgttgctgggacaagcgcgaggtcacccacgagcacttcctggccgcgctgtccttccccttcatctatccgccgtacccgctggaggacggctattacatcgaaggcgccgccatcgacaccctcaacttcaagcgcctgttcgaactgcatccacacatcgactacaccgtggtgttcgacgtgctgggcagcgaccggctgctgcacccgccgcgcaatctgtacgacgcctgggttcagtccatcatcgccccgctcaccgccatcgcccgcgacgacctcaggctgttcgaggcgctgcacaaccgcgacgagcagggccagccgcgcaccgaggtgctgagaatcaatttcgacgcccacatcggcaaggaaagcgcgcgcgaagagctggactggtcgtactccaacctggccaggctgtaccaggccggctaccaggccggcaaggacgcctgccggcagcatgcgcggcaattgggcatccaggcctgagctgcgtagttgcaactattcaatccggcgaggcggccggttactctgaagctggcgcgcgcgaccgctgcgcggatttccaggaggcagaccatggcactacccaccgcagtcaacagccagatcaccgacgccgtcacccaggccaatgtcaaggtggtgggcgatgcccccgccatggcgatgggcgacctctaccagtccctcgcccactccgccggcatcctgtacgaaaacgccgcctcgtcgcagcaacagctcgccatcgcgggccaggccgccagcaaccagggcgtgatccagatttacagcgtggacgccggcgagccggcgctcgggccgatggacgcggccgagctggaggcgctgatccaccagctcaaatccgaatagcgccggcgcgccgcatagaaaaagggctgccggatggcagcccttttctctcgtcaaaccgtttcgcttcgagccagcttagtaccagtctatgccggcctttgcggtggaaatcaccgtgccggcctcgcccttgacgatcttttcgatgtcttccagcgcgccgatcaccgccttcttgccggtcaggcgggcgaactcgcaggcggcctccaccttggggcccatcgagccggcggcgaagcccagcttgtccatctcgtccggatgcgcatggcggatggccttggcttccggcgtgccccagccgacgaacacgcttttcacgtcggtggcgatcacgaaataatcggcgtccacttcgcgcgccaacagcgccgaagccagatccttgtctatcaccgcctccacgccgaccagcttgtcgccctggtacatggtggggatgccgccgccgccggccgcgatcaccaccacgcccttctcgatcagccacttgatcggccgcatctcgaaaatgcgcttcggtttcgggctgggcaccacgcggcggaagtactctccatcggccttcaccgcccagcccttctccgccgccagcttctcggcttcgtccttggaatacaccgggccgacgaacttggtcgggttcttgaacgccggatctttggcgtccacttcggtctgggtcaggatggtggcgatcggcacttcgaacggcagcacattgcccagttcctgctccaccatgtagccgatcatgccctcggtctgcgcgcccagcacgtccagcggatatggcgtcaccttgccgtccacgtggcgcgcgtaggcgtcgttctgcaggcccaacaggcccacttgcggcccgttgccgtggcacatcaccaggttgtggcccagccgggtgacggcggccagctgctcggcggccactttgacgttggcgcgctggttatcggcggtcatggcttcgccacgacgctgcagggcattgccgcccaaggctacgacgactcgcatattctgttcctcggtcttgccgggcccgccgcgcgtggcggcgagccgcgttctgaatgtgaaaccggccagggctcccggtcagggaagccttggccggcgaagttgctgcggatggctagcgctggatcattcgcccagcgtggccaccaggatggccttgatggtatgcatgcggttttccgcctgctcgaaagcgatgcaggcctcggactcgaacacgtcctcggtcacctcgatgccattggccagctccggatactgcgcggcgatttccttgcccaccttggtttcgctgttgtggtaggccggcaggcagtgcatgaatttcacctgcgggttttccgcggcggccatcagcgcgctgttgacctggtacggcttcagcaggcggatgcgctcggcccacacttcggccggctcgcccatcgacacccagacgtcggtgtggatgaaatcggtgcccttgaccgcggccttggcatcttcggtcagcgtgatgcgggcgccggtcttggcagcgatttcgcggcattccgccaccagctcgtcggtcggccacaggtgcttgggcgcgccgatgcgcacgtccatgcccagcttggcgccgatcaccagcagcgagttgcccatattgttgcgggcgtcgccaagataggtgtagcggatctgcgagatcggcttgtcgctgttttcccacatggtcagcacgtcggccagcatctgggtcggatgccattcgtcggtcaggccgttgtacaccggcacgccggcgaacttggccagctcgttttccaccatgtcctggtcgaaaccgcggtattcgatggcgtcgtacatccggcccaatacgcgggcggtgtccttcatcgactccttgatgccgatctgcgagccggacggcccgaggtaggtgacgttggcgccctggtcaaagcaggccacctcgaaggcgcagcgggtgcgggtggaggtcttttcgaagatcagggcgacgttcttgcccttcaggtgctgctgttcggtgccggaatacttggcgcgcttcagatcgcgggccagatccagcatgtagcggatctcgcgcggggtgaagtccagcatgcgaaggaagttacggttgcgcagattgaaagccatgatgttgctcctgattagagtctgggcaagccggccgtcgctcccggaggagccggcggtcaacctgtcgtattgcaaacaaactagatgcggatttctttttccggccggacgcgccggccgggacaacagccttacagcttcacttcgtcgcggatgatcgggcaggtcatgcagtggccgccgccgcggccgcggcccagttcggaagccggaatctcgatcacctccacgccgtgctcgcgcatcaggcggttggtgtaggtgttgcggtcgtaggccaccaccacgcggcggtccagcgccaccacgttgttgccgtcgtcccattgctcgcgttcgcgctggtaggcgtcgccgccggtctggatcacgcggatctccttcagccccagcgcctggcgcaccacttccaccagtttcacgccttcatggcgctcgaagcggatctcgccctcgcggtcgccggcgtacatgctggtgcaggtgatttcatcaaccacgtccgggaacaccgacagcaggtcgatgtcgaggaaactgaacacggtgtccaggtgcatcgccgcgcgcgatttcggcatctggcaggcgatcacgcgcttggcaccgccctcgcggtgcagcacgcgcttggccacttgcaccaccgcctgcgggctggtgcgctcgcccatgccgatcagcacggtgccgttgccgatcggcatcacgtcgccgccttccagcgtggctgggccgtgatcggaatcgcaaccgccccaccagatgttcaccttgccggcgaagtacggatggaactggtagatcgattgcaggatcagcgtttcctggcggcgcgccggccagtacatcgggttcagcgtcacgccttcatagatccagcaagacgggtcgcgctggaacaggctgttggggataggcggaatcacgaattcggactggtcgagatagccgccgaacaggcctttcgggtcgaacggcagctcgaacttggcgatgccgcccaccaggtggtcggccagctgcgacgacggcatctcgttcagccagctgcgcagatcctgcagcatgccgatgccgacgttgtcagccttgaccttgcggtccagcacccagttgcgggcggccttgtcgtccagcaccttggccagcgcgtcgtgcacttcgatcacttcgatgccgcgggcgcgcatctgctccaccatgtaggcgtggtcgcgctgagcgcgctccacccagatcacatcatcgaacagcaggtcgtggcagttgtccggggtcaggcgcttgtgggcgaggccgggacggcacaccatcacggttcgcagcttgccgcactcggaatgaacaccaaacttggtcataacgatactccttgagtcttgtttgacttcaggggcgggcgatccgcccccacgactggtttcgaaatctttcgcttacaggccgatcttgccgacggccagcatgtaggccgcgatcaccgccagcaccaccacgatggcggccagcgcggcttcgatcaggttgaacggcttctggccctgctccttcttggcccacaggtagaacagcaggccaggggcgtacagcaccatcgacaggaacaggtatttcggaccggcggcgtagatcagccagccgccgtagacggtggccaggatggcggtgcccagctccttgccgcggccctcgccttgggcatagccttcgccgcgttgcgccaccagccaggagtagccggcgcacagcaggtagggaatcagaatcatcgaggtggccagcgacagcagtgccaggtagccggccgaactgaacagcgtgatgatcaggaacagctggattaggccgttggtcagccacagcgaggcggccggcgtgtcgttgccgttgacggtgccgaacaccttgggcatcacgccgtccttgccggcgaggtagggcgcttcggcggccagcagcgtccaggccagcagcgcgccgccgacggagatcaccaggcccgcgttcatcaggttggcgccgaaggtgccgaaggccttctgcagcacgtaggcggtggacgggttcttcagcgcggccagctcaggctgggtcatcacgcccagcgacagcaccgacacggcgaccaacagcgcgatggtcagcaggaagccgatcacggtggccttgcccacatccttcatgctttcggcgcggccggagaacatcgaagcgccctcgatgccgatgaacacccacaccgtcaccagcatggtgctcttcacctggtcgacgatggagccgagcttggcgttgccccagaagtccaggctgaaggtatcgaccttgaaggcgaacacgatcaacagaatgaacagggccaagggcaccagcttggcgatggtggtgatggtgttgatgaaggctgcgccatgcacgccgcgcagcaccaggaagtgcaggcaccacagcagcaccgaagcgcaggcgatggcggtgggcgtattgccatcgccgaaagccggaatccagaaggccagcgccgagaacatcaccacgaagtaggacacattgcctatccaggcggaaatccagtagccccaggccgagttgaaacccatgtagtcgccgaagccggccttggcgtaaccatatacgccgcccgacacctcaggcttgcgcgaggccagcatctggaacacgaaggccagcgccagcatgccgacgaaggtgatggcccagcctatcaagatggcgccggcgccggcgccggccgccatgttctgcggcagggagaagatgcccccgcctatcatcgagccaacgaccagcgccgtcagcgcgcccagcttcagcctgggtgcggcgccttccgccacaccggcttggcttgcagtttctgtggacattttcgttctccgatctgagatgtgaaaccgagcattccgtactgttttattattaaattcttatcatctgaaataatggtatacccgttaaaatcaggctttccaggcatgtcgtgtattcagttgacctacatcaagcgggctttcccgcgccgccctcgacctcatgcagatgcgaccaggccttacgacaaggcgtcacggcaacttgccgaaaggggatgccggcgctggcgccgcggccagattcagcatagccggaggggggtgaaacggaagccggcatcgccaacgccatgaccttggacaaaaactacagaatttcaggctgtattgaagtgaggaacagcggaacaggcgcggcctgtcaggacaaatgcgatcggcgcggcggccaaatcatgcgtccgccatgcttagacagactcccgggcggcgcggaaagttcagcctgcgggcgcagcctggcggcggataaaaaaaacggatacggcccaccaccgtatccgccaacacacacatcaagaggaaatgccaaactgcagggataaaaccttacttgccgggcttgttgatgttcttgaagatcatccacagcgcgcccagcaccaccagcatcgtcactacgatagtcagcaggctcaaacggcccacgtcgtcagacatcaacagggtcagcaattccatgattactcctcccggcccgcggcctcagctccttgctgacgacatattacccactcagccatgtcggaaattgacccacatcaaatgccagaacccagccatttgatgcagagcaaataaaaaagccctcggcggcggccgagggctttctgtatgtaaatcagtgttttatctgtctacttgccgccattcatgtccttggacaggaagaaggcgtcggagaagaactcgtcttccggcaaaccgcgctcgcgggtgaagctgccatgcgccgcctccaccatcaccggcgcgccgcaggcgtaaacctggtggccggacaggtcggcgaagtcttccagcaccgcctggtgcacgaagccggtgcggccgctccagttgtcttccggcagcgcctcggacaataccgggatgtagcggatgtgcgggtgcgccgcctgccagctctcggccagatcggccatgtagaggtcggccttgctgcgcgcgccccagtagaacagcatcggacgctggatgccgtgatggatcgcatgctcgatgatgcccttcaccggcgcgaagccggtgccgctggcgatgaagacgatgggtttgtccgactcctcgcgcaggaagaacgatcccagcgggcccttgaagcgcatgatctcgcgctccttcatctggctgaacacgtagtcggagaacgagccgccgggctggtggcggatatgcagctcaaggaaggcgtcgtcgtgcggcgcgttggcgatggagaagctgcgcttcttgccgtccttcatcaggatgtcgatgtattggccggcgcggaactgcaggcgctccgacaccggcagcttcagcttcagcaccgccacgtcgtggatcttgtccatcttctccacgcggcacggcagcgtcttgatctggatgtcgccggcgccggtcacttcgcgcacctcgatgctgacatcgccctgcggccgcgcgcaacagaacaaggccatgccctgggcgcgttcgccggccgacagcgccttctcctggaagccgtcctggctcacttcgccttccaccaccttgcctttgcaggcgccgcaggcgccgtctcgacaaccgtacggcaggcccacgccctggcgcagcgcggcttctagaatggtttcgtgcgcttccacaccgaatgcatgcccgctggggagcaccttcacctggcaagtcatatcgtatctcaatcccgaattctggctaaaatgcacaccatgcgtactttgctgattatcggcgccggcgatgtggcccgccgcgccctgccctctttgctcgcccattggcgggtgctggcgctatgccgccaccccgccgccgccgaatcctggcgggcgctcggtgcccggcccatcctcggcgacctcgaccgcggcgacagcctggcgcggctggccggcatcgccgacgccgtgctgctgtgcgcgccgccgccgccatccggcgcggaagacccgcgaatgcgcaagttattgtacgcgctggcaaaaggcgacagcataccacagcgatttgtctatatcagcaccagcggcgtttacggcaacgccaacggcatgctgataaatgaaactgcggcgctgctgccacaaagcgagcgcgcccggcgccgcgtcgacgccgagcggcaattgcgccgctttgttggccgccacggcggcgcgctgacgatattgcgcgcgcccggcatctacgccgacgacaggctgccgctggcgcgcttcgccaacgcttcgccgctgatcgtcgacgcggaggacagctacagcaaccacatccacgccgacgacctggccagcctgtgcgccgccgcactgcgccgccgccagggcatccgcgtctacaacgcctgcgacgacctgccgctgccggtcagccgctggtaccgccagttgggcgctacgctccagctgcccagcctgcccgagctgccgcgcgccgaagtccaggcgcgggtgacgccgcagcaatggtcgttcctcgccgaatcgcgccggctggacaatctgcgcatcaaacgggaattgggcgtgcggctgcgctggcccagcgtgctcgactatctggcggcgctggcccaggatgagccgcgcaaggcggcaatactcgcaagccaggccaagattcggtaacatcgcggtttttttgagttttcagcaggccagcaaaatggaaaatccggctttcaatcgcgcgatccgcagctttgtgctgcgccagggccacctgtccgcaggccagcaacgggctatggacgaaggcatgcccaagtggggcatagcctaccatccggagacgatcgatctggaacaggccttcggccgcgccgcgcccaaaatcctggagatcggcttcggcatgggcggcgccaccgccgaaatcgccgccgccaacccgggcaacgactatctgggcattgaagtgcatggccccggcgtaggcaatctgtgcaaattgatcgcagagaaggaattgaccaacctgcggctgatgcgccacgacgcggtggaagtgctggacaatatgctggccgacggctgcctggacggcgtgcacatcttctttcccgacccttggcacaaaaagcgccacaacaagcgccggctgatccaggcgccgctggtggaaaagctgctgcgcaagctgaagccgggcggctatatccatgccgccaccgactgggaagactacgcgatccagattctggaagtgatgaacagcgtcgatggcctggaaaacagcgccgacggctacgcgccgcggccggactaccgtccgctgaccaagttcgaagcccgcggcatcaagcttggccacggcgtgtgggatgtgatcttccgccgcaaataagcctcgcccatcgctcgcggcccgccttggcgggccgttttcatatcgatcacctcgccagcaaagccttgatgtcgtctaccagctcatgcggctccaccgccggttcgtaacgcttcaccacccggccgcgcgcgtcgatcaggaatttggtgaagttccacttcaccggatgcgggtggtcggagtccgcctgggttagccagcgccacagcggatcggcgccggcgccgttgacttccagcttcgccatcagcggaaaactgacgccgaagcggctctggcaaaaagccaggatctcgtcggcgccgcccggctcctggccgccgaattggttgcagggaaagccgagcaccgagaatccctggccggcgaagaaatcctgcagctcctgcaagccggcgtactggcgggtgtagccgcattcgctggcggtattgaccaccagcagcacttggccgcgatacgccgacaagtcgcagacggtgccgtccgcggcccgcgtggtgaaatcgtagaacgtggccatcgcaacctccatcccgtataatgccgcagcccggaacggcaaccgcctgcggcccgacaccccaggcccgggcaggcggaagccccgccgcgccccagtcagtcacccccgaggttcatatccatgctgttcaatcccagccgccaggacgcccgccgctttttcttcgatacctggagcaagtccaaatccggccaggctttgtccgatctggaacaaatcgtcctatccattcttatagaccaccctgagtatcatcccatcctggaaaacccggaggccttcctggaacaggagtggacgccggacatgggcgagaccaatcccttcctgcacctgggcctgcacgtcgccatcgccgagcagcgctcgatagaccagcccttcggcatccgcgcgctgtacgcgcagctggcgttgcgccacggcgacgagcaccgcgcccagcacgaaatcatggaatgcctgggcgagatgatctggcacgcccaacgctacggcggcggccccgacgtcaaccgctacatttcctgcgtgcgcggcaaactggacatgggcgaagaagaacagccgcgggtcaaccccaacgatgtccctgactaagcctggcgcggccgacaaaaaaacaccgtggaggaggaccggccacggtgcaacaagcggggcaactcaaacagccacggctgttcaagccttcccaacatagtcagaaaatcaagcgatatcaaaatctttttaaataaaatcaataaaatagacactgtcatctcgaataaaagccggctatcccatcagaaatagccagcttttatcaattctgatttttcctgcttaaatattctcttacacaatccgattgcgcgcctcgccgcggacaaaggcttcgatattctccgccagctgcgccgccagcctgcgcatcgcttcggcgctggcccagcccacatgcggggtgacgatcagattgggcagccgcgctttcaacagcggattgtccggcgccggcggctcgctgctcagcacgtcgaaaccggcgccgcccagctggccgtacttcagcgccgccaccagatccgcctcgtccaccaggccgccgcgcgcggtgttgatcaggatggcgcccggcttcatcgccatcagttccgcctgcgcgatcatgccgcgggtttcgtcggtcagcggacagtgcagcgacaccacgtccgcgcgcgccagcgccgcgtcgaacggcacccgtccttccctggccaggcccgcgcccttgcgctcggcgaacagcacctccatgccgaaagcgcgcgccatcgcggccagttcgccgcctatgccgcccgagccgatgatggccagcaccgcgccgcgcatctcgcgtatcggcgcgccgaaatggcaaaactgcttggcctggctccataccccggccgccacgtcgcgctggtaggccggcaggtttttcatcagcgccagcatcagcgtcagcgcatgctcggccacggtgtggtcgccgtagtggcggatattgcacaccgcgatgccgcgctcgcggcaggcctcgacatccacgtggttgtaaccggtggcggcgatggcgaccagcttcagccccggcagccgcgccagcgcctcgcggtcgagcggcactttgttgctgatcagcacttcggcgccggcggcgtgctccagcagctgctcggcggcggtggccggatattcgcggtaatgggcggggaagctgaaaacgggaaccgggacaggcaggctgtcccggtccagaaatacaatgttgcgagaagtcattgcgcggcggtcatcgctcgaaagtgatcaaatcccgataagcatgccagctggccagcgccagcaccggcatgatgatgatcaggcccaggtaataggtggcgaagcccaccaccgtcatcgccacaatgataacggcccatagccccatcgtcagcacattgcggaacaccgcctgcacgctggctatcatcgcggtgatggtgtccacttccttgtccaacagcagcgggatcgacaccacgctgaccgagaacacgacctgggcgaacaggaagccgacggcgaaataagcgatcaggaattccagattgtccggattgaacgcgtcggcgacgatctcgttgaggttgggcagcgccgcggtgtcgtaaaacagcgcgaacatcagcagcgacacgcggaaccagccgaacaccagcaccgccaacagcaccgcgtacaagctgaaacccggcatgttgacgcgccaggccgccatgctgtgcagcagcttcacccggccgtggccatcaaaggcctccatctgcttggcgatgtcgtagatgccgatggcgaggaaggggccggccagcaggaagatggtggcgaaggtgatcaccagctccggcgcctgctcggcgtaaacgcccagcaagtagcccatcagcacgaacaccgcgccgtagaacaggcagtcggccggcgctttctggaagtcgcggaatcctttcttcaaccacacaaacggctgcgaaaacgctacccggcgcgcgactgggcgcacaggagggacttcatgttgagtgacatccatggcataccccttgcatcgcgtggaaagacagagacatggcgctctgaatttcgttatatgccaccccggggaaaacacaaagacgccgccggactgctacaatccggcgatcaaacccaatcacgcgcaaggaaacgccatgagcgaactgatcatcgaagaactggttgtcggcgaaggcgccgaagcggtagccggccaggaagtcaccgtccactacaccggctggctgaccgacggcaccaaattcgactccagcaaggaccgcatgcagccgttcagcttcccgctggccgccggctacgtgatcaagggctgggaccagggcgtgcaagggatgaaagtcggcggcaagcgcaagctgaccatcccggccgaactgggctacggcgcccgcggcgccggcggcgtgattccgcccaacgccaccctggtgttcgaagtggaactgctgcaggtgggctgatccaactgctcaatgtaaaaatggccttcgcgtgcgaaggccatttttattgcatttggctttatgggaaaacatacatctctccaaactgcaaaagcagcagtaaaaaactatcgtcctaaaaaacacgatagcttagctatacttaacagtcagtagcacaaaggagaagtagatgtatacgcaacaagaactgcacgctgccgccactcgtatgccaaatcttggaagcactaccaaaatgccagatggggagcttgctttccttcatcaattctataacgacctcgaatcgatgctgattgactacccatactcgattcaggtcaagcgtcctatattcaaggatcgaccacccggccaatggacatggcaatctaacacggacgatgacctaactaagccaaggaacgtatccagattgacaaagccttaactcccatcacagatcgcttgccacaatctgccgagtcatctttatgatcagaagaaattacttcttcgcgcaggacacccggcggcgcttcagccagaccccgcccaccaccagcagcagcagcgccaccgcgccgagaatgccggcctggccgcgatggaccatcgtcatcagccattcgcggttggccgcgccgtaataaccgaggtatacccacaccggcaccgaaatcagcgcggcgaagccgtccatcagcaggaaacgccagtaaggcacgcgccgggtcatgccggcagtgatgaagatgggggagcgcaagcccggcaggaagcgggcgacgaacagcacccagttgccgtacttggcgaacttctcctgcaccgcctcgaaacgctcctgggtaaggatgcgggcgatcgggcggaatttcagcaccttgttgccgaaggtgcggccggccatgaacatgatgccgtcgcccaccagcacgccggccatgcccaccaggaacatgtaatgcacattggcataccccaggccggaaatcacgccgccggccaccaaggtaatgtcctctggaatcggcacgccgaaaccgcaaaccagcaacaccgcaaatacagccaggtagccataaccggtgaaaaagtcgagaagtatctgcagtgtatccattattgttccgtctgccggcaatcaagtcatcacgaccaggcggccggcagttcggcaaaagtccaagaacgggggtgtataatagcacacctctagttcacgatttcttgacatgacacgccctatccggctggagatcgacctctccgccatccgccacaatttcctgtttacccgccagcgcgctcaagccaagcgcctgttcgccgtggtcaaggccaatgcctacggccacgggatattggacactgcaaaggcgttggccgacttggccgacggttttgccctgctcaatatcgaagacgccgtcgcgctgcgcgaagccggcatcgatcgccccatcgcgctgctggaaggcccgttcgacgccgccgaagccgccgccatgggcgaatatcggctctgcggcgccgtgcactcactagaacagatggcttggctggccaaaggttccgccgcgcggccggcggaagtctggctgaagatcaacagcggcatgaaccggctgggcttccgccccgagcaagccggcgacgcgctggcccgcttgcgcgccgaacccgccatccgccccgccgccatcatgacccacttcgccaccgcggacgaagcctatggcgtcgacgagcagtggcgcgacttcgcaacgctggcccgcgacagcgccctgccggtcagcgccgccaactccgccgccctgctgcgccatccgcatacccacggcgacatcggccgccccggcatcgtcctgtacggcgcttcgccgtttgaggactccaccggcgcggcgctgggcctgcggccggcgatgacgctgtcggccgacatcatcgccgtgcagcagctgcgcaacggcgacgcggtcggctatggccgccgtttcgtcgcagaccgcgacatgcgcatcggcatcgtcgcctgcggctatgccgacggctatccgcgcatcgccgccaacggcaccccggtggcggtggacggcgcggccagcggcacggtgggccgggtgtcgatggacatgctggcggtggatctcagccatctgccgcaggccggcgtcggcagccgcgtcgagctgtgggggccgcaagcgccgatcgagcgcgtggccgccgccgccggcaccatcagctatgagctgatgtgcgcggtggcggcacgggtgccgcgcagcctgcgcgcttaaggcattccgccagcagcggccccgccagcgccccgcaggcgtgggccgaccacaatatcggcaagccgccggcccccggctgcggccaggcccattgccaggccagccgcaacagcagcagcgccgccagcaagcgccccgtccaaacggcccgcccttgccacgccaatgccgcccaccagccgtacagcacgccggacgcgcccagaaacggccccgcgccgggcagcagcagttgcgcccaggctatcggccacggcagcagcaaggccagccagcacagcattcgcgcctggcccgcgccgcctatcccggccagcagcagcaggccagcgcagttgagcgcggcatgccgccaatcggcatgcacccagctgccgctccaggcgcgccaccactcttcgctcaacgccggatcgaaacgccagcgccgcgccgccgcgcccagcggcaggcatagcggcaacaaggccggcagcaggctggacggcaatctcaccgccgccgtcggacagccagcaggccgcccagtcccagcaaggccagcagcagcggatcggcggccgctacgctgccggcggccccccccggactggccgacgatggcggcaacgatggatcctgccgctgcggcgcgcccgcggcagcctgcaggtcgacatacaagggatcgtggtcggacgagcggtaggcatcggcggcgtaatagttttgttgttgcgcggccgatttgaactcgctgccgtattccaggacgccgggttcgtcggcgttgacatgccactcccccgcccggctcacccattgccccagcgtcgcgtcggccagcacgtgatcgagattgccggactcgccgccgtagacataggaataggcgtcgggctggaaacgcgccagctggttggctagcccgccctgctccagaatccggatcgggtcttccttggcgtaggcgttcatgtctcccatcaccagcaagccggactgcggcccctgcgcgcgcgcctgcgcccatttgagcagatcgcgcgccgcctgcgagcgggtgaggttgcaattgccctggccgtcgcccagatcgatatcggccacgccgtccacctggctgtcggcgcagctgctgcccttggatttcagatgattcaccgccagcgtcagctttctgccgtcgcccagagcgaaagtctgcgccagcatcggccgattgcgcgccgggtcgcccaccgccaccacctcggccgcgccttgcgggctcagccgcgccggccggtacagcatgccgggcgagatggcgtcgctgcctatcctctccgcgccgggagcggcgaagcggtactgcttgtccgcaggctggccatcgttcagcgccgccgccagttcctggatcgccgactgcagaccgaaaccgtcattctctatctccatcaaccccaccgcgtcggcgtccagcgcgcggatggcgctgacgatcttggctttctgccgcaggaaatcggcgcgggtcttcgcgccgcgcgcggtgggaaagccgccgcccagtccgtcgccgttgaagaagttgagcacattgaagctggcgagccgcaattggcccgccagccgggccggcgacgccgggcgcggattggcggccactacgcgcggcaagtccaagggctggatgcggtagccgccgttgctgaaggacaccacgccggtcaagccgtccagacggtcgcccacccgcagcgtgtgggccgcggacagaccgcccgggccgggcagccaggcgtcggcgttctgccaggttttgccatcgtccagcagcagccggtcgcgcagattggccgcgcgcagcgcctgggccgcggcgctgcccggcggatgcagctgggtcggcagccattgccgcgactggctggacagcgtcagttcgccgtaacggccgtagttgtagctgtcagccacgtacagcggctgctctaaagccaccgccatgccggccagcgcctccagctgagccggatccccgctcagcggcaggcgcagcggcgtcaacgcgagcgcgccttgcgcgccgcaggcttgcacgtcggcggccgccgccggctgcagctgcgtttcgctgccggcgtcgcccttgcgggcgaactccaccaccttgccgcgcacgccgaccacatcgccgcgcctcagcgcaggcaccgccagcttgccggtgtagacatagatgccttccgaggtggccgggtcctgatcctggttttgcggcgcttcctgcatgaagaagcccaccgggccgtccttgccgtagagcaggccgctgaccacgccctgcgcgacaacggtctgaccctgcagcggactggcggcgcccgcgccctggatctggtggatgcgttgcgtcgcggccgtcgaacaggccgcgccggccggcaggctggccgcggccagcaacaaagccaacccgccgcgcgcgggttggctggtgaacaatcgcttcatttttataggtcatcccgagtgaaggagcggcaattctagccgccacgatatgacattaggatttaaccctgctaaaaatgaagggatttacaaaaaaaaatgccaacccggacaggttggcattacacgagaaaacggcggctcggaccgtcaggccacccgctcgatcgcctgcgcgatggcgcgcgcccagttgtcagccagcgacttgtcgtcggcctccaccatcacccgcaccaccggttcggtgccggacggacgcagcaccacgcggccgcggccctgcagcgccgcctcggcctcggccagcggcgccgccgccgcctgcttccagtcgcagccgttgtggcgcacattgatcagcgtctgcggaaacggctgccagtcgctgcagatttccgccaggccaaggcccagctgcttgacgctggccagcacctgcaggctggagatgatgccgtcgccggtgctgtgcttgtccaggcacaggatgtggccggacgcctcgccgcccacctgccagccatcgccatgcagcatttccagcacgtagcggtcgccgaccttggcgcggccgaagggcacgccctgcttttgcagcgccagctccatcgccagattggtcatcacggtgccgaccacgccgcctttcagttcgcccttcgccgcgcgcgccttggcgatcacgtagatcagctggtcgccgtcgtagacgcggccggcggcgtccaccatgatcaggcggtcgccgtcgccgtccagcgcgatgccgaagtcggcatggtgttccagcaccgccagctgcagggttttgggataggtggcgcccaccttgtcgttgatgttgtagccattgggttcgcagccgatttccaccaattcggcgcccagctcgtggaacaccttgggcgcgatgtggtaggtggcgccgttggcgcagtccaccaccagcttcaggcccttcaggctgagctcattggggaaggtgctcttgcagaactcgatgtagcgctcggcggcgccgtcgatgcggcgggcgcggcccagctcctgcgacggattggtcgccatcggctgctccagcatcgcttcgatctccagctccagcgcgtcatccagcttgttgccgccttcggcgaagaacttgatgccgttatcctggaacggattatgcgaggccgaaatcaccacgccggcttccagccgcaacgcgcgggtcagataggcgatgccgggcgtcggcagcgggccggtcagcagcacattgacgccggcggcggtgaagcccgcctgcagcgcggcctccaacatgtagccggagatgcgggtatctttgccgatcagcacggtgggacggctgtcccggtcgtggttgaccagcacgcggccggcggcgtaaccgagcttcatcacgaattccgggttgatcggaaacttgccgacctcgccacgcacgccatcggtgccaaagtatttgcgactcatcagtgttctctatcgtcgattgaatgccgggtcgatgtcggatcccggacaaaacctgcgccattttgccatcagcgcggggacaaaaaccagtttcagatcaagattcccgcaaggcttgccataattgcagcgcctggcgggtggccttgacgtcgtgcgcgcggatcaccgccgcgccgcgccgcgccgattccagcgccgccgccacgctagcgcccaggcgctcggccggcgtttcctcgccggtgatcgcgcccagcatggacttgcgcgacagacccaccagctgcggcacgccggcgatgcgctcgatctcgtccagccgcttgagcagcgccaggttgtgcgccagcgtcttgccgaagccgaagcccggatccaccagcagccgttcgcgggcgatgccggcgtccaggcacagctggacgcggcgctgcagatagcctgccacctcggccaccacgtcttcgtatgccggcttgtcctgcatgctgtccggattgccctgcttgtgcatcaggcagatggccgcctggctgcgcgccgccagcgccaaggcgccttcgtcctccagcgccgacacgtcgttgatcaggtccaccgcgtccaatgcgatcgcctcgcgcatcaccgccgcgcggcgggtatccagcgacagcggcgcgccgatgccgcgcagctgctccagcaccggcagcacccgatccatctcttcttccgggctgacgaaaggcgcgccggggcgggtggattcgccgccgatgtccagaatgtccgcgccttcggccagcatcgcctcggctctggccagcgcggcgtcgacgcggctgaagcggccgccgtcggaaaacgagtccggcgtgacgttgaggatgcccatcagcagcgggcgcgacagatcgagcgtgaaacgcccgcacagcaaagttttcatgtcactctctaatcaaggcgcggccagcgtcgtttggcggctgacgcaagcggggaaaggccatttatggatgcaaaaaaccgggcaagcccgtaaaggcttgcccggttaggatacggatccggttatcagacttcctgggccggatcggacgtcgcctcgaccggagccgtcggctcggccggcttgtcctcaggcttggcggcgaaactgctgcccggcttcggcggacgcggcggcttgccgtccatgatgtcgttgatctgctcggcgtcgatggtctcgaactccagcagcgcggcggtcatcgcctccaccttgtcgcggttctcgtccagcaggcggcgcgccagcgcgtactgctcgtcgatgatgcggcggatttcctggtccacctgctgcagcgtcgcttccgacaggttcttgtgggtggtgatcgagcggccgaggaacacttcgccctcgttttcgccatacaccatcgggcccagcttgtccgacatgccgtagcgggtgaccatgtcgcgcgccatctgcgtcgcgcgttcgaagtcgttgctggcgccggtggtcatctggttcatgaacagctcttcggcgatgcggccgccgaacaaaatggccagacggtccatcaggtagccgcggtcgtaggcgaagcggtcctgctccggcagctgcatggtcacgcccagcgcgcggccgcgcgggatgatggtgaccttgtgcaccgggtcggacttcggcagcagcttggcgaccaccgcatggccggactcgtggtaggcggtgttcttcttctcttcctcggtcatcaccatgctgcggcgctcggcgcccatcatgatcttgtccttggcggattccaggtcttccatgtccaccaggcgcttgttgcggcgggcggcgaacagggcggcctcgttgatcaggttggcgaggtcggcgccggagaagcccggcgtgccgcgcgcgatcacctcggcgttgacgtcggcggcgatcggcaccttgcgcatgtgcacgttcaggatctgctcgcggccgcggatgtccggcagcggcaccaccacctggcggtcgaaacggcccggccgctgcagcgccgggtccagcacgtccggacggttggtggcagcgatcacgatcaccgtggaattggtgtcgaagccgtccatctccaccaagagctggttcagcgtttgctcgcgctcgtcgttgccgccgccgaggccggcgccgcgctggcggccgaccgcgtcgatttcgtcgatgaagatgatgcacggcgagttcttcttcgcttgctcgaacatgtcgcgcacgcgggccgcgccgacgccgacgaacatttccacgaagtcggagccggagatgctgaagaacggcaccttggcttcgccggcgatggccttcgccagcagcgtcttgccggtgccgggactgcctgccagcaggatgccgcgcgggatgcggccgcccaggctctggtagcgggaaggatcgcgcaggtagtcgacgatctccttaacctcttccttggcctcgtcgcagccggccacatcggcgaacaccacggtgttggcgtcctggtccagcatgcgcgccttgctcttgccgaacgagaacgcgccgcccttgccgccgccctgcatctggcgcatgaagaacacccacacgccgatcagcagcagcatcgggaaccagctgatgaagatgctcatcagcatcgaaggctcttcttccggcttggcggagaagcgcacgttgttcttgatcaggtcgcccaccagctccggatcatacggcgcataggtggagaaagccgtgccgtcggtcaatttgcccttcagccattggccgcgcagcggatgcccctcgatggtcagggattgcactttgcccgactcgacatcgctgacgaactgcgagtactcgagctggttctgggtgtcctggcgcttgttgaactgattgaagactgtcatcagcaccaggccgatgattacccagatggcgatgtttttgccgatattgttcacgagtagcggactcctctgtgccctgactttttggttgcttgtagtaaattgctacgattgtacgccccgcggcaacttgtgtcagcggcgacccttgcccagcagatagatttcactggaacgatcgcgcgatgccttgggtttgcgggtgaccacctcgtcgaacagctcgcgcatggccttgaggtaggactgaaaatcgctgccctggaacactttgacgagaaagtggccgccgggtttcaaatgatcgcgcgcaaaatccagagccagttcgcaaagcaggaagcttctggcctgatcgatggcgctcattcctgacatattgggcgccatgtcggaaattacaaggtcaagcgcccggccgtccagcaaagcttcgaattgtctgagcacgtcctcttcgcggaagtcgccctggatgaagctgacgcccggcaccgggtccatatccaggatgtcgagcgcgaacaccttgccctgctcgccgacaatgcgcgccgccacctgcgaccagctgcccggcgtggagccgaggtcggccagcacggtgccgggacgaatcagcttgtccttgtcgttgatttccagcagcttgtaggcggcgcgggcgcggtagccatccttttgcgccatctgcacatattgatcgttgacgtgttcctgcaaccaggagttgctgctcttgcttcttgccatcgtggcggatgctttctgtcggttcaatcgtcaggatagccgaattggccgctttgcatcgcgctatcctgttgtttttcggttatttcaggcccggactttgggtgcggggccaaattctagtagaatcgggttttgctttgaattccctagtttccatgaaaattgacctcaagccgtttcagcgcaagtacctgcaaggcctggcgcacggcatcgacccggtggtgatggtaggcaacaacggcctgaccgaagccgtagtccgcgaaatcgccatcagcctggacgcccatgaattgatcaaggtgcgcgtgcaaggcgacgaccgcgaagcccgcgtcgccatgttcgagcagatctgcgaagaactgggcgccgccccggttcagcacatcggcaagctgctggtgctgtggcgccccagcgacaagcagcgcatcgcgctgccgaagaacaagcaggcgctcaagggctgagcgccgcgcgccggatgtgagaaagcggtggccgcggccaccgctttttctttgccccgccgccggccgcgctagccgcggtcctgccagacgtaggccaggcccagcaggctctgcagcaggtagatcaggctggagatcgcgtgccaggtggcgaagccgccgccgaacaggccttcggccgcgtggttcatctgctgcttcagcgtgacgatgatgggggccacgccgaactggttgatcagcgtgcagaccagcatgccgacgatcagccagaagccgccgtgcttgagcccggccacgccgttgcgccacacctggtccaccagcaggatcacgccgcacaccaggcccacccaggcgatgacggcgaacaacctgcccgccaccatgccggccgtggccgcgtccagcgacttgaacaagaccggcgccacgatgatgccgatcacccacaatccgccaatccagaaggttttggcgagagcacgcaagccgtccatctttcccccaaactcggcaacggtcgcggccggaaaaaacgcgcggaacagcgtgccgcgcgtcgttcaggccggactcagatgtatttgacgtccagtacttcgtattcgcggatgccgcccggcgccaccacttcggccacgtcgccggcttccttgccgatcagcgcgcgcgagatcggcgaattgaccgacaccttgctgaccttgatgtcggcttcgtcgtcgccgacgatctggtaggtgacgctctcttcggtttccaggtccatcaggtcgaccgtggcgccgaacaccacgcggccatcggcgtccagttcggacggattgatgatcacggcgttggacagcttggcttccagctcggcgatccggccctccacgaaagcctggcgctccttggcggcgtcgtactcggcgttttccgacaggtcgccatgcgaacgcgcttcggcaatggcctcgatcaccgccggacgctcgatgctcttcaggcgttgcagttcttccttcagaagctcggcgccgcgtacagtcaacgggactttgatcattacagtattctccacaggcggttgtccgccttcatcaaaagcacaagccgccgtacgggacggcggcttgcacaagcgggtttcagcgggattgtaacggcaaatcgcctctacatcaaagcctacccgtcaataccccttcctcagccgcggatctgcgcgtgcagctcttgcacgctgtagacgtcgaaggcttcggcgtgcttcatccccacgcacaccgccttggcggcggacagcgtggtgtattgcggcacccgcgcctgcagggccgagcggcggatggagtggctgtcctggatcgccaggcgcttttcatccacggtgttgaccaccagatccacttcgccgttcttgatcatgtcgacgatgtgcggacggccttcgttcaccttgttcaccacctgcacgatcaggccggcctcggtcagatgcttggcggtgccgcgcgtcgcgcagatgccgaagcccagccgttgcagttcgcgcgccacgtccaccgcgccgttcttgtcggagtcgcgcaccgacaggaacaccttgccggtcttgggcaggcggtcgccggcgcccagctgcgccttgacgtaggcttcggcgaaggtcttgcccacgcccatcacctcgccggtggacttcatttccggccccaggatggtgtcgacgcccgggaacttgatgaaggggaacaccgcttccttcaccgcgtagaacggcggaatcacctcgctggtgaagccttgatcggccagcttgatgccggccatcgcgcgggcggcgatcttggccagcggcgccgaggtcaccttggagacgaagggcacggtgcgcgaggcgcgcgggttcacttccagcacgtagatggtttcgccctgaatcgcgaactgcacgttcatcaggccaaccacattcagcgcgcgggccatcgccacggtctggcggcggatttcatcctgcagcgccgggaacaggctgtacggcggcagcgagcaggccgagtcgccggagtggacgccggcttgctcgacgtgctgcatgatgccgccgatcaccacctgctcgccgtcggacacgcagtcgacgtccacttcgatggcgtcgttgaggaagcggtccagcagcaccgggctgtcgttggacaccttcaccgcctcgcgcatgtagcgctccagatcggccggctcgtggacgatttccatcgcgcggccgcccagcacgtaagacggacgcaccaccagcgggtagccgatctcctcggccagcgtcatcgcctcggccggcgcgcgcgcggtgcggttcggcggctgcttcaggcccagctcctgcaacagcttctggaagcgctcgcggtcttcggcggcgtcgatcatgtcaggcgtggtgccgatgatgggcacgccgttggcctccagcgcgcgcgccagcttcagcggcgtctggccgccgtactggacgatgacgccgaacggcttctcgatgcggcagatctccagcacgtcttccagcgtcagcggctcgaagtacaggcggtcggaggtgtcatagtcggtggacacggtttccggattgcagttgaccatgatggtctcgaagccggattcgcgcaggctcaatgccgcgtgcacgcagcagtagtcgaactcgatgccctggccgatgcggttcggcccgccgcccagcaccatcaccttcttgcggtcggtgggctgggattcgcactcttcctcataggtggagtacatgtaggcggtgttggtggcgaactccgccgcgcaggtgtcgacgcgcttgtacaccggatgcaggcccagcgcccagcgcttggcgcgcaccgcggcctgatcagagcccaacaattcgcccaggcggcggtcggagaagcccttgcgcttcaggcggcgcagctcggcgtagtccagttcctcgatcttgcggccgcccagcgctttttcctcgccgatcaggtcctcgatctgcgccaggaaccacgggtcgatcttgctgacggcgtggatgtcgtcgcggctcatgccgatgcggaaggcgtcggcgacgtataggatgcgctccggccctggggtgcccagctcgtggcggatggcggcttcgtcggtggtgacagggtcgaagccggacaagccggtctccaggccgcgcagcgctttctgcatcgattcctgcagcgtgcggcccatcgccatcacttcgcccaccgacttcatctgggtggtcagacggtcgtcggcctgtgggaatttttcaaacgcgaaacgcgggatcttggtgaccacgtagtcgatcgacggctcgaacgaagccggggtggcgccgccggtgatgtcgttcttcagctcgtccagcgtgaagcccaccgccagcttggcggcgatcttggcgatcgggaagccggtggccttggacgccagcgcggaggaacggctgacgcgcgggttcatctcgatgacgatcatctcgccggtggccggattggtggcgaactgcacattggagccgccggtatccacgccgatctcgcgcagcaccgccagggaggcgttgcgcatgatctggtattccttgtcggtcagcgtctgcgccggggccacggtgatggagtcgccggtgtgcacgcccatcgggtcgaagttttcgatcgaacagatgatgatgcagttgtcgttcttgtcgcgaacgacttccatctcgtattccttccagcccagcaccgactgctcgatcagcagctcatgggtgggggaggcttcgaagccgcgctcgcagatcgccaggaattcttccttgttgtaggcgatgccgccgccggagccgcccatggtgaaggacgggcggatcagcgtcgggaagcccaccttggtctgcgcttccagcgactcttccatcgtgtggcagacgaaggacagcgggcaggacaggccgatcttggccatcgcctccttgaagcggccgcggtcttcagccttgtcgatggcgtcttcggtggcgccgatcagctcgactttgtatttttccagcacgccgtgcttggccaggtccagcgcgcagttcagcgcagtctggccgcccatggtcggcaggatggcgtccggacgctccttggcgatgatcttctccaccactttccaggtgatgggctcgatgtaggtgacgtcggccatgtccgggtcggtcatgatggtggccgggttggagttcaccaggactaccttgtagccctcctcgcgcagggccttgcacgcctgggcgccggaatagtcgaattcgcaggcctggccgatgacgatggggccggcgccaatgatcaggatgcttttaatgtcggtacgctttggcatggtcttaactctatttcaataatcaattcggtctggccgcgcggcagcccgcgcggcgccctcacactcaacccagccccgccgccgccagcttggcgccgaagccgacgaacaccgcgcccaccgagccgcccagcgccgccgacagcttgcggcggcggcggaaggccgcggccaggcggttgccggccaggatcagcagcgtcatgtagctcaggctgcacacctgcacgatcaggcccaggccggcgaaagtcagcgccgggtacgggtagcccggatcgacgaactggacgaagaaggacacgaagaacaggatggccttcggattcatcaggctgatcagcagcgccttgcggtacggatggccgctggccagcgccgacggcgccgccgacgcttcctcgccgcgccgcatgcgccgccagccgacgatggcgcccttcaccatattgaagcccagccaggcgagatagccgccgcccaggtacttgatcaccgcgaacagcgccggattggcctgcagcaggcccgccgcgccgatggcggccagcgtcatcagggtgaagtcgccgctcatcacgccggcggcggcggaaaagccggcgcggatgccgcgctgcgccgccaccgacagcacgaacatcatgttcggccccggcagcaggacgatgatcagcgtgccgatcagataggtagtgaggtcggtaatgcctaacatgctgtgctccggatcacttgcgctcggtcatcgcgccgatgaaacggtcgaacaggtaagccacgtcctccggtcccgggctcgcttccgggtggccctggaacgagaacgccggacgatcggtcagcgcgatgccctgcaccgtgccgtcgaacagcgaacggtgggtgacgcggacattggccggcaggctggtttcatcgacctggaagccgtggttctggctggtgatcatcacgcggccggagtccaggtcctgcaccgggtggttggcgccgtggtggccgaacttcatcttggaggtcttggcgccggaagccaggcccaacaactggtggccgaggcagatgccgaataccggcagcttggtttccaggatttcgcggatggcgtcgatcgcgtagtcgcacggttccggatcgcccgggccgttggacaggaacacgccgtgcggattgagcgccagcacgtccttggccggggtctgggccggcacgatggtcagctggcagccgcgctcggccagcatgcgcaggatgttgtgcttgacgccgaagtcgtaggccaccacgtggaaacgggtggacgactgcacctggtagccggcgcccagctgccattgtttctcggtccaggcgtacggtttacggcagctgacaaccttggccaggtcctggccggccatgctgccgaaaccgcgggccagttccagcgccttggcctcgtcgatgtcgccggccatgatgcagccggcttgcgcgcccttctcgcgcaggatgcgcgtcaggcggcgggtgtcgatatcggcgatggcgacgacgttatgctttttcaggtagtcggacagcgagtcttcggcgcggaagttgctgtgcagcagcggcagatcgcggatgatcaggccggatgcaaaaacggcgctggattcggtatcttccgaattcgcgccgacgtttccgatatggggataggtcagagtgacgatctgcctggtataggaaggatccgtgaggatttcctggtaaccggtgatggcggtattgaataccacctcgccgaccgtgtggccagcggcaccgatagcactacctttgaaaagcgtgccgtcagccaagacaaggattgcgggggtgtttgacactggctggctcctgttgcatttgcctgggcgcttgtacaaaaaccggctgcgccggtttcgttttccaccctgggattttcgaatttcttatgtgaataacgggactgagcgccttgcgccagtcccgtttggataaacctttctataatatcgcgcatattgcgatcgcacaatacgccaaccgtcattttttgcaaaaaaaccgtcacatccccggcttcacctgccagctgacgctggtggggcccgccggctggcccagcatcagcaacaacggcttgagcgcgtcgtactgttccggcgggctatcggcggtgcccgccatgctgaaggcgccgccggctggccagctgccctggccgttgatcatcagcggcccttccagcgtggacagcgtgaagttcagcccctgcggcgtgccggcggcgtccagctggtagctgccgaaaggcagcaccgtggtcagcggcgacgccgcgccgcgccaagccagctgcaccgcgccgctgacttccttgccttggcgcgccaattggggaatgttcagctgcaattcgccacccagcctggccacctgccaagttttggacagattggccagcgccgccaccggcatcgacaacgccaggccgcgcacttcctgcttgcccaagcccagctgcagcaagcccggctggccggcgctgtccagatgccagaccaacaggccggacaacaaggccttgggctgccattgccagcctagcgggctcatgccctgcacttcgccggccggccccaggtacaccagctgggcgccgccgttccagaccgtgcccctggcgtcgctgacgccccagcggccatcgctccagcgcgccaccggcaccgccagcaggctggccggcagcgccgacagcgcgccggccagcagcaggacagccagccccagccacttgatcatccgccgcctcatgccgccgctcccgcgtgcgccagcagcgccttgatcttgacctggcccggcaccggctgcgcctccatcttcacgttcaccacccgcacctgctgctgcgccgccaacacgccggcgaaacgcacccaggcgtcgaaccccaccacgccttccatgtcgacgccggactcgccgtcctggctgaactgcagcgcggcgaccgccaggccctggctcttggcggtctgctgcaatagcggaatcagttccttggccggcagcggcgtctgcgccggctggcgcttgagcttgtcggcctcggcggccaggctgcgcaccgcgcccagctcggcctgcagccgcgccaccgacgcgcggttgcgctgcagcgaggcgctggccggctcccataccgccaggtacagcagcgccgcgcccagcaccagcgccatcgccgccagcaggcgctgctcgcgcgcgctgcgttgctgccagtagtcgagaaattgttgcttgtaggctgtcatcacggctcccgcgccaccaccagttgtttgctgccaggctggctgctcgtcgcatccagcatgatctggcgcgccgccagcactttgcgccagcgcgccaggctttccgccggcacctcgttcacctgcagcttcagccggccggcctcgtactccagcgagcgcgcttgcagatcgcggccgctggccgcggccagcgcgcccatcagctccagcatgtcgtcgcgcgccggcaagccgtggctgagccgcagcttgtcgaccgcgcgcgtcatcagcagcgcgctgctgcccggcatcgcctggccgccggtccacggcgcggcggcgctcttgatctgctgcgacaagctgtgcttctgccaggcgtaccagccggactggcacagcgtcagcagcaattgcgccgccagcaggccgcccagcagccagccggcccgcttcagcgacggcgcccagtcgcgccagcggcggttggccgccagctcgccctgggcgaagtcgaagccgccctcgcgtttcccttgtttccagtcgtgggcttcgccgcgcgcgctgtcgccctgccagcccggcaggcggctcagcagctcctcgggacgctccacgccgtgcagttgcagccgcgccggcggcgacagcgccagcagcgaggcgaacagcgcctgctccaccgccgcgccgccgcgcggcaggcaagcggcgtacggcgaggccgcgcgcaccagatagcggtcggccagcgccgtcacgctccagccgtcggccggcggcggcggcagcaggcactcctccggtacgatgcggtcgcacaagcggcccaggcttttcagcatcgccaccgctcggcgcagcgccgccgcctcggtcaccgccaccaggcggcggccgtcggccagcgtcggccccggcgcgtacagattggcgcccggatcgttgcccagcccctcttccagcgcgaagcccatcaccgccggcgtcggctgcttcaccgcgtccggcagcctggcttcggcgaacagggtgcggccggccggcagcaccagttcgcaatggtcggccttgggccagccccccggcgcgctgtcgccctgggcgctcagctcgccgcgggcgcccagcagcgcccagggcaagcccggctcgctatcgggccagcccgcccgcagatagagtcgcagcgtcgtcatgtttttctccaccgggccgcgccgactggctgcggccgtcattgccgtcctgccgccacaacagcttgacggcgttcgggctactgtaaatcatcgctcgcatctgcaggcgcgccttgccgaagctggagcggctgtcgagctggaaataactggacgcggcgccgtagtcggtgtcggcgacggccaccgcgcccggcaagcgggccttgaagtcggccgcgtccttgaaataattgctcttgcgctggttcaacagcaccagcagattgccgtcgcctatccccggcagcagcgtcttcatcaccatgtcggtggcggtattgacgttgatctggctgacgccgggcggcagcgccgccacatgcggcgccagcttctccatcacttccggcgtgtagccgggcagccagcgcagcatttccacccgcagcagcggatggttgggctgcggcgcggccgcgttgccgctgtctgccgccggctggcggccatcgtcctcccggccgccgcgcagcgacttgagcagcggctccgacagcttgctaggcagccccagcgtcaccagcaggcgcttgtagaacaccacctggcgggtattggtctggccgttcgccaccagcgaattgagattgaagcggccttgcaggtcggacagcgagccgctcaccttcactccctgggcctcggtttgcggcaagggctgcgcccacagctgcgacagcgccaccacgccgttgccggccggcccgctgttgaagcgcagaatctccatcgcccagcccaggccggcgtcggccaccagccgcagctgcgcgcggctcttgtcgttttccagctggtgccaccacagcccctgctgccacagcaccaggctggccgcggtggtggccagcgccacgatcagcagcgccatgatcaccgccatgccggattgccgccgtctcatggcaggctccagatgcggcgcaccggctgctggcccggcatcagcacccgcatttccagcgcccgcgccacccggccctgggcggcgtcgcccatcggccaggcgtcctgccaactgccgtcgttcaacatcacccgccagctcaccttcatgtccggccccagcagcgcgtagcggatcggctcgccgccggcggcgtcgccggccgaccagctgagtacgccgccgccggcgtgataggaaatccgctccatgccgctcggataacgggcggacaccgactccagcaccagcgactggcccttgccgtcctgcaacagcgtcaggctgctggcgcccagcgccagcccctgctgctggtctccggcgctgggctgcggctgctggccgctcaggtcgctctccagccggcggaaggcgcgcgccgcgtccacccattgctcgccggtctgcatcagccgctcccgcgcgatcagcagcgaaccgaacgccttgtaacccatcaccgacaagatggccagcaggctcatcgccaccaggatttccagcagcgtcatgccgccctgcccgcgcgcgctcaaccgccgctcccggccgtctggcgcaggtagccggtgacttcggccaacacgtaatggccgctgcccggcgccaggatgcgcaccaccaccttgcggaaattgggattgggagtcggcgtgatatcgcgctcccagcgccaggcgatgccgtcctccttgctctcgccggcctgctgcccgggttcggggaactgccgcagcgcctgcagcgcggcgatctggttctgcgcctcccaattggcctgcatccgccgctccatgccttcggcgttgtcggcggcgaggccggtggcgcgcagcaacgctcccagcgccaccgcgatgatggccagcgccaccagcacttcgaacagagtgaaaccttgctgccgcctcatgagccgtccgccaccgtcacccggcccagcggcgactgcaatatcgtcaagcgccggcccgcgccgcccagcctgagcgccagcgtcgccgcccggccgtcctgccacaacagcaggggcctgcccgccggccagggcttgccgtccaacagcacgccctcgccctggatgccgtccggccaaggatgctcagccagcaggtcgtcgccggccgccacccagttgccgtcgtcgtcctgccggctgaaggcatagcccttggcgttccagctcaaggccagcgtgtcgcccatttcggcggcgtcgccggcttgctccagcacccgcgcgaagcgataggcctcgtcgttcagcagacgatgggtgtcgggccgcaggctgagggtcacggtggtggccaggacgccgatgatcagcatcaccaccatcacctcgatcagcgtgaagccgcgctggcgcgggcgcatcatgccggttctcgctcaggcgcgcttacttgccgctgtcccagttgccgatgtcggcgtcgttgccctcgccgcccggctcgccgtcggcgccgaagctccagatgtcgatttcgccgtgcgtgcccgggttggcgtactggtaggcgttgccccacgggtctttcggcaggcgctccaggtagccgcccggcttccagttcttcggctccggcgccgcggtcggtttctgcaccagcgccgacaagccctggtcagagctgggatagcggccattgtccagccggtacagcttcagcgcctgactgatggcgccgatgtcctgcttggcggcgacgatgcgcgcctcgtccggacggctcatcaccttgggcaccaccagcgcggccagcacgccgaggatgacgatcaccaccatgatctcgatcagggtgaaaccgcgctgggcggtacgtttcaactgtttcatcgcttctccatcatttgatccggcggcgcttggccatgccgggttgcttccaatttccgaatatccgtcaaacagccgggcaggatctcatcctcccggcctgcaagtcatttttcctgatcgagcgcctgttgcagcagcgtctgcagcgcgtcgacgcgccggcgcaggctgatgcactcgcgcaaggccgacacggcaaacagatagcccgcgatggccgtcagggccagcaaggccatccacgctcccgactgaagaaaaaccacggcgccgatgctggcggcaaccgccagccatagcgccggatgccaggcctggatgggcaagggccgccgcgccgccagcgcggcgcgcgccttgtccctatccgccaccgcgtccagcaatttccggtattcgcggttgcggatcgggtcggcgtccagcatcttgtctttcgccatgggcacggctcaatgcaccatctggttcatgtcgatgatgggcatcatgatcgccagcacgatcagcagcaccatgccgcccatcaccaggatcagcaagggctccatcagcgtggtgaaggtggccagcttgcgctccacctcctgttcctgctgctgcgcggcgcggtccagcatctgcgacagcgtgccgctggcctcgccgctggaaatcaggtggatcagcaccggcgggaactgcttgctggcgttgagcgcgcgcgacagcgacacgccttcgcgcaccttggccatcgcgtcggccaccgcgtcctgcatcggcagcatggtcatcaggccgcgcgcggtctccagcgcggtcaagagcggcacgcccgaacccaccagaatggacatggtgctggccatgcgcgcggtgttgagcgcgcggaacaggcggccgaacaccggcagcctcagcacccaggcatggaaacggcgcttgagcagcggcgcgcgcaaggcgcgcaccgtcagcgccaccgccgcgacgatggacgccagcagcagcaggccccattggcgcaggaaatcgctgcacgccaccagcgcgcgggtgaggaaaggcagcgattgcttggtctgcgcgaacacgctgaccacctgcggcaccacataggtcatcaggccggacaccaccaggatggcgacgaaggtcaccaccgccgggtaggcgagcgccagcgtcactttctgctgggtgttctgccgcttatccaggtattccgccagccgcgccatcaccatgtcgaggtggccggactgctcgccggcctgcaccagcgagcggtacaagggcgagaacacgccgggcgcggcggacagcgcctgggcgaagctcttgccttccaggatgtcgctgcgcagcgccgccagcacggtgcgggcgcgcgggctttccgcctgctcggtcaccgcggtcagcgccttctccagggtcaggccggcgttgagcagcgtcgacagctgctcggtgagcatcaccagctcggcgcgcggcaggccgcggcgcaacacattgctgccggagttgccggtcttggcgttgacgctgtccaccgccaccggcagcaggccgcgctcgcgcagctgcgcgcgggcggcgcgggcggagtcggcctccagcaggccattctgctccttgccggccgcatcgtaggcggtgtatcggaaggcggccatatcagcttctcgtcacccgcaggatttcttccaggctggtttcgccggccttgacccagcgcaggccgtcgtcgcgcaggctgcgcatgccgtggcgctgcgcgtggtcgcgcagccgctgctcggaggcgcggtcgtggatcagccgctgcatggtgtcgtccaccagcatcaattcatacacgccgtagcgccccttgtagccggagttgccgcaggccgggcagcccaccggacggtaatgaatggcatccggctcgtcttccagcggcaccggatgcggcgccttgcactgcgggcagacgcgccgcaccagccgctgcgccatcacgcccagcaggctggaagccagcaggaagggctccacccccatgtcggtgaggcgggtcaccgcgctggcggcgtcgttggtgtgcaaggtggccaacaccaggtggccggtcagcgacgcctgcaccgcgatctgcgcggtttccagatcgcggatctcgcctatcatcaccacgtccgggtcttggcgcaggatggcgcgcagcgccttggcgaagctcatgtctatcttggggttgacctgggtctggccgacgccgtccaggtggtactccaccgggtcttccaccgtcatgatgttggtgtggctggcgtccagccgcgacaaggccgcgtacagcgtggtggtcttgccggagccggtggggccggtgaccagcaggatgccgtgcggctggttgatcagcttgtccaccgaggccagcgtgtcggcggccatgcccagggtggccaggtccagccgcgcgttttccttgtccagcaaacgcagcaccacccgttcgccgtggctggtcggcagcgtcgacacccgcacgtccacgggccggccgcccagccgcagcgagatgcggccgtcctgcgggatgcgcttctcggcgatgtccatgccggacatgatcttgatccgcgacaccatcgccgcgtgcagcgcgcggtgcgggctgaccacgtcgcgcagcgtgccgtccagacggaagcgcaccaccgagcgatcctcgaaggcctcgatgtggatgtcggacgcgccgtcgcgcagcgcctgggtcagcagcgcgttgatcatgcggatgatgggcgcgtcgccctcgctttccagcaggtcctccaccgtcggcagcgactccaccatctggttgaggtccatgtcctggccgatgtcgtccaccatctccgccgccgcgccgtcgcggctggcgtagtgctcggacagccgcttctcgaactgggcctgcgtcagcgtctccacccccaccagcgtgccgccgtgcaggcgcagcgcctccgcccacgccgccggccgcgcgtcttcgcgcagcagcagctggcggccgctttcgccgtccagcaggatcacaccgttggcgcgggcaaaggggaaggccagcagcggcatcagcgtgggcttgttcatttcggcacggccttcacgtcccgctccaggctggccttgatcccgccttccggcagcgactggatcgccgactccaagtccagcggcagttttttcccgtcgcgcttgagatctcccaggatgtactggtagcgatcctgcgcgatgacgcggccgtcctgctcgccgcgcaggatggtcggcttgaggaatatcatcaggttggtcttgttatgggtcttggcgctgtagcggaacagcgcgcccagccaggggatgtcgcccaagagcggcaccttctgttcggcgtcgtccacctggtcctgcagcaggccgcctatcgccaggatgctgccgtcgtcgacattggcgatggtttccagcacgcggcggttggtggtggggccggcgttgctcccggcgttcagattggggctggacgccaccaggctggcggtttcctgcaggatcttcagccggatgctgccgccctcggaaatctgcggcgtgatttccaggttgaagcctatggtcttgcggtcgtagctggtggttatcaccggctggccgctggtgctgctgctgggcgtgctctggttgccgatcgggatcggcacttcctggccgatcaggatgcgcgccttttcattgtcggtggccagcaaggaggggctggccaccacattgctgccgctctcgctttccagcgccttggccagcgcggccagattgccgtgccggatccagcccaggttcaccccgccggagcccgccaggctggtggccagtccgccgacgccgccggcggccagcgccgcgccggcgccgatgatggaggtgccgctggtgccgctggtggtcgcgccggagaagttggtgccgcctatcaccgcgccgccggccgcctgccactgcacgcctagttccatcgcccgggtggccgacacctcgaccaccagcgcttcgaccaatacctgggcgcggcgcttgtccagcatgtcgatcacgttgcgcaggttctggtacatgctgtccggcacgttgaggatcagcgcgttgttggtggggtcggcctggatcatcgagccgccgccgccggcgccgctgctggcgctgtcgttgaccagcgggctggccgccgccggcgcgttggcgttggccggcgcgccgcctaccgcattattgctggcgctgctgcccaagccggagctggaagtgttgccgctcagcgcgctgctgccggccgagctgccgccgttggtggtgaccgcggtgcggccctgcagcgggcccggatcgccggtcagcagcgcgcgcagcgtctgcgccaccttgccggcctcggcgttcttcaggtacaccacccggacgttggagccggcctggctaggttgatccagcattttcagcaggctcttgatcttgcctattttgcccggggtgtcggcgcgcaccatcagcacattggcgcgcgggtcggccaggatggtggtcttgccgccgtcggcgccgccttcctgcatcagcttgttcagggtgttggacaactccaccgccgagccgaacagcaccggcagcaccacggtgtcgccggcggcggcggactccaccgattcgatgatggattcgatgcgctggatgttgtccgcgtagtcggtgacgatcagcgcgttggattgcggataggccgccacggtgttgttgggcgagacgatggggcggatcaccggcaccagctggttggcgttgctgttcttcaacgcgaacaccttggtgatcagccggtcgccgtcgccacgcggaatgccgcggctcgccttggcatgcagcttggcgtcggcctccggcacgatcttgaccacgccgttgccctccacagcggcgaagccctgcagccgcagcgacgacagcagcacctggtaggacatcgcgcgcggcaccggccggctggagacgatgttgaccgtgcccttgacgcgcgggtcgatgatgaaattcttgccgctgatctcgcctatcgccttgaccacggtctcgatgtcggcgttgacgaaattgagcatgaccgtgtcgttctgcggggctgccagcagttggcagctatatgccagggccagggtggcgacgagtttggaaattcgcattgcactctcttattggcgaatcatcgcggcaggatcgaccgcgggttggggcggagtatcgggtacggaattctggctggggacaggcaccggcacggcgccgggaccggcctgcggcgcctggccgggttgcgggggcggcagcggctgtccggcatcgccgtcgccggcaaccgcgccgccgctgcgcgcctgcaacggcacgaattgctcattgccgccggagcggatggtgacgccattaggcgcgaccttcaccagctcccagccgtcggcggtctgcttgccctgcaacagcggctggctgtggccgttgctgtctatgatggcgaagccctccacgccgggccgggtcggcgcgtacacgcccagcaagcgtatcggcggcggcgcggccaccggctgctgcggcgcctcgccaaaccagtgcgcctgcgcggcggcggccgccgcggtttgcggctgggccggggcgagggtgcggtaggtctgcgccgacggcgccaacagggcggtcagctgctggcccagccagaacgcggccagccccatggccaggaccggcagtcccttgtgccattgccggccaggcagcgtccagcggctgaaatccggcttgcgacccaatcttgtcttatccccagaacccatcggcttcccgttataaaaattatgctgaacagctgtggctgcaggcttgctagattaagcagcaagagggtgcttttgcaatagccggctcgcagatttgatgacaagtggaaattcagccattgttaatatttacagccagacaacccagttcttggtttcacgctcattgccaatggatttaccgacacgtaaaagcaaatttttggcattttcgcataaaaaaacgccacggcaaggccgtggcgccgtctctggtttttttccgctcagaactggctgtcatccagcgccagcgcgctgtccgcgccatgcaggatggcggcggccaaaccggatacctgcggcagcagatgctcggcgaagaagcgcgcggtgacgatcttggcattgaggaattcgacgtcggcgtcggcctcctgcaatttgtccttggcgatcaatgcggcgcggcccagctgccagccgcccagaacgatgcccatcagcttcaggaacggcaccgagccggcggccgccagctgcggctggctgccgaaggtctccaggatgaaggccacgcagcgctcggcgtcggcgctggccgcttcaagattggcagcgatgctggcgaaccccgccgcctgcagcttggcgaccgtggcatgcgcctcgcccagcagcgcgcgcgcggcgacgccgtgatcggcagccgtcttgcggccgatcaggtccagcgcctggatgccggtggtgccttcgtaaatggcggtgatgcgggcgtcgcgatagtactgggcgacgccggtttcctcgatgaagcccatgccgccgtgcacctggatggccaggctggtgatctcgttggcctgctcggtattccagcccttgacgatgggaatcaggaaattcagcagcgcctggttgcgcgcggcttcgcccggcgccgggtggcggccggcgcggtccagcgcggcggcggtatagaaggtcagcgcgcgctgcgcctcgatctgggcgcgcatggtcatcagcatgcggcgcacgtccgggtgctggatgatgggcacgccggccgggtccggcgagccgacggcgcggctctgcacccgatcgcgcgcgtactccaccgctttctgataggcgcgctccgacaccgccatgccctcgatgcccacgcccagccgggcgtggttcatcatggtgaacatgtagttgaggcccttgttgggctcgcccaccaggtagccgaccgcgccgtcgttgtcgccgaagctcatcacagcggtcgggctgccatggatgcccagcttgtgctccagcgacacgcagcgcacgtcgttgcgcgcgccgagcgagccgtcggcgttcaccaggaacttgggcacgatgaacagcgagatgcccttcaccccggccggcgcgtccggcaggcgcgccagcaccagatggacgatgttctcggccatgtcgtgctcaccccaggtgatgaagatcttctggccgctcacgcggtagctgccgtccgccgccggcacggcgcgcgaacgcacctgggccaggtcggagccggcttgcggttcggtcaggttcatggtgccggtccactggccgccggccatcatcggcaggtagatctgtttcagttcatcggaggcgtggtgatggatggcctccaccgcgcccagcgtcaacagcggcgccagcgaaaacgccaggttggacgcgcaccacatttcctccaccgcggccgccaccagcgccggcatgccctggccgccgaactcctccggcgcgcgcaggcccacccagccggattcgacatattgctgccaagcgtccttgaagcccggcgcggcggtcacgtcgccatcgtgccacttggcgccctggtcgccctgcttgttgatcggcgccagcacgccctcggcgaacttggccccttcctccagcacggcgtccaccagctccaccgagcattcgccgtagcccggcaggccgcagatcgccggcagctcggccagctcgttcagtacgaaacgcatgtctttgacgggtgcttggtaaatcatcgccctctcctctgttttctcgcgttggcccgactagaccgggccgtgaaaaagccggcgctccctgattgggcgccggctgctgttgtgggttccggcggctatgctgcctgctcggtcgggggcgcttgcggccgcgcccccggctgccgattatttcgacagctcggcgatcagctccggcaccaccgtgaacaggtcgccgacgatgccgtaatcggccacctggaagatcggggcctcttcgtccttgttgatcgcgacgatcaccttggagtccttcatgccggccaggtgctggatcgcgccggaaatgccgaccgcgaagtacagttgcggcgccaccaccttgccggtttggccaacctggtagtcgttcggcgcgtagccggcatcgacagcggcgcgggaggcgccgacggcggcggacagcttgtcggccagcggctcgatcaccgccttgaactgctcctccgagcccagcgcgcggccgccggagacgatgaccttggccgagcccagctccgggcggtcggacttggtcagctcctggccgacgaaggcggacagctggccgtcggccgcggcggcgatgctttccacggcggcggagccgccctggccggcggcgtcgaaggccgtggtgcgcacggtgatcaccttgatggcgtcagccgactgcacggtggccagcacgttgccggcgtagatcgggcgcacgaaggtgtcggccgattcgatggcgacgatttcggaaatctgggcgacatccagcagcgcggcgacgcgcggcagcaggttcttgccgaaggacgaagccggggccagcacgtggctgtagcccttggccaggtccaccgccagcgcggacaggctttcggccaggccgtgcgcgtagtgggcggcgtcggccagcagcaccttggccacgccggccacgctcttggcggcgtcggcggcggcggcggcgttgtggccggccaccagcacgtgcacttcgccgagcttggcggcggcggtgatggtgttcagggtgcctgctttcaggctctggttgtcgtgttcagcgataacgagaatagccatgtcttacagcacctttgcttcgttcttgagtttggcgaccagttcggcggcgttggccaccttgatgccggcggaacgcttggccggctcggccactttcagcgtcttcaggcgcggagcggcgtcgacgcccagatcggccggcgtggtcttgtccagcggctttttcttggcggccatgatgttgggcagcttgatgaagcgcggctcgttcaggcgcaggtcggcggtgaccaccgccggcaggcgcagcttgacggtttccaggccgccgtcgatctcgcggatcacttcgacggtttcggccgccacgtccaccttggaggcgaaagtgccttgcgcccagcccaacagcgcggcagtcatctggccggtctggttggcgtcgtcgtcgatcgcttgcttgcccagaatcaccagttgcggctgttctttgtcggccaccgccttcagcagcttggccaccgccagcggctgcagttcggtgtcggtttccaccagaatggcgcggtcggctcccatcgccagcgcggtgcgcagggtttcctcgcactgcttgacgcccatcgaaacgacgacgatctcgctgaccttgccggcttccttcagacgcacagcctcttccacggcgatttcgtcgaacgggttcatcgacatcttgacgttggcgatgtctacgtcactgccgtcggctttgacgcggactttcacgttgtaatcgacaacgcgcttcactgcgactagaactttcatattcctccagcaaacatctgtgggttaatcgaacgcggaaggcaacgacggccagctgagcctgattatgccccaagcaaaattcaaacgagcgtttggtttgtgcgccagcgcatggcgcgtggtgaaaatgcaactcggcgtcgatagtacgccatttgccggtggtttgcatttcaggcggaagctgtcacaatgcaccgcagcatttccctgtcataaccagcgggagtcctcatgaccgtctatttcgaagacatcgccgtcggcgacagcgccgaagccggcagaaccctcaccgaagccgacgtgctgctgttctccgccgtcagcggcgacaacaacccggtgcacctgaaccaggtttacgccgccgccaccaagttcgaaacccgcatcgtccacggcatgctgaccgccagcctgatctccggcgtgatcggcacccagctgcccggctacggcaccatctacctgtcgcaatccacccgcttcaaatccgcggtgcgcataggcgaaaccgtcaccacccgggtcagcgtggtggagctgtttccggaaaagaagcgggtcaagctggccacccagtgcctggtgggcgacaaggtggtgttggaaggcgagtcgctggtgatcgcgccgtcgcgcggctgagtcaacaggactcgccgtgccgggccagcgcccagcgcaccggttcggccaccagctcgtcgggaaaatccagccgccgccgcaaggcggcgatcacttccgcagagctaggcgcattgcccagccccaccgccagattggacagccatttgtgatagccgatgcggtaaatgggactgcccgccatccgctcgcgaaaatcgtccgcgctccagccgaacagttctaccagactcacgtcgtccaaaccatgacgcaccgcaaaatcggtttccgccgtctgcaccgcgaaacggttccatggacagaacagctgacagtcgtcgcagccgtacactcggttaccaatcaaagggcgcaatgcctggggaatcgcggccttcaattctatagtcaggtaggaaatgcagcggcgggcatccactgagtacggctcgacgatggcgccggtgggacagacgtccaggcacttgcggcagcggccgcagtggccgtcctcggtgtcgtcggccggcagcggcagatcggtgaggatttcccccaggaagaacagtgagccctggcgcttggtcagcagcaaggtatgcttgccgcgccagccaaggccggcctgcgacgccagcgccacctcggccagcggcgcgctgtcggtgaacacccggtagccgaaagccccggcggcggcttcgatgcgttcagccagcttctgcagccggttgcgcagcaccttgtggtagtcgcggcccagcgcgtagcgcgacaggtaggcgcgcgacgggtcggccagcacttgctcggcggcccgcgccgccggccaatagttcatccgcagcgagatcaccgacagcgtgcccggcaccagctcggcgggccgcaggcgcagcgcgccatggcgttccatatactccatctcgccatggaagcccgccgccagccaagccgccagccgctgctcggcctcggccggcaggctggcgcgagtgatgcgcgcctcggcgaagccggcctcgacggcccaggctttgatttggcgcgacaattcgggataatccggtttttgaggaggattctcagtcatggcgatggatgataccagcgttcacagcggcagcttgccggacgagggcgcgaccctggcgctgggcgcggccttcgccgccgccgcagcccccggcctgaccgtccagctgcacggcgacctgggcgccggcaagaccaccttcacccgcggcctgctgcgcgcgctggggcatgccggcaaggtgaaaagtcccacctataccctggtggaaagctacgcccttaacgaatatagtgtccaccatttcgatctgtaccgcttcgccgatccggaagagtggaacgacgccggcttcagcgaatacttcggccaggacagcctgtgcctggtggaatggccggacaaggccggcgacctgctgccgcccgccgacatcgtgctggaacttgccgtagccggcgagggtcgcacttatcatttcaaagcccagactcaaaccggacagtcatgcctcaatcgactttcgaccccaagcgccgcgcgctgctaggcgcagccgccgccacctttttgctcgccgtcagccgcaatggtttcgctgccggcagccagatcgtcgccctgcgcatctggccctcctccacttacacccgcatcacgctggagtccagcgccgccatccagtacaagcagttcacgctggccaatcccagccggctggtgatagatctgcaaggcgtgcagctgaacggcgtgctgaaggacatcagcggccagatcgccgccgccgatccctatatcgccaccgcccgcgccggccagttcgaccaggacaccgtgcggctggtgctggaactgaaaaccgacgtcaagccgcaggccttctcgctgacgccggtcgccgaataccagcaccggctggtggtggacctgtacccggccagcggccagcaggacgacccgctgctggcgctcttgcaggactacaacaagggcaagctggaacagccgccggcgcaagtgaagcccaaggccaagaacaacggccgccccatcatcgtgatgctggaccccggccatggcggcgaggaccccggcgccatcggcatggtcggcacccgcgaaaaggacgtggtgttgaagataggtcatcagctcaagcagctgatcgacgccgagccgaatatgcgcgcctacatgacgcgcagcgacgacgtcttcatcccgctgggcgtgcgggtggcaaaagcgcgcaagctcaacgccgacctgttcgtctccatccacgccgacgccgcgcccaaccgcgccgcccgcggctcgtcggtgttcgcgctgtcggaaaagggcgccaccagcgccttcgccaaggcgctggcgcagacgcagaacgactccgacctgatcggcggcgtcaagataggcagcaaggacaaatacctggcccacaccttgctggacctgacccagaccgccaccatcaacgacagcctgaaactgggcaagacggtgctgggccagctgggaggcctcaacaagctgcacaagaacgcggtggaacaagccggcttcgcggtgctgaaagcgccggacattccgtccatcctggtggaaaccgccttcatctccaatccggacgaagaacagcgcttgctgaccgccgaattccagcagcagatggccaacgccatcttcagcggcgtcaagcactacttcgcctccggcgccgcgctggccgcccgcgcctgagcgcgccgccccaaatgaaaaccgccggtctctgccggcggtttttttatcgtctgacgggcgcggctcaatgcgccggcggcagggcgtcgcctgacggcgactcttcctcggccggcaccttgtacgactcgctggcccattgccccaggtcgatcagacggcagcgctcgctgcagaacggacggtagcggctttgcggctcccagcgcacttctgcgcggcaggtgggacaggcgacgatgcggacggaatcggacatgaaactcagaatttgcaattggtgaggtaaaactcgacatcctgctcgatctggcgcggccgggcttcgccggtgaccgcgttgatgaagcggatgttgagcgcgtatttgttggccgacagctcgggcagcaattcgagattgtcatcgtaggcgacgcggatcagctgcaccaccttgccgcccgacatctgctggaacgcgcccttgcgcgcgacgtaatgatgggtcttgccgctgtcgcgcaacagccgcagcaggatgtccgacgcgtcggcggtgggcatcagcggcgccgcccagcgcagcaggtcctggcggcgcgtctccgccgagcgctgctgccacaggtgataggacggcaggtcgaactggcaggtgccgccgggaatgccggcgcgctgcttgatggccatcagccattcgttctcgcgcaggttctggccgaatttccctgtcaatgccagcagcttgcccgacgcccgttcgatttcctccagcacgccttccagcgtctcctcggccacgttgggattctcgcgcagcgcctccagcacctgcttctgccgctccagctcctgcagcagatccgctttgagatcggcgcgcgaggcggtctccatcagctcgaacaacaccagcagcgcggcgtggtgatcgtaagggtcatccttgccgacgaagtaggacagccgcccatacaggtattccaggcgaagcagaatacgggtgcgctcggtgacaggaaattcaaaactgatcacggcagatctgcccttctccaaggcttgcagcaagcctataacaatgcattgacaagatttgccagataataactgtgtttggcatcaacttgaagcctcaattctgccaagccgccattgttgtcgatgatatcgtcggccaactggcgccgacgctcccgcggcagctgcgcggccatgatcgcgcgcaccgcgctttcctccaggccgctgcgccgcatcaccctttccaactggatctcctcgcgacaatccaccaccaggctgcgcgccagcaagggcgtgtagcgctcgctctcgaacagcagcggcaccaccagcagcgcgtaatcgccgcgcgccgccgccagctgccgcaggctttcctcatggatggcgggatggaggatcgcctccagccggcgccggcaagccggatcggcgaaggccaattcgcgcatcgccgcccggtccagcgcgccgtccgccgtcagcgccgcggcgccgaattcgcgcgcgatcgccgccatcgccgcgccttgcgggccggtcagctgatgcgcgatgcggtcggtatccaccaccggcacgcccagctcggcaaacctgtcggccgcggcgctcttgcctgagcctatgccgccggtcaaaccgactaccgggatagccatgtcaaatatccatttacgatttgcggcccccacaccagcgcgatccagccggcggcggcgagataggggccaaacgggatttcctgaccggggccgatccgcgaggcgcagcgcatcgccagcccgcacaccgcgcccaccagcgacgacagcagcacgatcagcggcagcatgccccatcccagccaggcccccagcgccgccagcagcttgaagtcgccgtagccgaagccattcttgccggtcagcagccggaagccatggaacaccagccacagcgacagatagccgaatgccgcgccccatatcgcatcgctcagcggcaccaagccggtgtgcaggttgaaaagcaagccgccccacagcagcggcagagtcaggctatccggcagcagcttggtgtccagatcgatgaaagccaaggccagcaggcaagccgtcagcgccaaagcgccggccagcggccagccccagcccagcgtccaggccagaaaaccgaacatcgccgcgcacaatgcctccaccagcgggtagcgcaggctgatcgcgacgccgcaagcgcggcaacggccgcgcagcaaaacaaagctcagcagcggcacgttctgccagggccgcaccggcgcgccgcaagccggacaatgcgagccgggccgccacagattgcagcccgcctcgccctccatcgccgccgccgcgccctgcgccgccagccgcaattcgggaaagcggcggttttccgccaggtattcgacgctgtccgccaaaaactcgccatccagcatctgcggcagccggtggatcaccacattgagaaagctgcccaccaataagcccaacaccagcgccacgcccgtcagacaacccggatgcgtggccagcaaccacgtaatatcctccagcatcaacccaccacctgacccattttgaagataggcatgtacatcgcgatcaccagaccgccgatcaatacccccagtatcaccatgatggccggctccagcaggctggacagcgcggccaccgcattatccacttcttcttcgtaaaagtcggccaccttgtccagcatctggtccagagagccggactcctcgcctatcgaggtcatctgcagcaccatattggggaacagatcggtgcgctgcatcgaatagttgagactggatccggtgctgacatcagcctggatccggcgcgtggcctcggcgtacacctggttgccggcggcgccgcccaccgaatccagcgcctccaccagcggcacgccggcggaaaacagcgtggacagcgtgcgcgcccagcgcgcgatggtggccttgcggatgatgtcgcctatcaccggcagccgcagcaggatgcggtccatctgctcctgcatcttgggggtgcgcttgaacgcgtaaaagaaggcgaacaggccgccgaaaatcgtgccgaagatcagccaccagaaatggacgaactgatcggacagccagatcacgaacagcgtcggcgccggcagattggcgccgaagctggagaacaagtccttgaaggccgggatcacgtagatcatgatcaccgcggtgatgatgaaagcggtgccgacgatggccgacgggtagatcatcgccgacttgatcttggccttgatcgccatcaccttttccttgtaggtggcgagcttgtccagcagcgtgtccagcacgccgccggtttcgccggcggcgatgatgttgcagaacagcttgtcgaaatacagcgggcgcttgcggaaggcctcggccagcgacagcccggtttccacgtcggcgcgcacctccagcagcatccgcgtcaccgccggattgctgtggcctttcgccgcgatgtcgaaagcctgcagcagcggcacccccgcccgcatcatcgtcgacagttggcgcgtgaacaacgcaatgtccttttcggtgatccgcttgccgaagccggtgcggcgcttgcggattttggatacgttgatgccttggcgccgcaattgagtcttggccacggtttccgactcggcgcgcaattctccgcgtatcgccttgccggcccggtctttcccttcccattcccagatgtagccgggattcgtctttttcgcagctgtcgtcgccatcgatccaaccttccctgtctgcatgccatccgcgcttgaagaccgtacgcgctcagtcgttggtcaccgcttcgatttccgccagcgaggtcaccccgcgcttgaccttgagcaagccggcgtggcgcaaatcaaccatgccctcctgcagggccaggtcggaaatatcgaccgcggtgccgtttttcatgatcagccgcgtcatcgcgtcggtgatcggcatcacctcgtaaatgccggtgcgcccgcgatagccggtattgcggcactcctcgcagccgaccgggccatagggctgccagctgccgtccaggtcttccttgcgaaagccggcgcgcagcagcgcctcctccggaatgtcgaccggcttcttgcaatggctgcacaggcggcgcgccagccgctgcgccatgatcagcagcaccgagctggcgatattgaacggcgccacccccatgttcagcatccgggtcagcgtcgccggcgcattattggtgtgcagggtggaaaataccatatggccggtctgcgccgccttgatcgcgatgtcggcggtttcaaagtcgcggatctcgcccaccatgatcacatccgggtcctgccgcaggaaagccttcagcgccgaagcgaaagtcaggcccgcccgctcgttgacgttgacctggttgatgccgggcaggttgatctccaccgggtcctccgcggtggaaatattggtgtccggccggttcaaaaggttaaggaaagtatacagcgacaccgttttgccgctgccggtcggcccggtcaccagcaccatgccgtagggacgcgctatcgtcgtcatcagcagctgtttttgttccggctcgaagcccagctgctcgatgtccagcgtcgccgccgacgaatccagtatccgcatcacgatcttttcgccatacagcgtcggcagcgtgctgacgcggaaatcgatggcgcggctcttggagatcaccagcttgaggcggccatcctgcggcagacgcttttccgaaatgtcgagcttggaaatcaccttgatgcgcgaggcgatcttttccttcaggatcagcggcggctgcgccacctccttcaactcgccgtctatccggtagcgtatgcggtaatacttttcatacggttcgaagtggatgtccgacgcgctgccggcaatggcgtccagcagcatcttgtggatgaatttgaccaccggcgcgtcgtccacctccacctggggaccgctgtctacctgggcgtccggatcggcgaactccaggtcgccgaaatcctcgttttccagctccttcagcgccgaggtggaattgtcctgatagcgtcccagcgtcttggacagcttgtcatcctcgaccacgacgatttccaccgtcagaccggtcttgaaggtgatcgcgtgataagcggaagtctgggtggggtcggaagtgccgatatagagcttgttgccgcgcttgagcagcggcagcaggcgccggctggcgatcaactcgtcgtcgatcagccccttgggcagctgttcggtatccagagagctcatgtccagcaaggggtagccgaaaacccgcgacgcgaataccgcgatgtcccgcgcgctcattttcttgctgagtatcagttgctcgacaaaagtgatatgcgaagcgcccgcctggcgcatgatggcgtccgcgtcctgctgcagcagcatattgtgctgaaccagggccctacccaggccggaaatccctgccgaagcttccataggcgaaatcgatccagttttgacgttgtggtcacgatcaggcgcaggctgtgacgatattatatgcaaaatccggccgcgcctccgccgcgaatcccgccaggcctgccgcggcatccgaatcgggtggggcaaacgccatattgccatgaaaaagggactgccgaggcagtccctttccgataggcgaagcgccggatcagaagtggtgaatcaggccgaggccgaaggagctttcgttttgcgcgccttgcagcttccagttgacgtggccgtaggaggtgtagacgtcggtgcgcttggacaccgcgtaatcaaggcccagcacccattggtcgtagccggagttgctcacgtcgccgaagttcgccaagttgacattgtaacccttggcatagctgaggtacggagtgaaagcgccgaaggtgtagccgccggtcagcgcgatttcacgcgtgcgccccagttgcaccgtcttggaattcaccagccccggattctgcgcaaccaggccagccaagttcgcgctcgcggcgttgccgttgtacagcagcccgccattgtcggtaatgctggtagccacgccgcccgccgagttgatgcctacatagccgcgcacttgctggaagcccaaggctacgtagatgttgttggcgttatagccgccctcgaagcggtgccagtccttcagcgaggccagctcgctcggggaaccccagctgccgaagttgtacttgccgaagaagccggagttttcatagctcaggccgatgttggagaactggccgttggtcacgatgccggctacgttcttgcgagcctcgtccgccgcgtacagcacggagatgttgaagccgtagaactcggggccgtcgtagcggacggcgttgttgtggcgaccgtccacgcgggtgaacatcgccaggccgcccacgctgggcgcgccgccgaatgtcgcgccgccattgttggagtaatggcccgggtcaacctgctccatgtcggagttcgcgtagtcggacagtttgccgacgcgcaccttgccccagctgtcgccggccaggccgatgaagctgtcgcgggtgccgaagccggtgctgttgctgccgtccatgttcaggcggctttccacctgccagatcgccttcaggccgctgcccaggtcctcattgcccttgaagccgatgtaggagacccagtcattgatctcggtgcgggattgcaggccgccggcctgcagcgcgccgccgaacgacgtggtgttggcgttgtaggttttcagggattcgacgccggccgcgatggtgccgtagatggtgacgtccgccatggcggcggcaggcagggcggccagtgcgagtgcgatgagcttcttgttcattgcagatcctttcaagtcagttgattttgtcctgttgacttcgcggcagcgccgtctgtccggacatttatgtgccgacggtatattccgccgatcgctgaaagcaatataagaccggcgttgcaaaaaaacaaagctcacccaggaaagaccagtgaaaattaccaaaaaaacaacagcatcccgctaaaccattgttaacaaatagttctaactcgaccagaacctgccaaacggcgatggaaaaacaacaaaaccatccaattgtttcaatttcacaacagttaatttcccgccacggccggttttcccaacccgccataaatcgcgaatgcatgaaaaaaccgccagtcggcggctcgctgactggcggtgatgtcggccgcgccggaaaggccggcgcgaatgcggggaaactacttggcggccaccggcttggcgcccggtttggcggccggcgccgcgccgcccacggtcaggtccttgcgcagcttatccagcgtcttgtcgccgatgccggaaaccttcttcaaatcatccaccgtcttgaacggaccgtttttggcgcggtagtcgatgatagccttggccttggccgggccgattccctgcagcgcctccagttgcggcgcggtggcggtgttcaggttgacggcggcccaggcgaaattgcacagcagcatcaggccggcaaaggcagcgaacagcttcttcatggcaaactccttgattgaaggtgcaagacgggttttgtcattgaatggacatcgcagcgctcagccgcgctgcaggatcaattctaaaaccaccttgctgcccacgtatgccagcatcaatgacaggaaaccggccagcgtccagcgtatcgccaccctgccgcgccatccctgcaggcggcgccccagcagcaaagccgcgaacaacagccaggaaatcacgctgaacacggttttgtgggtcagcgcggcggccttgccgaacacctcttcggagaacaccacccccgtcaccagcgccacggtcagcagcaggaagccgacggcgatcacctggaacatcattttttccagcgtcagcagcggcggcaactgccgcgccagcagcgacatccgcttatggtgcagcgaacgctccagcaacagcatcagcaccgcgatcagcgcgccgatggcgaacaggctgtaggccagcatcgacaccaggatgtgcagcacgaaggccggattggacaggtcgctcaccatgtgccggccggggaaggcgatggcgaaggccagcgcggccatcgccagcggcatcatgaacagctgcaggccttccactcgataaaagaagctgcaggtccagtaaatcagcagcatgatccataccatcacccccagcgcgtggccgacgcccagcgacagaccgccgctgacgctgagcggcgccaccaccaccagcgcctgcaccagcaacagcacgccaagcaggctgtgctccaccctcggattgcgcggccagcgggccgtgccccgccagttggccaggtagtgccaggtaaacgccccgtaggacaggatcaggaacagcgacaaaacgagcaggatgctggtcatattatttatggagtgtgatcaaatccgggcgctcacccggcggctcgtggtaaaatcgacagtttgaaagtctacaccaacctgccgtccggtggcagagagtaaggacagcaccatgctagacaacctgaccaaccgcctgtccggcgtgatgaaaaccttgcgcggcaacgcgcggctgaccgaatccaacatccaggacgcgatgcgcgaagtgcgcatggcgctgttggaagccgatgtggcgctgcccgtcgtcaaaacctttatcgcccaggtgaaagagcgcgcgctgggccaggacgtgatgggcagcctgaccccgggccaggcgctggtcggcgtggtcaacgaagagctcgtcaagctgatgggcgacaagaacgacgagcttaacctggccgccgttccccccgccatcgtactgatggccggcctgcagggcgccggcaagaccaccaccgtcggcaaactggccaaaaggctgaaggaaacccagaaaaagaaggtgctggtggtttcggccgacgtctatcgtccggccgccatcgagcagctgaaactgctggccgcgcaggtcggcgtcgaatggttcccgtccgacgcggcgcaaaagccggtcgacatcgcccgcgccgcgatagaccatgcccgccgccacttcttcgacgtgctgctggtggataccgccggccgcctcgccatcgacgaagcgatgatggacgagatcaaggcgctgcacgccgcggtcaatccgatcgaaacgctgttcgtggtcgacgcgatgcagggccaggacgcggtcaacaccgccaaggccttcaatgaagcgctgccgctgaccggcgtgatcctcaccaagatggacggcgactcgcgcggcggcgccgcgctgtcggtgcgacacgtcaccggcaaaccgatcaagttcatcggcgtcggcgagaaggtcgccgccatcgagcccttccaccccgaccggatcgccagccgcatcctgggcatgggcgacgtgctgtcgctgatcgaggaagtgcagaagggcatcgatcaggacgaagccgcggcgatggccaagaagctgaagtccggcaagggtttcgacctggaagacttcaaggcccagatgcagcagatgaagaagatgggcggcatgtccaatctcttggaaaagatgcctgggcagatcggccagatggccaagggcatccagggcgccgaggcggaaaaatcgatgcgccgcatcgaaggcatcatcaactcgatgacgccggacgagcgccgcaagccggaactgatcaaggccagccgcaagcgccgcatcgccaccggctccggcgtgacggtgcaggaggtgaaccgtctgctggcccagttcgagcagatgcagaaaatgatgaagcagttctcctccaagggcgggctgatgaaaatgatgcgcggcatgaagggcatgatgcccggcatgtaagcgaaaacaaacgggcgccagtcgcccgtttgttttgagatgaagacaagctgcgaatcggcggcaagcccgcgccgacccgctacattgaatagcacgcagcgaaggcatggccgacatgcccgacgcccggcttagcgccgtttgtattgcaacctgccgctgtttggcaaaccacgtttggaaataccccgcatgaatctgactacgttgaccgccctgagcccgctggatggccgctacgccagccaggtcgaagccctgcgcaacctgttctccgagttcggtttgatgaaatgccgcgtcaaggtggagctggaatggctgaagatgctggccgccgagccgggcatcgaagaggtcaagccgttctccgacgccaccatccgcgaaatcgacgacgtgatcgccaacttcagcgtcgagcacggcgaagaggtgaaggcgatcgaagtccgcaccaaccacgacgtcaaggcgatcgagtactggctgaaggaacgcctgtcgggcaacccggaagtgatggccgccagcgaattcatccacttcgcctgcacctccgaagacatcaacaacctcagccacgcgctgatgctgaaaaccgcgcgcaacaccgtgctgctgccgacgctggacgaagtcatccacaagctgcagaagctggcgcacgagctggcgaatgtgccgatgatgtgtcgcacccacggccagccggccaccccgtcgaccatgggcaaggaactggccaacgccgttcaccgcctgaagcgccagcgcgaacagctggtgcaccaggaaatcctgggcaagatcaacggcgcggtgggcaactacaacgcccacctggtggcctacccggacatcgactgggaaagcctgtgcggccgcttcgtcaccggcctcggcatcaccttcaatccgtacaccatccagatcgagccgcatgactacatggccgagctgtaccaggtggcgatgcgggtcaacaccatcctgatcgacctcaaccgcgacatctggggctacatctcgctgggctacttcaagcaaaaggtgaagaaagacgaagtgggcagctccaccatgccgcacaaggtcaacccgatcgacttcgaaaactccgaaggcaatctgggcatggccaacgccatcatgggccacctggcggaaaaactgccgctttcccgctggcagcgcgacctgaccgactccaccgtgctgcgcaatatgggcgtcggcttcggctacaccatgctgggcctgaagtcctgcctgaagggcctgaacaagctggagatcaacccggcgctgatcgccgccgagctggacaatgcctgggagctgctggccgagccggtgcaaaccgtgatgcgccgctacggcatcgccaacccgtacgagcagctgaaagagctgacccgcggcaagggcggcatcacccgcgagacgctgcacgccttcatcaagagcctggacctgccggaaagcgtcaaggcctcgctgctggagctgaccccggccaactacctgggcaaggccgaggagctggcgcgccgcatctgacgcgccgccgtcccgcaccgccacgcgccgcctgcctgcaggcggcgtttttcattgccgcgcgccgcgcgcgcatccccgcctccatccgctgcggcatgttcgccgcacgcgcctggcccatcccgccgcctatcacagaattttgtagtcaaaaaggtaattgcacctgacaatgtagtgtgaataacaccaaaaattatcaaaaaagcttcgctgcaacaggacgcaaggccccgcgccggcgcaaccacccctcacccgggtaacctgaatagagaatggatgatcatgcaatcaatgtacgaccaatcctcgaacaccccatccaccgacgacaacgacgccgcgaccgcctccccgccgccggtgtccgcccgtcacctgctcagcctgaacgagcgcggccatgccgggctgtaccagtacttcatcgagcacgacaccaaccgcatcctgcagcatctggacacgctgcgcggcatggccttcacccaggacgccgaagacggccaggtcggcccgccggagcggccgttcccgtcggtctgcctgatcggcctcggccgctgcggctccaatatcgcgctggacgtggcgacgctggtctacaacgcccgcaagttctacctgaacgagttcaaccaggacgacaagagcgcgccggaacaggagcagcggccgcggcgctggatacgccgcaacctgctgtcgccgcacaaggcggccaagccggccttcctgatcgagccgatggtgatgctgggcgacctggacaaggacatcaagggccgcatccgcttctcgcgccgcggcgagcagggcgacttcatcaacaactacaacaagctgaagatcatggacctggccgaggtccacgccggcggcgccggcaacgcgccgatactgggccaatacctggccaagatcatcctcaacaaggacacgctgagcttctccgatccggactggacgctgatccattcctatctggtggactcctgcggcatcaaggccaaccagtcgcggctgtacttctacatcttcagcgccggcggcggcaccggctcgggcatggcctcggaattcggcctggcccagcagtacgcctacatgagcaagaccttcgaaacccgcagcgaaggcaagccggagcaagccgacgactacagcttcgtattcgagcccatcttcaccagcggcatctgcatcctgcccaatatctccggccagcacgccgagggctcggaagcgctgcacatcaacgccggccggctgctgtgcaaatacctgtcggaagagtgggacttctcctacaacttcgacaacgaggaagccggcgccgaaagcgtgatgcgtcggatccggccgtggaacgcgatgatgctgatctccaacgacatcatgcgctacgccgaggaaaacgacgccggcagcatcgaaaacctcgacgtcaacgcgatggagcgccacgccaaccagtacatctcgcagcagatcttcaacatcctcaccgcccaggccgtcaccagcgactacgacgaaaactacttcctgcgcgccggcatcgacatgggcgaaaccatacggctggacgccaacgacctgttcatgagcctggccggcccggtggcggtggcttacgccgaatcggtggtatccgacccgctgggatcggacggcttcgtcaacaagctggacatcgacgacctgttcttccgctcgatcgacctgccgcacttcaaccagcagacccaggcgatagaaggcatcagcctgctgccgatagaatcggccagctaccgcgcggcgctggccgactacaagcagtccggctacgcggcggaaaaactgaaccagctgttcttcttccagaactgctcgtcggtggtggccatcctgtcgctgcccaagggctacaagctgtcctacctggacctgaaccgcctgaagcgccacctgaacgacctgttccccagcaccacgctgaagcgctacgcgctggtgataggcgcgtccaccaatctgtccctgaccacgctggtggcgaagagcccctgcctgagcgacgacttcctcacgctgatcgtcgccttcatcaagcgctgcttcgcccacggcaaccaccgtttcgacgacagcctggacaagacgatactggacctgatcaccgccgagcatttcgatgaaacggtgctggagcggctgctgaacgagtacgagaatccggccaagatcctcgacaccaactggttcgccatcaagccgatgtacgagaagaaataccgcgagctgatccgcgactccaagaagttcgtctcgatcaacgacatccgcctgacccgcgagcacgtgcaaaaagcggtgtgttatctgcgcgagatctaccgccaccgcatcggcaagacccgggtggtttcgctcaacacctacgcccacagcaagcacgcctgagccgtccggcgcgccgctgccaaccccgccgcgcccgatgcgccgcggggtttttactagccgaaatagtaaagtagattatttttttactacgatgggaaaaagtgtcaacggcatggccgcctggccagttaatgcagcttggacccctggcgatgcgccgcggcgtccgcaagcacaatccggccccaaaccgcgccaaagctgacataagctgcaacaagggcggcccggattgccatcggcaccaccggccagcccgcgcggctcatgcctgcttgggcggccgctcgccgcccccagccatgcgcccgccgcgcgcgccgcaatcaagaggcaacacgtccagatgtggattgtagaaacggccctgaaacggccctataccttcatcgtgatggccatcatcatcctgctggccacgccgctggcgatcatgcgcacgccggtggacgtgctgccggaaatcgacattccggtgatcagcgtgatctggggctatggcggcttgccgccgcagcagatggccgaccgcatcacccagattcatgaacgggtgctgaccaccaccgtcaacgacatcgagcacatcgagtcgcaatcgctgtccggcatcgccatcatcaagatcttcttccagcccggcgtcaacatccagaccgccatcgcccaggtggtggcggtgtcgcaggcggtggtcaagcagatgccgcccggagccaccgcgccgctgatcatcaagtacaccgcctccagcgtgccggtgatccagctggggctgtccagcaagacgctgtcggaacaggacgtgttcgacaccgccgtcaacacgctgcggccgcagctggtgacgataccgggcgtcgccatcacctatccctacggcggcaaggtgcgcctgctgtcggtggacctggacacccgcgccatcgccgccaaggggctgacgcccgccgacgtggtcaacgcggtcaacgcgcaaaacctggccctgccctccggcaccgccaagatcggcggcaccgaatacgatgtggcgctgaacggctcgcccgacagcatcgccggcctcaacaacatcccggtgaagacgacgaacggcgccacggtattcctgcgcgaagtggcgcacgtgcgcgacggcttctcgccacagaccaatatcgtcaagcaaaacggccagcgcggcctgatgatgtcgatctacaaaaacggcggcgcctccacgctggacgtggtcggccacctgaaggaaaagctgcccggcctgttgccgctgctgccgaagggcatccaggtcagcctgctggccgaccagtcgatcttcgtcaaaaccgcggtggaaggcgtgatccacgaggcgctggtggccgccgcgctgaccgcggtgatgctgctgctgttcctcggcaactggcgcaccacctccatcatcgccgtctccatcccgctgtccatcttctcgtccatcgtcgcgctgcacgcgataggcgagaccatcaacgtgatgacgctgggcggcctggcgctggcggtgggcatcctggtggacgacgccacggtgacgatagaaaacatcgagcgccacctgcacatgggctcgccgctgtacaccgccattctggacggcgccggcgaaatcgccatcccggctttcgtctccacgctgtgcatctgcatcgtgttcgtgccgatgttcttcctggaaggggtggcgcgctatctgttcgtgccgatggccgaggccgtggtgttcgcgatgctggcttcctacgtgctgtcgcgcacgctggtgccgacgctggcgctgctgctgatggggcaccagcaccgcggcggccgcgtcgacgcctggatccaccgcgtgcacgagcgcttcaatgcccgcttcgagcggctgcgcgaaacctatgtgcacctgctcagccacctcttgacccaccgcaagcgcttcatcgccggcttcctcggcttctgcctggcctcctgcgcgctatacctgctgctgggccgcgacctgttcccggaagtggacaccggccagatcaagctgcacgtgcgcgcgcccaccggcacccgcatcgagaacaccgccatcctggccgaccaggtggacgccgaaatccgcaaggcgatcccgccggaagacctggactccatcatcgacaacatcggcctgccctacagcggcatcaacctgtcctacagcaactccggcaccataggcacgctggacgacgaagtgctgatctcgctgaagcccggccaccgccccagcgcaggctatgtcgacgcgctgcccaaggcgctggaaaagcgcttccccggcgtggagttcttcttccagccggccgacatcatcacccagatcctcaacttcggctcgccggccgccatcgacgtgcaaatcgtcggcaagagccaggccgacaacgccgccttcgccggccggctgctgacccggatccaggcggtgccgggcgccgccgacgtccacgtgcaccagcggctggacgcgccgtcgattcggctgaacatggaccggacccggctgcagggcatgggcatcgcgccgttcgacgtggcgcagaacctgctgctgccgctgtccggcagccagcagacccagccggcgttctggctgaatccggccaacagcatcgtctacaacatgcaggcgcagacgccgcagtaccagatcggcaccctggaccagttgatgcagctgccgatcaacccgcccggcggccacgccgccagccagcagacgctgggcaatctggtcaccgccgcgccgggacgcgaagccgccatcgtcacccgctacaacatcctgccgtcgatcgacatctacgccagcgcgcgcggccgtgacctgggctcggtggccgccgccatccagcgcatcatcgacgaggaaaaggcccacctgcccaagggcagccagatccacatgcgcggccaggtggaaaccatgcagtcctcctacctgggcctgtcggtcggcattctcggcgccatcgtgctggtctacctgctgatcgtggtgaatttccagtcctggctcgaccccttcatcatcgtcagcgcgctgccggcagcgctggccggcatcgcctggatgctgattctcaccggcaccgacctgtcggtgccggcgctgaccggcgccatcatgaccatgggggtggccaccgccaacagcatcctggtggtgtccttcgcccgccagcggctggacgagggcctgccgccgctgtcggccgcgctggaagccggcgccacccggctgcgcccggtgctgatgacggcgctggcgatgatcataggcatgatcccgatggccatcggcttcggcgaaggcgccgagcagaacgcgccgctgggccgcgcggtgataggcggcctcctgttcgccaccgtctccacgctgctgttcgtgccggtggtgttcgccagcttccaccgccatctggccaaacgcaaacaacaggcggccgacgcgccggctgccgcacaggacgcatgacatgaccgaatcccgccatgcccaccagggcctgcccgaactgcatttgcaccatgaacgccgcggcgcggtggcgcgcaaggcccgcgtcgccgccgccgtgatcgtgatcctgctgctggccggcctcgcccgcacgctgctggtgcgccacgccgacgccgcggcgctggcccgggaggccgagcgccgcgcggtgctgaccgtcagcgtggtcacgccgtcgcccgcccgcgccgacgcccgcctcaccctgcccgccacgctgcaaggcatggccgaggcgcagatctacgcccgcaccaacggctacatcaagcgctggtacaaggacatcggccagccggtgaaaaagggcgagctgctggccgagctggacattcccgacatcgacaagcaggtgcaggaagcccaggccaatttcggcctggccaaaaccgcctacctgcgctggaagacgctgcgcgcgcaggacgcggtgtcgcagcaggaactggatgagaaggaaagcgcctaccgccagaccgaggccgagctgaagcgcctgcgcgaccagcaagacttcgcccgcgtcgtcgcgccgttcgacggcatcgtcacccgccgcaacatcgacaccggcagcctggtcaacgccggcaacggcggcagcgcgcaggccctgttcgccaccgcccagatcgaccgcctgcatctgtacgcctacgtgccgcaagcccaggccggcgccatccgcgtcggcgacaaggccgacatcgcgcgccaggaagcgcccggccagcctagcgtcggcagggtggcgcgcaccgccggcgccatcgaccccgccacccgcacgctgcaagtggaggtggaagtggccaacgccggccatggcctgctgccgggccaatacgtcgacgtgtcgttcaagctgcccaacggcggcaagctgaccctgcccaccaacaccctgcaattcggcgccaagggcagccgcgtcgcgctggtggacgcccaccaccgggtcaagctgcaaaccgtggcgctgggcaccgactacggccacgaggtggaaatcaaggccgggctgcaagccggcgacaaggtgatcgtcaatccgccggactcgatccgcgacggccaggcggtcgccatcgccgccgccggggagtgaggcgatgcgcgcccttcccctgctgatcgcgctgagccttggcgcctgctccgccgtcggacccgattacgtccgcccgcccagcgaactgccggcgcaatggaaaagcggcgacggctggctgccggccgcccccgccgacgccgagcccaaaaccgaatggtggcgcaccttcggcgacgacgagctgaaccggctggaagccgaggcgctggcgcgcagcccgacgctgcaggcggcgctggcccggctggaccaggccgaagcgcaaagccgcgtccatggcgcggccgcgctgccggccgtcagcctgggcgccgccgccgcgcgcagccgcgtctcggccgaccggccgctgtccagctacggcagcgtcaacagcagcgccgtgcagaacgacctgaagccgacgctcagcgtcagctatgagatcgactggctgggccgggtgcgccgcgacatcgaaagcgcgcgcgccggcgccgaacaagccgccgccgaccgcgccaacgtcgagctgctgctcaccgcccagctggccagcgcctacctgcagctgcgccaagaggacgaggaaatccggctgttggacggcaccatcgccgcgcagcagcgcgtgctggagctgacccgcatccgccatcaggccggactggccgccgccggcgacgaagcgctgcaagcggcggcggtgagcgccagccgcgcccagcgagaattgctgctgaaccagcgccgcgtcggcgaagacctgctggccacgctgagcggcgcgcccgctcccgcctttcgcctggcgcccggcgcgctgccggcggccatgccggcggcgccggccggcgcccccagccagttgctgcagcgccggccggacatcgcctcggccgaacgcgcgatggcggcggccaatgcccagatcggcgtggccaaggcggcctatttcccgcaattgacgctgacgccgacctacgccggcagcgaatcggcgtcgctggccggcctgttctccaccccggcgctgatctggtccatcggcctgcaagccagccagaccgtgttcgacaacggcaagacccgcgccaatgtcggctacgccgaagccggctaccgcgccgcgctggccaattaccgccagaccgtgctgcaggcggtgcaggaagcccaggacgcgctgggcgcgctgcgcggcctggacgaggcgcgccggcagcaggacatcgccgtccgcaatcaggaccaggcctatgccatcacccaactgcgctaccgcgaggggctggacagcgcgctgacgctggccatcgcccagcaaagccagctggcggcccggcggacgctggcgcaactgcgcggcagccagttgatcgccagcgtcagcctgctgaaggccctgggcggcggctggcaaagcggcgattgaattcgcatattctgcaattgcattctgtaaatcgtaataaaactgctacaaagaatggaacaggccgctcggccccttcgggctgagcggacggtttcacagcggcaggctttcttcccctcccccgcggcatcctgccgcgcggcgccgttccaggcgcgatgcccaccgcaaaaccatgtcaataaaatggtcataaactccgtatcggagtacgataaaaaaataccgaccgcagcacttgcatgaaatgggaatatccgcatcctgccaatcggcggatcgcctggaggagatggacgatggaagtcacccgacgccagctgttcaagctgaccgccgcgcagctgggagcatccagcctggtcgccatgggtttcgcgccgcagctggcgctggccgaagtgaggcagttcaagctgatgggcgcgcgcgaaacccgcaacacctgtacctactgttccgtcggctgcggcctgatcctgtacggcctgggcgacggtgccaagaacacgcacggcgagatctaccatatcgagggcgatccggaccatccggtcagccgcggctcgctctgtccgaagggcgccggcctgctcgacttcatccacagccccaagcggctgaaataccccgaagtgcgcgaagccggcagcggcgagtggaagcgaatcagctgggacgaggcggtttcccgcatcgcccggctgatgaaggacgaccgcgacgcgcatatcgtcgagaagaacgccgccggcgtgccgatcaaccgctggctgtccaccgcgatgctgaccgcctcggccggctccaacgaaaccggcatcatctcgcagaaattcatccgcagcctgggcatcgtcgccaccgacgcccaggcccgtgtctgccacggcccgacggtgtcggcgctggcctccaccttcggccgcggcgccatgaccaacagctgggtggacatcaagaacgccgacttcatcctggtgatgggcggcaatgccgccgaggcgcacccggtgggcttcaagtgggcgatagaggcgaaaaagacccgcggcacgcggctgatcgtggtggacccgcgctacaaccgcaccgcctcggtgtccgacctctacctgccgatccgcgtcggctcggacatcgccttcctgggcggcgtgatcaactggctgatccaaaacgacaagattcactgggactacgtcaaggcctacaccaacgccgcgctgatcgtgcgcgaggattatcatttcgacgatggcctgttctccggctacgacgccgccaaaggcaagtacgacaagagcagctggaactacgagctgggcgacgacggctacgccaagaccgaccccacgctgcaacacccgcgctgcgtctggcagctgttgaagcagcactacgcgcgctacacgccggaagtagtcaacaatatctgcggcacgccggtggacggctttctgcaggtgtgcaaggaactgggcgagaccgcccgccccgacaaggccggcaccatcctgtacgcgctgggctggacccagcacaccaccggcacgcagaacatccgcaccatggcgatgatccagctcttgctcggcaacgtcggcatgcccggcggcggcgtcaacgcgctgcgcggccactccaacatccagggcctgtccgacctgggcctgttgtccaccagtctgcccggctacctgacgctgccgagcgaagccgaccatcccgacctggccacttatctggccaagaccacgcccaagagcctgcaggccaaccagttcaactactggagcaacacgccgaagttcttcgtcagcctgatgaaatggatgtggggcgacaacgcgagcaaggaaaacgactggggctacgattggctgcccaagtgggacaagatgtacgacgtgctgcacatggcggagctgatgtaccagggcaagatgaacggcttcatcgtgcagggcttcaacccgctggccagcttccctgacgccgccaaggtgaccgaggccttctccaagctcaagtacatggtgatcatcgacccgatcgccaccgagacctccaccttctggcaaaaccacggcgaggcgcatgacgtcgacccggccaagatccagaccacggtgttccggctgccctccacctgtttcgccgaagaggacggctccatcgtcaactccgcgcgctggctgcaatggcactggaaaggcgccgaaccgccgggcgaggcccgcggcgacaacgagatcatcggcgaattgttcgtcgccatccgcgacctctaccgcaaggaaggcggcaagctggccgaaccgatcctgaaagtgaactggaactaccgcgacccgaaggccccgacgccgagcgagctggcgatggaaatgaacggcaaagcgctggccgacctgccggacccggccgaccccagcaagaccttggtgaagaagggcgagcagattcccggcttcgccgtactgcaggacgacggccgcaccgcctgcgcctgttggatcttctccggctgctggccgcaggccggcaaccagatggcgcgccgcgacaacaccgacaccggcctcggcaatacgccgggctggtcgtggtcgtggccggccaaccgccgcatcctgtacaaccgcgcctcctgcgatccgtccggcaagccgtgggacccgaagcgcaagctgatcagctggaacggcgacaaatgggtgggcggcgacgtgccggacttcaaggccgacgccgcgccggactccggcatgatgcccttcatcatgaaccccgagggcgtgggccggctgttctgcgccgacaagctggtggacggccccttccccgaacactacgagccgatggaaagcccgatcggcaccaacccgctgcatcctaaagttgtctccagcccggcggtgcggctgttcgacagcgacaagaagcggctgggcacgcacaaagacttcccctatgtcgggaccacgtaccggctgaccgagcacttccaattctggaccaagtcggtgctcttgagcgccatcgcccagcccgagcagttcgtcgaaatcggcgaggcgctggcccgcgaaaaaggcatcgtccagggcgacatggtcaaggtcagctccaaccgcggcttcgtcaaggccaaggcggtggtcaccaagcggctgatggcgctgaaggtcaacggccagaccgtgcaccaaatcggcatcccgctgcactggggctgggagggcgtggcgcggccgggctatctgaccaatgcgctgccgcccgcggtcggcgactgcaacacccagacgcccgagtacaaggccttcctggtcaaactggaaaaactgtaaggagccgccgccatgccattgcaatccctggatatcaagcgccgctccgccagcccgaccgaaagccccaaggtccgccagacgctggaagtggccaagctgatcgacacctccacctgcataggctgcaaggcgtgccaggtggcctgttccgaatggaacgacatccgcgaggaggtcggccacaacatcggcgtctacgacaatcccaccgacctgtccgccaaggcctggacggtgatgcgcttcgccgaggaggaaagcaacggcaagctggaatggctgatccgcaaggacggctgcatgcactgcgccgacccgggctgtctgaaagcctgtccgtcgccgggcgccatcgtccagtacagcaacggcatcgtcgatttccaccaggaaaactgcataggctgcggctactgcatcgccggctgtccgttcgacatcccgcgcatcagcaaggaagacaacaaagcctacaagtgcacgctgtgctcggatcgcgtcgccgtcggcctggagccggcctgcgtcaagacctgtcccaccggagccatccagttcggctccaaggaggacatgaaggaagtggcggcggaacgggtggccgacctgcagcggcgcggctatcagcatgccggcctgtacgatccgcaaggcgtaggcggcacccacgtgatgtacgtgctgcaccacgccgacaagccggagcagtactccggcctgcccaacaacccggagatcagccccaccgtgcaattgtggaagggctggctcaagccgctggcgacgataggcatcgccgccgccggcctgttcggcttcctgcactacatcaccgtcggccccaaccgcgccgacggcgatgaggaaaacgaaacccgcgaggaggataagcgatgaaggaaaaactgctgcaacgctacagcgccgccgagcggatcaaccattggatcgtcgccatctgcttcgtgctgctggcgctgtcgggactggcgctgttctacccggccttcttctggctgaccggcgtgttcggcacgccgcagctggcgcgcatggtgcaccccttcgtcggcgtgctgatgttcgtcggcttcttcgtccagtttttccgctactggcggcgcaacctgatcaacggccaggacatccagtggatgctggcggtgaaggacgtgctgcgcggccatgagacggtggaggtgggcaagtacaacggcggccagaaggcgatgttctggaccatgaccctgtgcgtggccaccatgctggtcaccggcgtcatcgcctggcgccagtacttttccggctattttcccatcccggtgatccggctggcgctgctgctgcacgcctgggccgccaccgcgctgatcgccagcatcatcgtccacgtctacgccgcgctgtgggtgaagggcacgatacgggcgatggtggagggggtggtcacccatgcctgggccaagaagcaccatcccggctggtataaggaaatgacggggaagaaatagcgagtgtccgctgcgcggacgacatgtttaggtgccggttccgcccggcagacgggccaggggctgagcggccagccctatcgctgagtgaatcgaagattcacacgcagaggcaatcccaggccgccccaacagcgcggcgaaaccccggcaccaaacccattcccaaggagccgccggaactagcggggcgctaacgtcgccccgcgtcgaacaaccggcgtcttaaaaccttagaaatggctttggagccggcttgcgctgatggggaatcagccacgtcgactcgatcctagcgtcgataaagatcgatttcttacgatgtaaatggcaaacaatctcaaagcctcaatatcaaccatgacacccacccaacccatcctccccgccgagcagatccgcgccggcgacgccccgctgatgagcctgcccgtgctgcggccgccgcccgacatcttcgcccgccgcgccgcgcggctgctgcaattggccgacggccacgcgatggccgattttctgcggctgtgcgccgccatctgccagcaacagcaggcgctgcacgacgcctcccggctggatccgcgctccgcgctggaaaaactgctccagtcgctggagtcggaactgcccgatccggtccggggctctgcgggcctcttgctggcgcaggacgccgccgcgctcagccggctggcggaacatctgctcaacggcgagtatccgacggacggcccgctgttcgccgccttgccgctgctgggcgccgcgctgcaggcgcaggccacgcgcagcatccgccagcgcccgctgcccgagccgcaaagccaacaggcgaggtgcccgtgctgcggcggcctgcccttggcctcgctgctgctgcgcggcgacagcggccatgcccagcgctacgtgctgtgctcgatgtgcagccatgcctggccggtggggcgggtgcgctgcctgtcctgcggcaacagccgggacctgcattactactcgctggcggcgcaggaccatgtccccgccgcgcccgaccatcagcaaccgcaccaggcgcgcggcgcgcgcgaagtggaagcctgcggcgagtgccatggcgcgctgaagcagatctcgctgctgctggacaccagcgcggaagccggcgccgacgacctggccagcctggcgctggacctgctggccggcgaggccggcttcgcccgcatcggcttcaatccgctgtttctgcctggccgggagccggcttgagatccgcccgcacttgagccgcggcccccggcgcgagatacttgccgtcaaaccggcaatcactcgcatggacgcacgcatgacccaccgcatcgtatttgtagaagacgacgccgatctggcggaactgatcagcgacttcctgtcgcgccatgaaatggaagtggtggtggagccgcgcggcgacgccgcgctggacaccatcgcgcgccaagcgccggacatggtgctgctggacatcatgctgcccggcaaggacggcctgtcgatctgccgcgagctgcgccccaagttcgacggccccatcatcatgctgacctcgctggacagcgacatgaaccagatcttgggcctggagctgggcgccaacgactacatcctgaaaaccacgccgccgtcggtgctggtggcgcggctgcgcgcgcagctgcgcaatctgcgcccggcgcaaacggccgcggaagcgcagcagccggccaagggctcgcgcaaggcggtgttcggccagctgtcgatcgacccggtcagccgcgacgtggtgctggccggcgagaagatcccgctgtccacctcggacttcgacctgctgtggctgttggccagccacgccggcgaaacgctgaaccgcgacgtgctgctgaaggaaatgcgcggcgtcagctacgacggcctcgaccgcagcatagacgtggccatctcgcggctgcgcaagaagctgggcgacaaccccagcgaaccgttccgcatcaagacggtgcgcaaccgcggctatctgttctcgctgtccggctgggagtaagcgcggatgcgccgtcttttcatccagttctacctgctgctgatgtcctgtttcctggtggcggtgatcatggttggcgtggtttacaagcaggcggtggacgatgtcggcgaacgctacctggccgacctgctgcgcaccacgctgtcgctgatcgaggccgacctgcgcggcgtgccggaggaccgctggagcgaaaccctggccaacgccgactacggcttcaccttccgcgtcaaagtggaaaagatgagcaactacatcctggacgacgagtccaggcaggcgctggaccgcggcgaaatcgtgatgctggaggacaaatacctgttcctgcaaaagctgcaggacagcaattacctgctggtggccggcccgctgcgctacctgttcttcctgcataggctcaagtggttcgactacgcgctgctgggcctgttgggcctgtcgctggcgataccggtgttcctgtggatgcggccgcactggcgcgacctggtggcgctggagcgcgcctccggccggctggccaacggcgacctctccgcccgcgtcgacctgccgccgcactccggcgtccagcacctggccgtggcgttcaaccacatggccgacaacatcggcgcgctgatcaacagcaagaaaacgctgaccaacgccgtcgcccatgagctgcgcacgccgctggcgcggttgcgctaccggctggcgctgctggagggcgacgaggagtccaaggagcgccaggcgatagaacgcgacctcaccgccatcgacaagctggtggaagagctgctgttccacgcccggctggaccgcccggaagcgccgctgaagctgaccagcttcaacgccatcccctgggcgcgcgaccgcatcgccggccaggcggcgctggcgcaggaaatccactggatagaaccagtgggcgacacgctggaaatcatcgccgacgagcacctgatcacccgcgcgctggacaatctgctgtccaacgcccgccgccacgccggctccatcgtcgccacccatatcctgatcgacaagcagcactactgcatcatcgtcgacgacgatggccccggcattccggccgaagaccgcgagcgggtgttcgaccccttcgtgcggctggacgagagccgcggccgcaagaccggcggccacggcctgggcctcgccatcgtcgccggcattgcccgcgcccatggcggcgacgtcaaagtggaaagctcgccgatgggcggcgcgcgctttttgcttcgctggccgacagcctgatgtacattttgtaacatagagatacacgcctcccctagacgctcccccttgccatagatagcatcacggcctgaattaggacttttacgggtccgtttcaccccaatcgaaagaaacttaggagtttcgtaaatgaaaaagctggctctgctcgccctgaccgctgctttcagcctggtatccgctaacggtttcgccgctgaaaaagctgctgcttccgctccggccatccacaaggccaaaaaagttgaaaagaaaaaagtagcttccgctgctcaaaaagctcaagccgccaaggctgacgcttccgctccggctaaaaaagctgccaaaaagcacgctaaaaagcacgtagccaagaaagacgcttccgccgctcagaaagcccaagccgccaaggccgacgcttccgctccgaaagccaagaaggctcacaagcacgccgctaaaaagcacgctgtgaagaaagaagcttccgctgctcaaaaagctcaagccgccaaggccgacgcttccgctccgaaagccaagaaggctcacaagcacgccgctaaaaagcacgctgtgaagaaagaagcttccgctgctcaaaaagcccaagccgccaaggccgacgcttccgctccggtagccaagaaggctcacaagcaccacgccaagaagcacgctgccaagaaagaagcttccgctgctcaaaaagcccaagccgccaaggccgacgcttccgctccgaaagccaagaaggccaagaagcacgtagccaagaaagaagcttccgctcagaaagcccaagccgccaaggccgacgcttccgctccggtagccaagaaggctcacaagcaccacgctaaaaagcacgctgccaagaaagaagcttccgctgctcaaaaagcacaagctgccaaggcagacgcttccgctccggctaaaaaagctgcccacaagcacgctaaaaagcacgtagccaagaaagaagcttccgctgctcagaaagctcaagcagccaagaaagaagcttccgctccggccaaaaaagccgctgctaaaaagcacgctggcaagaaagccgctgcttccgccgccaagtaattgacgcgcgaacgccgcggcttttcagttgcggcgctgtattgcacggggcgctctgcgccccgttttcattgccaggtgccatccgatgaagctgccacgccttgccctctgcctgtccctgctatccacgctcgcccatgccgctccgctcagcaaggagcaccgcatcctgtttttcggcaaggacgaccgcgtgctcgaacatcccgaccacatgccctggcaaaccgtgggccagctggaaacccgctcccgcaccatctgcactggcaccctggtggcgcccgacgtggtattgaccgccggccactgcttcgtcgacgaaaagggacgcttcgaccccgccgtcagcttcaccgtgggcctgtggggcaatgaataccaggcgctcagccgcatcaaggaagtgcaggtggacaaggccttcctgaaaggattgatccacaaacgcgatggcctctacatcccgccgcgcatcgcgccgcgcgatttcgccttcgtccggctcgccacgccgctgggccacagccagggcaccgtgccggtattctccggcgacgcccaggcgctgaagacgctgttggccaagcaaaactggaccatcacccagggcggctacccggtggacgaccagcgccacctgcgcgtgcaccacggctgcaaggccaccaaactgcgcgacgacggccgcctcacccatcgctgcgacacgctggaaggcaatagcggctcgcccatcttcgtcatcgacgccaagggccaggccaccatcgtcgcggtgcaaagctcggcgccgccggcctcccgccgcaagctggaggacaatatgagcgtctccgctccgatgttccgccaggcgctgcaggccttcatcgccaaatcggccaagcccgccaagccggcaaaatcggcccgcccatgaaaaaagccgcccgatgggcggcttgtcgcatctgcggcgcgaacgcgctcagccggccagcgcctggcgctgcagcgccagcaattcgcctatgcccttgcgcgccagcgccagcatcgccagcatctcctcttcgctgaacggctcgccttcggcggtgccctgcacttcgacgaagcggccgctgccggtcatcaccacgttcatgtccgtttcgcaggacgaatcttccggataatcgagatccagcaccggctgtccctgatagacgcccaccgagatggccgccacctggtcgcgcagcgggctggcgtccagcttgcctgcccggatcagcccctggatcgcgtcggccagcgccacgtaggcgccggtgatgctggcggtgcgggtgccgccgtcggcctggatcacgtcgcagtcgatgacgatctggcgctcgcccaacctggccagatcgatcaccgcgcgcagcgagcggccgatcaggcgctggatttcctgggtgcggccggattgcttgccggcggcggattcgcgccgcatgcggctgccggtggagcgcggcagcatgccgtattccgccgtcacccagccctggcccttgcccttgaggaaggacggcaccgtctcctccacgctggcggtgcagatcaccttggtgtcgccaaactccaccagcaccgagccttcggcgtgcttggtgtagcctcgggtcagccgcacgacgcgcatcgcgtcggcactacgttgggaaggtcgcatgatggccttgtcaaagaaagtggaaacggcggcgattataccagcctccgccgggcggccgggctcagctgcccttgcccacctggctggccaggatttcctgatgcatggtttccagattggactccagaatcagccgcccgcccttctgcggcggcgtcttctcggtatccagcacatcgtcgcgatcgccaagctccaccgaatcgtccagcagcgtgaccgccagcgcggacagattgtcgccgccggcgccggcgcgccgctccgccacattgatcagcgccggcaacacctggttgacgtggcggccggcgaacaccttttccatctcgccgtcctgcacctgcgaccacaggccgtcggtgcacaacacgatggaacagcccggccccacttcctggcgctcgccgatgtcgatgtccgggtcgctggtcgcccccaggcagttgtagatcttgttgcggtccgggtgggttttggcgccctcctcgctgagcaggccttggtcgatcaggcgctgcacctgcgaatggtcgcgcgagcgcagccgcatgccctgcccgtccagcaagtagagcctggagtcgccgacatggcaccaatacagctggccctgctggatgatggccaccaccacggtggtgctgggcacgtcgggcagccggtggtcggcggcgtattccaggatcacctgatgcaccgaactgatggcgttgaccaggaagcggttgggatggctgagcgtcggcgcggcctgctggtagaacagctcgctgagcaggtccaccgtgatctgcgcggccacttcgccgcgcatatgcccgcccatgccgtccgccaccaccagcatcaccgtatcgcgcgaatgcgccagcgccagcctgtcctggttgtagctgcgccctcctatcctgctctcctggaaaatcgacagtttcattcggtcccctctcgatggcgcccgccggtcaggccgcggatccagccgaccagcttgttgccgtcgccgggcggcggctccggctggctgtattccgtctcctgcagccgcttttgcacctccatcaccgtggccggccgcagatccggcgccagcgccaggcagcggtcgcacaattcggtcagctcgcgcgaatacaagtgccggaacgccttgccggccggctccagcccatcccgctccagcctctccctggcattcggcggcgtggcgccgcccatgcaaacgtacagacaggcgccgatcgcgtagatatcggtccacggccccagcggctggtctttctcatactgctccggggcggcgaaacccggcgtgtacatcgcggcgaaatgcttgtcgcggcgcgacagcgtctgccgcgccgcgccgaagtccagcagcagcggcacgccgttgcgccgcaaatagatattggccggcttgatgtccagatgcagcaggcgctggctatgcacctcgcgcaggccggacagcagcgcggtgaaccacttgcggatcagcctttcctccatccgcccccccgccagctccagctcgcgccccaacgagcggccgtcggcgtactccatcaccatgtacaccgtctggttggcgcggaaaaaattgctcacccgcaccacggtcggatgcgcgatgcccgacaacacccgcccttcctcgaagaaacacttcaagcccaggttgaaggcgtcccggtccatttcgtgcggcaccgtcacctcgccctcgcggttgcggtcggccaggttgcgcggcagatattccttgatggcgaacttgtggtcgtcatcatccaaagccagatagaccacgctgaagccgccaaccgaaagttggcgcactatggtgtactcagcgaggcggtagcctgccggcagcgcggtttgcttgctggattgagtcatcggatggcagttgttatagtgtccactggccctgaattgagcttagcaaagcaattcgggcccggcatttggaaattggacagatacaggagccccgcatgattctgagcatgaccggctttgccgccgctacccgggaattccctggcggcatgttgagcctcgaagttcgcgccgtcaatcaccgttacctggacgtgcagatgcgcctgccggaagagctgcgcatcatcgaaccgcaactgcgcgagcagatcgccgcccgcgtcacccgcggcaaactggagtgccgcgtcggcctcaaccaggtggacagcgccgcccccacgctggaactgaaccaggccttcctgagccgcctgctcgaggtctcccgcgaagtgcagcagcaaagcggcgagaacaaaggcttgtccgtcggcgaactgatgcgctggcccggcgtattgaaaagcaacgaactggcgcccgaagtgctgcaacagctgtgcctggcggcgctgcaaaccgcgctggccgacttcaacgcctcgcgcggccgcgaaggcgaaaaactgaaggcggtgctgatcgagcgcatcgagtcgatggaggccatcgtcgccgccatcaaaccgaagctgccgcaaatcctggacaactacatggccaagctgtccggccgtctgcaggaagccctgggcagcgtcgacgaagaccggctgaagcaggagttcgcgctgttcgcgcagaagatagacgtggacgaggagctgtcgcgcctcaccacccacctgtccgaagtgcgccgcatcctgaaatccggcggccaatccggcaagcgcctggactttttgatgcaggaactgaaccgcgaagccaacaccctgggctccaaatcggtctccaccgacaccacccaggcctcggtggaactgaaggtgctgatcgagcaaatgcgcgagcagattcaaaacatcgagtaagctttcacgacgcgtcacggcgtgtcattgaaacaacaaaagccccgccagccggggctttattcatttcaaaccgtgtcatggagtgccaacaaaacgcaggctcgccgtgcatccgatgaggtccacacagcactttcgcggagtcgtttgacagccaacgtcagcgcgacggcaaagaaagccaggatctcccgccgccacatgtaccggctgcgcaaagataacgaggacttggccgccgcttggcaggaggccatcgccctcggcaccgcagcgctcgaggataaggcggcccgccgcggcgcgccaagcgataaagtaaggccacccggccgtgttaccgcttagtccgccgcgcgcgggcttttttgcgccccgggcggctcgacacgaggtaatggctccgtggcgaaaacaaaccccatgaaggacgctgtcaagctgcctgccaatggcaggccggctttattccggccatcccgcttgacccggctaacattcaatttcaaccaccaagactcttcaaaggggtatccagcatggtcattatctatgtgctcaaagagcactatgcgaaagttaaaaaagcctacatcccgtggttgaagacaatcactgacgcatccatcacatcgctcgccgttgaggccgtaggaccgaccgttgttggaaatacggtcgttgattgtacgtttggagtaccagaagagttcctggcagagctcgacaggctgaacattccctatcgccgtgcatgatagaagcctggagcattccgttttatcgtgtacccatgggtgtactcataagaaaaacgcgaatggcttgatcctttacaggcaaggctttgagccatctactcaataatcagattcaaaagctttcacaacgcgtcactgcgcatcagcaaaaccacagaagcccctccagccggggcttttctgtatcccctggccttttcctgcgcctgcgtcctcagcagccaccgccacaccgcggccccctccgcctgaaataccatttaatgacatcaaattatttaaataactcttaacaatggcggcaaggtttgtgactcaagccaggctggccggcgacgataacgggtttatgccgtgatgcatccgcaccgcaagccacgctcgatcacagtggcaagccgggcaaagacgacgttggacagcaatgacaccggcccccgccggtttgaatggaaaaggaaacatcatgagcgtaagcagcatcggtggcggcgcatccaactggcccgtccagaacagcggttccgccacttggcagcagaaccagcaaaacttccagcagctggcttccgcgctgcagtccggcaacctcggccaggcgcaatcggcctactccagcctgaccgccaacctgccgaatggcggcaacggctccggctcgcagagcaacagcccgttcgcccagcttggccaggcgctgcaaagcggcaatctgcaaagcgcgcagcaagccttccagacgctgcaaagccaccactccggccaccaccatcgccatggcggcggcggcggcgaatcgagcggcgccgacgcttcgacctccaccagcgcttccagcaatagcggcggcactgtcggctcgctgctcgacaccactgcttgataccgccagcaaaacgcccgccccacgcgggcgttttgctttgccaagccggcggcgatggccagcctatcggtgtcctgctgcagcactgagatatatccatccgctttcgccgcctctagaacattccggcctgcccgcaaaacaaaaccgcccttccaataggaaaggcggtcttgctttgggcgcggagatgcgccgcggcagctcaacaggaagcgacttccaggccatgctcctggaagtagcgggtccagaacgggctggcctggatcatttcatccagccgccgcgctagcgcctcgctttcgtcaaacttgcccatcaggtttttgcactcgatcaccttgtacatcgccaaagcatggtcattgcgcagcagcaagacattgctgaaggtttccagcgcccgctcgtaattgccgtacttcaaatcggagttgcgcaggaagttcatctccagattgatatcgtaggcgacggcctctatctgcgccggcgtgaagtccttggtttcgacgacgcatttcttgtagcctgccatccggatatcgcccttgatctggccattcttcaccgcattgatatacatctcgctgccggccaacggcgtggcgacattgattcgataccaattcgcatccaaagagcgcaaaaactccctggtatcgtcgatatcgcgcagcgtttcgcccggcatgccgataatgatgttgcagtcggtataaatgcccaaatcccggcaatcctcgaccacccgattggtaatcgacagcttcagcggttttttcattacctctttcaacacccgcgcgctgccagactcgaccgccagcgtcaattgacgcacgccggttcggtacagctcctccagcatcggccgatccaaagcgtacaaggccaaggcattggggaaaaagcaaaccaggttcagcttttgcgcgatcttcagcacgcttttcgcccagtccttgtcccacaggaacatatcgtcctctatcaccaaggtattgggcgaataccgttcgcataaatcgaaaagttcgcgctcgattctctcgatggaaaagctgcgcatcttgcgaccatgcacggtatgcgcggcgcagaaggtgcaatggaatgggcagccgcggctacccatataggttatatagtttgttctatccccaatcgaggtataggctttgatggtagggttaagatgatacgcctccagatcgatgcaatcgtaatcaagatcgggaatttcatcgagattggagatgaagttatgctggtagagggcgccggccttcacgctctcccgagtcacccactgggcggaggcattgcagtaatcctgcttgttttccgccgccatcagctccgacaggggcaactccccttctccgaaacaaagcgcgtcaaaagcctctggactatccgcaaacacttcgcgatacatggttgtggggaggttgccaccgcaaatccggaatgcctgagggaaaatctgcttcgaaatatccgccaagctcaaaagattttcatacccggtgatgaacaaggaggaaaaacctatcagatccggctcaaaaccagacttcttcacagaggacagcactctttcaaaccagtcatgaaaggaagtggcgtcaggatcatcccaagtctggtgtatttccgtgttgaaatcgattaccttgacttcagcatcgcatttttccttcagccatgcgctgatggtcaacacgccaagcgggacgtcggtaatcagcacgccatatctcttgccgttcgcgtgagtccaatacttgctattggcggatggattgacaaaagcctcaaaggtaatgttaggcgggataatcaataaacacttggaagacattgttgacctcgcgaacatgtaatcaatccaggatgcatcgcctttcaaacatcgacatgatagcgccaagcagccggcgccacagcccttatcctgctctccacttctatcggacaatagggatataccttgagacagccatttcttccactcgccccgccttgagagagccgccggacaagaatgggaaaaagcaatacaaaatgctcattccaagacataaaatgcacaactcaaccaatcactgagcctgctttaaaaaaacattgcaaacagcacgccctaggctagcgccgcgtctatcaatatatgcgctgagatgcgcgtaaaaatcaagccgtcaatgcagaaatcgatagcgcgcgcgagcgccgggcggcgccgagaacatcgccgaccccgcctgcgcatccgcaccactcaccgcccggccgcggcatccgccacgcgccgcagcgcgcacccgcgcggtttggaccggccgcagcccagcaagagaatgacattcgcacaaaaaaatccccatatcggcaaagctgaggctgtcgcaccacgtcagcgccaggatcgggacaaaaaggtgcttatttagctttcttgctgccggaaaatcacggaaaataaggctttacccttcgcgaaagacgcacaccatgaccaaagccgaactgattgcccttctctccgacaagtccggcctcaacaaggccgatgtactgcgtgttctgggcgccttcgacgaagtgctgctggacaccctggccaacaacggcgagctgagcatcgttgccggcaagttcaaggtgaaggaaagcgccgcccgcaccggccgcaatccgaaaaccggcgaaaccattcaaatcgccgccaagcgcaaagtggcgtttgttgccagcaagcagctgaaagaccgcatcgcctaagctttgcgcgatcggcagatatgaaaaacgggccggtttcaccggcccgttttgcgtgtgggcgccgctcagttctgctgccagatcaggcgggcgatagcggaagagtccaactccccctcgccttgccccaccagttggtctatcagttgcatcgtccgttccgccgccggcaggctgatgccctgctcgcgcgcggtatccatcacgatgtgcatgtccttggcgtgcagcttggctttgaagcccggcgcgtaattgtcgtctatcatccgctggccatgcacgtccagcacccggctctgggcgaaaccgcccaacagcgccgcgcgcaccggcgccgggtcaacgtcgcaggcccgcgccagcttgacgatttccgccaccgccgccacccccaccgccaccgcgatctgattgcacgctttcgccacctggccggcgccgctggcgccgatgtgggtgatggtctgccccatcgcctgcagcgccggcctggctttctccagcgcctgagcgttgccgcccgccatgatggtgagcgtgccgttgatcgcgccgacttcgccaccggataccgggcagtcgagaaattcgacgccatgttcggctagccgcgcggcgatccggcgcgcgccgttgggggcgatggtgctcatgtccacgcataccaagccgggccgcgcgccttgcgccgcgccgccctcgcccaacaatacggactcgacgtcagcggtatccgacacattggtcaccagcacttccacctgcccagccagctccgccgggctatcggcccaggatgcgccggccgccagcgcctcggcggcgctctccttgcgccgcgcccatacgctgacctgatggccggctttcagcaggttgatgacgcaagggcggcccatgatgcccaagccgatgtatccgatatgcatgccagtctccgattgatcgtccttgatcggcagagcataggcgattgcgcaaagctgcgccagcaggggatgcgggaatcagatcagggattgctgaccggggttttgcggcccgccagccagtcttcgaactcggcctggccatcgccggcctgccgttccaggtaatagacgaaggccaggatttcagccaccgcgcggtagagttcggggggaatgtgcttgtccatgtcgacctgcatcagcaaggacaccagttccggcgaatcgtgaacgaacacgccggcctcctgcgcgcattcgatgatgcgctgcgccatctggccgtagcctttcgccaccacgcgcggcgagcgctggccatcttgataggaaagcgccaccgccgagcggcgcttgtcgtcattctgcgggttcattctgattcaccaccaagctggccagcgtcaaaccggcggccgccatgccgttttgcagccgggccgcgttctgctgaattctctgtccggtttcgccttcgtcggcgctgaatgaaacctggaccgactggccgaccatccgcacccgcaccgccatgccgcccaaggccggcagctccagcgccaggctggtgttccagaccgggatatcttcctggccatcgccgcggcgctcgttctgcagcgcctcctgctcgatttgcagctgcatcggctgcccaggccaggccatgccctggaactgcaccgcgcggttctccaaaccatccagttgccgctgcaccaggccgcccagctcctgcagctggggccgggtctgcgactggctggtcttcgagccatcgtccagcgccagcgcatgcaaggtcagcgtcaacttggcttgcggctcctgcttgagctgctcgatcggatgcaggccgttgctgaaatccttcagatgcgactcgtaaaacaaaccgctttgcttgacgtcctgctgcagctgcttggccagcaccgcgggcggatgctcggcggcatccagttgcaacggcttgctgggcgcggcggattcgtcggaagcgccaagcagggtggtgaggtagcgcgacgcctggctgagcttgaccgccaccgagccgtcctgcgccggcggcgcatccttgccgccctcttgcagggcgaaggtgagagccggctccagcgaaaccactttcagattcagcgtatcgccggatggattgacgcccggcggcaggctgagggtgaacagcccattcttgatcagcaccgccagctggttattgcccagttgatcggccactttggcagtcagcaactcgcctatcatcagcgatggcaggcgggaaggctgaaccagcgcctccagcaagcgggcgccgtctaccggggccctcagctggttcagggtttgcgcgccttgcgtggtgatggcgatcgcattgggcagtgaaggaatcatgaagtgggactgttacgataaagtgagacgatcaactccgcttcgctgcgggaaatgccgcaacgcgacgccacttcggacgcggtgagcccctggcgtatcatttcgatcgcctgattgtacgggctgagtcccggctccgcctgcgcctggtgctcgctccgcgattgcagccgggccacctcgcgctgcagcgagctgatctgctgctgctgctgatccaggtacagcgaagtgaggctgtcgcgcttgctttccagccgctgcagcctgccgaaaaggtagaccatggcaaccgccagcgtcagccagagcacgaccatcagatatgggaagaaggcgccggacatggaaaattcccctcgggtgaacatccgcattgactttaagtgtatggcgaaatacggcacaacccaagtcaaaaccccatcacccgacaagcagttgcggcgcttttacggccaggccgcgcatccggccggcagagccggcatcgctcacgccttgtattgccggcttagcttggaactctggctcaacgccctcagctcatgcttgacctgctcggcccaggaagcgatttgctgctgggtttgcacccgcaagccaagcacccggcgcaaggtatcgcgttgtgcgccgctcaattgctgcgattcgccggcctcgagccgcttcagcaattgctgggtgtaggcttcctggctgcggtacaactccacgaatcggggccgatcatggctgcgcgccacctccagcgtttgcgccgccagcggctccagcgcgtcgatcaaatctgccagcccctcggcgctcatcgcgaattgctgctccatggctgccgtcacgctcccgattgcgcgctagcgtcgtgctgcttcgccgcgttggccttatccacctgctgccatgccggcaggatggtttccagcaggccgcggacttcggcgatgatttccttgtcgttcttcaggctggccttggccaggcgaagcttcatgtacaggtagagatcgttgaggttggccgcggcctcggacgcctgatccaggtccagggcgatccgcagcccttccaggatatccacggtcttggagatcatccgcgccttctcgtcgaaacggccggcatccatcgcgatgctcgccgcgcccagcgccttgatggccccttcatacagcatcacaactatgccaaccgggctcgctccgtataccgcagttttcaaggcgtcattggcgtaagcctgattgaactgcttgagcattcgcgaattcagcatgggtcaccatcatttctaaagctaccggacggcttatgccgcccggcgtgatcttacttggaaatcaggttgaacaggctgttcgaacccgactgcatctgggccaaagtcttgttcagcgccgtgtattgctgaatcagctgggtttgcttggagtccagcctggcctgaagcgaactctgcagctgggtttcggtgctgaccttgctcttgatcgtggcccggctggtttcaatcaaccctgtcggccccagcatgccgttgatctcggtattgaaacgctgggcgaagccggtgttggccgggttgccgaacagattggtcaccgcttgcttgtcttttttcagcgcgtcgttgaacgcggtctggtccagcttcagggtgccgtccttctgcaacgagatgcccgcctgcgacaggaacgccaccgaattgaccggatccgcgcccgccaccggcgtggacaatacctgctgcagccgggtctggatgtccagtatcgacgcattgcctttcatcgcgccggaacgggcggccttgacgtcgccgaccacctggttgtacgcgtcgacaaaagcctggaggttcttgccgaccccggcgctgtccggcgccagcgacaccgtgaacgtgccggccttgtacaagtcgacttccgcgccgggaaccgcgttggacaccttgttgctgccggcggtgatggccacgccattcaccgtcaggctggcatcctgggcatcctgcgattccttggcgccattgtcgctttgcgacagccccgccagcgtcgaaccgccggtcttgccgctatctgtgccgccgccggtgatggtgaacttgttgtcgttgcccgattccgacgaagccagcaccagcttgtactggctgccgttctgcacgatggtggcgttcaaaccgatgccggccgcgttgatcttgtcgttgatcgtctgcagcgacaccgcttcgtccggcttgtcgcgcagcttcacggtctgcgtcttgccattgatctggaaggtcagctggtccggcgcgccggctatcgtcgctttcggatcggtaatattcttcccgccggactggtcgaacaccagttgccggttggtcgccagattgcttaccgaaatctggtaggtgccggcattgccgccgctggtggtggaaaccgccgccatcgacgcatcgctgaccgacgccttgaacacttgcagaaaacggccggacgacaggctcgtcatggcggtctgcagggccgacaacgacgaactgagcttgccgacggtgctgagctgggtgttgtattggtccgcccggccctggcttgccgtcaacggctgtctttcaatcatcatcagctggctgacgatgccctgaacatccaatgcacccacggaactggtaatggctgtcatgttatatccatgttatagccgcatcgggacagtgaaatcaggctttgtccttcagcaaaagtcctttgaagtcaccgatcgccttcgcgatgcgcagcgcttcctcggacggaatctgacgaatcacctggttgttcgccttgtcgacgaccttgaccacggtcgcgccggtgtccttgtcgacggagaactgcagggagctattgtacaacgatgccgcagtgttcagctggttgaccgaatcctgcagttgcttgggatcggtctgctgcttctgcgcatcggcggacgactgttgctgctggctctgcccagccgcagcgacagcctgcgcggaatccgccagaaccgattggttcgggtcggaggaaggcgcctgcgccaactctaccagttgttgacgtggcgccggggcgttcgccgtgttgatggaaggcgacaaaacagaagggatttgcatgatcacgctcctcatgaccgcagctccggttgcccgaccggagctgcagactggcttataccatcagtttacacttactgcagcagcgtcagcgcggactggggcagggtattggcttgtttcagaatcgatgcgccggcctgttgcagaatctggttcttagtcaggttagccgtttccgaggcgaagtccacatccacgatacggctgttggctgcggtcaggttttgtacgtagttgtgcaggttggccacaacagcgtcaaaccggttctgcaccgaaccccaggtcgaacgcacggtagagatttccgcgatgtcgctgtccagcgtcgacaggatggccgacgcgccggactgcgaggtgatgttgatggtgccggtggcggtcagcgacgagttgtagctgcacagcacgccggcagacgtcatgtccaccgaggaaatcgaaacctggttgctgctggcgccggacgaacccacctggaaggtcagaatcgcgctgcccgacaacagctgggtgccgttgaactgggtggtttgcacgatacgcgaaatttcctgggtcagctggtccacttcgctttgcagctgcgaacggttagtgttgctgacggcgccgttggacgcctgcaccgcgatttcgcggatacgctgcaggttgttggcgatctgtcccaacgcgccttcagcggtctgcccgacggaaataccgtcgttggcgttgttgatcgcctggttgttgccgttgatggcggaagtcagagtctgcgaaatggccagacctgcggcgtcgtccttggcgctgttgatgcgcaggccggaggacagacgttgcagcgacgtggtcagcgacatctgggaattgttaaggttcagctgggcttgcagcgacgctatattagtgttgacggtaatggccatgatgactctcctgatactcagtgtgggcaaagaggcttgcttacactgcatatcggccggcacattccgaactttacggtgaaaatgtgaattttcacactttcattcccgctgccgtctgctcccgctttgtctttatcgctgtcctgttcgcattctccctggcttccagcgccttcgccgcctccccggggaggcggcgaaaccttcattcaaacccttattgcagcagggtcagcgcggcttgcggcagcgagttggcctgcttcaggatggagccgccggcctgctgcagaatctggttcttggtcaggttggcggtttccgacgcgaagtccacgtccatgatgcggctgttggcggcagtcaggttggcggtgtagttctgcaggttggccaccaccgcgtcgaagcggttctgcaccgcgccgaaagtggaacgcacgttggagatctgcgagatgtcggcgtccagcgaggacagcaccgcggaggcgccgccctgggtggtcacgtcgatggtcttcaccgcgctcaaggaggtgttgtacgaatgcagcgtgccgccggaggtcaggtcggtggcggataccgaaacctggttgtccgacgagccggacgaacccacctggaaagtcagcgtggcgccgccggacaacagcttggtgccgttgaactcggtggtctgcacgatgcgcgagatttcctgggtcagctggtccacttcgttctgcagctgcgaacggttggtgttgctgaccgagccgttggacgcctgtaccgcgatttcgcggatgcgctgcatattgttggcgatctggcccagcgcgccttcggcagtctggccgacggagatgccgtcgttggcgttcttcatcgcctggttgttgccgcggatggccgaagtcagggtctgggaaatggccagaccggcggcgtcatccttggcgctgttcacgcgcagaccggaagacaggcgctgcagcgactgattcagcgaggtgctggagttgttcaggttgatctgggcctgcagcgaggccaggttggtattgacggtgattgccatttcattccccttatcggcccagaggaccatcgaaagttcttgcctgttgcaagaaagatcggccgacttcggagaatgctgacgaaaatggtaattttaccaacaaatgccgcgatttcgcggcaaggcatgaaaaatggccccgaagggccatgggaaaaaacgcgccgcggcacgcctagccgtgcaagatgcggaaccagtcttcgtaatggtcttccagccagtaatggcggttgaaccagtcgcgcagcgcgtcgccctcgcgcgcggtggcgtccatatcgtgggcgcgggcgcggatggcctcgatccaggcttcggcctggttgggcacccggcagaccggcgcgtcgttggtctggtagggataaatgtcggaacacaccaccggccagcccagcaccccatactccagcagccgcagattgctcttggcctcgttgaacgggttgatctccagcggcgccaccgccagatccaggttcagactggccaccttggcggcgtagtcggcgaaggtgaccgcatgatgcacttcggcgacgtaaggacggaactgcggcaggcacatgcccatgaagacccagtccacttccttgtgcgtggcgcggatcacctcgtggatcaactccaggtcgccacggtgctggccggcgccgacccaacccacgcgcggcttgtcgccgacgcggcgttccgacttcagatcgccccagatcgagcggcgcagccggttgggcaccaccgccacctcacccaccatcttctggatgagatcggccagcggctgggtggacaccaccgccgcgtcgcacagcttcagcacgcggcgcaaacgctgcttggcgtccggatagtggcgcgaccagtggtcatacaggctgcttttctccggcacgccgccgaccaggtcgtccaggccgaacacgatgcgcagatcggggatatagcggcgataagcctccatggtttcatagatgtagtcgctgatgccggtatgcagcaacagcgcgtccggtccctggcgcaccagctccaccacggtgggaatgccggcagagggctggtggatttcgccgtccagcttgcctttctcctgcagcacctgcaaaggctggctcaagcggtattcgccgctgccgcccggcaccgggatgcccagcacctttttgcgcccaggcagcttggcgtcccaggcgacgatgcggtcggactcgatcgccactcgcttggtgcgcagcgacaagtgccggttgaagcccggatcgttgcccatcaccggcagccagcgcgccagcatcgcctccatctcctcgcgctcgcgcaccgccgccttcagcgcggggcggggatcggtggtgacccggcctatgctcttggcgtggtggtggtacagcaccgcgtaaggagtgtagacgttgcgcaggccgccggcctggatcttgaggcagaagtcgacgtcgttgaagcagacctggaacacctcttcgtccatgccgcccaccgcttcgtagatctgcttctccaccatcaggcacgccgcggtcaccgcggaatagttctgcatggtcaggctgcgattcagatagcccgggtacaggtagtccatatcctcgaatacgtggtccgccaccgaatacatgccgccgggcatgcccagcacgatgcccgcatgctgcacgcggccgatctccggatagagcaggcgcgcgcccaccgcgccgacgcccggctgctgggcggtagccagcatgcgctccagccagtgcgggaacaccacttcggtgtcgttgttcagcagcagcagatattcgccgcgcgcctcgcgcgcgccgaggttgcattgcgcggagaagttgaacggcgcgtcgtagctgaggatgcggatccgccccggatagcgcgcctggaccttttcgtagaactcgaaggtttccggatcctgcgaggcgttgtcgacgatcagcacttcgaaattctggtagccggtgatgccgaacaggctgctcaggcaaggctccaggcattcgagcttgtccttgctcgggatgatcaccgacaccagcggcgaggccagcagctggtattcgtagtagaaggttcccgccaccaggccctcgtccaccgacgccggcaggccgcagcggccgatatggctttccagcgccacccggcgcgaggcattgcccaggctgtccatcttgggatccacccacggcagcgacaccagcacatcgtcgacatggccgatggcgccgcggtcccaattttcgtatatccgcagcagcgcgtcgtagcaatgcgcgcgcggatacggctgcatgccgccgatcttggccagggtctcgcgctggaacgccaccgcgtagctggtgtaatccatcgaccgcaggtactccggcgagaaatccggcaggaaggacgggcggaagcgcttgcccatcggcgacaccacgtcatggtcggtatagatcgcgccgtattccggatgcgcgtggatctcctcgcccagccgcgccagcgcgttcggctgcaggcgcgcgccggccggcagcagcatcacccagtctgccggcacgtcggcgatgatgctgttgatcacctcggaaacctgttgctcgtcgtccatgctcgccagttgcacccagcccaggttcgggctgctgctgaacaccgggtccggctccggcgcgtcggacaccacgatcagccgccaatggcggtacagcaggttttccatcgcggtgaagctttccgacaagcgcgtcaggcggttgctcggcgccagcagaatcaggttgaacaccggcacctgcttccaggccatcatcatccgctccgccagctgttcggcgtgcacttcgcggatctggcggcgtttcacccacttgcggtaggccttcaggccatccacgtcgttttcggccaatgcgtgcgtgacgatgcggcccggctgcgccagcggctgcggcttgagcgcttcgggcagcagcgccgcgtactgggccagcaaatcgcccacccgcggctccagcagccggttctccagcacatggcggcgcgcggcggcggcttgctcggcgcgcagcgcggcatcgtcgatcagcttgctgatcccggccacccagccttcttcggtattgtccgccaccatcgccagcccgctgtccttcaaaccggcgtaggcggtgacatcggacaccaccgcggccgcgccgaccagcgcgtactccagccacttgatgtccgatttgtaatcattgaattcgctctgcaccagcggcgcgatgccgatgtcgatcttgagcttggccagttcggacaggtattcgttgtaggtgacgaattccggcaccttgcgcacatccttgatgccgacgaaatcgggaggcacatctccccaaaacacgaacttcacctggccggcatactcgtggtagatccgcagcagcgccgacgaaatcatttcaacgtctttggcgtgagtgctggtgccggcgaagccgatggtgacctggccgctatgcggcagcggctccaccacccgttcggtcgccagatggttatggaacacgaagaccttgtcgttgtaaggcttgaccttctcaaccagcgcttcggtcgacaccgtcaccagcgagcactgcggcagcagccactcgatccccttgaacgacggctcgcagatgctgtacatcacatgctgctcggacatgtccagcagccagtcatccacttcgtagacgatgggcttgcccgacgcgacgatcatttccagcaagggccggaactccggatagggaaacaggcgctggacgatgaacatgtccatcgcgtcgacgaaatcgcggtcctccttgaacgggtacacgccctcgtagctgtgatcggcctggttcttgaaatggtaggcttccagcaccggcgacatcaggcagagcggatcgccaagtctcagtttgtagcaggcggcatcctgcagatctcgcgtcagaacgccgacgcgcggtttacggatttgggatggttccacgttattttcctgagattccatggcggcagctcgccaggtcatgaattgaatcgggtccgcagccggacaccccggacggcaatacagcaagaacgcactcgaagcgaacgaaagaaaagggcctgccggcccttgagcgaaaaccgcgccgcggcgaagccccgcgctcccatcggagcggagccgccgcggccgtcaggccgatcagcgccactatagcagcccgcgccgtggcgacgccatgccgggcaatgccgcccatcggtccgcgtcgccgttccgcctcaagcctgggcggccagcgcgatcggcgcgtcgccttccggcgcggcgcgcggcagcaggatttcggccagcaagccgtagttctcctccgaccagtcgtcgggattgacgccatccaggccgaagatccaggcccagcgtccccagaacgagctctgcaccgactgcaggtagcaatcgcggtggtgttgggccaggtcaagccggcccagcccgcggtaacactccgccaggtaatagtgggcgaaggcgtggtcgctcttcaggcgaagaacgttcttgagcccccgttccgcccattcgtaattgccgcagcgcagatcgtagttatggacgaaattcagatccaggttcatgaagtactggtattcctggatgaactcggccgagaagtcctcggtattgatgaccgcggtgcggtagtccgaccccaggctattgatcttgatatagcccttctctttcgagatttcgtggatctcgctgccgacgatggggctggcgcaagcgatgttgaaccagttggaggcgatctcgcgcagattgcggcgcgcttcttccagatcttccttggtctcgcccggcatgccgatcaaaatattggtattggtgtagatgcccagctcgcggcaatccctggccaccctctccgagatcttcatcttcagcggcttcttcatctgcttcttcagcaccttctcgctgccgctttccaccggcagcaccaggtgccgcacgccggcgtcccagaaggcctgcagcatcggacggtccagcgcgtaaagcgtcaggccgttctgatacaccgactgcaggttcagcgacttcacgatgtccagtatcttgtacacccggtcggaatcggccatcaggtggtcgtcctggaagatgacggtttcggcgccgtaatgcttgaccagccgggtaaagtcctccttgacccgctccagcgagtgatagcgcatcgacctgccgtgggtgcggtgcgaggcgcagaaggtgcacaggaagggacagccgcgcgatgtcatcacatggaagccgcgcgtcttgtccagattgtggtaggaggccaccacctggttgatttcatgcttgtcgatgtcgcacaagtcataatcgaagaacgggatttcatccaggtcgtcgatgaagtcgtgcttgggaaccagcagcgcctcatccatcacattgctgcgcgtgatccatgccgacgagctggccaggaaggccagcggatcttccgcctgcaacaggttcagcatcggcttttcgccttcgccgaagcacaggccgtcgaagaaggtgcaacccatgtcgcggtagatctgctcgtagctgttggtggggatattgccgccgccgaccacgatgctgtccggccatacctcgcgcgccatccggccgcaatccatgaagttggcgaacgaggggctgaacagcgaggagacgccgacgaagtccggcgcgaaatcctcgatctgccggaagaaatggcggcacagcgcttcgaacgaatcgaagggcaccgcgtccagcgcgttgacctcggcgttgaagtcgatcagcttcacatccagcggcaggaacttcttcaagtacgccgagatggacaagggccccaggggcaaatccgtgcgcgggatgttgtagaccttcccatcggccttggccagctgcacattgtagaactcgggcttggtgaacgagtcccaggaaatgtgcatgggcacgacaaacaacagttttttcatcccaccctcctcgatcaacgtcctgccgcgccgcgggcgcgtcccgccaggcaggcgttcatcctcatcccttaagattacaagaaaaaaaccggcgcccatccccaacgcgcggccggcataccccgctgtcggcgcggcgggccgcatcgacgtcaaacctgcttcatcctgcaaagcggcaggcgccgcgcgcggcgaccaccccttactctgctttatcggccaagcgcctccagccatgagggcaaatgcgggccgagcatgcaattttccttgacccaggccttcaaccgctcgccttcgcggccggcccgctccagatcgcgcgcgcgttcgagcaagacctggctccacgccgcggcctcgttgtccgcccgcgccaccggcgcttgcgccagtcccggccagtcatccagcgcgctgcacgccaccgggatgcccaaagcgccgtattcgagcagccgtcgccgccccgccgcctcgcggcggccatcggcgtgcttgggcatcaccgccaagtctattcccaggctggccagcttgcgcgggtaatcctcgcttgccaggtcgaagggatggtattccgccaggtagggatgcagcgcatccggacagtggccgaatacgatccagtcgatctcgccgccggtggcgaggatgatcccagtgagcagcatcaggtcctccacctcggcctccgtgccgctccaagccacgcgcggcttcttgcccatgccgcgcagcgaaatcaacccttcccagcgcgcctcgtccagcgcctccggcaccaggcgcacatcctcgcagaacgcgccggccagcgcccgcagcgcttcggtcggcacgatgatcctgtccgcctcccgcgccagcgcccgcaacatcgttctggcgtaacggtcgctgacagcgccgccggcgtccagatcgtccaacaccaggatggacagcatgtccggccggctgcggcggctcagacgcagccaatcgaggaagccaggctcgaagcgcgcggcttgcaccaggacatcgggcgccaggcgttcgagctcgccggcgctgggcaggcgctgcccggccggaagcatggtggccagcagcttgccgtcatccatcaagcgcagcagcggcgcccgcaagcgggcggcgccggccggcgacgtgcccggcagcatcagcacgcgggcgcgctcgtagaaatcggggtcccactcggcggagtagacgttctccacctggaaagcctgccggctgtccagactcaagtgccggttgtacgccgcgtcatgccgcagccagccataccagcgccgggacaacgcctcctcgtccagcctcgccgcgagaggggccgcatcgggctgccgcagcgcggacacgaacggcgtccagaccagcagcttgtcggcggcgcggatcttcaggcatagatcgacggcggcgctgtcggcatcctccagcgaggcgtcgagcccgccgatttcctcatacagcgcgctggacatcagcaggcagtccagcggcacggctcccggattgtgctcgatcagctggcggcccagatcgccgggcgccgccgcgtcggcgccgtcgaacaccgatgcggcgccggcgtccgcgcccagcagcagcggaccgcgccagaccgttttgccgtcggctcgcagcaggcgcggcgccgcggcgccgacgccttggcgcgaggccaggccaagcaggtccggcaaccagtcgctccggcccacttccacccggctgtcgaggaacagcaggtaatcgccgctcgccgcctcggcgcccaattgatagcgtccggccagcgacaactcggaggcgcacgccacccgccgcgccgcggcaggcagctcggccgccgccggcgtcaccgccagaatctcgcaaacctgctcccagtccgccgccaacacggcgtcgatgctggacgacaggctgacgccgtcgccggcgtcggcgatgatgacggaaaccttgcactggccggccgccagatagcggatatggaagctgccgactgccgcccccggctggatgacggccgcgccgccctgccgctccaggtgcgcggccaatgcccgctcgcgcgcggcggcggcgtcggccggctcggccgccgccgctggcaaatgcaccagcatgtcggcgatatggccgatgacccggccgccgtaggcgtcatgcagccgccacaaggcgtcgcagccatcggccgccggcgcttcggcgaaagccccggtctcctgcagcgcctcgcggcggaaccagacgcttgggctgatgtagtcggcaccgcgctgcaggtcgagattgaagtccggcttgaacaccggccggcagcgcttgccgtccgcgcccaactcgtcgcagtcgctgtagatggcttgccattccggatgcagcgaggcgtgatcgcccagcgacagcagcgcgttgaccgccaattcggcgcctgccggcagcaccgtgatccagtcgcacggcaacgcccctatcaccgcggcgaaagcctgggtcagctggctgggatcgcgggcgtcgtctatgcgcagccaacccagcacgtcggagccctggaaagccgcgtgcggccagtcgaagtcggcgatgaagatcagttgccaatgcttgtacagctgctgccccatcgagccgatggacttcaacgcctcctgctggcgatcggcggtcagcggcatcagaacgatgaagcggggctggctgccccagctgcgcaccattctttcggcgtggatttcggcctgccacggccgcaactcattgcgcgcgatccaggcgtcgtagcgggcctgctccgggctggcctgcgcgggcttcagcgaagggaagacaatctcgttcggaccgccctgcggcatcttttgcgacgcggcgatgaagccctcgagctgctgcagcagctcgagctggtattggtgataaacctgctgatagtccaccaccttgccatgggcggcggcgatcgcctgcggcgtgtcctcgaaggtcacgcccggcagcgccagccccagcgccagccccgcccgctcttccggttttttggaaaacaccgtttccatcaccaccaccgggcagccgcacagcagcgcctcggagatgatcgccgaattggcgaaggtgtacagcaccttgccctgcctcaacagcgcggccagctcctcatggctttgcggccactcgtaggtgatgacgtcggtgttctggaacaacgccgggaaatcccgctccgcgtgcttgtagcgtcccgggtaaaccagcacccggtggcggctgtcgtcgtgcgggttgtcgtcgttgttgaagatggcggtgtcgatcgatgggatgaaaatgaaggacgggtcgggatacttggcgtaatcgacataatcctggtgccagaacaccagcaggtccgacggatcgtaatccttggggccgcccaacaggccggggtggttgagaatgtagcgcgccaccgccttgccgttgagcggattgccatgcaccacttcagggtagacgacgatgggggaacgcccgctggctttatggcgatcgacgatgtcctgggtcagatacggcgttctgagcttgggatcggtttcgggggagaagacataggcctcctcccccagcttgttcaggtaatggcacagcaggtgcatggcgcgcacgccattggagacccgggtatagcctggcgcgcatatgtagtagggctggtgacgctcattgtagaattttttttcgatctgcatattcgcttgctttcatgaattccaagcatggaaaccagggccagccgccgcggcgcggccgggtttccgaatcagcggcggcgccgcggatgggcatcgcgcgcagccgccgttcaggctccggcaaacgcatcgacggaaaaccgtatcgcgtcgcccagcggcgtccagggcgcgaggcccagctccgcgcgggcgcggccgatatccggcaggtacaggttgcgcgccggattgccgacgctggcgtcggattgccccagaatacggacttcggcggcgggacacacccggtccctgacctcgcgcgccaattcggcgatcgtgatcgcggcatccgatcccacattgaagaccctggcccccccctcgcgctgcaacagcgccagcatccagaccaccagatctcccatgtacagataggagcgcgacggactgccgtcccccgttatgatgataggatgaccgcgcatcgcacactggatgaaattgcctatcgcgtaatggatgtccagcggcatgaaggggccgacgaaggcgaagcagcgcgcgacgctcaaatgccagccatgctgctgcgcataggcggcgcaaagaaactcggccgcgcgcttggcctggcccagcgcggtgatcgggtccatcgtgtccggcgcgaacgggtcgtcctcgcgcagcggccggccggcgagcgacggcccgtaggccgcgccggagctggtgaacagaaaatgctcgggctgggcctcggcggcaaagtcgagcacgcggcgggtgccgctgaccagcgtgtcgaatttgttcagcgaagtctcgccgcggaaggtttcatgcgccgaggtggtggcggcatgaatgaagtggctgaaacgctccctgggaaaggagaagtcgcgcacgtcgccgacatggaaacggatggccggattcgccgccagatgcggcgcctgccgggtgaaggcctccggattgcggctgagcgccagcacccggatgccggcgtccagcctggcgttggcatgggcgatggactccaggatccagcggccgaaccagccggtcccgccgctgatgaacagcgacgcgccgcgcaggctgtcccagagctcgggtttgcggcccagaatggcgtcgagatcctgctccaacgtgcgcggcggcatgaggcggtgcaaagccatgcgcctggcgactaacccagcacgaccagcgcgctggcccagtattccgccgcctggtcgttgtggacgcggcggttgaaggtcaggtcgtagccataggcttcgaagtgatagccgacgccgtcgcgctccgcctccaggccagacagccacaatagcggcggatagcctgccttgcgcagcagcaggtccggcgagccgatgaaggcggcgcagctatcgtagccgcctgccagcaggaatggcgcgggcagcgtttccagctgctcgatcgcggccggcaccgaatattccagcaggcaggggaaatagaaaccgaccaccgggccttggcgcatcgcctctatcaggcggtcatggcgcgccccttccgccggcgtcaacaggccggagaggctgggcttgtgatggttgacgaagctgtactgcggcagctcggcgtcgtacacgcttttcaccgccggcaggtaacgctcgtccagcgcctggccgatatcgtcgtgcgccgcctgcggcaggaagaacggcacatgcgcgccgttcagcagccggcggccgtcggcgtcgctctccagcttggccaagatcgcgcgggcgcgctgctcgaaagccgcggcgtccaggccttccgccgcgcccagatggcggctgatgcgctggtggatggccgcgtagtctatccgcggctggtgcggcaggaaatagcgccgggtctggcggtggcaggcggcctgggtggccgtatgcggcaggcagcggccgttgtcgtcgaagcgcggcgcgctctcgacggccggggtcatgactggtgcgttcattcggaaaagcctttaccgtgattctgtaggtcgtgccgtcatcaatcgtacagggagtcctggtcggagaaaccctgcccccacggcagcggcaggaacttggcgcccgcggtcttttccgtgtggatcttgatgaacttgggatcttcgccgatcaggcaatcgggccggtgcggccccagccacgggttgcgcatgccgcgcgccagcacttccttcagcgatgtctcgcgcaggttgccgatggagaaatcgatgtatgggcacggcgtcacttccatcgtcgaagtgacggtgatgatgcccttgaccgtgatgcagcccttgtgcgaaccataagacggcgtcatgtgcgagaagacgttgtactccttctccagctgccgcaggatgtcggcgtcctctttctcgatgacgaattccgggtgctcggtgcacgagccggtcggcttggcgtaggacacgtagaggccgatgccgcgctgggtgacgtattcgcacatccggcggaattcttcggtcttggcgcggcccttgaccagcacggtcgacaggatcaggttcagcccggcgtccagacaggcgtcgacggcgcgcatcacccgcttgtacgagccgggcttgttgcggaagttgtcgtggtccttctcgacgaagctgtccagcgagatctgcactttctcgacgccgatcgccttcagatgcttggcgcgctccagatctaggaaccagccgttgctgtcggtgatgatgtaatgcttttccggatcgagggcttcgatcacctgatcgaaatccttcatcaccagcggctcgccgccggtgatcacgaaacgggccagccccagttcgtcggcctggcgcgacagattgcgaatgtcgtcgtaatccatcttgctgcgggtatccaccaccttgatcacattcttcaggtggcggtccatatagtattcagccgagcagtgcgtgcacttgaaattgcacagatagctcttttccaggcggatgatcgggctgatctcgccgcgttcttccatttcggcgatgcgcgccaacttggccgcgacataaggcttgcgccgggcgaggtcgtttcgtttcgcctgctctgcctggctcagcgccaggttggtggtgtccagaggagcgttcatatggtgtctcctaaccatcgcggcggcgcagcggccgcgagcctttcgcgatggcagtcagctgtttcgagtgtatcagagaggctatgcagaatggcgcttctgcctatttatctgtttgcgcatttctactgatggtcttcggcattttcggccaaaacttgaatcggcgggctttgccgcatggcggggtcgtcgtcgatatagccgcggtagacctgctgcaccggcagcaggtcgtccggacaacgcgcgtgccacgcccaatcgccggcgcgcggcgccgccgggtcgaagcggcgcgcggagtcgggcggcgtggtcagccggcaggcgtgcagcagcgagatgaaatggccgcggacgtcgcgcttgggaatcagcatctcgtgccggcacaagggatgcgggtcgaagctgacctcggcgcccagctcgtgcgcggcgacggcggcgatgcggtcggccgagctttccttgaagcggatgatgccgcccgggatatgccagccggggccgcagaagcggtcgtcgcgccaggtcagcagcgtccgcccctgttcgtcgcggatcagcaggtcgacattgatcatcggcgtcaggctgctgacgaataggaaaatctcctcaggcagcccttcgcgcgccgagccgaccgcctgccgcagcgtgtctatcgcgtcgagtatcgcctgttgccggtctgccgggtgtttatgcatcgccagcctccgggtcaacggtttgcaggcggttgtcggccaggaaggcgacggcgaagcgcgcgccgtggcgggcctggatctggcgcaccacctcggcggaatagctggccgccagcacgatcaccgcgtccacctctccgtcctgcagccgctccggcgcgacgatgggcagatgggtggccggcgtgtagcggccctgcttgaacggcgccgaatccagcacatagcggatgcggccggcgacgcccatcaggctgatcaaggccagcgcctggtggcccgcgccccagatcgccacccggcccggcgcgaagcggcccaggaattcgtcgaacgacgcgcgcagcgccgtctcgcaggcgaccagcgccgacagccgctgcggcgcgcgtttgcggaccgtggccgacaacacgtagtcgtgccaggcggctcggcagtccagcacttcgaagccgttggcctccagcaggccggtcagcgtgcgctcggtgaagtagaacaggtggtccgggatgaattcggcgaacaagcccttttcgacgatcatgtcgaaattcggcacttccaccatgccgacggcgccgtcggccagattggcggcgatgccctgcagcgtcaggtgcgcggccgggatgtgttcgaggaagttcaggatcatgaagccgtcgaatggaccgtccgccagcctcgtttccggactgtccacgaagccccgctccacccgcaggccggcctggccgcaggcttccaccgaggccggcagatgctcgacgccataagcgtccgcgccggcctcggccagcagcgacaggtattcgccgcggccgcagcccacctccagcaccttgcgcccggccaggccgtgcccggccagccaagcgccgaactgcgccagccggaaggcgcgcatttccggcgagatgccggcggcgcggatcacgtcgcgccagtacggcaccggctcggcgtccagttgcagcagcccgcagccgccgcactggcgcagtgccagctcgacgccgcggtcgtcggccagccgctcagccgccggcaggccctgggcggcggccggcatgtcgcgctgcaccagcagcggctcatcgaacagccgctgcgcgcagatgcggcaatgcgtgatggcagccatcgctcagccgccccgctgggcggcttcggacgccggcagcaaaggaatcagcatttccgcgcgcagttgctccagcggcagcagcggcgacatgtcctccagcggcatcgacagcatcgagccgtccggctgcggcagcgcggcggctttgggctgcagcgtctcgttctcgttcagccgcacgtcgcacagtatcgggcctgggtgggccagcaccttggccaggccttcggccagctcctcgacgcgctcgatgcgcaccgccggcaggccataagcctcggccagcgccagcaggtccggaatcgccaccccggcctccgggccggtgccgatgtagcggctatcgaaataattgcgctgggtgttgcggatcgacgcgtagccgttgttgttcatgatgaacaggcggatcggcagtcgcagggccttcagcgtggccagctcctgcaggttcagctgcaggctgccgtcgctttccagcgcgatcatcggctgggagccattgcccaggcaggcgcctatcgccgccggcaggccatagcccatcgaaccgaggccggaagtcaggaacacccgctggcccggcttgttgcggaacacggtatagaacacctcgaccgccaggccggagctgccggtggaaatcagcgtgttttccggtgcggcgtcggacagcgcgtcgacgaaatggtagtggctgatctggccgctcgccgggaacggcgcgccgtcctgcaccgggtagcggcgcttccagccggcgcagcggtccagccacggctgccacctggacttgggcagatggtctgcggccgccagcaggccctccagacaggctttggcgtccatcgccagcggcaggtcgatttccatctccagcttggcgatctcggcggcgtcgacgtccaccaccaccttgcgcgcggcgcgggcgaagcctttggggttgtaggcggtgagaatgttgtccagccggctgccgatggcgatcaacaggtcgcagttctgcaccgcgaagttgccgggccgcagcgccaccacgccggggcggccggcgcacagcgggctgtcccacgggatcaggtccatcgcgttccaggtggcggccaccggcacctgcagcgcttcgctcaaccggcgcagcgcgtcggcgccgccggaaatgcgcacgccgtggccggccaggatcagcggccgctcggcctgcttcagcaaatcggcgatggcggcaacatagttctgggcggccggcgcggcgtccgcttccggctgccagccaggcaggctgtccgggtcgatgcgcgccgcctgcacgtccagcgggatgtccagccacaccgggccgggacggtcgctgtgcgccaggtgcagcgcctgctccaggtgctggcggatggcctgcgggtcggtgactgtgaccgcgtgcttggtcaccgggcgcgccatggacaccacgtccacttcctgcacgcccttctggcgcaggccgctgccttgcagcaggtcggcgcgcttcacctggccggagatcaccagcagcggcagcgattcgatccaggcgccggccaccggcgtcaggatgttggtggcgccggggccggtggtcaccatggcgacgccggtgcgctcggccaaccggccgtaggcctcggcggcgatgccgcaggcctgctcgtggtggcaatgcacggcggtcagatccggctgcagcgccagcgcgtcgttcagatgcatcgcgccgccgccgggcagcaaaaacacgtggcgcacgccgcgcgcggccagaaaatccatcacgtagtccgccaggcggacaagttttgcgctcatgcttacatccagtaggtcaggcgggtcttgcggtccttgttggcgctgatccgctcgtcggtatagtaggaatcgtcgacgtagtgggtggacgagatctcctcgaacaccaccccgccccgggtatggaagcggtggcgcacgccgcgctgcacggtgatcacgtcgccggcctgcgcctggcgctcctcgtcgtccagccagatggtgatgtcgccgtacagcacgatgaaggtttcttccttcttcaggtggtactgctccggatgggtctgctccggcagcatcacgatcagtttcttgcagtactcgcggttgatcaccgtcaccatggtcaggccgaactcgctgaaacgctccatgccgtaatgatgggaaatctccaggtcggaacgcccgggcaccacgatgttggcggtcttgaacagcgccttcacggcatccaccgtcttcatcaccctgtcgcgcaggtgctgcggctgcaattgcgcgctcagcaccggcgcgtcggcggcgatgtcggccgcggcggtgtaatgggtgtacttcgaccattcattggcggtcagttgcccttccaccggcgggaaggcgaaggtgacgttgtcttcggtcaggctctcccccgccttgatcggccgggtggcgaacacgccgcggcgcagcgagcgcaggctggcctgctccaccgtcgacgccgggtcgcagccgccgtcgcccagcatggcgaaggcgcgcgcggcggcctggatccagcgccggatctgctccggcgtggccgagtaattgttgacgccgtatgcgccggtcggcaggccgacgtgcttttcgaacaccgtggcgccctgggcgatggccagcatcaccggctccatcagctccgggtcttcgtgggtggaatagccgatgcgcacgccggcgtactggtcgcgcagctggcgtatccgcgccaggtgcagattctcgttcggggtcgggtactcggccacgcagtgcatgatggtcaggtccttgtcccggtgcagcatgaagctgaccacgttgtcgatgtcctcgcgccgcgcgccggcggtggaggccaccaccggcttgtcgctgcgagcgatgcgctccagcagcggccagtcggtgaacgagcagctggccaccttgatgatctcgatgccatgcgcttcgatcaggtccaccgactcctcatcgaacggcgtgcagatggtcttgaagccattggccttcatctcccgcaccagccgcagcatctgctccggcgccagccgggtttcctcgaagcgcttgatgtatttgacgtcgtcgcggcccttgaagctggggtggatgaaggtgtccagattgcggtactgcagcttgaagccgaagtcgaaatcgaagccctggcaggattcgcggatggcgcggatcagcgcgatgccgtgctcgacgtcgcccatgtggttgttggccatctcgaagatgaataacggctttcgcatgatgggcctctctttcaatcaaaattggcgccgaggaaggtttccagcttcccggcggcgaaatccagcatctgctggctcaggcccggatacaggccgatccagaaggtgtcgttcatgatgcggtcggtcaccggcaacggcgtggcgcagcggtaattgcggccttgcatataaggttgccgggtcaggttgccggcgaacaagagacgggtgccgatccggtgctgatccaggtaatgcagcaactccacgcggctgacctgcgcctccggcttcagcgtcagcggaaaaccgaaccaggatggctccgaacccggcgtcgcctgcggcagcgtcaggaattcggcgcagctttgcagccgctccgacaggtaggcgaaattgcgcttgcgcgcggcgatgaagccttccagccggtccatctgcgccaggccgcaagcggcctgcatgtcgctgatcttcaggttgtaccccatatgggaataggtgtacttgtgatcatagccgcagggcagctgtcccagctgccagtcgaagcgcttgccgcaggtgttgtccttgcccggcgcgcaatagcagtcgcggccccagtcgcgcaccgattccatgatctgcctgagcagcggatcggcggtgaacaccgcgccgccctctcccatggtgatgtggtgggccgggtagaagctgagcgtgccgatgtcgccgaaggtgccgaccttctggccgttgaaggtggagccgagcgcgtcgcagcagtcctccaccagccacaagccgtgcttgcgggcgaaggcggctactttttccagatcgaacgggttgcccagcgtgtgggcgatcatgatggccttggtgcgcggcgacagcgccgcttccagcagctcggcgtcgatattgtaggtcggcagttgcacgtcgacgaacaccggcaccgcgccattctggatgatgggattgactgtggtggggaagccggccgccacggtgatcacttcgtcgcccggctggatcgcgcgcgcgccgagcttgggcgaggtcagcgcggtgaaggccaccagattggccgacgagccggagttgacggtcagcacgtgcggcaggccgatgaactcggccaggcgagcctcgaaagccgcgttgaagcgcccggtagtcagccagccatccagcgcggcatccaccatattgacgatttcatcggcgcctatcaccttgcccgagggcggcaccgcggtctgccccggcaggaagtcagcctgggccaggcgcgcttcggcgtgttgacgcgccagggcgaggacggcctctcggctaatatcggtcatatcgtgattctctctgcttaaacacgcgagtaggccgcgatttgttcaatggtgaaggcccgcatgtccgcgccgcgccgccaggcgcgatgccagtccagcgtggccgacaaggcctcttccaggctccagcgcggcgtccagcccaggcgccggcgcgccttggcgctgtccagcctgaggatgcccgcctcgtgcggatgatcggcgccgtcgcggtgccagccgccgccgccccataatccggccagcgtgtcggcgacccaggacaccggacggttgctgtcgtcggccgggccgaaattccaggcggaggcggcgtccggctgccccgccgccagccgctcggccaggcgcagatagccggccagcgactccagcacatgctgccagggacgcaccgcgtcggggctgcggatggccagggagcggccttccgcgaaggcctgcagcaagtctggcaccagccggtcggccgaccagtcaccgccgccgatcacgttgccggcgcgggcggtggcgatcggcgcgccgcccggataagagctgcggtacgccgcgcacaccagctcggcgcaggccttgctgctgctgtacgggtcgtggccgcccagcgcgtcgctctcgcggtaggcccacggccactcgtggttttcatagcatttgtcggtggtgaccacgacgacggcttcgacgccgggacagcggcgcgcggcctccagcagattggcggtgcccatcacattggtggagagggtgcccagcgggtcgtcatagctttgccgcaccagcggctgcgccgccaggtggaagacgatggagggttcggcgcgagccagcgcggcggatagcgcggcggagtcgcggatgtccgccagttccgacgccgccgcgtcgcctacgcgcgcggcgtcgaacagcgacggccgcgccgacggcggcaaggcatagccatgcacccgggcgcccaggctgtccagccacaggctgagccagccgcccttgaagccggtgtggccggtcaggaagacgcggcggccggaccagaacgcggcgttcaccactttttccacggtgcctccccgctctgccacagctcctcgagcaggttcttgtcgcgcagcgtgtccataggctgccagaagccgttgtgctcgtaggcggccagttggccgcggctggccagcgtttccagcggctcggtctcccagacgcactcgtcgccgtctatcagatccagcaccgcggggttcaatacgaagaagccgccattgatcatgccgccgtcgccgcgcggtttttccttgaagcattcgacgcgctcgttgcggatgtccagcgcgccgaaacggccgggcggatgcaccgccgtcacggtggcgtccacgttctggctgcggtgataggcgatggctgcgccgatgtcgacgtcgctgacgccgtcgccgtaggtgaagcagaagtcccgctcgctctccaggtgcttgcgcacccgccgcaggcgaccgccggtctgggtgccttcgccggtgtcgaccagcgtcacgcgccagggctcggcatggcgctcatgcaccagcatctggttattgcacagatccagggtgacatcggaattgtggagaaagtaattcgcgaaatattcttttatcacatagccacgatatcccaggcagatgatgaaatcattgatcccgtgcgcggaatagattttcaagatatgccagatgatcggtttgccgccgacctcaatcatgggcttgggacgcaaatgcgactcttcactgatgcgcgtgccaagacccccggccaaaatcacggctttcatacatctctctcttgttgcacccagaccatatcaaacaaatgggatcatccattgccatgcaagctaggttatcggcgtcgtcgggaaaagcgcgccatgcgaacgccggcgaaccgctgtttccccccggccgcacagctaatccagcgcctgcgcgggccaacctgccctgtgctgattatcggcatcaaccgcgcggcacttgagacagccccggcaatctcccaaatggaatgtcgtccctggccgaacgccgcgcctgcctcgctccacgcgccgcaaggaagcggcgattccgctgccctcctcgatgcgccgctgaaaggtatacaggtcggccgcggatggcaagcgcgcgtcgcggcctgaaaatcgccaaaagcatatttaaaataaaaaagctcgcctttagcatgccgccgcgtcattttctccccgcccgcccgcgcgacgcgcgggcggatgcccggcgtcagttggcgaaacacgcctgcagggtgtgcatcagatcttgcacgctcttggccgccaccgccgggtcgaactccacccgcgcgttgcttcccttgcccgccgcccagttgctcaccaggcacaggtgggcgtacggcaggtccaactcgcgcgccagcgccgcctccggcatgccggtcatgccgacgatgtcggcgccgtcgcgctccagccgggagatttccgccgcgctctccagccgcggcccctgcgtgcaggcatagacgccgtcatgcacgccgctgatgccggaggcctggatcgccgcgcgcagccgctggcgcaggctgtcgtcgtagggcgaagtgaactccgcatgcaccaccggccgctccgggccttcgaaataagtgtgcttgcggccccagctgtaatcgatgatgtcgtgcggcaccaccagccggccgggcgccatgtcgggacggatgccgccgacggtgccgatggcgatcacgcccttcacgccctggttatgcagcgcccacaggttggcgcggtagttgatttcgtgcggcgccagcgaatggccgtagccgtgcctggcgatgaacaccacgttttgcttggccagcttgccgaaagtcagcgcgcaggagggatcgccgtaaggcgtgcgcaccacctgccggtgcgtcacttccaataccgacagctgggccagcccgctgccgccgatgattgccaacatatccgtctcccctcttgtcattgtgcgcagccccgccagcagcgcggctgtcgttccgattatgtctgaaaatcgcccggctgcgggcggcaaatcggcgcgcggacgcgctgcttggacaatttccttgaagttgcgcatgcgctgccctcacccgctccgcattgccacctgggaccgcgcggccgatttcgcgcgcggcattcttccggcatgacttcctgcttgccgattcaaatgataatagttatcattaacaaatgaactcgaaccacaataaatccacgcccaaaacggacccgccggccgcgccgcagctgctgcacagccggcagctgttcggcgccgggcgggaaatcctgatcgagcatcagggcgagatctaccgtctgcagctcacccgcaacggcaagctgatactgatcaagtaatacccgcgagccagccgacgccagccagcggaaacgacaacaataccggagtttccatggccctgttccgcgccacccccttgatgctgagcctggcggcagcctggccggccttcgccgaccccgcggcgccaacgctggacgccgtgcaggtgaccgcccaccgcagcgagaagccgctggccgaaaccgcgcccaacgccagcgtggtgtcgggccacaagctggacgaccgcctgatcaacgacatcgccgacgccgccaaatacgagcccggcgtcgaagtggccaccgaccccaaccgccgcggcaacgccggctggaccatacgcggcatcgacggcaaccgcatcctgatgctgatcgacggcgagcgcctgccggaagcctacgccggcggcggcaacggcaacggcgccatttccggacgcgacttcgtcgaactggaaaccctgcgcgcgatcgacatcgtcaaaggccccacctccagcctgtacggctccgacgccatcggcggggtgataggctaccgcaccaagaccgtcgacgatttcgtgcccgaggacaagggcgtgggcggcagcttcaagggcttcggcgccagcgccgacaacagctggggcggcaccgccggcgtcggcgtcaagggcgagcgcgccgacgcgatgctgatctacacccaccgcaatggccatcaggccgacaatcagggcggcaacgacagcggcagcgccgcccgcaccacgccgaacccgcagaactggcacagcgacaacgtgctggccaagctcggctacaaactgaccgagcagcagcggctggagctgacgctggagcattatcgccgcgacaccgacaccaatctgctgaacaccctctacccggcctatgtctccaggggccgcccggtgccggcgcagctggcccagaccgccgcagaccgcacccagcgcgaccgcgtgtcattgggctgggaaggcaagcagctggggccattcgaacgcctgtccgccaaggtctaccagcagaagctggacaacgccgacgacagcttcgcacgctacggcgacggcagcagcgtcgcctccaactacggcttcgaacagaaaatccttggcctgagcctggacgccgagcagcgctttgccgcgctggcggccgagcaccagctgctgtggggcgtggacttgtcccgcaccgacaccagccggccgcggatgaagacgcagtacaacgccaacggcagcaccagcaacgtcatcggcggcgaaaccttccccagcaagaccttcccggacagcacctccgaccgcgtcggcctgttcatccaggacgagatgaaattcgccaacggcatcgcgctgtcgccgtcgctgcgctgggaccactacaagatgaacacccagcccgaccaggcctatgccaacagcggcggccaggcggtgccgtcgttcagcgacggcgccttctcgcccaagctggggctgagcatccccttcgccggccactacaccggcttcgcccagctgtcgtctggcttccgcgcgccgccgttcgacgacgccaacatggccttcgtcaaccgcgcctacggctaccaggtgatcgccaacccgaatctgaaatcggaaaccagccgcggcgtcgaactggggctgaagggccagtgggacagcttcgacttcggcctgaccgcctaccagaaccgctaccgcgacttcatcgaacagcaaagcctgggcacgataggcggcttgctgacctaccagtaccagaacatcggccgcgtcgacatcaagggcgccgaagcgcgcgccgcctggcgcttcgcccccggctggcagacccaggcctccatcgcctacgcccacggcgaggacctggacagccatgcgccgctcgcctcgatcgcgccgctgtcggcggtgctgggcctgcgctacgaccagtccggtttcggcggcgaggcgctgctgcgcgccgccgcgcgcaacacccgcgcgccggcggtagcgctgccgccgccgtccaccgcgcagaccgccggcttccaggcgccgggctacgccaccctggacctgaccgcctactggaaaccggccaagggcaccaccgtgcgcgccggcgtgttcaacgtgttcgaccgcaagtactggaaagccgccgacgtgcgcggcctggccgcaggcgacgccacgctggaccgctacacccagcctggccgcaacgtcagcgccagcgtcgaataccagttctgatccacccgccccgcgggcggccgatgccgcccgcgcctccacaggagaaaaccatgagccagctatgggaccgctaccagacgctcaaagccagccaaccccgactgcgcgcgcgcgacgccgccgccgcgctgcaggtcagcgaatgcgagctgaccgccgccgatccggccgccaccccgctcagggccgaatggccggaaatcctggccgcgctggcgccgctgggccgggtgatggcgctgacccgcaaccacgcctgcgtgcatgagaccaagggcgactacgccaacgtcgagatcgacggcaaggtcggcctggccatcaacccggtgatagacctgcgcatcttcctgttccactggcgccacggcttcgcgctgcgcagcgagacgccccgcggcgtccagcgcagcctgcagttcttcgaccgccacggcgaagcggtgcacaaggtctacctgaccgaagccagcgacatcgccgcctacgacgatctggtcgcgcgcttcgccgcgcccgccgccgcgctggagcttgagccggtcgcggccgccggcgccgaacagcccgacgaagccatcgaccgcgacgccttccagaacgaatggcaaagcctgagcgacgtccacgccttccaccccttcctgcgccgctggcaggtatcgcggcgccagggtttccgcctggcgccgccgggccaggcctggcgcgtgcgcgaggacgcggtggaacagctgttgcgccgcgccgccgccaccgcgacccccatcatggtgttcgccggcaaccgcggcatgatccagatccacaccgggacgatagtcaacgtgcaagtggtgggcgactggctcaatgtgctggaccccgatttcaacctgcacctgcgcaccgacctgatcgccgaagcctggatcacccgcaagcccggcgacaacggcgtggtcacctcgctggagctgttcgacgagcagggagagtcgctggccaccttcttcggcgaacgcaagcccggccgtgccgagcgggccgaatgggtgaagctgctgggcgagctgccgccgctggagcaagaagatgtcgcgtaagaccatgctggccggcgcgctgctggcaatgctggccctgcccggccacgccgccgagcggctggtggtggtgacgcccgacatcgccgagatcgtcgtcgcgctgggcgccgccggcgacgtggtcggccgcgaccgcagcagcaaggagccgcaactggcccatgctcaggtggtgggcttttcgcgcgcgctgaacgcggaaaccatcgccggcctcaagcccaccctggtgttgggcagcgccgccgcccagccgccgacgctgtggccgcaattgaagcagctgaagctgcgggccgaagaggtgtccgcccgcgaggacggccgcgacttcgccgacgccatccgcaaggtgggccaactgctcggccgcgccgacgccgccgccaggctggcggccgactggcagcagcggatgcagccgcggccggcgcgcgccgtccgttacttggtcagctacgacggcagcctggtggccggcaaggacaccgcgccggataccctgatccgcgccgccggcggcgtcaacgccgcggccggcatcagcggcttcaagccgctgggccgcgacgcctggcaagcgctgcggccgaacgtgatcatcctgggcagccacacagccgcggtttacggcggcaaggaccttttcgccaagcggccggaagtcgccgcgaccccggccggcaaaaccggccgcatctatctgctgccgccgcagcaggcgatgctgatcggcctggacagcccggcggtggtcgaacggatggtgaggatgtgagcgccgcccgccgcttgttgtggccgggcctgatactggccagcgtcgcgctgccgttgctggcgctgtccagctccgccggccagttggcctggccggatctggccgacccgctggtcagccagctgcggctgccgcgcatcgccgccgcgctgggcgtgggcgcggcgctggccgccagcggcgccgcgctgcaggcgctgttccgcaatccgctggccgatcccggcctgatcggcacctccagcggcgccgcgctggcggtgatcgccgtgctggcgctgggcttgtccggcctgacgctgccgttggcggctttcggcggcggcctgctcgccacctggctgatcctgctgctggcgcggctggtcaagggaggcatcgccggcctgctgctgatggggctggtggtgggcgccttctgcggcgcgctctccagcttgatcctgtttctgtccgacgacctgaccctgcgctccgccagcagctggctggccggcaacctgggctcggcgctgcccggccggctcggcctctgcctggccgtatccgcgttgggcatcgcgctgttgtgcgcgataggccgcgacctagactgcctgctgctgggcgaggaaagcgcccgctcgctgggcatcgacacccgccgcacccgccggctggccgccatcggcgccgcgctggccacaggcggcgcggtggcgctgtccggcgtgatcggcttcgtcggcatgatgatccccaacgcgctggcgctgctggtgggcggctgccgccgccggctgatcctgctgtccgcctgggccggcgcgctgtttttgctggcggtggacaccctggcgcgcaacctcgcctggccgctggacctgccggtgggcctgatggccgccttcgccggcccgcccttcttcatctggattttccgccgccaacaagggagccgctccgatgcctgacacctacacgctgaaagtccgcgaactggattaccggataggcggacgcgcgctgctgagcgacatccgcctggaccttcccgccggccaggtatccgcgctgctggggcccaacggcgccggcaagaccaccctgctgcgcctgctggccggcctggccgcgcccagccgcggcgcggtgcggctggccggccagtgcgtgtgccggatggacgcgctacagcgcgcgcgccgcatcgcctgggtgccgcagcaactgccggccgacattccgctgacggtggccgaattcgtcgcgctagggcgcatgccccacctcggcgccttcgcccgcccgggcgcggacgaccgcgcggcggtcgcggcggcgctcgccaccgtggaaatggagccatacgccggcaagcggctggagcagctgtccggcggagaaaggcaaagggcggccatcgcccgcgcgctggcgcagcaggcgccggtgatcctgctggacgagccgaccaaccacctggacctgcgccatcaacaccagctgcaacagctgctgcgccagttggcggggcaaggccggacagtggtgcaggtgctgcacgacctgacgctggccgccgactacgccgaccgggtggcgctgctggagggcggccggctggtggccgccggcgcgccgtcccaggcgctgacgccggagcggctgctggcggtgtaccgctggccggtgcggctgcgccaccacgcgccgccgcaagcggcctgagcgcgcccatgaaaaaagccgcgccggatgccggcgcggctttgtcggacatcgagcccgcgtcttacttcagcgcgtagatggccggcaggttgcgccaggcgccgcgcacgtccatgccatagccgaacacgtagcggtccggcacgtccaggccgacgaagtccgcctgcatcggcttttccttcgagatcagcttgttggcgaacaccgcgctgaagcaggccttggcgcccatctccatcactttgtcgcggatggcggccatggtgtggccttcgtccaggatgtcgtccagcaccagcaccacgcggtcgcgcacgtcttccttcggcgcctggcgccataccaattcgccgccgtgggtcttgtcgccgtagcgggaaacatggacgtagtcgaagtccagcgggaaggccagacgcggcagcagttggccggtgaacaccaccgcgccgcccatcaccgacaacaccagcgggtattcctcgcccagcttctcggtgatttccaccgccatccggtcgacggcggtgctgacttcctcggcgctgaacagcacgtcggcgctgttgatcagcccgcgggcttcggaaatattaggcatgatgactccttgacagaacaggcggcgccgccgggctgcggcggcgcgaatggaaaaacaatcagttgcgcttcaggccgtccaggaaggcggcgaactcgtcggccacctcgtggtgcttcaggccgtaattgacggtggctttcaggtaacccagcttggagccgcaatcgtaacgggtgcccttgaacggcagcgccagcaccggctcgctcttcagcagcgcggcgatgccgtcggtcagctggatttcgccgccggcgccggcgccggtgttgaccaacttgtcgaaaatgcgcggcgtcaggatgtagcgccccaccaccgccaggttggacggcgcgtcttccggacgcggcttctcgacgatgtgctcgacggcctgatggccatgcgcatcggtcttgaccttgacgatgccgtaggagctggtgtcctgcggcgccaccgtctccacccccagcaccgaggagtgggtttcgtcgaacagccgcaccatctgctccatcgcgcccggcgcgccttcgatcaggtcgtcggccaggatcaccgcgaacggctcttcgcccaccaccggacgggcgcacagcaccgcgtgccccaggcccagcgcctcggtctggcggatatagatgcacgacaccgacggcggaatgatttcctgcaccagctccagcagcttgtgcttgttcttgtattcgagttcggtttccagctcgtaagccttgtcgaagtgatcttcgatcgagcgcttgttgcggccggtgatgaagatcaactcggtcatgccggcggcgatcgcctcctccaccgcatactggatcagcggcttgtccacgatggggagcatctctttcggactggccttggtggccggcaagaagcgggtgcctagaccggcaaccggaaacacggctttggtgatctttttcatctcgattccgtaacgcagtgacgatttcaacaacgacagcgccgcattctagctcgacttggcttcaggtcaaaatgcccattgcttcgacaaggcctcgctcagttcgcggaccagcggctgccagtttccgggctgagcctgccgccataggcgcaccgagggataccacggcgcgaccggcgcttccgccaggaagaatggcgcgctttcggcgcgcagcagcgcccacaccggcttgcccatcgcgccggccagatgcaggatggcggtatccacgcaaaccaccagatccacctgcgccagcagcgcggcggtatcggcgaaatcgtcgatgcggctggcgcggacgcatccacgcagctcgtccggcaccgcgccgggctgcaaggcgatgaaatcgatatccggcgcttggcagatttcggcgaactgcgcgggcggaatcgatttatgctggcgtccgagatccgccacgccgacgccccaatggccgctttcccacaccacgcccacccggcgccgcttgccggccggcaaaaccggcggcgccccgtccggcaaacgcaggtacggcgcggtcggcaaattctccagcgtgacgcccagcaaacccggcaatgacatcagcggcagctggcaatcgtgctcgggcgcggcgtccgcctccagcaaggtcaggccctcgaactgcgcgaacaggcggtggaacgagcgcgggcaagcgaacagcagcctggcctgcggatgggcgcgccgcagctgcggcaggaatctcgccatctgcaaagtgtcgcccaggccttgctcggtccacaacagcagggtgcgcgcgcccagcgcgtctccctgccagcgccttgccgtcagccttggccgcagcacgcagcgccagcgcgcttcgtacaggggccaggcctcggcgtatcggccggccgtcaacagcgtgatcgactgattgaactgcaaggtggcgtcgtccggcgccagcgccagccctttttgctgcaccgcgatcgcctcgtccagcagcagcgcgcagctgtaggcgttgcccaggttgctgtagcgcgccaccgacggcccgcccagtaccagcgcgcgcaattggcagtcgatggcgtcgcgatagcgctgctggtgctggcggacgatgccgagattgacccaggcgtcgagatggcccggctccgcggccagcacctcttgcagcaaggccgccgagatgtccagctcgcccagctccttcagcagcaccgcgagattgctcttgatgttgcacgacgtcgggttcagcgcggcggccgccagataatcatccagcgcgccgggcgtgtcctccagctgcagcctggcgttgccgcggttggccagcgcctgccaatcctgggggttcagcgacaggcagcggtcgaacgccgcgatggcgccggcccagtcgccatgggcggcgcattgattgcctacctcgaaatccgctgtcgccatcatgcttgatgtcatcccgccctctctcagttgcccgacaacaacgcctgcaggccggcttcgtccactaccgcgacgcccagttcctgcgccttggcgagcttgctgcccgcctcctctcccgccaccacgtaatgcgttttcttcgatacgctgcccgacaccttgccgccggccgcctcgatcaaggccttggcctggtcgcggctcagcgtcggcaaggtgccggtcagcaccagcgtcttgccgtccagcggcagcgccgccgcctcggcggcctgcggcagttcggccaggatggcttcgcgcaagccggccagacggctcagcgactcgcgccggcccggctcgtccagccagtcggccaacgcgttcaccacctcggccggcagatccagctccagcagcgcgcgccgttcgctggcggccagccaggccaggctgcgctgcgccgccagttgctggctgcgcacttcggtcaagcgcggaatgcccagccgcgccagcaaggccgcgtcgtccagccgctcgcgcaatctgggcgacggcgcatgctcgtcggccgggcgcacctcggccagcagcgcgtccagcgccttttcattgttgtcttcggcgaagaagtccgccagcgattccgccaccaccgcgccgatgtcgggcaaggcggcgaacagcgccgccgggcagcggcggatcaacgccatgccgcccagccagtccgccagcgtcttggcggtggattcgccgacatggcggatgcccagcgcgaacagcagccgcgccagcggcggcgcgcggctggcgtctatcgccgcgatcaggttttccgcccacttgctggccaccttgccggccttcaccgtttccggcgtgacgccctcgtcctcgtcggcgcggcgcttcatctccagcaagtcttccagcttcagccggtacaggtcggccacgcctttcacgtaatcgtattcgaccagcttgtcgatatagcgctcgcccaggccgtcgatgtccatcatgcgccggccggcgaaatgctggatcgcctggctgcgctgggcgcggcaggacaggccgccggagcagcgggcgatcgcctcgccttcttcgcgcgccacgtggctgccgcacaccgggcaggcgctcggcaaacggtaggccgggtattgcggcgcctcgccggcgctgaacagatcgccgccctcggccggctgcatcggccggcgctccagcaccaccgacaccacctcgggaatcacgtcgccggcgcggcgcacgatcaccgtgtcgccgacgcgcacgtccttgcgccgcacttcgtcctcattgtgcagcgtggcgttggtgacggtgacgccgccgacgaagaccggctgcagccgcgccaccggggtgatggcgccggtgcggcccacctgctcctcgatggcctcgaccaccgtcagcgcctcctcggccgggaatttatgggcgatggcccagcgcggcgcgcgcgacacgaagcccagcgcgtcctgctggtcgcggcggttcaccttgtacaccaccccgtcgatctcgaacggcaggccggcgcggcgcgcctgcaccgcttcgtagtaagcggacagccccgccacgcccttgaccaccggccgcaagctttcttccaccaccgggaagcccagctgcttcagccaggccatttcgccggcgtgggtgtccggccagtccgcgcccgccacctgggcgatggcgtaggcgaagaacgacagccggcgctgcgcggtgatgcgcgagtcgagctggcgcaggctgccggcggcggcgttgcgcggattggcgaaagtcttgtcgccgcgctcgatctgatcggcgttcaggcgctcgaagtcgcgcttcagcatcagcacctcgccgcgcacctccagcagcgccggcggagccgcgccgtccagcttcaagggaatggcgcgtatcgtgcgcacgttctcggtcacctgctctccggccacgccgtcgccgcgggtggcggcgcgcgtcagcacgccgttttcatacagcagcgaaatggccagaccgtcgaacttgggctcggtggcgtactcaacctcggccgcgtccaggcccttgcgcacccgctcgtcgaactggatcagctcggcatggcgctctgccgggtcggccagctgcatgtcggaaaaggcgttggccagcgacagcatcggcaccgcgtgcacgacgctgtcgaattcggccagcggcgcgccgccgacgcggcgggtcggggaatcggagagcgccagttccggatcggcctcctccagcgcctgcagttctcggaacaggcggtcgtattcggcgtccggcacggtcggcgcgtccagcacgtagtattcgcggccgtagcggttcagcagctcgcgcaattcggcggcgcgcagttggtttgcggtcatgggaagctctcgaacggcaaaagggccggcaaggccggccccgtcatcataaattcatcgctcaggcgaacaggcgcagggcggcgacgctgcccggcgcgatgcccctgtcgtccatgctgccgtaaatgtgcagcagttggtcgcggatgcgggccaggccggtttcggtcagcacccggcggttgtcgtccaccagctgcgcgtcgaattcctgggccaggtgcttggcgaagtgcacggcgcggtcgaacacgtctacgccgccggccacgcgcggcacgtcgaacagcagcgtcagcgccgggaacgacttgtccagcaaggtatggaaagtgaacggcatctggtcggccgccaccagcgaatacagcgtgttgccggagtcggccaggtaatggaaggcgccgtccggctccagctgcagcccggcggcttcggcgaagctgcgcaggcgcgcgccctcgatcgaagcctgaggcacgatgttgatgccgatcagcacgtcgacgtcggcgcagaagcggtccagttcccgcgccgccaccagcttttgctggcgctgcgggaagctcaccgccgcgtcgtggtcctcggcgaagcgcgacacctgctggcagaaggcggccagttcctgctcgcccaccgcgccggagcggtccaccatctgcatgctgacgttgatctgcttgtagcgggtgccgggcagcgcctcggccactttccacaggccgcgctcggtgcggccgatcagctgggtgcgcttgccgacattgaagcgcggcatcgccgccagctcgtgcggctcatggaacatcacctcggcgatgaaatccagcgacgggtccagcatcgccaccaccagcgcctggtggtcggcggagtccatcgccagctcggcctcgtcctcctcgtccatcaccggcacttccacttcctgcagcgccggttcgcggcgcggcgccggcggcggctcgcggaccggcgcttccgccggcggaatctcgaacaacggctcgtcgtcctcttccggcgccctctccggctccagttccgcatccagcagcaccggctccatccggtcggctttcacgccgtcgcggacattgttcttcggcacatccagcagcacgtcgccatgcgggcgcgcgaaggcctggtgcgtccgcttgcggaagcgccattcctgaaacatgttgaaacccagcaccagggcgatcacgccgccgcccaaaatcaaaacaccaatctgcaattcgctcattagccagtccgcattaaggcgaataatcgaggctgccagccgcgcccgtcggcgatccggcctgtcagcctccctcgatcctgtcaccgcctcggccgcagccattcggcggccggcccgttctgcagcgggcatttcaggctcattataacgaaagcccgccgcagcgcgccatttggcattgcaaaaacgcttgacaaacccccgacgcgaaaatgccattgccaagacggctgggccaagccattagaccagctacgcatttccccgcaaccctgtataacgctcaggaaaattcgccaggatgaatatgacatttcagacaggcgaatttatccggatcgcgtgccagaattggagataactctgttacagggccgtactagtctgtacaacactgcttagaacagcacggggactctttacgatgaaaaaatccgaccaagccagtttcctgcctgtcgtacgcgaattgtcgcgcacttaccaggcctttgaacagttcgccagcttcaacatccgccggctgggactgacaccgccacagttcgacgtggttaccaccctgggcaacagccagggcatgaattgcaaggagctgtccgaccacaccctgatcaccaaaggcaccctgaccggcgtgctcgaccgcctggaagacaagggcatcgtcacccgcagcatgcagcccaacgaccgccgcagcgtattcgtggctttgacaccccacggccagcaattgttcagtcaagcctttccggcccacctcgactacatgcacaacgctttcctgcatttcggcgagcaagacctatccggcttctgcaacgaactgggccgcctgcgcgccagcttcagccaggcattggagcaacaggagaacgagccggcctaagcctaagcaagcctcctcccgctcaggcgcgccgcctcactgccggaagctcaccgggatggtcagcaccgattccgcggccgctccgccgcgcctggccggcgcgaatcgccagcgcgccacggcgtccatcgccgcctggtccaggcgccggaagccgctgctgcgcgccagcgtcaccttcagagcccggccattgacgccgactctgacgctgagcaagacctcgccctcttctcccagctgcagcgaccgctccgggtaagggggctgcggattctccagataggctggacggtaaagcgcctcatggtcgccatcgctctggccttcgtcctttgcctccatcccgcccgtagccgaaatctgcccgcctcccgccgcatcagtcgcggcggccgcggcatttgcaaaacggccagccggcgcagactggggccccgcgacgccggcggcaagcgatccggccccggcatgttcagccctctgcgactgccgggctggcatcgccggccggcttccagccaaaccgcctccgccgcgcagcgcgcccgcggcatgcgcagccgcagcgctccccgccgccagacgaaccgccagcggcggctcgggctgcgccggcacggcatcgcgcgccggccagcttgcccaaatccagactgccagcgcatgcaggcccagcgacaacaggcaggctcgcctcaacgtgaacatcgcggcgctcagcagcgcatggcagcgcccagccggctgtaatgccaccaggccagcgccatgcacagcaggtaaaacaggaaaaacatcgcgaacgccggcaaaaagccgccgaaccagctcagcgacgagccgaaggccttgggaatgacgaaaccgccgaacgccgccatcaccgaactgacattcatcgccgacgcgccgcgcctgccgccgcgggcataggcctgcaacaggctttcgccgcgccgctgcgcctcgcgcccggccagcaacagaaacaccttgggcgccaattgataggacgagccgttgccgacgccggccgcgaggaaaatcagctggaacatgccgagaaacagccagaacgagccgccgctgccggccgacggcaggctgagatacaccccgacggtgcccagcgccatcaggagattgctggccacggtggcgatgccgccgccgatccggtcgcccatccagccgcccagcggccgcgccagcgcgcaggccatcgggccgacgaacagataggggctggcgtccacttgcggaaacatgctgcgcgccagcagcggaaaagcggcggaaaaccccaggaaggtgccgtagctgcccatgtacagcaaacagatgtaccaggtgtgggcgtcgcgcatcgcgtccagctggtcgcgcggggtgatgcgcagcttgggcagatcgtgcgcgtacagcagacaggccagcgccgccagcagcaccagcggcagccagacataggcggcgttctgcagccagacgtaatgcacgtcgccgccccggccccatacctgcggctcgccggcatgcaggccgaacagcggatagaggatgcacagcggaatcagcaattgcgccaccgacacgccgagattgcccagccccgcgttgatgcccatcgccagccccttttccgacttggggaaaaagaagctggtattggacaaatgcgaagcgctggcgccgccgccgacgccgcacaagccggccaccagcagcaattgccagaatggcgcggcgatgtcctgcaccaccgcgcccacgccccaggccggcagcaacagcaacagcgtcgacaggcccagccacaatccgccgccgacccagctccaggcccaggaatagatcagccgcatcagcgcccccaccagtggcgggatggacaccagcaggaactgctgttggtcggaaatgagaaagcccaccgccggcagattgaccaccaccatgctccacatcatccagatgttgaaattcagatgcagcgagaaggtggacagccacagattgcgccgggcgatgccgcggccgcggctcagccagaaaatgacgttttccggctcccagcgtttgatgcttacggtcatggctacacttccacaatggcgagaacgcgccggcggcgagcgacgacgcgttccgttcggatccgcagaatggtttcgatcaggcctatcaaggcggcgcagtatgccatccgtccgcctcgcgccctttgcgccgcgtcaatagtggaatcaggcggtctcgcgcatcttcagcgcttcgacgatgtccaccgcgacgatgcggctgacgccctgttcctgcatggtcacccccaccagttgctcggccatttccatggtcaggcggttatgggaaatatagaggaactgggtgcgctccgacatttgcttgaccaggtcgcagaagcggctggtgttggcgtcgtccagcggcgcgtccacctcgtccagcaggcagaacggcgccgggttcagagaaaacagcgagaacaccaggctcatcgcggtcagcgccttttcgccgcctgacagcaggtggatggtgctgttcttcttgcccggcggctgggcgatgatctgcacgccggcgtccagcaagtcttcgccggtcagcaccaactcggcgcggccgccgccgaacagcgtggggaagaattcgcgcatcttggcgttgaccgcctcgtaggtggcttgcagcatctcgcgggtttcgccgtcgatcttggcgatggcctcctccagcgtcgccatcgcctggttgaggtcgtcggactggctggccagatactcgccgcgctttttcgcctcttccagctcttgcagcgcagccaggttgaccgcccccagcccctccagcgcccgcgccaggcgggcgatttccgccgccagcgcgttcggcttcaccccttcgttgagatcggccagcaacgccgcctcgtcggcctcggcctgggccagctcctcggcgaagcgctccatcgccagcctggcctcctggtgcttgagcagccagtctgaacgcgcctggcgcagcgccggcagcgcggcgttggcttcctgctggcgctggcccagctcgcgcagccgctcggtcagctggttgagccggtcgcgcgcggccgcgaggccgccttcgcgggactcgcgctcggccagcgcctgctgcagcgcctcttccggcaccgcctcgtcgacggtttccgactcggcggccagcgtctccagccgttcctgcagctgctcgtcgcggtcggccagctcgcggccgcggcgcgacagttcggccaccttctgctcggcgctgtgaagcgccagcttgatctcgtgcagcacgcgctcggcgtcgcgcgccttgttgcgcgccagttgcaggccggtttcggcattcagccggtccagcctcacctcttccagctgcagcgccagttcctccagcgtcagcgccgcttcctcgcccatcagttcggcctcggcgatgccgtcgtcggcgtgcgcgcgctcttccgcgatgcgctggcgctcggcctcgatcgccgacaagcgcgccgcgccctggcgcgccgcctggtccagcttgacgtgctccagcgtggcggcgttcagctccgcctccagccgggtcagcgagcccttctggccgcgcaccgcctcggccagcatattgcccatgctcaagaggctgtcgcgcttcttctgcatcgcttcgatttccggccgccaggcctcggcgcgggcgctggcttcgtccagctgccgcttgcgcgccatcaggccgtcgccgctggcttcggcgtggtagcgcacgctggcggcatcgacacgatggccctccggcgtcagccagcattcgccggccgccaattcgccgcggcgcgccaaagcggcatccagcgtgtcggccaggtacacgccggccagccagtcgcccagcgcggcatcgaacggcgcttgcgccttgacctcggccaatagagccggccagcttcgcgccggcaatccggcggcggccgcgcgcttgccgtccaccagaaccagcgcggcgggcggctgcccggccggcagcgcggcggcgcgggcggacaggcgttcgcccagcgccgcttccagcgcctgctgccagcgcgcgtcgatctgcagcgactgccacagttgcggcgcgtcggccaggccatgctgttccagccagccggccagttgctcgccggccgcctcgcgctgcagcagcgccgccagcgcggcggcctctgcctcggcgcgcgccagctcggtgcgcttggccgccagctgctggtccagtttttcgcgctcggcagccaggtcggcctgtttggcctcgtcggccaccagccgcgcccgcaccgcgtccagcgcggccctggccttggccacttcctgctgcgccgcttccagcgcggcgtgctccggcaggttcaggtccgacaattcgcgcgtcagcgcggcgtcgcggccggccagttgctgcatgccgcgctgccagtgttcgatcttctgccgcgacaggtcgcgctcgcgggtgaggttggcctgctgggccaccatctgcgactgccgctggtccagcacgcggaaggcggcctcggcgcccggcagttcgtcggcgccgtcctccagcgccatctgcgcctcttcctgcctgagctgcgcctcttccagccgcggcagccaatcgtccagctcggcctccacctgctggcggttgtcggccagttgctggcgttcgctgcgcgccgccgccaggtcgcgctccagccgctgccggctctgctcgcggtggcgctgcgcctcttccagccgcgccagctgcgcgttggcctcgaacagctgctgctgcgcctcgtgcaccgcgtcgctggcggcgaaatggctttcgcgcaccgtctcctgttcggtttccaggtgggtggccgcgctctccagcgccgcctcctcggtttcgatgcgcgccagctcggcgcgggcggccgcctcgttgcgcgccgcctcctcgcgccgcgccagcgccagcaggttctgcttgtgggtcagcgcgcccttgaggtcgtgatactgggacgccacttcagcctgctccgacaggcgctccacttggcgctccagctcctgctgcaggtcggcgatgcgctccaggttggcgcgggtgtcggtcaggcggttttctgtctcgcggcggcgctccttgtacttggacacgccggccgcctcttccagataggcgcgcagctcttccggccgcgcctcgatgatgcgcgagatcatgccctgctcgatcaccgcgtagccgcgcgcgccgacgccggtgccgaggaacaggtcggtgatgtcgcgccgccgcacctgctggttgttgatgtagtagctggattcgccctggcgggtcagcacccgcttgatcgccacttcggcgtactggccccaggggccggtcaactggccgtcggcgttgtcgaacaccagctcgaccgacgcccgcgacaccggcttgcgagtggacgagccgttgaagatcacgtcctgcatcgactcgccgcgcaactgcttggcggacgattcgcccaatacccagcgcacggcgtcgatcacattggacttgccgcagccgttggggccgatcaccgccaccagttggcccggcaccgcgatgctggtggggtcgacaaatgacttgaaaccggcaagcttgatatgggtcaggcgcaagacatcctcactgctcgtatgtagagattaagccaaagcggcattttatcaggcccgccgcgccagcggtgcggcatggcggccccggccgcgccggcgaatttgcgctggcctggggctggggcagttgtgccataatggccgtatggaacccttatcgctgtgcaatcatttcctgatcgccatgcccggcatgggcgatccgctgtttgccaagtcgctggtctacctgtgcgagcacggcgaacacggcgccatgggcctgatcgtcaacaagccgtccggcatcgccatggcgcagctgttcgaccagatcgatctgccgctggacgacgaggacacccgcaccggggtggtctacttcggcggcccggtgcagccggaccgcggcttcgtgctgcaccaaccctccggcaactggcagtccagcctgatggtcaccgacgacatcgcgctgaccacctccaaggacgtgctggcggcggtgtccgaaggccgcaagcccgagcggctgctgatctcgctgggttacgccggctggtcggaaggccagctggagcaggaaatcgccgacaacggctggctgacggtgccggccgaccccgccatcatcttcgaactgccctgcgaagcccgctacgacgccgcgatggcgctgctgggcatcgaccccaccctgctgtcgtcggaagtcggccatgcctgaaggttgcgtgctggcttttgatttcggcgagcgccgcatcggcgtcgccgtcggcgacgcgatgctgggcatcccccacccgctggctaccatagacaccgccgtcaccgacgagcgcttcgccgccatcggcaaactgataggcgaatggcagccggctcagttggtggtgggcctgcccatgcacccggacggcgtcgaacacgaaatgagcgcgctggcgcgccgcttcgccaaccggctcaaaggccgcttcggcctgccggtatggctggtggacgagcgctatacctcggtgatcgccgagcagctgctggaagaggccggcgtcaagaaaggacgcaagcaaaaaccggcgctggaccaggtggccgcgcaggccatcctcgccggctggttcgagcagccgggcaccgcagtttgatgccggccaggctcttcgccctgctgctgctcgccgccagcgtcgccggcttctgctggttgtggcgccaggcgcagctggccaacgcggcgcgcgattggccgatcgcggccggcgtcgtggagcgcagcgcggtggaatggcggcagcgccgcggcggcgacaacagcgatcagcgcgagtaccgcgccgacgtcgtctaccgctaccaggccggcggccagcactaccgcgccggcaatatccgcatccccgacgccggcttcggcggcagccagacgctggcccaggataccgtcagccgctatcccgccggcgcggcggtgcaggtgcgctacaaccccgccaaaccgcagcaagcctgcctggagaccggcgcgcactggagcctgagcgccggccagttgctgatgctgctgttcgccgccgccggcgtcgccctgctgctccgccgctgagcccttcgccaccgggcgcccggttcccctgccagagaatctccgcaagccattgttttgttagaagctattaagcgccattgagtcgggccggcaaactggcgatactgatagcgatggcagattcagcggagggccccgccatgagcatcagtcaaaccacgcagatttcactggcgagcgccgccttgctcaacggcggcaccgtgccgtcgccggtggtgcaaaacggcaacgccacgcaggcgctggccgcccaggcggcccagctgtcgcaggagtccagcgtggtgacgctgctgggcggcggcgacagcagcggcgccacctacgaccccgccggcatgctcaacggcttcgccaccgccggcgtgctgcaaggcagcgcgctgagcccgagcagcggcgaaagcgcgcaggacagcaccgatcagcaggtgctggaccaaacgctgggcgtcagcggcgccgcatcgtccggcctcaacggcaactgggcgacggtgctgcaaagcaatccggcgctggccggccaggcggtggcggacagcaccaacggcaatatcgtcgacaccctggcctagcgccggccatgaaaaaagcccggaatgctccgggctttttcgcgggcctcagcggctgccctgcttgcggctttccttctctttcagcttttcctcgcgcaggatcgcgcgctcggcggcgatggccttcgcgcgcttttcccacgccagccattcatccgggcgctccagcgtgatgcggccgacctggccgtcgcggaagtcggtcagcacgatctccgccgccttctgcatattgatgcggccgccggacagcaccgcgccgcgcttcctgcctatcatttccagcacctgccagtcctgccggccctccacgtcgtccagcttgtagcgcgcgctcaattccggcgcgtaatggaccagcagatacttcagcagctccagcgtcacctcttcctcgtccatcgcgttgcggcccaccgcgccgctggcggccaaattgtagccgccctcctccacctcgatcttcggccacagcatgccgggggtgtcgaacagttcgaagtcgtcggccaggatgatgcgctgctcgttcttggtgacgcccggcatattaccggtcttggcgatcttgcggctggacatgctgttgatcagcgtggatttccctacgttgggaatgccgcagatcagcaccctgagcggcttttccaggccgccgcggttgggcgccagctcgcggcaggccgccaccagcttctgcgccggcgcgcgctcgccggcgtccatgcccagcgcctgggtatggggcttggcgttgtaccaggccagccactgctgggtgatggccgggtcggccaggtcctgcttgttcaagatcatcagccgcggcttgcccttcgccatgcgggccagcatcggattggcgctggaagccggcaggcgggcgtccagcagctcgatcacgacatcgatttctttcaggcgctcggtaatatccttgcgcgccttgttcatatggccggggaaccattggattgccattgtcaacgctttctaatcgggtccagcagataagtcagaccattgtggtcgagttcttgcatcagttgcagcagccggccgatctcgccgggcggaaagccttcgcgggcgaaccagttcaggtagttgcccggcagttcgcaaatcagggtgcccttgtgcttgccgaaaggcatgacgcgggtggtgaggctgagcaggtcttcggcttgcatgatggcaggtatagattgaggctgggcattgtgccaaagccggccagcgccggccaggcttgatatggcgcaatcacgcagcgggtttcgctttgggccggcgcggcggcgatttagcatgtcggcgcgacacctgcggccggcgctggtccggccaggcttttcggttcgcgcagagccgtttgcgggcgcttcggcgcccgccttttcacggctgcggcatgggcttgcggtcgttgaaatacaggaagcccttcaccacgcggtagatgtaccaaacccacaccgcgaacagcactacgccgcccaccaacagccacagcgtggcgaagccgacgacatagccgagcagggccagccagaaggtgcggatctgccattcgaaatggctttcgtacaaggtgccgcgcacatcgtcgcgcttcacgtagttgatgatcacgccgaccagcgcggtgacgccgaccagcaggctgaccgcctgcaggatgtacaccgccagcgtcagattgttcagcttgcgttcgccttcgtcgtgcagctccagctccatgcatcttctcccgcggggttagcaattcagcaatttttcgaaacgcccggccaggccggcgcgcgcgcggcggctggcgtccagcgccgcggcgacgccgcggccggcgccaggctgagccggccgcgggctccagccctgcaaaccgccttcgccgcggcccccggacagcaagaccggcagcgccggccgccacgccaggccggcagccgccgccagctccgccgcgcggcggttggcgtcatccagcgccgccagctcgtccagccccagcgccacctgccgccattccagcagcagaatgcgcgccgccaaccaatcggccggttcggccaggcgcggcggcaggccctgcgccggcaagccgcgccgcagcgccaggcgcaaggccagcaggcggatttccggcagcatggactccagcagcggcgcgccgccatcgcaagccgccagccaggaagacaactgcccggccggcggcccggagcgataagccagccactcgccgtcggtcaccagggcgaccgggtacagcgtggactccgccatcgtggcggcctggctgcgggcaagggaaaaggcgtctctgacttcgttcatggcaggtgtctccggatcgggaacggtgcggtcggaccggagaacattcgcttcttgcaagatcaaaaaaacaaatgccaccggtaaccggcggcatttgtcgggaatgtgctcgcagacctcgtcgtcttggccaagcctatccctggcgccgccaggatgagcggtaccaataggaatagcggtggaaaaggacggcatttcggtcagtcatgcccagcatgctgccaatgatggccgccgccgtcaagccatagttccggcggcggggcgcggcaacaagctgatcccgcaagaaaaaaccgggccgtcctcgcggagcggcccggtttcgcggcgcggcgcgcggcttacatattggggtagttaggcccgccgccgccctccggcgtcacccagttgatgttctgggtggggtccttgatgtcgcaggtcttgcaatgcacgcagttttgcgcgttgatctgcagccgcggcttgccttcgtcctggccgacgatttcgtacacgccggccgggcagtagcgctgctccggcgcatcgtacagcgccaggttgaccgccaccggcaccgacgcgtccttcagcttcaggtgcgccggctggtcttcgctgtggttggcgttggagatgaacaccgaggacaggcggtcgaaggtcagcttgccgtccggcttcggataggcgatcgggctgaactcataggcctgccgcagcgactcgttgtcggcgtgcttgtggcgcagcgtccacggcgcgcggccgcggaacaggaaggtgtccagcgccgaatagatcatcgccggccacaggccccagcggaacgacgggcggatgttgcgcaccttgtagagttcggcatgcgcccagctctgctggaacttggccgaataggccttggcttcgccgccctgcgcccgcgcctcgtcgcccaacagctcgaacaccgcctcggccgccagcatcgcggatttcatcgcggtgtgggtgcccttgatcttgggcacgttgaggaagccggcggtgtcgccgatcagcgcgccgcccgggaaggtcagcttgggcaggctctgcagcccgccctcggtcagcgcgcgggcgccgtaggagacgcggcggccgccctcgaaggttttcttgatcgccgggtgggtcttgaagcgctggaactcctcgaacggcgacaggtagggattctggtaatccaggccgaccacgaagccgaccgccaccagattgtcttccaggtggtagaggaaggagccgccataggtggcggtgtccagcggccagcccacggtatgggtgatgtggccgggctggtgatgctccggcttcacttcccacaattccttgatgccgatgccgaaagtctgcggatcggcgccgtcgcgcagcttgaagcgctcgaacagcgtcttggtcagcgagcccctacagccttcggcgaacagggtttgcttcgcccacagctccatgcccggctcgccttcctggtcgccgttcttgccggtgccgaccgcgccggtggccacacccttgaccgagccgtcggcgtggtacagcacctcggccgcggcgaagcccgggtagatctccacacccaggttttccgcctgctggcccagccagcggcagaagttgcccaggctgacgatgtagttgccggcattgtgcatctgcggcggcgtcggcagctggatggattcggtttcggtcaggtagaggaaacggtcggacagcgccggcgtgttcagcggggcgtccagctctttccagttcggcagcagctcgctgagcgcgccggtttctatcaccgcgccggacaggatgtgggcgccgatttccgagcccttctccagcaggcagacgctgacttcgcggccctgctcggccgccagctgtttcagacggatcgccgcggacaggccggaaggcccgccgccgacgatcaccacatcgtattccatgtattcgcgttgcaccgtttctcctttgcgcccgccgggacttattgatttgattgacatcatgctatgaagcgatgatgccgtcaaaatcaaacaagcgtttaaacggtgccactgttgcgcaatgcgacaatgtccgattcgccataacctagcgtgcgcaagatctgctcagtatgttctcccagagcgggaggggctagattgtactcgactggcgtgccggaaagtttgatcggacaccctaccagcggcacttcttgtccgacattatcctccaaagccagctgcatgccgcgcgcctcggcctgcggatcggcgaaagcctcctccacgtcgttgatcgggccgcagggcacgccggccttgtccagctccttcagccagtgctcgcgcgaatggtggcggaacgccatcgccagcagcggcaccagctgggcgcggttcgccacccgctgcggattggtggcgtaacgggcgtcgcgcgcccactgcggctggccgatcagccggcatacctcggcgaactgcttgtcgttgccgcaagccaggatgaaatggccatccgacgcggcgaacacctggtagggcacgatgttggcgtgggcgttgcctagccgcggcggcaccttgcgccccaccagccagttggacgccacattggccagcatcgccagcgagcagtcgaacaaggccatgtcgatatgctggccggcgccgctgcgttcgcgggcgatcaacgccgcctgcaccgcattggcggcgtagaggccggtgaacaggtcggacaccgccacccccaccttgtgcggctcgccgtcggccgggccggtgatgctcatcaggccggacatgccctgcacgatatagtcgtagccggccaggccggcatagggcccgctctggccgaagccggtgatcgagcagtacaccagccgcggattgacggctttcaggctggcgtaatccagcccgtacttcgccaagccgcccaccttgtagttttccagcagcacatcggcctcggccgccagcttgcgcacgatttcctggccggccggctggctgatgtccaccgtcagcgaacgcttgccgcggttggcgcacaggaaataggctgccttgccgtcgggcaggctgggcggcgcccattgccgggtatcgtcgccgctgcccggcttttctatcttgaccacatccgcgcccagatcggccagcagctggctggcccatggcccggccagcacccggctcaaatccacaaccttgatacccgccaacgctcctgccatcgcgctctccttgttctggccgccaagatccatggcgcgcctgtccgccgctaaaaaaaagtggcccggcaagccgggcccccaaaggacagacaggaatcaacggcgcggccggccctccggccgcgccggcttatcaggcaaacgcctgaataccggtctgggctcggcccagaatcagggcatgcacgtcatgcgtgccctcataagtgttgaccgcctccagattcatcacgtggcggatcacatggaattcgtcgctgatgccgttgccgccgtgcatgtcgcgggcgacgcgggcgatgtccaacgccttgccgcagttgttgcgcttgatcagcgagatcatttccggcgcggcgcggccttcgtccatcagccgccccacccgcagcgcggcttgcaggcccagcgcgatctcggtctgcatattggccagtttcagctggatcagctggttggcggccagcggccggccgaactgctcgcgctccagcgtgtactggcgggcggcctgccagcagaactcggcggcgcccatcgcgccccaggcgatgccgtagcgcgccttgttcaggcagccgaacggccctttcaaacccttgacgccgggcaacagctgctcgtccgacaccagcacgtcgtccatcacgatttcgccggtgatggaggcgcgcaaggagaacttgccgtggatggccggggccgacaggccctgcatgcccttctccaggatgaagccgcggatttcgtcgtcgtcatccttggcccagaccacgaacacgtcggccgccgggctgttggtgatccacatcttgctgccggacagcaggtagccgccgtccaccttgcgggcgcgggtcttcatgctggccgggtcggagccggaatcgggctcggtcaggccgaaacagcccagccactcgccgctggcgagcttgggcaggtatttgtctttttgcgcgtcggagccgtaggcccagatcgggtgcatcaccagggacgactgcacgctcatcgccgagcggtagccggaatccacccgctccacctcgcgcgccaccaggccgtaggcgacatggctgaggccggcgcagccgtagccttctatggtgcagccgaggaagcccagctcgcccatctcgttgatgatctcgcggtcgaagcgctctgcgcggttggcggtcagcacccgcggcagcagccgctgctggcagtagtcgtgcgcgctttgctgcaccagccgctcttcgtcgctcaattggtccagcaacaacagggggtcttcccagacgaagggcgcgcgctgcgaggatgctgccatatgctttctcccgattaattccgcattgcggaattgaatttcaccatgcaaaatagactaaacactctggccgcgacttgtaaagcgatttgctcgtcatgccggctatcttttgccgtgatggggaacaagatgcaacaaacagaagaccggcaattcgtcaccgcgctggcgcgcggtctggaaatgctggcggcgttccgccccggcgagggcgcgttgtccaaccaggagctggcgcgccgcaccggcctgcccaaatccacggtgtcgcggctgagctacacgctgacccggctcggttatttgcagcaggaaggcgacggcggcccgtaccggctggggctggcgttgctggcgctgggctcggcggcgctggccggctacgatctgcgcgcggcggcggcgcccttgatgcgcgaattcgcgctggccaacaatgtgtcggtgagcctggccctgctggacggcagcgatatggtgtatctggaaacctgccgcagccaggcgcgggtatcggtgcagcttgccaccggctcgcgggtgccgctggccaccaccgcgatcgggcgcgcctatttcgccggcttgccggccgccgagcggcaagcgctgctgccgcggctggccgagcgctacggcgcggaatggccgcaactggagcaaaggctggagcaggcctgcgccgactactcgcggcacggctactcggcgtctttcggcgaatacgaagcggatgtgatggcggtgggcacccacctgccggcgctcttgcccggccagccggcgatggcgctcaacgccagcggcccggccttcgccttcgacgcggcggcgatgcgcgaacggatcgcgccggccttgctggcgctgcgccagcgcatcgcgccgacggtctgaacgccaggaacgccgcggcccgcttgcgcgggccgccgggttcaggctgactggatgtaatgcaccaggtggttgatcacctgcgcctgctcgtctatcgtcgcccgcaccagatcgccgatcgacagcatgcccagtacggtctggtcttccatcaccggcaggtggcggatgcgcttttccgtcatcaggctcatgcagtcgtccagcgtctgcagcggcgtcacgtacaccacgcggctggtcatgatgtcgcgcaccttggtcccggccgaggtgcggccctgcagcacgatgcggcgcgcgtagtcgcgttcggaaaagatgccgacgatgtcgccggactccatcaccagcaccgcgccgatatcgttttccgccatcacctgcagcgcctggaacacggtgctgtccggactgacgtacaccagcgcccgcaccggtttgccatccagcaattgtcttacggtttgcatgtcgcctcccctttttatagcctgtggcaccgccgcgcgcggcggtatgccataactatagatcaccgccgcggcaggcggcggcggggatgggtcaggcgcggatcatggtgccgacgccggcggcggtcaggatttccagcagcagcgcgtgcttgacgcggccgtctatgatgtggaccgcgccgacgccgttcttggccgcgtccagcgccgagctgatcttcggcagcatgccgccggaaatggtgccgtcggcgaacagctcgtcgatgcgctgcgcggtcagcccggtcagcagcttgccctgcttgtccagcacgccgggcgtgttggtcatcagcaccagcttttccgcctgcagcgtttccgccagcttgccggccaccaggtcggcgttgatgttgtaggcctcgccgtctgcgccgacgccgatcggcgccaccaccgggatgaagtcgcggctgtccagcagcgacaccagcgacgggtcgatggcttcgatctcgccgacctggccgatgtccaccgcctcgtcgccgtcggccttcaggaacagcttgcgggcgcggatgaaatggccatccttgccggtcaagcccaccgccttgccgccgtgcttgttgatcagcgacacgatttccttgttgaccaggccgcccagcaccatctccaccacttccatggtttccttgtcggtcacccgcatgccctggatgaattcgccctgcttgcctacgcgcgccagcaagtcgttgatctgcgggccgccgccgtgcaccaccaccggattcatccccaccagcttcagcagcaccacgtccttggcgaagccctctttcagggcctcgtcggtcatcgcgttgccgccgtacttgatcacgatggtcttgccggcgaactggcggatatacggcagggcctcggccaggatgttcgccttttcggctgcgtctgttgccacttcatttctccttgctagcggatcgcgttcttcaaccctaaacggctggccggcgatttcggattacggtgtcgcattttaatcacggcaattgctgaactgtgatttattaattgccgaaccctgatcgaaagacctacagtgccgatattactgaacaagaattcagaaagatcgtcatgaccgacaccggcaacagccgctggcagcgcaagaaggacgccaggcccagcgaaatcctggacgccgcgctgaccttattcgtcgaaaagggctatctcgccaccaagatggaagacatcgcccgcgccgccggcgtcaccaagggcacgccttacctgtatttccagaacaaggaagacatcttcaaggcggtggtgcgcgaaaccatcgtcgcccgcgtccacgcgatgagcgcgcaactggcccaagtgcacggcgtcggcagcagcgaactgctgtttctggcgctggacgattggtggactcatatcggctccacccgcgccgccggcctgtgcaagctgatggccgccgaggccaccaatttcccggagctgacgcgcttttattacgacgaagccatcctgccggcgcgccagttgctcggccacatcatccagcgcggcatggacagcggcgaattccgcccggtccatctcgattacgcgatcgacgcgctgaccgcgccgatgatgatgacgatgatcctcagccactcgttcgccctggtgcccggctgttgcgacagcatcaaggacaatccgctcgaattcctcaagacctcgctgcggttgacgctgcaaggcatgcaccagcccgcgccccaggacgcccgcccatgaaacacatagttcccctcggcctcgcgctcgccgccgcgcttggcctttccgcctgcaagggccaaaccgccgcgccggaagacattcgcccggtgcgctacgcggtcgccggcggccatgccgaaaccggcggcgacagctacgccggcgaaatccgcgcccgccacgagacccagctggcgttccgcgtcgccggcaaggtggtggccaagctggtcaacagcggcgagcgcgtgaaaaagggccagccgctggcgcggctggaccccagcgactaccagctcgacctcgccggcaaacaggcgcagctggcggcagccgaatccgacctagcccaacagcagctgaacctgaagcgttaccgcgagctgctggccaaacagttcatcagccaggcccaggtggacggccagcagaacggcgtcaacgccgcccaggccaaggtcaaccaggcgcgcgccgcgctgtccgccagccgcaatcaaaccgcttactcgacgctgacggccgacgccgacggcgtggtcagccagatgcaggccgaacccggcctggtggtggccgccggccagccggtggccaagctgtcgcaggacggcgcgcgcgaagtggcgatccaggtgccggaaaacgcgctggagcggctgcgcgccgccggcgtgttccaggtcagcctgtggaagggtggcgcgccgctgcaaggcaagctgcgcgaactggccgccgacgccgatccggccacccgcacctatccggcccgcatcgcgctgtccggcgacagccgcgcgctgcagctgggcatgaccgccaatgtgcgcgcccccggccaggccgccgccggcgcgctgcgcctgccgctgaccgcggtgctggacctgcagggcaaacactatgtctggaccatagacgcgcaaagcctgcgcgtcagccgcaagccggtcagcgtcggcgcggcggacaacgacagcatcgccgtcaccgacggcgtgcgcgccggcgacaaggtggtgaccgccggcgtgcatctgctgcgcgaaggccagcgcgtcaagctgctggatcggtgaggacgcggcgatgaagaaactgaatctctccgaatgggcgctgcaccaccaggcgctggtgcgctacctgatggtgatgctgatgctggccggcgcctgggcctacacccagctgggccagaaggaagacccggaattcaccttcaaggcgatgctggtgcaagccaactggccgggcgccaccaccttgcagatggagcagcaggtcaccgacaagctggaggaaaagctgcaggagatgggcgagatcgactacgtgcaaagctataccaagccgggcgaaagcctgctggtggtgtcgctgcgcgagaacgtgccgcccaagaacgtgccgcagctgtggtaccaggtgcgcaagaagctgggcgacatcgcctacaccctgcccgccggcgcgcaagggccgttcttcaacgacgagttcggcgacaccttcggcaatatctacgccttcagcggcgacggcttcagctatgaggagctgcgccgctacgtggaagcctccaagcaggaactgctgcgcgtgcccgacgtagccaaggtgcaggtgctgggcaagcaggagcaacgcatctacgtcgacctgtccagcgccaagctggccagcctgggcctcgatacccgcgtggtctggcaggcgctgcagcagcaaaatggcatgacgccggccggcaccttcgaaaccgcctccgaccgcatctgggtgcgccccagcggccagtacggctcggtggaagcggtcgccgccacgccggtcagcgtcggcggcaaatcgttccggctgggcgacatcgccagcgtcaagcgcggctacatcgacccgcccgccaccagcgtgcgcttcaacggccagccggcgctggcgctggccatcagcatgaagagcggcggcgacgtgctgaagctgggcgccaacctcgaccaggccatcgccggcatccagggcaagctgccgctgggcgtggaaatccacgcggtgtcggaccagcccaaggtggtgcacgacgcggtgggcgaattcatgcgctcgctggtggaggcggtggtgatcgtgctggcggtcagcttcttcagcctgggcctgcgcaccggcgtggtggtggcgctgtccattccgctggtgctggcgatgaccttcctcgccatgtattgcttcaacatcgatctgcagcgcatctcgctgggctcgctgatcatcgcgctgggcctcttggtggacgacgccatcatcgcggtggaaatgatggcgctgaagctggagcaaggctggaacaagttccaggccgccacctacgcctacagcagcacggccttcccgatgctgaccggcacgctgatcaccgccgccaccttcctgccggtgggcctggccaaatcgatggccggcgagtacgtgttcagcctgttcgcggtggtcggcatcgcgctggtgctgtcgtggatagtcgcggtggtgttcaccccctatctgggctacaagctgctgtccagccatgcccgccacgaagaggtcgacgtctaccagaaaccgttctacctgcgcttccgcgcgctgctgggctggtgcctggaccaccgcaagacggtgatcgccgccaccctggccgccttcgtcgtgtccttgttcgcgttcaagctgttcgtcgcccagcagttcttcccctcgtccaaccggcctgagctgatggtggacatgtggctgccgcgcggcgccagctaccacgccacgctggagcaggtggaaaagatggaaaagctggcccgcgccgatcccggcgtggccagcgtcaccagctatgtcggcagcggcagcccgcgcttctacctgccgctggaccagcagcagcagcacaccaattacgcgcagctgatggtgatgacccgcgacgagcatgtgcgcgaagcggtgaaggcgcggctggaaaagattttcgacaacgacttcccgctggtgcgcggccgcgtcacccggctggaaaacggcccgccggtcggctacccggtgcagttccgcgtgatgggccccgaccacgaccaggtgcgcaagatcgccgaccaggtggaagcgctggtgcgcaagcacccgtccacgctgcacgtcaaccagaactggggcgagcaggtgaaggcgctgcgcatagacatcgaccaggacaaggccgccacgctggggctgtcgtcgcaacagctgtcgcagcagctgcagatgctgatctccggcagcgccgtcagcgattaccgcgaaggcaaccagagcatcgccatcgtcgggcgcctgaaccccggcgagcaaagagacgtcgccgcgctgggcaacctgatggtgcagaccgccagcggccgcttcgtgccggtatcgcagatcggccatatccgctacgaaccggaggaaggcatcatctggcgccgcaatcgcctgcccaccatcaccgtcagcgccgacgtggtcgacggcgtgcagggcgccgacgtttccacccagctgtcgccgggcatggccgcgctggagaagatgctgccgctgggctaccacatcgaggccggcggcacgctggagtccagcggcaagtcgcagcaggcgatcgccgccgtcgcgccgttgatgattgttgtagttctgacactcctgatgctgcagctgcagagcttccaacgcacgctgatggtggtgctgaccgcgccgctcggcatgataggcgtcaccttgacgctgatcttgttccgcgcgcctttcggcttcgtcgccatgctgggcgtgatcgcgctgtccggcatgatcatgcgcaactcggtgatcctggtggaccagatcgagcatgacatccgcgaaggcatagaccgcttcgaggccatcatcggttccaccgtgcggcgttttaggcccataatgctgacggcattggcggccattttggcaatgattccgttgacccgcagcacgttctggggtccgatggcggtggccatcatggggggcctgctggtggccaccgtgctgaccctgctgttcctgccggccctgtacgcccaatggttccgcgtgtcgcgcgacgagcggcagccaacacttccacagcaagaataacgagcaccagatgaagaatacccgcctcaccttattgggcagcctgctgatgctgggcctcgccgcgcccagccaggctttcgacctggtcggcgcctggcaggccgcccgcgactacaacgccgatttcgccgccgcgcgcgcgcaacgcgaagccggccaggaaaaacgggtgcagggccgctcgcaactgctgccgcaggtcagcctgaacggcagctacgcgtacaacaacccgctgcagcccaaccgcatcgccgacgccttcggcaacgtggtgggcaacaccccctacgaaacccacggctacacgctggggctgcagcagcccttgttcgacgccggcaaatacaccggctacaaaaaaggcgagatcggcacccgcctggccgacaccaccttcgacgccgccgaacagcagctgatcctggacatcgcccaggcctatttcgacgtgctgcgcgcccaggacacgctggccgccacccgcgccagcaagaaaacttatctgaacctgctgcagcaggccaaaaccgcgttcgaggtcggcaccgccaccatcaccgacaccaacgaggcgcaggccggctacgacggcgccgtcgcccaggaaatcaacgacgccaacaacctggagctggcgcagcacaatctgcagcggctgaccggcctggagcccggcgccatccagaccgtgcgcgaccagctgccgctggacccgcccaagcccgccggcctggacgcctggcaagacctggcgctgcgcaacagcctgcgcatcagaagcgccgagcaaaacctgcagctggccgagcagaccgtcaccgagaaacgcggcaaccacctgcccaccgtcaccctcaatgccggctacgccgacaatgtcagcaaccagtacggcaactatccgcatacccgcggcagcaatgtcggcgtcaccgtcagcgtgccgctgttcgccggcggcggcatcaattcccaggtgcgcgaagcggtggcgcagcgcgaagccgctcgcgatcagctggaatccacccgccgccaagtgcgggaggacgtgcgcaaggcattcctgggcgtgaccaacggcgcggcgctggtgcgcgcccagcagcaactgctgctgtcggccaaaagcaaggtggactccacccggctgggcaaggaagtgggcatccgcaccagcatcgacctgctgcaggctgagcaggcctactacaccgcggtcaccagcctggccaacgccaaatacagctacctcaccgccaagctggcgctggcccaatccgccggccagctggcgccgcaggtgctgaacgaggtcaaccaggtcatcgtccgctaaactccgctgccctcgccgccgcatgccccgccatgcggcgcgcctttccgctgtgccactcccgccacaagtgtttaactttttattgcatgtgtggctttttgctaaacacgctcatagaatgatccgctaacgcgccggcatgccgccggcccgataccgacaacgccgaggcatcgccagccgatcgccgcgcggccccgaggagacctccatgagccagcagcaactgatgcaacgcaaagccgacgccaccccgcgcggcgtgggcgtgatgtgcggtttcttcgccgaacgggcgaagaacgcggaagtgtgggacaccgaaggccggcgctacatcgatttcgccggcggcatcggcgtgctcaacaccggccacctgcacccgaaagtggaagccgcggtggcggagcagctgtcccgcttcagccatacctgctatcaggtggtgccttatgaatcgtacatccgcctggcggagaagctgaacgggctgaccccgggccagcacgccaagaaaaccgcgctgttcaccaccggcgccgaagcggtggaaaacgccgtcaaggtggcgcgcgccttcaccggccgcccgggcatcatcgccttcggcggcgccttccacggccgcagcctgctgggcatggcgctcaccggcaaagtggcgccgtacaagcttaacttcggccccttcccctccgacatctatcacgcgccctatcccagcgcgctgcacggcgtgtcgatagcggaatcgctgaccgggctggagcggctgttcaagtacgatatcgatccggcccgtgtcgccgccatcatctacgaaccggtgcagggcgaaggcggcttctacccggccccggcggaatgggtgaaagcgctgcgcgcgctgtgcgaccgccacggcatcctgctgatcgccgacgaagtgcaatccggcttcgcccgcaccggcaagctgctggccagcgagcatttcgacgcggtgcccgacctgatcaccatggccaaatcgctggccggcggctttacgctgtcggcgctcaccggccgcgccgaagtgatggacgcgccggcgccgggcggcctgggcggcacctatgccggcaacccgctggcggtggccgcggcgctggcggtattggatgtgatcgaaagcgagaagctggtggagcgcgcccagcgcctgggcgacgcgctgaaggaaaaactgagcggactgaaaaccgcggtgccgcaaatcgccgaagtgcgcggcctgggcgcgatgatcgccgtggaattcaaccagcccggcagccacacgcccgaccctgacttcgccaagaaggtgcaacagcacgcgctggccaacggcctgatcctgctgacctgcggcgtctacgccaatgtggtgcgcttcctgttcccgctgaccatcgaagacgagatcttcgccgaggcgctgggcaagctggaagcggcgctgaaagcctgatcgactgacactattctcccctgcgagcggtcgcgcctgatggcgcttccgctcgtttgcacaaggaacaccccgatgctcactctgcaagacgccaagctgctgcgccagcaatgctatctggacggccaatggctggatgccgacaaccgccaagccatcgccgtgcaaaaccctgccaccggcgaaaccataggacaggtgccgaaaatgggcgcagccgaagccgagcgcgcagtggccgccgccgcgcgcgccttcccggcctggaaggccaagagcgccaaggagcgcgccgccatcctgcgccgctggttcgacctgatcatcgcgcaccagcaggatctggccgtgatcctgacctccgaacaaggcaaacctctggccgaggccaagggggagatcgcctacggcgccagctacatcgagtggtacgccgaggaagccaagcgcgtctatggcgacatcgtgcccggcccggccggcgaccgccgcgtgctggtgaccaaggagccgatcggcgtcaccgccgccatcacgccgtggaacttccccagcgcgatgataacccgcaaggccgcgccggcgctggccgccggctgcaccatggtggtccgcccggccagccagaccccgctgtcggcgctggcgctggccgagctggccgagcgcgccggcattccgcccggcgtgttctccgtcatcactggcggctccagcgaaatcggcgcggtgctgaccggcagcgatacggtgaagaagttctccttcaccggctccaccgaagtcggccgcaagctgatcgcccagtgcgccggcacggtgaagaaggtatcgatggagctgggcggcaacgcgccgttcatcgtattcgacgacgccgacctggacgccgcggtggaaggcgcgctgatctccaaataccgcaacgccggccaaacctgcgtttgcgccaaccgcctctacgtgcaggacggcgtctacgacgccttcgccgaaaagttcgccgccgccgtcgccaccttgaaagtcggcaacggcctggaagccggcgtcagccaaggtccgctgatcgaccagaacgccgtcgccaaggtggaagagcacatcgccgacgctctggccaagggcggcaagctgatcgccggcggcaagcgccacgcgctgggccacaccttcttcgagccgacgctgatcgccgacgtcaccagcaatatgaaggtggcgcgcgaggaaaccttcggcccgctggcgccgctgttccgcttccagaccgaggaagaagcgatccgcctggccaacgacaccgagttcggcctggccagctatttctacgcccgcgacgtcggccgcatcttccgcgtcgccgaaggcctggagtacggcatggtggcggtcaacagcggcctcttgtccaacgaggccgcgccgttcggcggcgtcaaacaatccggcctcggccgcgaaggctccaagtacggcatcgaagactatctggaaatcaaatacgtgctgctgggcggactggaccgctgagcggcacgccccatgacaagagccgcccggcatgccgggcggctcttgtcgtttcgcggttggcgctcaatgcgcgccgctggtgtccaccttgccctgcggcgcgcccggcttggccagccacaccacgccgatcagacccaggaacatcaccgccgatccccagaatatgtcattggccgccagcatataggcctgggtgctgatctgacgctccagcagctggtaggactggctcaggccataccccatgtccgacagctgattcaagctgatgcgggtggccgccgagaacgacgacaccgattcgcccaactgcacgtgatgcaggctggcgcggctgtcccacaaggtgctggccgccgacgcgccgaacgcccccgcggtgatgcgggcgaaattggccagaccggaagccgcggccaagcgttgcggcggcaggccggacagggtcagcgcggtcaaaggcacgaagaaggtggccatcgccgcgccctggatgaactgcggcagcatgatggtggccacgtcggcctgcatattgaagcgcgagcgcaggtagcaaacgatggcgaacaccaggaaagcgaagctggccagcacgcgggcgtcgaagcggccgatgttcttgcctatcgtcggcgacagcagcagcgccagaatgcccaccggcgcgctgacaatgccggcccaggtggcggtgtagccggcgaactgctgcagccacagcggcagcagcaccaggttggcgaagaagatgccgtagcccagcgacagcgccagcgaaccgatggcgaaattgcggctcttgaacaaggtcaggtcgacgatgggatgctcttcggtgatttcccagatcacgaacaagatgaatgcgaccagggccgccagcgcgagcgccacgatctcgccggaaccgaaccagtccagctccttgcccttgtccagcatcacctgcaggcagccgacccagatgatcaacaggcccaggcccatgcggtctatcggcttcttcacccgcggcgactcgtaatcgcgcagcagcacccaggtgagccaggcggcgaacaggccggtaggcacgttgatatagaaaatccacggccaggagatattgtccgaaatccagccgcccagaataggccccagcaccggcgcgatcatggtggtcatcgcccacatcgccagcgccatgccggatttttccttggggtaagcctgcagcagcagggcctgggacagcggaatcatcggccccgccaccgcgccttgcatgatgcggaacaggatcaacgactccaggctgctggccatcccgcacagcagcgacgcgatgacgaacagcaccaccgaggccacgaacagccgcacctggccgtagcgctgggtcagccagccggtcagcggcaccgcgatggcgttcgccaccgcaaacgaggtgatcacccacgttccctggctggcgctgacgccgatatcgccggcgatggagggaatggatacgttggcgatcgtgatgtccagcacgttcatgaatgtcgccatcgccagcgcgatggaggccagcaccagcctcatgccggtcagcggcgtcgtttgggcagctgcactcatgcttttctccttaacggctcaggttggcggcgatgatgtgcttggccatgtcgtcggcggcggcggcctgctcctggtacacgcgggtttccgccaccgcgcgcgccggcgctgcgctggacagctgcgcgccgctctggtccttgacctccacctcggcctgcatcgacaagcccacgcgcagcggatgcgccttcacctcggccggatccaacgccacccgcaccggcagccgctgcaccaccttgatccagttgccggtggcgttctgggccggcaacagcgagaaggcgctgccggtgcccgctcccatccccaccactttgccgtggtacaccacgtccttgccgaacagatcggcgctcagggtcaccggctggccgatgcgcatatggcgcagctggctttccttgaagttggcgtccacccacagttgatccagcggcaccaccgccatcagcggcgcgccgacgctgacgcgctgccccacctgggcgctgcggcgcgccacatagccgctcaccggggcgacgatggcggtgcgcgccagcgccagctcagcctccttcaatttggccaccgcctgcaccaccgccggatgctgctggatgccgccggcgccggacagcgcgcggctgctggccagttgctcttgcgtcgaattcaacgccgcctcggcggtctgcaccgtgccctgggcgtggcggatttcctcggccgataccgcgccgctgcccgtcagctcctgccggctggccaggtcggccttggcccgggccagttcggcggtcttgccggccacatcggcggcgcgggacgcttgggtcgtgtacagggtctgggtctggcgcaccacctgcgccagctgcgacttggcttggtccaccgccagcttggcgtcggactggtccaactgcaccatcacgctgccggccttgacgaaattggtatcgtcggcgcggatcgccaccacggtgccggcggtttgcggagtcagttgcaccacgttgccggccacataggcgtcgtcggtgctttccagatagcgggcggaagcgaaccagtagctgccgtaagccaccgccgacacggcgaggccggcggccagcatcagcaccaggctcttgcggcgggcctgcagattggcggcgggttggttggaggccggcagggtggcggtttgagtggtcatgttgttttcctttgcgcgatgtgaatgaggttcaggcttgcttggattcggcgagggacagatccagaccgccccccagcgcatgattgagacggatcgcggtttgcagccgcagagcctgcagatcgatgtccgcggccttctgcgccagcagccggtcttcggcgccgatcaccgccagatagctggacaggcccttgcgataacggctctgcgccgcctggtcggcggattcgagctggcgcaacgccgcctcgtgctggccctggcgattggccagcgagcgccagttgccgacctgatcggcgacatcgcgcagcgcatccagcaccagttggttgtacaaagccacttcggcgtcgtagtcggcgttgcgcagcgccaggcccgcccgcagcctgccggcgtcgaacaggggcagatggatcgccggccccagattgaagatctggctgccgcccttgaacagatcggacgcgttcagcgcgtcgccgcccacgcccgccatcaggtcgatgttcgggtagaaatcggccttggccgcctggatatcgtggctggcggcctcgagacgcagcttttgcgccgccacctccggccgccgggccagcaaatcgctttccagccgggcgggcaggcgcagctcgccgcccatcttcagcgtcggccgggccagagcctcgccagcggccggatccattcccgccagcaccgccagccggtgccgcagcagcaccgcctggttgcccagcgcctccacgtccgcccgggccatcgacaccgacgcgccggactgtttcagctccacgtccgaatccaggccagccttgagccgcgactcgcgcagcgccacttcgcgctcccgcagctgcacgcgctgttccgccagcgctttttgctgctccagccgggccagttcgacatagctctggctgaccgagctggccagcgccaagcccacggcctgcgcctccagccgggccgcgtcgcggcggttcagctcggacagggtgcgttcgcggttgcggccccagaaatcgaactcatagtggaaatccagccccagctcgaccgagttgtagctgctgccggccagcggcgccgggaaggcgccatgcgcgctgaaacgatggcgcgacgccacgccgttcagatccagctgcggcccttcggctgcgctttgtccggccaggaaggccccggctcgctccagcctggcttgcgcctgaatcatcgtgggagaggcgctcagcgcgcgctggatcagatcggacaattgcgcatcctggaagcgtccccaccaggcggcctctggccaggccgcttgctcagcgaccgccgccgccgccgacgccgcgcccagcttgagcgtttccgcggccagcggccgcgcttgcggcgccaggccatgatcgctggcgcagcctgccagcagcaggctggcgcacagcgtggtcaaccacagtttcttgttcatgttcgcctcctgatccttgccatggcttttactgccatggcagggattcagttaaaaaaaattcaggggttgagattcgcgctcagctgcgccaacaaacgtctcagcgccgcgaaatcgtcggggtggaagttgaccagcgcccggttgagcacctccaccgccgcgtccaccagctccggccgcagctgccggcagatgctggtgggcttgaccagcaccacgcgccggtcatccttgctgcgcagacggtggatgaagcccttctcctccaggcgatccagcatccgggtcatcgacccggtatcgcattccagctgccggcacagatccgaggcgctgcgaacctcgccgctcagcaccctcatcaacaccttccattgcgcggcggtgagttcgagcggctccatgcgctggtcgatctgccgcagcagctggtggtgcagactggcgatctgctggcccaggctggtgtcgatgcggtaggtttccgcgctgtaaggggtgaagagcggcgaggtcgctgcgtgttccatggactttcctttccaatcagagcgttttgccggcttcggacggcaaaccgctttggacatacagcagagacgacagcgtgatcaggatcagcgtcatgtgcaccacctgcaccgcgccttgcttgatccagtagccgaaccacaggccgccgcaggcgaaccacagccacagcaacaggaagcaggacaacgcggcgatggccaccaccctggcctggcggaatcggcgcagctcattgctgaccaccgcgcgggcaaaggccagcgccgccgcccacaatccggcggccacgcacagctggaagccgatcaccgcgtgcagcaggctgggcacccatttggccggccaggcatgccagaccaggccctgccccagttgatgatccatcgacagcaaatccatcgacagcatgtggcccagcagtacctggttggtgcccggatcggtgatgttgttgaacaccgcgatgctgagccaggcggcgaggccggccagcagcagcaggcggctgattgcggcaatgcgaatagacatgacggtttccttagaaagaaacggaaggcttgagcaccggccaaccgcgttgattggccgcgcgcaccagttccggatcgcgggccaccaccgatgggtggccgacggtttccagcaatggcaagtcggaaatgtggtcgccgtagccgtagcagacggcggcatcggagccgcaacgcgccaggaaggccagtaccgcggcctgcttgccggcgcctatggtctgcggcgacagcagttcgccggagtagcgcccgtttctgacctccaggcggttggccagcacatggcgcactcccagcgcctccgccagcggctgcaggatgtccaccgacgagccggaaacgaagaccggctcgacgccatggtcgatatgtctttgcagggcgttcagcgccgggcggatgtaaaagccatcccggctcgacacttcggcgaaccacgccttggcggcggcggccagttgctcgggcgcatggccggcaaactcgcggaagaaggcgcgattcacctcgctgcggtcgcagccgcaatccagcaggtcctgcagccggcggcgggcgcgccattcctgcaggcggcccagcacggggccgaagcggcgcagaaagtagtagcggcgaaagctgaacatgcttttcatatcgatcagcgtttcgtcgacatcgaaaaacgcgaagcgggcagtatccatatcaggctccacgggccagccaaaccggccccgggtcggttgcgggatgggcggtcaggcagccagcgccttggcttcggccggggccaggctcaacgcctggcgcgcctcttccagaaccgcgttcagcgctttctcagccagctgcctctcgcggggcgccagataggcatcgtcaaagaccgcgaacttgaccgccatgctggccgccggcttgccgttctgccacacctccatgttcgcgctgaagttgtagcggccggggcgcggctgctcgctggtcagcaccgtgtagcggatgctggccggcagcgggaaggcgaactcgaggaagctcatattcatttcgttgatcacgaaataacgtttggacggcgcattctcatccaggcaatgcgcttcggtggtggcgatgaacatctggcggcaagcctcggtcaagaccatgccctgcacatggaacccggtcagatggtccagcagcagttcgccatgcgcgtcgagcagcaggtcggcctcgaagtgatgggcatcgacccggcgcggcgtcgaaatcaggatgttctccgccttgtgcttgtgggagagcgcgcggccggccggcgcttcgcagctccacagccgccagtgcgacaattcctcaagcaggccgaggctgctgcccagcgcgtacacttggtcgcgctgcgcctggttcagtccctggccggccaccaggcggctgcccctcagctcctccagctggttgctgcgcagctgcgccagcaaggttcccagcgtttgcacgccttccagttgcgcgaaagtggcgaattcgtcggctacgatcagttgaatggtcatattgatttttcctcttttatttcaaattcttacagttgattttttttggaatgaaaacggttcacattgtctactggctcaggcggtcaaacgctcgacgacccagctgtcatgcagccatttttcggtctggcgctgcgccctgaggaaatcccacaccacatcccgttcgaaagtcagcacctggccttgcgcgccgactatcacccagaaatagcggccatccttgctattgcggcatttcaccttcatgccggtcagcgtccgggcgctcttgccgccgtggccgtcatcgaccaggaacatctcgccatgcggcttgatccactgcagcgacaagccatcgatcagatcgggcgcatgctcgtccagataagccactgcatgccgatatgcctcgcgctcgtcgggcagcgccgcggaaatcaggtcttgcgcaaaatgcgtggcccccagcaagccgccctcttccgcgataagcaagctgaaatgctcgccgcccagacccgtgttcaatccatcttcgcgctcatagcgcaggtgccaggcggagcggccatccacgcggacttgctgaaccttggccaagctgtcaaaacctgccggcggcgtcagccactcgccaaccgaagcgggcaggacatgttgcagaagtgcttgcatcgtgtttctccaggggtgataagaaaattgaaaactcgattccatccaggccaatgccagcgcgtcgccctgccgctggtcggctgcctcaacagtatttagctaataacaatttagcatgctaaatataatccctaaataaaggccgcactgcggcctggccgatgtatgactgttcatgcggcagcaaacgcctgcttgatcagtctacgcagataatgctgactcacgatccgagcactgccaaacgctgagcccaccttgtgtctcagctcatgatcataggatattttctcagctatcatttagcaagctaaataattcatagacagaactttgcatctcaagctgttaccaatttgcatcatactacccaaaacaaattttaaaaatcattaaaattcaaatagttaaaaagattaaatgacattgccatttttaacacaacattcaaaaatggcttgagcagaatgtttccgatcgcaacctctgcaacatgtcccttcccttttaccccgcggacgcgcaacccctcatagcgccgcaagcggcaggattggcgcaacgcaacgtccatggcgcgtcggcatgccgacgatgagggaagacaaaagcgggaaggagacaccggaaacgcaaagaagggatccgctcgatggccaaccagcgaatcatggacacgcgaagtgaagaggctaagcgattggggacgcgaagcaaacgagtgaatcgaggcggacgttcacatgcggcgcctcgcttaccactcgacggcatagatgaagcgccgacattcgaccaaggcgccaaggccttagcattgaccagatacggtctggtcgggatcgcgtcattgccgtcacggcaaagcggtgatgggaatcacgccaggatagcggcggccggcagtggcggcgtcaaaggccgcgggcgactcttgaccaggatatttcaacagcaggaagcgggcggctggaccacccagccctgaagcgcagcttgccaagcaaggcatacagacccatccatgccctttgcacgcctcccggcggcgcaatgaacatcaattcgacagcgcagcggcttcccgagcagactcggcgtgactcaacgcttgagtcaagcgcgccatcaactcgcatagttgcagacgatcggccgtgttgaaatcactcatcaagcgcgccacccacaaatagtgatcaggcagcacctgcgccagcaaggtctctccctccggcagcaagcgcacgatccaggctcgcctatcattggcgtcttgttcgcgccggcatagatccgatctttccatgcgatcgatgatgcctgtcatcgtaggagaggagacgctgacgccttccgccaacttccccaggcccaagccggacggattgcgctttagcagcagcaaaacaaagaatttggtctgcgacaggccatggcgagccagattagcctcaaacgccagcatcatgtcgctggtcgccttggcgacctgcaaccaagtctgcaccccctccaggtccgggttatggtattccttggcaaacttggacaaggtttcgaaactgggcaggtctttcaactcaaacatagtcatgatttacacaccaaattaatatggcgcctcaaatttagcaggctaaatatatatagtcaaatagagtatttgtttatcattccctgccgctgaagccgccctccttcgccgaacgaacgacagcttgctcacctggatcgccaaacccctctcgtcagcctggcgcatacatcggcatgcgacaagcttgcaatcgtaggcccgacaatggaagccaatcatacaatccaaatatccggccgtagagcagaacctgaactttatgactaaataattatattatttccacataaatctgcaaaaaatagcacaacccgcactattaaatatcacaacgcagcacaaaaccatgcacacgactggcgcctagccgcaccagctgaagcgttgaaacaaggcccgcgatcgggcaagcggcacgtcgactgcccagtcaaagcccgccaggcgcctggcgggcagcgggatgcgccccctcgcggggactggcggatgggcagcggcgacggacggtcgccgcgggggaacggggagaggacggcaaggtcgaaacggcgccgcccggcgggcggggcagaaacgcagaaacgcagaaacgcagaaacgcagaaaccccagctcatcgagctggggttctgtatggggcgtctggcggtgtcctactttcacatggcgaatgccacactatcatcggcgctaaggcgtttcacggtcctgttcgggatgggaaggcgtgggaccacctcgctatggccaccagacataaactgtacaaacttaaagaagcccgaacccgtctctcagacagattcgcatatattcggtatttgatgtacgtcgcacagagagtggatgtgcgacgtacatcaaataccgaatatatgcgaatctgtctgagagacgggttcgggcttctttaagtttgtacagtttatgtctggtggccatagcgaggtggtcccacgccttcccatcccgaacaggaccgtgaaacgccttagcgccgatgatagtgtggcattcgccatgtgaaagtaggacaccgccagacgccccatacagaaccccagctcgatgagctggggtttctgcgtttcnggctggcgtgccaggcggtgaggccgtcctcgtcttcggtggcgtcgctgcggtggaagcgcacccgttccacttcggccggcggcaggctgtaggcgtcgtcgaacaccaccagcttgacctggggcgcgtcgccgtcgacatgctcgaagcgccaggcgtagccttcctcgtgcagcaggcggacgatgaagtcgtagtcgctttcgcggtattgcaggcagtagcttctgggctgcgccgggccgaccttgatctcgatcgcctggccgcgggcgaaggccgggttggcggcctggtgctcttgcaggatctgctggacgatgtcgggcaccgtcaggtcctggaacacgcgcgaggtgcggcggtggcgcagcagcgcgaacggcggctcgatggtcagcgcgtagcgggcgaagccgccgtcggcgcccagctgccgggcctgggacaccacgccgcagcgtatcgtctcctggccctgggcgtcggcgatgccgaggcgggcggattgaccgagcagggtcttgagttcgatggcgccgtcgggggacaggcaggtcagggtgaagcgatagggccgggacacgccttcctcgccgtccaggctttgcggcagcagctgctcggccgcgacatggccgtcgcccagttgcagggtgagctggcggcggtcctgggtgaaggcggaggcgtaggaggacagcaggttggtgaggtccatgatcgaaagaagagggcgttcagccctgcaccttgtaaacgttggaggagagttgcagggtggcgtcgaatgtcaccggcggccggtgcgggtgcactttcagcaccgcgtccacgcgaaagcgcaggtggcgctccagctcgcgcggcgcgtccaggttgacgcgcacgcgcgacagcctgggctcgtgcagttctatcgagcggcgcagctgttcgcgcagcgtttcgcggtcgtccgggttgagcaggctgatgccggacaggtcggggatgccgtagctgagcaggctgtcgcgggcccgcgggaagggctcgaacagctcgtccagcggcatcagccgggtgttgagcaaggcttccaggtcgcgcgccaacgcctgcttgaactgcgagagctcaaacaggctgatcgcttcgatgtggctcaggtccggagcgtcgtccagcaaacggtccagcaccgatggcagaatctgcgcgtggcggttgccgctcataagccgaatacggaagccgcctggcgcgccagcatccagcggaaggcgatgaagatgccggcgcctgcgacggccagcagcgcgaaatacagccacagcggcagctcatggcggacaaaggcctggaagcgttgcggcagctgccagttgggcgcgaaatcggccttgccgccgcggatttgctggatttcctggccgagcttgtgcagcaggtagcccagtttctcctcgccttccagcaagtacttgccctggaagcccagcagcaggcaggtgtagaacacctccagcgcctcgatgttttcagccggcgcgtcgcgcagctgttccaggcgattgaagaagccctcgccggccaggtgttcgccgaacaagcgcagctgcagcggcatgcgttcccattcgtcgcgcagcgcgaaatcggacgacaggatgatttcgtccatcagcgcgcagaacgcgtatttggaatggctgatggcgttgccgtccttgccgaaattgcgcgcgttgcgctcgaactggccgaggaagtggtcgacgcggcggttgaactccaccgcgctgctgggggcgttgccttccttcagcaggaacagcagatagatgccgtcttccagcatttcgcgcaggctgggcgcggcgggggcggctacgctcaaggcgcgttccgcggtttggatgcttgcttggttcatgtcggtatcagcggaagaccgctatcagttctatggaaatattggccagcgtctgcggcacgtagatgcagatgctgcgggactgcagcatgcggctgtagatctcgctgcccggctccagcgcgaagtagtggttgcccacgcgcaccgggatggccgacggcgtttgcgccgagtgcgccaggctgacgccgcgcatcgccgagttgaggatgcgttcgacatcgtccggcgcgccgatcttgagcttgagcggcacgttgtcgaggatgtagctggcgggttggtcgctttgcaccgacaggtagaagtcgacattgtccagcagccggtcgctttccagccggccgatatggaaggagggccgcggcgagtgcagcggaatcaccttgtagcgggccgataccacggtttccagcagttcgcggatttgcaggtccagcggcgggaataccaggtgcagctggtcgtggcggtaggccgggatgtcggacagcgtgtacagcgtggcgaaagtctgcagttcgccgcagaactcggccaaggccatgtacagctcttccggatgcagcggctggcattgcgacaggtggcgcaggcgggcgaagttgcgattgacggtgtgcagcagccagaacgagctgatgtcggccgagccgaactccatcacgctcttggcgcgctcgcggtgggcaccggacagtgcctggctcttcaccagcaatatgtcgagcagccggcgcagcatctgcatcatttcgccggaaccctcgatcgccagcagcggcggcaggaactccttgcctaccgtccattggccggtggcgtccttttccagctggcacagcgggatggagtcgtagccgtcgcggttttcctcctccagcatcagtttgatgtcgagctgcagggtggagaggtcggccgccagcgcctgggtgtacagatcggagacttcgctgtggtcgctgtggaagcgggtcggccgggcgctggcctcgccgccgcgggtgttgccgccatagggctgcagttgcgcgagacaggcgtacaacgtggtcttgatgccgatctgcggcatggaggcgaggtcgcggctgagcggcagcggggcgctggcgggcgcctggcacagcgagccgtcgcggaacagcgcagtcagctcgtcgacgcggatgatgccgcctttcagcgccgcttcatccagcgacagcttttggatgccccaggcgtggcgatgggtcagccgcagcaggctggattgggcttgctccagaaataaagcctgttgctgaaagtgctgcgggcgaaggaacatgccttcgccccataatattctctgtgcatgaagcattgctgcttgaaccttggctgaattgggaggtgatggccgctattctagttgcgcgcggtggaacaatcgactgcgccggtattgggctggtctggcagctgaatcgcttcgggtttgatcgcctgcaaatagcagtcgtcgactttgaatttgaggtccttgctgcgcacgcggccggcatcataaagcaaacgccagaagtggggattcggctgacggaaataaccgattacgccaacataattggcgtcttccaggattgtcatatccagttcctgcttgccgcccggaacgaatatcaattctttgctggatattaccgaagcgcctaacacatctgctatcggctttccactggccaaaaggtcaggtgtgagtagtttaaatccttggtccgatttcaattgataaacttgtactaccacagacaatggtttgccatgcttgtcgcggttcagcgcggtggtggcttcgctgctgagagtgatgtttttcgggcctgcgcagccgcccagcagcggcaaggccagcgccgcgatcatcaagcaagttttttgccagcgtttagttaaatccatataatcggcacctgaaataagacggcatacaacggttcattctaaagaatacgcttgtctctgcttgcatgtgccgtatcgaattcgaccccggcacttgacttctttgcaaatcaaatcaagcatatcgcgtaatttgccggttcatcaatcgtttgtataaaaaattccaatgacgttaattgtgccactggcggtggcttgcatcttattgctcatgttgtggttggggtggcgttattttcttggcggggcaaggcttcgggtggttcaggcgccgattgagattcctcaaaatccggcctttgccgcagttgaggaaagccggaatgacgaggcgtcttcgcgtttgtccggaacggtttcggctgcgcgcggctgggtgaatagacgctcgctgacgttgtttctgcctttgttgtcgctaatgttggtcggggccgttgtggcaattacgctgcactttggcggctatcatcaggacccccaattcaccccgaatgaatatgcccacggcagccagatccggcaggcgctgctggaggaaaagctcgtgccgccgccgccgctgccgcccagcgcctttgtcgacgcggtggccgagaagccgcaattggcgctggacaaggccgaccgcgattggagccggatggaccccgctttcgtacaggatgtgctgcgggtgatggaaaagatgaaggcccgcggttttccgatggtgctgctggagggctatcgcagcgccgagcggcagaaccgcctggccggcggcagcgccaaagtgacgcaggccaagggcggggagagcaagcaccagtacggcctggctgccgaccttgccccggtgagaaacggcaaggtggtgatctcggagcgcgatccgtgggcgatgcaggcctataccgcgctgggcgaggaggccaaggcacaggggctgggctggggcggcgtgtggagcttccgcgactacggccatatcgagcgcaccggctccttgcgggcattgctggcgcacaagaacaaatgattgtcttttagcttctaagggaaggtaaattcggtgtttaacaaaggttggctacgcaatgccaaggtggcgtccgccatcgggtttttgatcctgatcgccttgatctggtggctgggaccctggctgggcctcaagtcgctggaggcgcgcttggggtggatcgtcgtggtgatgatcgtatgggtgctggccttgctggtcggccaggtgttggcgcgccgggcgggcgggctgctggagggcatgttgcggcgccaggcggatgaggcggtgatcaacgccagcgccgacaagcgcgccgaagtgaccttgctgcgccagcgcatgctgggcgcgatcgacacgctgaaaaagtcgaatatcggcaacgcgcgcggcagcgcggcgctgtatgagctgccttggtacatgatcatcgggcacccggcggcgggtaaaagttccgcgatcctgcaatccggcttgagtttcccgttcagcgacaagagcggcatccagggcgtgggcggcacccgcaactgcgactggttcttctccaccgagggcgtgctgctggataccgccggccgctacgccaccgagagcgaagaccgcggcgagtggctggccttcctcaagctgctgaagcaataccgcgccaaggcgccggtcaacggcatcatggtggcgatcagcctgccggagctggcgcagcacaatagcgaaggcttcgtgctgtacgcgcgccaggtgcgcgagcgcatccacgaagtgtgcaataccttcggcctgatggtgccgatctacctggtgttcaccaagctagacctgttgggcggcttcgcccagttcttcaacgaggccggcgaggaggagcgctcccgcgtctggggcgccacgctgtcggccgaccaaggcaccggcttcgatgcctccgccgtggtgtcgcagcagttcgagcagttgtaccgcggcttggtgcaaatgggcgaggagcagctgtcgcaggcgcgcggcgacgcggtcaagtcggcgcacttcgccttcccgatcgagttccatggcctgcaggaggcggtggtcaagttcgtccgcctgctgttcgaggaagacccgtaccattcgcgcccgttgctgcgcggcttctatttcaccagcgcgctgcaagaaggcgtgccgcgcatcgtcaccgccggccgcgtgcaggggcagttcgacctgtccgccggcgggttggacaagcatcaggcgccggcttcatacagttacttcctgcgcggcctgttccgcgaagtgctgttccccgaccaacacctgattttccagcagaccaagcccagcggcagccgctggcgcctggccggcatgatcgccggcgtggtcagcctggcggcggtggccggtctgtggacctggtcgttcgtcggcaaccagcaattgatcgcgcaggtcagcgccgagcgcgcgcaggcgcagaaactggccgcttccggccagctgtacgaccgcctgaagggcctgctgatcctgcagaaccggctggaagagctgcagaactaccgccgcaacggcgagccgtggcagatcggcatgggcctctaccagggcgaagaactcgagcgcaatctgcgcaaggcctacttcgccggcgtcaaggacgtgatgctgcgcccggtgcagaaaaacctggaaaccacgctggcggcgcttaagcccggcgtgccgcagccggtggcggtcagcgagccgccgaagccgcagcccaagccggaagccaaacccgagcccaagccgcagccggccaagccgatcaaacagtacaagccgcgtccgaagggccatgcgctgcccaatatcaacctgagcgcgctggagctgccgcaacgcgcgaccaccgccaagctggacgcctcggcgccggccatcggcggcgaaaccgccggcaagccgcagaatccgcagcagctggatgtcggctacaacgcgctgaaaacctatctgatgctgcatgagcagcgccgtatggaagaggcgcagctggccgaccaactgccgcgctactggcggccgtggctggagagccagcgcggcgagtacccggtcaacgaggtgatgggccaggccgagaagctggtggcgttctatgtcagccagatcaaggagccggacctgccgctgatcgacaacgatcccaaggtggtggccgacgcccgcgacgtgctgcgcggctcgttcaagcgcctgtcggcgcaggagcgcgtgttcagcgagatcaaggcgcgcgccaacacccgtttcgcgccgttgaccgtggcccgcatcctcgacaaccgcgacatggacatcatggccagcagccagatggtggagggcgcctacacccgcgaggcgtggaacacctatgtgcgcgccgccatcgacgaggcgagcaagggcgagatccgcagcgacgactgggtgctggcctccagcagccaggacaacctgggcaaggacggcgacgccgagaagaaccgcgccgcgctggaagcgctgtaccgcgcccaatacatcgccgcctggcacaaattcctgcagggcgtggtggtgcgcgacatcaccaatccggcgcagtcggcgtcggcgatgacccgcctctccgacaagcagaactcgccgatcaggctgatcctggcgcgcgcggcgcaggaaaccgcctgggacaatccgtccgagctgaaccgctcgctggagaccgccaagcgctcggtgctggaaaaaaccaccgaactgttcaagggcgcggatagcccggccgacgccaagagcgacaagcagttcggcgtggtgggcgcgcagttcgccggcgtggccgcgctggtcaagggcgacaatccgccgatcaacggttacctcgaccagctggccaagctgaaagtgaagatggcggccatcgccaccaccgacgagcccggcccgcaggcgcgcaccgcgctgcagtcgacgttgaacggctccggttccgaactgggcgacacgctgtcctatgtcgacaacaccctgctgaacggcgcgacgccggacaccatcgagatggtgcggccgatgctggtgcggccgctgtcgcagtcgtacagcgccttgctgggcccggtggcgcaggacatcaaccaggcctgggccaacgaagtgctgccgcagtggaaacagctggccggcaagtacccgttcagcgactccagcagcagcgcctcggtggcggacatcaaccgcttcgtcaaggccaatgacggcacgctggacaagttcgtcaacaaatacctgaacggcctggtgcagaagaagggcgacagcctggtgccgcgcgcctggggcaaccagggcgtgcgcttcaatccggaattcctcaccggcgtcagccggctgatggcgctggccaacagccagttgcaggatggcgagaacagccgcttcgagctgcagccgctgccgaccccgggcctgtccgaaaccgtgctcagcatagacggccaggagctgcgctaccgcaacggcccgcagccgtggcagccgttcaactggccgggcagtggcggcggcgaaggcgcccgcatccaggtggtcaactacgccggcgccagcaccgtggtgggcaaccagtctggccgcatgggcctgatgcgcctgctggccagcgccaaggtgcaggacggcggcgacggctcggcccaactgagctggaacctgcccaagggcagcggcgccgaggcgcaaaccgtgcgcttcaatttccgcatgctgggcggcgtcaatccgctgcagttgaaccggctttacaaactgacgttgcccgaacgcgtgacgttgtaattggagataagcggcatggcgttcaatttcaagcgcacccaggaagtgcccccgcagttctgcattttcggcaagctgccgcggcgcgccgacttcgtgcgggtcaatgccacccacccggcggcgatgcagctggatcaactgctggcgcagagcctgcagcggatggagttcaacgaggacagcacccgccgctatctggcgatgccggccacctccttcgtgctgcaaagccgcgaccagaactggctgtcgctgggcgtgatccagcccagccgcgatgaaggcggccgcaactatccgctggtggcggcgtcgctggtggcgatagacaccgccttgccgccgacggcgatcctgctgctggccaacgagctgttcttcaccggcctgaaggaccaactggccagcgccatcgacaattcggtggagatgctggcctgcaagcagtttctggaagagcagctgcgcttcggcgcctcgtcggtggccgacatcgatctggcgcagcaactgctggaaaaacacctggcggtgacgccggcgtcggagctggggcgaagcctgagccaggcgggcagcggcgatctggagtcggtgctgctggccttcgtgttccatcaccgcctgctgcgcaaattccgcgacagcctgccggtgcaggcctacttcctgccgctgccggcggtggagggcgagaacgtgttggccgccgtcacctggctggcgctgtatcacgccgccacttacgacaacggcgacgcgcaggagcagtgcctgatcctgcgccggccggaaggccatttcctggtgctgctgccggccgggctcaacgagcagatcgccagccagtgctggggcagccagccggacgccaagttcgtcgtcgacatcaacgacgccaaggcgccgtggcgcagccaccaggcctatgccgaggcggcgtacgtgctgggccggcaactgaacgatccgggcctgtcgctggcgcagctgcggacggttttaaccagtctgtcgcgcaatatcgcgtagtcatttttgaaccttttgaacatctagagaaaaaccatgggtaaagaaagcactcagaaaaaactgtcgagggtacgtccgccgcgcgtgcagatcacctatgacgtcgaaattggcgacgcgatcgaaaccaaggaactgccgttcgtgctgggcgtgctgggcgactactccggccacagcaaggagccgctgccgaagatgaaggagcgcaagttcgtccagatcgaccgcgataacttcgacgaagtgctgaaaggcatggcgccgcgcctgaccatgaaggtggacaacgcgctgaaggacgacggcagccagctgtcggtggagctgaattttgacaacctggccgacttcgaaccgcagaacgtggtgcgccagatcgacccgctgaaccaattgctggaagcgcgcacccgcctggccgacctgcgcaacaagctggccggcaacgacaagctggaagaactgctggacgaagtggtgcgcgataccgagaagctgcgccagatcggccagcaggccggcaagcaggaagggggcgagcaatgagcgcggaactgcagcaacaggcggctccggccgcggcggaaggcggtagcctgctcgacagcatcatcgagcaaagccgcatcgccaccaatgacagcgaaaagaaccatacccgcgacctgatcggcgaactggtcgaccaggtgctgaagggcagcgtgacggtatcgcgcgacctgtccgccagcattgacgcccgcatcgccgagatcgaccagctgatcaccgaccagctgaacaatgtgatgcatcatggcgacttccagaagctggaagcctcctggcgcggcctgaagtacctggtgatggagtcggaaaccagcacccagctgaaaatcaaggtgctgaacgcgtcgaagaaggacctggtcaaggacttcaaggcggcggccgagttcgaccagagcgcgctgttcaagaaaatctacgaagaagagtacggcaccttcggcggcgcgccctacgccgcgctggtcggcgattacgaattcacccgccatccggaagacttctacctgatggacgagctgtcgcacgtggcggcctccgcccatgcgccgctgatttccgccgccgcgccgggcctgttcggcctggaaaccttcgccgacatcggcaagccgcgcgatctggccaagatcttcgacaccgtcgaatacgcgaagtggaaatcgttccgcgaatccgaagactcccgctacgtcggcctggtgctgccgcacgtgctgggccgcctgccgtacggcaaggacaatgtgccggtggaggagttcgacttcgaggaaaacgtcgatggcagcaaccacgacaaatacctgtggaccaacgccgcctacgcctatgcggcgcgcctgaccgacgccttcgcccagtacggctggctggcggccatccgcggcgtggaaggcggcggcttggtggaaggcctgccggcgcacaccttcaagaccgacgacggcgaagtggcgctgaagtgcccgaccgaagtggcgatcaccgatcgcaccgaaaaactgctgtccgatctgggcctgatctcgctggtgcactgcaaaaacaccgactacgcggccttcttcggcggccagtcggtgcagaaggccaagacctacaacaccgattcggccaacgccaacgcgcgtctgtccacccagctgccgtacatcttcgcggtttcccgcatcgcgcattacatgaaatccatcatgcgcgacaagatcggcagcttcgcctcgcgccagaacgtgcaggactacctgaacacctggctggcccaatacgtgctgctggacgattccgccagccaggaagccaaggccaagtatccgctgcgcgaagcgcgcgtcgacgtggtggaagtgccgggcaagccgggcgtctaccgcgccgccgccttcctgcgtccgcatttccagctggacgagctgaccatttcattgcgtctggtagccgagttgccgcaaccggcgggctgacgctttgctagctaggggggtggaacgcccccgtttatcgacccatgtaaggagaagtactaatggcttttgatgcattcctgaaaattgatggcattcctggtgaaagcggcgacgacaagcacaaagactggatcgaaatccagtcgttcagccacaagctggaacaaccggcccaggcttccgccagcaccgccggcggcgcgaccgccgagcgcgtgaaccatggcgtgtacgaaatcacccacttcctggacaaagccagcccgaagatctacgaagcttgctgcaccggcaagcacatcaaggacatcaccatcgagctgtgccgcgcgggtggcgacaaggtgaagtacatggaaatcaagatggaacaagtcctgatctccaaggttgagccgcaaggttccgctaccgattccggcttcccgtcggagaaggttagcttcagctacggcaagatcaagtggacctacactcagcagaagcgcgccgacggcgccggcggcggcaatgtcagcgccggctgggacctgaccgcgaacaaagttatcgcctaattccagcgatggaatgccgacccgcccgttctcgggcgggttttaagccttttttagtcacttggggaagtgtagctatgaaacgtttgttgataaccgtggctgtcgccgtgctgtgcagcgcttgtcagacggcacccaccaaggctcaacaggccgaaatgcaggctgcagccgccgccaatgaggccaaagctgaaatcgccaaagccgccgccgccaattacgccgccgactccacgctggttccgtttgagaaaatgagcggcaagctgactcccgtgggcgaagcccagctggacctgctgctgccgagcttgaaatccgccaaatccatcatcattcgcggccactgctaccgcaacgatatcggcaacgccaaggccgccgcccaggcgcgcgccgccgcggtaaggcaatacctgctgatggccgacatcccgtccagcaagatcaccgtgcgcttcgacaccgaacgcccgctgcacgccgtccgcctgctggtcagcaactaaacgcggttgatccgcactgaagccgctccgttgcctatcgccccatcagcctggcaagcgatagccggcgcggcttgtcattatcgattcgcacaagaatgcccatggacctcctcgccagcttcgcctccgccttcacccaggaccgccgccagctcaccctgcaactgggcgacggccatgtcgcggccgagcagctgctgccgcaaagcctggacggcgaggaaggcgtgtcccggccctatcgcttcaccctgacctgcctgtcccccgacggcgccatcgaactcaagaccctgctcggtcaatccgcccgcctcggcatcgccgacgcccagggccaggagacgatacgctgcggcgtggtgtcccaggcccggcagctgggcgccgacggcggcttcgcccgctacgcgctgaccatcgagccgccgttcgcgctgctgcgccaccgccgcacctcgcgcgtgttccaggacctgacggtgcccgacatcgtccagcagatcctgcaagagcaccaggccgccaacccggccttcgcccgcggccaggcgatcgagatcaaggtcggcccggcgcagcccagaagctactgcctgcaataccgcgaaagcgactacgacttcatcgtccgcctgctgcacgaggaaggctacgcctggcgcttcgagcatgtcgacggcgacgcgccccaggtcaagctggtggtgttcgacgacgcctacagcctgccgccggccgaagtggaacgggtgcgcttccaccgcagcgacgccancacccgacgcccgacttcagcggcgccggctcgctccccgccaacaagaccctgtccggcatcaaatccaaggaacaccagggcggaaactataacgagctgctgttcgacgacacccccggcgaagtgcgcgccaagctatccagcgaagcgggcaagacccagctcaaccagggctacctcgcccacccaagaagcaacggcaaagcccagccgcgcggcgacggcttcgaactcagaaccgaccagcacggcgccatccgcgccgcccacggtctgctgctgtccaccgaagcgcaaaacggcgcatccggcaaacagctggcgcgcgagcacgcgcagagccagctcgacgccgccctcagcctctcccaggcgctggccgaaaccgccaccggccaactggccgacagcatggaaaccggccccgacgaaatcagcgcggacaacgccaaaaccggcaagaaatcccaaggccacctgcaacaccacgccgacgcgctgaaggcctgggaagccggcagcaacaccgacaaagacggcaaaaccgcccaggaccaagccggccaacagccgctgctggtgctgtccggcccggccggcatcgccgccctgaccgagcagagccagacgatatcggccggccagaacctcaacctggtcgcccaacgcgacgccaaccacacgacgggccggcgctggatccacaacgtcggccagcacctcagcctgttcgtggcgggggtgaaggacaaggtggcgctgaagctgatcgcggcgaagggcaaggtgcaagtgcaggcgcagagcgacgcgatggagctgacggcggagaaggatgtgaccatcacgtcctgcaaggacaagatcatcgtccacgccggcgatgaaatcctgctgaccgccggcggcgcctacattcgcatcaaaggcggcaatatcgaggtccatgcccccggcaaagtgacggtaaagggcgccagccacacgctcgacggcccagccagcatggattggtcacagccgcaatacaagaagatcgtctgcaccgagcagatcgatgcgcagttgctgaccgaggcgcaccccgagttcatcggcaaaaaatacgtctactactccgccgataccggcaagaagatcgcgtccggcgcgctggacggcagcggcatgaccgaccgcatccatctgcccggcgtcaacaacatcaaggccctgatcgggtccggtgaatgggaaatcctgtaatgaaccatcgctatgcttttatcgccattggcgtgctggcgctgtctgctgcccgcgccgacgccgccaaccaggctgaggacgcctcggtagacctgggttggaacacgctgcagcttcatgccagccagacgctggccggcttgacgccggggcaatattcggtgaagaacctgttcgacccgagtccagccaaggcctgggtcttccacggcgagcagacatttcgctattccgagcaaatctccaatccggcaacgctgacgctgacgttggcgaagccgagctcgctgttcgccgtcgcgctgacgccaggctacgccaagtcggcggccacccagttccagaacgcctcgccgaagagcgtcaccatcagcctgtaccggccgcatgaagacaaaccattcgaaacgcgccgtttcgccctcagctaccatgcgcgcgagtattcgctgccgcagttgcagcgcgagctgaaaacggtagccttcaccaaccagacggatgacaagatcaccggcaaatcggacaacgcgttgaactcggccgaaaggctgctgctgatcaacgctggcgacgccgaaatcgccaagctggagctgaaaatctccaccattgagccgggagcgaaattcaccgatgtcgccgtcagcaagctccgcctgctggaccggcaagccagtcagaatagcgcggaactgcggctggcgcgcttcatcgcgcgcgacctggacaacgccgccaagcaactggccgccacgccgcgctgcttggtttacaccgaacagaacgcctggccgcagctgaccaaccgcgcctgcaccggcccggccgcgcaactgcaacaaggccaggccgatcaaggcgtcgacgatatcatcctgacacgcaaagacgctgccagccggcaataccaggttccgttcgccgtcgcgctgcgcgacgcgcaaaccactggctccggccgcaacagacagctgcggctgtccgccgccgacatggcgggcagtgaactgatactcggcaaaaacgccaacggccagttgcaggcgctgtccggcctagcgctgacccaggccttcctggccaaccgcgccgatggcttcggcaaggcgtacctgcaaccccaggacagcccctacttcttcttcgcctactcccgcccgcagttcacaccggacaaggacggctaccagttgagcatctacggcccggccggacgccaggaggcgcaatgggcaaccaggtagaaaagtacaaggatttcaacttcggcaaatacagcgaagaacagaaatacgacatcctgcagcggctgttcgaacatcacgccgccgccaacggcaagaataatgtcgacggtttcgcgttcgagaccgccaacggccgggtcaacctgataggcgcgcgcggcttcgaccacggcaaagtcgtcaaagacagcaacaaggtgttcgacgacacattgttcgtcgtctacaaggacgcatccggcgagaaaaaagtcgccgaattcgaattcaacaccgaaccctacagcaagcagaacggccagctggccggccgggtgctgatcaacggtctataccagtacaaactgggcaatcacaagatatcgtcgtaccacgaccatgccagcctggcggaaatgcaaagcacgcaccatttcgcccagcaccacaactaccgggcgctgaggatagtcaaaggccttgcttttcacgcccaaaacaccggcacggccaaggccccggagtatgagttcagtccggaccagcccggcacgccgtcaacaacctacgaacacaacatccactacggcggcgaaggcccgagcaaccgcaccagcaactggagcgaaggctgccagacggtcaagggcctggataactacatccggctgctgaaaattctggaacaggactacagcctgttcggcaccatccacaacgagctgatcgccaagccggctgtcgatggcaagcgagcggtggtctacgcgctgctggacggccaccaggtcgccgatgaaaccaagattcaggtcaaattcctcgaccgcatcctgcagccgatgaaagacgtctggtatgagatccgccacggcgaccaaaccattaccggcaagaccgaccatgacggtgacaccggcgcgctgttcggccacaacccaaaggacaaaatagacgtcaagctgcaagggccggtcggcgacgccaagaagctgccgccggtgcaggccggcgagagcgtgttccacaaatacctatgcgtggtcagccccaaggtgctgtgtgatggtctgtcgcgtcccgacgccgatcataaggaaccggaaatcgacaagacccagtccaagacccacaaacatcacaacaagcaacgcaagccggtttccaaggtggaggtaccgaaagaccgcaacccgctggaggcaccaatttcggattccgaatttgaggactgcaacgcgctaagccaggaacagatcaccaccatcatcaggtccaacaatccggtgctgatcgaccaataccaggccgacgtgctggtctacaaggcggcgcagaactacaagctgaacccaaaggcgctgctggcgacaatgaagcaggaacaaggctgggccaagaataacaataaatacaacaagctgatgggcgtcggtcctggcggccagcccacaccgatgggagttgaggcctcgatcaacacgtcggctggcacctatcgcaggctgttcgacgagggcaagaaaaagctgtcttcgttcaaaatcaactacgaccccaaatcccatgaagtcgccgcggtaggcagcggcggcgcctccgtcagcgaagaggaggccgcggcgatgaaggcaggctatctgtacacgccgcgcaccgcctctgaatacgccaagctgcattacacgccgtggacctactttcctccccaacgcagccgaccttacgacacctgggtaaaaactttccggagcttctgaatgaaaatcaattttctgctaagcgtggccgcgctgctgttggcacagcacgcgtcggccgcttgcgacaaagacgactggcaacagctgctgcgccacgccgacgcgcctaccgtcagcgcttacatcaagagccagcactgcgacgtcgaccaatcgctggatgatgtttcgaaaacgccgctcgtttacgcaatagatgccggcaaccggggcgccgtgcaagtattgctgcaagccggcgccaatcctaacgtcgacggctacgatggcaacaccccgctgttctacgcggtgtctgccaaaaatctgaatatcgtgcaggacttgatcgccaaaggagccgatgtcaacgccgccacccgcaccagcgaaatcaccgtgttgatgaccgcggtgctggactcgactcccgccgtcgcgtcatatctgatcgcccacggcgcatcgctgagcgataccgacaaatacggccacaagcctatcgactacgtcgccaagctcccagccaagaaacaagcggccatgcgcgccgcgctgaaaccgcactgatcctacaagaacagccaaacaaaaacggggagccgcttgcgccgctccccgtttgccatcagacggtatcgatcttagccgtagtggcccgcattcgcggcagccaccgcgcggctgtgcggcggcgtctgcccatccaccgccatcatcacgctcagcgaggtgatggtaatgatggagaagaagaacacttggcgcgcccaggccctgtcgtcggtttcgcgcttgtagccggacagcgccatcttcagccaccacaggctggtggccaccgccaccgccaggtagccgtagccggcgtagccgccgtacaccaacatcacggtcgccgcggcgaaagccaggatgtagagcacgatctgctgcttggcggcggagatgcccttcaccaccggcagcaccgggatgccggccgcctcgtagtccttgaagcggaaaatggcgatcgcgtacgagtgcggcatctgccacaggctgaacatcaccagcaaaatggcagcgcccatgtcgaagcggccggtgacggcgcagtagcccgccaccggcggcaccgcgccggacaggctgcccaccagggtgccgtacaccgagttgcgcttcatgtacaggctgtacacgccgacatagatcacaaagccgaacagcacgcagccggtggccagcggattggtgccgaaccacagcagggcgaagcccgccaggcccagcaccacgccgtgcgccagcgcggccttggtgctcatcgcgccggtgaccagcacccgtttctgggtgcgggccatcttggcgtcgatgtcctgatcgatgcagttgttgatcgcgcagccggaggccaccactagcgacaggccgatgacggtggccgcaagcagccaccagtctatcgccccctgcgccgccagcagaaaaccgccggcggccgagatcaggttgccgaagatgatgccgggcttggtgacctgaagataacgcttgagcttcaagacgttctcactcagcgcatcatcagcgcgtcggcggtgtagatgatccagatcgacaggccgaccagcagcacgatcaccatgccggtgaacaggaaggaaatgctgttgagcttgccttccttgctgaagtccaggtgcaggaaatacttcaggtgcacgatgatctgcaccaccgccagcgcgaagatgccgaagaaggtggcctgcttggtgaaggcgccgcccattaccatccagaacgggatggcggtgaggatcaccgacagtaggaaaccgatggcgtagcttttcacgctgccgtggctgttgtgctcatgcgcttggctcatcacatggctcctttcagatacacaacggtgaacacgcagatccacacgatgtccaggaagtgccagaacagcgacaggcagttcaggcgggtcatggcgcggccggtcaggccggtcttggccacttccagcatcatcacgcccatccacagcaggccggcggtcacgtgtaggccgtgcaggcccaccaggccgaagaaggccgacaggaaggcgctcttctgcgggccgtggccctcggcgatcaggtggtggaattcattgatttccaggccgatgaacgccgcgccgaacaggaaagtgacggccagccagccgagaacggccgacttgttgcccttgtggccggcgatcatcgcgaagccgtaggtgatggaagacagcagcagcgccgcggtttccaccagcacgtacggcagctcgaagatttccttgccggaaacgccttcggccacgttgcggaacagcactgcataagccgcgaacgccgtcgcgaacaggatgcagtcggtcatcagatagaaccagaagcccaggacagtctgcttgccgctgtcgtggtgctcatggtcgtcatgcgcgtcgtgcgcttgctctacataagtcgtcatgtttgatccagcctgttacacggtggtggtcggacgggcggccttcttcggcttggcctgctgatcacgctcggtgtagttgtcgacatcgatgcccagcttctcgaagcgggcgcgctcgatggcctccacttcgtcaaccggcacgtagtagtccaggtcgttgtcgtaggcgcgcgccagcatgaagccgatgatgccgacgaggccgacgatggccagccaccagatgtgccagatcatcgcgaagccaaacacggtggagaacaggccgatgaagacgccggccgaagtgtttctcggcatgtggatgggttcgtacgacttcggcaccgcgtaagccacgcccttttccttcatatcggtgaaggcgtcgatgtcgtgcacctgcggcagcttggcgaagttgtagtacggcgccggggacgaagtggaccattccagggtatggccgttccacgggtcgccggtttcgtccttcagctcattgcgcttgatcacgctcaccacgatctgcagcagctggcagccgatgccggcggcgatcagcagcgcgccgaacagggccacgtacagccacggctcgtattcaggattggtggtgtagttcaggcgacgggtcatgcccatgaagcccagcacgtacagcggcatgaaggcgaacatgaagccgatctgccagaaccagaaagcagccttgcccagcttgggctccagtttgaagccgaacactttcgggaaccagaaggcgaagccggccaggtagccgaacaccgcgccgccgatgatggtgttgtggaagtgggcgatcaggaacaagctgttgtgcagcacgtaatcggcgcccggcaccgccagcagcacgccggtcatgccgccgatggagaaggtcaccatgaagcccagcgtccacaggatcggggtttcaaagcgcaggcggcccttgtagatggtgaacagccagttgaacagcttcacgccggtcggaatcgagatgatcattgtcgcgatgccgaagaaggcgttcacgttggcgccggagcccatcgtgaagaagtggtgcagccaaaccatgaagcccaggatcgagatcgcgccgctggcgtagatcatcgacttgtggccgaacaggcgcttgccggagaaggtggacaccacttccgagaaaatgccgaaggcgggcagaaccagaatgtaaacctcggggtggccccaggcccagaacaggttcaggtacatcatggcgttgccgccggcttccgcggtgaagaagtggaagtccaggtagcggtccagcgtcaacatcgccagcgcgccggtcaggatcgggaacgaggtggcgatcagcacgttggcccaggtgcaggtccaggtgaagatcggcatttccatcagcttcatgcccggggcgcgcatcttgatcacggtcaccaggaagttgatggccgtcagcgtcgtgcccaagcctgacaactgcaaggcccagatgtagtaatccacccccacgtcagggctgaatcccagctcggccagcggcggataggccacccagccggtgcgggcgaagttgccgacgcccagcgacaggttgaccaggatcaccgccgaaaccagcagccagaagctcagcgagttcaggaaggggaaggccacgtcgcgcgcgccgatctgcagcggcaccacgatgttcatcaggccggtcatgaacggcatcgccatgaagatgatcatgatcacgccgtgggcggtgaagatctgatcatagtgttccggcgggaaaatgccgtggccgccgccggtggcgactgccaattgggtacgcatcatcagcgcgtcggcgaagccgcgcagcagcatgatcatggcgacgatgatgtacatcacgccgattttcttgtgatcgaccgaagtcagccactctttccagagatagccccacttgccgaacttggtgatgagcgcgaacagcatcagccccatcaggccggcgcctcccagcgcccccatgatgatgggctcatggtacgggatcgcgtccagagtcagtttacctaaccacattaatcgttactccttgacaaccggcggggtgatcgcggcgcacagttctttggtcatcttggccagcttgatggcgtcgtcgctgtcagccagcgacggacgggcggccatgtacttgtgcacaacggcttcgaacaggtaaggcgtggtcgaagcgtagtgagccaccgggttgttctcgctaggcttgagcaacttcaggtaggcaggcgcgtccaaggtttggccggaagccttcaccttggccacccaggcgtcgaactcggccggggtcttggtggcgacagcgttgaatttcatgcccgagaagccggcgccgctgtagttggacgagaagcccttgtaggtgcccggctcgttggcgatcaggtgcagttgcgtctgcatgcccgccatcgcgtagatctggccgcccagctgcggaatgaagaaggagttcatcgccgcgtcggaggtgatcttgaagctcaccggcgtatcggccgggaacaccagttcgttgacggaagcgatctgctgctccggatagatgaacaaccatttccagttcagcgcgactacctgcacctggatcgccttcttctccgactgcagcggacgatacggatccagttcatgggtgctcttccaggtcagcgcggccaggaaggcgatgatgatgcaggggatcagccataccacgatctcgatcttggtcgagtgcgaccatttcggctcgtaagcggcatccttgttgctggcgcggtacttccacgcgaataccagggtcatcacgattaccgggatcaccaccagcagcatcagcgcggttgccgtcaggatcagggacttctgctcagcggcgatatggcccttgggatcgagaatgccgccttggcatcccgaaagcagggctaacaccacaggagagagcccccacatcaggcgggagggtctatggtttctcatcttacgacttttcgggttaaaaatccttcaacgcgccgatgcgcaacaggcgttgcgagccacgctccaacgccagcgaaatgttcacgccaaccggcccaaacctcccgtcggcggggaggcggtcgaaccgcccggcaaaacaacagactttcagggctcgcgggaaccgcgattggccagaccgcatccgtttccacggcggctgcgctccggatggaagcgactccacaatcgcttccggacgatgacgtgacagctgaatgctcactgtccgagtgaaacgccggcaaaggcgcgggaagacaggaattcggcaacacaaacatctgcccggcaacatgcaccgggcgggcgtattaaaaacagttttgcctgatatttcaagacccttgaccaggatcaagcccgccccgccatctgatatgcaatatgattgaccgtaatcaaggacgccggatcggcaaatctatagccgcgacaatggtttaggacaatgtgcttaacatgaaccgccgcggcgcggcgttgcaaattgttacaaaaaatattctcgctcaaacaatcgctgggggggcatcgctattcattgcacagaatcaggaaaacgagaaagaaaattgcgccgcgccaacacaactttcccatgaaaatccagcaaatgacgcaacaatatttcagcgcaaaaccagccgcgccacacggaggccgtgttcgaaaggcagccctgaaatgcaaaaagccgaatcgttgtcgattcggctttttctgaaacttggttgcgggggcaggattcgaacctacgaccttcgggttatgagcccgacgagctaccagactgctccaccccgcgtcagagaaatgcaataatagtgaaatcatttgccggcgtcaatagcctggaccaaatattttcactcgcagcgaactgccatgaaaaaagccgaatcgttgtcgattcggctttttttctgaaacctggttgcgggggcaggattcgaacctacgaccttcgggttatgagcccgacgagctaccagactgctccaccccgcgtcagagaaatgcaataatagtgaaatcatttgccggcgtcaatagcctggaccaaatattttcactcgcagcgaactgccatgaaaaaagccgaatcgttgtcgattcggctttttttctgaaacctggttgcgggggcaggattcgaacctacgaccttcgggttatgagcccgacgagctaccagactgctccaccccgcgtcagaggaaccaatattaaacgggctcttcaaatccgtcaagacttatttaaaaataactgcaaaatcagcaccggcaagcctgggccgccgtcaatgaaaaagggcggccatcgccgccccttccacagtgcggccgcgccgcttacttcttctcgctgcgcgccttggcgatcagctcgttcatcaccacgatcatccgctccggcgtgctggtggtcaccacgtacttgccgttgacgatcacggtcggcgtgccctggatctggtaatcgcgggtgatcttggtcgcgcgcgccacctgggcattgatgccgaaggagttgtaggtctgcagcagcttgccgctgtcgacgcccttctgcagcttgacccacttggtgaactgctccgggttggacaaatcgatgcgctgcttgatctgcgcgtcgaaggccgggcggtgcagcttgtcgaaggtgcctgtggcgttgaaggtggcgaacatccgcgcgaagccttccatcgacttctgccatacgatctgctccttgcggaagcttacgtcggcaggcagcttgcccgcccaggcctggaaagccggatcatcgtcatagcagtgaatgcagtggtaggaaaagaactcgatcacttccaccttcttgggattggccaccggctgaggcgtgctcagcagtgtgtaatccttgcccagctcgatggcggcattcgccgcgccgctcaccgccagcaacaccatcagcaaccatttcttcattttgttttcctgtattgggagataacgactactcggctttcaccacattggcgttgatgccgtcctgtttcaattgggcgcgcacgcgatccacctcatcctgccggctgagcgggcccactcgcacccggtgcaccatccccttgtccggcacattgacggactggatcttcgcctccacccccaataacgccagcttggctttcaggttgtcggcgtcgtcctggttctggaacgcgcccaattgcagatagacctttttggcaggcgccgacgcggaaggttccgcggcacggctgcccttggcatcggacgtcaccgcatccacttggccgggcaatatcttgtagaaatcaaagcgctgatcgttcttgtcgctcttggcctgctggccggcgggcgccgccttgggcttggcctcatgcggcgcgggcgctggcgcggccggcggcggcaacgccacggtgtcggagtccagcgtcgcctgcttgggctgcggctgcgcggcagcgggcgcggtagccgacgcggcatcggaaatgcgggtgcccggagccagcagctcggtcggcgcctgcgaagccgcctccggcttgcgctcgcccttggcctggaacggcgccggcgagcggttgagatacatcgccaaccccaccgccaccgccacgcccacgatcaggccgatgatgatgcccgccatcatgccgccgccgccgctgcgcgacgaggacgaactgctgcgtccgcgagagggacggggggagtttttcagatctcgattagccattcaccactaccgctatgtcaaacggacggcaagcatgccatccgggttggattgagaattctatcaggcgttgccctgcatcacgcgtcggagctggatcgcctgcaatacatggctgcggcctatcttcgcctcgccttgcaagtccgcgatggtgcgcgaaacccgcagtatccgatgataagcgcgcgccgacaagccaagctgctgcaaagccttgcccagcacggccaaggcatccgcgctcgcctcgcagtgccgctccagctccgcgccttgcaaggccgaattcaggccgccctggcgttccagctggcaagtcctggcggcatgcacccgcaacctcacctgctcgctgctttcgcccggactggccgactgcaattcggccgccgtcagcgccggcacctctatatgcaggtcgattctgtccagcaaggggccggagattttaccgcgatatcgccccacctgctcgggcgtgcactggcagcgccccgatgggtgcccatgatagccgcaggggcatgggttcatcgccgccaccagctggaagcgcgccggaaagctggcctggcgcgccgcgcgcgagatatggatcaccccgctttccatcggctcgcgcagcacttccagcacgcggcggtcgaactccggcaactcgtcgagaaacagcacgccgtggtgcgccaggctgatctcgccaggccgcgggtcgctgccgccgcccaccagcgccaccgcggaagcggtgtggtgcggcgcccgaaacggacgcaaacgccagttcgaggccagaaacccttgcgagcccaacgacagcagcgcagcggactccagcgcctcctgttcggacagccgcggcaacaagccaggcagccgcgccgccagcatcgacttgccggtgcccggcggccccatcagcagcaggctgtgaccgccggcggccgcgatctccagcgcgccgcgagccgctgactggcctttgacatcctgcagatccggatagttcggccaggctccgccgtcagccggaaccgagggctgcaaggtttgcagcccgttgagaaacgcgcaggcctccagcagcgagcgcaccccgtaaatctgcgcctcggccaccaccgcggcctctgccgcgctggcagccggcagcacgaaggcgcggcgggccgcatggcactggcaggccatcgccaacgcgccgcgcaccgggcgcacggcgccgctcagcgccagctcgccggcgaattcatagcgggaaatgtcaggattttgcacttggccggacgccagcaggatgccgatggcgatcggcaggtcgaaacggccggaatccttgggcagatcggccggggccagattgaccgtgatcttgcgcgcgggaaattcgaagcccgaggtcaagatggcggcgcgcacgcggtcgcggctttccttgacctcggtatcgggcaagccgacgatattgaacgccggcaggccattggcgaggtggacctcgacggccacctctggggcgtcaagcccggacagcgccctgctcgccaccaccgccaatgtcatggcgactcaggagtggccgagttccgactgctcctccacccgggcagccgcctcttcagggaaggccgccgcctccacccgcgccaggcgcgcctccagcgccgccagctgctcgcgggtacgcgccagcaccgcctgctggacatcgaattcctcgcgcgtcaccagatccatcctggagaaggtggaggccatcatggccttcacattcttttccaggtctttggccgggctggcggcgatggtttcgctgatcttggcgctgatttcttcaaacagtttctggctcaacatggtgacggctcctgcgtgtgtcttgatctatggcgagtgtagcaaaaagccgcgccgaactcgcgccttcctgtccccatgggcatcgattccgcccttgcgcaggccgcgccacgccatcgtctcagcacgtagacatgctgcagcgcagcttcgcaccaaaacagggcagagtaaacagccgccgcgcacaaggaaagtgcctgaatggccagcgcggtattttttgcggcgcacaacaattcaatctgcgcccgcgcgcgcctggcacgattcatgcataacagtcaggcagccaatcgttgtccctcacttgatcgtccgagaaggagccgccatgaaactcgtcacagccgtgatcaagccgttcaagcttgacgaagtccgcgaagccctgtccgccattggcgtgcaaggcgtcactgtatccgaggtaaaaggtttcggtcgccagaaaggccataccgagctctaccgcggcgccgaatacgtcgtggacttcctgcccaaggtaaagctggaaatcgccatcgacgacgccctgctggaccaggtggtggaagccatcgagaaatccgcccgcaccggcaagatcggcgacggcaagatcttcgtctacgacctggagcaggtgatccgcatccgcaccggcgaaaccggcgccgacgcggtctgaccgctgtgtgaaactggggaaaccataatgaaaaagatactcgctgcaatgtgcggcggccttgccgccctgtctctgccggccctggccgacgcgcccgccggcccggccgtagccgccgccaaggtgatcaattccggcgacaccgcctggatgctgacctccaccgccctggtgctgttcatgaccattcccggcctggcgctgttctacggcggcatggtccgcaagaagaacgtgctggccaccctgatgcaaagcttcgccatcaccgcgctggtgaccgtgctgtgggcggtcatcggctacagcctggccttcaccgtcggcacgccctacctgggcgacctgtcgcgcttcatgctggacggcatggtgtacatgaaggacgccggcaaactggccgtgcacccgctggccggcaccataccggaatcggtgttcatgaccttccagatgaccttcgccatcatcaccccggcgttgatcaccggcgccttcgccgagcggatgaagttctcggcgatgctggtgttcatggcgctgtggtcgctgctggtatacgtgccggtggcgcactgggtgtgggcgcctggcggatggatgggcgacaagggcgtgctggacttcgccggcggcacagtagtgcacatcaacgccggcgtcgccggcctggtgaccgcgctggtgctgggtaagcgcgtcggcttcggcaaggaagcgatgccgccgcataacctgatcctgaccctggtaggcgcctcgatgctgtgggtgggctggttcggcttcaacgccggctccgccggcgccgccgacggccgcgccgggatggcgatggtgaccacccaggtcgccaccgcgatggccgcgctggcctggatgttcgccgaatgggtgaccaagaagaagccgtcggtgctgggcatcgcctccggcgcggtggccggcctggtggcaatcaccccggccgccggcttcgtcgacgtcaagggcgcgctgatcatcggcctggccgccggcgtggtgtgcttctggggcgccaccggcctgaagcacgcgctgggttacgacgactcgctggacgccttcggcgtgcacggcgtcggcggcatcctgggcgcgctgctgaccggcgtgttcgcggtcaaggacatcggcggcgccgacggcagcctggctacccaggcgctgggggtcggcgtcaccatcgtctactgcggcgtcgtcaccttcatcctgctgaagctggtgaatctggcgatcggcctgcgcgtggcggaagacgaagaacgcgaaggactggatgtggtgctgcacggcgagcgcgtggaataagccgccggccaagccaagattgttgtgtaagggacttgcggggcattcgtgccccgttttttttgcacgcgcaaagaaaaaccggcgcggcggccggtttgatcgcaggcgaaacgccagcttatttgacgatgcgcaggctgggcctgccgctgggccgatccggccccgggtcgccgcccttcggcggatcggcgtccaccggtttggcgtcctgctcggcctcgggcgacggctcgacctcgaaccccatgccctctccggtttcccgcgcgaaaatcgacatcacattgccgatcggcacccagatatcgcgcgacacgccgccgaagcgcgccgagaacgacagccagtcgttgtcgatccgcagattcttggtggcgccttcggcgatgttcagcacgatctcgttattcttcacgtattcgagcggcacgtcggtgcgctcgttgacccacaccaccacatagggggtgtagccgttgtcgccgcaccattggtgcagcgcgcggatcatgtagggcttggtgctggagctcatcgcgtcaccttacttgcgcatggccttctcggacggagtcagcgagtcgatgaaggactggcgctggaaaatgcgttccgcgtatttcaggataggcgcggcgctcttgcccagatcgatgttgtagtgctccagacgccacatcagcggcgcgatggccacgtctatcatcgagaaatcgtcgcccagcatgaatttttgcttggagaagataggcgcgatggtggtcaggccgtcgcggatcgcttcgcgcgctttggtcgcctccttgccggtggcgccagcttccagcgttttcacgtagatgaacagctcgttctcgaaacggtgcaggaacagacgcgcgcgcgcgcgcatcaccgggtcggccggcatcagctgcgggtgcgggaagcgctcgtcgatgtattcgttgatgatgttggattcgtgcaggatcagatcgcgctccaccagaaccggcacttcgttgtacgggttcatcacggccagatcttccggcttgttgtggatatccacgtcgatgatttcgaaatccatgcccttttcgaagagcacgatacgacagcgctggctgaaggggcaggtgattccggagtagagggtcatcatggcggaaataatccttgactaacaatgaattgatgtagcagggcattctagcaccttcccacccccatttgccagcttttcaatacaacatcatgattacaaaagaaaaaaggcggaatcgcttccgcctttccttctgccgccccgcgcttaatgcacgtcgcgccagtattccttcttcagcaggtaaaccagcgggaacagcagcaggccgaggaacatcagcaccacgtagccgatctgctggcgctgcacctgggcgggctcgcccatgaacaccagaaagttggtcagatcggtcatccgcttgtcgtactcgacggtgttggccttgccgttttccagcttggtcagggtgccggctttcaccaactgcagcttgtgcacctcgttgccctcggcgtccttctcggtcttcagcacctgctcgccttgccattcccagaagacgtgcggcatgcccaccttgtcgaacaccagattgttccagccggtggggcgggatggatcgcgataaaagctgcgcaaatagctgtacaggtaatcggcgccgcgcgagcgggcgatcagcgacagatccggcggcgtggcgccgaaccagttcttggcgtccttcttgtccatcgcgatattcatctggtcgccgatcttggcgccctccggcagcaggttggccttgatctgctcttcggtcaggccgatgtcctccagccggttgtagcgcagcatgctggccgagtggcaggacaggcagtagttgacgaagatctgcgcgccgcgctgcaggctttcggtgtcctggatgtcgatgtcggccttggccagcgccgggccgccctcgttggccagcgcaggagccgccaacggcagcgccagcgccagcgcggcggcggcgatcaggttgcggatcgtgttgttcattttccttatccccttgcttacacgttcatggcgaacagcgccgccaggaacacggtcagcagcaccagcaccacgaactggatctgccgcttggcgttggtgtcggtgacgcgctccggcaccgggatgctgccgacatcgttcttggtgtagaacggcatgcccaggaagaaggcgaagtagaccaccgagaaaatctgcgacagcgcggtgcgcaaaccagtcggcggcatcgcgcccaggatgcccaggccgatgaaggcggcgatgaacagcgccagcgcgatcttgaacttgggtccgcggtagcggatggatttgatcggcgagcggtccagccacggcaggaaggcgatcagcaccaccgccgcgcccatcgccagcacgccccacacctgggtgccggcaaacgacggcaccgcgcgcagaatggcgtagaacggggtgaaataccataccggcgcgatgtgcggcggcgttttcagcgggtcagcctggtcgaaatttgggtgctcgaggaagtagccgcccatttccggcaggaaaaacacgatcgcggagaacacgatcatgaataccaccacgcccaggatgtccttgatcgagtaataaggatgggagtagatgccgtccagatacaggccagtgttcggatccttgggttgctgcttgatttccacgccgtccgggttgttggagcccacttcgtgcagcgccatcaggtgggccaccaccagcgccagcagcaccagcggcaccgcgatcacgtgcagcgcgaagaagcggttcagcgtggcgtcggacaccacgtagtcgccgcggatccataccgacaggtcggggccgatcaccgggatggagccgaacaggttgacgatcacctgcgcgccccagaacgacatctgcccccagggcagcaggtagcccatgaaggcttccgccatcaggcacaggaagatcagcgtgccgaacacccagaccagttcgcgcggctgcttgtacgagccgtagatcaggccgcggaacatgtgcaggtacaccaccacgaagaacatcgaagcgccggtggagtgcatgtagcggatgatccagccgcccgccacgtcgcgcatgatgtattcgaccgaggcgaaggcgaccgggatgccggcggcgttcagcgtgccgtccggcttgtagttcatggtgaggaagatgccggtgacgatttgcagcaccagcaccagcatcgccagcgagccgaagaagtaccagaagttgaaattcttgggggcgacgtatttgccccattggctttcccacagggcggtcagcgggaaccgcgcatccacccagttgagcagcttttgtgctttgttcatttttcgccctcagcttatttgtcgtcgccaatcaacaggcgggtgtcggacagatacttgtgcggggggatttccaggttcttcggcgccggcacgcccttgaacacgcgggcggcgaggtcgaacttggaaccatgacaggggcagtagaagccgcccagccattccggccccagatccgcgggcgcgagatcgggacggaaagtgggggaacagcccaggtgggtgcagatgcccacagccaccaggtattcgggtttgatcgagcgatgctcgttctggcagtacttaggttgctgatccacctcggattgcggatcgaccagcttggggtcgttcttcggcaggttcttcagctgctctggcgtgcggttgagaatccacaccggcttgccgcgccattcgacgttgatcttctgtcccgcctcgatcttgccgatgtcgacctcgaccggcgcgccggccgccttggcccgctcggacgggaagaaactcaggaaaaacggcgtggccgcgccgaccaccgccacacccccaacagcgctggaagccaccgtcagaaaacgacggcgccccgtatcgacttgctgttcactcattacagtcatcctcaatcgtggaaatcgagcccttaaccgctggattttacccgattactagtagggacttgaagcttctatgcaaataaattgaccaggacgccagcaacttgcttaaactgggtttaaaacatcaataaattcgacatttatgccagagaattgcgccaaatgctgcccaagtgcctggatgccgaagcgttccgtggcatgatgcccggctgcgatgaatgcgacatcgcactcgatcgccatgtggtaattctgttccgacgcttccccggtaatgaaggcgtccacccccagcgcgatggcgtcggcgaaaaatccctgcgcgccgccggtgcaccaggccactttgcgcaccggcttgtcgccgcgccccaacagctgcgcatcccgccccagagccgccgaaacatggctggcgaaggcctgggcagcgccaccaccgcgccagtcgccatgccacagcaggccctgctcccccgcctggccgacgggctccagccccagcacctgccccagctgcgcgttgttgcccagcgacaggtgcccatcaagcggcaggtggtaggccagcaggctgatgtcgtgctgcagcagggtgcggatgcgctgcttcttcatgccgcaaacgcgcgcgtcctcgcctttccagaaatagccgtggtgcaccaggatcgcgtcggcgccgcgcgccgccgccgcatcgatcaatgcctgcgacgccgtcacgccggtcacgaccttggccacttccgccctgccctccacctgcaagccattgggcgcgtaatccttgtaacgccacggctccagccagccgtccagcagactctgcatttcgctcaacaacatcgcgctctcctttcaatatctaccatttcgcctattttgccagatgcatgcctatttcccgccgaaaaacaaaaaaccccgctcaaggcggggtttcgtttttcagcaggaaaagccgagcttacatcatgccgcccatgccacccatgccgcccatgtccggcatgccgccggcagccggcttgtcttccggcagttcggcgatcatgcagtcggtggtcagcatcaggccggctacggaagccgcatgctgcagagcggagcgggtcaccttggccgggtccagcacgcccatttccagcatgtcgccgtattcgccggtggcggcgttgtaaccgaagttgcccttgccttccagcaccttgttgaccacgaccgacggctcgtcgccggcgttcttgacgatctggcgcagcggagcctcgatggcgcgcagcacgatcttcacgccggcttcctgttcggcgttgtcggtcttcaggctgtccagcgtagcgcgggcgcgcagcagagccacgccgccgccggctaccacgccttcttcaaccgcggcgcgggtggcgtgcagcgcgtcttcgacgcgagccttcttctctttcatttccacttcggtggcggcgccaaccttgatcacggcaacgccgccagccagcttggccacgcgctcttgcagcttttcgcggtcgtaatcggaagaagcttcttcgatctggcggcggatttcaccgacgcgggtctggatggcggcagcttcgccggcgccgtcgatgatgatggtgttttccttgcccacttcgatgcgcttggcttggcccagcatgtccagcgtggctttttccagagtcaggcccagctcttcggcgatgacggtgccgccggtcagcacggcgatatcctgcagcatggccttgcggcggtcgccgaagcccggagccttgacggcaaccactttcaggatgccgcggatggtgttgaccaccagggtggccagcgcttcgccttcgacgtcttcagcgatgatcagcagcgggcggcccgacttggccacttgctccagcaccggcagcagatcgcggatgttggagatcttcttgtcgaaaagcagcacgaacggattgtccagagcggcaatctgtttgtcttggttgttgatgaagtacggggacaggtagccgcggtcgaactgcatgccttccaccacgtccagctcgttgttcaggctcttgccgtcttcaacggtgatcacgccttccttgccgaccttgtccatcgcgttggcgatgatttcgccgatgtcgctgtcggagttggcggaaatggagccgacctgggcgatttccttggaggtggagcagggcttggcgatcttggcgatttcgccgaccagcgataccacagccttgtcgatgccgcgtttcagatccatcgggttcatgccggcggcaacgtacttcatgccttcctgcacgatggcttgcgccagcacggtggcggtggtggtgccgtcgccggccacgtcggaagtcttggaagccacttccttaaccatttgcgcgcccatgttctcgaacttgtccttcagttcgatttccttggcgacggatacgccgtccttggtgatagtcggcgcgccgaacgagcggtccagcaccacgttgcggcctttcgggcccagggtaaccttgacggcgtcggccaggatgttgacgccagcaaccattttgctacgcgcggaatcaccgaattttacgtctttagcagccattctctaactctccagaactcagtatatgaagtgggggtaagggtcggatttactcaacgatgcccattacgtcttcctcgcgcatcacgaggacttcgtcgccgtcgaccttgacggtctgaccggaatacttgccaaaaatcactttgtcgccaactttcagatccagcgaacgacgctcgccgttctccaggatcttgccgttgccgacagcgagaacctcgcccatgtccggcttctctgcagcggcgcccggcagaacgatgccggaagcggtcttttcttcagcctcgaggcgcttgataacaacacggtcgtgcaggggacggattgccattagatctctcctaatacagtggctgtttgagagttgaaaaccagaaatattcaagtgtgcggataggtggattagcactcaccgcttgcgagtgctaataatagggacgacagggaggcttttcaagaggggacaagcccctctcgcaaggcaaagtcaacgggagggagccgagcggcgcaacaccagccagcgcggcgtgcgaaagcggatgatcatccggtacaccatcacgtatgccacggcgaacagcaggcagaaccccatcagcacataggtgtgacgccagaacaacatcgccggcgccaccgaagccgatgacagcgcccataagtagggagaagtcagactgttgcgcaaggtgaggtggccggcatccttcgaacccaccatccagcgcaccaaccgcttgtacaccagcatgtgcagatgcaggccgtcgggcaggccaggcgacatgccgcgcagaatcttcttgcggtagatcgaatacagggtttcgaacaccggatagatcacgcacagcaagggaaaccaaggcgacacctgcggatgccgcgtcaccagcagcaccgccacttcggcgatcatgaaaccgaccagataggcgccgccgtcgccggcaaaaatcagcccgcgcgggaagttccaaaacaggaaaccggcgatggcgccgatcatcgcaaaacaaacccccagcagcatcgtatcctgcactttgaaagcgacataggccatcgccaggaaaatgaagacggcgaccacaccggataggccgttgtagccatctatgatgttgaccgcgtgcgccacgccgcctacggctatcaccgtcaagacgaaggaaaacagggtgaaattgaccagaaggctgtcaatcaccgggatgtccagccgatggagcccagcctgcaacgaaaaatagccaagtcccgccgacacaaaagtggcgagcagacgcggcagcggtcccacttgcttggtcatgtcctccatcagtccagccgcgaacgccggtacggacaccaacaacagcaacagcgccgtggcatccgacagcgaccaggacagcacaccgcatccggccaacaagcccgccgccaggggaacccctcccaccctgggaaccggcatcgcatggaatttttgcactcctccaagatcgtgatcagacgtgaagcgctcatgcaaatggctgaagtggatcaggaacatcgccatgaacagagacaggaaagttgaaattatcaagatctgcagcataatcctcgccaactgtttgattgagaacgccagaccggaagtctcctcgccggagccgccgggggccgaacacccaaacacattgccaagccatgctcttggcaatgaccagttacatcgatacttaaactgccacgccaaccactgcctcaggccatctcaaagcaatcgcaagatgccccgcccccccgctccgcatgcgtcacgcggaacgcccagccgcgtcgcagccaagccaaactgatgagaaaaaaacatacagaatccaagcgctgcgcccacagccgcagatgccggcagcttgcggcctagacgctgcgccccattccgccgtcaaaccatcggcatctggctcgacgccaggccaaagccaatctcgtgccatttacaaaatatcatgcgaaaagcgtccacgcccatagaattaaaatcacaaaaaataatgtcggagaaatcaccattcactataaatatatcaaccttccgtcaattctttgtgtgattttttattcaacgacacggcaccgtcacattaatttcatatctctacggctccggccgaaacatgtcaaacactgccatagctcgcgaaacagggcaacattgttgcggaccttgcgcgaccgcaatgccaaatagacatagcaaaacccgacatgtcttgccgcaatcccccgcatcccccgccctttaggtcacaaaacttgtcccaaatatatcgatgcggaaaaccggcaacgcttggtccagcaccgccgcccggcatcgtaacgcaagccccatatcgcccttgcgctttctcgccgactcgatttattctaatcccgcttcgccggtcttcacgagcggattcaagcggacagccaagctccacgacagaagccatcagcaaggcctaatatttaacgatgttgcactcgcctcgcgccgttcactatctgggcatgagagcgatgcgattcttaaagaagagcccaaaaaattcagcttgccggcacgtcgaaaagcagaatgcgattcgccatgtcgttaaataaaaacactggacaggatagctgactttcgcatcaaagtcgtaaatggcacccacctccgactttgtttcaaatggaaagattaacaacccggaacaagatggagaatcggaatagtcagttgcgatcagttgatattaagaaacatcggccaaatgagcgacaatcaacattaacaatcacggtttgcaaagcggcggtgttttgggtcaagctgcgataaaattcgagatacgcgccccaggcagtccagcaaggcctttttttgaaatgtagccgtaacgttcggctgacagacaacgcaataggtactatagattgaagtaagtcgcggcgcttgccggcgcagcgcagcatgaccctacacttgaaagtctcgacagcgaaagcgatatccgcccacctcagaactgcggcacagcagtcccggcaaggtcggcgcagtacgatacggtttaccagttgcaaatataacgggtcatcccgactacccgttgcccggagaggcaacgaacccaatgcctgatttcttgaatagtacaggggggatttgcaaaaaatgccagtcggtcagcaccacgcgtcgaaaaaactctcgaaactctcagccgcatccgctctgtcgcggcatgggctagctccccttttccactcggcttcgcaaagcctgcctgccgctcggccgcatcttcgccccagtagcgcaggatctgccggtccgcgcgccaaaaaccgtcggccgcagcccgcctgcaccggcgccatcgcggctgcccagcattcagccggctgcttgagcgcccgaccttcttcttcgcgccagcaagactaaagcgcaggccatgtgccgcctcaatcactccgtctcttggacgcttgccaaagaggaaatattgaaatgaaagccgtcattcttgcaggtggattgggtacccgtatcagtgaagaaaccaccgctcggcccaagccgatggtggaaatcggcggcaagcccattctgtggcacatcatgaaaatctattcccactacgggataaacgatttcatcatttgctgcggctatcggggctacgtgatcaaggagtacttcgccaactacttcctgcatatgtccgatgtcaccatcgacatgtcgagcaatcacatggaagtgcatcaacgctacgccgaaccatggcgcgtcaccctggtcgacaccggcgaacacaccatgaccggcggccgcctgaaacgtgtgaggaaatacctgcagggcgaggacgcgttctgtttcacttatggcgatggcgtagctgacatccacatcggccaactcatcgacttccacaaaacctatggcgcagcagccacgctgaccgccgtctatccgcccgcccgtttcggcgtgctggacatcaaggacaacctggtgtcgaacttccaggaaaaaccccagggcgatggcggcatgatcaacggcggctttttcgtattgtcgccgtcggtcatcgacctgatcccagacgatggctgcgtatgggagcgggagcctctggaaacgctggcccagcgcggccagctggccgccttctcccatgaaggcttctggcaaccgatggacacgctgcgcgacaagcttcacttggaaaacctgtggaaatccggccaggcgccatggaaagtatgggaatgaaccgcgacttctggaaggggaagcgggtctttctcacgggtcataccggcttcaagggcagttggctcacgctgtggctgcaagcgctcggcgccgaggtgtccggctatgcgcgcgaaccggcgaccgagcccagcctgttttccgccgccggcctcgcgcaaaccatgcactcctcgttcatcggcgacattcgcgaccccgaccgcctgcgcgccgcgcttgaccgcgctcgtccggatatcgtcttccacctggcggcgcaggcgatcgtgcgccgctcgtatgccgatccggtggaaacctatgccgcgaacgtgatgggcaccgtccacctgctcgaagccgtgcgggccacgccgacagtacgcgccgtggtgtgcgtcaccagcgataaatgctacgaaaaccgagagtggccatggggctatcgcgagaacgaggccatgggcggctacgatccatacagcagcagcaaaggctgcgccgagttggtcgccggcgcctaccgcaattcctttttcaatccggccgaccacgagcggcacggcgtggcgctggccaccgctcgggctggcaatgtcatcggcggcggcgattgggcgcaagaccggctgattcccgatttcatccgcgccatggccgccggcgaagcgctggcgatccgcaatccgaacgccattcgtccctggcagcatgtgcttgagccattggccggttaccttctgctggcggaaaaactgcatcaatccggcccaagcttctcttccgcctggaatttcggcccgcatgagcaagacgcgcgtccggtcgaatggatagccgcgcagctgacccagctgtgggggcaaggcagccgttaccaggtgcagcgcgaggccggagccgcgcatgaggcccactacctgaagctggattgctccaaggccaatcaagaactgggctggcgaccgcgctggtcgctgcgggaggccttgcagcgcatctgcgactggcacctgcagcaccgggcaggcgccgacatgcgcgcggtatgcctgcagcagatacgcgcttatcaagaaaccgtcatagccgaataacacgatccttccgcgcggacagttggcgcgcggagtttcaccgaatctggatgcgatatggaaaagactcaacagcttcgtcagcaaattgcccaactggtggccgaatacgcggaaatcgcgctcgcccccaagcccttcgagcccggcaagaccgtgattccgccgtccggcaaggtgatagacggcgccgagctgcagcacatggtcgaggcgtcgctggacggctggctgaccactggccgcttcaacacccaattcgaaaaacaactggcggaattcctgggcgtcaaacacctgctgaccaccaactccggctcctccgccaacctgctggcctttaccgcgctgacctccccgcagctgggcgagcgcgccatccgcaaaggcgatgaagtgataggcgtggccgccggcttccccaccaccgtcaaccccatcatccagttcggcgcagtgccggttctgatcgatgtagacatccccacctacaacatcgacgcggcgcgcatcgagtcggcgatcaccgacaaaaccaaggcgattatgctggcccacaccctgggcaacccatacaacctgcgagtggtgcgcgacatctgcaaccgccacggactatggctgatcgaggactgctgcgacgcgctgggctccacctacgacggccaactggtcggcaccttcggcgatatcggcacgctcagcttctatccggcgcatcacatcaccatgggcgaaggcggcgcggtcttcaccaacagcgaccaattgaagaaaatcgtggagtccttccgcgactggggccgcgactgctactgcgcgcccggctgcgacaacacctgcggcaagcgtttcaactggcagctcggctcgctgccgcacggctacgaccacaaatacacttacagccacctgggctacaacctgaagatcaccgacatgcaggccgcctgcgcgttggcgcagcttggcaagctcgaacagttcatcgccgcgcggcgcagcaacttcggctacctcagcgagcggctgaagacctgtgaggaattcctgatcctgcccaaggcgaccgagcgcgccaacccgtcgtggttcggcttcccgatcaccatccgccccggcagcggcatcgaacgggtggacgtgctgaagtacctggacgaacacaaggtcggcacccggctgctgttcgccggcaacctgacccgccagccctatatgcacgggcagaatttccgcgtgcacggcgaactcgtcaataccgacctgatcatgaacaacaccttctggatcggcgtgcacccaggcctgacccgcgacatgctcgactacgccgtcgagaagatcgaaaccatcattggcgtgaatttttaaggagcaggcaatggaaaagaccagactctctgtctacaccgcggcggtcagcgaaaacttctccttcctgaagcgggctgccaccattcaggaagcctacctgcgcgcgattccgatcgccggcggcggctacctgctgccggtatgcgaaatgcacaagcaggatgccgccctgatccggctcttgaccgaatggcgcaaccgcaatgtccaggcctatccgacccaattcatcgccactgagcaaagcacccgcgactggctggagcagcagctgctggccgtcaacgaccggatgctgttcctggtggtgagcgccaccggcgcgacgctgggccacctgggcttcacccgctgccataattccgacatgatgttcgagatcgacaatatggtgcgcggcgccgccgacgccgaagcgggcctgttctcccgcgcgctggccgcgttgatcgaatgggccaggaaaaccatcaacgtcaacggctttttcctgcgcgtgctggacgacaatcccgacgcgatcgccttctacaagaaaaaccatttcacggtcgaatccaatattccgctggtggcggtgaaaaacggcgacagcctccagtaccgcgaggcgctgccgacggaaaccgccagcaaacaattcgtccgcatggcgtacaaagccccgtcgcaaggggtgggcgagaagatgatcctcaccgcgggtccgtcgatctccgccaaggaggccgcctattcgttcgatgccgcgctcaacggctggaacagcgattggtcgaaatatctgactcgcttcgagaaaagcttcgccgaatatgtcggcgtcaaatacgcgctggccacctccagctgcaccggcgcgctgcagatcgcgctgatggcgttggacatcggccccggcgacgaagtgatcgtaccggaccagacctgggtcgccaccgccaacgccgtccgttataccggcgccatcccggtgttcgccgacatcgagctggacacctggaacatcgacgcccgttcggtggagtcgctgatcaccagcaagaccaaggccattgtcgccgtccacatgtatggccacccggcccgcatgagcgccatcctggcggtggcggagaaatacggcctgaaggtggtggaagacgccgcccccgcgatcggcgccgaatggcagggcaagcgttgcggcagcttcggctccttcgccgccttcagcttccaaggcgccaagctgatggtcaccggcgaaggcggcatgctggtcaccgatgacgacgcgctgtacgccaaggcttacaaggtttgggaccaagggcgcaacccgtcgcgcaccttctggatcgacgaggacggcgtcaagttcaagatgtccaatatccaggccgcgctcggcctgggccagctggagcgcgtcgacgaactgatcgagatgaagcgccgcattttcgagtggtaccaggaaggcctggaaggcgtgcctcatctcagcctcaaccgcgaagtggaaggcgcccgcagcatctactggatgagcagcatcctgctggacaaggacgcccgcatcagccgcgatcaattgatgcagcaattgaagtccagaaacgtcgacacccggccggtctttcccgccatcagccagtatccgatctggcccaggcagcagcaaccgcaacccaacgcgatgcatgtcggcctgcaggcgatcaatctgccaagcggcgtctgcttgagccgcgacgaagtggcttacgcctgcaagcagatcagaagcattctgctggggtaagccgaatggaaaactcgatcacgctggcgcgcgccatccgcgccaccgccctgcaaatggtgcatgacgcgcgggcttcgcacatcggcagcgcgctgtcgatcgccgacatcctggcggtgctgtatcgcaatcatctgcgcttcgaccccgccgcgactcgggatccgctgcgcgaccgcttcattctcagcaaggggcacgcctgcgtcgcgctctacgccgcgttgggcgcgctgggcgcgctgagtccggaggagattgccagctacggccaggatttctcgccgctgatgaaccatatcagccacaaggtgaatggggtcgagttttccaccggttcgctcggccatggcctgccgttcgccgccggcaaggccatggccgccaagctgcgaggacagccttggaaaaactacgtgctgcttggcgacggcgaaatggacgaaggcagcaactgggaggcgctgatgttcgccgcccaccaccgcctggacaatctggtggccatcatcgactgcaacaatctgcaaagcttggacaccgtgcgcgcgacattgaatatcgagccgctggaccaaaagctggccgccttcggctgccgcgtattcgaggccgacggccacgaccaccaggcgctggaccaggccttgcttgccatcgccgaggtccgcggccaaccgtcggtattgatcgcgcgcaccgtcaagggaaaaggcgtcagcttcatggaaaacagcgtggactggcactaccgcagcccggacaaacagcagctgcggcaggcattggaagaactgggagtccagcatgcgtaacgctttcatcgatgaactggtcaaactcgccgccgtccaccccgacatcgtgctgatggtaggcgacctgggatacggagtagtcgaaccgttcgccgagcggtttcccgaccgtttcatcaacgccggcatcgccgaacagaacatgatgggcatggcggcaggcatggcgtccgagggctgccacgtcttcacctacagcatcgccaacttcccgactttccgttgcgcggaacagatacgcaacgatgtcgactatcacaatttggcggtgaccgtggtcagcgtcggcggcggcctggcctacggcaacctcggctactcccatcatgcggtgcaggattacggcctgatgcggatgatgccgaacatgactatcgccgcccccggcgacccgatggaagtccgcgcctgcctgcgttacctggccagccaccccggcccgtcctacctgcgcctaggcaaggccggcgaaccctgcctgcacccgcaggtgccggatgtcgtccccggccaatggctgcccatcagacaacgcgacagcgccgccgccctgctcaccaccggagccgccgtcagcagcgccatcgaatggctggacacgcctgatttcgccgcccattcgctatacacgatgccgctgtggagcatggccgccaaacaaaagcagccgcagcagctgtccgactgggatctggtcgtcaccgtcgaagaccatatccacgacgccggcttcggcagctggctgatggaggcagccgcgccggccggcatgagcggcaagatacgcaaccgcgcgctgtcgactgagatattcggcaaggtcggcagccaaaaaaccctcaacaagctgggtgggctgtagtgatactggcactgaagaagacgctggggctggacagggcgatactgtatgtattgctcaaccgcggctggaccctgctggccggcttcgtcacgctctatctgatctccgccaccatgagcaaggcggaacagggctactactacaccttctccagcattctggcgctgcagatctttttcgagctgggcttcagcggcatcatcgcccaattcgccagccacgagatggccaagctccactggcgcggcggcgacatcgtcggcgactcccagtcccgccagcgcctgctgtcgctattccggctggcgatcaaatggtatggcgtgatttcgctgctcaccgttttcctgctcaataccgcgggcttctatttcttcagcagctccgccaggcagtccggcgtcgactggcaccttccctggatgctgctgacgctgggcgcgaccttgaacctgtttctcagcccgctgctggcgctgttcgaaggcagcggcctggtcgccaatgtcagcgcgctgcgcctgatgcaatcgatggtcgcctacagcagcggctggctgttgctgctcaatgacggcaagctgtataccgcggcggccatttccatcatgaccgccgccgtcgggttttactggctgggcaagcattacggcgcctttctcaaatccttgctgcaaaacctgcctggcaaagacgatgccggcatttgctggcggcgcgaaatctggccgatgcaatggcggatcgcgttgagctggctaagcggctacttcatctcccagttgttcacgccgctggccttccgctaccagggcaccgaagccgccggccagctcggcatgtcgctcagcatcgtcaccactatgtccaccgtcgccagcgcctggctaaccaccaagctgccaagcttcggcatgctgattgccggccgccaagccgctcaattgatggcgctgttccgcaagagcagcttgcagtccatcgctgtgctgctggcccaacacagcctgtttttcatcctgctgctggccatgcgccattaccagttcgccttcgccagccgcctgctggagcctatcgacatcttgtggctgctgctcgccgcccaagcctgccacatcgtgtttttgcaggccgcctatatccgcgcccacaagatcgagccctatcttaagcatgcgattctgttggcgctgctgatttccagttccagctattatttgattcagcattactcgatccgggaaatgctcgccctctacgccatcatttgcgggacggtaggcgttggatattccagctatatctatgcaagcttcaataaaagaaaaatggcggggcaatgaaatgaaccaagcgttattatcgatatgcatccccacgttcaaccgggcatcctatttgaaaaggttgctggacgatctattgccggcaattgcgcgccatcatcaactcatcaacattttcatcatcgacaacgcctccaccgatcagacggcggcgttgtgcgatagctatatccaagccggccatgccttgaactacgtccgcaatgaaagcaatatcggcgcggatgccaatgcggttcgagcattcgaatgtgtaaacgggatatatggctggatactaggcgacgatgaatatgtctatggccaaaccgtcgacaccatcatcgccaccttgaccaaacagcctctggccttgctgtatctgaaaagcgagccctgcaccgccagcgccatcgcgcaaaaaaaaccgcgcagccaagccctgtcctattacatgtccaatgtggaattttcccgcaagatagggatttacttcacattcatctcggcaatcatattcaacaagcagcaagccatgcaggatgacgcgctttgcgcgaatatccgctatggcaccttcattccccagctggcctgggtgctgcctttgttgaaacagggcaagcatttcgccagcagccaggcctgcctgatcgcggccgaacccaacaacaccaccggctacaagctgttcgaggttttcggcatcaacctgcgcgccttggtggacgcgtttctgccggaccaaccccggctgagaaaagccatcctcagttcgtcgatgtggtttctggcaagctttttttatggcaaccgcggcaacttcaagcaggaaaacccaaaaccggcattcgaccaggcctttggagaattgcgcgtctaccgtttgatcgtccgccccttgctgacctaccagaacctcatgtccaagctatgcgtaaaaacgatctgccgttttagaaaaaacatactgcagcaagcatgacggccacgcgcaaccgaccagcaggatgcatatcgccatgaagatactggtcatcaaactatcggcgttgggagatatcctcgccaccagccccttgtttcggctgatcaaggaggccaatcccggatgcgaaatccatcatctggtgatgcggcaatgcgcggccgcatccgaaagcaacccgcatatcgaccggcagatcgtcatcgatctgatcccgtccggcaatcgcctgaaggacgcccgaatcctgctgcggctatggtggcggctgctgaccggcggctacgacatcgccgtcatcctgcatcgcaacgctctgttccaactgttatgcaaagcggcgggcatcggcaaactggtgggcttcaccgcgccgcggctcgatctgctgcaacatgggcaggcgttcacgatgcagggcaaccgcacgctgcaagaagcccgcctgctgcagcgcgccggcctgatcgacaaaatgcccgatcgtctggagtttcatctggcccccggcaaagtggatcgggaaaagcttgccggcctgccgcgcgactacatcgcgatcaacccgggcggcggcaatccccatgcgccggccgacaacaagatctggccggccgacaactatatccggctgatacaggcgctggacctgccggtcgtattgctgggcagcggcggcaaggaccaggaaatctgcgcgtccatcgcccgcgcctgcggcacgcgcgccgtcaatctggtcaatcggctgaacctgcacgaagcggcgcaagccattcgccaatcgcggctctacataggcaatgacagcgccttgctgtacatcgccgccgcgctgaatgtgccgctgatcggcctgtacgggccgaccccggctgatgcttttctcccgctgggcggaccattgcatcatctcagcggcaaaaccgagtgctccccatgctacagctcgctggagggcgcgcgctcgcctatgtattcatgtgtgaacaatatttgcatgcaaggcatttccaccgaacaagtcctggccaaaaccagacagctcctgacccttggaaagcaggcctgacatgaaattacagacgctgaaattcctggacaagctgctatccaccacaatcgcctggctgccgcgccgccgcaagccatcgactcaagctcctcgccggatattgctgatcaaactatccgcgatgggcgacgcgttctgcctgcaccccgtcgcccgcaggctggccgcggcctttcccgccgccagcatcgactggctgacgaccggccgctccaatcctggcctattccggaatttgccgtttctgcacgacacgctgattgttcccacccaggtccgcgccttgctggcatggctgcccaggctgctcttcgcgatacgcaagtacgacatcgtgatggacttcgatcagtactaccatttatccgaactgctctcccgctgcggcaaaaccagcgcgggcttcagcaccgcgctgaaagggaaaacgttttccctctccatcccctatgatccgcagctcaatgaaaaagtcctgttccacaagcttgccgagcgcgtgatggagcattatggcgtgacccacgcgcctccccgcgacttttatctacccgaattgctggatgcgttcactccttcattgccgttgcagcaattggcagcggagatcaagacacaccaattgccggtggtggttctctacgccggctccagcgccaacgccgcattccggcgcctggacatagacaaatatctggccatcatcgagcagacccgcaaccgccataccttcgtgatcgccggcggaccggatgaactggcgctgaaaacgcatttccagcttcagcacccaaacgtgtacgaactgataggcagcttgaacctgctggagtgggcctggctgttccgccatgtcgccgacctgctgctgggcaacgacggcggcctgctgcacgtcgcggaaagccagtccacgccgatgctggccatcttcggccccagcctgttccgcaaatggggatcgatcaacccggaatcgcgcggcatcgaaaccgatctgccgtgcaggccatgtctgaaaaactatctcggcatcgttccgacccgctgccagttttccacggtcaaatgcctggacgccatcgaggtggccaccatcattgccaatatggaaagcatgctggaaaagaaacagcgccaacacatgctgatcagtccctgacgacatgaaaagaatctatctgcccttatcccgctttctcaggcgcgctctgcccaggctgcggccatgctggttccattgcctgaccgggctgcgcttttttcggatgggccggatgaacaaggtttacggcgttgaaaacatccacttgggcagcagggtatcgataggcgacttctgctggctggaggccgtcgagcgctatggcggccagcaattcgcgccccggctggaattgcgcgccgggaccagcttgtccgacgccgtccacatcagcgcggttgcccgcatcgtcatcggcgagaattgcctgctcggcagccgcatctacatcggcgaccattcgcatggcaccggccggctggacaccgcatcgctgcagaccccgccggggcagcgcccgctagccaacatcgccgaaatcgacatcggcgccaactgctggatctgcgacggcgccgtcatcctggccggcagccgcattcatccgggctccatcgtcgccgccaacgccgtcgtccgcttgcagaccgacgaagccgcgttgatcgccggcaacccggccaaagtcatacactatttcaggtaagcataatgaatacaataaccgtcgccgtgcccgcctattcgcgccccgatgagctgggccaactgatcgattcggtcctgtccgccgatgtcctgcccgatgaattgctgatctgcgaagacaagtcgcctcgccgcgcggagatccgagccgtgattgaaagcatgcgcccgcgcttcgccgccggcgcctgcgcgctgacttacatcgaaaacgaggaaaacctcggctatgacggcaatatccgcaagatcatcacctcgtccgcttcggactacgtgctgatcctgggcgacgacgacgtcctgttcaaggaagccatccccaaaatacgcgcgttcgtgcagcagcatccgcaagcgaatttcatctcccgcaccttcagccgcttcgccgaacaaccgcaaaacatcatcaacaccacctggatacgcacgagcgattgcgtcatcaaacgcgacgacgccgatccgaacatcatcttccgcctatgcggcttcgtcggggggctggtgatcaatcgccgctgggcatcgcagctggcgacagaggaatacgacggctacctgtactaccagttctatcttgcctgcctcgcctacctgggcgatggcataggctatatctcggccgccatcgtcggcggccgcgccggcaatccgcctctgttcggctcggccgacagcgaaaaggacacccatattcccgggtcgtaccgccccaaaggccgcgccaaaatgtggcagggactgctggccatcgcggcggacatcgacaaggcccatggttcgaacatttatccctacatccgcaacgagctagccggcaggcaggcctaccacatattcgaaatgatgccggcgcaaggccgcgcggccaccctggacctgtttcacgagctccggagactgaagctgacccacaaggcgatgccgtggcttctaaccagctacattctggttttcggtccctacgcccgcatcggcttcgcccttagcagacgcctgcaattcgctatcgagcagcatgccggcctaaagctgtaaagccccgcgaccatcacgatcaggatctctgcaaatgagaaaaatcgcgttgttctacttctacttcgtcagcctgtactggtatccggtcaccgtcatgcaatggggcagctatggcgcagtggaagagagcactcccatatggttcaagctcctgcgcgtgatcctggtcgcgctgctgctgctattgctggccgcgcggccaagcatcagcaagaaaatcgcctttccgctgcttttcgcgctgtactgcatcttttccgcgccggatatcgtcacgatcaccaatgccatcaccttcatcgtctgcatcgccatctgcctgaaaatcgatatccgcgccgtcaattggagacgccatatcggcatagccagcggcatcggctacctgaccgctctgctcgagatattggggattgtcgtttcgcctcactcctacgacggcaccttgcgcatcgtcgcgactttcggcggacccaataacgccgcgatcatcttatccggttttgcgctgtaccatttcatgcagctgcggaaaacccgcagcatcgccgatttactccacttcctggcctgctcggtgctggtgctgctcaccgggtcactgagcgcactgatcgctttcctgctttgcatgatttcgctgtcgccgcgactgttgctattggtgccgcccgccgcgatcgccgcgaacttcatcagcgacttcatctcgttcaaagtcgagcagttcgccaatctattcagcaataactcgcaaaccatcggcaccttcagcgaccgcctcgaaaacatccagctgatatggcgctctttcaatgcatcgcttggcaatgcgctgttcggcaccacgctgacttcggaaagcgactatttgaatattatttcgcaacacggtttatttggattggctctttttctgctagccatcctggcactgggtatcgatatctttttggcgctgggactattgcagggcatcttcacccccttcttgtttccatttcctagttttgccattctgtttctactcagcaaaatataccaaactgaaaaggaagcgaaacctacgcttattgctaaaaaatctgagcaaaacagttccgttcagcccatataaatacaaatttatcaaagatttatttttgattacagcggcatacatttcccaaccagccatgaggttgaatcatgaaaaacaatttcaagattgccctatttgcaaaccatgctcctggattgcatattgctcaatatctctccagttgcgcggcaacggattctgtaagcgcgctttacatcagcgatgaacaaaaagaaaatgaccaagcgataataaactctttaaatgtgccaagagatcgaatattccgaggaaaagacatagtaaaagatccagaccacatacaatggttccgagaacaagactttgacgcgatcataactgtctattggccatggctgctgaacaaagaaatatttagtgcatcaccaatcactgtaaattttcacccggcactactgccaatcaatcgcggctggttccctcacgttcatagcctgatagatggcagcaaaactggggttacattgcataaaattgaggatggcgccgacaccggtgcaatctgggcgcaaaaagaaatcccgattcaagcgctggataccgcaaaagatatctatgataaattgcagtttgaaattgttgatttgtttaaggaaaaatggccagacatcaagaatgggagaattactcccttgatacaagatgaatcaaaagcagtctaccatgcaaaaaaagagattgaacaactagactttattgaacttgaaaaggaatacagtgctcgcgagttgattaataagctaagagccagaacattcggaaatcgaggctttgcatattatgaagaaaatggcgaaaaagtttatatcaagatttcgctatcgcgtactagtaaattttagcagcgcttacagaactgagacccttgcactcccctgcaagggacctcagttttgtcaaacaggctctaagggatcgctgcttagcgatcaccccatgcacggtcgccagcaccgctacggttcatgtttatgcacgcaaggcggcaactcagatgctatagcctctcagtctgccgtcatcaggctcaactcgccgcaaaccgacgtgcaacagcaaaaccatcgcgccgaactgatcaccccgctttcgcgacgctagcgcccgctagcatgatcgccagaccttgccgattgcgttttatcgcagcgctacgactcgccccggcgaccatcaaccagagcaccctgcattgcagccgaatgccctgcccgcttggcactccgcgaacaggccctccctgtcggcgcagcgctcttccatcctgcagctcgccgcacgacagcggtccatcctgagcatctgcagcgcaacaccacgcaagtgcaagctaagttcattcctgactgataacaacagtcaaccatcatgctcaccgcccgttacatatccacgtaccgcgcaggctacacgcctctacgcctgggctcgccaagtgcgggaaccagcttcccgcaacgcctgcccaagcgatgccgtccagcggatgccggactgaacggtttagcgcagcgatgtcgcgccgaaccttaagcattgcagtggtactgtgcagcccatttgtcacgaacagcatcaagttgaccatgtcaagttgggcaacaccgccacattccggtactatcacgctagccgattgcagtacccctatttgatcgaaatggccatttaatcgatcctagtaatttgacaaaaaatacaatcccatagtcattttttgatattttccgacaggatagaccaacaataaatgaataaaaaaattatttatttcgtcacagttgattggtttttttgttcacattttcttgctagagcagtcgccgcaaaagcacaagggtatgaagtctatgtactgaccaatattgacaaacataaagacaaaatattggctgcaggattaaatattattgatataaagactgatagaaagactttaaatccattttcgtggctacaaaccttattaaaagtttaccaagtctatcgcactgtaaaaccagacatcgttcatcacatagcgctgaaaccaattttactaggcagcttggctgccagaatgtccagtactagaaatgtaatcaacgccattgtaggcggtggctatgcattcatctcaaatgatatatcgatgagaatgctccgccccattattcgttttacattgggcaagttgcttaatcccgctggcagtaaagtagtatttgaaaataccgatgatttagatacgtttacaaaatctggtcaagtgcgtagagactgtgccgtcttgattcgtggtgcaggtgtggatccaaatcttttccataccaaccgaacaaagccctctaagcctatcgttcttcttaccgctaggcttctctgggataaaggcattggagagtttgttgaagctgcccgcttgctgcgacagcgcaacatcaacgcgcgctttgtcatcgttggcggccaagatccaggaaatcgtgcatctatcgaccaagagactttatcaagctggcaccaggaaggagccgtagaactttggggatttagcgaagacattccgaatattctggctcaatccagcatcatgtgcctgccgtcctatcgagaaggcttaccaaaatctttaatagaagcaatggcagcaaagttgccatgcgtaacaacggatgtgccgggatgtcgtgaagctgtcaggcataatgacaatggtcttttggttcctccaaaaaatattgccgctttagcaaaggccattgaaaccttgctgctaaaccatgaattaagccataaaatggggctacgtggatacgaacggctagtaactgaattttcttcggaaatagttatcaaagacaccatatgtctatataaagaattgctagaactatgaaagcgctaattacaggagccgatggtttcgttggccgtcaccttgtccaaaatctcttgcatataaataacgaagtcattcccacctccagaaacgggaacaatggctgcatcgcaacaggagatctatctgaagactataactggtatcagatattggctgattgcgacgtcgttatccatcttgctgcacgagtgcatcaaatgcacgataccgcacctgatcctcttagtgaatttagacgcgtcaacactagcggaacccttcatcttgcgaagcaagcgatttctgcgggtgttaaacggtttgtatttattagcacgatcaaggtgaatggcgaggaaagtgccataccttattccgaaaatagccctccacagccatcagacccttatgctttatccaaatgggaagcggaacagggcctgcttcaacttgccaaagacagcacgatggagattgttatcatccggccgccactagtttacggccccggcgtaaagggtaatttttcttcactgatccaaatagtaaaatatggaatcccgctgccatttaaatccatcaaaaacctccgctctctcatcggcttatcgaatttagtcgattttattatattgtgcgctgatagaaatcgctcgcccaaagccgccggccaagtttttttaatttctgacggctcggacatttcaactcctgagttgataaaaaaggtatccgccgcatgtcagctaaaaccaaggttgatttgctttcctccatgcctattaaggctcgtagcggtatttatgggaagaaaatcagctgcagatcgcctcctcgggtcattgcaagtagatattacgaaagctagatctatgctgggctggcagcctatagcgacaatggatcagcagcttcaccagatcacaaatcaaataaaaaaataaactgtagcgaatttatatcaatacagaaattgcaccttactttcaattaacgcacacattgcacatggaaatcaataaatgggcgtttttttgtatagtactggccataagctctacaaacaaagcattttttatgctaacaaatggatagctccgctatttcgtgacgataaaattttccgccgcaactgcatatatcttgctcttgcattattcacgtggtgtttactactaagtccgttccaatcgtcaaaagaagctataattagcgcgtcgcgattgcttgttgaaacctcgctagtttttgcgttgattaaatttcagccacaaaatacgccaagatggtgctttaaattcataatctggcttggcactatcaatggtatcattgttgttttccagataatggaaggcctaaactatctggatatcggcttcagcaagattattacggatgtttggaaactcccagtaaacgaatatagccggaagccagggctatttagtggatttcaatcatcatcgtatatctcattcatggcaattgtactgttaattcagtatgaaaaaagcaagactggaatatttggagccataaattttttcacaattttttttggcgcaaggacttttcttgttttcctaccagcgtttgcattaataaatagaagaattttagcttattttgtattcattaacatagcgctgttaggtacgacaaacattttagacagccatgcttatgtgaaaatgatggtatcccatttaaaaaccagagttttcccggcaatggatgctgtatacactctgcgccccggtataagcgagagcgcaagtgacacatttacccaataccaaataacccctcaggacataaacaaaaaatctgaggctgtagagaatacaatagcagccgggaataaatttccttataaacagctgctacttggaaatggtatgccgaggtattctaaagaaggaggcctagacactatgctaagtagatggctaaagcaatcaggtgctccagcagctattttagttagcttactaacactattaatttgtctaaaaattggcagtaaaaaaggactcgtgaataaggtgttgatgcttgcgttattgctatccagcgtcaaaggagaactagtcactgccacgcttattttcagttcgcttcttatttactcgctaactgactttgatttacaaaaaaactattaagctcataaaaagtcgagggcaccatcatgatcccaaagatcattcatcatatctggcttggcgataatgatttaccagctcagtttaaaaaatttatcgatgatgcgcgtgaactattgcccgattatgaatttaaactctggaatgaaagtaatatcgacttagagagtccatttgtaaaaagaaattatgccgctaaaaactgggcctttgtttctgattatgttcggttcaaaatactttccgaagaaggtggaatttatctagacaccgatatggaagttctaaaaaattttgatgaactattggattgttcaggctttgctggactcaatcgacaagaaagtgcaatttattgcggaataataggatgcatgaagggtcttccattgatgacagccgtactgaaaaagtatgatcagcttccagatggagttaatcctacatcacctgatattttaacccaagcatatatagaaatccaggaaagctcatttttaatttacccagcccaagcattctacccgactgaagaaggcgaaaaaattacaaagcagtcacttatcgaatcatatacaattcatcactggggtgaaagttggagatcatacgtccaccttcgccgcgtactacgcagaatcgggcttatgggcatatatcacaaattcacccggaaaaagggtatcctgaaatctaatcttcacattcattcaggcccattagcgtgagtaagccagaagtttttgaaaagagttttccttatcttaaccctgatgatgtgcaacacttgtaccgccatagtctagccgttgaaagatccatcgatggtattagtgatataaccacccctcgggttctggcatgtgacgggctatccatacattatcagtatctcgaattaggtgattcattccaccatgtactatcaggcgacacggacagcaatgactatctatttagaattggaaaagcgcttaaagctatccattcatatcaactaagcgaaaatactcggagcctgcttcatagtgattttgttccgcataatatttttatatctggaacgaaaattactctgattgatccacatccgccggagaagcttgatttctctacagaccgtttgtatggaaatccctattctgaaatcgtggatttcatattttgcttaatgtcggatgttggttttaaacgttcaataaccaagctaggtctgaacgtcagccatgctagtagtttttttgatggatatgggaaaagtaatctaagaatacacaattttttccgacctattttttataagtgcaaggatagctatatattgaaacgacgagcaggttttcctttaacacacgcgactctgcattgtgtttccggtagtatactgacgctcctcgttttatggaaggcattatgattgcccaagacttgtgtactctcttgcagcgtgaattcggctgccggctattatcagagatcgggcctgctcctgctgatattgatatttttgtgccaatagagcatcgtgatgctgtagccagaaaagtagaggcttatggttttattcgctgcggtgttgatcatggccaattagattatcgtctttatgaagatggaaaactgtatatccttgacctattaagcgaatttcaagtttatacgcgctatatcacatgtttaaaattaaataataacggtaatgaggcgatagggaaatcgccagttctgcacaaagcgtttaaatatctttgcctcaatcgaattgataaatttgactttgtacagcagcacattactcaaataactgcttttttacgagaaacttcaaactttgaatggcttcatcccaaagtgttgaacagcgctgcatcaggttcagcggaagctctgatccaagtattcgcctgctcattgcttggcagatacacctcgcgagatttcatccgcgccaagttaataaatccgatactcatgaggtataaaaggattggaagaggtctctctatagcgtttgttggaccagatggttctggaaagtcttttatcatagacaagctatcccaggcagcctctagcaaacaaatttatatgggggattggtttttcttctttcaaaaattttatagctttttgataaaaataccatccccttacaaccgggttgtatatttaatatatcctattgagaattatttaaggacattaaaggttctctttttccgatcgattggaaagttagttcttattgacagattcccaggcacaaaccgcaatgtcattcaccaaggtctactagggaaaatcaatcgaattacatttaaaatttttcccaaaccaaacttgatcgtattattgctggctcgccctgaggttgtatatgcaagaaagcaggagctgaccgttgaagaaattcgagagatgcaaaatcaactacagctattgcttaaagatactccgcatttatttctagatacagaacagctggatcctgcattgaatcagctattaaaatttatagaggtatgatgtgtttatcaaacccagtatcattaaaagcaggttgcgtgtatttctttcactagtacttttcacgcttgcaaaaattattcctttttactcgaaagagtataaaggaaaaactagagtgattttgtttcatcacatagacacgcagcgtcagtttgaaaaaattgtaaaaaaactatctgaaaaatacaaccttattggatttgatgattacttggctggtaaaaaaaatccatcaaaactgaatttgatcttggcgtttgacgacggctacttgtcatggaaaactaatgcttaccccgtgttaaaaaaatactgtgtacggcctttattttttctgaattcagattttgtagatttgggtattgaagatgctcatcgctattgtgaaaatgtcatccatacatgggcggaaccgtctcttacttggaaggatgtacaagaactattttcttatggagcagagattggcggacactgcgaactgcaccttgacttgtccgccatttcaactggtgcaactgcacatagcgcaattgaaaatgataaagtccgaatagagaaaaatctaaatcatgacatccgaagctttgcgtatccgtttggcagatacacaccggaaagcgtggcgagcgtcagcaagattggctaccagtatggatttacctgtgaagcaggctatctagaagatgccgtggatccgctacggctgccgcggacgaatatcgggatgcgtcctccgattgccatatgcgctgcagcagaaggctggcttgaagtgataaccgacatttttgcgtatattaaaaaaagataatgaattgatgagaatcggcagcttgaaattacttgtcaaaaatttttccgcgcaaggtctaaataccttacttggcctagtatttactattgctggcgcacgtttgatgagcttggctgattatggcgaacttcgctatatgatgacattacttccattactgatggcttgtactctgccaggattcgattcgatcatacttagaaaagccaacctgcgtgagcaggttccattgcggaatatattctatatccgcttggttacaggttgcgtcggtgcactgagtgtttccgttgcactgtacttcttttcgcctgcactcagtgcgtcattgaaatttctcctcctcattaccgccctacttttgcctttctttgaaactgcaacaggatataaaaactacttgataggcattggactacgtaatcaaagcttgaacctagtatttttttctaggcttactagcatgttgctgttcctcttgctaggactattgatttactcccattaccttagtcctctgtggatctatccatcctacttgcttgctattatattgcctactatctggactttttccctgatcgctcggaaaatccgacatgcggagaatttcttcccgataaaatggcacgcactcattttaccagcagctgtctcaaccatagctagtttaacgtacacatacgcttattcgatggataagctctggatacgtaatttatccggcgcgcaagccttggccatatattctattttggttatggttcctcaggagctggcgaaattatgcgatgcctcttttcctttgtactataaacgcttattttttgatcacaatactgaaaagaggaaaatccatagaagccgcacactatttttcttgctggcggcaatcattgtattatttctttacgcaagcgctttcgaagttttttcaccatggatattcggggaaaagtatagttacccattttatttatgcttattatccgggatgttgatatttgggcaagcctttgaatactttaatagccataaaatttttgcccatcatggatctcgtggccaatttatttacacattgcttaacttggctctatgttctattttcatcccgattggtataaagcttggcggtctaagtggccttctgcttgctttgctcttcaagcaattgctactccctattttttactactctggggtatctattacctcgaagttgcatttcgacagtcgaaaatttttctaatattgaaacagtgagctattgatgcgtctgtctgttattatttcaacactcagtcggaaagaaacactagttcgtttactagaaaacatctcccggcaaacaaagctaccagaagagattataattgtagaggctggatcgggtgatctcgaaccatctgatattccagtctcaattagagagctggtcattacaatttatgcatatcaagcttctcttgcctattctagagaatctggcagaaagacggcgacaggcgatataatcgtcttttttgatgatgacattgtaataccagatacctatattgaagatgtcacatcctacatgcaagaaaatcccgatgtaatgggagttggtggcccatacacggatgaaaatgtggccaagcgtgtagataaaagtttatggattggccgcctgcttggcatttacgcagatggccacagtaatcgcattctcaagtctggttgggctgactatgttcgatcagaatatttaaacgatatcacgcctgcacaatggttatttggttgcaatggcgcataccgtgcggatgcttttgtggttccttcagtatgtattcaaaaagatatggcgacttggtcttttctagaagatgtcgtacttggggccatgctgacacgacaatacggcatgtgcttgcgaatattgccaaaacttgcagtacgacatgcccctcccgcaagttttggcagtataaataaatcaacgctacgtatgcgtatactatatcgctatattttttggcgcgattttcttgatggcgtttgtgctccatctctgcctgcatttttgatcggaatgattgcaaacctcttgttaatgttgaaacaagagcgtgcattatgggtagcgcgcgagtgctttcagtcattgatatttatttatcgcaatccaaaaatatcctggcaacatgccaatgattttatctttgataaataagttatatttatttgcttttaattggagtttttcatgagtttgttattccgcagcatcagcgtcttcggtcgcttccccttcgtaagactcatacaagtaatcgacaacccgcgctatctgttgcacataattaaaaaaaacttaatttataaaagatccaagattgactacaccgataaatattcagcattcacttttatgagtgggcaagaatcacttgaggacttgataaaaaataagaaaagtttagcacgtttcagcgatggtgaatttgaacagattgtcggcgctggtgagtacccccctgattctgactggtgtcaaaaatggtccaagccattaattgatgacatgctgaaaaccctttcctctgaggatgatcgcttacttgttgccgtagacccaccatcgacattccttgggacgcgggattcaactcacagcattcgctttgaatacaatatgtgggtagatatgcgccggctgatgtggacattcctctgcccgggaaggtcatatggccatagccatttattcatagaggccaactccccagactttaattgggcgcaatttaaagaccatttacgcgaaaaacatgtcattgttgccacaggaaataccgacaaaataagcgatcttaacttagggttaaaaacatacttcgtagagtgcggcacagaaaatgcctacgagcgaaaatctatcataaaagataatatatcgaatcttatcaagaacaatgggcttgataaaaataatgtacttgttttattgagcctaggacccactgctggtattttggcgcgtgaatttattgatgatgacatttgtgcttgggataccggtcatatgtttaaatttgcagctaaaaaattttctgcgtgacatgtgaattaatttcttaacgaacaaataaagaaaattgccaacactaaataatgcactaccactctgttttgcataaaaatcaaaccggtttggaagtgattttagctgcgtgctaacttatttatagaagacaactcctatggatagcactctaaaattgattggacgtaccgcgccattatttggtgcggacatcactcaacataagcaggatttggaagaaatcgttgctgaaagcagttttctggtcatcggtggagctggctctattggccaagccgtagtacgcgagatcttcaaacgtaatccaaaagtattgcatgttgtcgatatcagtgaaaacaacatggtcgagctcgtacgtgatctacgcagcacccttgggtatatcgatggggacttccgcaccttctctatcgactgcaatgggccggaatttgatgccttgatgtcttggggaaagggctacgattatgtgctcaacttatcggcattgaagcatgtccgtagcgaaaaagacccattcaccttgatgaggctgataaaggtcaatatcctcaatactatcagcacgttgaaacatgctaaaaatagtggcgccaaaaaatatttctgcgtgtccaccgataaggccgctaacccagtcaatatgatgggggccagcaagcgcatcatggaaaaatttttgatgcgcgagagccttgacctagctatttctaccgcccgctttgccaatgtagcattttcggatgggtcgctactgcacggattcaatcagcgctttacaaaacgccagcctatttctgcacctagcgatattcagcgatatttcgtcacgccgcaagaatctggggagctttgcttgatgtcttgcttgctaggtcaaaaccgggagattttctttcccaaaccaagtcatgatcttcagctgactagtttttctgatatcgcaagccgatatctggagcagctgggatacaccccctacccatgcagctcggaagaagaagccagagagaaagcctccgcgctaattgctgacaagaaatggccctgctactttttctctagcgatacgaccggagaaaagagttatgaagaatttttcactgaaagagaaattctcgacatggcacgattccaaaacattgggattattaaaaatgaccccgctttcgatgagcaggcactgaattcattcctggatggtatccagaaattgaatcaaaacggccgctgggaaaaaattgaaatcgtatcgctttttgaagcaatcctgcctgagttttcacacttggagactgggaaatatctggacggaagaatgtaatatgcagcgtttttttgacatatttttttcagcaatagcattgctgattttatctcccttgctgatacccatcatgatcgctttgcggctgacaggcgaaggtgagattttttacaagcaaaaccgaataggtcacggcgggaaaagctttggcctgttgaagtttgcaaccatgttgaagaatagccctaatataggttcaggcaatataactctcaagaatgatccgagagtgctgccgatggggaattttctcagaaaaacaaaaatcaatgaactgcctcaactaattaatattttgactggagacatgagtgttatcggccctcgccctttgactaaagataattttgatatttaccctgtgtcggtaaaatccgccttatataaaatacggccaggtctttcaggaattggttcaatcgtgttccgagctgaagaaaacatgctggacaatcgagaagatccacgggattactactgtaaattcatcgctccttacaaaggcgagctggaacgctggtataccgagaaaaagaatgggattttatactttactttgattttccttaccgtgtgggtcgtattatttccgaattcaaagataatctggaaaaccttcccagacttgcctttaccaccgcaagagctgaaagagtttatttaatttaatcaaaaaaaggctatgcccatacaggcatagcctttttacgcggaacaactcacttttcaaaactggccaagatgccctcagcagcctccctgccttcgaacaccgctctcaccaccaagtccgcgcctcttaccatatcgccgccagcgaaaattttggggttggctgtctgatatttgaagcccttggctactcgcgacgacaccatcgtccgtccgctgccatccacctcgatcccctggctggagaaccatggcgccgcggaagcctgaaagccaaaagcaatcagcacatgatcgcactccaccacttcttccgagccgggaatgacctccgcctttcgccgccccttggcatctggcgcgcccaggcgcgtctccgctagcttgaccgccaacgtgccgcctatcatcggttcgatggcgatgggctggcggttccacagaaactccaccccctcctccctggcgttggcgacttcgcgcttggagccgggcatattggcctcatcgcggcggtaagcgcagatcacgcgcttggcgccctggcggatcgcggtgcggttgcagtccatcgcggtatcgccgccgcccagcaccatcacccgcttgccgcgcatggacagcggcgcctcgcccttgggcagcgtgcccagattctgccgcacgttattgatcaagtaaggcaaggcctccagcacccccggactgtcttcgccctggaaaccgcccttcatgtactggtaggcacccatgcccatgaaaaccgcgtcgtgctgcttgagcagcttgtcgatggaaatatccttgccgacttcggtattgagcacgaagcgcacgcccatgccctccagtatctcgcgccggcggcggaccacgtccttctccagcttgaattccgggatgccgaatgtcagcaggccgccgatctcttcatagcggtcgtacaccaccggcttcacgccgttgcgcgccaacacatcggcgcaggccaggccggccggcccggcgcctatcaccgccaccgtcttgtcggtccataccaccctggacatgtccggccgccagccggccttgaacgcctcgtcggtgatgtacttttcgatgctgccgatcgacaccgcgccgaaaccgccctggttcagcgtacaggcgccttcgcacaaacggtcttgcgggcagacgcggccgcagatctccggcaggctgttggtctggtgcgacaactccgccgcctcgaacaagcggccctcctccaccagtttcagccagttggggatgtagttgtgcaccgggcattcccattcgcaataggggttgccgcaagacaggcagcggccggcctggtcggcggcgtccacagcgtgcagcggctggtagatttccttgaattcaatcttgcgcacggatgcttcaaccttgtcgccgggattgcgcgacaacttcatgaactggaatacatcggacatcttgttctctcccgcggggatgggcggcgccttcttgcgccgccgcgtatcgattcaaccggcgcttagtctttcagcaggctttccagcttggcggccttgggcttcaccagccagaagtagtcgacgtagtcgtcgaagttctgcagcatcgcgcggccggtttccgagccggtcagttccacgtgcttggcgatcttctccagcaggaaggcgcgatacatgcccatcgcctcgccattgatcaagtggatgtcgatcagctcgttgttgtagcggtaagcgaacttctcgcccgggtcgtagacgaaggcgaagccgccggtcatccccgcgccgaagttgtagccggtttcgcccagcaccacgaccgtgccgccggtcatgtattcgcagcagtggtcgccggcgccctcgatcaccgccaaggcgccggagttgcgcacgccgaagcgttcgccggcgatgccggcggcgaacagctggccgccggtggcgccgtacaggcaggtattgccgatgatgatggattcgctggccttgtagccggcatccttgggcggatagatggtgacgcggccgccggccatgcccttgcctacgtaatcgttggcgtctccctccagctccaggtgcaggccggccgcgttccacacgccgaagctctggccggcgctgccggtgaatttcactttcagacagccgaacggcaagccggccgcgccgtggacgcgggcgatctcgccggacagccgcgcgcctatcgagcggtgggtgttttcgatcgggtattccagctccagcatctgcctgttgcggatggccggcagcgcgtcttgcaggatctgctcggccagttcgcccttgtcgaacgacgggttgctgtccgccacgcagaagcgcggctcgctgtccggcaccgtgccttgcgacagcagcggacgcaggtccagcttgtgctgcttgtcgctctcgccctccagcaattccagcagatccatgcggccgatcaactcctccatggagcgcacgcccagcttggccatccactcgcgggtttcgcgcgcgatgaacaggaagtagttgaccaccatgtccggcaagccggtgaagtacttggagcgcagcttgacttcctgtgtcgccacgccggtggcgcagttgttcaggtggcagatgcgcaggtatttgcagcccagcgccaccatcggcccggtgccgaagccgaagctctcggcgcccaggatggcggccttgacgacatccaggccggttttcaggccgccgtcggtctgcacccgcacccggccgcgcaggccgttggcgcgcagcacctgctgcgcctcggacaggcccagctcccacggcgagccggcgtacttgaccgaagtcagcggcgaggcgccggtgccgccgtcgtagccggagatggtgatcaagtcggcataggccttggccacgccggcggcgacggtgccgacccccggctcggccaccagcttcaccgacaccagcgccgtcgggttcacctgcttcaggtcgaaaatcagctgcgccaggtcttcgatggaatagatgtcgtggtgcggcggcggcgagatcaggctgacgccctccttggcatggcgcagccgcgcgatcaggccggacaccttgtcgccgggcaactggccgccctcgcccggcttggcgccctgcgccaccttgatctgcagcacctcggcgttgaccagatagtgcggtgtgacgccgaagcgcccggacgccacctgcttgatcttggacatcttctcggtgccatagcgcgccgcgtcctcgccgccctcgccggaattggagcggccgcccagccggttcatcgcgatggccagcgcctcgtgcgcttccgggctcagcgctcccagcgacatgccggccgaatcgaagcgcttgacgatggcctccaccggctccaccgcgtcgatctccagcgcttgctcggccagcttcaggctcatcaggtcgcgcagcatcgccaccgggcgggtgttcaccgtttcggcgtattgcaggtaggcgtcgtagtcgtcgttctgcaccgccttttgcagcagctgcaccacgtcggggttgtaggcgtggtattcctcgccgtgcacgtacttgagcaggccgccttgggcgatgccgcgcatcggattgaaagccagccgcgccagttgcttctggtcggcctcgaagtcttcgaaattggcgccggacacccgcgacaccgtgcccttcaggcactgcgcgaccacgtcctcgtgaatgcccaccgcctcgaacagctgcgcgccgcggtaggaggcgatggtggagatgcccattttggacagcaccttgagcaggcccttgttgatgcccttgcggtagtgctgcagcgcctcgttggccttcagcgccacctcgccgctgttcaccaggtcgatgatgctttggtaggccaggtaggggtagaccgcggtggcgccgtagcccagcacgcaggccatctggtgcgcgtcgcgcaccgccgcggtttccaccacgatattggtcttgcagcgcaggccggcgtcaatcaaggcgtggtggaccgcgccggtggcgaacaaggcgtggatgggcaggcgctggccggtggcgtggcggtcggacagcaccaccaccaccgtgccctcctgcaccgcctccaccacgtgccgggtcagacagcaaagcgcctcgcgcagcgtggtctcgcccgggtcgtagcacaggtcgaaattggtggccttcagatagctctccggccgggtggtgacgcgggtgaatttctcgtggctgagcaccgggctgcgcacctccagccgcttcgcgtgttcggcgctctcctcgaacatattgcgttccggaccgaacaccgtgttcagcgacatcaccaccgcctcgcggatcgggtcgataggcgggttggtcacctgagcgaactgctggcgcaggtaatcgaacggcgagcgggccttctggctcagcaccgccatcggcgtgtcgtcgcccatcgagcccaccgcctcctggccgtcctcggccagcacgcgcaggatctggtcgcgctcctcgcggctgaagttgaacatcttctgcagccgcgccaactcatccttggacagcggctcgacgccggcgtcgtcctctatcgacagctccaggtacttggcgctgtccttgatccactgccgatagggtttggcgcttttcagctgggcgtctatctcttccggcagcagcaattcgccgttggccaggtcggcgccgaacagttggcccggcttgacccggcccttcttcaccacgtcctgcgcgcggtagtcccacacgcccacttcggaggcgatggtgagaatattgtccttggtcagcacccagcgcgccgggcgcaggccgttgcggtccagcatgcaggcggcgtagcggccgtcggtcagcacgatgccagccggaccgtcccagggctccatatgcatcgagttgaattcgtagaaggcgcgcaggtccttgtcggtgctatcgacgttctgccaggccggcggcaccaacaggcgcaaggcgcggaacagcgggatgccgcccatcagcaagccttccagcatattgtccaggctcatcgagtccgaaccgtcggtctggacgatgggccgcaccgcgtccatgtccagatgcggcgaagccatgatgcgctcgcgcgcgcgcgcccagttgcggttgccctgcacggtgttgatctcgccgttgtgggcgaggaagcggaacggctgcgccagcttccattgcggccaggtgttggtggagaagcgctggtggaacaccgccaggctggactcgaagcgcgggtcggcgagatcggggaaaaacactgccaggtgatccggcgtcaccaagcctttataggagatggtatgcggcgacagcgtgggcagatagaaatgcgggtcgtcctggcggttggccttctccgccagccggcggcccatgtagagccgacgctggaaagccagctcgtccatgccgaacggacagttcacgaacacctggacgatggccggcagcgacgccagcgccgcctcgccgcaggcgctcacgtcggtgggcaccacgcggaaaccggccacttccagttgctgagcttccagctgttcgcgcagacgcgccaggctgcgttcgcccagcgcccgctccgggtggtggaacaccaggcccgcggcgtacactgacttcagcgcgatgccggcctccagggccacctcgcgcaaaaagccgtccggtttcttgaacagcaggccgcagccgtcgccagacttgccgtccgcggccaccgcgccgcggtgggtcagcttggccagcgaggaaatggcggtggccaccagccagtggctgggcttgtcgtccagttgggcgatcaggccgaagccgcagctgtcctgctcgaactccggtttatacaatgtgccttgcaggcggctctgtctgtccatttctctgcccatttatactttgtagtgatggcttcgattctaagggcaagatcgcgacagccgcaaccgcgtttggcgcagcgcaacaagcattcaatttcaaccacttaatcaacaattgattgattttaaatgtaatttcactaccaaaaaacagctgcattcttgattttttgagacgtgaattttcaaaaaaacgacagtcaatcaggtctgaaagcagatacaaactggtatttttcgcaatattttgtattttgtcagacaaaattcgaaaataaaatgaaccacgacgacgcctccgcatccacgctgcaattcgtccgccaactggccgaacaggccttgtcccgctccgccggcgcgccgctgatcggcggaaaccaggtggatttgctgtacgacagcgccgacaacttcccggcctgggaaaacgccatcgccgccagccaggattcggtgttcatcgaaatgtatattttcgccaatgaccaatttggcggaaaaatcagaaatatcctgatagataaagccaagcaaggcatccaaatttgcctgctctacgactggctgggcagctggcgcgcgcatctgtcgagttttttcaagcccttgcacgaagccggcgccgaggtgcgcgcctatcatccgcccagcctgggcggcggactgagcctcctgggacgcaaccaccgcaagatgatcatcgtcgaccgccggctgctgttcgtgtccggcctgtgcatcagcgacagctggcgcggccggccggacaaggggctggctccctggcgcgacaccggcctggcgctgcgcggccctttgctcgcgccggcgctggccgccttcgccgacagctgggccagctgcggcgccgcgctggacaaccgctggctgcaaccgctggcggtgaaagccgaaggcggcgcggcggcggcgcggctgatcgccaccacgccgtccaccgccaagatgatgcggctggacctgctggtcgccagcttcgcccgccgcacgctgtggctgaccgacgcctacttcatggccaccagcctgtatctgtcggcgctgaagcaggcggcgcgcgacggcgtcgacgtgcgcctcttggtgccgcgctccagcgacatccgctggatcgccgccgtttcgcgcacccagtaccgaccgctgctggaagccggggtgcgggtgttcgaatggaacgggccgatgatccacgccaagaccgccgtcgccgacggccgctgggcgcgcatcggctccaccaacctcaatctgtccagctggctggtcaaccgcgagctggacatcgcgctggaagacgagggcttggccggcgagctggcggagcgcttcctgcgggatctggagcaatccaccgaaatcgtgctgcgccaggagcgccgccggccggtgccgcggccggtgggcaagccggaaaaacgcccccgcggcacgcccaaggagatggcgctcagcggcgccagcgccgccgcccgccaggcgatacgcatcggcgacgcgctgggcgcggtggtgcacggcagccgcatggtggaaagcagcgaggcgccggccttcctcagcataggcttggccttgtgcctgctggcgctggcgataggttatttcccttggctggcggccgcgccgctcaccctgctgctgggcataggcggcctgggggtggtattccgcgccatcggcctgtacctggccaagcggagaaaaaaacaacagtccgcgccgcgcgccggcacagatcaaacgcaatcgccgccgccgcccgactgccaatgaaaacagccgcttacccgaccagaggatcgccgcggcgggcagccgccccgcttcggcaagcggctaattggtcacaccccgaagttttttgcgcatccggccatgctgcataacaacatgacaggcaaaaggtctacaatgcgcgcttcttgggatgttctccaggccggctgacgtgaagcgacctacggtcgccatgtacggaccgcggcgcaaagcgacccgttttattcgcgcctcaaggccagcctccagggcggcggcgaagacccgttcttcagcccgtgcgtacagaatctgcgccccacgcgcaccgagtgacgctgcagcgatgcaggccgccaggtgacgccacccggccccgccgcagtgtccgagttaacagcaacaaggactcaggtatgcgttttcatttccccatcgtgatcatcgacgaggatttccgctcggaaaacaccagcggctccggcatccgcgaactggccgccgccatggaggcggaaggcatgagcgtgatcggctacaccagctacggcgacctcacctctttcgcccagcagcaaagccgcgccgccggcttcatcctgtcgatagacgatgaagaattccagaccgaggactcggcccaagagtcgctgggcaatctgtacggcttcgtcgccgagatccgccgccgcaacccggacatcccggtctacctgtacggcgaaacccgcaccgcgcgccacatccccaacgacatcctgcgcgagctgcacggcttcatccacatgcacgaggacacgccggagttcgtcgcccgccacatcatccgcgaagccaagagctacctggacaacctggcgccgccgttcttccgcgcgctggtcgactacgcgcatgacggctcctactcctggcactgccccggccactccggcggcgtcgccttcctgaagagcccggtcggccagatgttccaccagttcttcggcgaaaacatgctgcgcgccgacgtctgcaacgcggtggacgagctgggccagctgctggaccacaccggcccgatcgcggcctccgagcgcaacgccgcccgcatcttcaacgccgaccacctgttcttcgtcaccaacggcacctcgacctcgaacaagatcgtctggcacagctgcgtcgccgccggcgacatcgtgctggtggaccgcaactgccacaagtccaatctgcacgccatcatcatgaccggcgccatcccggtgttcctgatgccgacgcgcaaccactacggcatcatcggcccgattccgaagtccgaattccagccggacaccatcaagaagaagatcctggccaacccgttcgcgcgcgagatgctggaaaagcaccccaaccgcaagccgcgcatcctgacgctgacccaatccacctacgacggcatcctctacaacgtcgaggagatcaagggcctgctggacggcgaggtggacaccctgcacttcgacgaagcctggctgccgcacgcctgcttccatgacttctaccgcgacttccacgccatcggcgaaggccgtccgcgctgcgaagacagcctggtgttctccacccaatccacccacaagctgttggccggcatcagccaggcctcgcaaatcctggtgcaggacccgcagaaccgccagctggacaccgcctggttcaacgaggcttacctgatgcacacctcgaccagcccgcaatactcgatcatcgccagctgcgacgtggcggccgcgatgatggagcagccgggcggccagtcgctggtggaagagtcgctggtggaggcgatggaattccgccgcgcgatgcgcaaggtggacgaggaatacggccgcgattggtggttcagcgtatggggcccggacaacctgtccgacgacggcatctgcgaccagaccgactggacgctgcgcccgaacgagcgctggcacggcttcgccggcatcgaggacggcttcaacatgctggacccgatcaaggccaccgtgctgaccccgggcctggacgtggacggcagcttcgaggaaatgggcatcccggccgccatcgtcaccaagtacctgaccgagcacggcgtggtggtggaaaagactggcctgtacagcttcttcatcatgttcaccatcggcatcaccaaaggccgctggaacacgctgatctcgctgctgcagcagttcaaggacgatttcgacaagaaccagccgatgtggcgcgtgatgccggagttcatcgccaaatacccgcaatacgagcgtgtcggcttgcaagacctgtgccagcgcatccacggcttgtacgccaagcacgacgtggcgcggctgaccaccgacatctacctgtccgacatggagccggcgatgcgcccggccgacgccttcgccaagatggcgcaccgcgagatcgaacgggtgccggtggaccagttggaaggccgcgtcaccgcggtgctgctgactccgtatccgccgggcatcccgctactgatcccgggcgagcgcttcaacaagaccatcgtcgactacctgcgcttcgcccaggccttcaaccgcgagctgccgggcttcgaaaccgacgtccacggcctggtggcggtggaagtgcaagaccgcaaggtttactgcgtcgactgcgtcaagcaataaggctgcggcgagaaacgaccaaggcgggagcgatcccgccttttttcatgcccgctacagccgcacgcgccaggtgttgcggccgccggccttggcctggtacagcgcctcgtcggccctggccagcgccgccatcaggtcgtcgccgccgcgcagcagggtcatgccggccgaacaggtataggtaaaggccggcgcctcggccaacggccgcgaggcctgcacctcgatcaagatcgcctgcagcagcgcctccgcctgctccaggccgctgcccggggccagcagcagaaactcctcgccgccgagcctgcccaggctgtcgtgcggcttcagcagcggctgcagccggtgcgcgaaatcgcgcagcaccgcgtcgccggccagatggccctgcacgtcgttgatcaatttgaaatggtccaggtccaggatggcaatggctgccgcttggcaggcgccatggccaaactgcgccagcatgccttccagttgctgcaggatgtggccgcggttgcccaggccggtcaaagggtcggtcagcgccgcgcgctgcgccaggtcgcgcgcctgcctcagctcacgctcgccgacgcgcaggtcggtgatatcgctgccgacgcacagcatccagccgcccggctgggtggtttcggtcatccagatccagcggccgtcggccaggtcggtctcgaaggcgcgaaacggcagcttggcgcgccgcgatttcgccgaagcgagccaagcttcgaagtcccgggtctggatcaaggtgccgcggccgttgcggtaattgcgccgcatcagctccacccagcaaatgcgctcgtccggcgccacatccagcgcggcgcagaaggccggattggcgtaacgcaggccatcgcgttcgtcgaacagggcgatcagcaacgggctgtccagctgcaacgacagcaggcgggcggcgatgtcttggtcttcatcggcaggcttcatacactggcatccggcaatacccgggccggcgcggcgcggcccgccgccgcccgttgcggacggcgctcataagccatggtagcgcaaaaccgcggcggctaacggcgcgcgccggcgcgcaagcgctggatgatgaagtaggtccacgccagcgtcgcggcgccgatcagcagcagcaccgcggctgcgacgaatgtccctcccagcaacagcagcagcgccgccagcgtcaatatcaggccaagcaggcccagcaacgccgcagccagccatcccaacgccgccggcagcggcgtctgcgccgactgcgactgctgccctacccgtttgcgcgtgtcgcgatacgcctcaatcgtcggcagccgacccagcaacacggccagcgcgcccggcaacagagccaggaccagcagcagcgccttgacgccgtaagcgccattgccggacaagccttgcagcagcaaaccgccgaacagcccgtacaggaacaaaccccaagccagggtactcaacggccgccgcgtcgccaagggcagcagcaagagcagcgcggcgatcagcaaggccgcctccagcatatagctggcccagccatgcagatgcacgccaggcccatgtttgccgggcacgtagaaatcgcgttgccagcagctgaaaccggcgtagccagccgtggcggcggccagcaatgcccgcttcgccttgtcctgcggcgtcagcgccggctcgcgccgttcgatttcttccatatcgcccccaagctcaacgctggccggccgccagcaagcgcagcgccaacccgccgaacaccgtcgccagcaggtattgcggccagcgccccgcgccctggcccgacaaggccctgcccatcctgctgctggcgacgatcaccagcgcgttgacggcaaaacccaccgcgttcagcaccgtggccaacagcatgatctgcagcgccaccgggccggcctgcggctgcacgaactgcggaaacagcgccagcacgaacagcgccatcttgggattgagcagattggtggtcagcccctgcagcgcgatgcgcgccagcggccggccgggttcggcggagccggccgcgcgcagcacgctcttgctcttcaaggtggtccaggccaggtacagcaaataggcggcgccggcgatgcgcaccgcgtcataggccatcggcaccagcatgaacagctgggccaggcccagcgccgccaacagggcgtggcaataggtgccgagctgaatgccgaacagcgtggcgaagccggcgcgcagcccctggccggcgctgcggctggcgatcagcagcatgtcggggcctggcgtggcggccaacgcgagacaggcgagggagaatagcagcagggtggacaaggtgggcatgggcgaggctccgcaatcggtcacgaaggcattcatcataccgacatcgtcaggagtcgaacaaccgtgagcatacggtttgaaacgcatcgccatttccggcatagctatttgtcctaaccagatggagcccacgatggactttcccacgcttcgcaccgaacgcctgacgctgcgcgagatcacgcagcgcgacgcgcccgcgctgctggccatccacggcgacgccgatgcgatgcgctggtacggcaccgacccgatttccagcctggagcaagcgcgcgcgatggtggagacattcgccggctggagaagcttgcccgcgcccggcgtgcgctggggactggcgcgccgggaggatgacgcgctgatcggcagcctcggcctgttcaaatggaaccggggctggcgcagctgcacgctgggctacgaactggcgcgcgcctgccaagggcagggcctaatgggcgaggcgctgcgcgccgcgctggcctggggcttcgagcatatggagctgaaccggatcgaggctcaggtgcaccccgacaaccaggcctcgctcacgctgctggaacggcttgatttcaaggtggaaggccgcgcgcgccaggccggcttctggctgggccgccatcaggacttgatcacacactcgctgttgcgagaggacagcgcgctggccaccgcgtaacggcgacgagcgatcacgattcgcttggctggcggcgtcccgccgcggagcgttgccagcctaccagccgttttccagcacgatgtggcccggcgcgttctgccgggtcatccggtagcccattttcatcaactggcggtgggtgtcctccaccatctgcggattgccgcacagcatgaagcggctatgctccggcgacatctccaccccggcccgccgcgccagccggccgtcggccagcaattgcgggtagcgggcgtccagcatgtccgccggcgcgtcccgggtcaccaccggcaggtagtgcagcttgtggccgtgctcgcgccacagcgggtgctcgcgcagttcggcgatttcgcgctggaacgacaactccgcggcatcgcgcacgcagtgcgacaggatgatgcgctcgaaacgctgccaggcgtccggctggcgcaatatcgacagatagggcgcgatgccggtgccggtggccagcagccacaggtcgcggccggccggcagcctgtcctcctggaagaagccgagcgccttcttgtccagcatcacctggccgccgggcgcgagcttggccagcaaggggctgaactggccggcctccaccacgatggagtagaactccagatgctcgtcgtacaccgccgaacacatcgaatacgcgcgccacacctggccgccgttcgccagcggcaggccgagccgggcgaactggccggccgcgaagcggaagccggccggccgcgtcaggcggaagctgatcagcttgtcggtccagcgccgcatgtcgagtatggtttcggtggtgtatttttgttggatctcggcttccagttcggcattcatctcagggcgaccattagttgagtgatttactcaacaattatgcgccgccggctcctgtctgccaagccagtccgccagctgcggatgcagctcgtccgccgccagcgccgtcaaggccgccagcggcaagggcagcagcgccgccacctccgggccgagacgccagcgcgccggcagcggcgcgtcgaacaattcgcagacttctccgtccagcttcatccgccccaaaggcctgagcggcaggtccgcgatgcccagttcctcctccaattcgcgggccgcggccgccgccggcgtctcgccagcctcgatgccgcctccagcggcgaaatccagccgccccggatggctgtcgtcgtcccaggcgcggcgctgccaccagcattggctatcgtcgcgcaggaaaatcagtacactggtggctgcaacatccatcttgtctccatgctgtcgcgcaaagcgtcacatcctgccaggcggatgtcatgcagacaaccacccgacaaggaagccagccatgcccatcgccatcgccctgcacggcggcgcaggaaccctgcgccgcagcgaaatggacgccgccgccgaacaagcttaccgcgccggcctagcccgcgcgctggaggccggccatgcggtattgcgcgccggcggcagcgcgctcgacgcggtgtgcgccagcgtctgcgcgctggaggacgatccgctgttcaacgccggccgcggctcggtgtacacgctggacggcaagcaggaaatggaggctgcggtgatggacggcagccgccaggatgccggcagcgtcaccggccttggctgcgtgcaaaacccggtgctgctggcgcgcgcggtgatggagcgcagcccccatgtgacgctgggcttcgccgccgccgaagacttcgcccgccgggaaggtttggacatgcggccgccggaatacttccacaccgacaagcgctggcaagcgctgctgctggagaaagagcggctggccagcggcggcaaggacgaggacattcccgaagaccgcaaacacggcacggtgggcgcggtggcgctggatgaccagggccgcctggccgccgccacctccaccggcggccgcaccgccaagtggccgggccgcatcggcgacacgccggtgataggcgccggcacctgggccgacggcgactgcgcggtatcggccaccggccatggcgaatacttcgtccgcgccgccgccggccatgaaatctcggcccggatccgctatctgggggaaacgctggaacaagcctgcgccgcggtggtgcaagacgacctgccgcggctgggcggcaccggcggggtagtggcggtggacaagaacggccgggtggcgctgcccttcaattgcgaaggcatgtaccgcgccgccatcgacggccagggccgcgccacgctggccatctaccgcggggaaggctagcggtaagccgcctgccattcggccagcagctgggcgaccaattccgccgccggcagctcgcgcgccagggccacgccttcgccggcccacagcgacatcaggtcccggcgcccggcctggaccgcggcggcgcgcagcgggccggtcagcgcgttggtcaccggataggccggcaactggtcctgcgacttggccatctcttccatgtagcggttgtccagcccgcgcgccatccggccggaaaaagcgcgcgtcagccgggtcgccccgctctgcgccgccgccagcgcctgcttccacggcgcggaaatgccggactccgggcaacgcagaaaagccgtgcccagcaagcaggcttgcgcgccgtggcgcatcgcgccggcgatgtccttgccgttcatgatgccgccggcggccagcaccggcaccggcaggttttgcgccagctcgtacaccagcgacaacataggccgcagcgactgctcctgcggcccgatgaaggtgccgcggtggccgcccgcctcgcgcccttgcgcgcacaccgcgtccgcgcccagctgcgcccaggccagcccttcggccaggttggtggcggtgcctatcacctggatgccggcttgcttcaacgcctgcatccgcgcggcgtccagaatgtcgaaagtgaagctggcgaaagccggccgcaacgccagcagcgcgtcgaactggcgatcgaacggctggcagaaactggccggaaccgatggcggcgccaaccccagctccgcatgccacggcgccagcagcttcagcgccggctccagctcggccaccgccggcgccggaggggcctgaacgaacagattgacgccgaacggccggtcggtcagggcgcggatgcgcgccgtctcctcgccgatctgctccggcgacagcatggcgccggccagaaagcccaggccgccggcgccggacaccgccgccaccaattgcggcgtggtcgcgccgcccgccatcggcgcctgtatcaccggcagcttgagctgcgacttctgccagaatgctgaagacatcacgctctccttgtcgccggcgccgcgccggcctgtggtgtcggatgtgccgccaatcccgctggccgggctcagtcgcgcagcgcctgttccaggtcggccagcaggtcgtctatgtcctcgatgcctatcgacaggcgcaagccgccctcgacgatgcccagcgcggccttgttgtcggccggcatgctgccgtgcgacatggtatagctgtggttgatcagcgactccactccgcccagcgactccgccagcacgaacagccgcagccggctggcgaaacggctggcggcctcgcggctgtcgtctcgcaggcggatgctgatgatgccgccgaaacgcttcatctgcgtcttggccagctcatggcccgggtggccgggcaagcccggatagaacacctgggcgatccgctcctggccgcacagccaggcagccactttttccgcattgtcgcagtgtctctccatccgcaaggccagcgtcttgatgccgcgcaaggtcaggaagcagtcctgcggccccggcaccgcgccggcggcgttctgcacgaagcggatatcgtggtagagcttgtcgtcgctgaccgccaccagccccagcagcacgtcggaatggccggccagatacttggtggccgaatgcacgacgatgtcggcgccgagcgacagcggctgctgcaggtaaggcgtggcgaaggtattgtccaccgccaccttgacatcatggcgatgggcgatggccgacaaggccgcgatgtcaaccatgcccagcagcggattggtcggcgactccagccacagcaggcgcgtctgcgcagtgatggcggcctccagttcggccggctcgcgcaggtcggcgaaggtcaccttgacgccagccggcgccagcagccgcgtcagcagccggtaggcgccgccgtagaggtcggccaccgccaccacctcgtcgcccggtttcaggcaggcccgcaacaccgcgtctatcgccgccatgccgctggagaaagccaggccgtgcttggcgtcctccaggctggccaggcagctctccagcgcgctgcgggtggggttgccgctgcgggcgtagacataaggcatgctctcgccgatgtgctcatacgcaaacgccgatgtctggtacagcggaggcatgaccgcccggttgtgatcggcgctgtggtagccgacatggatggcgcgggtcgcgaatttcacaaaaactcctcaaaatcatcaacttgggcaaattgcccgacaatcgaacgcaaacggccggcaaagcatgcatttgccatgaccatttcatcacaaagctaaaacttcaacgcaattgcgaacaaatatcagcaaattgctatgatcttcgccaagcctgcacggatttttactttacaccgacgcgctttagggctattttgctgcgtttcgcattaaaactaacgtttgcatgaagacaaaacgcgttttcgacatcctgtatcaccagttggccacccatccccgccaggattgcctggccgccaaatccggcaaggcatggcggcaactgtccaccaccgaggtacgggacacggtcaaccgcgtcagtctgggcttgcttgagctgggcatcggccccggcgacaaggtggccatcgcagccgacaacagcatcgaatgggtgctggcggacctggcgctgcagcaagtgggcgccgtcagcgtgccgctgtatcccaccatcaccctcgatgatgcacgctatatcctgtctcatgccgaggtcaagctggcttttgccggcagtgctgcattgcaacgaaaactgcacgaggcattgggcaagctcgcttgccccatttacggcctggccgatatcgacggcgtgccctcctggcgcgaaatccgcgatctgggccgcatcgagcgcatggccgaactggaagcgctgcgcgacggcatccgcgccgacgatgtttacaccattatctacacctccggcaccaccggccgttccaaaggcgtgatgctgtcgcaccgcaatgtggtcagcaccgtcaccgccaccgccgaattcaccggcctgccgcatggcagctgccgcgcgttgagcttcctgccgctgtcgcacatcttcgagcgcgccggcgtctactactatctgtacagcggcaccggcatctacttctccagcgtggagtgcctgtcgtcggcgatggccgacgtcaagccgcacaccttcagcgccgtgccgcgagtgctggagaaggtgcatgaaaagctggtggccaaggcccgcgacctgtccggcgccaagcgccgcatctacctgtgggcggtcgctcgcgccgagaatttcaatcccaaccgcaagctgtcgccgctggaggcgatcaagcacgcgctggccgacaagctggtgtacagcaaatggcgcgcggcgatgggcggccagctgatctcgatcaacgtcggctccgccgcgctgcagccgcggctggcgcggatgttctgggccgccggcgtggccgtggccgagggctacggcatgaccgagagctcgccggtgatttccgccaatccgttcaacgcccgcggcgtgcgcatcggcagcgtgggcctgccgctgcccggcgtggaagtgcgcctggccgacgacggcgaaatcctggtgcgcggcgacaacgtgatggtcggctattacaaggaagcgcagctgagcgcggaagcgctgcaggacggctggctgcacaccggcgacatcggcgtgctggaaaacggctacctgcgcatcaccgaccgcaagaaggaaatgttcaagaccagcaacggcaaatacatcgcgccgcaagcgctggagaacaagctgaaggaatcggccttcatcgaccagatcatggtggtgggcgacggccagaaatacgcggccgcgctgatcgtgccgctgtacgaaaagctgaaggaatggtgcagcgaacacggcatcgcctacaccaccgacagcgaaatgcgcagccaccccaagatcgtcgatctgatagaccgcgaggtgaaacgtttcaaccgctacttcggcagttgggagcacatcaagaaattcgcgctggtcgacaagccctggtgcgtggacgccggcgagctggcgccgacgctgaagctgcgccgcaaagtcatcgccgagcgctgccgcgcgctgatcgacaatctgtacgtgcacgcctgagcctgccgccagacgtaaaaaagccccgcgatgcggggcttttttcttgccgcgcgaaccaggatcagcgccggtgcgccaactccagcctgtcctccacccggcgctggatgcgctcgaaagcggcgctcagcagccagtagatggcggcggcggccaggtacagcggcaagggctggaaggtctgggcgatcacctctttggtcgccagcatcagctcggtgaccgtgatcaccgacaccagcgaagtatccttgatcagcgagatcaggctgttggacaagctgggcaccgacaagcgcagcgcctgcggcgcgatgatgtggcgcatggtctgccaccacgacaggcccagcgagaacgcggcgtcccactgccccttggcgacgccggcgatgccgccgcgcaggctttccgacaggtaggcggcgacgttcagcgtcagcgccagcacccccgccggcaccggctccagttccagccccacgcccggcaggccgtagtagatgacgaaaatctgcaccaacagcggcgtgccgcgcatcgcgctgacgtagaacgcggccagctgcgacagcagcggcagtttcgccacccgcaccatcgccaccgcaaagcccaaggccagccccagcaccatcgccaccaaggcgaaggccagcgtgtagcccgcgcccttcagcagcaccggcaacgccgactcgaacagcgtcatccaatcgctcatgccatcccttccctgaaaatactacgcccccgctgcggcaggggcgtcttcccatcctgattccaatacagattacttcttggccgccgccggcgccttcgacacgtcgatgccgaaccacttgaccgaaatcttcttgaaggtgccgtcggccttcatgccggacagcgcttggtcgatggccgccttgaactgcggattgcccttggcgaacggaatcgccatcgtcgccacttcgccgaccggcgcgcccgccttcaacggcagcttggcctgtttgatggcgaacgggatcagcaggctgtcgttcagcgccgcgtccaggcggccggtggccaggtcctgcaggtattccggcgcgcccgggtaggttttcacttccacgccggccgcggccttggccatgtcggcgtagttgctgccctggccgacacccagcttcttgcccttcaggtcggccaggcccttgaaggcgcggctttcattcttgcgcacgatcagctgcgcgctggaataggtgtaaggctggctgaagtcgaacaccgccttgcgctgctcggtcacgcccacctggttgaccacgatatcgaacttgccgctttgcaggccggccaagaggccgctccactccgcggtggtgaactccggcttcaccttcatccggcgcgcgatctcgctggcgatctcgacatcgaagccggtcagctgttgcttggcgtccttgaagttgaacggcgggtaggttccctccagcgcgatcttcagcgtgccgcgctgcttcaccgcatccagcagatccgccgccagcgcctggcagctcagccccgccagcagcaataccgtcatcagcttgcgcatatcaatataacccaaaagaatttagaattgaaaaaatattggatgcaagaatatcagtaattcgtgatatcagacaagcctaaatgcgcgacggtccgcgcggcgccaaccgcgcggaccgtcgcgacgacacgtccccaaaccagcctacgcgccggctcttctgctgaaactcctgccgcggtgctgcagcgcgatgacggccaatgcgacaagcagcaaaccggccatgccggacaacaggacaatgatgatccgtttcggcgccgacttttccagcggcggcgccgcgggcaacaccacctgcacatcctgcgacgccaccacccgggcaacctgaagctgctgctgcagctcgcggatcagcgcccgattgaagtaaagattgcgcagggccagcatctgcccgctcggcaactgccgtatcacgcggttgcttccctccagctccttgcgcatttgcaggatcgcgctgcccagattgctggactggccgccctcgagctgcccttccagtcctgcgaacccgctgatgatgccgactgtggccatgtccagcgacgcttcgccgcccggcaccctggccgccacttccgcttcggcctgcttcagttgcgcccgcgccgcagccagcttctcctgcagcacatactgcttccggccttgctcggtaatatgcgcgtccagtatctgctgcctgctgatctccgccaggccgttggccaattgcgccgccaattccgggctggcatcggtcaccgagacctcgagcagcccttccttggtcggggagagcttcagccggctgttcaccaactccagcttggcttcccgcggcgaagccgactgataatgatcgaccaaagcaaacttatccaccatccgctgcagcacgccatcgctctgcaacacgctggcgcccccttgggcgccgatcggcgcggcgatcgtcagcaaggttctggcggtatacagattgggcattgccagactcgcggccaagcccgacaacgcggacaaacaaaaaccggccagcaaaactcgccaattgcgcgaaccgaactggccgattttcaacaaggcaatttcgttttcttcacgttccaccagatgatcacccgcaacgattcaaacatgtagtcaaacaaaagaatgaacggcgatggacagctgtcgcccacggcagagcatataacaaaagtggcggctcatcgccaccacttttatctgccgctttagacgttgaacaggaagttcatcacgtcgccatcctgaacgacgtagtccttgccctcggcccgcatcttgccggcctccttggccttggcttcgccgcccagcgcgatgaagtcggcgtaggcgatggtttgcgcgcgaatgaagccgcgttcgaagtcggtgtggatcacgccggccgcctgcggcgcggtatcgcccacatggatggtccaggcgcggacttccttcaccccggcggtgaagtaggtctgcaggcccagcagcttgtagccggcgcggatcaggcggtccaaacccggctcttccaggcccagcgtctccaggaattcggctttgtcggcgtcgtccagctcggcgatttcggactcgatggccgcgcacagcgccaccaccggcgcgccttcgctgtcggccagcgcttgcacccgctccagcagcggattgccgctgaagccgtcttcggccacattggcgacatacatcgccggcttgatggtgagcaggcacagcggcttgatcagcgtcttttcctcatcggacagatccagcgagcgcgccggcttgccctggtccagatgcggcgccagcttttccagcacctcgatcagcgcgcgcgcgtccttgtcgccggacttggccttcttgccttcgcgctgcatcgccttttccaccgcggacaggtcggccagcgccagctcggtcaggatggtttcaatatcggcgatcggatcgaccttgccggcgacgtggacgatattgtcgtcctcgaagcagcgcaccacgttgacaatggcgtcagtctcgcgaatgttggccaggaactggttgcccaggccctcgcccttggaggcgcccgccaccaggccggcgatatcgacgaattcgacgatggccggctggatcttctgcggattgatgatcttggccagttcagccaggcgctggtccggcacttccacgatgccgacattgggctcgatggtgcagaacgggtagttggcggcttcgatgccggccttggtcagcgcattgaacagggtggacttgccgacattgggcaaaccgacgataccgcatttcagactcatgtccgcttccttgaatttctaaacagtcaatccattatggcggcggccgcgcgggccgcccgccctgatttcacttggcctcggtatgcagggccttcatcgcctcggccattttgccggcgatcgcgcgcggcaattcgcgcaacgatgccaggatggcctcgtccagcgcctgctgctcttcgccgcgcggcttcttcagcacgaagttggccacttcgttgcggtcgccgggatggccgatgcccaggcgcaggcgccagaatgccggcgagctcagacgagcggcgatgtccttcaggccgttatggccgccatggccgccgccctgcttgaagcgggcggtgccgggctgcaggtccagttcgtcgtgcaccaccaggatctggtccggcaggatcttgtaaaactgcgccagcgccagcacggcctggcccgacagattcatataggtcatcggcttcagcagccagacgtcctggccgttgatgtccaccctggcgacgtcgccatggaatttgccttcgctgcgccagttgcccttgaactgccagcataattcgtccaccagccagaaaccggcgttgtggcgcgttttttcgtattcggggcccgggttgcccaggccgacaatcaggcgaatgccggacatatcgtcattccaaattaaaaagcccgctgcccgccacttgggcgcacaacgggctcttcaccgttaccgccaggcggcacggcagcagggatcacacacgagtgaagtcgatgtgcatgacttgctgtttgtacgggtgcatctggaatgcagccactttgacttgctctttctgaccgtcgatgaccagatccagcacggaggcgtggaaggcttcgttcttcagagcgtagtacatggtgttgtgatccagcaccagggaaacggcttctttgccggcgccgtaaaccacggccggcacttggccagcgtgacgcaggcggcggctcgcacccgtacccagatcaacacgcttgctagcaatcagttcaaaagacattgtaaaactccagtttcagttagaagcacccggcccgccgcgaccagcaggccagatgtttacggcaggcaggcgcccgtcgcaaccagttcctcattgaagaggtaggacaccgattcttcgttgttgatcctgcgcagcgtctccgccagcaggccggcgatcgaagccacccggatgttcgggcaggccttggccgcggcggtcaacgggatggtgtcggtcaccaccaccatatcgatgtcggaattcttgatgcggtccaccgcttgaccggagaagatcgggtgggtcgcataggccagcacgcgttgggcgccgcgctctttcagcgcggaagccgccttgcacagcgtgttggcggtgtcgatcatgtcgtcgacgatcaggcaggtgcggccggacacgtcgccgatgatgttcatcacctcggccacattggccttggggcgacgcttgtcgatgatcgccagatcagtgttcagcgccttggccaccgcgcgggcgcgcaccacgccgccgacgtcggggctcaccacgatcagatcgtcgaagcgctgggcgcggatgtccttcaacagtaccggcgtcgcgtagacgttgtccaccgggatgtcgaaaaagccctggatctggtcggcgtgcagatcgacggtcagcacgcggtcgatgccggcgctggtcagcatattggccaccagcttggcggaaatcggcacccgtgcggaacgcggacgacggtcctggcgggcatagccgaaatagggaatcgctgcggtgatacgaccggcggaagcgcgcttgagcgcgtcggccatggtcaggatttccatcaggttgtcattggtcggcgcacaggtggactgcaggatgaaaacgtcgcggccgcgcacgttttccagcaactcaaccgccacttcgccatcgctgaacttgccgacgtcggcgcgccccaacgagatatccaaatgtttgactacgttttgagcaagttccggattagccgtaccggtaaataccatcaaactgtcgtatgccgccatgattcgctttgccttagctggataaagaaaaagcgtgtaagggactcttacacgcttttttcatgctctctcttcataaggagaaagtcctggctggggaggtagggatcgaacctacgaatgccggaatcaaaatccggtgccttaccacttggcgactccccagtaaccttattcagcgctgtcgaacagggggtggacatcgagtccttgcgctacaaatccctgatacttttccgacaacacccggtaaactttatcggcttcgtctttcgacttgaattccatgaacacgcaggctccggaaccagtcatcagcggcgaaccatattttctcagctcgctcagtacttcattcaccgctggaaacatgcctgaaacaacgttttgcagatcgtttcgtcgctgctgcgttgtttcgaggattcgcattatgccgtcgacccctacctctgtcaacatgctctgcgaaaaattgcggaatatcgccgcggtcggcacatgaacctgtgggtgaattaccaaataccaggccggctgcaaggcgatcggcgccaaaacctcgccgacgccggtggccagcgcgctgcggccgaagatgaaaaccggcacgtcggcgccaagctgcaggctcagcgcctgcagccgctcgcgcggccaacccagcccccacaaccggttcagcgcgatcagcaccgtagcggcgtcggaactgccgccgcccaagccgccacccatcggaatgcgcttgtccaggcggatgctggcgcccagcgcgcagccgctctcgcgctgcagcagccgcgcggcgcggacggtcagatcctgctcagccggcacgccgtcggtgggcgtcagcaattcgatcatgccgtcgccgcgcgcggcgatctccagcgtatcgccgaaatcgatgaaacggaacaccgtctccagcaggtggtagccatcggcgcgcttgccgaccacgtgcagcagcagattgagtttggccggcgccgggaacgattgaaactggaacgacatgatctgaatgattacctttgcaatgcggaatcgcgcggccggctagcgccagctttgcaccacgaccttcactgtcagcccttcgcgctgcatttccacccgcttgggatggtcggcctcgacatcggcgtcgcggatgaagcggatatgccaaccctgctgctgtagattgccgtcggcatcgacgctgctgtcgaccccgggagccggcaggccgcgtatccaccacaccaggttggacagcggcagcggccagcccatcacctgttgggtcaggctttccacgtcgtcggcctgccagctcttgccatcggccagcagcgtgacgccgcccggctcccgcagcaccttggccacggtgttgcctagcggggaattgatcgccacttcgtcgcgcggcggttcatgccgccaatcgaagttggcgacatgccccttgccgtccagattggccgacagcctgccgctgacattgaaaggctgatccgccgccgcggcaggcgactgcggcggccgaaacagcgcctcgttggcgcagccggccagcagcagcgccagcagcaaggccaggcacctcgccatcatagcttgacgcccaggcgctgcacggtctcggtcagcacttcatggccgggatgcgccgccagctccttgttccatagcgcgcgcgcctcatcctggcggcccagccgccacagcacctcgcccaggtgggcggccacttccgggtccggcatcgcctggtaggccttgtccagattcttgcgggcggcttccagccggcccagcttgaattgcacccagcccatgctgtccaggatcaccggattgtccggctccgccttcagcgccttttcgatatagccgtaagcttccttgtagcgggtggtgcggttggccagcgtgtagcccagcgcattgagcgcctgggtgtcgttcggcttgtccttcagcaccaagcgcagatcgcgctcggcgttgccggcattgcccagcaggtcggacaccagcgagcgctcgtacagcagctcgcccgacttgggatggctctgcagggccttggtcagcagctcgtaagccttgcgcggctgcttggcgtcgcgcgccagctgcgactgcagcagcgccaacgacacccgctcctgctcggtgccgcccagctggcccagccggctcaaggcctggtccagctgtccttcgcccgcttccagcagcgccagccgcgactgcgccggcaggtattgctggccctgcccgacctggcggtaccagccctccgcgcgcgccgcgtcgtgatcgtcttcggcgatctggcccagcgtgtagcggacaaaatcctggtccgggtattgctgcgccagcgcgcgctgcagccgctgatccgccaccttcaggtcgcgcatctggtaggccagtaggccggtcgcatacagcaggtccggattgtcgggatgggttttcagcagcgcctcgaaagccacccgcgcctcgacgaagcgcttggcgccgaccagcaggcgcggataggccgcctgcagctccaggccggcgtccgggcggcgcgccaattcgcgccgcaggaagtcggccgcgcccgggatgtcctggcggcgcagccgatccacctgccaggccaccggcagatcccatttcggcgcgatctgcgccaggcggtcgaactcgcggtccaccgccttttgatcgttattatccgccgccgcggccagcaccgcgaagcgcgcctcgggcaggtcgggatagcggctggccaggtcggccaccagcttgtaggactcggccgaaccgccgtcctggcgggcgctcagcctggccagctgcacgaagatggccggcgcgcgcgccggttccctttgcagcaggtcctcgatcagcggcttgctttcggccagcttgccgccgcgcatcagcgtaatgaacagctgctcgcgcgccggcagcgaatccggatccagctggatccacagcgacaaggcctccgcggcttccttcaactggccggacagcaggcagaattcggcggcgcgctgcgccatccgcggatcgcgggtctggcgcgccaggtcaaggtaggtcaggccggcggagccggcgccgccgcggcgggcggcgacctcgccggccagcacgccgtaaaggatctcgggcgtcagttcctgcttgggcagcttggcctcgtcggccttggcggaggcatcgccgtcggcgttgtcctgcgcggcggcgacaggctggggcagcggcggcttgacgctggcgcaagccggcagcagcagcgccagcagcaacgggagagttcgtttcagcggtttcattcgcatggagtaagttgcctgctcaaagcctgttgaacgcgtagaatagcatgtccggttttcatctttacaccatttgcgagccacgcttcccgatgccagaactgccagaagtcgaaaccacccgccgcggcgtgcaatcccatcttgagggccgcgccctgcgcggcgccatagtgcgcaacggcagcctgcgctggccggtgccgccggacctgtccgcgcgcctcgccggagaaaccgtgcgggcggtcagccgccgcgccaaatacctgctgctggagtgcgacagcggcaccttgctgatccacctgggcatgtccggcagtctgcgcatcctggcggcggacaccccggcgcaaaaacatgaccacatcgacctgctgttggacgggcagctgctgcgctaccgcgacccgcgccgcttcggcgcggtgctgtggcacatcggcccgatagaaacgcatccgctgctgcaagcgctggggccggagccgctgtccgccgatttcgacggcgccaccctccaccaggccatcggcaagcgcggcagcccgatcaagctggcgctgatggacaaccatgtggtggtgggcgtcggcaatatctacgccaacgaatcgctgttctacgccggcatcgccccaacccgcccggcctccagcctcagccgcgaagaatgcgagcggctggcggccgaaatcaaggcggtgctggcccgcgccatcgaggctggcggcagcacgctgcgcgacttcgtcgacagcgaaggcaagcccggctacttccagcaaagctatatggtgtacaaccgccaggaggagccctgccgccagtgcggcacgccgatccggcaaattcgccagggacagcgcagcacttactattgcccactgtgccagccatgttagagtggcgggctgtcatctctcagacatgaaatcttaaaatcttgaagtcacccgccacaacctcgtttccaacccgctgcggccgcgtattgcgcctgctgagccacttggccgtcggcgtgctcatcgtcgccacccgctactcccgcctggcccaggccgagcgcgcggtggtcacccgccgctgggcgcagcaggcgttgaagatcctgggcgtcagcatcaaggtgcagggcgtcaatccgggcttttatccgcccaacaccctgctggtggccaatcacgtgtcctggctggacatcgcggcgctcaacagctgcacggtgtcgcgcttcgtcgccaagcgcgagatccgcagctggccgctgataggctggctggcctatgtcgccggcaccctgttcatcgatcgcagcaaccgccgcgacgccagtcgcgtcaaccagatcctggccgacgcgatgagcaacggcggctgcatggcggtgttcccggagtccaccacctcggacggcagcagcctgctgccgttcaaggcctcgctgttcgaagccgcgctgctgtccggcggcacggtgcagccggtgtcgctgcgctaccagcggccagacggcagcctgctgctggaggcggcctatatcggccagatttcgctgttccagagcataggcaaggtgctgagcgtgccgcagatcgaagtggagatttgctacggccaggcgctgcgcgccggcgacgccggcctcgacaaccgcttcctgctggccgaacaggcccggcgcgaagtggcccgcggcctgcgcatcagcctggaagacgcgccgcaggccgccgcgccggcggaaaccagccgggcctgagtcagcgccccaggcgctgcatcaggttcaggtaaaggtcgtcagccaggcgggtgtagcccggcgcggtgaagtgcaccagatcgggccggcccagctggtgctgctgccacagccgcatgctgcacggcccgcccatcgcctgctcccaatcccaatacaacagatgattgtcgcgcgccaactggcgctgcgtctgctgcaccgctgccagcatcagcggacgcttgggccccgcgcattcctgactgaccgccccgcccttgcggcgcgcggagtcaggcgcgcccagcagcagaatggcagcctgcggcagctgcgctcgcaccaggccgatggcgccctgcaaggtggcgcggtattcgtccaggtccaatttggcgtcgaaagcctcgttggtgccgtaggccaggatcaccaggtcggcgtcgcgcgctgccatctgccggccccatattccgccccagcgccgccatagcgccagttcggcgccattgctgcctacgctgtccagcaccactcccggcgccagcttttccagttcgaacccgcccagttccggcgccggcaggctgtccgcccgcagcgtgaacggcagcttcagcttcatttccacccgctgccagccggcgccggcggcggcctggatgcgccgcggcccattgccgtcgtccacagtcagcgatgccgcgtcgcttgcctggcgcagccagacccgcacccgccacaagctattgtccgcggcgcgggcctgcacgctcaccagcgcgcccggacgctgcgccgcgccgatgtagccgcccagcggaaagtcggggtcgtcgtcgcggcggctgttacgcaggctccagccctcgctgcgcaccagccccagcgcgttgcgctggcccggcacgttgagcggcggcagccagcctatgccggcgtcgccgaaacgggcttgcagccgcgcgcgcaactcgccgctgaggtagtcggcggcggtatgcgaatcgccgaactggatgatgcgcactggctgctgcgcatcagcctgcaagctcaggcgcgccgccagccggctcaggttgggttcgccgaaatcctgcaccggcgcggcctgggcctggcccgccagcgcgccggccagcagccagcccacaatgaatttagctgtcattcaaacctcaattccgccaggacgcggcgcgccagcagcagctggccttgccgggtgaaatgcacgccgtcggcggtgcgcaccgccacctcgccctggtcgggcaatgtcatgaatttgttgaaactgtcgtcgcggctgcccagcacctcgcgggtggcgatgaagcgctggccggcggccgcggcttcctcgcggtacaagcggttcaagtagtgcgcgccgtcgttcagcttgtcccggcccatattgggcaggcccagccacaacaccttgatcttgcgtttattcgcgctcgcgtaaatgctgcggatgcgctcgcggtaacgctgctcccactccggcgaggcgaagcggatgtaatggctgccgcctaccatgtcccaagtatcattggcgccgatgaacatcaccagcagctgtactttgggattggccgtcaattgccgctctatggtagccggccagttgaagaagtccggataggtgaggccggtgctctgcttgctgacgtctatcgccttcacctggtgctggcggaacagcggcggcagcaaatgcagcgccaccccctgcatcatggaatcgccggccagcaacaccggcaggcccggctgcaacgccagccggggatccagcgccttggcggcggcggccggcgccgaagcctgcggcggcttcttggcggcagcggcaaccggcgcgggcgtctgggccaggcagcaggcgttcaaacgctccaccatccggcggtcccacatgcccacctgttgctgcaaagccacgctttgctggcgcaggccgccgcccaattcgccgccctcgcgccacggcgacagttcctccagcttctccagcaggctgggactatggaaagtctgccgccagtaagcattgatggcggcctgttccacccagaacagcagcagcatggagctgagcaggatgacgaggatgcggcggtgcggataggcggctagcatggcggacgatcagaattggtagtaaatgaaggcgggaatgcccgacggcgccagcgaaatcaccagcagcgcgcaggcgctgagcaatagcggcttgccccaccagggcaaggccgccaactggacgatgcagcgttcgcgcagcggcgccagcctgggcagcgccgccagccacaaggccagcagcaacagcaggcccggcgcgttcagcgtcagcgtctggccggtgccagccatcgcgcgcagaaagtccatcgcctcatccagcgactgggcgcggaagaacacccaggccaggcagacgtagtggaaggtgatcagccgcgccagccacggccagcgctggctgacgccgtcgcgccgccacagtttgtcgccgatgttcagccccaccacgcccaggccatgcatcgccccccacgccagatacttcaggctggcgccgtgccacaggccggacaacagcatcgccgccagcagattcgcctggccgcgggcgaagccgccacggttcccgcccagcggaatatagatgtagtcgcggatccagctggacagcgaaatatgccagcgccgccagaaatcgcgcaggttgagcgccaggtagggactgtcgaaattgcgcggcagctggatgcccagcagcagcgccagcgcggtgaccaggtcggtatagccggagaagtccaggtaaatctgcagcgcgtaggcatagaacgccgcccacacttccagcgtatggaaggtgtccggcgcggcgaataccgggtcgacccaggcgctggccagccagccggccagccacagcttcttcagcaaggccagcacgatcaggcccagcgcgcggtcgaaattcgccgcctggcgcagagccgggctgcgcaattgctccagcaggtcgcgcgcgcggcagatcggcccagccagcaaggtggggaaaaacaccaggaacagcgcgaactgcggcaggcgcgccggcgccatctccttgcggtacaccgaaaccagatagctgaccgactggaaggtatagaaagaaatccccaccggcatcaggatgtccagcgccggcagcatcgccgatatccccagcgcgtgcaggccggcctgcgcgctttcgcggaaaaagtcgaaatacttgaacagggccagattgaacaccgccagggccagcgccaattgcagccagcgccgcggatgggccgaggccagcatcttgcggctcagagcatgctggaccagcgtgtagcaggccaggatggcggcgaagcgccagtccagcttgatgtagaacaggtagctggcgaccagcagcagcaagttctgcaagctgggcatgcggcggcagccccagtaggcggcgaaaaagccgacaaatgccagggcgaattcaatggacagatagctcatgctgaaggtgaaagctggcggagggcgcaattatgacaacaaggccagcctcgcaccagcttccgtaaaactttatttatctgccggcgggaagcaaaatctcccggtaagccgggcatggcagagaaaacagctgcctgtcatccagccgcagcgccgacaggctgccgccccacaggcagccggagtctatcgccagcacatcatcgtccagatgcacccccagcgctgaccagtggccgcagacgatgggcgtgccgccatggcggcggttcggcgcctcgaaccacggaatcaggttggccggcgcgccgtccagctcgcccttgtagctcaggtcgagctcgccgtcgcgggtcaggaaacgcatccgcgtcatcacgttgacgatcagccgcaagcggtcagcccctttcagatcatcgctccagcgcaccggcttgttgccgtacaaacggccgagaaactcgcggtggcgcgcgccggacaagccgaactcgacctcctccgccagccggagcgacttggagatgctccactccggcaacaggccggcgtgcaccatcgcatagccctgtccctccagcatcatcggctggcaacgcagccagtccagcagcaccttgccgtcggcggcattgagaatatcgcctatggtgtcgtcgcgatgcagcttgccgaagccttccgacaccgccagcagatgcagatcatgattgcccagcaccatctccacctggtcctggtgctgatagacccagcgcagcacgtccagcgactgcgggccgcggttgaccaggtctccggtcagccacaaggtatccttgccgggattgaagtcgatttgccgcagcagctgctggaacggcgcgaaacacccctggatgtcgccgattgcgtagatggccatgttctttccctgagaagcggatcgggattgccgcccatccgcgatgagccatgataccgcatgctacaatgcacggtcctgattaccgatttgctacgcccgcccgggcgccaccgccatgtccgcacccctgctcaatccgccgcaacgcgcggccatccattacctagacggcccgctgctggtgctcgccggcgccggatccggcaaaacccgggtgatcacctacaagatcgcccatctggtgcgcgaaggcggcatcccggcgcgacacatcgccgccatcaccttcaccaacaaggccgcgcgcgaaatgctggagcgggtgagcaagctgatgacgccggccgagatccgcggcatcaccgtctccaccttccactcgctgggcatgcacatcctgcggcaggaggcgccgcacctgggctacaagacccagttctccatcctggacgcctacgatgccggcaagatcatcgccgacatcctgaacaccacttccaaggacgagatccgcaaggtgcaaagccagatctcgctgtggaaaaacgacctgaaaaccgcggacgacatgatggtgagcgcggatggccagtgggagagcgtctgcgcccgcacctacctcgcctatcaggacaccctcaccgcctaccaggcgatggacttcgacgacctgatccggctgccggtgcagctgttccgcacccaccctgaagtgctgctgaaatggcagggcaagctgcgctacctgctgctggacgaatatcaggacaccaacacctgccagtaccagatggtgaagctgctggccggcgtgcgcggcctgttcaccgcggtgggcgacgacgaccagtccatctacgcctggcgcggcgccaatatggaaaacctgcgcttgctgcagcaggacttcccggcattgaaggtgatcaagctggagcagaactaccgctccaccgcccgcatcctgcgcgccgccaacagcgtgatctccaacaaccccaagctgttcgaaaagcagctgtggagcgagctgggcctgggcgagccgatacacgtggtgcaatgcaaggacgaggagcacgaggcggaaaccgtggtgcagcgcctgctggcccacaagttcgagcaccgcaccgacttcaaggactacgccatcctctaccgcggcaactaccaggcgcgcatcttcgagcaatcgctgcgcaaccaacgcatcccctaccagatggcgggcggccagagcttcttcgacaagccggagatcaaggacctgctgtcctacatgcgcctgatcaccaaccccgacgacgacccggccttcatccgcgccatcaccacgcccaagcgcggcgtcggcgccggcacgctggaaaagctgggcgcctggtccggccagtacggcaagagcctgttcgccgccgcccatgatgccggcctgcgggtgcagatccaggccgcccagttggcgccgctggagcaattctgcgaattcatcaaccaactgcagtaccgcgccacccgcgagccggcaggccagctgtcgctggagctgttgcaggcgataggctacgaagcctggctgtacgacagcgaggacagccccaagatcgccgaaaccaagtggaagaacatgctggacatggtgggctggctggcgaaaaagggcgaggccgacggcaagaacctgatcgagctgacccagaccatcgcgctgatcaccatgctggaaggccgcgacgaaggcgaggtggacgcggtgaagatgtccacgctgcacgcgtccaaggggctggagtacccgcatgtgtttctggtcggctgcgaggaaggcatcctgccgcacagcgaatcggtggacaacggcatggtggaggaagagcggcggctgatgtacgtcggcatcacccgcgcgcagcgcagcctgacattgagctactgcgtcaagcgccgccgcgccggcgaatggcagttcatcgaaccgtcgcgcttcatcaacgaaatcgacggcgaggatctgcgccacttcggcaagcccggcgccgagcctttggtcagcaagagcgagggcaagagcaagctggccagcctgaccgcgatgctggccagcaaggacaagtccggggagccgccggcacagtgagccccaacagaagcgcgcagcgtccgccaaaagaaaaatggcgccgaaaggcgccataaagaagaatgaggaacatctctgggtgaagcgaggctggggaacctcacctgactggcaagcctgaaccgctaaccggtcaatcagatgagctaatgatgccgcaactccggccggttgccacctgtcctttctatccggtcacatttattgacatttctccgccaaccagcggacataaaaaaacaccccgctgcggcggggtgtttcgcgtctggcggccgggtttacttggagttattgaccatatactccaccgcggcgcgaaactcggcgtcgctgccggtgtagccgcccttcggcggcatcgcgttcaggcccttggtggcgattttcaccgcttcgtccaaacccggcttcagcctgaccgcccaggccgccttgtcgccgaacttcggcgcgccggctatgcctgccgcatggcaggtggtgcacacggtgtcataaatcttcttgcccaccaccgccgggtcggcggcggccgtggcgcccgccgcgccgcccaccgcaggctcggtgaacttggcgccgccggcattgcccatataggcgaccgcgcgcttcacttcgtcatcggtcaggtcggttgcgccgcccttggccggcatcgcgttgaagccgtgcagcgcgtgatccaccagcgtctcccagcccttggcgatatgcggcgcccaagcgccggcgtcgccgaacttgggcgaacccgccaagcccgcgccatgacaggaaatgcagatgcccttgtacacctgctcgccggtgcgcatgcccggcggcgcgtcgctggctctggattcgccgacaggcttcagacgagcggcgaccgcctccttggtcatcacctcggcatccacattgaaaccactggtcgccagtttggccagaagccaaatcgccacgacaagaaagacaacgatgctgaccagaacctttatgatctggccgggggccattccgttctcattactcatcccaagcctcgcctgaaaaaatgacaattaaaaccggttgattataaggtatgcatgtacgcaaggcaaaaaaccatactctggactcggattaactaattgaggtatgatgcgtcggttgatagcagttctgcagcgcacccgtagctcagttggatagagtgtcagtttccgaagctgaaggtcacaggttcgatccctgtcgggtgcgccaacaaaatcaagggtttgcaagcgtaccgctgcaaaccttttattttttccgcatcgtttcgcatttcatttccctttccgtccataaaccgcaaaattgccggaagcaccggtcttttggccagaagcggccttgacgcatccgcatcaagctttttttttgagcggaaacttgatttggatcagcttggcgtcgcgattcgccaacttaaatgatgtcgttctgcaacgctttttgcccccccgccccattggacaaaccttgcgtcgtcaccagccaggcagacgccagcgaaaaatcgtccgacatcccgccatcggcgctgcgacgcggccctcaccgccagaaaaactcgacgcgctgatcgctgccgccatatgtcggatgataggcgatgaatcgccataagcgacaggcggcatgacccgtcccccgcaaaaaatccctttcccccgtcagcgtggttgcgccggccaggcgcgggcgccgagtagaaaagtcatcgatcaggctagtgtccggcagcttcacttctgtttccagacctcgaaccagggatcgacatgttctcccccggcacattcagcccgcgccgtccatcgcgcgcccctctcgaccatgcagaaaaaacccctgcggcggctgcggcaggggtcggttcacatcatcccatcaacgagacttgctcgtcctgatcgtcgtcctcttcgccgaggaagccgccgctctggtgcgaccacagcctggcatacaggccgccgcgggccagcagctgctgatggctgccctcctccaccacgcaaccgcggtccagcacgatcaagcggtccatcgccgcgatggtggacagccggtgggcgatcgccaccacggtcttgccttccatcagccggtacaggctgctctggatcgccgcttccacttcggagtccagcgcgctggtggcttcgtccagcagcaggataggcgcgtccttcaacatcacccgggcgatggcgatgcgctggcgctggccgccggacagcttgacgccgcgctcgccgacatgggcgtcgtatccgacgcggcccttcggatcggtcagcgtctggatgaaatcgtcggcctcggcgcggcgcgccgcggcgaccatgtccgcgtcgtcggcgtcgggacggccgtacagcaggttttcgcgcaccgagcggtgcagcagcgaggtgtcctgagtcaccatgcccaccttgccgcgcaggctgtcctgagtgacgtcggcgatatcctggccgtcgatcaggatgcggccgccgtccagatcgtagaagcgcagcagcagattgacgatggtggacttgccggcgccggagcggccgaccaggccgatcttctcgcccggccgtatcgtcaggttcagcccgctgatcacgttcctggcgccgccataggcaaagtcgacattgtcgaagcggatctcgccgcgcggcacctgcagcttgaccgcgtccggcttgtccaccaccgccaccttgcgcgacaaggtggagatgccgtcctgcaccgtgccgatgttctcgaacaggctggacatctcccacatgatccagtgcgagatgccgttcagccgcagcgccatcgcgctggaggcggccaccgcgccgatgccgacctggccctggctccacagccacaaggccgagccggcggtgacgccgatcagcagcatgctgctgagctggttgacgatctcgaagccgctgaccaggcgcatctggcggtaggcggtggccaggaactcctgcatcgcgcccttggcgaagcgcgcctcgcgctggccatgcgaaaacagcttcacggtggcgatattggtgtaggcgtcggtgatgcggccggtcatcaggctgcgcgcgtcggcctggcggctggcggccttgcccagccgcggcacgaagaaccacagcgtggcgacgtagaacgccagccagccgaggaaaggcggcagcaggtgggcgtcgaaatggccgagcaccgcgatcatggtgacgaagtagatcaccacgaacaccaggatgtcggtgatgatcagcacggtgtcgcgcaccgccagcgcggtctgcatcactttggccgacacccggccggcgaattcgtcctggtagaagctgaggctctgccccagcaggtggcggtggaaattccagcgcagccgcatcggaaagttggagaacaggccctggtacttgctcatcgcctgcagcgccaccagcagcacgctgccgagcaggatggccgccaacagccataagtggccgctctcgcgttgcagcagttgatcaggcgggaccttggacagccaatccaccaccgatcccagcatcgagaacagcaaggcttcgaaagcgccgatgcaggcggtcagcagcgtcatgcacaggatcaggccgcgcaaaccttgggtgcagaaccagatgaaggaaaagaagccctgcggaggctgggccggaggcgtgtccggatagggagatatccggcgttcaaaccaggaaaacataaagatcgctccattgtctggaaccaagccggttccggataaggggttcaagtggagcgatgacggtagcgtatcctagcctggttcgcaatgggaaagttgcccttgagccgaaaaaaagcgccgattccggctgggcggcggcgcattccggcgcatcatgccatcggcaccattttgacgtagacctcctccagcttctccgaggtcctggccttcaggtccaccttgtgcacctcggcccgcacgcgccccttgtagacctgcagcatcaattcggcggccctgcgcgcctgctcctgggtggggtgcagcggaccgctgtcgtctatgccgaaatccggagagatcagtttcaaccgatacattattattgtctcaagataaaacggcgtgattgaagtttttatactaaatgcatttcctcaagcccattctacatgagtttatttgacagaaactattgtcatgtttctgtaaaaaaccagaaaaatacgtcaataattcatacataacagcgagatggcgaacccgcctgcctacaggggaagtgagcaaagcgcatgccaggcccgaataagcgaaaacccggcttcggccgggttttctcgttgcgcatcacaccgcgccgaacaagcgccgtttaggccggcgtcgccagatcgcgtgactgcccgtggcgtatccgcgcgagcgccgccgccacctggccgttgccctgctgccagtaacccagccggcacaaacagtctaggctgaccagcgcggcgtctatcatgaagcgctccgccaccaagagctgctccacctcggccagcggcagcaacagatgctcggccacctcgccgtcctgacaagccggccgctgcccctgcggcagccacagatcgtaggcatgcagccattcccggtgcagcccgcgcgccaccggccgctcggccagcagcagcgactccggccgcaagcccagcaacgcctcgcgcgcgatgccggcctcttcccagccctcgcgctccaacgccagctccagcgtctcgccggcggccacgccgccgcccaccagattgtccatgcggttggggtccaccgccttgtgcgggctgcgccgccccacccacatccggatttcgccatcgtccagccggcacagaccgttgacgtggaccgcgcggctggtcaggcccagcgggcggaaagccgcgcgctccagctcgaaataagcggagccgtcatggcgaaaggcggtgaaattctcgttgcgccagccgttgagccagccggcctgctgccagcgccgcgccgcctgcgccagcgcatggctgatgctgcggtagctgccgtcaagccggcagagcatgccctgatagttttcctcgaacagcgccgcctcgtgccggagcaagcgctccttccattgcgcgttgacgcaacccatgcgctcggtgccgatgtagagcggcgtgaactgttgcgcatcgaaacggcttaccttgtccagatagcccaatacggcatccacctgcatgacgactccccctgcggtttttccgggaaggctgcatattaggatgtctgatccggcttgactatccttgggcgcacaaagccggcaagtgttgcattccggccatcgcgcctcagcgcaggcggtcggccaggccggaatggcgctgcggcgccagctcgacgccgcgcagccacacctccccgcttcccgccgcggcgaagcgctggcgcgcccgggtgatggcggtgtacaacaaggcccggttcagcagcgcgcccggctgcgacggcaattgcagccacacttcgtcgtactccgagccctggctcttgtgaaccgtcatcgcgaaaaccgtgtcgtgcgccggcagccggccgggggcgaattcgcgccagcctccgtcgcccgccgggaacaccacccgcagcccctgggcgcgcggcagcgcgaaaccgatgtcgccgttgaacaggcccaggccgtaatcgttctcggctatcatcaccggccggccggcataccagtcccgtcccggctgcttcaatccggccagctccagctgccgctccagctcgcggttgcagtccgccacctggcgccgctccgccgccagcagcatgaaggcggaaaaggcgcgctgcaccgcgtccggctcggcgccggcggtcgccgcctgcagatagccgcggcgcttgtccaatagcgccgcggccgccaccgccggctgcaggccgatgtccggatggccgcccgcctgcagcaaatccagcgagccccgcccgtcgccgccgttgaccaggcgcgccagttcgccgatgccggaatcggcgccgaagcggtggctgtgggtcagcaaggccacgcaatcggtgagccgtccgccttccgcgccgtcgtccggcaggctgtcgccgcacacccgccgcagccattgccgcgtctcctcgcggtaggcgatccggccgcacaactcgcccaacaccgcgccggcctccaccgacgacagctggtcgcgatcgcccagcaggatcagccgcgcctgcgacggcagcgccgccaccgcgcgcgccatcagcgccaggtctatcatcgacgcctcgtccaccaccagcacgtccagcggcagcggattgccggcgtgatggcgcggcgcctccgcgccgggacgcaggcccagcaggcggtgcagggtttccgcctgcgccggcaattggcgccgcaccgcctcgtcgacatccagccggtcgcgcgcgccgcgcaccgattcggacagccgcgccgccgccttgccggtgggcgccgccatcgccatcaccagcggccgcggcgacagcgccgccagcagggccagcaagcgcaccacggtcgtggtcttgccggtgcccggcccgccggaaatcaccatcagccgctgccgcgccgccagcgcggcggccagcttctgccggtccggcccggtgtcgccgccgggaaacagccgcgccagcagcgccgccagcgcggactcgtccggcggcggcagcggctcggccagccgggccaggtcccgcgccaggatgtcttcatcgtgccaatggcgggcgaaatacagccggccggcgtcgtccaggatcagcggcgcgtaatcgccgggcctgccgaccagctggctgcgctgcagggctttgcgctcggcgcgatgcgcgagcggcaggcagacgtggccggcctggttggcggcgctcaactcgcgcaccagcgccagcaccgcgtcgtcggcgtcgggaaacagccgcaggaacaggctggaaagttggtcgggcaacagggagatggcggaattcatatggcggtcagcggttggcggcctgcgcgcaggcgtcggttatttcgcggcgaacagcggcttgagcttgccttggccgttcagggtctggatggcgcggttcagcctgggcagcagctcgcggtattgcggatgcaggcgcagcatcaccggcaggctgccggccgactcgcccggctggcagcgccggccttcggtctggcggctccagtagcgcgcgcggccgcgctccagcaccaccgcctgcacccggccttcgcgcagcttgtccagcagttcctcttcgttgccggacacgtcgcgccgcaaacgctggctctggaaggccggctccagcagagggtactgctggccgggcaaggtgcccaccgttccgcttttcagctccgcggccggcgtcctccccttggccagcggcaggcacaacacgaactccacttcgccgaacggctgggtgtagaagccggccaccggcgacaacgcgcgccaggccggattgacgccggcctccatgtccagccgccccacctggaacagctgctccagccgctgggtcggatagtaatccagctggaagcggatgccgctttgctgggcgatcagcgccagcgcctggcggtaggtttgcagcaagccgccctcctccgcctggcgcaggggttcggtggtgtcgttggccacgccggcgcgcagggtttgcgccggcgccgacgcgcacgacaacagcagcagcagaccgcacagcctattcactcagtctcgcctccagcgcgtcgcagatggtggtcaatatcttgatgcgcgcgaaatacttgttattggcctccaccagcgtccacggcaccttgctggtgctggtgcggtcgaccatgtcgctgaccgcctggcggtaaagatcccacttgtcgcggttgcgccagtcctcgtcggtgatcttgaagcgcttgaagccggtttcctcccggcccttgaaacgctgcagctgctcgtccttgctgatcgccagccagaacttcagcacgatggcgccgttttccgacaactggtgctcgaaatcgttgatctcgtaatacgcccgcagccaatcggcttccggcgcgaagccctccacccgctccaccagcacccggccgtaccagctgcggtcgaagatggtgatgccgcccttgcccggcacattgcgccagaagcgccacaaccacggcttgtccctttcctcctgggtcggcgccgccaccggcaccacccggtagcggcgcgcgtccagcgcctgggtgatgcggcggatgctgccgcccttgccggcggcgtcgttgccttcgaacaccagcaccagcgaatggcgggcgaagcgggcgtcgcgcgtcagcttgttgagccggccctgcagctgctccagcttggcgcggtaggcgtccttgtccagcttgcggtccagctccagcgcgtccagcaccagcttgttgtctatcggcgccagcagcggcggcgcctcgacgcggtcggtgctcagcatcggctggccgatgcggttgcgcatcgcttccaggatggtgttggccaccgtcaggctgcggtaattggcgtcctcgccgtctatcacgatccacggcgcgtgcgaggtgttggtcagcctgagcatgtgctcgccgtatttgcgtatcttgtcgtagcgctcgtagtgctcccagtcgctcttggtgacgcgccagctggtcgcctggtcctgctccagctgcttcagccgctgtttctgcttgtcgcggctcaggtggaaccagaacttcaacaccaccgcgccgtccagcgtcagcatgcgctcgaagcgcaggatgtcgaagatctgccggtcgaaggcgtcgcggtcgctgcgattgaacacccggtcgaacagggtgtcggaataataagagccgaaaaacatgccgatgcggcctttggccggcagctcgcgccagtagcgccacatccatggccgcgccctcgcctcgtcattgggtgcgtcgaaggccacggtgtggatcagccgcgggtccagccactcgttaatcagattcatcgtctcgccgcggccggcgccgtcgaaaccgtggatcaggatcaataccgggaagtcggccttttccttcaaatcgtactgcacatccagcaatgcctctcgcagcgagggcatcatcttgcgaaaggtttccttgtcgatgcggtggccgatctcggcggattcaaacatgcgtcaccatccttatccccttgcttagcttagttgcagtccccggtaggccacactgcgtagaactaccgagccttccacgattcaatgcccgcccagcaggccgtccaacgcgtccagcagcgcggcgcaaggcgcatcggcccatattccgccgccgccctccgcgcccatgccgcgcaaaaacaggtagcgcacgccaccgaagcggctgtcccaatcgacgccgcgcgcgcgcaggtagcgccgcagcgccaccaggtagatcaggtactgcagatagtagtgctcgcgcgccaccgcggcggccaggctgtcgccgcggtaatcgccgaactcgccgcccaggtggttggacttgtagtcgatcaggtagaagcgcccgcccatctcgcacaccaggtcaatgaaacccttgaggaaaccctgcacggcggcgaaatccagccccgccgccgcctggcgcagcggctccgccaggccgtgcgccgggtcctgcagcgccgcgatcagcgccgccacgtccagccgcgtcaccggcagcgtgaattccagttcgatcagccgcttaccgtccgccacctcgcgcaggcgcgcgcccggcgccagctccgcctccagcgtggaaacgatcagctcgcagccggcgtccagccattcctcgccgaagccatggcgcgccagcgccgtcgccaccgcctcgcggatggctgccggatcggcgccgaagctgatgcgctcgaagatttcgtgcaggcagatgccggccttggccccgcgcggaaaactgaagcggtcgcgcgccggcgcctcggtcggcgacgccggctcgggccgcggctcgcggtcgtggtctggcgcttcggccaggtggccgccggccgcgtgggtcagcgaggtgaagctggcgattttccacggcgtatacagtttgcgcgcaaacggccgcgcggcgtagcgacgctcggccgcctccgcagccgccagcgcgtgccagccctcgtcggccagcaccgccatcgcgccgccgcggccggcggcgaaagcgcgcagctggccctccacctccggaccatccagcttcaattgctccagcgcggccaggtccgccgcgcccggcgcgtgcagcagccaggacagcgccgcggtctgcatgtccttgacccagccccagcccaggtattgccggtactgcgcgcgggtcagcgccacgtacagcaagcgcagcttctccgccagcatctcgctgcgcgccgccagccgcacgccctcgttcgccaccacgtccggcgcgagccagggcgcgtcgccgcggtggtagctccagaagctggcgccgcgccgctccagcgcgccgtgccacaggaaggggcagaacaccaccgggtactgcaggcccttggaggtatgcacggtgacgatcttcaccagcgcggcgtcgctctccagccgcagcaccgcctcctcgccgcgcggcgggtcggccacccgcgcggcgaaccaggccagcagcggcgccatgccctggcggctttcgctttcctgctggatcagctcggccaggtggcccagattggtcagccggcgctcgccgtcgggaagcggcagcagccgcgccgccagctgttcgcgggcgaaataatggcgccaggcggccatgaagccgtgttcgcgccagcgctgatggtcgccggcgtttcgcagcagctccgcctcccaactggcttcgtcctccagccgcgccttcagttcggcggcatccaggccgcccagctcggtggccagcgccagccgcagccgcgactcgctggccggctctgcccaggcgtgcagcagcgccagcatctcgccggcttcgacgctggcgaacacgctctcctgggtcagcgccacgctggccacgccgcgttcgcgcagcgccagccggatccggtcgccctgcttgtgggtggccaccagcaccgcgatgtcgccgcccttcaagcgccggcgcgcatcgcccttgacgatggaagcgcggtcggcgactgccaggctcagcaagcgggcgatctcgttggcgcaggcgacggcggcggcctcctcggccgcctccttgctcaacgccttgtccccggcggccagccattgcgcgttgaacggcgcgcggtcgtcctccacctccaggcggccgccggatgaaggctgcgccgccaccggctggtaggcgatgccctcgatcaggaaaggcagctcgcggccgaacagcgcgttgacggtggacaccagcggcgcgtcggaacggcggttggtgtccagcgtgtaatggcgctcggcgtcgccgcgggcggccaggtaggcgaagatgtcggcaccgcggaagctgtagatcgcctgcttggggtcgccgaccaggaacaccggccgcgcctgctcgacgaagcagcggcggaagatcgcgtactgggtggggtcggtgtcctggaattcgtcgatcagcgccgcgctgaagctgcgcgccacctgggccgccagcagcgggccgctgtccggatgcgccagcgccgcgcccaggtcggtgagcaggtcgtcgaagctgcggctgcgctcgacgccgcgccgccgcgccagctcttcatcggcccaggcgatcagctccagcttgaggccggccagcgagttggccacctgcgccatatagccgtcccaggccgcgagccaggcgtcaacccgctcgaacaaagggtgggccggcggcgcgcaatccttcttcatgcccttggccagcgcctccggcctgagcttgtccagcgtcttgcggctgtcgctgtccagctccggcaggccgtccggctgcgccagccagccgcgcagcgccgccgccgcgcgttcgagaatggcggcgctgtagacattgcccttgtagccggcatgttcggcgaacagccgcagtccctcctccgccagctcgggttcggccgccagcgcctgccagcggctttgcgccagccgctgcgcggcctctaggccggcggcgtccggcgcctgcaagttgaggtagggcttggacagataggggcggatttccgccaaccactgctccggcgtggcgcgctgttccaccagcacctgcgccagcagcggcttcgacacgatgcggcggcgccagaagtcgtcgacgatctccaccagccggccggcgtcgtcctccatcagttcggcctggaaggtctggccgctttcgaaggccgcgtcggtcagcacccgctggcagaagccgtggatggtatagatggcggcggcgtcgaaaccggcgatggcggcggccagccgctgccgcgccagttcgcgcgcggcgccggcgggaaagcgcgcggccagcgcccgcaggaagtcgtcgcccccggccttgtcctcaagcgccgccagcatctcgcccagccggcggcgcaggcgttcgcgcaactcggcggtggcggccttggtgtaggtcaccaccagcagccggtctatcgtcggcggcggctggccgtcgctgtcctccaacagcagcctggcgaacagcgcggcgatggtccaggtcttgccggtgccggccgaggcctcgatcaggttgacgccgcccagcggacaattgagcgcgtccagcgccgtggcttccatcgtcgtcatcgctcttttccgcccaggcgctcggccagcggcaataacagggtttccgccagctgggcgaacagcgggtcgtccagcggctgttgatggcggaaggccagcgccagcgccggctcgtcgcgctgcgccatgccgccctccagcacgaagccgggttgccatttctgccaggcggcggccagcgccgcctcgcgcgcgtccggcgccttggccagcgcctcggcgtaggcccagctggtgcggccgaaaaagggcagcggctgcgcttggccctggcgccagcgcgccagccacggcgccagcaggccggcggcgtcgatctcatcggccagcgcggtgctgccggcgtcgtcgtaaaccgcgctgtggcaggcgatgcccgccggccgcgccgcgcacaggatcaggtgagtcagccacaattcgatgcgctgggcggcgttgagcttgccgacgatgaagctgagccggccctccggccgcagcccgtacagctcccccaccagggtgaagccgcccaggctcaggtgcaccggctgcggcggcagggtttcctccgccagcgcgcgcggcagtctgccggccagccgcacgctggcgcggccttcctcctgcagccaggcctggcccagctcgccgcagggcagcaggccggcggcggcggcccgctcgcgcagcggggcctgcggccggcggtgcagcatcgcctccaccaattgctggcgcagcgcccggctggcgtcggcctccatgctgaacggctcgcgcgcggccagctcgtcctcgcggccggacagccggatcgccagccgctcggccagccaggcgcgcggcggatgtttccagaaacggatgaaatcgtgcaggttgagcacgctggccggctcctccggcggcagcggcgcgaggaagggccgcggctcggcctgcggcgccgccagcgcggcggcgaaggccggctcgaagctggccagccgcgcgtcggcgccgtcataggcttgcggcgcgaacggctgcagcggatggcgcagcgtcagcctggcggccaggtcctcgccgcacatcgccgacaggctatccatcaactccgccaccagcggcgacggcggcagcgtttcgccgctgcgcgccgactggccgacataagacaggtacagcgtctgccgcgccgacagaatggcttccaggaacaggtagcggtcgtcgaagcggcgcgagcggtcgccgcggcgcgggtggcgcgccaccaggtcgaagctgaccgggcgctcgtcgcgcgggtaggcgccgtcgttcatgccgatcaggcacagcgccttgaaggggatggagcgcatcggcaccatcgcgcagaaagtgacgccgccggacaggaagccctgcgccgaggccacgcccagctggcgcagcagccagtcgcgcgccaccggcaagcccaccgcggcgtcgaagccggccagctcggcgtcttcggccagttcggcgaagacgccgcgcagcgtctccagcgcggcctcgtcgtcgccatcggccaggaacagccgctcgcaggcctggtgcaggcgctcggcccattgccgcggcgaagccggggcttgccattcgcgcgccagcgcgtccagcgcgtcgtagcagttggcgaaacgcgccagcgcctcgcccaactgcccctgcgcgccgccgtggggcagcagcccggcgaacaggccggcggcgtcgccggccagcgccggcggcagcaccgtgcccagcagcagcctatccagcccccagcgccaggtgtagagcgggtcggccggcaggcccagctgcgccttgtgcccggcgtcgcgaccccagcggatgccggcgtcgcgcacccagtcctggatgaagggcagatcggcttcggagaggtcgaaacgcgccagcagcgccgggctgtccagcaatgccagcaccgcgtcggcggcgaagcgcgaatcggccagccgcagcaccgcggcgaaggtggacagcagcggctgttcgcgctccacccggcggtcggcgatgctgtaggggatattgggggcgtcgtcgcggcggccgaacaccgcgtcgatatacggcgcgtagcggttgatgtccggcgtcagcaccgccacgtcggccgggctgagcttggggtcgtcggcgaacatcgccaacagccggtccttcaatacctccagctcgcgcatcggaccgtggcaggcgtgcagctgcaccgagtgatcgtccgccgccatcggcgctggcgcggcggccgggtcgttcagctccaggatatcgcgctgcagccgcgccagcaggctgcttcccttgggcgcggcgaacagcggcttggcgtccagctcggcgtcctcggcgatcagctcgaagaaatcgcgcccctgcttgcccagcgaggccagcagcgggtggccttcgctggcgaacaggtcgccggcctggcgcagcctgagcttgcggcgggcgtcgacgatgtcgccccagtaggcctcgcagggattgagggtgaacaggcagacgtcggtcagttcggacagccgcttgaccagcgccaggtacatcggcgccaggctggcgatgccgaacagcgtcacccgcgccggcaggtgctcgcttttgagctgggagaagaattcgtccagcatccgtacccggtggcggccggggtcgctctcggccagccgacgccacagcgccgcctgccaggcttcgtcctcgcccaggcccagcagcgcgccgctctcccaggcccggatccagtcggggcggaacaccaggtattggtcgaaaatgtcggcgatcttgccggccagctcgaaagctgcgctctcgccgccttccaagtaatggcgcaccgggccgaagggctcgccgtccagcgtcggcagcagcgccagcagccgccaggccagcacttcgggcacgaaggcggatttcctcggcaaatccggcatcaccttctgcatcagccgccaggcgaaggccgccggcagcacgaaatcgacattggccgccaccccggccttgcgcgccaggtccagcgtgatccagcgccccatgccgcggctttgcacgatcaccgtctccgccgcgaacgggtcggcgagcggcatcgcctgggtcatgccgcagaacagctcgcccagttgctccagacggttggattggtagagaaacagcatggaaggtggcggcagtcatcggatgcggatatggcccgattgtagcatcgcgcgccgcccgcgcccgcatcgcatcgctggcggcccttccatgccatcgggcttgccgcttgacggccatcaatgcccgcccgcgccggaaagcattcaataggcggatggaaatgccaaagtcatatccaatgcgcggcagctcagccgcctcggctataaatcgccgccgccgccgtgtaccatggcgggcatcggcgccctcggcgcctccccgggctcctggccatgtatccgtacctgatcgtcaaacacgcccacatgggcttcgcctttctgtccatcctgctgttcgccgcccgcggcggactggtgctgagcggccggcaacacctgctggcgaccaagccgctgcgcattctgccgcacctgatcgacaccctgctgctggcctgcgccatcgcgctggtggtgatgggcggctggccgatactgcacagcccttggctgctggccaagatcgccggcctggtcgcctacatcgcgctgggcagcatcgcgctgcgctacggcgccacgcccaagacccgctggctggcctttgtcgccgcgctggcggtggtggcctacatcctgctggtggccgccaccaaaacggcgctgcccacgctgtaagcgccgccgcccttgactgtgcccgatgcgaacgctaggacacagtaggggcgcggcgtccgcgccggccatcccgcgccccgtcccggtaatcgacgtcggagcccgcggccagatgatttccccggcacgccccttccttccccgcgcgcgcggtttttcgctgctggaattgctgatcgcgctggcgctggccgcgctgatcgtcggcttcgccgtgcccggctaccaaagccatatgcagcgcagccggcgcggcgacgcgctggaggcgctgtaccagctgcagcaggcgcaactgcgctaccgcggcttccatcccggctacgccaagagcctggcggaactgaacaccccgttcggcaatggcatcagccgccagggctactaccagttgagcaccggcatcgtcgacgacgacgcctccggctatttcgtccaggccgccgtccgcgccggcggcgcccaggccggcgacggcgagtgccggcagatcgtcctcacccagcgcaagcacacgctgagcctgacgccgctgccctgctggggcaagcgatgagggcggccgcgcgtggcatcacgctgatcgagctgatgatggtgatcgtcctggcctcgctgctgctgacgctggcgctgccggcgctggggcgctggatcgccggccaacagctgcagggcgcgctggacgacgtaggcagccagctggagctggcgcgcaaaaccgccaccacccgccagcagcgggtgtgggtggagttcagccaggacggccccggctggatgatgcgagtgtcggagctgcgcgacggcaaaggctgcgagccgggccgcgacctgagctgcgtcggcagcgcccagcatgccggcatcgccctcagcctgccgggcaagccgctggcgctgaagctggccttctcgccgatgcgaggcctgccgcaaaaccccgacggcaccctgctgagcgaaaccgtgctgcagctgggccggccggcctgccgccccgcccggctgcgactcttggccaccgggctgatcagcagcgaggccggctcatgctcctgaaacctgcgcgcggcatcagcctgctggagctgctggtgggcatgaccgtcagcctgctgctgctgctggcgatatccagcctgctggccggcctgctgggcaaccaggcgcgcgaacggcgccaggccaggctgggcgcgatgatggacgcctcgctgtcgctgatggcgatggagctgcgccgcgccggctactggaacagcaatggcgaaaccggcgtcaatccctacggccgcatctatatcgagcaaaaaggcggctgcctgcgctacggctacgacaccccgccgggacagaccggcggcggccctcgctacttcgctttccggctaacaagcgacagcgccggccgcggccgcatccagcgccgcgcgtcgaacgcggccggctggagctgcgatgccgacgccgccggctgggacgacctgagcaaacccgacatcggcgtgatcgacacgctgcgcttccgccgggacggcgccggccaggccatcgcgctggaggtggcggcgcgcaccccgccgggcggcgaggaggaaacgctgaacatccacaccagcatcgcgctgcgcaaccatcccgcggtggaaaaccaatgaccgccccgcgccagcgcggcctggccacgctgttcaccgtgctgaccttgctggccatcgccagcctggcgctgatcgccgcttcgcgccagctgctgctggcccacgccaacgcgcagaaccagcaccgctaccaccaggcgctggattacgccgaagaagggctgaaccaggcgcaagcggcgctggccgccggcgcgccgctgctcgacacgccgcgctaccaactgaagcggaccgacatcgcgcctgacctggtgcgcctggccagcaccggcctgtacgatcagcaccgcgtcacggtgcagcgcatgctccgcctgggccgcgctggcggcgactccccggtggcgctggccatcgtcggcgatctcgacctcagcggcgcggtgaatctgctcagcgacaagccggtggacatgacggtggacggcaaggtcaggctcagcggctcggtcaacggcatcggcacgctgcaaagcaccggcgacatcttcgtcagcggcccgcagaccatcggcgcgctgcactccaacggcaatatcgagctggccaacggcagctacggaacggtgaaggcggcgggcgacctgacgctgcgcggcgacgccgccatcacccgattggcgcgggtcaacggcaacgcccgctttttctccagccccggcgcggagccggcggtgcgcgcggcagaagtgaagggcgacgtggaaatcaatatgggcggcgcccgcttcggccggctggacagcgaaggcaaggtggacatccgccagttcggcggcatggaggcgctgcaggcgctgggcgacctgagcatccagggttggggcgcgccgctggccggcgtcgtcgccggccgcgccaatttcaacgccaataatcccgacatccgcgtcaatcaggaccccaagctgcgcctgaaactggagccggtgccgctgctgcaggtgggccgtccgcgcatcgacgcgttcgacttcaaaaacgaagcgcattaccgcttcgagttcgaccgcgccggccgcatcctggtgacggtgcgcaagatacacggcctggccgacggcgcttaccggctggggctgtcgcccgacagccagctgcccaactacctgtgccgcgacgccgacagccagggccgctgccggagcggcgcgccggcgcaactgatctgcaagggccattcgccgcagaacgactgcttcgccggcagccgccccggccactggaagctggacggccagaccatggcgccgggcgtgctgtggttcgacggcgatctggaagtgggcagcggcgtctaccacaacagcttcctcgccagcggcgacatcgccaccagcggccagcatgtcagctacgcggtgaactacgccggcgcggtgggcgtctgccgcaacagcgacttccccgcgctctacccggaagacgattgccgccagggcctgttcaagggccggccgataggcaacgcggccctgctggccggcggctattccgccgggcgctaccagggcggcaacatcacgctgggcgcgtccagccagatccacggcaacgtttgggccggcaacatgctgttttccggcggcagcaccaccatacacggctacatcgccgccgcgctgcaaggcgccgcggcggcggagccgcaccgctggggcgccagcaccaccatagacctgcgcggcctgcccgaaaccttccagcccggcagccagcccggcgatccgggaagcggcggcaagcgcggggtggaggcgctgccctacagctggatggacagcggagccgactcgtgagcgcgcgccggcaccgcggcttcacgctgctggaaatgatgatcagcctgctggtgctggcggtcggcgcgctcggcctgctgcggctggagaccgagctgctgcacagccagatcgccgccaacgactacaactccgccaccaatctggcccaggccgcgctggagcagcagcatgtcggcagcggcgccgactgccgccgggcggacttcgccccggccgccgccagcggcacgctggcgcgcttccagtgccgcagccgcgtcgccagcggcacggtcagcgtcgacgtgcaatggcgggacagccagggcgatggcgaaaccctcagcctgagcgcgccgcagcatctggccggagactgagccggcgcgcttgacccagagcaagggccggcggcggcgcatctgctactgtcgccgcatttcctcaaccagcgacttcccatgcctgccagtcagcgactgccggaactggtgtgcccggcgggcagcctgcccgcgctgaaggccgccgtagacaacggcgccgacaccgtgtatttcggcctgaagaacgataccaacgcccgcaacttcgccgggctcaacttcgacgaccataccgcccgcatcggcatccgctacgcgcgcgagcgcggccgccaggtgctgatggcgatcaacacctatgcgcagggcggcgatatcagccgctggcagcgcgcggtggaccaggccgccgacctgggcgtcgacgcggtgatcctggccgacctcggcctgctggactacgcccgccgccgccatcccgcgctgcgcctgcacctgtcggtgcagggctcggccaccaatcacgaagccatccggctggcgcatgagctgttcggcatccgccgcgcggtgctaccgcgcgtgctgacgctggaacaggtgcgccaggtgatcgcgcgcagcgaggtcgaaatcgaggtgttcggcttcggcagcctgtgcgtgatggtggaaggccgctgcctgctgtccagctacgccaccggcgagtcgcccaattcccacggcgtctgctccccggccaaattcgtcgaatggcggcacacgccggccagcctggacgcccggctgtccggcatcctgatcgaccagtacggcccggaccagcctgccggctacccgacgctgtgcaagggccgcttcgcggtgcagggcgatacctattacgcgctggaagagcccaccagcctgaacgtgctggccatgctgccgcaactgctggatgccggcgtggccgccatcaaggtggaaggccgccaacgcagcccggcctatgtcgcccaggtcacccgcatcatgcgcgaggcgctggacgccgccggccgcgaacgccagcgcttcacgccgcagccggcctggcagcacggcctggccaaggtcgccgaagggcggcagcagacgctgggtgcctacgaccggccatggaaatgagcgcgcccatcatggaaaccgtcatgccccccctcccgttgaaactctcgctcggcccggtgctgtttttctggagccgcgacgagatcctgcgcttttacgccgaggccgccgaatggccgctggacgccatctatctgggcgaagtggtgtgcggccgccgccagcaactgcgcggccaggactggatcgcgctggccgccgacctcgccgccgccggccatgaagtggtgctgtcctgccaggcgctgatagagagcgaatccgacctcaagcggctggccagattggcggacaacggccagctcacgatcgaagccaacgacctgggcgcggcgcggctggccagcgagcgcaagctgcccttcgtcgccggccatcacctcaatatctacaacaccgacacgctggcgctgatgctccgcctgggcgcccgccgctggctgccgccggtggaaatgggccgcgacgcgctggcggccatcctggcagaagccgcgcgtcggcaactggacatcgaaaccgaggtgttcgcctggggccggctgccgctggcgctgtcctcgcgctgcttcaccgcccgccactacaacctcaacaaggacgactgccgcttccgctgcctggagcacccggacggcctgcggctagccacccgcgacggccagggctttctcgccatcaacggcacccagacgctgtccgacggctgccaggcgctgctgccgcacctccccgccatgccgcccctgggcgtggaccgggtgcggatcagcccgcaggcgcagggaaccgccgcggtggtcagcgtcttccgccgcatgctggacggccacggcgacgccgcggcgttgatggccgaactggccccgcaggcccccggcgcgccggtggacggctattggcgcggcctggccggcatccttcccctggagacttccgatgcgcatccctgaactgaccctgcccgcaggcgccgccgccctgctgtcgcggctgcccgccgcgccgcccgcctggctgctggccgccggcctcaaccagctgctccggcgcggcatcctgcctgccgatatggcgcagctggccggcaagcgtttccgcgtccggctggaagacgccgggctgcagctggacttccgcgccgatggggggcgctttcaccccagtcgcggcgagcccgacctcagcctggccgccaactgttgtgatttcgcgcgcatgctgctgcgggaggaagacccagacaccctgtttttccaccgcaaactgcgcatcgagggcgacaccgagctggggctgatcgtcaaaaacctgctggacagcatagattggagccagaccccgctggccggcatgatggccaactgaggccgccgcttgccccgggccgccggatggactagcaagaagcaagaccggcatcaaacttggggcgccatgaagcactggccgttcagcacgcggcgggtaaagatcgaactggcctgggtcgtgcttttcaatctgctcagcttcctgctgttcgtgcacttcgaactgttcgacaagctggacgactggttccacagccatccggacagcgcgctggacgaagtgctgctggtgggattcacgctggccatctccatgtcggtgttcgccgcgcgtcgcctgcgggaggcgctcatcctgctcaaggcgctgcggcgccaggccgagcgcgacgacatcaccggcttggccaaccgccgccgcgccaaccagatgctgcagcgggaaaccgaacgcagctaccgctccaatcggctgtattcggtgctgctgatcgacctcgaccacttcaagagcatcaacgacacccacggccaccagataggcgacgcggtgctgcagcgcttcggcaaggtgctgcagaagcgggcgcgccagctggacaccatcgcccgctggggcggcgaggaattcatcgtgatctgtccggaaaccgagcaacccggcgcgctgacgctggcggaaagcatccgccagctgctgaaggaaaccgacttcgcgccggtgccgcaggtcaccgccagcataggcgtggccacgctgtccgacgacgacaccccagacagcctggtgcaccgcgccgacatgtatctttacgccgccaagcaggccggccgcaaccgggtggtcggcgacgcccagaccgcctccgcgccgctgcaggcatgaaaaaagccggcgcagggccggcttcgtcagcttgaggttggttcaggccaccgtctgcagcagcgcgctgcgcttggcggacaaatccaggcccggcagatcggccatgatgtccggatggtcggccagcttttccaccacgaagtcgacgaacacccgcgtgcgcggcgcgatgtggtcgcggtgcgggaagcagatgtagatcgaccgctccagcgacaccatgtcggtcagcaccggctccagttcgccgctgcggatcaggtgcaccacctcgtggccgggcagctgcgccacccccatgcccaggcgggccagttcggccaccgcctccatgtcgttcagcgtgtaggtgccgttgacctccagcgggatgcgctcgcccttgcggtcgaactcccacttgaacagccggcccgaagtcggaaactggaagttgatgcagtcgtagccgcccaactcctccggcgacgacggccggccgtggcggtcccaatactccggcgacgccaccacgtatagcggcatctgcgccagattgcgcgccaccatccggctgtccggcatcatgccggtgcgcacgccgacatcgtagccgtcctcgatcaggtcgctgaaatggtcgtccaggccgaagaacaccctgaccttgggataacgctcgcaaaattcgcccatgatggggagaatgaagcggcggccgaaggagttcggcatgctgacccgcagatggccggccggctcgtcgcggctggccttcagctggttgatcgccgagtccagattgttgactgggccgcggcattgcgcgtagaaacggcgcccgtcctcggtcagcgtcaactgccgggtggtgcggttgaacaggcggacttcaagctcctgttccaggcgggcaatgctctggctgatggcggcgggcgagacgccgagcttgcgcgcggcgtccgagaagctgccgttttcggccgtggtcatgaagaccatgagtgcttttaaggtatccataagcggggcgattcctgaactggcgtgtatgcctgcgcgtatccgggcatggccggagggcggcaagcacaaccgtccgcagaattatatgtattttctttaaaaagattacatcaattctgtacagtattaaaggatatatttaaacaaaccgtgatcaaaaactccggtcgcaccatctgcaaatcccacatccccggtccgccatcccgatctgtcgcgcagaccggcctcagaccctgctttatcgatattttatgcgatgcaattatgcgcttttaagcgtttgcttgccagaatttattagcctttgcttacaatttatgccagttgcgttgcacggcatgcgacaataatggaaattgcactgaataagcgcgtttgcagcccctcatctggaacaaagttcaacatctgaaatcacaatcacaacggctcgcggcttctcagccgcggccccgcaacctgtccccagatgcctcttccaggccgaaactcatccaaaaagtcaaatcatttactccattcgcatgtttccatttgtaacggatgaatttatgacaaataaaatgatgaattatcagtaattttcctaggatttttacggctgcaagtttggtatactcaatgacgaaaaaaaacaacaattcaaatgacttctgatgagcccggtcttacatgcaaggagcatgtaagctactatctgcgtgtgtaaacccacaagaccaaggaagactcgctcatggtgatctcgaaacccatcaacgcaagaccgctcccggccggcctgaccgcgtcgcagcaatggactttgctggagtggatccacatggccggtcacatcgagaccgagaacgaactcaaggccttccttgatcaggtgttgtcccaagccccttccgagcggctgctgctggccttgggccgcctcaacaaccagaaccagatccagcggctggaacgcgtgctgaacgtcagctaccccagcgactggctggaccagtacatgaaggaaaacaacgcccagcatgacccgatactgcgaatccatctcggccagggaccggtcatgtgggaagaacgcttcaaccgcgcgaaaggcgccgaggaaaagcgcttcatcgccgaagccacccaaaacggcatgggcagcggcatcaccttcagcgccgcgtcggaacgcaacaacatcggcagcatcctgtccatcgccggacgcgagcccggccgcaacgccgcgctggtcgccatgctcaactgcctgacgccccatctgcaccaggcggcgatccgcgtcgccaacctgccgccggcctcgcccagcaacatgccgctatcccagcgcgaatacgacattttccactggatgagccgcggcaaaaccaactgggaaatcgccaccatcctggacatcagcgaaaggacggtgaagtttcacgtcgccaacgtgatacgcaagctcaatgcgaataatcgtactcacgccattgtgctgggcatgcatctggcaatgccaccctcgaccgtagcgaacgaatgacctcgccgcggatctggccccagtcgaaatagccggccatggacagcactccgccgtcaagcggtcgcgggacccccacgggccggatggggaaaccaagcgcgaccagccggcggtacatagacggctctaccacgaaatacatccagcggatctcgttccactccgcccattgccacaagctgagatacagcaatcgggaagcggaagcggtcagtttcctgcccagcgtttccgtgtccaccgcgaaacgcgagatctccgcgcttgccccccctttgtacaaaatctcgtccggcaccaatagcctggaaaagtccttttccaacatataacgctcggttcccggagtaaacctgaccgaccccaccacctggccatccaggcagatcgccagattatcggaaatggcgtcgtattcatccctatccaagccattgccgcacaccggcagccaacgcagattctcccggaaaatcttgtgtctgaacgccagcaggtcgagcatcgtgctttcgtcttcgacccggtccaacaccaaaccatccaattgcaacgagtagaactttttcactcaagcctcctaattttggttgtccgtcaggcaggagcaaatgtaaaactagtacgaaagaactgaatctgtcctatcggacagttattgccctattaaataaatctataaatattaaatttgccaaaatatccccctagtgattccgctctctagccggccgatgccgcagcaggcgtaaatcccccgcaatggctgtcccgcagcgttttttttgttacatttagttctttgcctacggcagggccatgaccgccttcactagctgcaatcccgccaccggagaagtctccttcacccgccccgcctggagcgaaaccaccctggcacacagccaggccgcgctgcgccgggcccagcaaacttgggcgcgcatgacggtggaccagcgcgccgaccaactgctgcacttcgccgaccggctatcgctccagcgcgaggccctggccgagctcgtcacccaggaagtgggcaagcgcacgcccgagtgcctggctgaaatcgacaagtccgtgcaattagtgcgttattacgccgaattggcgccatctttgctcaagtcccagctgattcccacccaggccagccgcagcggcgtggcgtttgagccgctggggctggtgcttgccgtgatgccgtggaactacccggtatggcaggtattgcgcttcgcgattcccgcgctgatggccggcaatgcctgcctggtcaaacccgccccctcggtgccgcaatgcagccagctgttgctggatatcgcgcgcgaagccggcctgtcggtgctggagatggcctggattgaaccagacctggtggaagaggcgatacgcggctgcgatgccgtcgccttcaccggctccacccacaccggccgcgtcatcgccgcgctggcaggcaagcatctgaagaaaaccgtgctggaactgggcggcagcaatcctttcatcgtgctggccgacgccgatatcgccgccgccgcgcgcgatgccgccaactcccgtttccgcgacgcaggccagagctgcaacgccgccaagcggatgatcgtggtgccggaagtcgccgaagcgtttgtcgaagccttctgcgccgcagctgcccaactccgcgccggcgatccgcacgaccccgccaccacgctgtcgccgctgacccgcgccgaccttcgcgaagcgctgcacgcgcaggtgttggatgcctgcgcgcatggggcggaactgaaactaggcggccagatgccgcataccccgggcttcttctacccggccacggtgctagaccatgtcaacccatcctgccgcgtctatcacgaggaagtcttcggtccggtggccagcattctgcgcgcccgcgacgaagccgatgcgctgcgcctggccaacgacacgcctttcggcctgggcgccagcatctacagcgccgacagcgagcgcgcctggcaattggcccgccagatagaagccggcagcgtattcatcaaccgccacaccagttcggacctgcgcctgccattcggcggcgtcaaggcctcaggctatggccgggaattgtccgaattcggcctatatgaattcgtcaacgtgaaaacctactggcagaaatagccggcaagaaaaaaaggggctcaaggcccctttttcatatgctgccgctagtgcagccgcgccacgttttgcgacagcggcacgccggcctcgcgcaggcagtcggacaaatccttccagcaggcgtcacggtccggcgccacatcgggcaccagcagccacggcacccgcgccgcgatctcttcgctgcccttcacccgcagcgccacttcgtagccctggatttccggctggtattcggccaccgcctccagcttgtctatgccgccctggctggtggccagcaaggccgccgacacgcccaggcgcttgcggttccacgcgtgcatgccgctggccaaggcatcccaccacggcagcggcgcgaacagctcggcctcgccgtattccatttcggcggcgatcgcctgctgcaccagcggcatcgacgcgtccagcgccttgcgcgccaagcgccgcgcccggtccggcggcagcgcgccgcgctccaccaggaagggaatccaggccatcaccaattgcggctcgctggtcttgcgcgcagcctcgtaggtggcgcgcgaagcttcgggattcagcggcgcgaaatcgcagccggcatccatgatgggcgccagttgcaccatgtcctggcaggcgcgctcattgagcatgtccacggtgaacaaggtgggcgaaatccacaatatcgatttctccggcacttccagcgcgtcggccagcgccacctccagctgctccagccgcgggaaatgccaccacacgccgccttggctgcgcgaaaacgcgaacggcagcgcccacagctcgaacgacaccacggtgccatcctggcggatcacctcggggaaggccaccgcgtcgcgcgcgctgtccaccagcagctggcgcgcagccggctcggccagcaaggaaagctgcgcctcggtgaacaccgcctggtcgccggccatcaaggccatctgcaccgcggcggccaattgcatgccttccatcggcttgcccaccgcctggcgcgccttgtccaccaactggctgatagcctgctggcgctcggccggcggcaagggcttggtcgggccggtgcgcatctcgcgcggctccgggccggcggcgtcgcgctcggcgtaagccttgtgcagcttctggtaggtccgcatcgcctcgtcgcagatttcctgcaactcaccgacgctgggctcgatctcgccatagaaattgaaatcgaacaggcgcaagcgcagattgcagacatagacggtcaggttctccgcctcatcgaacaataccgcgctcgccaagccgtcgcgttcgcggccggggaagtcggtatcgtcattgcccaccagcctgcagatgaaggcgggggactcggtatgcaccaggtactcggcgccttccaacccttgctcatcgacggcgtcgccgaaaatgaagcggttgggcaggaaaggctctccccggatacgggcattgcgcggcaaagatttcatcaggcgacactatcaacggttacaggcacccattgtagcgccgcccaccgccggcatgaagcccgcggcgcgatttcgctcctgcattgcaacaatctgcgccagagtgcaacgttgcgcgccgccgccgtcaaaattgtcctcccgcagccaggccgccagcgccgcccgacgcgccggccattcctggtcgatgatggaaaaacaggcggcgtcgcggttgcgccccttagccacccgccgctgccgccacaaggcctcaaacgtgaagcccagccgcagggccgcgcgcagcgaagcctggttctgcgcgtcgcagcgccattcgcaacggcgatagcccagttcgaaaacatgccgcagcatcaggtagatcgcctcggtcgccagccggctgcgccgcaggcgcgcggagaaatgcaagccgcccagctcgatgcagccatccgccggcgcaatgccgagaaaaccggccaggccaagcgcctgcccatcccccgcatcgacaatcgcgtagtaacgggcgtcgacgcgcgccggctgcccgcgcagccaggccagccaatcctcgaggcaggcgaacggcccctggttcagataggtccagccggccgcctcctcgctccggcacaaagcatcgaacaaatcccggccatggcgcgccgcatccagcggcgccagccggcagtaacggccagccagggtgccgcccggcagaggcgcggcgcccgcccaatccggcagcggcaagccaaccgccagccccagcgcattccgcttccgggctgccgacagctcccgccactcggcccgcggccaggcctgcgcgttcatgcgccgccgccagcggcgatgtcggccaaagactgacgctgccggccctgctcatcgaaattgtccgcagccagccaacgctccagcgcctgtcgccgcgccggccattcgtggtccaggatggagaaccaggcggtatcgcgattgcggcccttattggtccgcgcctggcggaacagcccctcgaaagtgaagcccagccgcagggcggcctggatagacggctcgttctgcgcgtcgcacttccattcgtagcggcggtagccgagcgcgaacgcttcgcgcatcatcagatacatcgcctcggtcgcttgccggctgcgctgcagccgcggcgagaaattgagaaaccccacctcgatgcagccatcggccggggcgatgcgcagatagctggccaggcccaccgccacgccgtcggccgaatcgacgatggcgtaaaactgcggatcgtcgcgttcgacgttgtcgcccaaccacgccagccagtcctcgaagaccaagaatggtccatggccaagataagtccagttggcgccgcccggcatctggtgcaaggcatcgaacaactggccggcatgcttggccgcatccagcggctccacccggcagcaagcgccggccagcgtgcgccgcggcggatgcaaggcgccatcccagccaggcaccggcaaacccaccgactgccccagcgcattgagctcggccggctgcatcaattggcgcgcatcagcaagcatcgcacacctccttgccgcaaccggcgtcccgggttgtggcgtagccgtcccgtttccaccagtccagcccgccctgcagctccttcaccttgaagcccagttgcgacagcttcagcgcgcccttggtggagccattgcagccgatgccgtcgcagaaagccaccagcgtcgcatcgcgcggcagatcggcgcagctctcctcggtcatcaggcggtgcgggcggctgagcgcgccgggtatcgtttcctcggcatgcgcgccggcgctgcgggtatcgatcagcaccaaggatggatcgccgctggccagcgcctgcgccacgtcggcggcatcgatctcatacgccagcttggcggcgtaaaacgcttgttgactcaacatgctgctgtctccttttccagatagcaatgctgatatgctacggagaaagtcatcatccaaacagctccactttcattcactggatagaaccactttgaactccgcctggatctgcgagtacctgcagccgcgcttgcgccgcgatggcggcgaccatctggcgcgccagctctatcggctgctgcgcgaactgatacgccagcgcaaactggccagcggcagcgcgctgccggcaagccgggcgctggccgccgatctggcgatcggccgcaataccgtactggcagcctacgatcagctggccgccgaaggttatctggaaagccgccatggctcaggcacctatgttggccaagccttcagcgccgctgccattcccctcgcgcagccccgcactcaaatgaggcaactatcggcgcgcggccaacgcctagccgaagccagccggctgcccaccggccgcctgggcgccttcgtgcccggcctgccggaactggagcagtttccgcatcggcaatggcggcaatgcctaagccggcggcaaagacaggcgccgctggaatggctgcattaccagcatcagggcggcttgccccagttgcgccgagtcctgagccaatacctgcacctgacccgctcggtcaactgcagcccggagcagctggtgatcacctcaggcgcgcaaaacgctttgacccttttagcccaattgctggccgagcccggcgacaccgcctggctggaagagcccggctacaccggcgcgcaggccgccatgcaggcggcggcgctgcactgccagccggtgccggttgacccacagggaatggtgctggatagcgccgcgccgccgccgcagctgatctacgtcaccccctcgcatcaatatccgaccggcgcggtgatgagcctgccgcgccggctggagttgctggcgctggcggcccgccacgacagctggatcatcgaagacgattacgacagcgaattctgctacacctccgcgccgctggccgcgctgcaagggctggatcaggacaagcgggtgatttatgtcggcaccttcagcaaggtgatgtttcccggcctgaagctcgcctatctggtgttgccgccggagctggtcgacccgtaccggcgctgccaggccagactgcagggcgaaagcaattatctgcagcaggccgccgtcgccgatttcatcgagcaaggccacttcgcgcgccacatccgcaatatgcgcgaactctatctgcgccggcagcagctgctgcgcctcgcgctgcaacagcatctgggcgacgcgctgcctctgcatggcggcgaagccggcatgcacctgttggcggatctgccacgggggttcgacgaatgggaattgcagcaggcggcggcagaacaacagctatggctgcgcccgctggcgcgccacttcctggaaatgcccgaccgcaacggcctggtgctgggctatgccggcatcgccgaccacaccatccacccggccgtgcgccaattggcagcgttattggagacaagactgaaatgaaaaaaccgcgcctgctggtcagcgcctgcctgctggggcagccagtccgttacgatggccaggccaaagccatggcccgctccgactgggaagccctgcgccagcgcttcgagatcgtcccggcctgtcccgaatgcctgggcggcctgccgacaccacggccaccggccgaaatccgtcatggcgatggcaccgcggtgttgcaagggctcgccagcgttcagacccgacagggccaggatgtcagccaggctttcgtaaacggcgctcgacgcgcgctggagatcgcgcgccgacaaggctgccaagccgccctcctcaaagccaacagcccatcctgcggcaaccttcagatctatgatggcagctttgccgccgtactaagcgacggccaaggcgtggccgccagcctgctggaacagcacggcatccgcgtctggaacgaaacccaaatgggagacttgcttgcatggcaggcaggcggctctctttccgcgccttgaagtcctccgaaccacctcccaatacaagcccgccaggcgcctggcgggcagcgggatgcgccccctcgcggggactggcggatgggcagcggcgacggacggtcgccgcgggggaacggggagaggacggcaaggccgaaacggcgccgctccacgggcggggcagaaacgcagaaaccccagctcatcgagctggggttctgtatggggcgtctggcggtgtcctactttcacatggcgaatgccacactatcatcggcgctaaggcgtttcacggtcctgttcgggatgggaaggcgtgggaccacctcgctatggccaccagacataaactgtacaaacttaaagaagcccgaacccgtctctcagacagattcgcatatattcggtattcgtacatcaaataccgaatatatgcgaatctgtctgagagacgggttcgggcttctttaagtttgtacagtttatgtctggtggccatagcgaggtggtcccacgccttcccatcccgaacaggaccgtgaaacgccttagcgccgatgatagtgtggcattcgccatgtgaaagtaggacaccgccagacgccccatacagaaccccagctcgatgagctggggtttctgcgtttcnccgccatgctggagagcggtttgcgcaagcatcgggcgcggccggaggagctgttgctggcggccgcgctgttggcggcttgccgctggtcgggcgagagggcgcttactctgcggctggcgcaagatggccgcgcggccgacgccgagctggcggccacggtcggccagttcgatgtcgaacgcggtttgacgctggcgctggcggccggcgagcttgcgccgggggcggcgatcctggcggccaaggaaggctgccgcgcgcagacccaagagctgggcgacgctggccgaaccgcgcgcctggcattccgttacgacggcgatttcgacgcgccggcagcggcgcgcgccggcatcgcgcggctggcgctgccgaacgacgatgacgacgccggcgggccgccgttgcggctgcgcggcgagcggcgcgacggctgcttgcggctgacgctgagctgccgcgcggcggccgtgccggcgcaagggctggacgtgctggcggcgcggctggacgaggcgctgcgcgagctggcggagcactgcgccgacccggcgcaagccgccagcctgagtccgtccgacttccccggcctgggcctgacggcggccgaactggccggctggcggcaacgctttccggcgctggagcagttgagcccggccaccggcatgcagatcggcatggttttccacagccagttgcccggccatgccgacgcttataccaaccaggcctatctgaccctggagggcgagctggatgccggctggttccgcgaggcttggcgcatcgtcatcgaacgccacccggcgctgcgcgccggcttcgtcggtttcgagcgcgagcagccgctgcagctggcggtggcggcgccggcgctggactggcgcgaggaagacctccgcgggcaggcgccggacgcgttcgagcgctggcgccaggccgatcgccagacgccgttcgatttcgggcggccgccgttgatgcgcttcctgctggcgcgggtgggcgagcaaagccaccgtttttgctggacccatcaccacagcatcatcgacggctggagcgtgacgctggtgtgggacgaggtgttcgaggcttaccgcgccttgcgggcagggcaggaaccggcgctgccgccggcgccgtctttcgccgaggcggcgttctggcggcatggccagccgcgggaagagggcttgcgctactggcgcgagacgctggccggcatcggcccgcgcgcggcgctgcggatagagcagccgggcctgccgccgctgggcggcgaggcgtccaagtcgcggcgccggctgagcgagcaggcgacccgccggctgacggagatggcgcgcgccggccagacgacgctggccgcgacgatgcaggcggcctgggcgttgctgctggcgcattacagcggccagtccgacgtggttttcggcgtgacttcggcggggcggaccatcgatctgcccggcgtcgagcgcatcgtcgggccgctgatcaacaccgtgcccgcccgatttgcgctagaccccggcgccaggctgggtgactggctgcggaccgtgcgcgacatgcatctgctgcgcgaccggcatgccagcatcgacctgatcgacatccagcgccagagcggcctgcgcgccgaccagccgctgttcgacagcgtggtgattgtagacaactacccggccgccgattacggcgcggcgacggccctgcgcgtatcggaacgcggctacgccggagaaacccattacgggctcaccttgtcggtaatgcccggggcgcggctggccttcgacattgaatttgactcatcgcggtttcacaaaaaggacattgacgccatggccgataaactcgaatcggtgcttacccgcatgccccagaacctggccgagccgctgagcgcggcggtcggcgccgccgcgcgcgccgaagccgcaagcgacgccgccggcctcagcatggcgcggcgccagggcgacctgcggctgggacgggatctggtgccgcatctggtggaaaaccacgcccaggacacgccggagcagatcgcgctgatctgcaacgagcgcagctacagctacgaacagttgaaccgcgccgccaaccggctggccaatcacctgctggagcagtttccgcagttgggcgcggacagcctggtgggcgtgcgcatcccgcgcggggacaagctggtcatcgccatcctggccttgtggaaggccggcgccgcctatatcccgctcgaccccgtcctgccggcgcagcgggtgcgggacatgctggaaaccgccggcgcggcgttcgtgatcgccgacagcgtcgaggcggctgccgacaacgccgccgcgctgggtatgcgcgcggtgtcttacgacgccgtcgaacagttgccgggactggacgagcgcaatccggatgtgcacatctccggcaacgacctgagctacgtgctgtacacctcgggctccaccggcaagcccaagggggcgatggtcgagcatatcggcatgctcaacaacatcgtcaacaaggcgatcgactgcaaggtgaccgaatccagccgggtggcgcagaacgcgtcgatgagtttcgacgtgtcggtctggcagatgttcatcgcgctggcgcgcggcggcgccaccgtggtgtacgacgatcgcgcggtcaacgatgtcgccggcctgctggcgcggctcgccgccgaccgggtcaccgtgctggaagtggtgccgacctatctgtcggtgctggtcgagcatatcgaggacaagcacccgggtgggctggcgctgagcgtccagtaccttttggtgaccggcgagacgatagaggcgtcgctgctcaagcgctggttcaagctgttcccgcacactcacgcggtgaacgcctatgggccgaccgaggcgtcggacgacatcacccatcacctgatgtcggcgggcgatgcgctggagaatccggtgccgatcggccgcgcgctggccaacttcgacgtgtacatcgtcgacgacgaattgcggccgctgccgtacggcgagatgggtgaaatcgtcgtcaccggcgtcggcgtcggccgcggctacgtcggcatggccggcgccaccgcgcaggccttcctggacagcccattcccggacaagtaccgcggccggctgtacaaaaccggcgacctgggcgtgatgcggccggacggcgtgctgctttatcacggccgcaaggacaagcaggtcaagatccgcggcatgcgcatcgagctggaagacgtggagctggcgctgcaggccttgccggcggtgcggcaggcggcggtgctggaaatccgcccggcggggcgcgaggctttcctgtgcgccttcgcggtggcgcgcgccgacggcgagcgcgaagccatcgtcgccgaactgaaggaaaaactgccgccctatatggtgccgtcggtcttccgctttgaaagcgagctgccgcagctgcccagcggcaagatagaccgccgcgcgctgctggccggttacgaagagacggcgccgcgcgccgcctgcgtcgagccgaccaacgaggtcgagcgccggctggcggatatctggcgcgaggtgatcggcagccaggccataggcatcagcgacgacttcttcgatgtcggcggcgactccttcaaggcgatccgcatcgcggccaagtacggcgcgccgctggaggtcacccatctttacgactacccgacgatagcggcactggccgaacatctggccgggctggacggcgacgcgcaaaagacgctgacgccgatcgccggcgatccggtgcaagccgaggcgatgctgctgtgcatcgccaattcgggcggcggaccggtcagcttcatcgagatgggccgggcattctccgccgctggcgtgccgttggcggcatgcgcggtgaacctgccgcgcaacgaggtggacgacgatgccgcgatggtggcggaggtggagcggctggcggcggaggtctgcgacgaattgggccggatgtcgtctttgccgctgatggtgttcgcgcagtgcaacggttcggcgctggcgctcggcgtcgtgcgcgaatggaagcggcgcggcgccgacctgcgcgcgctgtgcataggcggggccttgctgcgcaccgagccgacgccgaaggatgtgcgcagcgacgagcagatcgtggcctttctcggctccatcggctccacgctgccggccgaggccgacgagcgggcgttcttcctgcacgacttcagctacgactgccacatggcggacagctactacaaccacttggtgcgggagcgggccgctgaggccggcgagcgcatcggcgcgccggtgttctgcctggtgggcaccgaggaccccatcgtgtccggctacgccgagcgttatcgcgactggggcctgctctccgacgaggtgagcctgatcgagtatccgggcatcggccattacctgctgcgcgattgcccggccgaactggccgcctcgctggccgacatctggcgccgcgtcggcggcaaggaggcgagaaatggccgctgagctgccgaaactggcattcgtgcatattccccgcaccgccggcaccgcgttcggccatgctctggaccagctgtaccagggccgccggacggcgaagttctacgccgacgaggaggtcaaggtggccaatggcaagatcgaggccttctgccggctggatggcgcggacaagcagggcttcgatctgctgcgcggccatttcgtccacggcttcgacccggcgctgcgcggcttcgactacgtcgcgctgctgcgcgagccggtgcggcggctgatttcctattacttctacgcgctgaaggacaagcgcaactacctgcattcctatctgctgaagcggcggctgggcctggagcccttcctgctcagcgacgccagcatagacctggacaactaccaggtgcgggcgatatcgggcgcgcaattcgcctcggtgcgcgaaccggtgtcgcagcagcattgcgacgaagccaagcgcaagctggccgaggagttcgccgccttcggcttgaccgagcgcttcgacgagtcgatggcgcgcttcgcgcgcaagttcggctggaacttgccggcgcccggcaagatgaacgccggcagctacggccccgaactggagctgtcggccgcctgcagggagcgggtgctggagaagaatcgtttcgacgtcgagttgtaccagttcgcctgccgcctgttcgaggccggcggcgcggcggcggaacaggccgggatacccattgcacaggagaggacagaagatggctacgcttgaaattcgcccgctcagcggcaccataggcgcggaagtgcgcggctgcgacgtcagcctgacgccgtcgccggagttggccggcgaaatccgccgcgcgctgctgcaatacaaggtgctgctgttccgcggccagccggccttgtcgatggcgcggcagatcgccttcgcccaggctttcggcgagatcgagaccgagttcccgtcgttcgcgcccaaactggccgagaacccggaaatcacgctgttcgacagccgcaacggcagcggccgcgccgaaatgtggcataccgacctgacggtgtcggagacgccgaccgctttcggcgtgctgtgcgtgaaggagcgtccggcgcgcggcggcgacacgatgtgggcggattccgaggccgcctacgcctcgctgtcgcccggcatgcgcgcctttctggaaggccagcgcgcggtgcacgacatgtactcgccggagtacgccgcgcggccgggcggcaacaagcgcaccgatctcgacatgtcgcggatttcccgcgccgagcatccgctggtgcgggtccatccggaaaccggccgcaaatgcctgttcgtcaatcccttcttcacgtcccacatcgtcggcttcagttcggaagagagcgccaacatcctcaacttcctgtacgcccggatggagcggccggagttcatcgtccgctggcattggtcggaaggcgatgtcgcgatgtgggacaaccgctgcaccacccacgtggcggtcaacgactacggcgacgcgcatcggctggcgcagcgggtgtgcgtgaagggcgacgcgccgttcggcgtgggcgaagcccggcgcgccgcgctggaaacggcctgacggccggcggcgcagccgcggataaagagcggccgggcatcgcgccggccgcgtggttttcactcacttcaatatgggtagcaagatgtcgaaccaagcaggcgtggcagtcgttgacttcaatggatcgatattcctcgaatccagcaatgtgcgggcgcaggccaatcggttgaattggcgctccgaggtgttgatgggccgcaaccccgattgtttcaagggcaagcgcgtgctcgacctggccagccatgacggccgcttcatgcacgcggcgctcaagcacggcgccagcaaggtgataggggtggaggcgcgcgaagagcacgtgatccacgcgcgccacaatctgagccgcgccggacacgcgccggacagctaccaggtgctgtgcggcgacctggtcgagcacctgaagcagatcgagaccggttcggtggacaccgtgctgtgcttcggcgtgttcagccacctgatcgagcaggtggagatcattcgcgagatccgccgcatcgcgccgggcgccttcattctggacacctgggtggcgaaggagcagtggaacctgcgcgagcggctgcgcaaccacaaggtcaacctgtgggtgcgcgacacccagcagggcggcgaccgcggcctgtccttgctggcgcgcttcaagcggctgatggccagcgtgttgccggggccgggcagcaaggtgggcagcatggtgctgctgtacgaggacccgcaggcgccgggcgcgacggtgcgccccagcgggctgatggcctgggccaaccgctcggcgctggaaatgctgttcgagcactttggcctggagcatgcgcgggtggactggatggcgcagcgggtcagcgactggaccgacctggaagactaccgcaacggctcgcgcgagagctgggtggtgcggccgggacgccgcgcgtcctgaagcgtttgccgcgcccgccgggcgcggcgcttgaaagagcgatggcatgagaaagatatacctgcgccgcgtgagcggcgtgacgcatggcgagagcaccaggatggtgcggccggacgatttcgccagcgatatcgtcgccgcggtggatgcggcggcgcagatagaggacttcggccgctacctgccgctatgcgtggactggcgcgccgagcgcctgcgctacagccgctgggaggacgcgtcgccgctgtcggacgcgccgttcctgtaccagcggcagcgacggcaggcggccatgctggccgacatcccgttcgagcggctgcctgaactgggacaggccgaaggcatgacgccgaccttcatcttctcgatcggccgctgcggctccacgctgctgtccaggatgctggccgcggtcggcgagcaggcggtgtcggagccggacgcgctgaccaatatcgccctggtcgacaacgccgaacagggccggcaggcggccgaggcgggcgagctcatcgtgcgcagctgcgtcgaggcgttgcgccgcgcctgcggcccgtcgccggtgatcaagctgagggcggtgtgcaatctggcggcggcggcgtttgtccgcgcgctgcccaacgcccgctatgtgttcatgttccgcgggcgggaggactgggtgcgttcctattcgcgcgcgttcggcgacagcgcggccgagctggaggccctgctgcggcagtcggcgcaggcgtttcagcacctgcgcgcggccggggccgagccggagctggtgtggtacgaggacctgctggccgacccggccgccgcgctgcggcgcatcttgccgcaccgcgccgacctggcggcgttcgaggcgccattggcggaggccttgcgcgccgacgcgcagcaaggctccatcctggcgcgctcgacgctggcggcgcgcccggtggcggatggcatcgtcgaggagttcgaggatttgtggcggcagtcgcggccggagggcttgttgcgggaggcggggctcgcgcgcctgctgtgagggcgggccggcttggaagctggccggcggaaaagcaaaaagccagctcggagagctggctttttgactgcgctggtggcgaatcagggactcgaaccccggacctgcggattatgattccgtcgctctaaccgactgagctaattcgccgcgagaaaccgcttgcgcgttttctcatcaaactgtggtggcgaatcagggactcgaaccccggacctgcggattatgattccgtcgctctaaccgactgagctaattcgccacatttcgatgccttcgcaccgagacgcgaactatacttaggccccctcgggctgtcaagcgccttttgcgagattgtggcgaagcctcacagcgtgtagcagcggtcgccgcgggcgaagccctgccagtctatgtccacgcccttgccgaagcctatcgccttgaaggtttcgcccatttcctgcggcgacagcagccgctgcacggccttggccaccggcaggtaggccttgacgtcgttgggatccagccgctgcagcgcctcgacgatgccgcagttaagcaggaactgcgcctggctggcgtagcctatcaggtccagcccggcgtcgaggccgctttgcgcgaccgcgctgaagtcgacgtggcaggtcaggtccatcaggccgggcaggtagaacgggtcctgcaccgtgtggtggcggtagtggcccagcagcgtgcccatgctgcgctccgggtgatagtactcggacgcggcgtggccgtagtcgatcagcaggatggcgccgcggctcagcgcgccggccacggtggcgacgaaggcgcggttggccaggctgatttcggtttcgtagcgcggaatgtccggcaccagttgcgcggccagctcggccagccgggcgtcggcgaagtcgcggtcctcgtaggccagcgcgccgtcgcggacggtgacgccgcgctggcgcagccggcggctttcatcgcggaacaccatttcgcagggcatcgcgtccagcagctcattgccgatgacgacgccgtcgatcgcgtccggcaggcggctggcccattcgacgcggtcggccaggtgaggcagcgcggcgcggatgttttgccgttgccgctcgatcaggtccggcgacaggtctaggatcacgtatttttgcggcaggcagcccagcgcctccagctcggcgagcacgtctatcgccagcttgccggtgccagcgccgaattcgtagatcgcgccggcggtctgcggcagcagctcggccagctggcgcgccagcgcctggccgaacagcggcgtcagctccggcgcggtgatgaagtcgccggcctcgcccagcttgctgctgccggcggcgtaatagcccattcccgacgcgtacagcgccagttccatataatgcgaaaaaggtatccagccgccggcgtcggcgatggcctggctgatgcggccgctcagggcctggctgatggccagcgcctcggggctggcggcgggtagggtgctcatggtggtcgtcctgctacaatgtggcgcgattgtggtgcaaagcgccgcgcccgtgaagaggcaattctaaacgaggaaacaatgctgacagagcgacaacaagatgagcgcgtgattctggtcaccggcgccgcgcgccgggtgggggcgggcattgtcaggctgctgcatgcgcgcggcttgaggctggtattgcactaccgcggctcgcaggccgatgccgaggcgctggcggcggaattgaacgcggcgcggcctggcagcgccaagctggtccgggccgatctgctggacaccgcggcgctgccggagttggcggcgcgcgcgctggcggcgttcggccgcatcgacggcctggtcaacaacgcctccagcttttccccgaccgaggtcgggcggatagacgaggccgcctggcacgacttgatgggcagcaatttgaaggcgccgctgtttctcagccaggcgttggcgccggagctggcgcgccgcggcggcgccatcgtcggcatcgccgacatccatgcggagcggccgatggcgcgccacgtggtgtacaacctggccaaggccggccacgcccagttgatccgcagcctggcgatagagctggcgccggcggtgcgcgtcaacggcgtggcgccgggcgtcaacctgtggccggaagacgagacgtcgttcagcgccgaggcccgcgccaggatagaggaaaccatccctttgcggcgcgccggcgtgccggaagacatcgcccgggcggtggctttcttgctgctggacgcgacgtatgtcaccgggcagatcctggcggtggacggcggccgcggcatcgtgttgtgacggttttgcgccggcatggcttttgccggcgggaaacggtaaaatcgcctgtttttcaatttcttagccgtacccatgtccgaactgaacgccgcgctcgacgacaaggccaagaaggccgcgtttgaaggcaacaaactggccaagcgcctgcgccaccatgtcggtgacgccatcaatgatttcaacatgatcgaagagggcgaccgcgtgatggtctgcctgtcgggcggcaaggacagctacaccctgctcgacatcctgctgggcctgcagaagtccgcgccgatcgacttttccatcgtcgcggtcaacctcgaccagaagcagccgggcttccccgagcatgtgctgccggaatacctcaagtccatcggcgtcgaataccgcatcgtcgaggaagacacctattccatcgtcaagcgcctggtgccggaaggcaagaccacctgcagcctgtgctcgcgcctgcgccgcggcatcctgtaccgcgtggcggacgaactgggcgccaccaagatcgcgctgggccaccaccgcgacgacatcctgcacacgctgttcctgaacatgttctacggcggcaagctgaagtccatgccgcccaagctggtgtccgacgacggccgccacatggtgatccgcccgctggcctactgccgcgagaaggacatcgaacgttacgcccagctgcgcgaattcccgatcattccgtgcaatctgtgcggctcgcagcccaatctgcagcgccaggtggtgaaggagatggtcaacgactgggacaagcgtttccccggccgcgtcgagagcatgttccgcgcgctgcaaaacgtcgttccgtcgcatctggccgacaccaagctgtacgatttcgcgtccttgacgaccggcgacgcgccgttcgccggcggcgataccgccttcgacaaggaagagttccgcgatccggcgccgcacgaggacgacgcggccgaggccgcgcccaagaagcgcaccatcagcattctcgactcgcgcaagccggagggcagcggctgtggcgcgtagggcgctgcacccgttccgccgccgcgtgaggccggcggtggaggcgatgccggaggtggaaatctcggaagagggcaatatccgctcgctgcacctggggtcggaaaccatccaaagctcgatggatctggacgatccgccggagctggtgctcagctacagccgcgcgatgatgggtttcctgctgtggaacgacgatcccaagcatatcctgcagatcggcctgggcggtggatcgttcgcccgcttcatcgacgaatacctgccggacgcggtcagcgtggcggtggatatcaatccgcaggtgatcgcggtggcgcgcgccttcttccagttgccggaggagggcgatttcttcgagatcgtcgaggccgacggcgccgactatgtgaaaattttccgcggctccaccgacgccatcctggtcgacggtttcgacggcctgcagatcgtcgacgcgctgaccaccgaggacttcttcgaggactgcaagcgggccttgagccccaagggcgtgttcgtcaccaactggtggagcggcgacaagcgctatcaggctttcatcgagcgtttgttgaacgttttcgagggccgggtgatcgaactgcctgcggccacccatggcaatgtcgcggtgatcgccttccgccagagcccgagcctgacgcagtgggaggcgctgaaaaagcgcgccgacgagctggaatatcgcttcggcctggagttcggcgagttcgtcaaccgcatcaagcagaccaaccagcagaccgccggccacttgctgatctgagcggcgggcggagtccggcgcggaatcgtcgatgcggttacgtttgcttacccaaaaaccgcggcgacggagcgtataatggccagttgcgcgcgctttgggcgctgttgcgggcttaggctccggcggcggcgtcgccgggcggcatcgaagctggcgcagtaccgagttaccgggcggcagacgggcgtctgccgctcaagcttttacatcctgttgggacattcatcgtgatcaagcagcaactgctcaatcgtatcgcggacaaatccgctgtgatcggcatcgtgggcctgggctatgtcggcctgcccctgatgctgcgtttcgccgaagtcggctacaaggtgctgggtttcgacatcgaccagagcaaggtcgatgccctgatggccggcaaaagctatatcgagcacatttccgccgacagcatcgccaccgcgctggagcgcggcttcgaggccaccaccgacttcagccgcgtgccggaagccgataccctgatcctgtgcgtgccgacgccgctgaacaagtaccgcgagcccgacctcagcttcgtgctggacaccatggacagcctggtgccctacctgcgcgaaggccagctggtgtcgctggaatccaccacctacccgggcaccaccgacgaagagctgctgccgcggatggagtcgcgcggcctgaaggtcggcgacaacgccttcctggtgttctcgccggagcgcgaggatccgggcaacccgaacttcaccacccgcaccattcccaaggtgtgcggcggcgtgaccgaggcctgtcaggaaatcggcgtcgcgctctacagcgcggtgatcgacaaggtggtgccggtgtcgtccacccgcgccgccgaaatgaccaagctgctggagaacatccaccgcgcggtcaacatcggcctggtcaacgagatgaagatcgtcgccgacaagatgggcatcgacatccacgaagtgatccgcgccgcggccaccaagccgttcggcttcgtgccctactacccgggcccgggcctgggcggccactgcatcccgatcgacccgttctacctgacctggaaagcgcgcgaatacggcgtcaacacccgtttcatcgaactggccggcgaagtgaacagcaatatgcccgactacgtggtgtccaaggtggccgccgcgctgaaccagcgcaagaagtccatcaacggcagccgcgtgctggtgctgggcatcgcctacaagaagaacgtcgacgacatgcgcgagagcccgtcggtgttcctgatggaaaaactgcgcgacctgggcgccgaagtggcgtacagcgatccgcacgtgccggtgttcccgaagatgcgcgagcacaagttcgacctgaagagcgtggcgctgaatgccgaaaccgtggccggctacgactgcgtgctgctggccaccgaccacgacaagttcgactacgcgatgctgaaggccaacgcccagttgctggtggatagccgcggcaagtacctggagccggccgggcacatcgtcaaggcctgatccatgtggcagcgctttccccgtctgggcgcgtggctggcggcagtgggcggcatcgccctgctggccgcgctggcgctggcgccgctgatccgctattccaagaccctgctggtggcggaaacgccgcagcagcgcgccgactggatcgtggtgctgggcggggagagcgggcaaagggtaatcggcgcggcggaactgtttcatcagggccgcgcgccgttcgtgtttgtcagcggcgagggcgattgcaggctgatcgtcaagcggctggtgatggcgggcgtgccgcgctcgcgcatcggctacgagtgcctgtcgaaaagcacttaccagaacgcgcagttcacccggcattacctggccgcgcagcaacccaggcgcatcacgctggtgacctcgtggttccattcctggcgcgcgctggaaaccttccgccaggcctggcccggcgtggagtggggcatgcacgcggtgtaccccggcgacgacctgtaccacagcctggcgctcaatgaagccggcgcggtgctgtccgaatatttgaagatactggtgtattcagtacgttactggactttctgaatgttagtgactcctccgattaccgatcgcaagatccgcttcgccctggtgggctgcggccgcatcgccaacaaccacttcggctcgctggaaaagcacgccgaccgcgccgagctggtagacgtctgcgacatcgacccggccgcgctgcgggccgctgtcgagcgcaccggcgcccgcggccacgacaacctcaccgcgatgctggcgcagaccaacgccgacatcgtcattctcaccacgccgtccggcctgcacccgcgccagagcatcgagtgctcggaagccggcttccacgtgatgaccgaaaagccgatggccacccgctgggaagacggcctggaaatggtcaaggcggccgacaaggcgcagaagcacctgttcgtggtcaagcagaaccgccgcaacgacacgctgcagctgctcaagcgcgcgatgacggaaaagcgcttcggccgcatctacatggtcaacgtcaatgtgttctggacccgtccgcaggagtattacgacgcggccggctggcgcggcacctgggaattcgacggcggcgccttcatgaaccaggccagccactatgtcgacctgctggactggctgatcggcccggttgagagcgtgcaggcctacaccgccactttggcgcgcaatatcgaggtggaagacaccggcaccgtcagcgtcaagtggcgctccggcgcgctgggcagcatgaacgtcaccatgctgacctacccgaagaacctggaaggcagcatcaccatcctgggcgaaaagggctcggtgcgcgtgggcggcatggccgtcaacgaaatccagcactgggaattcgccgagccgcacgcgatggacgacgaaatcaagaacgccagctacgcgacgaccagcgtgtatggcttcggccacccgctgtactacgacaacgtgatcaagaccatgcgcggcgaagccacgccggaaaccgacggccgcgaaggcctgaagtcgctggagctgctgatcgcgatgtacctgtcggcgcgcgacggccgccgcgtcagcctgccgctggattattgatgatggcatccggccggcccgactgggccggccttgttacgtggatattggctagcgatggctgaagagaaaaaagaaccctggcttaactatttggcgctcaccacggtgatactcgcggtgtgcgccacgctgtcgaccttcaagggcggcggctattccacccgcagcgtcatcgcccaggcccaggcatcggaccagtgggcgtattaccaggccaagggcatcaagggcaatctgtacgagatggagcgcgaccggctgcagttcgagcgcgacaacctgccggcgggcgatgcgcagcgccggcgctacgatgcggccatcgaccaggcggccaagcgcgcggagcgctacagtgcagagcgcaaggcgattgaaaagagcgcccgccagctggaagacgagcgcaaccaggcgcagcgccagggcaagccgttcggcatggcagtgatcttcctgcaggtggcgatcctgatttcgtcgatcgccggcctgttcaagcgcaagcgcatctggctggcggcgctgccggtggccggcctcggcctggtgtatttcgccgacggctttttcctgtttttctgattagaggtttcgcaccatggaatacacggtccatagctccgccatcgtcgacgaaggcgcgcagatcggcgcgggcacccgcgtctggcactgggtccacatctgcggcggcgccaggatcggcgccggctgttcgttcggccagaacgtgttcgtcggcaacgacgtgctgatcggcgacaacgtcaaggtgcagaacaatgtgtcgatctacgacgcggtgacgctggaagacgacgtgttctgcggcccgtccatggtgttcaccaacgtcaacaatccgcgcagccacgtcaaccgcaagaacgaataccgccgcaccgtggtgaagaagggcgcgtcgatcggcgccaacgccaccatagtctgcggccacaccgtcggcgagtacgcgttcatcggcgccggggcggtggtgacgcgcgacgtgccggcctacgcgctgatggtgggcgcgccggccaagcgcatcggctggatgtgcggctgcggcgagcgcctgcccaacgacatcggcacccattcctgcgcgtcttgcggcatccattacgaagtcggcggcaatcactgcacgccggtgtgagttttgtccgggcggcccgcctggccgccctcatccgaatatcgagaagaccatgtccatccagtttattgatctgaaagcgcagtaccagcacctgaaggccgacatcgacgcgcgcatccacgcggtgctggaccacggccagtacatcatggggccggaagtgaaggaattggaggagcaactggcggcctacaccggcgccaagcacgccatcggcgtctgcgacggcaccaaggcgctgctgatcgcgatgatggcgctggacatcggtccgggcgacgaagtgatcaccacgccgttcaccttcatctccaccggcgagatgatcgcgctgttgggcgccaagccggtgttcgtcgatatcgacccgatcagctacaacctggacccgaacctgctggaagcggcgatcacgccggccacccgcgccatcatgccggtcagcctgtacggccaggccgccgatttcgccgccatcaacgccatcgccgccaagcatggcatcgcggtgatcgaggacggcgcgcaaagcttcggcgccagccagcatggcaagaagtcgggcaatctgtccaccatcgccaccaccagcttcttcccgagcaagccgctgggctgctacggcgacggcggcgcctgcttcaccaacgacgacgcgctggcgaagaagatgcgcgaaatccgcatccacggccaggaccgccgctaccaccacccgtccatcggcatcaacggccggctggacaccatccaggccgcggtgttgctggccaagatgcccagcttccccgacgaagtggccgcgcgcgagcgcatcggcgcgcgctacagccagctgttgaaggatgtggcccgggtgccggtggtcggcgcgggcaacacccacgtctacgcccaatacaccatagaagtggacgaccgcgacgcggtgcaggcgcgcttgaaagagctgggcgtgcccaccgccgtgcattacccgattccgctgcacctgcagccggctttcgcccacctggaccagggcgagggcagcttcccgctggccgaggccgccggcaagcgcgtgatgagcctgccgatgcatccgttcctgacggaagccgcgcaggacgccatcgtcgccgcggtgaagcaggcgctgggttgaggggatgctgacgctggcttccctgcgcatgcctaaaagcggcttcatccgccacatcatcaccctggtcaccggcgccgccgtggcccaggtggtgccgctgctggcgtcgccgctgatcacccggctgtacaacccgcacgaggtgggcatccagaccgtgtacgtgtcgtggatgtcgacgctggcggtgctggccaccgcccgttacgaaatggccatcgtgctgccggccgacgagaagcgcgccagcaacctgatgggcctgtccttgctgtgcgccagcgcgctggccctgctgatcggcctggtggtgctgctgggcgggcattcgcacatcgccgcccatctgggggcgccggagctggagtcctggctgctgttgctgccgctgtcggtatggctggccgggctgatgcaggcctggaccaactggaacaaccgccaccgccgctaccaggccaacgccaacggccgcatgacgcagtcgctgggcatggccggcacccaggtgctggccggctggctgggcgccggcgctggcgggttgatcctgggccagctggcggggcagctgggctcgctgctgtcgcaagcctgggccgacttcaagtcgcgcatgccctggcgccgcgagctcagccgccagggcatgcgcgaggccgccgccgcctatatcgagtttcccaagatcaacgcgccgcacgcgctgagcaccgcgatgctggattcggtcacgctggtggtgctggcgatgctggccagcacctcggccgtcggcttttacgggctgatgatgcgggtgctgaagctgccggcggcgctgatcggccaggcggtggcgcaggtggcctaccgcgagctggccgaggcgcggaacctgggcaagcccttgcgccccatcctgcgcaagatgatgctgacgctgtttggcatggcgctgtttcccttcctggtgatccagatcttcggcgagccgctgttcacgctggtgttcggccacaattgggccgacgccggccgctacgccgaggcgatgtcgctgtacatcctgttccacttcgtcgcctcgccgctgggcatggtgccgccggtgatcaatcgccagcgcttcgcgtttttcctgtccctggtgcaggccgtgctgttcctgggatcgctgtggctgggtttccacatctggcaggatgccgtacccactttccagctggtgtcggtggtgatggccggctatttcattgcatatttcacctggctttataaggcagctcgatgaactggaatggatttttcagccgcatccgctttcggctgtcggcgtgggtgcggccgcggatggtgtacggcttccagcgcggcgacggcgttttcctcaagcgcacccgcgtctccaacatgacgcggatcgaacatatcgacaagctgatggtcgaggacaatgtctatatcggccatttcaacctgatcgactcttccggcggcctttacatcggcgagggctgccagatcaccaactacgtgtctttgctgacccactccagccatgtcgccatccggctgtacggccgcgagtatctggaccgcgacaaccacgccggctacctgaaaaagcccaccaagcttggcaagtacagctttgtcggcccgcattcggtgctgatgccgggcgtgacgctgggcaagggcagcatcgtatcggcgtacagcttcgtgccggccggcgagtatccggatttcgccatcctggccggcaatccggcgcgggtggtcggcgatacccgcgacatggacgccgaatggctggcgcagcacccggacctgcatccgctgtacgaggcctgggccgatgagtgaagcgatacgccgcctgctggtggtgggctcggcctcggtgcatacctggcgcttcctcgccggcatcgcgccgcacgtgggcgaaatctacctggcctgcaacggcgagccgccggcggacaagtgcccggccaatctgaagggcgagctgcgcgtcgatttcagcctgaaggcgctgggaagcgccggcaagctcaaggcctggatccagcagatccagccggacgtggttcatgtccaccaggccaacagcgtggcctggcacgcgcgccgcgcgctggcgggctcggacgttccgacgctgctgaccgcctggggctcggacgtgctgctgctgccgcggcagaaccggctgctgcgcgcgatggtgcgcggcaacctccaggccgccgccgcggtgacgtcggattcgctgtacatggcggcgcaaatccgcgagctggccggcgactgccgcatcgcgctgctcaattacggcatagacgcgctgccgccggaacccgctgtcgccgccaagaaaaagcaggtgctgtcctgccggctgcacaagccgctgtaccggatagacgccatcctcaagggctgggccgaagtggagaggagcggccgctgcgccgactggaacctggtggtcgccgccagcggcggcgagaccgacaatttgaaacaactggcggcggcgctggggctcaagcgggtcgagttcgccggtttcgtcgacagcgccactctgggcaagctgtacgccgattcccgcgtgttcgtcagcgtgccgcgctccgacgccaccagcatcagcctgctggaggcgatgggccatggctgcctgccgctgctgtccaatctgccggccaacggcgaatgggtgatagacggcctcaacggcgccatcgccgaggacgtgagccggctggggccggaactgctgcgagcgatggcgcaagccgaagacgacgccgccctgcaaagcctggcggcgaccaatcgcggcctggtggcggccaaggcgctgcaccaggccaatatggccggtttcgccgatctgtaccgcgagctggccgccgacaagggtagaaaaatatgaagatagcccatctgacctccgcccatccgcgccacgacatccgcatcttcgtcaaggagtgcagctcgttggcggcggccggccatgaggtgaccttgatcgtcgccgacggccagggcgaggaaatccggggcggcgtgcgcatccacgacgtcggccccaagaccggcggacgcctgtcgcgaatgaccggcaccgtcaagcgcgtctaccaggccgcgttgaagctgcgtccggacgtggtgcatttccacgatccggagctgattccggccggcgtgcgcctgaagcaggccggcatcaaggtggtgtacgacgtgcacgaggatgtgccgcgccagattctggccaagcactggatacccggcgcggtgcgcccgctggtgtccggcggcttcgagacgctggaggactgggcggcgcgccgcttcgacgccatcgtcacctccaccccgcacatccgcaaacgcttcgagaagctgggggccaatgcgctggacgtgtgcaacttcccgatactggaagagctggtgcgcgacacgccgtgggaaagccgccgcaacgaggtgtgctatatcggcggcatcagccgcatccgcggcatcgaacccatcgtcgccgctttgccgggcaccgccacccggctgaacctggccgggccgtggagcgagagcgatctgcgcgccaaggtgcaggccgagcccggctgggcgcgggtcaacgacctgggcgtgctggaccgcaagggcgtggccgaggtgctggcgaaaagcaagatcggcctggtgaccttgttccccacgcccaactacgtcgacgcgctgccgatcaagctgtttgaatacatggccgccggcatgccggtgatcgccagcgacttcccggtgtggcgcgagatcgtcgacgacgccggctgcggcgtgctggtggacccgcaggacgccgcagccatttccgccgccatcaacgaactgctgggcgacgaggcgcggatgcgcgcgctcggcgaagccggcaagcaggcagtgctgggcaaatacagctgggcggccgaggcggaaaagctggtcggcctgtaccgccagctggaaggccgcgcgcaatgacgtggcgtaccgccgcgctgagcttgctgttggcgctgccgttgggcgcgctgatggcggcgatcaactggcaattcaagggcacgcccttttccgcgcagacggtatggctgcacagcctggtggccttgctggcggcggcgccgctgttggcgcagagcgtctggctgcgaagcatgctggccagcggtcgctggccgcaagtggcggcgggcgggcaaatgcgctttttgctgctgcatggggcgataggccggggcggaccgatgctggctttcgtgctgggtatggagtggctgggcagcgggcgtttgccgttgttgaacggctcgctgttcaccctggcgttctggatggccttcggcgcctatttcgccagccgcgactggcggcggctgcaacgcgccgcaatggaaaacaagcaatagaaactatgcgcattctctacatcaatcactacgccggcagtccgcgccacggcatggaattccgtccctattacctggcgcgcgaatgggtgcaggccgggcacgaagtcaacatgctggcggccgacgtgtcgcacctgcggcagactcatccgcaagtggacggcaagtaccgcgacgaggacatcgacggcatccgctacacctggtgcaagacccgcccctacgcaggcaacggcttgggccgggtgttgaacatcttcagcttcctcgccaaggtgatgggcctgtccggccgctatttgaaacagtggaagccggacgtggtgatcgcctcgtctacctatccgctggacaccatcccggcggcctggatcgccggcaagaccggcgcgcggctggtgtacgaggtgcacgacctgtggccgctgacgccggtggaagtgggcggcatgtcgccgaaacacccgttcatccgcctgctgcagtgggcggaggacttcggttacagaaaagcggacaccgtggtgtcgatgctgccctgcgccagggactacatgatggcgcatggcatggtgccggaaaaatacgcggtgatccccaacggcgtggatgtgggcgaatggcagggcgaggcgcagcctttgtccgccgagcaccggatgcggctggcggagctgaagtcccacggccgcttcatcgtcggctacgccggcggccacggcctggccaacgcgctggattacctgctggaagcggcggccttgatgcaggacgcgccggtgactttcgtgttggttggcgacggcccggacaaggcagcgctggtggcgcgcgccgccgagctgaaattgaacaatgtgatgttcctgcccgccatcgccaagcgcagcgtgccggccttcctggcagaatgcgacgcgctgtacataggctggcgcaagctgccgatctaccgtttcggcatcaacccgaacaagctgttcgactacatgatggccggcaagccggtgatccactcggtggaggccggcaacgacatggtgaaggatgccggcgcgggcttgagcataggcgtggaagacccagccgtcatcgccgacgcggtcaaacgcatggcggtgctgcccttggccgagcgcgaagcgatgggcgcggccggcaaggcctatgtgctggccaaccacgattacgcggtgctggcgcgacgctttctggcggcggtgaagctgtgattttggcgtagggcggaagcccgcatagcgggcgttccgcctctgccgttgcaagagataaatggaatggcggaacgcccctttggggcttccgccctacgcaagattttgcaggccgcgcgcgaggcgcgcggcgatggacatggacggcggccatgctaggccgcgctaagacgaaagactgagaaatgagcgaacagaaatttttgccgtttgccttgccggacatcggcgaggaagagatcaacgaagtggtcgacgcgctgcgttccggttgggtcaccaccggccccaagaccaagcagttcgaggctgacttcgcgcaattcctcggcgacggcgtcgaggcgatcgcggtgaactccgccaccgccggcctgcatctggcgctggaggccatcggcatccgcgagggcgacgaagtgatcgtgccgtcctataccttcaccgccaccgccgaagtggtgcgctatctgggcgcgcacccggtgtgcgtggacgtggacgcggccaccttcaacatccgcccggacgccatccgcgcggcgatcaccggcaagaccaaagccattatcccggttcacttcgccggcctcgcttgcgagatggacgaaatcatcgccatcgcccgcgagcatggcctgaagatcgtcgaggacgccgcccacgcgatgcccacctactacaagggcaagctggtgggcacgctggattccgacgtgaccgtgttcagcttctacgccaacaagaccatgaccaccggcgaaggcggcatggtggtgtcgaagaacaaggacatcatcgcccgctgcaaggtgatgcgcctgcacggcatcagccgcgacgccttcgaccgctatgtgtccaagacgccggcctggttctatgaggtggtggctccaggctacaagtacaatatgccggacaccgccgcggcgatgggcattcaccagctgaagaaaatccgcggcttttacgacaagcgcgaagtcatggcccagcgcttcgaccgcgagctggccggcctgccgctgatcctgccggcgcgcgccaaggacgagggcagcaaccacgcctggcacttgtacccggtgcggatcaaaccggaagccggcgtcagccgcgacgacttcatcgccaagatggcggagaagggcatcggctgctcggtgcacttcatcccgctgcaccgccagccggtatggcgcgacggctaccagctgacgcgcgagcaattcccggtggctgacgccgcgttcgaggccgaggtgacgctgccgctgtacaccaagatgaccgacgacgaccagacccgcgtcatcgccgcggtgcgcgagatcctgggcgcatgagcgatcggttggaaaaagagggcggcgagttgttgccgccttgctgccagccgcgccgccatggctcgcgtttgctgaagcggctgttcgacatcgccgctgccggcgcgggtctcgccgtgctggcgctgccgcttatggcggtggcgctgtgggtgaagctggattcgccggggccggtgtttttccgccaggtgcgggtggggcgcggcggcgcgctgttccgcatccacaaattccgcaccatgcaggtggataccgaacgccatggccaattgacggtgggcgccgacagccgcgtcaccggcgccggccgagtgctgcgcaagaccaagctggacgagctgccgcagctgctggacgtgctgttcggcgacatgagcctggtcggcccgcggccggaggtgcccaaatacgtcgcgcactatccggccgaggtgaaggacatcgtgctgtcggtgcgcccaggcatcaccgactgggcgtcgataaagatgatcgatgaaaacgagatactgggccgcgccgccgatccggagcgcgcctatatcgacgaggtgctgccggagaagctgggctattacgtccgctacgccgaaacccatagcctgctcgaagacatccgcatcattgtcgccaccctgatgaagatcgtcagccgatgaccatcacgatccgcgccgccatgcccgccgacgccgatgcattggccggcatctacctggattgccgccgcgcgatgccctatgcgccgttggcgcatggcgaggccgccgtgcggacctggttcgccgaggccttgctgccggcgggcgatgtctggctggcggagcggggcggcgagatcgccggcttcgccgcctgttcggcgcaagatggcctcaggtggctggatcagctgtatgtcgccgcgcggcatcaaggcgcgggcataggcgcggctttgttgcagcgggttgtggtggagcgggcgcaggcttgccgcctgcatgtgttccaggccaatgccggcgcgcggcgcttttacgaggcgcatggcttcgcattgctgagcctgggcgatggactggataacgaggaacgctgtccggacgcgctgtatcaatggcggccggataggaaagaatgaccatgtttgaaaaactgctagccttctcccgacacaacaagatggcgatgctggcgctgatggacgcgctgctgctgccgctggcgttgtggagcgcggtattcctgcgcctgggcggttattgggaccccaagctcaatccgcacctgtggatcttcatcgtgccgcccttgtgggcgattcccatcttcatcaagctgggcctgtaccgcgcggtgctgaaatacctggacgacaagatcatcttcaccgtgtttagcggcgtgacgctgtcggtgctggtattgcaggcggtgatccagatggcccacgtctgggcgatgccgcgcgcgtcggtgatcatcttctgggtgttcgcgatggcctatattggcggcagccgcttcctgctgcgcggtctggtcaggcgcatcgacgccaccgaggcgccgcgcgatccggtgatcatctacggcgccggccaggccggcgtgcagctgatgctggccttgcaggccggccgcgagtaccggccgatggccttcgtcgacgacaaccccgagctgcgccgccgcacctatcgcggcgtggcggtgcatgcgccggacgagctgccggcgctggtcaaggatacccaggccaagtgcatcctgctggccatgccttcggtcggccgcggccgccagcgcgaaatcctggagtcgctggagcggctgcgggtgccgatcaagcgcctgcccggcatggccgacctggtgtccggcgaagcgcgggtggaggaattgaaggaggtggagatcgaggatctgctgggccgcgatccggtgccgccgaaggccgaactgttggcgcgcaacatccgcgacaaggtagtgctggtcaccggcgccggcggctccatcggctccgaactggcgcgccagatcgtcaagaaccgcccggcgcgcatcgtattgttcgagttgtcggaattcgcgctgtacagcatagaccaggaactggcgcagatcgcgccgcgcatcccgcgcacgccgatattgggctctgtcaccgactatgcgcggctgacccaggtgatgcgcgccttccaggtggagacggtgtaccacgccgccgcctacaagcacgtgccgatggtggagcacaatccggtggccggcatcgtcaacaacgccttcggcaccgacaccaccgcccgcgcggcggaggactgcggcgtcgacaccttcgtgctgatttccaccgataaagccgtgcgccccaccaatgtgatgggcgccaccaagcggctggccgagctgaccctgcagacccgccacgcccgcggcagccgcacccgcttcgtgatggtgcgcttcggcaatgtgctgggcagctcgggatcggtcgttccgctgttccgccgccagatcaaggccggcggcccgatcacgctgacccatgccgacatcacccgctacttcatgaccatcccggaagcggcgcagctggtgatccaggctggcgcgatgggcgacggcggcgacgtgttcgtgctggacatgggcgagccggtgaagatcatcgatctggcgcggcgcatggtgcacctgtccggcctggaggtgaaggatgcggatcatccgggcggcgatatcgaaatccgcgtcaccggcctcaggcccggcgagaagctgtacgaggagctgttgatcggcgacaacgtgctggccaccgaccacgcccgcatcctgcgcgcgcaggagtaccacctgtccgacgccgaaatggcatcgttgctgcagcggctggccgacgcctgccagcggctggacgcgccggccgccttcgccctgatgcaggaggcggtgcatgagttccaggccgcggaggcgacgcaggactgggtgacgctgcagggctgatcgtaccctatccctaaatcaacggctgcaagctaccacttgcagccgttgtctttatcgaaggcgtctttcagcagcatgggggcggcgagcaagcccaggttggcataggccttggcgcagtcggcgcgctcggcgcgattgatattgcgcgccagccgggccttttccggatcctcgcgcagaggtttggcgttggcgttttccggttccagctgccgcatctgctggcgcagcccctcaatggttaggcgtggctccgcgcgtgcggcgctggccgtggctttcccctgccgcgccggtcgggcggtcgtttcaacggctgtcgcggcgcgagcggcatgcgccgggcgtggcgatcgcgcggcgggcgccggcttcgccgaagcggcccgtgatggcgggtcaggcgggggcagggtgatgggcaccatactcacccgcagcggctgcggcgcggcagccggctgctgttgcgcggctttcaaggcgaacagcgccagcgcatgcaacagcaggcttgcggcgatggccagcggccgtcgtggcagcggcgaagggcggggaacggtaagcgcgctcatatctgtaaaataaatgcggacctttgccatgttgatggcattgttgtttgcgtttggtgcatggcttgtgacattgcggcggcgggactcatggtagagtgcgcgcgcgccgcaaagtgccccggcggtgtaccatctggcatccgcaatctggaccttgagcgatggaaacccgctggctggaagactttctggtgctggccgataccggcagcttcacccgctccgccgagctgcgccacctgacgcagccggctttctcccggcgcatccgcgcgctcgagagctggctgggcgcggacctgatagaccgcaccacttatccgaccaagctgaccgcggccggcaagctgctgcagcagcaagcggtgccgctgttggctcagctcaacaccacccgcaccatgctgcgcggcctgcagcccttgccgcagggcacgctggagttcgcggtgccgcacacgctgtcgttctcgtattttcccaagtggctgaccgcggtggaggacggtttcggccagttgtcctgccgactgcaggccagcaatgtgcacgacgcggtgctggccttcgtcgaaggcggcagcgatttcctgatgtgctaccaccatcccaagcagccggtagagttgcatgacgcgcgctacggcggcttgcggctgggcgtcgagcgcctgcggccgtacgccatcgccgcggacggcgcgcccgtgtatgccctgccggggcggcaggaggcgccgctgccgtttttgggttacgccagcaacgcctatttccgcttgatgagcgatttgctgctggtcagcgggccgcagccggcgcacctgtcgctgcgctacgaaaccgatatggccgaagggctgaagcagatggccttggccggccacggcctggctttcctgccggaaagctcggtggcggcggagtgccaggccggcttgctgctgccggccggcggcgacgagtggagcgtggaaatggagatccagctgtattgcgatctgcgccacgccaagccggaacaagaggctttgtgggcgtatctggcggcgcgccacccggcggtgtgaggcggtaagcccgcgcgggccaggctgccgcaaggttatgcaattcctgcataaccccatcccgattcggaattggccaagccggcggggcaggcatacagtgcggggcattgcaggccgcgcatgacggccgccctgaggagacccgcagatgaccacccgcatcgaacacgatttgcttggtaaccgcgacgtgccggccaccgcctattggggcgtgcacaccttgcgcgccatcgagaatttcccgatcaccggccagaccataggcagctatggcgatctgatccgcgcgctggcctgcatcaagcaagccgccgcccaggccaaccgcgacctcggcattctcgactccaagctggcccaggccatcgtcgacgcctgcgaggaaatccgcgccggcaagctgcatgaagagttcgtcgtcgacgtgatccagggcggcgcgggcacctccaccaatatgaacgccaacgaggtgatcgccaaccgcgcgctggagctgctgggccacgccaagggcgagtaccaatacctgcacccgaacgagcacgtcaacctgtgccaaagcaccaacgacgtctacccgaccgcgctgcgcctggccgccttttggggcgtgctgaagctggtgtcgcggatggaagtgctgcgcaaggctttcgaggacaaggccggggagttcaaggacatcctgaagatgggccgcacccagctgcaggacgcggtgccgatgaccctgggccaggaattccagacctacgccgtgatgctgggcgaagatgaacaacgcctgaaggaagccagcgcgctgatgctggagatcaacctcggcgccaccgccatcggcaccggcatcaccgcccatccggattacgccaagctggtttgcctgcacttgtccgagctggtgggcagccagctgatcaccgcgccgaatctgatcgaagccacccaggactgcggcgccttcgtgcagctgtccggcgtgctcaagcgcgtggcggtcaagctgtccaagacctgcaacgacctgcgtctgctgtcgtccggcccgcgcgccggcttcggcgagatcaatctgccggcgcgccaggccggttcgtccatcatgccgggcaaggtcaatccggtgattccggaagtggtgagccaggtggcgtatgaagtcatcggcaacgacatgaccatcaccatggccgccgaagccggccagctgcagctgaacgccttcgagccggtgatcgcctacagcctgttccgcagcgccggccacctggccaacgcctgcgacaccctgaccgagcattgcgtgaaaggcatcaccgccaaccgcgagcgcctgcgccagagcgtggaaagctcgatcggcctggtgaccgcgctgaacccggtgatcggctacgaagccgccacccgcgtggccgccgaagcgcacgccaacggcagcagcgtggccgaggtggtgctggcccatggcctgctgacccgcgagcagttggacgacatcctgcagcccgacatgttgacccggccgcgctgggtgacgctgtaaaccgtttctcctttgtttgactcgtgattcccggcgcctggtgcgccggttttttttgcgcgctcacatgcggctggcgatggcgtccaacagcgggtataactttattgtgcactgcacaaaacaaggagcgcatgatgagtccgatgctgtggtggagttgcgaattcccggcctgcgcctggtcctgcctgcaggacggctggcgctgccagcagcgctattggcgctccagcctgtttcacggcgctcgcgtttggctgagtccggcgcccttgccggacaagctggcgcgtttggcgcggcgcggctgcgccgacggcatcgcgttatggcacgacagcagcccggctggtttcgcatggctggagcaggccggcgcgcatgcgctgccatacgaaggagcgcgccgccaatggcaggactgcctgcggcacagccagcgggtctggcagcgcggcttgctgttgctggggcgggaatggtcgaggatataacggcaggccgcgcgccttgttcccggaagccaggcagaccgaaaatggcacggacatgccaaagaggtaaaaattagcgtgcgcgcattgcgagcaatgttatatgatatttggataatttctgagagggaaagtctgtcgaagaccactcagtccgcctgcgcgccgatccggcgcgcgggcgtttgttcacttgaggaaatattcatgatgcgcaaggcgttttttgtgattggactgtttgccgcgggctgggcgcaggcggattggtcgccaacactggtgtcggaccagtaccgggcaaccatcaattacggcggcgggtcgctcagctacagcgaggatgccaagtcgatggggcaattgcggcagaccgccatggatttgcaaaccgtgccctataccttgcagcagggcttgaacggacgagtgtcgcaactggtggcgcagaacggcgcgacctttctaggcggggtggtcagcggcaacgcgttggcaacgatacgcccggatgccagcggcgtggtctacatgaccttgtccgggctcagttaccaggtgcgtaaccagtattccggccataaatggggcgtaatcagctatacctgcaccaacacgctgacgctgagcaatattgtcattaccggccagtacggagccgcgaatggcgccatcgccggcgacaagaccggcatgacggcgacttccagttcgtccaccgattgcgactcgaacttgagctggattctgccggtattgggcgacgcgctgatcagcaaggccgaaggcaagatagacagcacggtgcagagcagcgtgcaggcggccctggccaaggtcaaggatactttgctgtacaagcccgaccagaacttgctgattggcctgaaccggctggttccgcccggcaaggtggtggccttgcccggcggcggcagttttccgttgggtcagtacatccagaacaatatcgcttacctgctggccaacagccagttgagcatacagctgggcagtccgatcgcgctcaagacggtggccggcaccagcgaaccgatgaccacgagcttcagcagcgatttggcgacgatttccttgtcatcgccggcgatggcgttttctatcaagttggctgagactgccgaggtcaactggttgtggcgttgcccggctggcgcgccgaggtgccaaatcccctagaccttcggcccaggagagggcgcgggcggtttttgcctggctatccggcagatggccgccgcgccataatcaccccttttgatccggacgcgacgatggccacccaattccttctcagcgagcagcaactgcaacacctggccccgcaagtgcaggcttatctggcggaccagctcgggctggagatcggcagcttcgacgcccgcttcctgctggatttcctggccgacaagatgggacgcgacatctacaacaaggccttgcaggatgcgcagaccgcgctggcggagcgcatggaaaccctgcaggcggcgatctgggagctggagcgctagcgccgccgtttgacggcggctgccggccgccgccgattgcggttacaatcattcatccttccccctgatgccgttgtgccgatgctctatttgcgtttgatgatgaaaggctttttgctggcggtgctgctggtggtgctcggtttcgcctacatcgcctggaccatcgtcgactacggcgacggggacgagcagaacggcgccgacgcggcgctggtgctgggcgccgcggcctggggcaacaagccgtcgccggtgttccgcgagcgcatcaaccacgcggtgaagctttaccagggcggcaaggtgcgctggatcgtgttcaccggcggcacgccgcagccgggctatccgtccgaggccgatgtcggccgcgagttcgccgcgcgccagggcgtgccgatgacggcgatgctggtggagaccgagtcgcgcaccacctggcagaatctgtccaacgcccgcgatctgggccgccagtttggcatccgctcctatctgctggtcagcgatccgctgcatatgcgccgggcggtgctgatggccgctgatctgggcctgcgcgcctacccggcgcccacccagtccagccgtttccgcacgctgtccagctggtcgcgcttcctggcgcgggagacctggctatacgtcggttatcgggcgtttcgccagttgtcgtgaagattgtggataaaagcgaattttgccgatggctgtggataagccgggtgggcaagaaaaaagccggcgtcagccggctttttttctgggcagcgtccgcgttcaggcggcgtgccacagatcgatcagctcgctggcttccagcgattgcacctcggcgcgcgcctgcagccaggcgaccagctcgccgcgcaccgcatcggtgatttggctgccgctcaccgggaaggccacgccttccaatcggctcttgccgtcgaaatggccgccgaagctgatgccggcttcgtcgaagcgggtcagccagccatccagcagcgcgtcggtgtccacgccttcgcgcagttgggccaccaggtggaaacccagttcgcggaactcgccgacgcgcattttcttgcgctggcggttgttgaggcgtttcaggcgttggacggagttgggattgcgcgggaaggccatgttcgatccttatttctaaacaaccggatgatagcagggggcgcggccagtgtctggaaaaaggaagcgcgggcggcaggacaggcgggtaaattgactggacggatattccgtctttattcttggcaatgttgcgatcattttacaaatccacggtttaatttacacttaattaataaaatgttgaataacaagcaaaacattctcgttctgtccgtgatggctgcgctgctgtccgcctgcggcggcggcggcggcgactcctcttcttccacgacgtccggcaatcaggtggcgacgaccctcaatccgccgcagaaggccgccgtcactggcgacctgagctgccaggccggcgtttgcgcgctgcctgccagcgccaacgcggatgcggtcggcaaggtataccagctgcagaacaataccggccaggacatgcagatcaccgtcaacggcccgctgacagcccgctgggacgcggtgatgacccaggtggacagcgatcccctcggttacggcggcagcagcggcgccgcgcgcggcaacaatgcggcggcggaggcagtgctggaacagaagatgcagcagttctacgcgcatgcggcaagctacggcgccgtcgccagccgggcgcaggcgcggatgcgcctggagaaacgcgtccagatcgccgcgcggagttacgcgctcaacgatagccgttcgtggtatgacagcatcggcagccgcgcgttgaacgccacgatgaaggcaagccaggcgctgccgaatggcggaaccgtctatgtctgggcgcaaaacgacgcggccgcggtgacgcagcagcaggcggctttcctggccgagcgcttcgccaacagcgtgttcccgatcgaggcggcggtgatcagcgagccgtggggcccggtgcattcgacctggcagggcatcaccctggatgccggcaccaaggatgtgcatctggtgctggcgcagctgaatcagccggccaacgctttccagggcttgctgggctatgcgtaccctctcaacgctatcctgaagtccgctgcgtcggaccccacttgcggcagcgattgcagcgagttcgccaacagcaatgaagcgctggtgaccttcctcaacgtggacacgctggtggccgccgacgatggccagagctggagcccgagcggcaaaggcccggcgctgacgctgtcgacgctggggcatgagtaccagcacttgctgtacagctacaataagctgttccgccgcatggtgggctccccgcgcaccacgacttgggagaacgagctggcggcgcagaccatgggctacctggtggcggccgatacctatggcggcggccgcggcgacagcgcgacctcgcatcccgatttgcgctcgggcggcgacttcagccagttcctgaagcagccggcttgcgatttgaagcgctggtcggcgatgagcggcgacagtttcggcaccacttgctatccgaaagcgctggccaccggcatgttgatgctgcatcagtacggcgccggcgtgatgaagccctgggtcaccggcgccaatgtcggcgagcgggcgttggacgacggcctggcggcggtaggcggcggcgactacggcagcctgatgcagcagctgtataccagcctggcgctggcggacttctccacctggcctgccggctacggcttcccggccaagcagctgggcttgccagccagccgctatttcccggccggcaagaccatcgcgctgccgcagatcaacattaaccccagcgaagtccagctgtcggcagactccgctcaggaagcataccgcttgaccctggcgccggtagccggccaggtgagcatcacggtgcctgccaactcgcgcctgagcctggtgaagcgatgagacggctgttggcgggcgtcttggcggcctgcggcctgctggcctcgctgggcatggccaaggtgccgtgggaacacggcaagctggtcagcgtcggcaacgcgccgttcaaccagctggcgatccagcgcagcgacggcgccttgctgaccatactgccgagcgatgaaaccggcgcgctggataagcgccagctggcgccgttcgcggcgcgcgccggcgacaaggtgcgctttcgcgcgctgcgcagcgcgcagagcaagctgtcgggcgaaatggtggtcttgagccagatggagctggagcgctagccgcgtttctggcggaccagcccggcatcggcgacgatgccgggttttttcatcggcgcgccgccggggtgtggacggcggcggcgcgtctctgcaagatggctgtcttcagcctggacaggagcttgccgcatgcggctatacacccaagatgctttccgcccgatgccgtgggccaatggcggcggccagacctgcgaattgttccggctgccgcacccgcgccggcaggacgccttcgccgcgcggctgtccatcgccgatgtggcgcggggcgggccgttttcgcattttcccggcgtcgaccggctgctgggcctgctggagggagagggcatggagctgcgcctggacgatggccgcctgttgcggctggcgcaggccggccaggtggcggcctttcccggcgaggccggggtggattgccgtctgctcggcgggccgctgcgcgattgcaacctgatgctggcgcgcgactggggccggggagagctggagcgcttgcaactgccggccggcggcgtgttgcgggcgccggcggccgacttgaccctgctgtatctgcaacaaggggaatggcattgcgacggaagcgcattgccgccgggctgcctgctggcggccgaggacgaagcgatggagttgcgcgccagcggcggcggcgtcgcctggctggcgcgggtcagccggctggattgaggacgaaaaaaagccaaccgcgaggttggctttcgggccgcgtcggcacggcgcttacagccccagttcgctccagatggcgtcgacgcgctggcgggtggcggcgtccatcacgataggggtgccccattcgcgattggtctcgcccggcagcttgttggtggcgtccaggcccattttgccgcccaggccggaaatcgggctggcgaagtccaggtagtcgatcggcgtgttgtcgatcagcgtggtgtcgcgcaccgggtccatccgggtggtgatcgcccagatcacttccttccagtcgcgggtgtcgacgtcgtcgtccaccaccacgatgaacttggtgtacatgaactggcgcaggaagctccagcagcccatcatcacccgcttggcgtggccggggtactgcttcttgatgctgatgatggccatccggtagctgcagccttccggcggcaggtagaaatcgacgatctccggaaactgcttttgcaggatgggcacgaacacctcgttcagcgccacgcccaggatcgccggctcgtcaggcggcttgccggtgtaggtgctgtggtagatggcattctcgcgcatcgtgatgcggtctatggtcagcaccgggaagctgtcctgctcgttgtaatagccggtgtggtcgccgtacgggccttccatcgccatatcgttcgggtggatgtggccttccagcacgatttcggcgcgcgccggcacttgcaggtaggagccgatgcatttgaccagctcggtgcggctgccgcgcaacaggccggcgaactggtattcggacagcgtgtccggcaccggcgtcaccgcgcccagtatcgtcgccggatcgcagcccagcaccaccgccaccgggtaaggctggtccgggttctgctggcggaattcgcggtagtccagcgcgccgccgcggtgggccagccagcgcatgatcacgcggttcttgcctatcacctgctggcggtagatgcccaggttctgccgtttcttgttcgggccgcgggtgacggtgaggccccaggtgatcaagggcgcgacgtcgccgggccagcagtgctggatcggcagctttcccagatcgaccgcgtcgccttcccagacgatgtcctggcacggcgcctttttcacttccttcggcgccatcgacaatacctgcttcaacaacggcagcttgtcccaggcgtctttcaggcccttcggcggctccggctctttcaggtaggccagcgttttgcctatctccctgagctgcatcacctcgctggcgcccatgcccatcgccacgcgctccggcgtgccgaacagattggccagcaccgggaagtcatagccccggtccgggctgcgcggctgttcgaacagcagcgcggggccgccggccttcagcacgcggtcgccgatttccgtcatttccagatgaggggataccggcgaggcgatgcgcttcagcagctgtttttgttcaagttgggcgatgaattcccgtagatcggcatatttcatgattttttcatgatctggcgcaaagtgtggaagagggggcttggataatctgccttcgaacgccgcacgctactgccggcagggttcgctgtcaacgccggcaggccgcacggctgttttttcagccccattggagaacagaaaatgaagaagctcgctctcgccgccgcgatcggcatgatttccgccagcgcttttgccgcccagggcgacattctggcccgcttccgcgtgatcgacgtggacccgtccgccagctggagcaacggcgcggccggcacccatgtggacgccaaatcgtccgccgcgccggagctggatttcacctatatgatcaccaacaatatcggcgccgagctgatcctgggcacttcgcgccacaagatcaccaataacggcgtcgatatcggcaaggtgtcggtgctgccgccgaccgtgaccgtgcaataccacttcgcgccggaagcgactttccgtccgtacgtcggcgccggcctcaactacacccgtttctacaatgacgggctggccaacggcgcgatcaccgtgaagaagaacagcttcggcccggcgctgcaagccggcgcggacatcgcgatcaacaagagctggttcgtcaacttcgacgtgaagaagctgtgggtgcagaccgacgtcagcgccggcaacgtcaagctgggcacgctgcatgtcgacccgtgggtgttcggcgtgggtgtaggcaccaagttctgaacgagacgttccatcgtgcaaaaaggcgccgcgaggcgcctttttcttttgccggcggtcgggattccggcatttgatggctttggcatggcgctggcgatgaccgccgcgcttgatgccgtcataatgcggcaaaaggtgaatttttcccggcggcggcggtcgatcctgcagggcgcgagggcagcagcctgcgccaaagcgcggctatcgcgccatgccatggcgccgaaggccgccgcaaaagcagctttcggcgccggaaaagccgtgctgggacaagcttgttgtcaaaatacatcatttgcaacaatgacagtcctgatatttttcaccgcgccagcccttgtccataaacgtttttttcattgaaaagagcaacttatccagatggcttgccagcttggcgcggctaggtgggaaaatgcgctgaggtcttgaatttacaagggatttcagcggacccggaaattgtttttttgttaaactggcgccctttttcgtggtggggaagatcaatggctctccttgaaatcaaaaacgtggtcaaacgcttcggcgactacacggcggtcaacgacgtcagcctgtcggtccaggcgggcgagttcttcaccctgctggggccgtccggttgcggcaagaccaccttgctgcgcatgctggccggcttcgaacagccggacgccggccagattctgctggatggccaggacatgtcgcaggtggcgccggagaagcgcccggtgcataccgtgttccagagctacgcgctgttcccgcacatgacggtgcgcgagaacatcgccttccccttgaaaatggccaagtgggacaaggcgaagatcgaggcgcaagtggacaagcttctggccgacgtgcgcctgacgccgttcggcagccgctacccgcacgaaatgtccggcggccagcgccagcgcgtggccatcgcccgcgcgctggtggaccgcccgcgcctgctgctgctggatgagccgctgtcggcgctcgacgccaagctgcgcgaggagatgcagatcgaactgatcaatctgcagaaggaagtgggcatcaccttcgtctacgtcactcatgaccagggcgaggcgctggcgctgtcgcaccgcatcgcggtgatgagccacggccaggtggagcaattggatgcgccggagcagctgtacagctacccgaagaatcgtttcgtcgccgacttcctcggccagtgcaatgtgctggagtccacggtcaagtcgctggacggcggcgcgatgacggtggacatcaagggctgcggcgaggtgaagtgcctggcggtcgacggcgtcaagcccggccagcagggctggctggcgctgcggccggagaaggtgcggctggacaagtcgctggccgcgcagccggacgaggcgcatctgaagggccgcgtgcatgattgcctgtacctgggcgacgtcaccctctacgtggtggaagtggccgacggcgtgcgtatcgaggcgatgcaggccaacaacatccccggcgtcgccaagttcttcgacgacggcgacatcgtcgaaatcgcctggcgcttcgacgccggcagcttcctgacggagtaagcgatggccatccgtgatcgtttcggcaagtgggcgctatcctggccccccttgctgtacttggtattgttctttctgattccgtcgctgatcatgctggtggccgctttccgccagcccggcgactacggcggcctggcgcccctgttcaccatcgaggacggccagcgtgtctggcagctgacgctggacaacttccaccgcctggtggaggagccgctgtacctggagctgttcgtcaaatcggccggctacgccgccatcaccaccgcggtgtgcctggtgatggcttatccgctggcctggctgatcgcgcgctccggcaagaaataccgcgacctgatgctgctgctggtgatcctgccgttctggtccaacttcctgatccgcatctacgcctggatgatcatcctcggcccgcagtcggcgttcaccaaggcgctgaacctggtgctcacttcgctgggcttcgagccagtgcgcttgctgttcacctcgttcgcggtgatcgtcggcctggtctacgtgcatctgcccttcatggtgctgccgctgtacgccaatctggaaaagcacgacatggcgctgctggacgccgcgcaggacctgggcgccaacgcctggcagcgcttctggcgcgtcacctggccgcagtcgctgcccggcgtgttcgccggctcggcgctggtgttcattccggcgctgggcatgttcgccatcccggacatcctgggcggcaccgaatccatcatgataggcaacctgatcaagcagcagattctggatacccgcgactggccgttcggctcggtgctgtcgatcatgctgaccggcggcgtgctgctgatcgccgccttgggggccgtggtggccagaagggggaagggccgtggctaagaaacaatcgaagtggctgtgggcgtcggctatcgtcacctacctgttcctgtacctgccgctggtgatcgtggtgctgtactcgttcaacgattcgcgcctgaacgccgagtgggtgggcttcacgctgaagtggtacgacaagctgttccataaccagaaaatgttgaccgccgccggcaactcgctgctgatcggcgtcatcgccagcttcttcgccaccattctgggcacgctggccggcgtcgcgctgcatcgctacaagctgaggctgctgcccttcctggtgctgacgccgatcgccatccccgaattgctgatgggcgtgtcgctggtgattttcttcgtcatcgtcaaccagctgatcggcattctggagctgggcttcatcactatcctgctgtcgcacatcgccttctgcatcggctttgtcgccatcgtggtgcgtgcgcggatgcagggcatggacgacagcctggtggaggcggcgcgcgatctgggcgccaccccgttccaggctttccgcctgatcacgctgccggtgatcaagcccggcatcatcgccggcgccttgatggcgttcacgctgtcgatcgacgacttcgtgatcaccttcttcaccgccggcgccggcgccagcatgctgccgctggagatctactcgatgatcaagatcgcggtgacgccggaagtgaacgcggtatccagcttgctgatgctgctgacgctggcgctgatcgtcatcgcctcccgggtgtcgcccagcgcgctgcgcgccaacggctgagacgcggggcaagacggggtcgggcagtccagaggggcgctgcccggtctttctcgtagtaccaccatgctgtgcaatacaaaggaagcaaaatatgaagaagattctcgcgatgctggcgctggcggcctccacccaggcgttcgccgccgatgagctgcatctctataactggaacaactatttgtccgaagcggcagccaaaaactttgaagcctactgcaagtgcaagctggtgcaggactactacggcgacaacgaagaaatgctggccaagctggccgccggcgccaagggctacgacatggtggtgcccaccggcttcgcggtggacgcgctgatcaagcagggcaaggcccagccgctggacaagacgcagctgcccaacttcaagaacctgaacccgggctatctgaacagcttcttcgacaagggcaacaagtactccgccccgtacgcgttcaccaccaccctgatcggctacaacgaaaccaagctgaagcagctgggcctgggcgacaaggtcaacacctgggcgctgatcttcgatccggcgctgctggccaagatcaagggcaaggtcaccgtgctggattcacagcgcgagctggtgtccgcggcgctgatgtacctgggcaagccggccaactccaccaatccggcggactggaaagccgcgcgcgacgtgatcctgaaggccaagccgtactgggccgccttcaacaaccagtcgtacatcaaggagctgactgtcggcaacatctacgtcgccttcggctactccaacgatatgttccaggcgcagcaggacgccaagaaggccaagcgcaacttcgcgctgaacttcagcctgcaaaaagagggcaacacgctgtcgctggataacttcgtggtgctgaaggacgcgccgcgcaaggacctggcctacaagttcatcaacttcatgttggacggcaagaacgccgccggcctgaccaacgagctgggcaacggcaaccccaacgccgccgccggcaagttcgtcaagaccgagctgaccaagatcccggccatcttcccgagcgccaccgatctgccgcgcctgcagcagctgcatgacctgaacgccaaggaccgccgcgaactgaacaaggtgtggtcggagatcaagctgaaataagcttactctatcgtgtggcgccaaaagaaaaggccgggaatccccggcctttttcgcgtccgcatctatatagagcgtttcagcccaattgcagccgcttcaactggctgatgcgctcgatgcggaaatcgacatgcgccggccggcgcggctccttgctgacccagatcgtcgtcatgcccaattccttggcggtcagcagattgggcagcgaatcctccaccatgatgcaatgctcggcgcgcagcccctcgcgggccagcaccgtatggaaagcgtctacatgaggcttgggcacgtaattgagattgtcgacgccgtataccgattcgaaatgatggcgaatgctcattcgctgcaaaatgccttccacgtaatggttggggccgttggacaggatgatcttgcggccgggcagcgccgtcaggctgtcggccagccggtcttcaaactgcagccattgagccagcacatccaccgggtgggtatccaccaggaactgctgcgggtcgatgccgtggtgggtagtcagcccgtgcatggtggcgccgtactgcgcccagtagcgcgagcgcagcgcgcaggcttcttcttcgcccacgccgaggtggcgcatcatgtattcggtcatcagcttgttgatgtggtcgaagatgccgccgctggcgtggtgcaaggtgtcgtcgagatcgaaaatccaggttttatggttcacgttgggactgcatgcggtgatgaaggtgggacgcagattatccattcccggcggctcgggtgccagagggagactttttgcggcctgctgaagttatggttttgttacatatcagccacttagcgatttccgccgaaaatctttcaatttttgtcgcgaaaggtgttgacgggtgtgggtcccgggcgtatagttcgcctcctcagctgacgcagcgaacgaaacagcggaaacgaaacggttccggtgatgacgacgcagcgatcggcaccgctctttaacagacagaataaccgataggtgtaagtgtttggcgaaagccaaaaacttgcactgcaagagacaagagatacttgtttatttctttgaacttgcgtgccagaaaatttgctatgagattgaactgaagagtttgatcctggctcagattgaacgctggcggcatgctttacacatgcaagtcgaacggtaacagggtgcttgcaccgctgacgagtggcgaacgggtgagtaacgcatcggaatgtaccgtgtaatgggggatagctcggcgaaagccggattaataccgcatacgccctgagggggaaagtgggggaccgtaaggcgtataacgtgaggccttacggtcccccactttccccctcagggcgtatgcggtattaatccggctttcgccgagctatcccccattacacggtacattccgatgcgttactctggcgaacgggtgagtaacgcatcggaatgtaccgtgtaatgggggatagctcggcgaaagccggattaataccgcatacgccctgagggggaaagtgggggaccgtaaggcgtataacgtgaggccttacggtcccccactttccccctcagggcgtatgcggtattaatccggctttcgccgagctatcccccattacacggtacattccgatgcgttactcnggtaataccacgagccttttcttccggcgcgctatcgatctgggagtagtctttagcttcgccaccgaacttcttcgacagaatggtggtgatcgctgcggtcagagtggttttaccatggtcaacgtgaccgatggtgccgacgtttacgtgcggcttagtccgcgcaaacttttccttagcccgcacgtaaacgtcggcaccatcggtcacgttgaccatggtaaaaccactctgaccgcagcgatcaccaccattctgtcgaagaagttcggtggcgaagctaaagactactcccagatcgatagcgcgccggaagaaaaggctcgtggtattaccatcaataccgcgcacgttgaatacgaaaccgaatcccgccactacgctcacgtagactgcccgggccacgccgactatgtgaagaacatgatcaccggcgcagcccagatggacggcgcgattctggtttgctcggccgctgacggtccgatgccgcaaacccgcgaacacatcctgctgtcccgtcaggttggcgtaccgtacatcatcgtttacctgaacaaggctgacctggttgacgacgccgagctgctggaactggttgaaatggaagtgcgcgatctgctgtcttcctacgacttcccgggcgacgacaccccgatcgtaaccggctccgctcgtctggcgctggaaggcgaccagtccgaaatgggcgagccgtcgatcttccgtctggccgacgcgctggactcctacatcccgactccggagcgcgcggttgacaagccgttcctgctgccgatcgaagacgtgttctcgatctccggccgcggcaccgtggtgaccggtcgtgttgagcgcggcatcgtgaaagtcggcgaagagctggaaatcgttggcctgaaagaaaccgccaagaccacctgcaccggcgtggaaatgttccgcaagctgctggaccaaggtcaggctggcgacaacgtgggcgtgctgctgcgcggcaccaagcgtgaagaagttgagcgtggccaagtactggtgaagccgggctcgatcaagccgcacaccgagttcagcggttcggtatacgtgctgagcaaggaagagggcggccgtcacaccccgttcttcgctaactaccgtccgcagttctacttccgcaccaccgacgtgactggcgcagttacgctggccgaaggcgtggaaatggtaatgccgggcgacaacgtggaaatcactgttaagctgatcgctccgatcgcgatggaagagggtctgcgtttcgcgatccgcgaaggtggccgtaccgtcggcgccggcgttgtttccaagatcatcgcttaatcggaccggagattttcatgtctagccaaaaaatccgcatccgtctgaaggcgttcgattacaacctgatcgaccgttccgcccaggaaatcgttgaaaccgccaagcgcactggcgccgtggtcaagggtccggttccgctgccgaccaagatcgagcgtttcaacgttctgcgttcgccgcacgtgaacaagacttcccgcgaccagctggaaatccgcactcacctgcgcctgatggacatcgtagatccgaccgacaagactgttgatgctctgatgaagctcgacctgccggccggtgtggatgtggaaatcaagctgcagtaatcgcttaagttcaagggtttgcgagctaagtgcttgcgattcttgaattttctgtgatacattagcggactcgccaatttggcgagtccgtttttgttttttatgtcgtgttttttatgccggtcaatcgcaatcggcgcctgaaaaaggaaataaacatgagtttaggtcttgtcggtcgcaaagtcggcatgacccgcatttttgccgaagatggcgcaaccatcccggtaactgtgctggacatgtccgctaaccgcgtcacgcaaatcaaaactgcagaaaccgacggctacaacgccgtgcaggttacttttggctccaagaaagccaatcgcgtcaacaaggcagcagccggtcacttcgccaaagctggcgttgaggcaggcgaagtcctggtagagttcgctctgtcggccgacgctgtttccagcttcaagctgggcgacgcagtcgcagttgaaaccctctccgttggccagctggttgatgtaaccggcacctccaagggtaagggcttctccggcgtgatcaagcgtcacaacttctcttccaaccgtgcttcccacggtaactcgcgttcgcacaatacgccgggttccatcggtcaggctcaggatccgggccgtgtattcccgggtaagcgcatggccggtcagtacggtaacgtcaagagcactgtacagtgcctcgagatcgttcgtatcgacgccgagcgtcagctgattctggtcaagggcgcagtcccgggcgccaagaacggcgacgtagtcgtgcgtcccagcgtgaaagcgggtgcgtgatggaattgaatgtaatcaatacccaaggcaaggctgttggcagcctgcaagtgtccgactccctgttcggccgcgactacaacgaagctctggttcaccaagttgtgaccgcgttcctggcgaacgctcgcagcggcaaccgtgcccagctgactcgtgctgaagtgaagcactcgaccaagaagccgttccgtcagaagggcactggtaacgctcgtgccggtatgacttccaccccgaaccgtcgtggtggtggccgtgccttcccgaacaagccggacgagaacttcacccagaaggtcaaccgcaagatgttccgcgccggcatggcggccatcctgtcgcaactggtgcgcgacgagcgcctgatcatcgtggacgagctgaatgtagccagcccgaagaccaaggaattcgtaggtactgttcagccgatgggtctggaacaggctctgttcatcactggtgaactgaacgaaaacctctatctctcttcgcgtaacctgccgaacgtgctggttatcgaagctcaacaagctgacccgtacagcctgctgcgcttcaagaagaccgtgatcacccgcgacgccgtgaagcaactggaggagcagtgggcatgaaccaagaacgtctgttgcaagtaatccttgctcccatcgtttccgaaaagagcaccatgatcgctgagaagcatcagcaaatggcgttccgtgttgctaccaacgcaaccaagccggaaatcaaggcggccgtcgaaatgctgttcaacgtaaaagttgaaggcgtttccactgtgaacgtcaagggcaaggttaagcgtttcggccgttccaccggtcgtcgcagtgactggaaaaaggcctacgttagcttggtcgaaggtcaagaaatcgacctgaccgctaccccggccgcggcggagtaaggagatagagcatgcctatcgttaaggtaaaaccgacttccgcgggtcgccgtgccgttgtcaaggtagtacaccctgacctgtacaaaggtgctccgcacgcagccctggttgagaagaaaaactcgaccggcggccgtaacaacaatggccacatcaccacgcgtcatcgtggtggcggtcacaagaagcactaccgtctgatcgacttccgtcgcaacaaggatggcatcccggcaaaagtggaacgcatcgaatacgatccgaaccgcactgcccacatcgccctcctgtgctacgccgatggcgaacgtcgctacatcatcgcgccgcgcggcgtgaaggttggcgccgtgctgctgtccggctcggaagccccgatcaaggccggcaacaccctgccgatccgcaacatcccggtgggtactactatccactgcgtggaactgcaacctggcaagggtgcccagatggttcgctccgctggtgcttccgcaatgctgctggctcgcgaaggcgtatacgctcaactgcgtctgcgctcgggcgaaatccgcctggtgcacgtcgattgccgtgcgaccgttggtgaagtgggtaatgaagagcactccctgcgcaagctgggtaaagcaggtgctactcgttggcgcggcatccgcccgaccgttcgcggtacggcgatgaacccgatcgatcacccgcacggtggtggtgaaggccgcactggcgaaggccgcgtaccggttagcccgtggggcactccggccaagggcttccgtacccgtcgcaacaagcgtaccgacaacatgatcgtacgccgtcgctattccaacaaagggtaattgacaatggcacgttcgcagaaaaaaggcccgttcgttgacctgcatctcctgaaaaaggtagatgcggtacgggcaaccagcgacaagcgtccgatcaagacctggtcccgtcgttcgaccatcctgccggacttcattggcttgaccatcgctgtacacaacggtcgcactcacgttcccgtctatgtttctgaaaacatggtcggccacaaactgggtgaattctcgctgactcgcactttcaaaggccatgctgccgataagaaggcgaagaagaagtaaggtgaagcgatgagagtatctgcaaatctgaaaagtgttcgcctgtcggctcaaaagtgccgtctggtggccgatctggtccgcggtcaatccgtagcccaggcgctgaatatcctggccttctccccgaagaagggcgcggtaatcatcaagaaagtgctggaatctgcaatcgctaacgccgagcacaacgaaggcgctgacatcgacaccctgcgtgtcaccagcatcttcgttgacaagggcgctagtctgaagcgtttcactgcccgtgctaagggtcgtggcaaccgcatcgaaaagcagacctgccacatctcgttgaccgttggcaattaaggggtaagaaatgggtcagaagattcatccgacgggattccgtcttgccgttaacaaaaactggtcttccaagtggttcgcgtcctcgcagaacttcccggaaatgctgaagcaggacatcgaagttcgcgaattcctgaagaagcgtctgggtcatgcttcggttggccgcgtcaccatcgagcgtccggccaagtccgcccgcatcaccattcacagcgcccgtccgggtgttgtgatcggtaagaagggcgaagacattgaagttctgaagcaagaactgcaaaagcgcctgggcgtcccggttcacgtgaacatcgaagaagttcgcaagccggaactggacgcgcaaatcatcgccgacggcatcgcttcccagctggagaagcgcgtgatgttccgtcgcgccatgaagcgcgccatgcagaacgccatgcgtctgggtgccgaaggcatcaagatcatgtcgtccggccgtctgaacggtatcgacatcgctcgtagcgaatggtaccgcgaaggccgcgtgccgctgcataccctgcgcgccgacgtggattacgctacctcggaagccaagaccacctacggtatcatcggcatcaaggtatgggtatacaaaggcgagctgaagccgggccaagttgtggccgcgccggcagctcccgagaagaaaatgagaaagggtgcccgcaatgctgcagccaactagactcaagtaccgcaaacagcacaaaggccgtaacaccggtatcgccactcgtggcaacaaggtgagctttggcgatttcggtctgaaggctatgggtcgcggtcgcttgacggcgcgccagatcgaagctgcgcgtcgtgcgatgacccgtcacatcaaacgtggcggtcgcatctggatccgtatcttcccggacaagccgatcacctccaagcctgccgaagtccgtatgggcgggggtaagggctctccggagtactacgtggctgaaattcagcctggcaagatgctgtacgaaatggatggcgtatccgaggaactcgctcgcgaagctttccgtctggccgcagctaagttgccgatcgccactgtgttcgtaaccaaacaggtaggtcagtaatgaaagcgtccgaactgaaagccaaaactgttgatgagctgaaggtggaactgctgagcctgctgaaggcccagtttgcgctgcgcatgcagcacgctactcagcaactcgccaagacctctgaactgaagaaagtgcgtcgcgacatcgctcgcgttcgcaccgttctgaaagaaaaggcagtttaagatgagcgaaaccaaagtagtacgtacgctgaccggcgttgtggtcagcgacaagatggataagactgtaaccgttctggtcgagcgcaaggttaagcacccgatctacggcaagattatccgtcgctccaagaagttccacgcacacgacgagaacaacgagttcaaggcaggcgacctggtagtcatcagcgagtcccgtccgctctcgaagaccaagtcgtgggtggtaactggcctggttgagaaatctcgccaggtataaagcttgcagaggacttcggtcctctgtataatggccagctcttgcatctactttgcaagagttccgcccttacggggtccaaaactggccgtttgacacgccacaggttgtctgtggcgtttcgtctgtttggtcttgctcttatgcgagaaaccggcaggtgaaagtgacggataaagttggattagaaaggtaatcatcaaatgatccaaatgcagaccatgcttgaggtcgctgacaacactggtgcgcgtcacgttatgtgcatcaaggtgttgggtggctccaagcgtcgctatgctagcgtaggtgacattatcaaggtgagcatcaaggatgccgctccgcgtggtcgcgtcaaaaaaggcgacgtctacaatgcggtcgtggttcgcactgccaaaggcgtgcgccgtccggatggctctttgatcaagtttgacagcaacgctgctgttctgctcaacaacaagcttgagccgatcggcactcgtatcttcgggcccgttacgcgtgaactgcgtaccgaacgcttcatgaagatcgtttcgctggctcctgaagtgctgtaaggaggtcacatgcgcaaaattcgtaaaggtgatgaagtcgtagtaatcaccggcaaagacaagggtaagcgcggcaccgtcctgcgtgttctggatgagaagctggttgttgaaggcgttaacgtcgccaagaaacaccagaagccgaatccggtacgtggcgtggctggcggcatcgttgaaaaaaccatgcctgtggacgcatcgaacgtcgcgattttcaatccggcaagccaaaaggctgaccgcgtgggcttcaaggttcttgaagacggccgtaaggtacgcgtgttcaagtccagcggcgaagttatcggcgcctaaggagcaaacatggcacgtctctacgatttctacaaagacagcgtagtgccggaactgatgaaacagttcggctacaagtcgatcatgcaagttccgcgtatcgagaagatcaccgtgaacatgggcgtgggcgaagccgttgccgataaaaaggtaatggaattcgccgtgggcgatatggaaaagatcgccggtcaaaagccggttgtcaccaccgctcgcaagtccatcgccggcttcaagatccgcgacaactacccggtaggttgcaaggtaactctgcgtcgcgaacgcatgtacgagttcctggaccgcctggtaaccatcgcgctgccgcgcgttcgcgatttccgtggtgtatccgccaagtccttcgacggccgcggcaactacaacatgggcgtcaaagaacagatcatcttcccggaaatcgagtacgacaagatcgatgctctgcgtggtatgaacatcactgtcaccactacggcgaagactgacgaagaggcccgcgcactgctggccgcgttcaagttcccgttcaagggttaagcacatggcacgacttgcactgattaaccgtgaagaaaagcgcgtcaagctggctgagaagttctccgccaagcgtgaagccctgatcgccaccatcaacaaccagagcctctcggaagaagagcgtttcgccgcccgcctgcaactgcagcaactgccgcgcaatgcttccccggtacgccagcgtcgtcgctgcgccatcaccggtcgtccgcgtggcgtattccgcaaattcggtttgggtcgcaacaagctgcgtgagatcgccatgaagggcgagattccgggcgttgtgaaggccagctggtaataggagacacataaatgagcatgcacgatcctatttccgatatgttgacccgcatccgcaacggccaacgcgcttccaaggtggctgtttccatgccgtcttccaagctgaaggttgcgctggcgcaggtgctgaaagaagaaggctacatcgaagacttcgccgttgccggcgaagccaagaagcctgttctcgatatccagctcaagtactacgctggccgtccggtgattgagcgcatcgaccgcgtttcccgtcctggcctgcgcgtgtacaagggctccaccgaaatcccgaaggtcatgaatggtctgggcgtggcgatcctgtccacttccaagggcatcatgactgaccgtaaggcacgctccaccggcatcggtggcgagctgctctgcgtcgtggcttaagggggtcaaatgtctcgcgtagctaagaatcccgtagccattccggctggcgttgaagttaagttcaatgctgcagaagtgactgtgaagggcgccctgggcaccctgagcaccgctctgtgcgaagaagttgaaatcaagctggacaacggccagctgactttcgctgccaagaacgacagcaagttcgcacgtgccatgtccggcaccctgcgcgctctgttgaacaacatggttaacggcgtatccaagggcttcgagaagaagctgcagctggtaggcgtgggctatcgtgcccaagcccaaggcgacacgctgaacctgtctcttggtttctcccacccggtggcccacaagatgcccgaaggcatcaaagtggaaaccccgactcagaccgagatcctggttaagggcgctaacaagcagctcgtaggccagatcgcagctgaaatccgcgcttaccgcgctcccgagccgtacaagggcaagggcgttcgctacgctgatgaagttgtggttctgaaagaaaccaagaagaagtaactgaggcactgatatggacaagaaacaagctcgactccgccgcgcacgtaaaacccgtgcccggatcgcggagctcaagatggtgcgtctcactgtgtaccgcaccaacagccacatttacgcccagatcgttgacgagaccggcagcaaggtactggctagcgcttcctcgctggaagccgatgtacgcgctgaactctccaacggcggcaacgtggcagctgcggccgtgatcggcaagcgcattgccgaaaaggcaaaggctgctggcatcgagaaagtggctttcgatcgttccggtttcaaataccacggtcgcatgaaggcactggctgacgccgctcgcgaacacggcctcgtattctaattcggagtgaagaatggctaagcacgaaatggaagatcgcggcgacggtctggtcgagaaaatgatcagcgtcaaccgcgtcaccaaagtggtcaagggcggccgtatcatggctttctctgccctgaccgtagttggtgatggcgatggcggtatcggcatgggtaagggccgttccaaggaagttccggttgccgtacaaaaggcaatggaacaagcccgccacaccatggtcaagatcccgctgaaaaacggcacgctgcagcacactgtagtgggtaagcacggtgctaccaccgtcttcatccagccggctaaagaaggtaccggcgtgaaggccggcggcccgatgcgcgcgatcttcgacgcaatgggtgttcacaatgtttcggccaagattcatggttccaccaacccgtacaacgtggttcgtgcaactctgaacggcctgagcaacatcaacactccggcgcaaatcgccgccaagcgtggcctgagcgtcgaggacatcctgggggtgggtcatgagtaacgccaagactgtcaaggtcactctggtaaagagcctgatcggtcgcctggagtctcacaaggcctgcgcccgtggtctgggtctgaagaagattcgccagactgttgaagtgctcgatacccctgaaaaccgtggcatgatcaacaagatcagctacctgctcaaattcgagggctaagagatgctgctgaacaccgtacaaccgggcgtcggcgccaagcatgccaagcgccgtgtaggccgtggcatcggctccggcctgggcaagacttgcggccgcggccacaagggtcagaagagccgcgctggtggtttccacaaggtcggcttcgaaggcggtcaaatgccgctgcaacgtcgtctgccgaagcgcggcttcaagtcgctgacggctcgcttcgtttgcgaagttcgcctgtccgaactgaacctgctgccggtcgatgaaatcgatctgctggctctcaagcaagccggtctggtatctgcccaggcacaagttgccaaggtagtgctgtccggtaaggttgagcgcgcggtcaaactgcgtggtatcagcgttaccgctggcgcccgcgctgccatcgaggctgccggcggcagcattgaataaggcataaatttgtggcgaatacttctctagtggcaaatgccaataagtttggtgatctgaagcgtcgaatctggttcctgattggagcattgatcgtttaccgtatcggtgcgcacattccggtgccgggtgtcagccctgccgagctagcgaagttgttccacacaccgcagacgggcctgctcgacatgttcaacatgttctcgggcggcgccttgtcgaggttcacggtgtttgccttgggcatcacgccgtacatctcggcctccatcattctgcagcttgcggccgaggcattgcccagcctgaagcagttgaagaaggaaggtgatgcgggacgtcgcaaaataacccagtacacgcgctatgcaaccgtgctgctcgcgactttccaaagtttcggcatcgcggcaatgttgtataggcagcccaacctggtgatgaccgctcagtgggagttttacctgacgtcggtggtgtcgctggtcaccggaacgatgttcctgatgtggctcggcgagcaaatcaccgagcggggcatcggcaacggtatctcgctgatcatctgcgcaggtatcgcttcgggcgtgccgggcgccatcggcaaaaccctgactcaaacgagcctgggtgcgatgaacgctctggtcgccatcgcgctgttcgtcggcgtgatcctcgtcacctacgtggtggtgtttgcggagcgcggccagcgcaaggtgttggtgaactatgccaagcgtcaggtcggcaaccgcgtcatgcagggtcagagcacgcatctgccgctcaaactcaacatggcgggcgtgatccctccgatcttcgcgtcgagcatcatcctgttcccggccaccattcttggttggttcggtcagggcgaacatatgtcgtggctgaagggcgtggctgacaagctgcatccgggtcagccgatctatgtgctgctgtatgccgccgcgatcgtcttcttctgctatttctacacggcgctggtattcagcccgaaggaaacggcggataacctgaagaagagcggggcgttcattcccggcatccgtccgggtgagcagacttctcggtacatcgagaagatcatcctgcggttgacgctgatcggtgcgatctacatcacgctggtctgcctgctgcctgagttcctgatcctgaagtggcacgtgccgttctactttggtggtacgtcgctgctgatcatggtggtggtaaccatggacttcatggcgcaagtgcagtcctatgtgttgtcgcatcagtacgagagcttgttgaagaaggctaacttcaaaggcaacgctctcacccgctgacacatacactgggttacatggctaaggaagacactatccagtttccgggcccggtttggtagattcgcttcacgcgattttccggtcggttcgaaagtggacacgtggttctggggcatatctccggcacggtgcggatgcctggcatccgcatcctgtccggcgacaaggctggcgcggggaagcccgcgcgatccgtcccaggcatggattgtgttccgtgcgaagtaacgcattcgctcttttttggatttgaaaggatctgaacatgcgagtacagccttctgtaaagaagatttgccgtaattgcaaaatcattcgtcgcaatcgcgtagtacgcgtgatctgcacggacccgcgtcacaagcaaaaacaaggctaacatttgttagacctggatttgcgtgatacaatcgcaaacttttcaaggtcttaaggcttaaggaaagagtatggcccgtattgcaggggtaaacatccccaatcatgcgcatgccgttatcggcctgcaggcaatcttcggcgtcggtcagactcgcgctcagcacatctgtgctgcagccagcgtgaatccctccaccaaggtgaaggatctgactgaagctgaaatggaagctctgcgtgatcaagttgccaagttcaccgttgaaggtgacctgcgccgcgaaatcaccatgagcatcaaacgtctgatggacatgggctgctaccgcggcatgcgccatcgtcgtggcttgccgtgccgcggtcagcgcactcgcactaacgctcgtacccgcaagggaccgcgtaaggcgatcgccggcaagaagtaatcttaaggaacacagagaatggctaaagcaaacacagctgtccgtgtacgtaaaaaagtgcgcaagtctgttagcgaaggtatcgtgcacgttcacgcttcgttcaacaacaccatcatcactatcaccgaccgtcaaggcaatgcactgtcttgggctacctctggcggcgctggttttaagggctcgcgcaagagtacaccctttgccgctcaggtagctgcagagcacgctggtaaagttgcccaagaatacggtgtgaagaacctggaagttcgtattaaaggcccgggcccgggtcgtgaatccgctgttcgcgcactcaactcgctgggcttcaagatcaccagcatctccgacgtgacgccggtaccgcacaacggttgccgtccgcccaaaaaacgtcgtatctaattcggagagtgtgagaacatggcacgttatattggcccgaagtgcaagctcgctcgtcgtgaaggcaccgaccttttcctgaagagcgcgcgtcgtgcactggattccaagtgcaaactggatacccctcctggtcagcatggcgcccgtcgcggtcgcctgtccgactacggcgtccagctgcgcgaaaagcaaaaaatccgccgcatctacggcgtactcgagcgtcagttccgcaactactttgcggaagctgtgcgccgcaagggctccacgggcgaaaacctgctgaagctgcttgagtcccgcctggacaacgttgtatatcgcatgggctttggctccactcgcgccgaagcgcgccagctggttagccacaaggctattgttgtgaatggccaggttgtgaacattccgtcctaccaggttaaagccggtgacgtagtgtccgtccgcgaaaaggccaagaagcaggcccgtatcgctgaaggcctggctctggccgagcaaggcggcttcccgtcttgggtgtcggttgactccaagaaaatggaaggcgtcttcaaatccgcaccggaacgttccgaactgtctagcgatatcaacgaacaactcgttgtggaattctactccaagtaatcgctagctcttagggaatgactatgcaaaacagcgcttcggaatttctgaaaccccgtctcatcgacgtacagccggtttccgcaactcacgctcgtgtgtcgatggagccgttcgagcgcggctatgcccataccctgggcaactcgctgcgccgtattctgctgtcgtcgatgccgggctacgctccgaccgaagtgactatcgctggcgttttgcatgagtattccgcgcttgatggcgtgcgcgaggatgtcgtcgacatcctcctcaacctcaagggcgtagtgcttaagctgcatggtcgcgacagtgtcgtgctgaccttgaaaaaggacggtgaaggcgctgtcttggctagcgatatcgagctgccgcatgatgtggaagtgatcaatccggaacacgtgatttgtcacctctcctccggcggcaagatcgacatggagatcaagatcgaaaagggccgcggctatcagccggtgtccgttcgatccagccatgatgacaaccgttccatcggtaccatccaactggacgcttccttctcgccggttcgccgcgtgagcttcgctgtggaaagcgcccgtgtggaacaacgtaccgacctcgaccgcctggttctcgacatcgagaccaatggcgtcatcgagccggagcaggctgtgcgcaacgcagcccgcatcctgatggaccagctgtcgatctttgctgatctccagggcacagcggttgaagaagtcgttgaaaaggcgccgccgatcgatccgatcctgctgcgtccggtagacgatcttgaactgacggttcgttcggccaactgcctgaaagctgagaacatttattacatcggcgatctgatccagcgtactgaaaccgagcttctgaaaactccgaacctcggccgcaagtcgctgaacgagatcaaggaagttctcgcttccaagggcctgactctcggcatgaagctggagaactggccgcctgctggcctcgaaaagccgtaaggtttgagataaaaggacattaacaatgcgtcatcgttacagtaatcgtaaactgaaccgcacgaccagccatcgtctggcgatgctgcgcaacatggctaactcgctgctgaagcacgaagtaatcgtgaccacgctgccgaaagccaaggaactgcgtcgtgtggccgagccgctcatcacgctcggcaaaaagccgtcgctcgccaaccgtcgtctggcgttcgaccgcacccgtgaccgcgatatcgtggttaaactcttcgacgtgctcggcccgcgcttctccgcccgcaatggcggttacgtgcgtatcctgaagtacggtttccgcaagggcgacaacgccccgatggctctggtagagctggtggaccgcgctgaagatgccgttgccgttgtagacgactccgccgagtaatcggcagggttgagaaaaaagccagctcgcaagagctggcttttttcatttgcggccgctgtcggccgcgagaatcaaatcaaaagatggatagcccggtgcgggtggtgaagcgatccagcgcctccagccccaataccgaattgccgcgcgaatccagttgcgggctccacaccgcgatgctcatcttgcccggtatcaccgccagcaaacctcctcccacgccgctcttcaccggcaagcccacccgataggcgaattcgccggccgcgtcgtaggtgccgcaggtcagcatgacagcgttcacctgtttggcctggctgcggctcaggtattgtcgcgtggtgacgggcgagacgccatggttggccaggaacaggccggcgcgggccagctgtcggcaactcatttcgatgctgcagttatggaagtattgctccagaacctgctcaaccggatgtcgcagattgccgtagctcttcatgaagtgcgccagcgcggcgttgcggtcgccgtgctcgcgctcggaagcggcgatgcgctcgttggccgccagcccgggcgcgccgctttcctcgcggagccagtccagcagctggcggtgggcgtcgccgaagtggcggatggcgcggtcggtcaccaccaaggcgccggcgttgatgaagggattgcgcggaatgccgtgctcgtactccagctgcaccagcgaattgaaaggattgccggagggctccttgccgacgtgctgccacagggcttcgccatcggcctgcagcgtcagcgccagcatgaaggccttgctgatgctctggatggagaatggctgttcggcgtcgccgcaggcgtagtgccggccatccagcgtgctgatggccatgccgaattggtgcggcggcaccgatgccagcgccgggatgtagtcggccacctggccgtggtcgtagaacggcagcgtctgctgccggatatcttcaatgagtgcttgcagattcattcaatgattgtaagcagcggcgatggcatcagtctagaagctatagcgctcctgcaatacctccagcggcgcgccgatttccagcatgccctcgttgcgggcgcgcaggttcatgccgaagcagacaccttcttccagcctgcgggtgcgcaccagcgtgcgcaacggttcgccgtcggcatccttgctgccggtgtcggggtctaccgtagtcagcacgcagcgggtgcagggcttcatcacatcgaattccacttcgccgatgcggatgacttgccattcgtcctccatccacgggtagtcgccgtctatcaccagattggggcggaagtggcgcagcgtgaccgggcgttgcagctggcggttcaggtcgtcgagcgaagcctggttgaccagcaggaaggggtagccgtcggcaaagctcattttctccgcgccgcctttgaaggcgcggccggattgagcgcccagccacaacagccggcactcctggcccagtatgtcggcgaaccaggcatccagccgttggtcgccgtgccaggcctggaattcgtccttccatacctgggcgcgatgcggtcgggtgtaggcggtggccatcgcgaagatcggcgccttgccctcgtaatgcagcaggatgccgccaggcatcagctccacgccgacgcgaaccagctgcgggtgggagcgggcggtgatctggtcgccgtcgggggtggtcagtatccactcgcggtcgtgcagcaggccgagcttgccggcgaaggcgcgctcgaaggcgatgccgcgggtcgatttgagaggatgaacgaacatgctggtcaattgcattgctatctccacattgcattccagcgggatgctaccaccgcaaggccgtggagtgttgccgagtgggcgccgagttgtccgacgaagcggtttttaagcgctggccacagtaagcgctgcgctgtttgtaagggggccattgcatatattcgcccggcaatttaaattgattacccagctgcttattgtcggattgttttgatgttgtccgaaatgccgtctcgcgcggcggcttcgtgatcgggatcaaacgtcgatggctgatgccctggcaatgtggaggcgcgatggaattgggcgttgagctttgtttggatagagactacaacctgagtagcaatacatcataacagtgcctgacgcagcgacgctggagctgtgatggcgtcgcaagtgattggggatgaggagaaagtgctatgcgctctttgcgtgtgaaactgattgcttttattgccttgttgttggtggtgctgggcgtggtgattacgattctggtctacggccagatgcgtaacgagatcatccatggcgtggaaaacgagctggacggcacttcgaaagggtatgccagccttgtgagcggctggtacaagagcaaggtgggggtggtgatcgcggccaatcctttggttggcgaaaccgacccgcgccagaccctggcccggctgagccaggctggcggcttcgacatgacctatatcggcaccgcgcagcacgtgatgctgcgctccgacatgaagccgcaaccgcaaggctacgacccggtggcgcggccgtggtaccagcaagcggccgccagcggcaatcccggcgtgtctgacccctatgtcgatttcgacaccaagaagctggtggtgaccttcgtgtcgccggtgaaagacggcagcggcctgaaggcggtggtcggcggcgacatcttcatcgatgatctggtcaagactgtgctgtcggtgaagttgcgcggcaacggctacgccttcctcaccgacaagagcggcaaggtgatcgcccaccccgacaacagcctgaccttgaagccgctgacggagaaagtgcccgagctgaccgcagaccgcctgacgcagctggccaacagcaacgaaatgggccgcatcagcgtcggcggcgaagagaaactggtggaagtgcagccggttgacggcaccaactggctgctgggcgtggtgaccgacgagtcggtggtgtccagcccgctgcacaccttgctgatgaccatcgtcggcctgggcgcgctgtgcgtgctgattctgatcccggtcgccagcgtgatgctgagcaagatgctggccggcctcggccgcctgcgcagcgcgatgctggagatttcccagggcgagggcgacctgacccgccgcatcgaggtgaccggccaggacgagatcgccgaaaccgccaccgccttcaaccgcttcatcggccaactgcagaagatgttcatcgcagtgaaggaagaggccgagaaagtcaccggcggggtggagagcgtcacccagaccgtggacaaggtggcgcacgattcgcgccagatcgccgacgtgtccagttccaacgccgctacgctggagcagatcaccgtcagcatctcgcacatcgccgacgccgcgcgggaagcggacggcctggtgacccataccggagacgtgtccagcgagagcgccagcggcatgcagcggatctccagcgagatgaacagcacggtggaggcggtgaagggcttgtccggcatgctgtcgtcgctggatcagcgttcgcagcagatcagcggcatcaccaatgtgatcaaggacatcgccgaccagaccaacctgctggcgctgaacgcggcgatcgaagcagcgcgcgccggcgaaatgggccgcggcttcgcggtggtggccgacgaagtgcgcaagctggccgaacgcaccggccaggccacggtggagatctccggcatggtcagcacgatccgcgaggaaaccagccaggcggtcagcaatatgcagcgcaccgtcaactcggtggatggcggcgtcgagctgacgatgggcgcggtggagcgcatcgagcagatccagaaggcgatggaagaagtgatggccaagatgaacgaaatcaccttgtccaccagcgagcagcacaaggccaccacgctgatcgcgcagagcaccgagcagatcaacggccgcatcgtcgacagcgacgatgcgctgcagaccgtccgcgacacgctgagcgagttgtcgcattcggccagcagcatgcgccagctgttctccagcttccgcgtgtaagccagcaggaaatcccccagcccggcaatgccgggctttttattgcgcgccgcggccaattcggcatggcggcggggggaggcgctttctagaataagtccatagtagaactatcagaatgagcacatcttagacatgtgccaggggaaggagcgggaaatgggaagcatggcgggaatgagcctgaagaccaggctgttcggcttgatggcgctggtggtgctggtggtgtgcgcattgggggtggcgacggtgttcagccagcgccaggcgatgatgcaggaccgccaggacaaggtgcgcaatctggtggagagcgcggtgaccctggtgtccacctacgagcgcttggcgcaaagcggcaagatcagcgaggccgacgccaagcgcacggtgtcacaggtgctcagttcgatgcactatgaccagcgcgagtattttttcgcctatgacgccgactggaactatgtcgcccacggcgccaagccggaattgataggcaagaacctggccggcgtcaaagaccccaacggcgtggagctgaaggatctgttcgccagggccatcgcctcgccgggcggaggcggtttcggcgaatacgtgtggaacaagccaggcttcgacaagccgcagcccaagatgtcatacgtcaccaccacgccgggttggcattgggtggtgggcactggcatctacctggacgacgtcaacgcggccttccgcgatcagctgctgaccctgggcgtggtgctggcggtggcgttgctgctgctgttggggctgggcggcctggtgctgcgcaatgtgctggggcagctgggggccgatcccttggagacggtggcggtggtcaagcgcatcgcctccggccaattggccgagccggtcagcctgaagcgcggcgaccagaccagcctgatggccgcggtcagcggcatgcaggaggagctcaggcggctggtgcgcgacatcgtcgccgacgccaaccagctgtcgcggatgagcggcgaggtgaccagcgaagcggcggtggtcggcaagggctcggaacagcagagcgaggcggccaccgcgatggcggcgtcgatcgagcaattgacggtcagcgtcaatcacatcgccgatcgttcgcaggacgcgcgcgacctggccagcgagtccggcagccgctccaagagcggcagcgcggtgatcgccgaggcggtgagcgagatgcgccgcatcaacgaggcggtggaccagacttccggcatcatcaccagcctggccgacaagaccgatactatctccagcatcatgcaggtgatccgcgacatcgccgaccagaccaatctgctggccttgaacgcggcgatcgaggcggcgcgcgccggcgagatgggccgcggcttcgcggtggtggccgacgaggtgcgcaagctgtcggagcgcaccgcgcaggcgacgcaggaaatcgccaccatgatccaggacgtgcagcagggcgcgcagaattcgcgcagcagcatggaggaggcggtggcgcgggtgaaggcgggcttggggctggccgaacaggccggcgacgagatcgcccgcatccaggacagcgccaacggcgtgatcgcggtggtcggcgacatctccttcgctttgcaggagcagagcgtggccagccagaccatcgcccagcatgtcgagcagatcgcccacagcgccagcagcaacgccgtcgccacccaggcggcggcgcgcgccatccagaatatggaccagctggcatcgaatctgcgccagctggtggcgcgcttctcggtgggcgagcgctccgcctagtgctggccgcggcggcgccagcccagcgccagcgccgccagcagcagcaagccgcagcccagcgccaccggcaggttgccgacgcgcatgtatggggtcaggccctggcggctctgggcgaagccggtcagcacctgggcggtgaacggcgcggcgatggcggaaatttcgccgtccggccggatgatggcggtcatgccgttattggtggcgcgcagcatgtagcggccggtttccagcgaacgggcctgcgacagctgcaggtgctggctcatcgcctcgctcttgccgaaccaggccaggttgctgacgttggccagcatgccggcctgcgccgccgggccggacagctcttcgccgaaactatcctcgtagcagacgttgaaggccactttctggccggccagcagcagcggcggctggttggcgccgccgcggctgaagccggacagcggcatgttcatatactggtagatccagcctatcaggccgggcagcgggatgaactcgccgaacggcaccaggtggtccttggcgtagtacggcattttcggatcggacaacgccaccaccgcgttcagatagccgcggccatcgttggtgcggcgcggaatgccgctggccagcgccatgccggcgcggctggcctcgccgcgcatcatcgacagatagccggaaggcaggtcgtccaggaatagcggcagcgcggtttccggcagtatcatcagatcggcgcgggtcatcgccacctggcggtagtaagtgagcagcgactgctccaggttttccggcgtccacttcaattcctgggcgatattgccctgggccagcgccacgctgatcggcttgccctgaggcgcggtccactccacatcgcgcagccagaagccgctcagccacagcagcgaggtggcgatcacgatgcccagccgcaagcgcatgccgctgcgcgccagcatcatcagcgcgccggcggacagcgccaccagatagctgaccaagtggatgccgccgatcggcgcgtagccggacagcgggctttcggtgatttgcgaatagccggcggcggcccaggggaagccggtcatcacccagctgcgcagccattcgcccagctcccaggcggcggggaaggccaccaggtagcgcacccaggggcgagggtcgacgcggcaggccacccaggcggccaggcccgggtacagcgccagataggccggcagcagcagcaccagcggcgcggcgatcagggccggcaggccggcgacatcgtgcaggctggcgtacagccagtggaagttgctggtgtaggcggccaggccccagacatagcctatccagaaggcgcggcgcggctcgcgctgtatcagctccagcagcgcggccaggcacagcggcatcagccagaacagccggtagggcgcgaaggaaaacacggtgagggcgccggctagcgcggcggccaggagcaggatcagtattcgcatggctagcgtgtcgtttgcggtagtgggagggcggcagccggcgcggcgcaggctgccttcagcataggccttattcggcctggccggcgctcagctggatgcgttccaccagcaggctgtccaggcggcggctgtcggcgcgcagcacggtgaagcgcaggccggcggcctcgattttttcgccgcgcttgggcaaatggccggtgagcgagatcaccaggccgccgacggtgtcgacatcgtcgtcggcgtagtcggtgccgaagtagtgattgaagtcttcgatctcggtcagcgccttgacgcggtaacgctcgttgccgcgcaccggcacgatgtcgtcctcgtcgtcctcgatgtcgtattcgtcctcgatgtcgccgacgatctgttcaatcacgtcttcgatggtgaccaggccgcagacgccgccgtattcgtcgaccaccaccgccatgtggttgtgggtggcgcggaagtcgcgcagcagcacgttcagcggtttcgattccggcacgaacaccgccgggcgcagcacgttcttcaaattgaaggtggcgggcgcatggaagtaacgcagcaactccttggccagcaggatgccttgcacgtcatccttgctttcgcctatcaccgggaagcgcgagtggccggagtcgatgacggtcggcaggaagcgggagatcgggtcgtcgatgttgagcacgtgcatctggctgcgcgggatcatcacgtcccggacggtcagttcgctcacttccagcacgccttctatcatgccgagggcctcggcatccagcaggttgcgctcgaaggcgttgtgcagcagctcgatcaactcctcgcggtcttccggctcgcgcaagagcatggtggacaggcgttcaagccaactgggccgcggtttactggggtcttccatttcttagaactgctcctcgtggtaggggtcgggatatcctagctgtttaacgatgacggtttcaagcgcttccatcgcctcggcttcgtcgtcttcttcgtggtcgaagccttgcaggtgcagcatgccgtgcaccaagaggtgcgcgtaatgggccatcaggtccttgttctgctccgcggcttccttctccaccaccggcgcgcacagcaccaggtcgccgaacagcggcaggccggccaccggctcgccttcgttcagcgcgaaggacaggacattggtcgcataatccttgccgcggtagtcgttgttgagctgacggccttcagcggcgtcgacgatgacgatgctgatctgcgctttttcgacgccgcgctgcagcgcggcctggcaggcgcggcggatcagcgccggcggcggcagcgcggcatcgctgcgcacgtccagggtcagctccagccgcgcgcgcaggcgggccagcagggggtggcgtttagcttgtttcatcttgcttgctttggtaagtgtcgtaggcgtcgacgattttctgcaccagcgggtggcgcaccacatcttggctattgaaatgatggaaatggatgccgcgcacctggccgaggatgcgctccacctcgaccaggccgctcttctggtggcgggccaggtcgatctgggtgacgtcgccggtgatcaccgcgcgcgagccgaagccgatgcgggtgaggaacattttcatctgctccggcgtggtgttctgcgcctcgtccagaatgatgaaggcgtggttcagcgtgcggccgcgcatataggccaagggcgcgatctcgatcaggttcttttcgaacagccgggtgacgcggtcgaagcccatcaggtcgtacagcgcgtcgtacagcgggcgcaggtaagggtccaccttctgcgccaggtcgccaggcaggaagcccagcttctcgcctgcctccaccgccgggcgcaccagcacgatgcgcttgaccgcgtcgcgctccatcgcgtccaccgcgcaggcgacggccagataggttttgccggtgccggccgggccgatgccgaaggtgacgtcgtgttgcagaatggccttgatatagcgcgcctgattcggcgtgcggcccttgaggtcgccgcggcgggtggccagcaccggcgactcttcctgctcgccgctggtctggcgctggcgcagctccaccagcgacagctgcacgtcgtctatcgatacgtcctgctgggcggccagcaagtagagccgggtcagcgcctccaccgccagcttggcctgttcgccctgcacgcggaaggtttcgccgcggcgttgcaccaccacgtccaggccggtttcgatctgtttcaggttttcgtccagcgggccggccaggcgggccagccgttcgttgtccaccggattgaagctcaggggttcggttgtgctcatgcgtttcgcagctgttggctaagcgttgcaaaaatggcggcgtggctgccgggcgcgacatggcgcaccgccatgcccagccgccgcgccggttctatgtcgcgttcgaggtcgtcgcccaccatcaggcaggcgcgcgcttcttgtccagccagctccagcgcccggcggaagatgcgcgcgtcgggcttggcggcgccgacggcgtcgcaggtgagcaggtggcggaaatgatgggcgatgcccaggtgctccagcttggcgcgttgctgctcggcgccgccgttgctgaccacgatgcggaccaggtggcgggtggcgtcgagaaaatccgccgcgccgggggtgagccggcggtggcggcggtaggcgtccatataaggctggaacagcagggcggcttcggcttcgctcatgtccggcgcgccgaggaagtcgcgcaggcgctcgtggcgttgctgcgcgaggctcagttcgcccagctcgaagcggcgccagtggcggtcgatgcagccgcgccagcgcgcctgcagcgcgtcgggcggttgggagaagcgcgaggcatgcgggccgatgaacgctgcgaacgcctgcgcgctggcgtaagcgtcgtcgaacagcgtgtcgtccagatccagcagtatcgcccggatgccctgcggcttcatgcttccttcaatccttccagtccggcggcggtcatgctcgggacgaattcgatgatgtcgtagcgggccacgccggctttggcgaacgggtcgtccgccaggcgggcttccagcgcagcgcgctcgccacgggccaggatcacgccgccgctgcgcggcaccttgcggccggaggccaggaacagcccgtcggcgtaagcctggttcagccatgccacgtgggcgggcagcagcgcgtcgatgtctgacagcggggcggtgtaactcagcgagacgacgtacatcacggtttctccatggcgggacgatgcacagcatacgcccggcgccgcgccgacgatagcatggcgatggtatgcacgcggctcaaacgctttcgtgaaccaacgcctcgccggccagcgagtgcggccgcgcctcggtgatgcgcacgtcgatcatctggcccagcagccgcggatggccggcgaagttgaccacgcggttgttggcggtgcgcgccgccagcatggcgtcgtccttgcgcgacacgttttccaccagcaccctctgcacgctgccgaccatcgccttgttgatttcgaagccgcgggcttcgatgacggcgttcaaggcttccagccggcgcactttctccgcgtgcggggtgtcgtccgccagattggcggccggggtgccggggcgcgggctgtagatgaacacgtagctgaagtcgaatgccaggtcggtcaccagcttcagcgtctgttcgaagtcggcctcggtttcgccggggaagccgacgatgaagtcggacgacaggcacaggtccgggcggatcgcgcgcagcttgcggatgatggatttgtattccaggctggtgtagccgcgcttcatcgccatcagcacgcggtcggcgccggactgcaccggcaggtgcaggtgggaaaccagtttgggcagtttggcgtagcagtcgatgatgcgttgggaaaattcgcgcggatggctggtggtgaagcggatgcgctccacgcccggcacctcgtgcacgtattccagcagcagcgcgaagtcggcgatctcgccgtcggccatcaggccgcggtaggcgttgacgttctggcccaggagcgtgatttccttgaccccctgcgccgccaggccggcgatttcggtcagcacgtcctcgaacggccgcgacacctcctcgccgcgggtgtagggcaccacgcagaacgagcagtatttggaacagccttccatgatggacaccatggcggcggcgccgtctaccttggccggcgggatatggtcgaatttctcgatttccgggaaggagatgtcgacctgagcgcggccgctgtcgcgcttggcgcggatcatttccggcaggcggtgcagcgtctgcgggccgaacaccacgtcgacgtagggcgcgcgcttgacgatggcgtcgccttcctggctggccacgcagccgcccacgcctatgatcaggccgggtttggcttccttcagcgggcgcacgcggcccagatcggagaacactttctcctgggccttctcgcgcacgctgcaggtgttgaacaggatgatgtcggcgtcttccggagtatccgtcttgaccatgtcttcggtgctgcccagcacgtccgccatcttgtcggaatcgtactcgttcatctggcagccgaaggtcttgatgtataccttcttcattgctactcgggtttcctgcggttcggtttaaggggtggtccgggcctggcgctgcttcagcgcctcgatctcatcgtcgcccagcacccagatgcggttgatgctgccttgcggatcgaaggtcacgcctacggttttgcccctgagatcattcaattgcccgctcagcagaaagcggttgccgccatcgaagatgcgcaggccgggggccagcgcgaaacgcggcggcggcacggcgatcagcccccctagccgctgcaggaaggtttggtcggcgcggacgaaggcgatgccggcggcgttctggtcgcccaacttgcccatcaccaggctgtcgggcagcagcctgccggcggctgcgggcagggcgaggcatagacagagggcggcgatgggctttttcatagcaatttgaacgctttgcgcgcgattctaccatagacggcccgactggtcgggcggggccagatgtttatagcattttttccggctactcggccgccagcgccgcaggccgaaagcgttcggccaacgcgaacatcatcgggttgagcaggatggaaacgatggagccggccaggatcagcgcctggccgcgcgggctgagcaagcccagcgacatgcccagcccggccaggatgaacgagaattcgccgatctgcgacaggctggcggcgatgcgcaggctggtggcgcggccgcggcggaacagccgcacgatgccgtaggcggccagcgatttgcccagcacgatgatcagcacggtggccagcagcgtcggcgcgtcgttgagcagcacttgcggattcagcagcatgccgaccgacacgaagaacagcaccgcgaacgcctcccgcagcggcagcgactcctcggccgcgcggtggctgaacggcgattccgccatcaccatgccggcgaagaaggcgcccagcgcgaacgaaatctggaacagctgggtggcgccgtaggccacgcccagcgcggtggccagcacgcccaggcggaacagctcgcggctgccggtgtggacgacgcgctccagcatccagggaatgaagcggcgcccgaccaccagcatcaacgcgacgaaggccgccaccttgcccaccgtcagcatcagcgtccagcccagttgctcgagcgacggcgcggcctgggcgccgcccagcgcgccggccaccgccggcagcagcaccagggtcagcaccatcaccaggtcttccaccaccagccagccgacggcgatcttgccatcctcggtttccagccagccgtgctcttccagcgcgcgcagcagcaccaccgtgctggccaccgacagcgccaggccgaacaccaggccttcgcccagcggccagcccaggaagtgggacagccccatgcccagcaaagtggccaccgcgatttgcgccagcgcgcccggcacggcgatggccttcaccgccatcaggtccttgatcgagaagtgctggccgacgccgaacatcaatagaatcacccccagctcggccaattccggcgccagcgcggtgtcggcctggaagccgggcgtgaacggccccaccaggatgccggcgcacagataacccaccagcggcggcaggcgcaggcgcagcgccagcatgccgaaggcgaaggcgaataccaggccgccgacgatggtggtgatcaggggggtgtcgtggggcatgggcggaattccggttgaatggctggatggtataaagacggaatatcaggaaccgagttccgataaatttattatttcattcagctttcatcatggcgcgaagccaggccgcgagccttgatctgctcgcgatgaggcgtccgcggcggcggagcaaggcgcagcgccatcaaatggaaagccggaggcgccagcccgcgcggcggagtcgggctggctggcgcgggcaagggtcagaagcgttcgaacggctgcagatagcgccattgtcccggctgcagtccggccaaggccaggcggccgatgcggatgcagcgcgcgctttgcaggcggacgccgagctggcggctgatttcggcgaagaaaccggcgcgcggcgcgtaaaccgcgcagcgcagctgatggtcgctctggcggctgatcttgcattggcgcaacggtttgccgtccaggcggatggctgcgacgcgcgctttaagctcgtcggccgccggcgcctgctccacttgcagcaggaattccatctcgcactcggccagatggcggggcagttttttatcctgggtcagcaccagcaggccgtggcattgctcatccacggcgccgaaggcgctcaggtgctggcggtggcgcgccagccagacttgctccgacgcgtcctgcggcgaacggctgtcttgccccagcagttgcgccggcggcgcgtcctcgcctgccgggcggtgcagcagcatcgtcaccggcagcgcggccaaggcctgcggcttgccggccagcgtgatctcttgctccggccgcacccgcgcgcccagcgtattgacgactttgccatccactttcaccaggccctgctcgatgcaggcatcggcctcgcggcgcgagcacaggcccagttccaccatgcgcttggacaggcgcacgcttgtatcatccattggttacatccttgcgtatgtggccggcgattatccgttgccggcgcgcggctgacaaatccagtgtagcgggctgggcaggccggaggatggctggcgcggccgactgcggggtaaaggtaatttgccttttaaaatatttgatataatatatactttgataaacattttatcaattgggtcgcggtgggctcctgcacggagcgtgagggctgcggcagtcatgggggggcacgatgtcgtgcgggaaagttttgttggcagcggcggtatgcgctgggttgttgagtgggcagcaggcgatggccgcggagaatgaggggccggaagtcactttcacctctctggggcagacggccttggctgatggcagcgtttgcgtggcgggcggcgaaaccgaggacttcgtcgacagcaagtcggtggtgctggtgaaaaagaacggggcggtccggcagagaatcgctctgccgttgccggatcccaattacagcgatgggagggccatggcctgcttgcagaaaggcgcggccttgtacgtcgtcgaagagctggataccagttccatcatgaccgacaagcggacattgctgtttgtcgatcgcatcgagcatggccgcctgcagaagcgggtcatgttgccggtgcgatacagcagccagaatttcggcgtggccagagtgggggaggggcctgccgccttcatgtgggacggcgcgggccaactggtggtgcgcggcaaagtttatcgagacgcgatgggcggcaagccgggcaaggcattctccgtgaaattgcaggctgatctgacggtcgccaagtaatcaggctgtcattcgaacaattttaaggaaaccgtgatggcagaaaagaagcattactctcaacaggacaagatcaatttcatcgtttccctctatccggcggcgagagaggcctcgcgcaagagcggcatgtcgtgggagctgattcttgcccaggcggcgcaggagaccggctggggcgagaaggtgctgccgggcagcaacaacgtcttcaatatcaagacggggtcgtcctggaagggcgactccaaggtttaccatgtctgggaaaaacagaacggcaagaaagtttgggtggatgatgctttccgcgtttatccctcggtagcggattctctggcagaccggatgcaaatgttgcagaacagctcgcgttatgccaaggcggggctgatggatcccggcgtgaagggcaatatggagaaggaagcccatgcgttgaagaaaggcggctacgctactgcagaaaattacgcggaaagcatgatcgaactgttccatggccgcaccatgcgccatgcgctggctgaagcccgcaagcggcatccggagtttgacgcggcgggccaggcaaagccggccgtcgcctcgcaggcgccgcattccagcgccgcgcaggcctccccgccgccggtcaaagccgtttcggcatctgtcgcgcatgataagccggcccagcctgtcgccgcgcatgctgctcagcagcaagcgcagcaaccgaaacaatcgcagccatccgccgcggcggcttccgcgcccagcgcggagcgggtgcagaccctgttgccggaggcgcagcagcatctggtgcaggaagccaaaaacgccgtgcaggcgctgcaacagcgcgacgcccgcctgcagaagctggacgccgcgcaactggacaatctgagcggccaactggcggtcgacgccgcgcgccaaggcatggccaagatcaacggtgcggtggtcaacgccgccgatccgggcaagatcagcctggtggggcaggatgccggcaacaagctgcaacaggtcagcgcggaattcggcgcggcgccggccgcgccctcgccaaaccagccggcatcgacggtcgctgcccagccccagtccggcgccagtccggcgcagcctacgccagccaagcctgtggagcaggccgcggcggccaagccgcagatcgagcaggcgaagcccgccgcgccgcaggcggctcatgtttcgcatccgccagcacagggtgcccatggcccagccaaagcgacggcgcctgccgggccggcgcaatcggctcacgctcagcatatgccggcacaggcagcccatgctcaagccaaagcggcggcgcatgccggccaggacaagtcgcagcatccgcagccggttgccggcaacgaccgcggctcgcgcatggtcaacgccgcgctggagcatttcggcgacggcacttttgaatatggccgcgccgacatggcgggccagttggccaacaagaagaaacccaacggcaatcgcatcgatggcagccggctggaggcggacacggatcacgatggcaagaaaggcgtggattgctcatcgctggtatggcgcacgctgcagctgggcaataccaaggtgaccgatgatttcaagagcgcggcgaacttcaccactcacaccttgttcaacggcggacacggcggccagcatccccacgccaatataaccgactacgccaagcgcaacttcaatgtgatcgacaacaagaaagacctgcagccgggcgacatcctgatgttcaagatggcgggcggcggccagcacgtggcggtctacaagggcaaaaacgagaagggcgagcagatgttctacggctcgcaaacctccaccggcccggcggaagtcaatctgagcagcaatccttactggagcaagcaggccttcctgggcgcgctgcggcccaaggatgacttctacaagcctgacgccgcgccgcaggcggcccagcacgcgggcctgtccgacggcaagcaaagcctgctggagcagacgcggcagcacgtgggttcgctgcagcagcgcgacggccgcttgaaagacctggcgtcgcaccaggtggacaacctgagcgccgccctggcggtggaagggtggaaaaagggcatcgagaaggtgggcgcggtgatggtgaacgccgtcgaccccggcaagatcagcatgctttacaagagcgcggccaacaaggtcgagcacgccgcggtggagctgagggatgcgatcaagcagtcggcgcagcactcgctgtcgctgctggcggcggcgcctgagcatggccagccagcggccaaggcgcaggcgcaccagccgccggcgcgcgccaagcagccggcgatggggatgtgagggcgcgcatttcgggatttttgcagcttgtgccggatggctgccgtgcttgagcatggcggtctgtcaccagctcgcaccggatgtgcgaaatgaaggagcgttgagtgtcccatccccaaagtcgtcgtgttcttttgctgatgatttttgtgctggccatcggtttggcggtcagcatgtttttctattggcgggagcgcacgcaagaccgctattggtttgtccagcctcaggcgccgatgagttttgactttccaatggataggcctggccaaaaagtaagttcagttttttggattgttcctggaaagtttaacccacaccttaaccgctatggcgtgattgcccggtttgttttcaaacggccagaggatgtggttcccgatttgctggagcaagttaaacttgagtttcgggtgcatgtctcccgtttcgatggggtgaagtggtcgccagttgtcttatatggcgagaaacctgagaaaggagagagcgctgtcggagatgtttatctgtctggggacttgtccggcaagggcagcgaggatgaaaaacaggtgtatattgatctggatgtgcttgattataaatttgaaccaggccagtatcatgccagtgtcgaacttgtgaagggcgatgctcgtttgaagggcttggactccagagttgtatttgatcatattgtttatgggaagtagcggggagaatcatgccttacacattgagcatttatgtggcagcgccaggcaccaagctgatgggcgacaagaatgacccgaatgcgacttctgcggctgggcatgtgtggtttggaatttctgatgggaaaaaggttgatgattatggcttcgcccctaaaaatcatggaagcacgcatggggctggcatagttgagcatggcgatacgaagagatatagttctccgtactatgtccgtactatagaaataactaaagagcagtatgaaaagctgaaagagtatggtgaggccgctaagaatcattctaacaagtatttcgacttgaattataatggacttaccaatagctgcatcgactttacgtggaaaggtttgaaccatgcaggtttgaatatgcaagcgtatggcctggcaggccagcaagcgcttcccaagtacgaaggctctctcaagccggtcaacaatgccaatgattttgactccattcctgcacctattccacatagccgattgaatcatcggcaaaccaaccccttgccggaaaaccggacgttgctgcagaagctgctgaccgaaaacgacgcgctgtcgccggaaaagcagaaattcgccacgcaaaccgcgcaggcggtggaggcgctgcagcggcgcgagcccaagttggcggcgctgcagcccgggcagatagacaatctgagcgcgtcgctggcgcacagcggctggaaaaacggcatggccaaggccgatggcgcggtgctgaacgccgccgatccgggcacggccacgctgatcggccgcgacggcggccagaaaatccagcatgccagcgtggaggtggacagcgcgatccggcagccggcggcgacggcgctggcagcgctggcggcgacgccggacaaggcagcgcccgcgccggcccaggcggtgcggaccgcctcccgttcggctgggggcatgagcctgggctgagcgccggcattctttttctctaccctattggtccgcggttttacccgcggactttttttgcctgcggatttgccgcatccagcatttccggtcaggacggcgattgccgtttttggcatagtcggcgtggcgaaggaggtgtcatgggcagatccagggccggcgactatgcgcggcgtttcacgcgggttttcgatcatatcgatcaacatttgcaacagccgctcaatatcgagcggctgagccaggtcgcgcatttttcccgctttcattttcagcgccagtttgccgcttattgcggcgccagcgtggcgcgctacatccagctgcagcgcctgcggcgggcatcgtatcaactggtgttccagcccttgttgcggatcaccgacatcgcgctggatgccggctttgaaaatccggagtcgttttcccgggctttcaagcacgctttcggccagacgcccagcgcctttcgccgcgcgccggattgggcgcattggcaaacccggtttcctgttcccgtcagagagaggatggaggatatggacgtgaagatcatggtcgtggatacggtgcgggtggccgcgctggagcatcgcggcgcgccggagcgggtaaacgacagcgccagccgcttcattgagtggcgcaaggagagcggcctgtcgccgttgaccagcagccagacttacggcatcgcttacgacaacccggataccaccgcggcggcggatttccgcttcgacatttgcggcagcgtggcggggccggtgccggccaaccgccagggggtggtggccaaggagattcccggcggccgctgcgcggtgctgcgccatgtcggctcgcatcagcggctgggcgaaagcgtgtactgcctgtaccggcagtggctgccgtccagcggcgagagcctgcgcgacttcccggtgtatttcctgtacctcaacctggtcggcgcaacaccggaacatttgctgcagacggacatttatttgcccttgagctgagggcggcatcgacgcactggtattttggccagggcatggttctcaacaggatgagacttggcgtcaatcaaatgtcattgcgatggcccggcctagcatccccggtttcgactgatcgatcccgtggggaagaacgcaatgcaagccttgagaatcgtcctgttgtcctcggccttcaacggccttacccagcgcgcctggttggagctgcgcgaatcgggccacgagcccagcgtggtgctgttcaacgatgcggacgatgtctgccggcagatagaggcggcggcgccgcagctggtgatctgcccgtttctgaaagaccgggtgccggcgcggctgtggcgcgacgcgccttttccggtggtgatcattcatccgggcatcgtcggcgaccgcggcgcgtcggcgctggactgggcgatcagcctgcagcagaagcgctggggcgtgaccgcgttgcaggcggtggaggaaatggacgccggcccggtgtggtccagccgcgagttcgatctgcccgcggggctgcgcaagtccgaactttacaacggcctggtcagcgacgccgccatctattgcctacgcgacgtggtggagaagttcgtcggcggctaccagccgcaagcggtcgactatgccgatccggcggtgcgcggccggctgcagccgaatatgaagcaggcggatcgggcattcgactggcgcgagccggcggaggcgatcaagcgccgcatcgacgccggcgacggccagcccggagtgctggcggatctggccggcggccgctactacctgtacgacgcccacctggatcataggcgcggcagcccgggccagattctggcggtgcatgacgacgcggtgctggtggcaaccggcgacgccagcctgtggctgggcgcgctgcggcgcgcgcccgaggccggcgaagaaactttcaaattgccggcgcgccatctgctggcggacctgctggatgaggtgccaaggctggaatggtctatcgccacccatccgcattgcgaagaatcctatcagcctatccgctaccgccgggtcggcaaggtgggcgagctgaccttcgagttctacaacggcgcgctgagcaccgagcaatgccggcgcctgcagcgggcgctgcaatgggccaagcggcaggattgcgaagtgctgctgctgcgcagcgggcgcggcagcttttgcaacggcatccatctgaacgtgatccaggcggcgcaggacccgggcgccgaggcctggcgcaatatccaggcgatagacgatgtctgcctggagatattgaccgcgccgcaactggtggtggcgggcgtggccggcaacgccggcgccggcggcgcgatgctggcgttggccgccgacgtggtgctggcgcgccagggcgtggtgttcaatccgcattaccagaccatggggctgtacggctccgagtactggacctacacgctgtcgcgcgcggtgggggccgaaacggcggtcaagctgtgcaacgactgcctgccgctgggcgcccgccaggcctggcggctgggcatggtgcaggacattgggccgcgcgacgagcaggagttcggccgctggctgctgcaagcggcgaagcaggctttgttgacgccggcttggcaggcctggcgcgagcgcaaagagacgctggatctggcgcagctggagcgatgccggcaggcggagctgggcgaaatgcggctggacatgttgcgcaaccgccgccagttcatcgagaaatgcggcaacttcgtccacaagcgccgggcctgcggcacgccgcagcgcttggtcgcgccatgggcgcggcagggaggctagctggcggaaagcttggcgcggacaagcggactgctcgtttttgccgcgcggacgcgcgattcgcctgggcgggaaactggcctgaatcatggattttctggccggacgacgcccttatactgtgcgcatcgccagtttggcggcggccagcgcaggctggcattcatccaggagtcgggacatgggctggcaaacgcatgaagtgagcaatcagttcgacgaactgacggactacaagctgctggacagcgacccggccttgggcgaggcgctgagtcgggccggcgccgagtgggccgtgccctggctgcggggctacggcgagacgctgggccgcgccgaaacctttgaactggccgaggaggccaatcttttcccgccgcggctgcgggcgttcgaccggcgcggccgacgcgtcgaccaggtggatttccacccggcctggcaccggctgctgcagatgtaccgcggccaggggctggtgtcgctgcctttcgccgaggagcggggcgggcgctgggcggccacgctggccggcagctatctgcacggccaggtggaggcgggcacgctgtgcccggccaccatgacgcaggcggccattccgctgctgcgcagggagccggcgttgtgggaggtgctgcgggacaagctgttcagccatgtccatgacggccgcgacctgccgctggcgcagaaggcctgcgcctggatcggaatggggatgacggaaaagcagggcggttcggacgtgcgcgccaacaccacccgggccgagccgctcggtcatggcggccgcggcggcgaataccggctgcgcggccataaatggtttttctccgcgccgaccagcgatgcccacctggtggtggcgcagctggcggacagcgggccgtcgtgcttttatgtgccgcgctggctgccggacggcagccgcaatgcggtggcgatccagcgcctgaaggacaaggtgggcaaccgcagcaacgccagcagcgaagtggaactccaggacgcctggggcgttctgctgggcgagcccggacgcggcattcccaccatcatcgaaatggccacctatacccgtctcaattgcgtgatcggcagcgcggcgctgttgcggcaggccgcgacgcaggcgttggcgtacacccgccggcggatggccttcggcaaggtgttggcggagcaggcggcgatgcgcgcggtattggccgacctggcgctggaaagcgaggcggcgctggcgctggcgatgcggttggcgcaggctttcgagcgtgacggcgagccggccgagcgggcctggaagcgcatcgtcacgccggccgccaagttttgggtgtgcaagcgcgcggtggagtggagcggcgaggcgatggagatcttcggcggcaacggctatgtcgatgccgggccgatggcgcgcttgttccgcgaggcgccggtcaactccatctgggaaggttcaggcaatgtgatgtgcctggatgtggcgcgcgcggtgcggcgcgagccggaagcctgggagcggctgctggcggatctggcggcgatggccgcgggcgaggccgggctgacggatgcgatcggggatttgcgcgcgcaggcgcaggcggggccggagcaactggaggcgcggggccgccgttttgcccagctgctggccctaaccgcgcaggcttgcctgctgcgcgcgcagtcgccggctttcatcgccgacgctttcatcgccagccgcctgcgcgacgcggcatggggccgggtggctggcgcgctggatgccggcgggatggatgtggaatccatcctgcggcgcagcctgccggtttgagccgccgctcagccgttccagcgctgggtgtcggcgaagaagcccggcaccggatggctggcgccctcggtttcgcttttccggtacaagaacatcgccaggcacaggtccagcacgcccaggccgaagggcgagaagatggtcggtttggcgggatccaggcggatttcgccctgcatcacttgcgccagcgtgccgtcgatgaagccgcgatggccgtagcgctgctccgccaggtgtggcgaggtgttggctttcatgcagtgctcgacgtcgtccagcacattgttggcgccgacgatggtttccggcgccaggtcgcgcagcgagacgttgaggatcagctgcgacggcgcgaaggcgtggccggcgggaatccacggcgtgccggcggtggtggcgagcaccacgatgtcggcttgcaaggcctcgtcccggctggcggcgcggatcgggtagcgcaggctcgcgcccatattgcgggtgaacgccgccagatgcgcatcgttgatgtcgtaggcgcgcacgtcgtcgaagtgccagccggcggcatcgaagaaggacaggatgctgccggcgatcacgccgccgccgatgatggccagcgagccggcgcgccggccgtggggccataactgctgcgcggccagcaccgccgacgcggcggtgcgcgccgagctgatctgggacgcttccaggcaggcgaacggatagccggtgcggtagtcgttgagcagcaccaccgccgaagcccgctgcagattagcgtcgacattgcccggatagctggctatccacttgatgccggagacttccagcgccgaatcggcgtcgcggatcgccgccggcagcgcgatgatgcgcgcctcgggcctgtcggcgaagcggaggaaatagctgtccggattgaccgtcttgcgctggtggtgcagcaaataggcctggcggatgatgtcgatcacctcggttttggcctgcgccagcgcgccatggatgaagtcgccggtgatcacgctgaaattcggggcggagttatgcataggtcagattctcgttgagcggttgggaggcctggcgccatgccgggccgaagcgttgatcgcaccagtcgtcgtcgtagaccgtgtccaggtagccgttgcccaggtcgggcgagatggccaccaccacggcgtcggccggcagttcggcgtgcaggcgccgcaccgcggccagcaccgtgccggtggacgcgccgcccagatagccgtagcgcagcgcgacatcgcggcaggcggcgatggtttcggcttccggaatctggatcagccggtccaccgcggcggcgtcgaagaagtggggctgcacgctggagcccagcccaggcagatagcgcgcctgccccggcgtgccgaaagtcaccgagcctaccgagtcgacggcgatcagccgggtttgcggcgaatggccgcggaagaacgcggcgcagcccatcagggtgccggtggtgccggcgccgacgaacaggtagtcgacgctgccgaactcgttcaggatggcgcgcgcggtcatgtcggcatggaccgccgggttggccggattctggtactggttcagccagatccgctcggggtcgcgcgcgatggcctggcggatgtaggcgagccggttgcccagatagccgttgtgctcgtcgcgctgctcgatcaccaccacggtggtgcccagcgcgcgcatcatgccgatgttctgggcgctggtgttcttgtcgacgacgcagacgaagtcatagccgcgcgccgcggcgatctggcttagcgccaggcccagattgccggaactggactctattatcttcttgcgggccgcgagctggccgcgctcctcggcgtcgcggatcagcgccatcgcggtcttgatcttgatcgatccgcccggattgaagccttctatcttcaagtgcacgtcgcccgatggggaaaattgctcgagcctcaggaaaatatcgtcggagacggcttgttcgatggagtcgtatcgcatgcaagattcctgcagcaggtgaaaggaaaataccgccggcaggcgggaagggcgcggccgggcgcctggctcaggcccgcggcggcagcagctcgtccagcgcgaaccagcagctgcaatccagcgccggcaccggcgtgtgccgggtggatttgggcgggtacggccggccttccaggccacgcgcgatcacctcttccggcgtgaccagcaggtcgtcgcggcgggcctccagcgcgacgtcggcgtagtccagcaacaggcagggcaccagcatcaagccgtggcgcagcgcgaattcgcggcgatgatggccgtccatcaccaccagcgtgcggcgctcgaccaggatcggcgtcttccatccgccatcggccagcacccgcgcggccacctcccccaagcgttccggcaggaactcctcggtcggcttcagccggtccggcggcagcagcgcaagcttgggcctggctgcggcggtctcgattggcctcggattcatgtcaccccttgtgcggaatatctaaaccaccggccggtcccgcatgcgcagggcggccatggattgatcagggaaagcgcttatatgttttttgcataatcaaatgacattagacaatgcaggtatgagattgtcaacttaagctcacgcgcgtgatgcgcgatcgggaatccctgctaatggccagttcgaagctgctctttgggatgaatttccggattgaattgtttgaggaaatttttattcataatgaattgaatttttgatatgtgtaatgtataagttcgtcatataccaaagtcatttgttcatttgctgtggcgaggcggctggtccggcggcatcgcggcgccttgcccagccaaaccgaaatttgcgaggcatggatgggcaaccgcatttctcccgattacgccaccccccactctccccagccgcttaccggcgcgccggcggtgttgtggctgaccggcatttccggcgccggcaaaaccaccatcgccagccatctcaagcagttgtgcctggcatccggccatgcggcggcgatgctggacggcgacgagctgcgcggccggctgaacgccgatctgggtttctctgagagcgaccgggccgagaacgtgcggcgcatcgccgaagtcgcggcgctgatggcggacgccggcctgctggtgatcgtgtcctgcatttcgccgctggcgtctttccgcctggcggcgcgcgacatcgtcggcgcgcagcgcttcgtcgaggtttacatcgacacgccgatcgatgtcgccgaagcccgcgaccccaagggcctgtaccggctggcccgcgccggcaagatcaccggcttcaccggcctgcacgcggcttacgagccgccgcgggagccggcgatccggatcgataccacggtcaccggcgtggaagcggcggcggagcgtctgctcggccattaccaggcgatggcgcgcgcggcggccacccgcgccgaggctggcgtttgtggctgagcgcggcgccggaacgagggagcgctggcgatggccttagctgcgctgcgcgcctggtgggcggatctgtcaggcccgttcgcgtaccgaaccttcaccgtcgtctggctgaccagcctggctgccaatgtcggctatacggtgcagggcgtgggcgcgtcctgggcgatggcgtcgatggcgccgacgccgacgatggtggcgctggtccagaccgcggccagcgtgccgatcgccctgttcgcattgctgtccggcgtggcggccgacgcctgggaccgccgcgcggtgatgctggcgtcgcaggcgctggtgttcgccgtcgccgcggccttgaccggcttcagcgccgccggctatctggcgccggcgatgattctggcctgcaccttcctcaatggctgcggcgcggccttgtttcagccgacctggcagtcgtcggtggccgaacaggtgccgcgcagccagctgtccgccgcgatcgccctggacagcttttccttgaatttcgcgcgcgccgccgggccggcgttcggcggactgatcgtggccaggttcacccctggcgcggcgttcttgatcagcgcactggccggcgcggtgatgatcgcggcgctgttgtcgtggaaacggccgccgccgcgccggcacccgcgcgagaagctgttggcggcgctggccggcggcgtcgcttattgctggcgcgcgcggcggatgcgcgacgcgctgttccgcagcgcgctgttcggttttctcggcagcccggtttgggcgttgctgccgctgttcgccaagcagcagttcggcggcgccgccggcacctacggcatgctgctggcggcattcggcgtcggcgccaccgccggcgcgctgggcggagccgcgctgcgggcgcgccacgccaaggaaacggtggtgcgcggcggcgctttcgcctttggcctgggcattatcgccgccgccgtgagcccggcgctgccgggcacgctgctgggcctgtccgtcgccggcgccagctgggtggcgtcggtgtccactttcaatctttcgattcaaaccggcgcgcccgaccggctggcgggccgggcattgtccctgttccattcctgcatcatcggcggcatgtcgctgggcagcttcgcctggggctgcgtggcggagccgctcggcgtgggggccgcgctgctgatgtcgggcctgttgatgtcggcgtcgtgcctgctgggctggctgctgccgctggcggaggcggacgagccggacgcggtcctggcggtgagcggtgccggcggaatggacggccactgcaaatgaacaagagcgaagcgatgaagacgattgcgattatcggcgccggtttttgcggcgcgactctggcggcgcggctgttgcggcagccgccggccacgccgctgcgggtggtgctgatcaatcggtccgggccgatggcgcgcggcgtggcgtatggcagccgcaccgcgacccaggtgctgaacgtgccggtgggcaggatggacgcgctgtcggagcggggcgacgggttttaccgttatgtccgccagcggatcgccgacgccgcgcccggcagcttcgtcgcgcgcagcctgtacggcgattacctggagcagctgttgcgggacgccgagcgcgacgcgccggcgggagcgagcttgcgcaccgtggttggcggcgtggcggcgttgcggccgcgcgccgatggcgagggtgcgcgcttgacgctggatgacggcagcgcgctggacgccgaccgggtggtgctctgcgtcggcaactacgcgccgctggatccgcccatcgcggcggcgcagcgcaggttttacgccagccgccgctacatccgcgacccctgggcgccgggcgcgctggcgcgtgtcgcgccggagcagccggtgctggtgataggcagcggcctcaccatgctggacatcctgctggagctgcgcgagcgcggccatcgcgcgcccatccacgcgatatcgcgccgcggcctggcgccgcaggcgcaccgggcgctggacaacccgccgcattacgacgagtcgctgttgcacgcgatgctgagcgagccgaccgcgcgcaactacctgagcctggtgcgcggcgcggcggcgcgccatgcgcgcggcggcggcgactggcgcgacatcgtcggcggcttgcgcgcccgcaccccggagctatggcaggccttgccgctgccggaacggcgccgcttcctgcagcggctgcggccgttctgggaggtgcatcggcaccgctgcgcgccgcaactcggggaaaggctgcgcgccgaactggcgagcggctcgctgcgcctgctcgccggccgggccatcgcctaccgcgagaccggcgacggcgtggaggcgacgctgcagccgcgcggcggcggcgaggcgctgcgcctgcaagtgggggcggtgatcaactgcaccggcccgcgcggcgatgtccgccggctggacgagccgctgctggacagcctgcaagccgacggcctgctggtgccggacgcgctcggcctggggttcgagctggacgagcgctacgcgctgcgcgacagcgccggcgtcgcttcccgctggctgcactacgtcggccctttccttaagggccgttactgggaggcgaccgcggtgccggaattgcgcgttcatgtcgcgcggctggccgaggccttgagcctggactgcggcgatgaaacgcggctgcggcagccggcgcaaccggcaagcgcgtgagcgccgccgacgacattttccgaagagcggcgatgaattcaagaatagagatgagagagccgatgctggcgcgggaggaagccccgccggcggacgcggcctggacgccgttgcgcgccggcgccgacggcgtgccgcgcgcctgcgacatgaccgcggacgactggctgctggcttacgacgtcgatgcccagctggccgacggcggcgcgccggcagccgccggcctggaaagcgcgctgcgggagatctggcagtcggtgctcggcgtcgagggactatcggcgaccgacaatttcttcgccgccggcggagactccatcgcctcggtgcaactggcggcgcaggcgcgcgccaagggcatagccttgtcggcgcaagacctgctccgccaccagaccatcgcggcgctggcggcgagcgccagccaggcctcgcccgaacggcagcccagccaggggcggttggcgctgcggcccgcgcagctggcggcgctggatggcggcgcggtgagccgccggttgctgcaagtgccggaagagatggacgagcgttttctgcaggcctggctgcgggcgctgcatgccggccacgatgcgctgcggctgcggtttgcgcgccagggcggcgaatggcgcgcggaattccgcgccgatgccgacgcgctggcgcgcgaggcgcgggatggccgcgcggcgtcgtcgatgccgccgcagccgcaggccgatgccggtcccgtgttgatggcggcgctggaaaaggggcgcgatggcgcgcggctatggctcagcgcccggcaggcggcggtggatgccgcatcgtggcgcacgattctggccgacctgcgcgcggccttcgacgaatggcggcggcgcggcgccatttccgcgcgcggcgcagccgggtttggccgctaccaagagtggtgtgagaagcgggaaggcgagccgcggcaagcagcttggctggcggcgggcggcgaatgggtcttagcgccggttgccgagctggatgcggcgcgcagcgccgccatgctggagagcggtttgcgcaagcatcgggcgcggccggaggagctgttgctggcggccgcgctgttggcggcttgccgctggtcgggcgagagggcgcttactctgcggctggcgcaagatggccgcgcggccgacgccgagctggcggccacggtcggccagttcgatgtcgaacgcggtttgacgctggcgctggcggccggcgagcttgcgccgggggcggcgatcctggcggccaaggaaggctgccgcgcgcagacccaagagctgggcgacgctggccgaaccgcgcgcctggcattccgttacgacggcgatttcgacgcgccggcagcggcgcgcgccggcatcgcgcggctggcgctgccgaacgacgatgacgacgccggcgggccgccggtgcggctgcgcggcgnccggcaaggcctgaaaatcgcaaggtattgaaagcaaaggaaacgccccgccgcttgcggggcgtttgccgttttgacgcgaaataattcaaattttttcgcgaaaggtgttgacggcgggggagggcatctataatattcgggtctctcacggggggggttaccccagcggtcaacgggtccggactgtaaatccggcggcttagccttcgaaggttcgaatccttctccccccaccagaatttgtaagacgtttggcaagtggcagtgttgtggtgtagtgaccaggcgggtgtagctcaatggtagagcagaagccttccaagcttacgacgagggttcgattcccttcacccgctccaagcgtttgatagcctgttttaagggcccatgtagctcaggggtagagcactcccttggtaagggagaggtcggcagttcaattctgcccatgggcaccaccaatttactttgcttgtttcgtattcaggaaatttgccatggctaaggaaaagtttgcgcggactaagccgcacgtaaacgtcggcaccatcggtcacgttgaccatggtaaaaccactctgaccgcagcgatcaccaccattctgtcgaagaagttcggtggcgaagctaaagactactcccagatcgatagcgcgccggaagaaaaggctcgtggtattaccatcaataccgcgcacgttgaatacgaaaccgaatcccgccactacgctcacgtagactgcccgggccacgccgactatgtgaagaacatgatcaccggcgcagcccagatggacggcgcgattctggtttgctcggccgctgacggtccgatgccgcaaacccgcgaacacatcctgctgtcccgtcaggttggcgtaccgtacatcatcgtttacctgaacaaggctgacctggttgacgacgccgagctgctggaactggttgaaatggaagtgcgcgatctgctgtcttcctacgacttcccgggcgacgacaccccgatcgtaaccggctccgctcgtctggcgctggaaggcgaccagtccgaaatgggcgagccgtcgatcttccgtctggccgacgcgctggactcctacatcccgactccggagcgcgcggttgacaagccgttcctgctgccgatcgaagacgtgttctcgatctccggccgcggcaccgtggtgaccggtcgtgttgagcgcggcatcgtgaaagtcggcgaagagctggaaatcgttggcctgaaagaaaccgccaagaccacctgcaccggcgtggaaatgttccgcaagctgctggaccaaggtcaggctggcgacaacgtgggcgtgctgctgcgcggcaccaagcgtgaagaagttgagcgtggccaagtactggtgaagccgggctcgatcaagccgcacaccgagttcagcggttcggtatacgtgctgagcaaggaagagggcggccgtcacaccccgttcttcgctaactaccgtccgcagttctacttccgcaccaccgacgtgactggcgcagttacgctggccgaaggcgtggaaatggtaatgccgggcgacaacgtggaaatcactgttaagctgatcgctccgatcgcgatggaagagggtctgcgtttcgcgatccgcgaaggtggccgtaccgtcggcgccggcgtggtctccaagatcatcaactaaggtttaaaggccagtagctcaattggtagagtatcggtctccaaaaccgagggttgggggttcgagaccctcctggcctgccaattaagaccagccggcgctatgcgccggttggtcttttgtcgcatatacgcgagagaagattcgacatggaaatgcaagataagatcaagttggcactggctggtcttgtggtggcggccggcgttgtcggcttttacctgataccggaaggtcaggacctgctgcgcgcgctggctttcatcgtctccatcctggtggctgccggggtggtgtgggcgtcggcgcccggcaaggggctggtggtctacgccaacgagtccatcgtcgaggctcgcaaggtggtgtggccgacccgcaaggaggcgactcaggtgacgctgatggtgttcgtattcgtcgcggtcctggcgctgttcatgtggctggtggactccagcctgtcctggctgttttacgatgtgattctcggtcgaggtagataatggcaaagcgctggtatgtggtacacgcgtactctggttttgagaaaagcgtgcaaaaggcgctgcgtgaacgtatcgaacgttccgacatcgcagatcaatttggtcagatcctggtgccggtagaggaagtcgtcgacatcaagaatggccgccgctcgatcaccgagcgcaaattcttccctggctacgtgctggtggaaatggaaatgaccgacgatacctggcacttggtgaagagcactcccaaggtgaccggtttcgtcgggggaaccggcaaccgcccggcgccgatttccaagcgcgaagtcgaggccatcatgcagcagatgcaagagggcgtggaaaagccgaagccgaaggtgctgttcgaagttggcgagaaggttcgcgtcatcgacggcccgttcaacgacttcaatggctcggtcgacgaagtcaactacgagcgcaacaagctgcgcgtgtcggtgcagatcttcggtcgcgacaccccggttgagctggaattcagccaggtagagaagctgtaaaattctgcttggcaagtttggcgaaggcgtgtaaaattctgcgctttcgtcctgggaagcgaacactgctgttcgcgttacacccgttttaggagttttaatcgtggcaaagaaaattgtcggctacatcaagctgcaagtgcccgctggcaaggctaacccgtctcccccgatcggtccggccctgggtcagcgcggtctgaacatcatggaattctgcaaggcgttcaacgcccagactcaaggcgttgagccgggtctgccgattccggttgtgatcactgcctacgcggacaagtccttcaccttcatcatgaagaccccgccggccaccatcctgctgaagaaggccgctggcatcaagtccggctccgccaaggcgcacgtggacaaggttggcaaggtaacccgcgctcagctggaagaaatcgccaagaccaagcagccggacctgaccgccggtgacctggacgctgctgttcgcaccatcgccggctccgcccgttcgatgggtctggaagtggagggcgtgtaaatggctaagatctccaagcgtctgcaagctctgaaggctaccgttgatcgcaacaagctgtacgctgttgaagaagcgattgccctggtgaaaaccgccgccaccgccaagttcgacgagtccatcgacgtctccgtgaacctgggcgtggatccgcgcaagtccgaccaagttgtccgtggctccgtggttctgccgcgcggcaccggcaagtcggtacgcgttgccgtattcgctcaaggcgccaacgccgaagccgccaaggctgccggcgctgaagtggtcggtttcgaagacctggccgagcaagttaaagccggcaacctggacttcgacgttgtcatcgcttccccggatgcgatgcgcgttgtcggtcagctgggtcagatcctgggcccgcgcggcctgatgccgaacccgaaggttggcactgttaccccgaacgtagccgaagccgtgaagaacgccaaggctggtcaggttcagtaccgcaccgataaggctggtatcatccacgccaccatcggccgcgcttccttcgaagctgaagccctgcgtgaaaacctttccgctctggttgatgccctggtgaaagccaagccggcagcttccaagggtgtgtatctgaagaagatcgccgtatccagcaccatgggtgtcggcgctcgcgtagataccgctaccgtcaacgcctaagcgttgccggagcatgacggggcggtgaaagccgccttatcaaaggctttgggctggcaggcttgcctgccagattgtcaaagaccgtaggtgccgcaaggcttaatagcgggcttgcttgttatcgaagccagcatcctacgcagatggtgtacccgaacaggcttctgaaagttcataagctcatgtagctcaggggtagagcactcccttggtaagggagaggtcggcggttcaattccgcccatgagcaccagttctttatgatgtctcctgatacaggtcgccgctgcaaagcgagatggaaattttttccatttcatttcagtctaggaggtagaccttgagtctcaatatcgaagataaaaaggcggtcgtcgaagcagtttctgccgaactggcaggcgctcagaccctcgttatcgctgaatatcggggcatcgaggtaagcagcatgaccaagcttcgcgcccaggcgcgagctaacggcgtgttcctgcgcgttctgaagaacacgctggtgcgtcgtgccgtggaaggcactccgttcgccgatctggctgaccaaatggttggcccgttggtgtacgcgatttccgccgacccggttgctgctgccaaggtgctgcatcaatttgccaaggccgacgacaaaatcatcgtcaaggcaggttcctacgaaggcaaggtactgtccgctgctcaggttgctgagctggcgtccatcccgagccgcgaagaactgctgtccaagcttctctacgttatgcaggctccggtcgctggcttcgcccgcgcgctggccgccctgtccgacaagaagcaagccgaagccgcttaacttatttgattcttatagaattcaggagattttcacatggcaatcaccaaagaagacatcctcgaggccgttgctggtctgaccgtgatggaactgaacgacctggttaaggcgttcgaagagaagttcggcgtttccgccgctgctgtagctgttgctggcccggccggcgctggcgctgccgccgctgaagaaaagaccgagttcgacgttgttctgaccgccgctggcgacaacaaggttggcgtgatcaaggttgttcgcgcgatcaccggcctgggtctgaaggaagccaaagacctggtagacggcgctccgaagaacgtgaaggaaggcgtgtccaaggctgaagccgacgacgttgccaagcaactgatcgaagctggtgctaaggctgaagtcaaataatcttctttgaaaaaagaaggtgaggctggcggagaaatccgccagccttattgcgcttgtagttggcggaaacgaagaaggtaaaagccagcaatatacttggcgtggctgctgacttttagtttcttgcgccacccacctcgatggagactctatgagttattcgtttactgagaagaaacgtattcgtaagagctttgcgaaacgtgccagtgttctcgacgtcccattcctgttggcgacccagattgattcctacaccgaatttctccagctgggcaagccgctggatgagcgcaaggatgtgggtcttcaggctgcgttcaagtcgattttcccgatcgtcagccataacggctatgccaagctggacttcgcccactatatcctgggcgaaccgccgttcgacgtgcaggagtgccagctgcgcggcatcactttcgccgccccgctgcgcgcccgcattcgcctgacgattttcgacaaggaatcgtccaagccggtggtgaaggaagtgcgcgagaatgaggtgtacatgggcgagattccgctcatgaccaccaacgggtctttcatcatcaatggcaccgagcgtgtcatcgtttcccagttgcaccgttccccgggcgtgttcttcgagcacgaccgcggcaagacccattcctcgggcaaactgctgttctcggcgcgcgtgattccctaccgcggctcctggctggacttcgagttcgatccgaaggacctgctgtacttccgtatcgaccgtcgccgcaagatgccggttaccattctgctgaaggcgctgggttacagcaacgaagaaatcctgtccgagttctacagctttgacaccttctacctgacccgcaacggcgtattcatgcgcgtggtgccggatcgtctgaagggcgaagtggccaagttcgacatcgtggccgccgacggcaagctgatcgtcgccaaggacaagcgcatcaccgccaagcacatccgcgacatccagaccgctgagctggatcgcattgaagtgccggccgacgcgctgctgggcaagatgctggcgcacaacgtggtgaaccagaacaccggcgaagtgatctcccgcgccaacgaggaagtgaccgaggaagtgctggccaagctggcgctggcggacatcgaccaggtcgacgtgctgttcaccaacgatctggaccagggcgcgtacatctcgcaaaccctgcgttccgacgacatccaggaccagctgcaagcccgcgtggcgatctaccgcatgatgcgcccgggcgagccgccgaccgaagacgcggtggaagcgctgttccagcgcctgttcttcagcgaagaaacctacgatctgtcgcgcgtgggccgcatgaagttcagctcgcgcacttaccagtacaaattcgacgacaagaccccggaatggttcaagtcgctgatcggcgacaagttcgcgtcgcgccgcgacgtgatggaaggcacgctgtccactgaggacatcgtgtccgtgatcgccattctgaccgagctgcgcaatggccgcggcgaagtggacgacatcgatcacctgggcaaccgtcgcgtgcgttcggtgggcgaactggccgagaaccagttccgcgccggtctggtgcgtgtcgagcgcgcggtcaaggaacgcctgaaccaggccgagtccgacaacctgatgccgcacgacctgatcaacgccaagccggtttccgccgcgatcaaggaattctttggttcctcgcagctgtcccagttcatggatcagaccaacccgctgtcggaaatcacccacaagcgccgcgtatcggctcttggcccgggcggtctgacccgcgagcgcgccggcttcgaagtgcgcgacgtgcacccgacccactacggccgcgtgtgcccgatcgaaacgcctgaaggtccgaacatcggcctgatcaactcgctgtccgtgtttgcgcgcaccaacgagttcggtttcctggaaaccccgtaccgcaaggtggtggacagcaaggtcaccaacgagatcgactacctgtccgcgatcgaagaaggccgctacgtgatcgcccaggccaacgccgagctgagcgaagacggcgcgctgatcgacgagctggtgacctgccgcgagaagggcgaaaccattctggcgacgccggaccgcgtgcagtacatggacgtggccaccggccaggtggtgtccgtggccgcttcgctgattccgttcctggaacacgatgacgccaaccgcgcattgatgggcgccaacatgcaacgtcaggccgtaccgtgcctgcgtccggaaaaagccttcgtcggcaccggcatcgagcgttcggtggctgtcgactccggcaccaccgtggtggctcgccgcggcggcgtggtcgattacgtcgacgccggccgcgtggtggttcgcgtcaacgatgaagaagcgaccgctggcgaagtgggcgtggacatctacaacctgaccaagttcacccgttccaaccagaacaccaacatcaaccagcgtccgatcgtgaaagtgggcgaccacatcgcgcgcggcgacgtggtggccgacggcgcctccaccgacctgggcgagctggcgctgggtcagaacatgaccatcgcgttcatgccgtggaacggctacaactacgaagactcgattctgatctcggaaaagctggtcgcagaagaccgctacacctcgatccacatcgaagagctgtccgtggttgcccgcgacaccaagctggggccggaagaaatcacccgcgacatcccgaacctgtccgaacgcatggcaggccgtctggatgaatccggcatcgtctacatcggcgcagaagtcgaagccggcgacgtgctggtgggcaaggtgacgcctaagggcgaaacccagctgacgccggaagagaagctgctgcgcgcgatcttcggcgagaaggcctccgacgtgaaggacacaagcttgcgcgtgccgaccggcaccgtgggcaccgtgatcgacgtgcaggtgttcacccgcgaaggcatcgagcgcgacaagcgcgcccagtccatcatcgattcggaactgaagcgctatcgccttgacctgaacgaccagctgcgtattttcgacaacgacgccttcagccgtatcgaacgcctgatcgtcggcaaggtcgccaacggcggtccgaagcgtctggccaagggcaccgtgatcgaccaggaatacctggccggcctgccgaccaagcacgattggttcgacatccgcatgagcgatgaagacatcgccaagcagctggaactgatcaaggaaagcctggcgcagaagcgtgaagaattcgacctcaagttcgaagacaagaagcgcaagctgacccagggcgacgagctgccgccgggcgtgcagaagatggtcaaggtttatctggccgtgaagcgccgcctgcaggcgggcgacaagatggccggccgtcacggtaacaagggtgtggtttcccgcatcctgccgatcgaagacatgccgtacatgggcgacggccgtccggtcgacatcgtgctgaacccgctgggcgtaccgtcgcgtatgaacatcggccagatcctggaagttcacctgggttgggcagccaagggcatcggcgaacgcgtcgaccgcatgatcaaggaacagcagaccgctgccgagatccgcggctacctggaacgcctgtacaacgaaaccggccgcagcgaggacctggcgtccctgagcgacgacgaagtgctgcaactggcgcaaaacctgcgcaagggcatgacttttgctacaccggtattcgacggcgcgaaggaagccgagatcaagcacatgctggatctggcctacccggacggcgacgagctgaccgacaagatgggcttcaacgagtccaagacccagatgaccctgcacgacggccgctccggcgaagccttcgaccgcaaggtgaccgtgggcgtcatgcactacctgaagctgcatcacctggtcgacgacaagatgcacgcccgttccaccggcccgtactcgctggtgacccagcagccgctgggcggtaaggcgcagttcggcggccagcgtttcggtgagatggaggtgtgggcgctggaagcttacggcgccgcctacacgctgcaggaaatgctgaccgtgaagtcggacgatgtgaccggccgtaccaaggtctacgaaaacatcgtcaagggcgagcacaagatcgatgccggcatgccggaatccttcaacgtgctggtgaaggaaatccgttcgctcggcctggatatcgacctggaacgttattgattgggagcatgggcgcggcagtttgaggccgcgcctgtcccctgactggagacgcaatgaaagctctgctcgacctctttaagcaagttacgcaagaagaagagtttgatgcgattaagatcggcatcgcctcgcctgacaagatccgttcctggtcttatggtgaagtaaagaaacccgaaaccatcaactaccgcaccttcaagccggaacgcgacggcctgttctgcgcccgcatcttcgggccggtgaaggactacgagtgcctgtgcggcaagtacaagcgcctgaagcaccgcggcgtgatctgcgagaagtgcggcgtcgaagtgaccctgtccaaagtgcgccgcgagcgcatgggccacatcgaactggccagcccgaccgcgcacatctggttcctgaagtcgctgccgtcgcgtctgggcatggtgctcgacatgacgctgcgcgacatcgaacgcgtgctgtacttcgaagcgttcgtggtgaccgatccgggcatgaccccgatgcagtaccgccagctgttgaccgaagaggacttcctggacaaggaagaccagtacggtgaagagttcgtcgccatgatgggcgccgaggcggtgaaggaactgctgaagaaactggatctggacagcgagatcgagaccctgcgtcgcgagctcgaagccaccaattccgacaccaagatcaagaagatcgccaagcgcctgaaagtgctggaggccttccagcgttccggcatgaagccggaatggatgatcctggacgtgctgccggtgctgccgccggaattgcgtccgctggtgccgctggacggcggccgcttcgcgacctccgacctgaacaacctgtaccgccgcgtcatcaaccggaacaaccgtctgaagcgcctgctggaactgcgcgcgccggacatcatcgtgcgcaacgagaagcgcatgctgcaggaatcggttgactcgctgctggacaacggccgtcgcggcaaggcgatgaccggcgccaacaagcgtccgctgaagtcgctggccgacatgatcaagggtaagggcggccgtttccgtcagaacctgctgggtaagcgtgtcgactactccggccgttccgtgatcaccgtgggcccgaccctgcgcctgcatcagtgcggcctgccgaagaagatggcgctggaactgttcaagccgttcatcttccacaagctggaagtgatgggcctggcgtccaccatcaaggcggccaagaagctggtcgagcaggaagtgccggaagtctgggacatccttgaagacgtgatccgcgagcacccggtgctgctgaaccgcgcgccgaccctgcaccgtctgggcatccaggcgttcgagccggtgctgatcgaaggcaaggccatccagctgcacccgctggtctgcgcggcgttcaacgccgacttcgacggcgaccagatggccgttcacgtgccgctgtcgctcgaagcgcagatggaagcccgcaccctgatgctggccaccaacaacgtgctgtccccggccaacggcgagcctatcatcgtgccgtcgcaggatatcgtgttgggtctgtattacatgacccgcgacaaggtgaacggcaagggcgaaggcatggtgttcgccgacaccaaggaggtgcatcgcgcttacgaaacccgccaagtcgagctggctacccgcatcaccgtccgcctgaaggaatgggaaaaggacgagcagggcgagttccagccggtgatcaagcgttacgacaccaccgtcggccgcgcgatcctgtcggacatcctgcctaagggcctgccgttcgagcacatcaacaaggcgctgaagaagaaagaaatctcgaaactgatcaacgtttcgttccgtcgttgcggcatccgcgacacggtgatcttcgccgaccagctgatgtacaccggtttcgcctactccacccgcggcggcatctccatctgcgtggacgacatgcagattccgaagaaaaagaccgaactgcttggcgaagccaacaaggaagtcaaggagatcgaagagcagtatcgccagggtctggtgacccagggcgaacgctacaacaaggtggtggatatctggggccgcaccggcgacaagatcgccaaggcgatgatggacgagctgtccaagcagcgcgtgctggatcgcgacggcaaggaagtcgaccaagagtccttcaactcgatttacatgatggctgactcgggcgcgcggggttccgcagcccagatcaagcagctggccggcatgcggggcctgatggcgaaaccggacggttccattatcgaaaccccgattaccgccaacttccgcgaaggcttgacggtactgcagtacttcatctccacccacggcgcccgtaagggtctggcggatacggcgttgaagaccgcgaactccggttacctgacccgtcgtctggtcgacgtgacccaggatctggtggtgatcgaggacgattgcggcaccaccaacggcttcaccatgaaggccgtgctgcaaggcggcgacgtgatcgaagcgctgcgcgaccgcatcctcggccgcgtgaccgcggtagacgtggtggatccgtccaccggcgaaaccgtgatcgaagccggcacgctgctggacgagcagatggtcgactcgatcgacagcctgggcatcgacgaagtgaaggtgcgtaccgccatcacttgcgacacccgctacggtctgtgcgcgaagtgctacggccgcgacctggcgcgcggcaagcgcgtcaacgccggcgaagcggtaggcgtgatcgccgcccagtcgatcggcgaaccgggcacccagctgaccatgcgtaccttccacatcggtggcgcggcgtcgcgaaatgcggccgccagccaagtggaaggcaagtccaacggtaccgtgcgcttctccagccagatgcgttacgtggcgaacaccaagggcgagctgatcgtcatcacccgctccggcgaagtggtgatccacgacgacatgggccgcgagcgcgagcgtcacaaggtgccgtacggcgcgaccctgatggtgaccgatggtctgcagatcaaggcaggcacggttctggccacctgggacccgcacacccgtccgatcatcaccgagtacgctggccgcgtgaagttcgagaacgtggaagagggcaacaccgtagccaagcagaccgacgaagtgaccggcctgtccacgctggtggtgatcgacccgaaacgccgcgccggcgcccagtcgaagatgctgcgtccgctggtgaagctgctcgacgacaacggcaacgaagtgaagctggccggttcggacgcttcggtttcgattaccttccaggtgggcgcgatcattaccgttcgcgacggccaggacgtgggcaagggcgaagtgctggcccgcatcccgcaggaatcgtcgaagacccgcgacattaccggtggtctgccgcgtgtggccgagctgttcgaagcccgttcgccgaaggatgccggcatgctggccgaggtgaccggtaccgtttccttcggtaaggacaccaagggcaagcagcgcctgatcatcaccgatctggaaggcagcggctacgaaaacctgatcccgaaggacaagcacgtgctggtccacgacggccaggtggtgaaccgcggcgaatccatcgtcgatggtccggtcgatccgcacgacatcctgcgtctgcagggcatcgaggcgctggcccgctacatcgtccaggaagttcaggaagtgtaccgtctgcagggcgtgaagattaacgacaagcacatcgaggtgatcattcgccagatgctgcgtcgcgtcgtgatctccgacagcggcgacaccgagttcatccagggcgaacaggtggaacgcgccgaagtgctggaaatgaacgacaagatggtcgcggagggcaaggagccggcgcagtacgaaaacgtgctgctgggcatcaccaaggcgtccttgtcgaccgactcgttcatctccgcggcttccttccaggaaaccacccgcgtgctgaccgaagcggccatcatgggcaagaaggacgatctgcgcggcctgaaggaaaacgtgatcgtcggccgtctgattccggccggtaccggtctcgcgtaccatcgcacccgccgtcgccagcaactgggcctcgacgccgccgaatcgcagctgttcgactcgggcatgctcaacacggcgctggaaaacgacgaataacaccggcctgacggcctagtgttgaaaaaacgctgcttcatcaacggttaacgttgctggggcggcgttttttatttgacgcttgaccgttgactaaaatataatcctccgtcctttctggaggcgtgttgccttcaggaagaatcaactaggaactgatagtaatgccaaccattaaccaactcgttcgcaagggccgcctcgccagcacggcgaagagcaaggtgcctgcgctggaagcctgcccgcagaagcgtggcgtgtgcacccgtgtctacaccaccactccgaagaagccgaactcggcgctgcgtaaagtgtgcaaggtacgtctgaccaacggtttcgaagtgatttcctacatcggtggcgaaggccacaacctgcaggaacactcggtagtgctgatccgcggcggtcgtgtaaaagacttgccgggtgtgcgttaccacaccgtgcgcggttccctggataccgcaggcgtgaaagaccgtaagcaagcccgttccaagtacggcgccaagcgtcccaagtaattgggaaggtctcatggcggcctgagcgtttcgtaatggtcgtctagtaagtggctgctccattgggtggtcatgagccaaagctcaactgaataatttaaggaagtaacatgccaagacgcagagaagtccccaagcgtgaaattctgccggatccgaagttcggttcgcaggatctctccaaattcatgaacgttgtgatgatcgacggcaagaagtctgtagccgaacgcatcatctacggcgctctggaacagatcgaaaagaaatccggcaaaaacgccctggaagtgttcaacgcagcactgtccaacgccaagccggtagtggaagtaaaaagccgccgcgtaggtggtgcaaactatcaagttcctgttgaagtacgtccgtcgcgtcgtatggccctggccatgcgttggctgcgcgacgctgcgcgcaagcgcggtgagaagtccatggacctgcgcctggctggtgaattgctcgatgcggccgaaggccgtggcggcgcgatgaagaagcgtgacgaagtgcaccgcatggcagaagccaacaaggccttctcgcacttccgtttctaagctcacccccacttattcaaggtgtagatcgtggcacggaaaaccccccttgagcgctaccgtaatatcggtatctccgctcacattgacgccggtaagactactactaccgagcgtattctgttttacaccggtgtgaaccacaagatcggtgaagtgcatgatggcgccgccaccatggactggatggagcaagagcaggaacgtggcatcaccatcacttccgccgctaccaccacctattggaagggtatggccatgcagtatccggcccaccacttcaatatcatcgacactccgggacacgtggacttcaccatcgaggtggagcgttccatgcgcgtgctggacggtgccgtgatggtttactgcgctgtgggcggcgttcagccccagtcggaaaccgtatggcgccaggccaacaagtacaaggttccgcgtatcgcgttcgtgaacaagatggaccgtcaaggcgccaacttcttccgcgcggttgagcaggtgaaaacccgcctgcgcggcaacccggtgcctatcgtcgtgcctatcggcgcggaagatagcttcaccggcgtggtcgacctgctgaagatgaaggccatcatctgggatgaagcttcccagggcatgaagttcgagtacggcgatatcccggccgacctggtttccgttgccgaagaatggcgcgagaagatggttgaagccgccgccgaagtcagcgaagaaatgatggacaagtacttgggcggcgaaacgctgaccgaggaagaaatcgttgctggcctgcgcgaacgtaccctgaagtgcgaaatccagccgatgctgtgcggctccgcgttcaagaacaagggtgttcagcgcatgctggacgccgtgatcgaactgctgccgagcccgctggatgttccgccggttccgggtgagaacgaagacggcaccccgaccacccgcgaagcttccgacgacgcttccttctccgctctggcgttcaagctgatgaacgacccgtacgtgggccagctgaccttcttccgcgtctactccggcgtggtgaagtccggcgacaccgtgctgaactcggtcaaaggcaagaaagagcgtatcggccgtatcgtgcagatgcacgccaacgaccgtaaggagatcgaagaagtgcacgccggcgacatcgccgctgccatcggtctgaaggaagttaccaccggtgaaaccctgtgcgcgatcgacgctccgttgatcctcgagcgcatggaattcccggaaccggtgatccacgttgccgttgagccgaaaaccaaggccgaccaggagaagatgggcgttgccctgaatcgcctggccaaggaagacccgtcgttccgcgtgcgtaccgacgaagaatccggccagaccatcatttccggcatgggtgaactgcacctggaaattctggttgaccgcatgaagcgcgaattcggcgttgaagccaacgtcggcgcgccgcaagtggcttaccgcgaaaccatcaccaagacggttaccgacgttgacggcaagcacgtcaagcagtccggcggtaagggtcagtatggtcacgccgtgatcacgctggaaccgtccggcgaaggccagggctacaagtttgtcgacgagatcaagggtggcgtgattccgcgcgaattcatcccgtccgtggacaagggtattcaaaacaccctgtccaacggtattctcgccggcttcccggtggtggacgtgactgtgcgtctgaccttcggttcctaccacgacgtcgactcctcgcagatcgcgttcgaactggcaggctcgctggctttcaaggaagccatgcgccgcgccggtccgtgcatcctcgagccgatgatggctgtggaagtggagactccggaagagtacatgggtgacgtcatgggtgacttgaaccgccgtcgcggcatggttcaaggcatggacgacgacggtctgggcggcaagatcatcaaggctgaagtaccgctggccgagatgttcggttactccaccgacctgcgttcggctacccaaggccgtgccacctactcgatggagttcaagcactactcccaggctccgaagcacgtcgctgacgctgtaatggccgccaagaagtaatgcgcgctgaggctggtcggcttttccaatcaagaccgaccagccccgatctaatgttctttaattaaggatttgtaaaaatggcaaaagaaaagtttgcgcggaccaagccgcacgtaaacgtcggcaccatcggtcacgttgaccatggtaaaaccactctgaccgcagcgatcaccaccattctgtcgaagaagttcggtggcgaagctaaagactactcccagatcgatagcgcgccggaagaaaaggctcgtggtattaccatcaataccgcgcacgttgaatacgaaaccgaatcccgccactacgctcacgtagactgcccgggccacgccgactatgtgaagaacatgatcaccggcgcagcccagatggacggcgcgattctggtttgctcggccgctgacggtccgatgccgcaaacccgcgaacacatcctgctgtcccgtcaggttggcgtaccgtacatcatcgtttacctgaacaaggctgacctggttgacgacgccgagctgctggaactggttgaaatggaagtgcgcgatctgctgtctgaagtcgtaggaagacagcagatcgcgcacttccatttcaaccagttccagcagctcggcgtcgtcaaccaggtcagccttgttcaggtaaacgatgatgtacggtacgccaacctgacgggacagcaggatgtgntcgcccaacgcgacgccaaccacacgacgggccggcgttggatccacaacgtcggccagcacctcagcctgttcgtggcgggggtgaaggacaaggtggcgctgaagctgatcgcggcgaaggggaaggtgcaagtgcaggcgcagagcgacgcgatggagctgacggcggatcaagacctctccatcacctcggtgaaacagaaaatccacctcaacggcaaacaggaaatcctgctgaccagcggcggcgcttacgtgcggatcaaggacggcaagatcgagctgcatgcgccgggcaccgtcagcttcaagggtggtagccatgattggagtggggggacgagtcttggccagacctataacgccatgccgcaagccaagtttgatgatcgtttccagctagtagatcagcatacgggccagcctctggttaatcataagtatgagatacatcgtgaatttgggggagtagagcgaggatatactgatagtgaaggatttacccacatgataaaaaatcctgatgcagcagagagtattgaaattaaaatatttaagtaatgttggaagggtaaatgtatggctaatcaagtgttgcaatcgcattcagcagtactgtcaccagaggcaaacaagagcaataagaaaattttcatatgcaagccgcctaagatagttattttttttgtgggcggagccggggataaaaggcaatttttaggtagcggtccaaatcataatatagttgatgttcagaagtactttgaaagtaatttcaagaaagaaatttctgaagttctgataagttccgtctatgttgggtactatgagcttcatgatgaagataatttaaaaagtattgctaaccaatttattttagacaaaaaggccaaggtttatattgtcgggcacagtttgggggggtggaatggcgcacacttttcagaaaaattatctaagcttagttatgatgttgaaatgctgattactcttgacccagttggtgaggatttttcattgaaaatgtttgcggatatatatgcatctgttcctgagccaaaagcatatatctggattaatttacgctatgaccaaagctatttttcaatcgtaaagaagtacctgccaagaaaaaaatatgatgatatgaaagtggatttatctgcaaattttgtcgctgacctaggtcggcaatggtggattgggcctcgttttgatggagttaaaattcctgatcgcaggccagatttaaataagtttatagacgtaaatcatgttgaaacgttgcctgccatgctatatcctttggataataatataactgcctggagtatcttgaaaggcagtgttgaaacaaatttgaaaggcgagtaaatgaggctggtgagagtaataatggtatgtactgtgcttgcagtgctgctggcatgggtatcaagttctcctccgatagttaagtatgatcacctagcattaggggagggagggttggttgaaatttacttttcaagtgataaaaatgactttggtggggcctacaatatagcgtgtgcgttatctgaaaaaactaaatatccaaatgtttttccagatgatggtgttgcaatttacggtaaagtcattaacaaaattgggggcggaaagtttaaggctatggtttttatggatggcttcagccgcagtggtcaatacgcggtagggaagtttgatattgatagagagttaaacggggagaaatatattccttgcgtcatttatcgaaaaggtttcttttcttttggagaaactaccaagcctattgaagttcctgttaaggatttatattcggtattgagttggtgatgcgtctatgaaaaataatccagatggctgatgtgctgagctgggtttctatttgggttaaggtggggagtggaggttttgattatgatggtgttgctggcgagtataaacataaggcaaattaggttgagtacagttgcaggcatgaatcaatagaagacgtgtcatccgatgaagtcaaagccgcttttcaacgagtaaatatttggattgtagagtggttgtaagaaattatgtggcagggccagcactatctgattcaatcaaaatatctgtaaaatactttctcaatccatattcttggtgatgggtgattatatgtgtaaaattctcctgaaatagtttggatagtgttgaaatagatagaggatttttcaactatttattttcatgccaagtgattgtggtgaaatttttccgtgatattgagttaagctggcggattttatgtttttaaatttgtaatctgcggcagtgtccctgcgcgaaagattaattgaaagcttgggccttatttatatgccgcttcttatatttttccatgtaatggccttggtaatcagctgggcaagtgctattggttcaattcaatatgttgctgctgagaaagctacggcggaggtggtgttcaaattttccagcgaagaatctgcgttagctgggaagttaaaccggctaaattgtcgggtaggtagtcaacctgttggcagctttattaatctggatgatgggctgttttggagtgggagtgtcgaggaagttggccatgaaggacgagtgtttatttacaaggcagatgctttagaaaattatgtagaagaagggcggtggttgctaccttccagtcataacattattcagaaattgacaggagaggaagctgtgcaatgccgtgtagtacaaggtagctatcttcacaggccaaccgcttcgccagcgatgatagtgccgatcaaagcaatttcggcaatatatcgtgattgagctatccgtgattggaatggatttcggaatgccatttcaattgagaaaaatctcgtaatggtgttgattttttgtgtggttttccgattttttctattcaaaatttaggaaaatgcagagcaaaatgtaattgtggtagggcgccctcacgtgatacctgtagtttactaatcaacccatcgagggcgctgcccatgcggactaccctggcgccggcctcttgcaggcggcgcgacaaggtgggctggctaaggccaagctgggcgcagagttccgtcgcggttttggggtcgcttcgcaggctggtgaggatagcttcaacagacatgggctgggatttgaatagatattgaatagatactaatagatagaatccataaaatacaataacttgcttgtattcgtgcagtaagtttgaatagattcctgacggcgcacagctagcctagtgtctgcgcgccagcttaaagcccaccccgccatccggccgggtgggcttttttgctacaccctgccctccaactggtaacgggcctgcagcaactggcggtgcagcggggagatcaggctgaacagctggcgcgagggcaacggggtggcgtcggccagcagcagcaggttcaacagcgactgcatgccttcgctgacgcgggccagcgtgtggctgctggcgctgagggcttgttcgatgtcgcggtccagctgggccagccgctccatcgacaagcgcagcgtggtggggcaggtagggtcatgcgggctttgcagcttggcgatgacttggcgcagctccaccagcgccgccgcggtggcggggagcggggcgggcctgggagcggcgggcgggacaaatggcgagacattggacatggcgcatccttcacggaacggaatgatgaaaacagccgggccagcgcgccggcccggctgaggcgcgcttagcgcacctgggcaagcagcgtcagcgccttgtccatgcgcgcatccagcggcagcagcaattcccgcagccggctggaaggcaggcgcaggtcgtcgcccaggcaagtcagcaggtcccgcaccgcgtgctggctctgctggccgtcggccaggtggcagatggctgccaccaccgcgccttcaatgtcgccgcatagttcgtttagccgcgccagcggttggttcaggctggccaggtccgggtcggccagcatggcttgcagctgggccagggcttgcttcagccctgccagcgcggcggtgggtttggccggctgcggccggcggtttgccgcgcgggcttgggcggaagtatggggcgccagttcggtgtgatgggtcatcagtgttctccagggagaaagcccgcccacccgcgcgcgcgccagcgcctgtccggccagcggccggggaaaggccaacgtgcgcgggcgagcggtaagtcagtgcgtcccgtgtgggggcggagaaagcggcgagggcggaaggtgcctgatgcgcaggcggcgtggggcgcgatgggtgagtgcgcccccaaggtgccgccacgccgctgcccaccccaacacggggttctcagcggccgccgtgcccggatgggccgcggcggcagcggcttacagcacgccggtcagccggctaagcgacgcctccacccgcttgtccagcggctgcaataattgcagcaggcggctggaaggcaggcgcacatcgtcgcccaggcaggcaagcaggtccaacagcgcctgcaggcccagctggctatgggccaggtggcagatggtttctaccaccgcgtcctcaatgtcgcggcacagatgcgccaactgcgccgccggcacgcgggcgcaggcctgcggcttgcgggctagctggtcctgcaaggcggcaaaggcatcatgcagcctatgcatggccagcaggctgggctgagacaaagaggcagacgccccggaacggagcaaagggctggaggatacggcaaggtgagacgcactgcgggaaatgctagtcatagcaagatcctcacggagatgagtgctcaatcctgctttcccgacgccaatcgggggtggcaggcgcatggcgggattggcgttaccggcatctcctccggcgtgtctcgcgacactcccaccacggcccgccataaattgcgcgtagcaatgatgatcgaactggcgcggcgaacgcggcagttcgatggaagatgtaacaggacgccaatcccggtgccgctattgaacggcacggggtcaattatccggtggggggatcaggctggcaaggctgggattaacacttattccagtcttgtggccgcaggcggccggtttggtagtaagtggaaaccagttctacaaattcgcgcatgtcttcgttttcttccaccagccggtggaccgattgccagtccacatcctgacgggctcgggcggggacgacgatctcgctctcgctggggttgctgctgtccagtacgatcacgcctataccgtgcagggcggacagcatgcgcaattcgtcttccgtgtctttgccgacgatgccggtgcaaaccaagtagccttcgttagcccagctggaattactgacggcctggaagaaggacttgcgcacattaccccgggttagttctttctttacttcaaaagcccacagccgcacgctctggccaccgccatgcagtacgcagctgcgtaccagctcgtgccagtcttttgccactggttgcatggctaccaggtctgggtgcagccaatggttgccgccgctgccgcgctggttacgtgagcgtttttcgtcgacacgcaggccatacaaagacagttcggtttgcagatactgcatcagcaaggggtacagttggtactcgcttagatcggcctgctcggctgccgggctgtcatcttcgtcttcttcaattaccgtttccaccaccgcatccgtggtttcataccagtacacccgtggccgaggtttgtcttgccagcgtatccggctatctgcgccgatgatggcatctttctgcgcgccaatctccgctaccacttgggagagaaatgccttgtcgttggcaaaacgcgggttgctgcgcttgtctgcatagtcttctgggtattgatgcacgatggtgctggcaatctggcgggcggtgaaacgttgaccagggtggctgcgcagcagttgcgccactttttgggattgggacaggcggctcatgtcaatgatctaaacatgcgaaagcgtaatgatacaggatgcaatgcagcttatgcatgattgccatgccattcaggttgcttgttctgcaactgtggtcggaaaaaagccaagctacgatagcttggctttttcgtttttggttcatgtctggttgcagctacattctactacgcaaaccattaaggcaataatggcagccccaattctttgaggaaggtattgtgtttggccttggccttagcaatctcttgctcgatatcgcccagtgtctgattcaactcatctaatttgatttcttcttcagccactgccgtgctgatgtagcgggagatattcaggttgaagtcattcttctcaatctccgccatctcaaccctgcgggcgtagcgctcgataggcttttctggccgttgctgataggtgtcgataatttttgcgatgtgctcatcgctcagctggttctggcgcttgcctttcacaaagtgctcggcggcgttgatgaacaacacgtcgtccggcttcttgcactttttcagcaccaggatgcagaccggaatgccggtggagtagaacagattggcaggcaggccgatgatggtgtcgatgtggccgtccttgagcagcttggtgcggatgcgttcttccgcgccgccgcggaacagcacgccgtgcggcagaatgatggccatcacgccttcgtctttgaggtagtggaagccatgcagcaggaaggcgaagtcggccgcggacttgggcgctaggccatggctcttgaacctcacatcgtcggccagcgcgtcggtcggttcccagcggtagctgaagggtggattggcgacgatggcgtcaaagctaggcctcttggccgggttctgctcgcgcatcatgtcccactcgttgagcagggtgtcaccgtggaagatctcgaactccgtgtccttcaccccgtgcaacagcatgttcatgcgtgccaggttgtaggtggtgatgtttttttcctggccgaagatcttgccgatggtgccgcccgccttggctaccttcttgcgcacgttgagcaacagtgagccggagccgcaggcaaagtccatcacgctttctagccgcttcttggtgccggttttcggctcctggctgtccagtgtgacgatggcggagaggatgtcggaaatctgctgcggggtgtagaactcgcccgctttcttgcccgacccggcggcaaattggccgatcaggtattcataggcatcgcctaatgcgtcaatgtcggttgagaattccgccaacccttcggcaatcttctggatgatggtgcaaagcttggcgttgcgatcttcgtaagttttgccgagcttgggagaggagaggtcaatctctgagaacaagccctggaaagtgctctcaaacgattctgtctcgatatatttaaaaccatcctgcaacctgctcaacaaatacttgctctgcgtgcgtgccagattggcaatactattccataggtgttcaggccggatgacgtagtgcaccttgcggcgcatctgcttttcaaacgcaggaatatcactctcattggcgtcgtaccagcgcgccagcggcacctgacacccatattcgtcatctttcggatagtcccgccctaactctttcttcgccgccgtctcgtagttgtcggagagatagcgcaggaagaggaaggacagcatgtagtcgcggaagtcgtccgcatccatcgccccgcgtagttggtcggcgatgctccaaagggtgttgcccaattgtttttggttttgttcggtcatggtgtgttttcgtcgtgttcgttggatgggcgcggtggatggctgcgtgccggttcctggatagccttgatgtctatgtggaagcggacctgttcgctcatggctttgcccgccttttcaaggtgttctccagtgcctttagatcgatctcgtcctgctggtcggcagcaatcgcttcctgccgtttgcggttctggtcaaactggagatatagctcacctgtgcgtgcttccatctgctcatggctgatggtgccggcgtgggtgagcagcgggaatccgttgaaggtgatgatctgatccacgttctgtttccagaaggccatgcgcgtttcttgcttgctcttggcccgcagctcggcggtttccaggaagatgaccaccagccggttcagggtgtcgatctcgtcctcggtcaggtagttcttggccaccacaatgtctgccttgcgtaccttgttacccttccaggcgagtaggccgaaattcggatcagccacattggcgcgggcggtaatgagttcagcggcggtcttctgcgtcacggcatagatcaataggttctgcacagtggcaaagaaaacctgcgtggccttgtccgttttgtcgtagtcgctggagagcgcaaacagatcgcgtaccttctggtaaaagcgcttctcggaggcccggatatcccgaatgcgcgccagcatctcgtcgaaataatccgggcggccatccggattcttcaaccgctcatcgtccatcacaaagcccttggtcaggtactctttcaggacggtggaagcccagcggcggaactgcaccccgcgcggtgagcgcacgcgatagccgacggcgagaatggcatcgaggttgtagagcgtgacggggcgctgtaccttgcggctgccctcgatttgaactgtcaaggattccttgacagttgccgctgcgtccaactccctgtcttcgaagatgttttttaagtgcagggagatgttctgcttgctggcgtcaaacagctccgccatctccagctgtgtcagccagacggtttgctcctgcgctcgcagcttgatctggctgcggccgtcttcggtggtgtagagaatgagatcggtcatggtgcaggctcgggtacaggtgcagccacagcgggcgttgtcgccaaaatctctggcaggtcaaactggaactgagtagtgaaatctctaaaaatacgccggaagaggtctttgttgtcctcgcccatttcggtcggttcgtggatggcgtatttgccgtgactgagcaggttcagggcgcggttgtagagtgccacatcttcggtgttcagcgccttgaggcagaaggaaatatccgcatggccaaagaaggacgcggttttttccatgatgctgcgcagggcgttgaaatggaaagtatagagcttgccggtgccaggggccgcggccagctgaagctcggcgagtgatgcaacgtgatgaaagaacggcgtgtcctctgtggctcgcaaggtatatttcccatcgccattcgggcgatgcaggaaataacgcctgtggctgactttcgtctccccttctttcgtcctgccaagctcgttgcacattacgttgaagaacagcgcgtgatgggacgagaacaccactttgatgggcgcgagcgcgccgctctcgtcttttcggctcgcggctcggcgcaggagcttggcgaggtcacaggccacggcgatggcgttgttgtcgtccagcgaggagatggggtcgtcgatatagaggtatttgttcgactgataggagacgtgtccgtcgagcatccgctcgcaaatggccatgaataggcaccagatgaagatgttctgctcgccacgggagatcttaatattttcgtcctcccctttgcgaaaagagaccttccatgtctcgtagtcaatgtcgaaatcgaagtctgcgtagcggtcaaggtagcctgcaatcgttgcgtccagcgccaggtctttcaggccattgaaaaaagtggagttggcattgagctggagctgtcggaccttatcaccgtcgaggtcgttgtcccaggtgaacaagtcttcggtataggcattgaaataaagcgtgtcggcgattccgtccggattctttttcgtcttacgcttaccgtcatccttgaattccatcgatagccgcgtcttgccggtacggttgtaggcatagagcaggatgagatcaatcccggtgaggtcagaccgcagctttttcgcgagcgtctgcagattggcatagctgttgatcgtaggtttgccgctcatgcctcgacctcctccgaggatggaaatagctgctgcatcaggccctttttgtgggtcttgagggcctcgagcttttgggtttcggcggcgatcagagcatcgaggctgctgaaactagtggctatttttcgctgctcttcaagttgcgggagataaacctctagtgtttctaatgcaccggcattgacgttcttttgtgcccctcccgcttctgctcctaacataaattttttcccaatgggggaatttatatatagacatagataatttgaatctaaaatatcagcttttggacgagttattagggatgtaaagcactgcgcattttcaaagggtttggtaactaccgcagacaaacccgggtagccagttcttacggtgatgacatcgcccgctctcaatcgtttgttcttgtgagtcgcttcgtaagtggggtcgatatatagaaggctggagtcatcaattccactctccttaatatttagattcctcaacataggcacgcctgtttcacgatatgcatgagtagccgcacttgcaattcctaccataatcttgtctgtcaaaactgcaagtggcaaaactttccaattcccttccttttgaaactccggaaaccgaaagctaggcagtgtctcaccttcgcggggaaaaagctgctgcatcagcccttttttatgggtattgagcgcgtccactttccgcgcttgcgcggtgatcagctcatccagcgaactcaggcactcggcgattttttgttgttcggcgaggggtgtcgtgcctgtcgggatgggaacaggtagagccatcagatcgctgtcgttgatgctcaacgagccatgggccctagcgcctacctgaataaatttgcgcagccaacgcccgtgaatgttgtctgagaattgatagtttaaaaacagcgcatctggtgactccccgttgattcggaaacaagtgaatatgctgttcggaaccgctgccagctcagtgcccgagtacaaggtgagaaaaccttcgggatattctttggtggcgctcttgttgtacgcaaaatcgtatggcttcaagagcaggtaatttctgtatgagtcgcccgcaattacgcgcccaaatttttcttcttggctcacaagtcctacgcccgatgtgatgctcatcggcacgcaaatgttcttgccaactttttccgtacagatcgtcgcaattgctccgagctttactgtcgtccaatcgccagcgctttgaaattcaggaaaccgcagcttcggcaccagcgtgggctttttctctcccgtcatcgcggtggttttgttcttactgctcatacgcactgagtcctgaaatatcgcggccagcggcgcgttgggtgagtagggggtgcaaatcttccattaaggcaagctctgcctgggtgcgggctttccagccgagatctagcggggccatcaggtcgctgagctgttcgccgtcgaagatcatgcggtcgaggatgctgtcgacaaagttttgtaaggcggcagtgtccagaccgtgtttggcggcaatggcggcgagttgcgtggcgttcttctcggccttgaagcgggtatagccctcttcgatggcggccaaggagagaccctcgccggcctggagtgtggcgatgtatgcggcgatgtcgtcgcgctcgttgatgaacttggcgtcggcgctgataacgccgatgagttcctcgcggctcatcttggccttgcccggctccttggctgagtagttggcgagcaggcccatgatgtagtcgtagtcgataacggcagaagcgaagaggacgaactcgaagtcgagttggtccagcgggtcttcggtggagtcgtccttgccgctggctttgttctgctgatctttaagccgcttggcggtttccaggtactggcccttgaagccgcgcaggttgtcattaggcagcacctgctcgatggtggctttgttgtcttcgctgaggtcggtgtattgatcgagctgggttttgagccgctgcacttctttgaagtgggtaacgaaggcggcacgagcggcgtcgcctttcaggttggccacctcggaaggggtgcaggccaagccctgggatttcatgaaatcgtccagtttctgtactgcggtctctagccgctggataaccagcggggccttgtccaccagccagatttcccgtgccttctcctcggatttctcgccggagaagagggcaatggcggcatccacagcatctttctgttgacggaaatcgagaatgttgccgaatggcttggtgccattcggtttcttgtcatctgtctgaatgctggtcagcacgcggttggtgcgcgagaaggcctggatcaagccgtggtgcttgaggttcttgtccacgtagagtgtgttcaggaacttggagtcgaaaccggtgagcagcatgtccaccacgatggtgatgtcgatcttctgcgtggccgggtaatcgctgtttggccactgctggtctttgatgcgcttttgcacatcctggtagtagaggtcgaactcacttaagcggtggttggtgccatagcgggtgttgtagtcggccaggatggtcttgagcgcggctttcttgccctcggggtcttcttcgttgtctgcctgctcctgtggcaggtcttcctggatctgcttcacatcggagttgccctcggcgggcggtgagaagacgcaggcgatgtttagcggcttaaaatcgggatcagcggcctgtttctccgcctgcatggtcttgaacagggcgtgatactcgatggcgtcattgatggacgcggtggcgaggatggcattgaaacggcgcccagccgtggcggcatcgtgtttggcgagaatggcctcgatgacggctttcttggcgatggcttcgccgggtttgggcggttttttaccttcaggcttgaagtaatcgacgtggaagcgcaggacgttgccgtcctcgatggcgtgagtgatggtataggcgtggagctgcttgtggaagagctcttcggtggtctgatatgaggccacctctccgtcgatttttatgcgagtggcgttgccatcttctccaccaaatatcggcgtgccggtgaaaccgaacatctgcgccttcgggaaaaatgctttgatggccttgtggttgtcgccaaactgcgaacggtgacattcatcaaagatgaagacgatgcgcttatcttgcagcgcttcgagctgttccttgtaggtggcttggccgctcttgctgcgctgcttgttgcgcttgctgttttcgtccagtgccaggcccaacttttggatggtggtgacaatgaccttgtcggcgtagtcctccgacagcaagcggcgcaccaaggcggcggtgttggtgttttcttcgacgcaaccctcctggaagcggttgaattcctcccgcgtctggcggtcgaggtctttgcggtccacaacgaacacacacttgtggatgtgctcgttttccttcagcaaggttgatgccttgaaggaggtgagtgttttgccactgcccgtggtgtgccagataaagccgttaccgttgtcttcgtcgatgcacttgatgatgtgctgtacggcatagacctggtagggccgcatgaccatgagcttctgctcgccggcgagcaacaccatgtagcggctgatggtgcggccgaggtcgcactttttcagaaagtgctcggcaaactcgtcgagttgagtgattttgcggttgtcttcatctgcaaactcatagatgggcaaaaagcgctcgtcggcattgaaggcgaagtggcgggagttgttgttggcgaagtagtagctgcggtcgcggttgctgacgatgaacagctgcatgaagcagagcagcgtcttgctgtagccgttgccgggatcgtttttgtattcgacgatctgctccatggcacggcgcggattgacgcccagggttttcagctcgatctgcacgcagggcacaccgttgatgagcaggatgacatcgtaacgctggtggctgttgtcggtgttgatgcgcagctgatggatgacctcgaagtggtttttgcaccagtccttgatgttcaccagcatgtagttcagtggtgtgccgtcgtcgcgggtgaaggcattgatgctgcgcagggtcttggcggcggtgaatacgtccgaggtgactatctcgtcatgcagccgcttgaactcggcgtccgtgaggcggacgcgattcaacgcttcgaatttttcgcggaaattgttctcaagcgcagcacgatcattgatgtctgagcgtatggtgtatttgagctcattgagcttggcgatgaaatcatgctcgatctgacgttcatgcgtgttcattttgtctatttctgtgctcaatattcgtgaattctatagatttcgcgctgatctgacacccctgcgcagagtgcaagccatggtggcaaggtggatggctgcacgctgtggtagaacgatattgtgtattgggtcaccgccgtgtgggcccgttaacgctgacagtgcgccgtttgtattgtacgcatggtgctgctggtgaccgtctgcagggttgctacgcaacatagaaaaagcggccactcggccgctttaaatttaatgtttaaaattaaaaatttattttaaacatctatgttgcgtgcgatcaaggcgtttccttcaatgaactgacgtctcggctccacctcgtcgcccatcagggtggtgaacacgtcgtccgcgcccatcacatcttcgatgcgcaccttcagcaggcggcgcacggtcgggtccatggtggtttcccacagctgttccgggttcatctcgcccaggcctttgtagcgctggatgttcatgccctttttcacttcggccagcagccagtccagcgcttcgccaaattccgccaccgggcgcacggtttcgccgcgcttcacctgggcgccatcgcgcagcaggttgttcagcaggtcgccggttttcttcagctcggcgtagtcgccgctgtccaggaagttttggtccagcaccgtcaccagcacgttgccgtgcagcttgcggatgatcttcaccaggtggccgtcgttcttttcgtcgcgcagcagctgcaggtcgatggtttcggccggcagcagcgcttgcagcgcggcgacgcaggcggcggcttcagcctggctttgcagcgacagcgggccgctcttcagcatggcttccagcaccagcgggtcgatcacgcggctttcgcgctctattaccgcgcgggtcagcaggaactggcgggcgatttcggccagggtgtcgccggccagcggggcttcgccttcggccgggatcagctcggctttttccagcgccagttgtagcaggtactggttcagctcgtagtcgtccttcaggtagcgttcctgcttgccgtgcttagccttgtacagcggcggctgggcgatgtagatgtggccgcgctccaccagttccgccatctggcggtagaagaaggtgagcagcagggtgcggatgtgcgcgccgtccacgtcggcgtcggtcatgatgatgatgcggtggtagcgcagcttgtccgggttgtattcgtccttgccgatgccgcagcccatggcggtgatcagcgtggccacttcctggctttgcagcatcttgtcgaagcgggcgcgttccacgttcaggatcttgcccttcagcggcaggatggcctggaatttgcggtcgcggccttgcttggcggagccgccggcggagtcaccctccaccaggtacagttcgcacagcgacgggtctttttcctggcagtcggccagtttgccgggcaggcccaggccgtccatgatgcctttgcggcgggtgatttcgcgggccttgcgcgcggcttcgcgggcgcgggcggcttccacgatcttgccgcagatgatcttggcgtcgttcgggttttccagcagataggtcttcagcgcttcgctgatcacttcgttgaccaccgggccgatttcgctggaaaccagcttgtccttggtctggctggagaacttggggtcgggcagcttgacggacagcacgcaggtcaggccttcgcgcatgtcgtcgccggtggtgtccaccttggcctttttggccacttcgctctcttcgatgaactggttcagcgtgcgggtcatcacctggcgcagcgcggtcatgtgggtgccgccgtcgcgctgcgggatgttgttggtgaagcactggacgttctcttggtaagagtcgttccattgcatcgccacttccaccgtcatgccgtctttttcgccgatgccgtaaaaggttttcgggtgcagcacgttcttgttgcggttcatgtattcgacgaagccggccacgccgccggagaaggcgaagttttcttccttgccgctgcgcttgtcgatcagctggatgccgacgccctggttcaggaacgacagctcgcggatgcgcttggccaggatgtcgaagtggaattcgatgtggccgaaggtttccacgctggcgaagaaggtgacttcggtgccgcggtggctggtatggccggtgacggtgagcggggccaccgcgtcgccgcggcggaattccatttcatgcaccttgccgtcgcgccagatcttcagcttcagccagtcggacagcgcgttcaccaccgatacgcccacgccgtgcaggccgccggaaatcttgtagctgttgctgtcgaatttgccgccggcgtgcaggatggtcatgatgacctcggcggcggagcggccttcttccgggtggatgtcggtgggaatgccgcggccgttgtcttctacggagacggagttgtccgggttgatggtgaccttgatggtgtcggcatggccggccaacgcctcgtcaatggcgttgtccagcacttcaaacaccatgtggtgcaagccggtgccgtcctgggtgtcgccaatgtacatgccggggcgcttgcgcaccgcatccaggcctttaagcaccttgatactgtccgcgccgtattcttgttcgctcatactcacactttccaaatggcggcgctctggcgcggcggggatggtttcccgccgctgccggcgcgctgccggtcattcttaaacccggttgggaggccgcggcctcccgctcacatcacggttcgcgctgtcagatgcgcatcggcatcacgatgtacttgaagttgctgacgtccggaatggtgaacagcgcgctgcggttggagtcgccaaacgccagctgcagggtgtctgtcggcaggttggtcagcacatccagcagataattgatgttgaagccgatttccagcgtgccgccctggaaggcgatttccagctcttcttccgcttcttcctgttcgctgttggtgcacaggatggacatcttgcccggcgccagcaccaggcgcacgccgcggaatttctcgttggccagaatggcggcgcgctgcaaggcgtgcaggaattccaggcgttcgatcaggaaaatcttttcgttgtccagcgggatcacgcggttgtagtcggggaacttgccgtcgacaaccttgctgatgatcacggtggcgccgaagctgaagcgcacctggttggccagcacttcgatcttgatttcgtcgtcgctgtcctgcagcagcttgtacagctcgatgatggtcttgcgcggcaggatcacctcggccttgggcagggtggcggcgacgtcggcgctggcgaaggccaggcggtggccgtcggtggccaccaggcgcacctggttgccgtcggtctgcatcaacaggccgttcaggtagtagcggatgtcctgcaccgccatcgcgtattgcacctgggagatcaggcgcttcagctcgcgctggctcagcgtgaagctggagtcgctggcgttgcccaccgacagcagcgggaagtcttccgccggcagcgtctgcaggttgaagcggctcttgccggccttcagggtgaggcggccgccgtccagctgttccagcgtgacggtggcgttgccggggatggcgcgcaggatgtcctgcagtttcttggcggacgtggtcaggcggaagtcttcgcccggcagttcgtcggcgctggcggtggtgatctggatttccaggtcggtagccagaaagcccacctggccgccctttttctcgatcaggacgttggacaggatgggcagggtgtggcgacgctcgacaatgccggtcactgccagcaggggcttgagcagggcatcgcgttcggcttgcaggatcagcatgtggcgggctcccgttgaatggtgaagagtcggttcatggttgaattatcagttgcgcagcatggccagcagcgtgtcgtagtcgtgggcgatgtcggcgtcgttggcgcgcatttcattgatggttttgcaggcgtgcagcaccgtggtgtggtcgcggccgccgaacgcgtcgccgatattgggcagcgacagctgggtcagctccttggccagcgccatcgccacctggcgcggccgggcgatgtcgcggctgcgcttcttgctgtgcatgtcggacagcttgatcttgtagtactcggccaccgtcttctggatggcgtccaccgtcacctggcggttgccggcggccagaatgtccttcagcgcttccttcaccagctccagcgtgatgttttggttggtgaagcgggcgtaggccaccacgcgcttcagcgcgccttccagctcgcgcacgttggagcgcacgttctgggcgatgaagaaggcgacgttgtgctccagcttgatgctgtcggcctcggccttcttcatcagaatggccacgcgcatttccagctccggcggctggatttccaccgtcaggccccaggagaagcgcgaaatcagccgctcttccatcccttcaatctgcttggggtagctgtcgcaggtcatgatcacctgcttgccgccctcgatcagcgcattgaaggcatagaagaattcttcctgggtgcggtttttgccggcgaagaactggatgtcgtcaatcagcaacaggtccagcgagtggtagtagcgcttgaattcgtcaaacgccttgtgctggtaggcgcgcatgatgtcggccacatagcgttcggcgtggatgtagcggatcttggcctgcgggttcttctggaacacgtggttgccgatcgcctggatcaagtgggttttacccaggccgacgccgccgtagacgaacagcgggttgtaggcctggtcgcccgggttttccgcgatctgcatcgccgccgcgcgcgccagctggttgcccttgcctgtcaccagcgtgtcgaaggtgaaggaagggttcaggcgcgtgctttcatggctgccgccgatggccttcaccgccgcctgcttggcgggggacggcgccgccggcgcgctggccgcggccttggcgggctccttggccttgggcaggctgctggccgccggctgcagcggcttggccgacggcgcgcccaggcgcagctccaccgggcattcgccgatcagttccaccgccagttcctcgatgcggcccaggaagcggtccttgatgaactgcatgatgaagcggttgggcgcgagcagcgcaacgccctcgtcgccggcttcggcggtgaggggtttgatccaggtgttgaactgttgcgaagacagttcggcctccaggcgagcgaggcaagcaggccagaattgatccagttcggtcattacatacacgcaagtgaaagcgaaaaacccgctgccggcgcaaggcttgcaacagcgggagaggccgcctgcgacctttatagagcaaggcggcgcaggcggcgggtgttcggcatggaagcggccggcaggctgcggtggtttggacgcggcgggttgtgggccctgggtgcgttcatttgttgtgcagccggacggcaacgataagcccagacattctaacggttttttgcaaagttatccacagggtggcagaaaattcctcgttgacaaagccgccgatttcgagtcaaatcacgcgtttatttccgtttcgaaacaggaaacccatatcatgaaacgtacttaccagccttccaatacccgtcgcaaacgcactcacggcttcctggtccgcatgaagacccgcggtggccgcgccgtcatcgccgctcgccgctccaagggccgcaagaagctggccgtataagccccttgtcggcttaccgctttcgccgtgcgcaccggctgttaaaaacggatgatttttcatccgtttttagtttgcggcaacaacgcagcaatgcgttcttccaggtgtatgtccgccccaacgggcttgaccatccccgcgtagggctggtggtcggcaaaaaggtggccaagcgggcggtgcgccgcaattacatcaagcgctgcgtgcgcgagtggttccgcctgcatcggcaagagctgggcggcgtggactacgtggtgcgggccaagctggcattcacccgagagcaacgcggcgaagctgtcacagctttgtcggctctgtttgctaaactggcacgatgtcacgcatcctcatcctcctgatccgcttttaccagctggctatcagcccgtggctgccgccgcgctgccgctatcagcccacctgttccagctatgcgatcgaggcggtgaggaaacatggcgcactcaagggcggctggctcgccgccagacgcatcggacgttgccacccctggggcggcagcggctatgacccggttccctgaactttccggtatcgagagatggattccaagcgactcataatcttcgttttactgtccgtgggcattctgtttggctggaatgaatatttcatgcccaagcacagccagcagcaggcggcacagacccaggccgccgcgggcgcgagcaatgcgcagcagccggccgacgtcaacaagctgacccgcggccagcgcatccacgtcaagaccgatctggtcgaggctgaaatcgacaccgtcggcggcgatctgcgctcgctgcagctgctgaagcacgccgccgcagaagaacacggcaagccgttccagctgttcgaggacgacgccaagcgcacctacgtggcgcaaaccggcctggtggcagccagcaacccggcgctgcccacccacaaaaccgttttcaccgccgcccagtccagctaccagctgaccggcgacaagctggaagtgaagctgactgcgccggacgccaacggcgtcaaggtgagcaaggtctacaccttcagcaagggcagctacgagatcggcgtccgctacgacatcgtcaacggcggctccgccccggtcgcgcccaccgcctactaccgcctgctgcgcgacagccaggcgccggaaggcgaaggccgcatggcccacacctacaccggcccggccgtgtacacctccgagcacaagttccagaaggtgagcttcgacgacctggccaagggcaagggcgactacgccaagaccaccaccgacggctgggtggcgatggtgcagcactacttcatgtccgcctggatcctgaagccgctggacgccgcctcggtgtgcaaggacgacaagtcctgccgcttcgagctgaagcagagcaacggcctgaactccgccgccgcgctggttgactacgccaccatcgccccgggcaagagcctgagcgtgagcgtgccgctgtacgccggtccggaagagtacagcatcatctccaagctggccgacggcatggaatacgccaaggacttcggcatcttctacatcttctcctcgccgctgttctggctgctggtgaagctgcacgcgctggtgaacaactggggctgggcgatcatcctgctgacgctgaccatcaaggcggtgttctacccgctgaccgcggcgtcctaccgttcgatggccaagatgaaggcgctggcgccgcgtctggagcggatgaaggaacaatacggcgacgaccgcatgaagttccagcaggcggtgatggagatgtacaagaccgagaaggtcaacccgctgggcggctgcctgccgatgctgatccagattccggtgttcatcggcctctattgggcgctgctggcctcggtagagctgcgcggcgcgccgtgggtgctgtggtacaccgacctggcccgcccggacccgtacttcgtgctgccggtgctgatgaccgccaccatgttcctgcagaccttcctgaacccgccgccggccgacccgatgcaggcgaagatgatgaagatcatgccgctggccttctcggcgctgttcttcttcttcccggccggcctggtgctgtactacgtggtcaacaacgtgctgtcgatgagccagcagtggtacatcaaccgcaacatcaacaagcagaacaaggccgcgctgcaatcgtaagcgctgagtctggactgctgaccgaacccggccccaggccgggttttttgctggccgggccgccggccccctctcgctcataatcaagaggccggacttcggcttgccaggatccattcgcagcgaaagccgcttcgaagcgctggaattgcgggataatggaagcagtgaatgcgtcgcgatgtctgcgccagaacgcatgagcgggcgcccgctctctctgggggagagggccggagcgatgcaggcagcttccaccgccagccagcagcaggcagataaatcgcggccaagccatcaaggaatgtcgatgaacctcagttacacccccgccaccatctgcgcggtcgccaccgctccgggccgcggcggcgtcggcgtgatccgcgtctccggcaaggacctgctgccgttcgcgcaggccatttccggcggcaagtcgcccaagccgcgctatgccacctacaccgactttttcgatgcccacggccaggccatcgacaacggcctgctgctgtacttcccggggccgaacagcttcaccggcgaagacgtgctggagctgcagggccacggcgggccggtggtgatgaagatgctgctggcgcgctgcgtggagctgggcgcgcgcctggccgaaccgggtgaattcaccaagcgggccttcctgaacgacaagctcgatctggcgcaggcggaaagcgtggccgacctgatcgacgccagcagcgaaaccgccgccaggagcgcgctcaaatcgctgaagggcgcgttttccaaagagatccacgtgctggtggacgaactgatcaccctgcgcatgctggtggaagccacgctggacttcccggaagaggaaatcgactttctcaagcaggccgacgcgctgggcaagctcatgcggttgcgcgaccggctggtgcaggtgcaggccaccgccaagcagggcgccatcctgcgcgagggcatgcacgtggtgctggtgggccagcccaatgtcggcaagtccagcctgatgaacgcgctggccggcgacgacatcgccatcgtcaccgatatcgccggcaccacccgcgacaccgtgcgcgaggaaatcgtcatcgacggcgtgccggtgcacatcatcgacaccgccggcctgcgcgacaccgacgacgtggtggagaagataggcatcgagcgcacctggcaggcggtggagcgcgccgatctggccctgctgctggtggacagccgcgaaggcctgaccgccgaggtgcaggccatcctggagcggctgccgccggcgctgcccagggtgcaggtcttcaacaaggtggacctgtctggcgaagcggcgggcctgtcggtggaaaacggccacccgctggtgcggctgtcggcccgcacccaccagggcgtggacgtgctgaaggccaagctgctggagatgataggctacagcggcgccgacgagggcgtgttcctggcgcgccagcgccacctggatgcgatcgcccgcgccgccgagcacctggagctggctcacgccgattgggaacaggtggagatcttcgccgaggaattgcggatggcgcagaacgcgctgtccgagatcaccggcgaattcagcgccgacgacctgctgggcgtgatcttctcccgcttctgcatcggcaagtaagccgccgccgcgaatcgcgcatcagccccgcctggcggggctttttctttgcgtcggcgcaatatcgccgcactcgcgctgtcaagtcatttggcattcatggcgcagcatggaaaatgaatagcgagccggtcaatttttatgaattttggaataagatacgcgctgacgccgcaatatggccttgtcctggcgattgggcgccagtcccggcattaccgcggccgccttgccggctgtactgatttttgaatcgtgctggtcattatgtttcccattgaaaggatttcatgttgcgcagatggctgggggtgttattcggcattttgatggcaagcggcgcggcgctggcggcggaagacccggtgatactgaccgtttccggccagatcgggaaatggacgaataataaaagccggacatacgaattccgcgaaagcgacttgcaggctttgtcgcagcacgccatcaccacccgcaccagctggacgccggaggcggttttttccgggccgctgatgcgggatatcctgcgccgcgtcgaagccaggggcgggcaggtgaaattcgtcgccttgaacgattacgcctatacggtgagccgcgacgaactggaaaaatacaatgtgattctggcccgttcgttcaatcacaagccgatggcgatcaaggagcgcgggccgctgtggctgatgtatccgctgccggacatgccggcggaggaaaggggaccgctgctggatgcgaaattgatctggcaggtgtatcggatcacggtttattgaggctcattctggcgcgatgaatatggcagatggcgaaagcagtgcgagcaagcagccgtcctggctgctctggggtttgtccccgatattctggctggttgtcctgctggtctccatcagcatgtatatcgcggtggaccgttacgccgcgatcaagaaattcgatggccgcagcgaggacctgtattggtcggtggcgcagctgcagatcgcgctggagcgctcgcgcgccgagctggtgcggctgaaggccggcgaaatcagcccggagcaggcagacatccggctggagatcgccaaaagccgctatcaggactatgtcacgccgtcgaccctgcacggcatgctgaacgcggtgccgggcttccgcgaaaccgccgacatgctgggcaatttcttccgcgacggcaatatcggccatctgagccgggattcggcgcagcggcatatcgaccagatcgacgacattcggccgcggctggccgagttcgcggtgcagtcgcggatgtcggaagtgtcgttccgcgatgagcgcaacaaggatctggaacgcaagcggctggtgttttcgttgtggttcgcgttgtggggcggcatcgtcatcgtcatctgggtgctgctgtcgagctaccgccgggcgcgccgcgacgtggcttcgcgccaggcgctgctggagaaggaaagggcggcgcacaaggccacggtgtcggccgagctggaccgcaccacctttctcgccaccatcagccacgaaatccgctcgccgctgcagaccatgcaagtgtgcgtcgagctgatggagctggatgtgcagcccggcaatcgcatccacgccaacctgatgcggctgaaggccagcatgagccatctgctgagccaggtgcgcgacatcatggacatttccgccatcaacaatatgcagctcaggctgcatcccgaggacgtcagcctggcaggcatcctgaccgaggtggtggacgcctaccgggtgcagctggaaggcaaggggctgcggctgcatttcgcgatggccaatctgccggagaccgccaccctggacggcaaccggctgcggcaggtcgtcggcaacctgctggccaacgccatccgctataccgatcacggcgaggtgtcggtgacggcccgggtggacggggtgcgcggattccatcatctggaaatccgggtgcgcgataccggggtgggcatccccgccgactaccagtcgcggattttccagcccttcttccagggcaagcagcgccggccgggcagcagcggcctggggctggccatcgtcaaggagctggtcagcctgctggggggcgagatcgagctgaacagcgaggagggccgcggctcggagttcatcgtcaggctgccggtgcgcatccagccggaagagggtggccatgagcgttcggtgctgctggtggacgacgaccagaacatccgcgagcctttcgccgactgcctgagcctggacggctacgcggtggtgatggccagttcggtggccgaggcctgccagcaggtgcagcagcggccgttcgacgccatcctgctggacatgcagctgggcaacgaaagcggctacagcgtgctggagttcatccggaaaagccgcaacaaccagcaggccagcatcatcgccatgaccgcctacccggaagaatacgccgacccccgctccgcctgtttcgccgagcggctggaaaagcctttcgacttcaaccgcttgcgcgcggtgctgaagcggcagatgtcctagcgttcgcccccgggccgacggctaggcgtgtctttccgtccacaaatgctgaatcgcataggcgcgccatggctgccaggcttcggcgcgcctgtgcagccgttcccgctcggcggcgctcaggcctaaatcctccagcaagcgttggcgaacggccgggtaggcatccggctcggcttgcgccgaatccgcggcggcgtccggcgcgtcccagcggccgggcagccgcaggccgggccgcgcggcgatcaggcccgccaatcgcggatcctgggataggtgccgctcaatcatggcggggtcggccgccagatcgaacatcgcccgcacccgcgccaggatggccggcagcgccgccagttgcgggaagcggatggtgacgctcagcgcgtggcccgcgccgggacgcaccgccagttcgccgcgggcgccgttccacgcgatggtccgcgcatagccgtcgtcctgcacggtttccacgccgggaatggcgtgggcggccaggtgcagcagcatggccggccagtggtagggcggccggtagcgcagcagcagggtgatctcgccgggcgcggccggcgcggcgccggcgtcgcggcgcaacgcgccggggggccgccggtacagcgcctggaatacctcgttgaagcggcgtacgctgccgaagccggcggcgaaggcgatgtcggtcagcggcatccgcgtttcgtggatcagctgcttggccagcagcacccgccgcgtttgcgccaccgccagcggcggcgcgccgacgtgttcggcgaacagccggcgcagttgccgctcgcccacgcccagcttgtcgcacagttcggccaggctggcctcgtccagcatgccgcgctcgatccaggccagcgcgcgcgccacggtatggctgtggccgctgttggacacgccgcgccaggcgccggagtcgggcgcggcttccggccggcaacgcaggcagggccgcaggccggcttcctgcgccgccgccgccgtgggataaaagtccacgttctcgcgcttggcggtgcgcgccgggcagatcggccggcagtagatgccggtggtgcgcacgccgatgaagaagcggccgtcgaagcgggcgtcgcggctggccagcgcgcggtagcagatgtcgggatcgagtcgcatgcgcgcatcatccagcgaaacgccgatgccggccagcggttttcggccgccgactgcttgatggccaggtccgaaaaccgccagccggcggcggcgcgcggcggcaagatgcgggccttgtccttttccgacgcacggagcgcgccatggccgcagacattcagcagtttcatcatttccgccaattgaaccgccagggccgcctgttgctgcccaatgcctgggattgcgccagcgcccggctgttcgccgccgccggcttgccggccatcgccaccaccagcggcggcatcgcttacgcccgcggttgccacgatgcccagcacctaggccgcgaggcgatgctgcgcgagatcgccgccatcgcgcagagcgtcgatctgccgctcagcgccgacatcgaggccggctacggcctggcgccggaggacgtcgcgctgacagtgcagggcgcgcttgccgccggcgcggtgggggtgaatctggaggacaacggccatggcctgctggcgcagcccttgttcgacatcgccgcgcaatcggcgcgcctcgccgccgcgcgccgggcggcggagcaggccggcctgcccttgtggatcaatgcccgcgtcgatgtctggctgctgggcctgggcggagatgaggaggcgcgcctggctcagaccgtggcgcgcggcaatgcctacctggcggccggcgcggacatggtgtttgtgccggggctggccgacgcggcgttggcggcgcgcttggcggcggccttgaacgggccgctcaatctgatggcgctgcccggggtggcgggggccgaggcctggtttgccgccggggcgagccgggtcagcctgggcgtggggccgatgctggccagcatggggctggtgcgcgagatggcgcgcgaggccgcccagggcgtctggccgagcatggctgcgcacttttacggcttcgccgaggcggaagccttgttcgccgccggctgacgctgcggcgcgacggcatcgtccagccattggaacagctggtcgacgactatcgccagcagcgccaccggcagcgcgccctggatcacgtaggcggtgttgaagccggacaggccgacgatgatgggcaggcccagggttttggcgccgacggtggaggccagcgccgcggtgccgacattgatcaccaccgcggtgcgtacgccggccaggatcaccggcgcggccagcggcagctcgacccgcagcaggatctgccgccggctcatgccgatgccggcggcgacttcgcgcatgtccggcggcaccgaggccaggccggccagggtggcgtgggcgatcggcagcaggctgtacagcgtcagcgccgccagcgccggcagcgcgccgaagcccagcaagggcaccgtcgccgccagcaccgccaccggcggcagcgattgggcgagggacaacagcgattccagcagcgggcggaattcacgcccggcggggcggctggtccacagcccggcgccgccgcccagcagcagcgcgagcgcgctggacagcgcgacgatgccaagatgggacaaggtcagcgcggcgaagtcgtcctgcaggtatagcggccgctccagttccgggaaggcgaggcggaacagcgcggcgctgcgcggcagcgccagcagcaggccggccagcgccaggctggccaggatcagcgcggcgcggcggcgcagccagctcatgcgcgcgggcccagcaggtcgtcgaaacgcagcgcgcctatcctggcgccctggccatcctccaccggcagcgccgcggcgccctgggcgacgaaggccgacagcgcctcgcgcagagtgctgtcggcgcggatggccgcgccgtcggcgcgctcgcccggccgcatccgctctcccacccgcaccaggcccagcaggcgcacgccgacatcggccgggttgaagaattggcggacaaagtcggtggccgggcgcagcaggatgtcgcgcgcgccgccctgctggacgatgcggccctggtccatcaccacgatgcgctggcccagcagcagcgcctcgtcgatgtcgtgggtgaccaggatcacggttttgccgaacagccgctggatgcgcgccagctcctgctgcagattggcgcgcgtcaccgggtccagcgcgccgaacggctcgtccatcagcagcacgtcggggtcggcggccagcgcgcgcgccacgccgacgcgctgctgctggccgccggacagctggtgcggatagcgcgggccgaactcccgcgccggcagccgcagcgcgtccagcagttcttccacccgggcgcggatgcgcgccggcggccatttgagcagctgcggcaccgcggcgacgttctgcgccaccgtccagtgcgggaacaagcctaccgactggatggcgtagccgatgtggcggcgcaggatttccggcggctggctgcggatgtcgcggccggcgacgcggatgctgccgctgtcgggttcgatcagccgattgagcattttcagcgtggtggacttgccggagccggaggtgcccaccagcaccgccagttcgccctcggccactgtcaggtcgaggtcggccaccacgcgcgagccattgaagcttttgttgacgccagcgatttcaatcatgggcagcgtggtccatccgggagatgacgatcttgaacgcggcgtcgcacgcggcagccagcagcgcgatgggcagcacgcccagcagcgtctggtccggcgcgctggcggacaggccctggaacaggatggcgccgaagccgccggcgccgatcagcgccgccaccgccgccagccccaccgcctgcacggtggtgacgcgcaggccgctgagaaacaccggcagcgccagcggcagctccacccgcgccagcagctgccatggcgacatgccgatgccgcgcgcgctgtcgcgggccgccgtcggcacctggcgcagcgcggccagggtgccgtgcgccatcggcagcagcgagtacagcgtcagcgcggtcagcgccggggccaggccgaccccggcgatgccggactgaggccacagccggcccagccaggccagcggcgcgatcaacagcgcgaacagggcgatggacggcaccgtctgcagcgcgttcagcgccgggaacagccaggcttccacccgcgggcggcgaaacgcggccaggcccagcgcgccgcccagcagcgccgccggcagcaccgagaagcacaccagttgcaggtggcgcagcagcgccaggtggaagctgtcctggtagttgcggtattcgcgcagcagcgccagttggtccagcgcgccgcccagcagcatggccagcgccggcaggcaggcggcgcagaccatcagcgcgcgccgcgccggtgatggcgacaggccgcgcagcgcttcggccagctgcaggccggcggccagttgcagcagccagaagccggcgccgaaggcgacgcgggccagcgcgtcttcgccggcggcgaggcgcagcgcctcgcggccggccacccacagcaggccattgcccagcaggcaggcgcacagcgccagcaacagctggctgccagccgagcggcgcagccagggcgccagcgccagcggcaacgcggccgccagcaacagggcggcctcggcgccgggcaggctggccaggtacaggccctggccgctcagcagccggttgggggcatagctgagcagcgggcagcagaaacccgccgccagcagcagggccagcagcaggccaacccggttgcgcagccgcatcagccgcggcgcctcatcggatgaagcctttgcgcttcaggtagtcggccgccaccttgcgcgcgtcgcggccctcaagggcgatgctggcgttgagcttctgcagcgtggcctcatccagcgactggaacaccggcttgagccagacggcgatctgcggctggcgcgccagcgcgtcggcgcggatgatggccgccggcgcgtataccggctgcacgcccttggggtcgctcagcgtcgtcaggccaagcgcggccagagggccgtcggtgccgtaggccatcgcggcgttgacgccggaggtttgctcggcggcggctttgatggtggcggaggtgtcgccgccggccagcgtcagcagctggtcctgacgcagcttgaagccgtaggcctgttggaaggccggcagcgcgtcgggccgctcgatgaattcggccgaggccgccagcttgaagcggccgcccttggccagccagcgctggaggtctgccagcgaggccagatggttggcggcggccaggtcgcggcgcaccgcgatggtccaggtgttgttggcaggcgccggcgccagccagacgatgcggttcttgtcgtagtccagctgcttgacgcgctggtagccggcggcggcggatttccaggccgggtttttctcgtcggcgaagaaaaaggcgccgttaccggtgtattcggggtagatgtcgatttcgccggcggcgatggcggcgcgcactaccttggtattgcccagcgacagccgattggcggttttgacgccgtgagcctcgagcacctgctggatgaggttgcccagcagcgcgccctcggtgtctatcttggagccgacgcggatggcgtcggcggcgccggcggcggcggcggacagcagcaggccggcggcaagcgcggccagcggggcaaggcggaaaacggggcgcggcatgtgggctcctcggtttgctcggcggcggtcagactgggcgcggccgcatgacatgcggctggctgcgctcaatataccgctccttgccggcgttcggccagcggcggggaagggggagggaaaagcgaggcgggtttagcccgcggcgtcgccgtggcgcgccaggaagtcgcgcttggcggcggcggagagctgcttgaacgcgtattcggccttcagcgcggtggaacggtccgggtattcgatcaccagcgcgatggcgctgggcgggttgaggcgggtgtagcgcgcgcccttgccggcctggtgctggcggtagcggcgcgccacgtcggtgctgacgccggtgtagagcgcgccgcccgcgcagcgcagcacatagagaaaccagggccgcggcggccccggctcatgctcagatggcggcatcgaagccgtcggcgatcgggctgatcagcacccgctcggtgcggttgcctttctgcgcggtgacgcgcagcttccattcgcccaccgtcacctcgtcgccttcgcgcgggatgcgctccaggcagtccatcaacaggccggccacggtgtggaagtcttcgtcctcgaagtcgcctagcgtcaggtattgctccagcgtcatcaattccaggctgccctccacgtcgtagctgccgtcggcattggccacgatggccggcagctcgtggcgttcgtgctcttccgggaattcgccggcgatcgcctccatgaggtctttctgggtgactatgccttccaggctgccgaactcgttgaccacgaaggccatgtcggcggcgtgctggcggaagctctccagcgccttcagcacggtgacggtttccggcagcaccagcggctggcgcagcgcggcgtcgatgtcgagctggccgccatccaggagctgcgccagcaggtccttgcgcgcgacgatgcccagtggctcgtctatgctgccgtcgcgtatcaccaccagccgcgagtaggggctgtcgcgcagcgccttgcggcgggcggcttcaggctggctgaggtccagccggtggatgtcggcgcgcggggtggcgatcacgcggatcggccgctcggccagcgtcagcacgctgtgtatcatcgcgcgttcgttgtggccgaaggcggtttcctccaccggctgcgggccgacttcgggcttggcctcgggcttggcttccgacaggcgggtgcccatcaggctgagcaccgcgttggcggtgcgctcgcggaagctctggttgcggttgaggtagcggacgcggttggcctgcgccacctggttgaacgattcgatcaataccgagaagccgatggcggcgtacagatagcccttgggaatgtggaagccgaagccgtcggccaccaggctgaagcctatcatcaagaggaagcccaggcacagcatcaccacggtcgggtgggcgttgacgaaggcggtcagcggcttgctggcggcgatcatcaggatcatggcgatgatcacggccagcatcatcaccggcaggtgttcggacatgccgatggcggtcaccaccgagtcgatcgagaacaccgcgtccagcaccaggatctgggcgacgacggtggcgaaggcggcgtaggcgcgctggccgctggccttcacttcgtccacgccttccagccgctcatgcagctcggtggttgccttgaacagcaggaacacgccgccgcccagcatgatcaggtcgcggccggcgaagccctggccccagatcgagaacagcggggtggtgagggtgaccagccaggaaatgctggccagcaggacgaggcgcatcagcagcgccagcgacaggccggtgatgcgggcgcggtcgcgttgttccgggggcagtttttcggccaggatggccacgaaaatcaggttgtcgatgccgagcacgatctcgagaatgatcagcgtcaagaggcccagccaggcggcggggtcggacagccacgataagtccatgatggtgtagtacgttccttagagggataaaaaagcgctaaaagcgctacaaggataccaaatgccgccgccgcgggcggggaaaatgcaaaacgccccgcgcagacggggcgtcgatgatgcctgggaaagattacaggccgccgtacgagtgcaggccggacaggaacatattgacgccgaggaaggcgaaggtggtgaccagcaggccgccgaccgaccaccaggccagcggcgcgccgcgccagcccttcaccaggcggatgtgcagccaggcggcgtagttgagccagacgatcagcgcccaggtttccttcgggtcccagctccagtagccgccccaggcgtccgccgcccacatcgcgcccaggatggtggcgatggtgaagaacaggaagccgacggaaatggccttgtacatcatctcgtccagcacctcggcgctgggcagcctgtccttcagccagcccttcagcaccagcagctcgcccacgcccagcatcgccgccagcgcgaaggagccatagccgacgaagttggccggcacgtgtatcttcatccaccacgactgcagcgccggtatcagcggctggatctcgtgggcctggcggtccaggctgtaccacaggatgaagccgacggtggcgcagatcaccggcagcaccagcgcgccggcctggcgcgcggcgaagcgcgcctcgtagtagaggtgcatcagcgcggtgatcagacagaacagcaccatcacttcgtacaggttggacaccgggatgtggccgacgtccggcgcgatcagatagctctcgtaccagcgcacgaacaggccggccaagcccatcgccgccgccgcccaagtcaggccgcgccccatgcgcagcagcaggtcggagcgccgcgccacccccagccagtagacggcggtggccaggaagaacagcgtgcacatccacatgatggccgactggctggccagcgcgaacttcagccagaacgcggtctggccgcgggccagatcgtgctggtagtcggcgatgccgagcaaggcggcgccgccggccagcgggaagaaccagcgccaggattgccagaaccagcccagcgcgatcaggcccagcgccgatccggccaggatgccctgctcgtagacgtccatgtcctggtgatacagccggaagctgtaaccggcggccagcaggatcagcagcgcgtaggcgccgtcccacagcgagagccgcttccacagcggcgtgcgtgcaaaggaagaagttgccagttccatcatgatccccgtgtcagctgtttgatggcgtctagatgacgctggaagtcgcggtcgagatcgcggttatgccggtttgaggtcatcgccaccctgagctggcggccgtggatgcgcacccacaggcgcagttcgcgcacatagaacattagcacgatgcccagcaccagcaagatcgaaccgagatagaccagggtcttgcccggcgagcgcgtcagctgcaggccggacgactgcacctggtcgaagctgtccagctgcaggaagaccggcgcgccgtagtcgcgcaggccgctgctggccaccaggccgtccagcaggaagcggtaatgcgcggcgtcggcggctagcggcttggcgccggctttttcgtcggccaccgccatcacgtccaccaccgcggtctgcaggatgcggatataggtctgcgccaccgcctggcgcttgtcggccggcacctgcttttccaggaattgttccaggccggcgaagccgccgtcggcgaagcgctgcagcatcaccttgatgccgtccttgaagtcgcgcgccagtttctcgtccggcttgccgccctgcatcgcctggcgggtggcgcgttcggcgatggcgtcgtacagcgtcgggtcgcgcagcgccgcgtacaggcgcatgaagcgttcgaggcccatgtcgtcgtccagcggcaggcgcaggtactggaagggctcggccggggttctgcgcacgccggccatcaggtagctggcgccgtcctgctggatcggcgacatgtaatgcatgtattccactgcctggccctgcttgtcgcgcagcttgaagctgatcgacgggccgaagttcttcagctccttgctctgcttcacttcgcgcgcgtcgtgcatgcgctgcagcaaggtggggtcggcggcgccgggcttgccgacgttctcgatgttgaacacccgcagctcgcccaattccagcgtgtagtccttgccgccggcctgcagcggctggctggccagcgacaccgcccgcaacggctccggcgcggcctgcggctgctccaggttccacttgcggaacagcagcggcgagccgccgtcgccgaacgaggactggtagatggcgacgccgtcgacgatcagcgggtggttgaccttgaccgtggcggcggtgctcttgccgctggccttgtcggtcaccacgatgtcgctggcgaacagcttgggcatgccgctgctgtagtagtcgacatggaatttcttcagcgtgacgacgaagggcagatcctgcaccaggtagccgttgccggagtcgatgaagccgacgtcggcgctcttgccttcggcgatgttgacgttgccgcggaaggacaggttggtgaccggcagccggctgtgctcgggaatctgcgcctgcgggatgttgcgggtctcgggcaccagccggccggccaggatgccgagcttaagcggcacgttgccgtccatcaggccgccgacgcagatcacgatcagcgcgatgtgggcgaagaagtagccaagcttgccggcggcgccttttttggcggcgatcagcaggctgccgtcggcctgttcgcgctggcgcagccggtagccctgcgcttgcaggtaggccgccagcgtctgcgggtcggcggcctcggcctccagggcctggctgtgcgacatggccgccagcgagctttcgccggccttgtcgcggtaggagcgcatctgcttgatgaagccggggccgttgcgcagcacgcacagggtcagcgacagcaccaggaagaccaggatggtcaggaaccaggcggaatggtagacgtcgaacaatccaagctgttcgaaggcctggaaccagaactggccgaactcgaaggcgtagttggggtagggctcgttttgcttgagcacggtgccgatgatggaggcgatggccaggatggtcagaagaccgatggcgaagcgcatcgagctgaacagttcgtacagcgctcggcgagtggtgttgcggcgatggtttgtcatgaatagctaacacaaaaagggaagccggtccggagcttcccttttgaacgcgcctggtcggcaaagttgcgtcggcgcgccgggccgcatggcgggcatgcggcgcgcggctggccggcggctggcgtcacggctcagcgcaggccggagatgtattcggaaaccgccttcatctcggcatcggtcatgcggctggcgatgtcggccatgatggtgtttttgcggtcggtgccggccttgaagtcggccagctgcttggcgacgtagccggcgtgctggctgcccaggcgcgggaactggtcgggcaggcccttgccggccggtccgtggcaggacatacaggccggcacgtgggtggaggcgttgccgacgcggtagatcttggcgcccagcggcatctgctgcttgtcggccgcttcgcgctctttcggtttttgctggctgaaataggcggccaggttgcgcatgtcgtcgtcggacaggccggcgctcatgccgaacatggtgggattcttgcgttcgccgctcttgaacgccttcaactggctatacagatactgcgggttctggccggccagggagggattggccgccgcgacgctgttgccgtccgcgccgtggcaggccgcgcagacggtatccacgatctgcttgccttttgccgggtcccccttggccgccggagccgccgccagcgcggagccggccagggttagggttgccatcgccaacagcattttacgtctcatggtcgctcctttagggcgttgccctaaaatatctgtaaaagtagcaattccaaacctgttattctataccaactgatttcaaccttactaccatgtcgatttttcagaacgcccgattttataccaccgtcaaccacatgaaagacctgccggccacccgcgccgaggtcgcattcgtgggacgctccaacgcgggcaagtccagcgccatcaacacgctggccaaccgcacccggctggcctatgtgtcgaaaacgcccggacgcacccagcatatcaacttcttcgagctgggagacgagtgttttctggtggatctgcccggctatggctacgccgaagtaccggaagcggtgcgcgcccactgggtggagctgctgggccgctacctgcagacgcgccagagcctgatcggccttctgttgattatggacgctcgccacccattgaaggagctggatcgacgaatgctggaatttttccgcgtcgccggccgtccggtgcacatcttgctgtccaaggccgacaagatgtcgcgccaggagcagagcaaggtgctggcgctggtgaagcgcgaactggccgactatccgtcggtcagcgtgcagatgttctccagcctgaagaagactggagtggaggaggtggagcaggtggtgaagggctggttcgacgcgctggagccgcagctcccgccggcggaggaactttaagcccggcttgccgcctaaacagcaggtgttcacacctcccgcttggctccctgagcggggcctgggtcgttgatcgccaggcattgccccggaccgaaaggccggggctttttattggccggcgggcatgaaaaaaggcgaaggatgcatccttcgcctttcgccctgtgccatacggttcagctgccagccgctacaggctggtgatcacggtctccacgtgcagattctcggccgcgttgcgcacggcgtcatccgacgggaacggtcccaggcgcactttgtacaccccctgctgattgacgatgccgagcttggaatcgtaatgatcgtccagctcgcccaacgtcttctgcaacagcgcttcggcattggccagcgtggagaaagtccccagttgcagatacttcggattgtcgcctgcgcgcaactctcggcttgccggctgggtggccggctgcgcggacgcggagtaggtgttgtcggctgcgggccagacgcggtctaccgcgatcttggcgctgccctgctggataaagcccagcttgtacgcggcggcgtacgacagatccatcaaacggctcctgtggaacggtccgcggtcattgacgcgcaccaccacggacttgccgttggtcagattggtcacccgggcatagctcgggatcggcagcgtcggatgcgccgcggtcatggcgaacatgtcgtatcgttcgcccgaggacgtcttgcgtccgtggaactgcttgccgtaccaagaggcacggcctgtggcgtggtaaggcttttctcgcacatcgggacggaagctcatgcccagcgccgagtaaggcaggttggccgatttgatcagcggctcatcctgcggcacggcgtcgggcaccagattcaggttgaccgggatatgatcggccggaccgtcgttctggaaataagctccgttcttggcgacggtcttcttgttggtcggcgaagccgactggtttgtggcgctggccgtcttcacggtggaacaggccacaagcacgagactgacgaatacaagccacagccatcggagtacaggttgcataaacctccctatgctgttgggccaaccttgcgaactgctataccccccctgcgaaatcgagctgccgccatgcctcgtacactgtcaccgcgacagcgttggacaggttgaggcttctcgactcgggacgcatcggcaatcgaatcctttgctgcgccggcagggcagccagcacatcttgcggcaagccgcgggattcgggaccgaacagaaaaacgtccccgggttggtaggaaatccggtcatggcgcgtagcgcccttggtcgtcgcggcgaaaatccgtcgtccgtgaagggcctgcaaacaggcaggccagtcttcgtggaccacaacgcgggcatactcgtggtaatcgagtcctgcgcgccgcaacttggcgtcctcgagcggaaagcccaagggtttgaccagatgcagttcacagccggtgttggcacataaacgaatcacattgcccgtgttgggcgggatttccggctgaaatagaacaacagtgaacatcgttggcaggctggattgttccaaggaatcaaaatcttggtcaagtttttggggaaaacgcccgggccagcacccatgcatcgacccgttccgccccctgttttttgagcgctttggccagggaggagagggtggcgccgctggtggcgacgtcgtctatgatggcaatggaaagcccgtcgcagcggcgttttacgccgaatgcatgacgcacgtttcgcagtcttgcggcgcgaccgagcgaggcttgcggcaatgtgttgcattttcgccaacacaggtcgtccgaaaaacggctgtttattgtaacagcgaacgctttggcaagctcggaactctgattgaagcctctttccgcaagtctttcatttgccaatggaacgggaatgacaaggtcgtatttgcaggcttgacaagcggcgaaatcggtgagcaggccggtcagcgtcccggccaattgtaagcgtttgccgtacttgaatgcatggaccaggccattcagggggtagccaaacagatagggaacgtgtagcgcgtcgaaggccggcggatgacgctgacagtggccgcacagcgcgctgtccggggtcggttctgagcaacgcgggcaatgcgcggcgggcagccgcggcagcatctggcggcagggcggacagagcgcctgctggctgtcggccgcgccgcacagcgcgcatttttgattaataaatgagcaattgtcaattaaggcattgagcaggtttgacagcatcgcttccgggctccaagattttgcggttcctgcccgagtaggcagggtgacgaacgatccggttcgccgccaaaatgacaaacacatgttggagcataagatgcattcagtgacgatggagttcaagcgcccggccgccccgcatccggaaaaggccaattggagcgtcgacgaggtggaggtgctgctgggtctgcccttcatggagctggtgttccgcgccgccgaaatccatcggcagtttttcgatccgacccgcgtccagctgtcgacgctggtgtcgatcaagaccggcggctgtccggaagactgcggctattgcccgcagtcggtgcatcacgacaccccggtggccaaccagccgatgatgacggtggacgaggtggtcgccgcggcgcgccaggccaaggccaacggcgccgggcgcttctgcatgggcgccgcctggcgcggccccaaggacgccgacctgcagaagacgctggaaatggtcagccaggtgaaggcgctggggctggaaacctgcgccaccttcggcctgctgcgcgacggccaggcggaacaactgaagcaggccggcctcgattactacaaccataatctggacaccgcgccggacaagtacgccgacatcatccagacccgcgagtacgaagaccggctggacacgctgggcaaggtgcgctcggccgggctgtcggtgtgctgcggcggcatcgtcggcatgaacgagacccggcgcgaccgcgccggcctgatcgcccagctggcgaacctggatccccagccggagtcggtgcccgtcaacaacctggtcaaggtggtgggcacgccgctggagggcgcggaaacgctggactggaccgagttcgtccgcaccatcgcggtggcgcgcgtcaccatgccgcgcagctatgtgcgcttgtccgccggccgccgcgaaatggacgaagccacccaggcgctgtgcttcctggccggcgccaactcgatattttatggcgacaaattgctgacgacggggaacccggatgtgctggccgaccaggcgctgatgcaaaaactggatctgcaggcgctgtaaaaataaatcttcgcaatttcccgctgtcggcttaaatgcaaacatatatatagtgtgtcgtgccggggtggcttggccgccgcggtttggtcaacaacgtaaaagagtgcaatcgccatgcgcctacaagacctgtccgcagccctgctggatctggacgccagtcaccgccgccgccaacgcgcgtgcctcgagtcgccgcaaggcgccgagatcgtcgtcgacggcgaggaatacctgtctttcgccagcaacgactacctcggactggccgaccacccgtcgctggtgcgcgcgctgcagcagggcgcggaccgctggggcgccggcagcggcgcctcgcacctgctcaccggccacagccaggcgcaccagcaggccgaggaggcgctggcgcgcttcgtcggccgcgaggccgcgctgctgttcggctcgggctacgccgccaatctggcggtgatcaccagcctggtcggccgcggcgacgcggtgttcgccgacaagctgaaccacgcttcgctgaacgacggctgtctgctgtcgcgcgccgatttccaccgtttccgccataacgatctcaaccagctcgaacaattgctggccgccagcggcgcgcgcaccaagctgatcgcggtggacgcggtatacagcatggatggcgacgaggcgccgctgccggagctgctggcgctggccgaacgctacgacgcctggctgtacgtcgacgacgcccacggtttcggcgtgctcgggcaaggccgcggcgcgttggccgaacatgacctctcaagcgagcggctggtctatatggcgacgctgggcaaggcggcaggactggccggtgcttttgtcgccggcggccgtctgctgatcgagtggctggtcaaccgcgcccgcacctatatcttcagcaccgcccagccgccggcgctggccgccgccgtcggcgtcagcctgcgcttgatagaggaggccggcgacaggcgcgaacggctgcggctgctggcggcgcgctgccgcgcgcgcctcgacggcacgcggtattcgggcggggcttcccgtaccccgattcaaccatttatcataggcggcgatgcgcatgccatgagactggctcaaggtttgcgggaacaaggctattgggtgcccgccatccgcccgccgacggtgccggagaatggcgctaggctgcggatttcgctgtcggcccagcatgaggtgtcgcaattggacgccttgctggactgcatgctgcagctggccgaaagctgatcgcccgccgccgcggaaatcgcctcggcatgccatcgccgcgctgacgacgcaagcccggagtcccgactccgggctttcgcatatccggccgcccaggcggcggcggggccgcgccggccttggggaaggggcgcggggcgtcgcgtgcggattttccagctaactcatactacgataacgacatgaagagcacggctgaatacctggagactccggaacaggctgccggacgggcgctggcgctgctgtggcaggccggcagcctggcggccatcgccgcatgggggcaggcggacgggaaatggcggaggctggccagcttgggggcggccgacgcgctgccggcggccgaggctctggacggcgatcggctgccggggccggacggcggcgcgctggcgttgcgcgccgccggcaagacgctgggatggctggcgtggcgcgggcgggagccggcgggaatggccgatgtcgccgccttgttgaccggccatttgcaatgcgccgcgttgcgcgacgagcaggcggcggcccggctcgccaatgaaaccatgctggagatcaatctgctggccggcgaaagcggcgcgccggagcgcatgctgccgcggctgcaccggctgatgatgcgcttgatggatgccagcaatttccacatcgctttgtacgacgccgacaatgccacgctgcgctatcccttttacgccgaccggcgcgatccggcgccgccaggacccgacgcggtgtttgccgccggcgcggacagcggctcgctggcggcctggctgatccgcggcggcaagccgatggtgatgagccagcagcggctgctggaagtgtgcggccaggaggggctgacgccgccggcggcgttgccggcttgctggatgggcgcgccgctggccgatgccggcggcgagtggatcggcgcggtggtgctgcagcagtacgatgaccaggcgccgctctcctcggccgaacaactgctgttcatgttcgccgcgcgccatgtcggtttcgcgctggaccgggtgctgcatcgcggccagttggagcgccaggtctggctgcgcaccagcgagctggagggcgccaacgccaggctgcgggccgaagtgtccaaccgccgccgcgccgagcaattccaggacgtgctgttccgcatcgccgaactgtccaataccagcttgtcgctggaggcctttctcagcggcctgcaccggttgctggcggaaatggtgccggcgcgcaactgcatggtcgccttgtacgacatggtcaacgaccgcatcggctttccgtactgcgccgacgagtactcgccgccgctgcagccgcgcaaacccggcaagggcttcatcgagcaggtgctgcatagcggccggccattgctggtggacccgcacagcccgctgcaggcgcaaatggaagacgtcggcggcatgcggccgcaaagctggctgggcgtgccgctgtattgcggccacgagctgctgggcgtgctggcggtgcaaagctaccagagcgacgtgtcctacagttaccgcgatcaggaggtgctggaattcgtcgccaacaatatcggcgccgcgctggccagggtgcgcgcgctggaaagtctgcagcaggcctacgccgaactggagcagcgcgtgcgcgagcgcaccagcgagctggacgcggtcaacgcccagctggaattcgacagcctgcacgacccgctgaccaagctgcccaaccgcacctatttcgccaaggcgctgcgccgcgcctgggacgcctatgccgacggcggcgaccgtttcgcggtggtgttcatcgatctggaccgcttcaagctggtcaacgacaccctgggccacctggcgggcgaccacctgctgttcgaggcaggcgcgcgcatccgctcctgcctgcgccattatgattttctggcccgcctcggcggcgacgagttcgcggtgctgatgttcggcatggacgcggcggacgagtgcgaggtgatcgcccgccgcatcgtcagcgaattcgagcgcgcggtgatcctggccggccgcgaggtgttttccaccgccagcgtcggcgtggtgctggccgaccgcgagcattaccacaaggccgacgacctgctgcgcgacgccgaccacgcgatgtactgcaccaagcagcagggccgccagggctacaccctgttcagccaccagctgcggatagaccaggccgaccagctggcgctggaagccgaattgcggcgcgcgctggaggaggaaggccagctgatcccttactaccagcctttcatcgaggccaggaccggcaagctggcgggcttcgaaaccttggtgcgctggcggcacccgcagcgcggcctgatctcgccggcggtgtttctgccgatggccgaggagagcgggctgatcaatcggctggaccgctacatgatcaacgccgcttgcgcccagttgcaggcctggcgcggcgagggccgggtcggcgaggacatcggcctgcacatcaacctgtcgtcggccaatttccacgatcccgacctggtcggctggataggcgagcgcatcgtccattaccagctgccgccggcgatgctgcacctggaaatcaccgaaagcgcgttgatcgaccagccggaaaccgcgtccagcgtgatgcaggcgctgcacggcctgggggtgaagctggcgctggacgatttcggcaccggctattcggcgctgtcctacctgcatcgctaccgcttcgacgtgctgaagatagaccagtccttcgtgttcgatctggaccgcaaggaggaatcggccgccatcgtccgcgccatcctggcgctggcgcgggcgctggacctggacgtggtggccgaaggggtggagacggccgcccagctggcgatgctgcaggagatgcattgcagcaagctgcagggcttctatttcgccgcgccggcgccggcctggcatatcgactgggagcggctggcgcgcttcgagcaggaaatccgctgtgcggcgtgaatggtcgacccgcttcaaccgctggcgctacgatctgtacgcgccgctctacgacaagctggcgcagggcttcgccgccggccgccgccgctcgctgggcctgctcaatccgcagccgggcgagcaggtgctgctggtggcggccggcaccggcctggatctggacttcctggtgcgctgccgtcatctcaccgccatcgacatcgccccggcgatgctggaacagctgcgcgagcgcgcgcgcaagctggggatggaggtgcgcgccgagctgatggatgcgcagcggctggattttcccgacgcgagcttcgacgcggcggtgctgcatctggctttggcggtggtgcccgacccgcaggcctgcctgcgcgaggtggagcgggtgctgaagcccggcggccgggcggtggtgttcgacaagttcctggccgacggcgcgcgcgcgccgttatggcgcagggccggcaatctgctggctcggctgctggccagcgacgtcaaccggcggctcggcgacatcgtcgccgtcaccaaattgcaaccgattcacgacgaagaagcgggcctgggtggtttctttcgcatcgtactcttgcgaaaatagcgtctttgcctcatttgtctgtccatgaatctgtttgttgaaacgctgggccaggggccggacgtggtcatgttgcacggctgggggctgcacggcggcgtattcgcccgggtggccgaacatctggcggggcgtttctgcgtccatctggtggatctgcccggccatggcgcgtcgccggcgctggccggtttcgacgccgacgcggtggccgacttggtcgcgtcccatttcccgctgcccgtgcaggtggtgggctggtcgctgggcggcctgatcgcccagcactgggcggcgcgccatcccgaacgggtgaagagcctggcgctggtgtcgaccagcccgcgcttcgtccgcgacgaaacctggccgcacgcgcaggagcgcaaatcgatagaagccgtcgcccagagcctggacggcgctttcgagcagacgctggagcgcttcctcgcgctgcagatgatgggcgcgccggcggcgcgcgacaccctgaagtccttgcgcggcgagctgttttcccatggccggccgcaaggcctgctgccggcgctgcagctgttgctggaggccgacgcccgttcgctggccggccgcatccgctgcccggcggcgctgttctgcggcgcgcgcgacgccatcaccccgataggcgccggccgctggttggctgaggcattgcccgacgccgtcctttacgaattcccgcaagcctcgcacgcgcccttcctgtcgcatgaacaggatttcgtgcgcgcgcttgcccagcatctggaagcccaggcatgagtgaagcgttttataccgacaaggcgcgggtgcgcgcctcgttcgaaaaggccgcggccagctacgattcggcggcggtgctgcagcgcgaggtgtccgaccggatggccgagcggctggagtacatcaagcatcagccggcggtgattctcgacgccggcgccggcaccggctacggcgccgcgcaattgcgcggccgctacccgcaggcgcgggtgctggagctggacctggcgcatgcgatgctgctggcctcgcgcgagcgcggccgcgccggcgacggcctgttgaaaaagctgttcaagcccagcctgccgtggcaggtagtggccgacatcgagcggctgccgctggccgacgacagcgtcgacatgatctggtccaacctgaccatccagtggatcaacgtgccggacaagatgttcgccgagctgcgccgggtgctgaagcccgatggcctgctgatgttctccacgctgggtccggacacgctgcacgagctgcgcggcgccttcgccggcgtcgacgccgccacccacgtcaaccagttcatcgacatgcacgacatcggcgacgcgctgatgcgcgccggcttcgccgagccggtgatggacatggaaaagatcgtattgacctacgacgacgccaaaggcgcgatgcgcgacctgaaggcgataggcgcgcacaacgccaccgctggccgcggccgcggcctgatgggcaaggcggcctggcgcaaggtggaagaagcctatgaaaagcaccgccgcgacggcaagctgccggccagctacgaagtggtgtacggccacgcctggaaaggcagcggcaagaaggtggccaagatgaccgacgacggccgccaggtgatcgaattcgtcaagaaagcgccgcgcgccgattgagcggcaaccagcggcgcgcacgggagaaggctgcatgcgtgtggacatccgcaatgcctgccgcgaagacgcggcgagtttggccgccctgtcgatccaggtgtggctgagcacctatgcgttcgacggcatccgccaggcgttggccgactacgtgctgacggaattcacgccggaaaagatggcggccctgatcgccgatccggcgcgtcagctgctggtgatggagaaagacggccatctgctgggttacgcgcagctgaaactggacgcagcctgcgagggctgcgatgccccgtcgctggaagcggagcgggtctatctggtggagagccataccgggcatggcctgggccggcggctgatggacgcggcgcggcaatgggcgctggcgcagcccggccagccgcggctgtggctgcgcgtgtggcatggcaacgcgcgcgcgatcgcgttttaccgccgcgtcggcatggcgctgcacggcgagacccattttgaattggagggcgcgcggcatctgaattacgtgatgctggatcccgcgcccattggggcggccatggcggccgtcgatgtctgaaagactgatggaatcatgattagcaagagcattctacgtcccgcgctgctggccgggatcgcctccctgttgtccgcctgcatgaccgccacgccgccggagagcgccgccgtggccaaacccttgcccaagcccaggatcgcgctggcgctgggcggcggcgcggtgaagggcttcgcccacatcggcgtgatcaaggtgctggaaggggccggcatcacgccggacatcatcgttggcaccagcgccggcagcgtggtgggaagcctgtacgcctccggcctcaccggcatgcagctgcagcagcgcgccatcgcgctggaccaggccgatctgaccgactggacgctgtcgaccaagggcgtgctcaagggcgagaagctgcagaactggatcaacgcccaggtgggcaaccggccgctggaaaaactgggcaaacctttcgccgcggtggccaccgagctggattccggccgccgggtagtgttccgcaccggcaacaccggccaggcggtgcgcgcctcggccagcatccccaatgtgttcctgccggtgaagatcggcggcaagagctatgtcgacggcggcctggtcagcccggtgccggtcagcgccgcccgcgaaatgggcgcgcagttcgtcatcgccgtcgacatcaccggccgtcccaagcccggccgcgccaccggcttcctgtcgatgctggaccagagcctgagcatcatgaacggcccggcgctgacgcaggagctgaagcaggccgacgtggtgatccacccgaacgtgctgaacatcggctcggccgaattcgaagcgcgcaaccaggccattctggaaggcgagaaggcggcgcagcagatgctgccgcagattcgccaattgctgcagcaaaagagcctggcgctggctaaataagggaataggctggatgatgtaggccgcgcgccgatgcctcgcccgcatcggcgcttacgaacacatcgctattggagtcggcatgatcaaacttcacggtattccgctatcgccttattacaacaaggtgaagatcgccttgctggagaagggcgtcaatttccaggaagtggtgacgacgccctcgcaagaggacgagctgctggaaaagagcccgatgggcaagattcccttcgttgagatcaatggccacccgctggccgaatccacggtgatcctggagtggctggaggatgcctatcccaccgcctcgctgctgccgccgacgcccaacagccgcgcgctggcgcgcgagctgaccgcgatgcttgagttgtacgtgatgctgccggccagcccgctgatccgccacatgctgaaaggcacccggccggagccggagaaatgcgaggagatccgccaggcgctggcgcgcggcatcggcgcggtggccaagctggcgcagtgccgtccttggctcgccggggaggatttcagcttcgccgacctcagcgccgccggcatcctgccggtggtggcgcgcttgagccagacttttctcggcgaggacatgacgctgcggctgtctggttgcggcgaatacctgcagcgcttgggctgtcgccacagcgtggcccgcgtctgggccgaccgcgacgcttcgctggcggcgctgatggcgcgccgcgactagcccgcctatggttttattgccacatggcggcggcggagccgccatggccggcgtccgcagttgacagccgggcaggcttagagcctaaactccaatcgagtgtttgctcgtttgagggggcgtcgatgaagtttccggttgagttgatcctgctggcgctggtgccggtattcctgttgttcgtcgccggcgagctgtggctgctgcggcgcggcggccgcatcggcttgtatgatctgcgcgactcgctctgctgcgccgcgctgggcctgttgcaccagggcgccgacaagctggcctggctgttggtgctgcccctgtacggctggatctaccaacatcaccgcctgttccagttttccgatagctggctgagcttcttcctgttgttcctggggcaggatttcctctattactggttccaccgcgtcagccaccgcgtgcgctggctgtgggcggcgcacagcgtccaccacagttccacccggatgaatttcaccaccgctttccgtcagagcctgatgtacccgttggcgggcatgtgggcgttctggctacccttggcctgggtgggctttccgcccgagcaagtggtggcggtggtgctgctcaacctggctttccagtttttcgtccatacccagggggtgcccaagctgggctggctggagtacgtgttcaacaccccgtcgatccaccgcagccaccatgccaagaatccgcgctacatcgatcacaactacgccggcgtgctggtggtgtgggaccgcctgttcggcacttatgccgaggagctggacagcgaaccgtgcgactacggcaccgtgaagccggtgaacagcttcaacccgctatgggtcagcgtggcggaatggcgcgacatgctggccgaggcatggcgcgccgataactggcgcgaccgctggctggcgctgttcggtccgccggaggcggcggaagaggcggcttcgcgccagcgcgcgcggctgcaggcgcagcgtcaggccgcttgagcggcgcgcggcaaaaaggcccggttttccgggcctttcgcatggggctggcgcccggcgctcacatcagcagcttgccgtctttcgccggcagggtcttgccctccggcttctcatccatccgcaccgtggcggttttgccgtccagcgagtagcggacgtcgtagccgaccactttttccttgtctacgttttcggtgttgcagatggtctgggtgctggtcacctgatcgcgctgctgcatgccttcctgcaccttgttgccggccaggccgccggccagcgcgccgatcacggtggcggccttcttgccgttgcctccgcccacctggttgccgagcaggccgccgaccacgccgccgatcaccgagccggcgatgcggttgttgtcctgcaccggcgcctgatgcgccacttgctcctgatggcagacctgcttgggctcgctgacggtctgcttgatcggcgtgacgcccagcaccttggcatagctggcgtgaaccggcttcggcctgggcgccggggccggagcagcggcggcggcgggcgcggccgctttcggcgcggcttgcgccaccacggcggaggcggcgctgggcgccagcgcctgcacggccggcgcggatgccgcggccagcggcgcgctggccgggatgacagtggccggagtggccggcgccgccggtttcaaggcctggatgccggctaccccgatggcgccgagcgcgatgccgccgcccagaatgctggcgatcaatatcggttgtttcattgttatctccctgatatggcgaacgaagcgccacttgctgctcagacactgcatgttgacagacagtttccggcgctgtgttcgccatttgtcaccgcaggtaaccgaacgttcgtgccgcgccggatcgggctagggtggaaatttgcagcttgatggggtggttttggcaatttatggtttgatattgccaatataagagaattttatttttaaaatgcaatcgaatggcatgttttgggcatatatattgtatccaagggtttgacggccagccgcgccggatggttagatggcggagcacctgtcagggtggcctagcttgccgcccaccccacaaggagaattcaccgtgagcgaaacccaaaccggtttgaagcgagagctgaaaaaccgccacatccagctgatcgcgctaggcggcgcggtcggcaccggcctgttcctcggttcggccagcgtgctgaagtcggctggcccgtcgatgatcctcggctacgccatcgccggcttcatcgcctttctgatcatgcgccagttgggcgagatggtggccgaagagccggtagccggctcgttcagccatttcgcctaccgttactggggcaagttcgccggcttcctgtccggctggaactactgggtgctgtacgtgctggtcggcatggccgaactgaccgcggtgggcgagtacgtgcgctactggtggccgaatgtgccgacctggaccaccgcactggtctgcttcgtcgcgatcaacggcatcaacctcgcgaacgtcaaatcctacggcgagtccgagttctggttcgcgctgatcaaggtggcggcggtgatcgcgatgatcgtcttcggcggttacctgctgctgtcgggcaccggcggtccgcaggcttcggtcagcaatctgtggaacgatggcggtttcttcccgcacggcgtcaatggcctgttcatgatgatggcggtgatcatgttctctttcggcggcctggagctgatcggcatgaccgcggccgaggcgtccgatccgcagaagaccatccccaaagccgtcaaccaggtgatctaccgcatcctgatcttctacatcggctcgctggtggtgttgctgtcgctgtacccgtggagcaaggtggccgccggcggcagccccttcgtgatgatcttcgagcagatcggcgccggcttcaccgcccacgcgctgaacttcgtggtgttgaccgcggcgctgtcggtgtacaacagcggcgtctacgccaccagccgcatgctgttcagcctggcggagcagggcaacgcgccggccggcctgaaaaagctggacaagcgcggcgtgccggtcaacgcgacgctggtgtcggcgatcgccaccttcgcctgcgtgatcctcaactacctgttgccgggccaggctttcggcatcctgatgtcgctggtggtggcggcgctggtgaccaactgggcgatgatcagcctgacgcacttgaagttccgccgcgccaaggccggcctggcgctggtgttcccgtcgatctggttcccggcggccaactggctctgcctggccttcatgatcatgatcctgggcatcttgctgttcacgccggggatggcggtgtcggtctacgtgctgccgctgtggctgggcctgttgtggctgggtttccgcctgaagaaagccgggccggccgatggcaggctggttggcgaaaacgtctgagcgcgcatgccggacttgacgcctgggggcgcaaaccggcatgcttgaaccatcatgaagcagattatttcactccaaagccgaaattggtggtggcgcggctaagccggcgcgccaggagtgttcgtatccgctttccgggccgccgtcatgggcggccttgttgtatccagcttttcaccccgtgcggcggcaaactgttctgactcaggagttgtcatgccgcgcacgcaatggggttcccgcctcggtttcattctggcttcggccggcgccacggtgggcctcggttccatctggaagtttccctacgtcaccgccatgaacggcggcggcgcgtttctgctggtgtatctggcttttaccttcaccatggggctggccctgctgcaggccgagctggcgctgggccgcgccgccggctgcggcgcggtgggcgcgttcgcccggctgggatcgccgcgctggaagctgctgggctacggcggcgtgctgtgctgcttcctgatattttccttctacagcgtagtcggcggctggacgctgggctatctgctgcgcgcgctggacggccgggtgatgagcgatgacgtcggcgcgctgggcgccttgttcggccagtacgtcggcaatccggccgaggcgctgctgacccacgcgctgttcgccggcctgacgctgttggtggtggcgggcggcgtgcaaaaaggcatcgaacgcatgggcaagctgctgatgcccttgctgttcctgctgatgctgggcctgatcgcccgcgccttgaccctgcccggcgcgatggcaggggtggaagcgttgttccggccggatttcgcccggctgacgccgggcatgctggtggaggcgctgggcctggcttgcttctcgctgtcggtgggcgccggctgcatgctggcctacggctcctacctcgggccgggcaccaggctcggcaattccgcgctgtgggtgaccggcctgacggcgctgacctcggtgctggccggtttgatgatcttccccgccatctacgccttcggcctgaatccgcaggccggtccgggcctgacttatatggtgatgccggtggtgttcaaccacctgccctacggccagctgttcgccaccgctttcttcgcgctgctgctgatggcggcgctgacttcggcggtgtcgctgctggaggtggtggccatcctgccgatagacgagttcggcgtcggccggcgccaggcgacgctggcggtgaccgcgctggccttcttagccggcgtgccggcggcgctgtcgttcggcccgctggcggattgcaggctgttcggccgcaacgccttcgagctgatggactacgccgcgtccaatgtgctgttgccgctgggctgcatcggcaccgccttgttcgccgggcgcgtggcgtggccggcggtgcgggacgagctgcggctgtccgcgccggctgcgctgctgatgcgcgtcgcctgccgctggctggcgccgctgctgataggcctggtgttggcctacaacctatagcagccagcgcagcgcgccgtagacggcgaagctgaccacgatggccagcagcgttttgccgtttttccaggccacggcgatggcgacgatggtgccggccagataggcgttatgccaggacaggtctatggttccggcgggcgccagcgccatcggcgccaccagcgccgacagcaccgccgccggcacgtagtgcagcgcgcggttcagccagccgggaaaggccagccgctggccgaagaccaggaagctggcgcgtatcgccagcgtggcggccagcatgccgatgatggccgcccagtgttgccatgagttcatgccgcctcccgtttctgtccgcgttccagcagcatgccggcggcgacgccggccagcgccgccagcatcaggtccagcttgtagggcaggccgcgcgccagcagcgccaccgcgccggccgccagcgccgcggccagcgtcggccgcttcttcagctgcggcgcgacgatggcggcgaaggtggccaccatcgcgaaatccagccccaattggtccagccccggcaccgagcgccccagcgccacgccggccagcgtccatagctgccagttcagatacatcgacagcgacgatcccagccaataccactggccgccgtccgcgcccaggctgcggaagcggtgctccaccacggcgaaggtctcgtcggtgagccagaacgccagcggccagcgccaggccagcggccatggccgcgcgtagggcagcagcgtggcgctgtacagcgcgtggcgcaggttgacgacgaaggtggtcagccagatcaccggcagggcggcgccggcggaaaccaggctgacggcgatgaactgcgaggaaccggcgaagaccagtagcgacatcgccgccgtggcggcgggcgacagtccggcggcgatggccagggtgccgaagatcacgccgaacggcgccgcgcccaccatcatcgggatggtgtcgcgcgcgccgtccagcagccagcggcggcggtcggataaggaaggcatggatgaatcctgcgtgcggcggggccggacatcggccctttgttcctgatgatggagcaggccgccctgcctgtcttgaacgattttgcgggcggctcagcgggggcgcgcgcccacggccttttgataggcggccggcgtgacgcccagcgtctgctgaaacgcgcgggtcaggtgcggctggtcggcgaagcccagttccagcgccgccgcgccgggccgcatgccggccgccagcagcttgcgggcgcgcgccacccgcagctggttgcgccaggccaccggcggcaggccggtctcgcgcttgaacaggcggcacaattgccacggcgacaagccgaccgccgccgccagctgctgcagcgagtggttggcggcgggatcgtcggccagcatctgcctgacggtttccacggggccgggggcggatgccggctcgtccgggcgcagccgcatgtatttgaccaacacctcgctgaacaccgcggccagcgccgattcgcgccgcaaggcgtcgcggctgtcgcgcagcagcaggtgcaggctgtccagccggcgcgcgaggccggggtcgacgacgacggtgtcgcggaaatagggcaggccggccttgccgttcaggtcggcggccagccggcccatcatgtcgacgccgggatagaagccgcggtaggcccagccgttttcgtgcgcggtctcgccggtgtgcacttcgccggggttgatcagcaccagcgcgccgacgccggcgcggtgcaggccgccgcggtggcggtaggactgcgcgcccagggtcagcgtgttgacgacgaattgttcatggaagtggggcgggaaggtccgctcggcgtattgcgcgtccaggcattccagcgcgccgaggtcgtcggcgcggaacagctcggagcgttcggcggaagaggcgggcatggcgcggacctgcggtggagatccgcccattgtggcagaggcggcgcggcttgtgcgcgccggcttgtctggcttaggagccggccatgaaggtgcggatgccggaaccgacgaactgcacgccgatgcagatcagcaaaaagcccatcagccgcgtcatcacctcgcggccgccgcggcccagccgggccgagatcagctgcgacgacttcagcgtcagccacatgccggcgcaggtcaggccgatggcggcgaaggtcatcgcgaaggccagcgccttggccggcagcgtggtcagttcggcgatctcggtggagatgccgatcaccaccgcgatggtgccggggccgctgatgccgggcatcgccagcgggaagaacgcgtagtcctcgcgttcgcccgattgcttgggcgtctggccagggtcttgcgacaggaacagcatccggtagcccagcaccgccaccacgaagccgccggcgatgcgcagcgcgccgtaggaaatgccgaaggcagccatgatcaggttgccggccagcaggctcaccaccatgatggcggcggcgaacacgcaggcgcggcgggcctggctggcgcggccggcatcgctcatctcgcgggtcagcgtgatgaacaggggaatcttggacagcgggttggtgatggtgatcaggctgagcagaccgccaaacaggaattgcagcgacaacgttttgaacatgatgcggggccgattgaatagcctgtcgattgtagagcgttccgccagcgccggatagcgcgcgcccgcgctttaaaccagcggcatggcggggtgtggcagccgcgccgacgcctgcgacattttgccgcgccgcccgcgcgcccggccatggtaaagtggcgcggttttcccttccccatcgatcatggagcccgcgatgaaacgtttcgccgccgccttgttcggcctgtgcctgtccggcctggccgccgcccattccttccagctgggcgacatccacatcggccatccgtggagccgcgcgatgccggcgaccagtcccaccggcggcgtctacctgtcgctgaagaaccagggcaagaccgaagacaagctggtgtcggccagcaccccgcgcgcggaagccgccgaactgcacacccacgtcaacgacaacggcgtgatgcggatgcgcaaggtggaaggcggcgtggcgatcgcgccgggccagaccgtgaaattcgccccgggcagctaccacgtgatgctgatgggcctgaagcagccgctgaacaagggcgaccacttcccgctgacgctgaagttcgagaaggccggcagcgtcaccgtggacgtggtggtgcaggacggcggcgaaggcgacagccacagccactgagcgttggcgcattgatggacagcggctgccccggcgggcaagccgctgtttttattcgtcttgccgcggcgttgcgccgaagttacatggtgctttgcagcaactgtccgtcccgggagcattcgctttacacccgcggcggcgctcggcacactggcaccgggtaatgagttttgaacaagacgtcatcaccggccgccggctcccgaaactggttttgcgccaagtctgcctataaaagagaaacgatggaggagcgggtgttccacacccgacaacaagctacaagacagggggccggcgtcgtttttctgcggtatgctgtgcttttgtcccgccatcgactttcgtcatgaccacctccgtttcctccccgcttcccgccgccttgccccgggtcgtcatccactattgcaccggttgccgctggctgctgcgcgccggctggctggcgcaggagctgctgaccacctttgagaaagagttgaccgaagtggcgctgcgtcccggcagcggcggcgtgttccgcgtcgaggtggacggcgaattgctgtgggaccgcaaggcggaagacggctttcccgagctgaaaatcctcaagcagcggctgcgcgaccgcatcgcgccggacaaggcgctgggccacagcgaccgccaatcctgacttccgccgcgatgaacgccccgctgcgcaagatcatccacgtcgattgcgactgcttctacgccgccatcgaaatgcgcgacgaccccagcctgcgcgaagtgccgctggcggtgggcgggcggccggagacgcgcggcgtgatcgccacctgcaattacatcgcgcgccgttacggcgtgcattcggcgatgtcgtcggcgcgcgcgctcaggctgtgcccggagttggtgatcctgccgccggacatggcgcgctaccggctggccagccagcagatcatggccatttaccagcgctacaccgaggtgatcgagcccttgtcgctggacgaggcctatctggacgtcaccggccagccgcacgagcagggcagcgccacgctgatggccgaggcgatccgccgccagatccgcgaagaggtgggcatcaccgcctcggccggcatcgcgcccaacaaattcctggccaaggtggccagcgactggaacaagcccgacggccagttcctggtgcggccgcgcgacatcgacgccttcgtcgcgctgctgccggtggagaaggtgcacggcgtcggccgggtcaccgccgagcgcctgcaccggctgggcatccgcagctgcggcgacctcaggcgctggaccgcggccgacctgttccgccatttcggccgtttcggcgaacagctgctggcgatggcgcagggggtggacaaccgcccggtgtcgaccgaccgcagccgcaaatccatcagcgtcgaggaaacctacgcgcaggacctgccggatctcgccagctgcctggggcggctggcggagctggtggaccggctgcaggcgcggctggcgcgcaacggcaatcccgaattcaagggcctgtcggtgaaactgaagttcgacgatttcacccagaccacggtggagcagcccggctacgcgctggggatggcggccttcggccagctgctgcgcaccggcttcgcccgcggcgcgcggccggtgcggctggtgggagtgggggtgaagctggcggacgagcacgacctgccgcgccagctgcggctgttcggccgcgacggccggccgctgccggacacccagccggacggccaggccgagctctccgccgatgcccagccggacggcggcggcccggctagtcgcgcttgagcgccgccggcgccttggcggcgaaatcgccggcgtagacctccaccaggcttgccggtttcaggtaacggcgcagcgcggcgttgacgtcggccggcgtggcctgctgcagcttccgctccagcgccgcctggaacgccatgtcgcgcccttggtccagctgttggctgagcatgcggctgagggtgtcgtcctgcgcccgggccagttgcgccgattgcagcagcgagcgcttggcgtcggccacttcctgcgcgctgacgccgtcgcgcagcagccgcgccagctcctcgccgacgccgtgctgcagcttggccaggttttgcggcgcgtagatcgcgtacagctgccagctggccaccggctggcggctgtcgacgctcagcgcgctgccggcgccgtagctcaggccgtcctgctggcgcaggcgctggaacagccgcgactggctttcgccgcccaggatgtggttggccagcagcagcgccgggtagtcgtcgtcggtatcctgcaccgccagcggcagcgcggccaggtaagcggcattggccttgtcggcgatctgcagcagctgccggccggcttgcggttgcggcagcttgtcgtccagccggcgataaggcgccgcgctgcgccagtcgccgaagcgctggttaagctggcggccgatggcgtcggcgtcgaaatcgccgaccagcgccagccgcgcctggcccgcgccgtagaagccgcggtggaagcgccgcagttgctccaggccgaccgcgttcagctcggccagctcttcgtccagcgccgggacatggcggatgtcgccggcggggtagcggttgagccgctggcctagcgcgcgcgccgcctgcgcctgcgggttgtcgcgcagcgccgccagccgggtgcggttggcctcgcgcagcttgtcgaattcggcgggcgggaagctgggctcgcgcagcagccgggcgatcaggtctatcagctgcggcagggtgtcgcgctggctggtgaagccgacgcgcacttcctggccgctgccgctgatctgcagcgaggacttgagctgttcgatgcggttggcgatgtcggcctggctgaggccggccgcgcccttgtccagcatggcggcggtcagccggctggccaggcgttggccggccaggccttcggcatcgccgaaggcgaagctgaaatagccgctgacggcgtggccgcgggtttgtttcggcagcagcgcggcctctgcgccattgtccagcgtcagtttgcggctgcgctgctcgatattggccgggctggggtcgaagttttcgccttgggccagcgccggcttgccctggtaatccttgaccatcgcggcgacgtccggcgcgggcggaatcacgctgcggtcgggatgcggggtcggcaggtattcgcccagcgtgcggttgctgggcttcaggtagttctccgccaccctttgcacgtcggccacggtcagccgctcgatgcggtcgcgctcgaggaagaacagccgccagtcgcccagcgcgatggcttcggtcagcgccaggctcagcgcctgcgggtcgctgaccgtttgctcgaactggttgagccaggcggcgcgggcgcggtccagctcggcctggacgatgggatggcggcggatgtcttccagcgtggccagcatgacgcggcgcgcctcggccggcttttgccccttggacagcgtggcccagtacgacacgtagccgggctcggccagcgccgggctcagcgccgacaccttgaccgcgtggcggccgtcgaccagcgcctggtacagccggccgctgggggcgttggtcaggatgtggtccagcgcctgcagcgccgcccagtccggatggctgccggccgaagcgtggtagagcgcggccagcagcgtggtgtcgccggcgcggcggaccgtcaccttgcgcgcgccgtcgcgctggggctcttcggtccaggtgggcgtcagcgcgcgcgccgggcgcggcacggcgcccaggctgtcacgcgtcagcgccagcgcgcgcgccgggtcgaagcggccgctgatcaccagcaccgcgttgtccggctggtaatacttgcggtagaaggcgcgcagattgtcgatgcgcaccttttccacgtcggagcgggcgcctatggtgttgtggccgtagttgtgccagtcgaagctgaccgccgtcagctgcttccacagcgcgcggaacgggtcgctttcgcccatctccatttcattgcgcacaaccgagaactcgcggtccaggtctgcgcgggcgatgcggctgtccgtcatgcggtcggcctccatccgcagcgcccaggccaggttgtcgtcgtcggcggggaaggtttcgaagtagttggtgcggtcgaggaaggtggtggcgttggcctgcatgccgcggcgcgacagctcgtccatcacgttggcgatgcgcgtggtgcccttgaacatcatgtgttcgagcaggtgggccatgccggtttcgccatagctttcgtggcggctgccgaccaggtaggtcaggttgacggtgatggcggcctgggaggcgtccggcgccagcaataggcgcaggccgttgtccagccggtattcgctgacgccttccacgctggcgtaaggggcgggcaatgcggcggcgcgggcgggagcggcctggctcacggccagggccagcagcaggcccagggtttggattcgcatggtctgactccgcggcgctcccggcgggaggccgcttgggcaagtgaatggcgggatggcgaagtgtatatgatgtgaagtttgatttgaataaattgacagctaattgtcattattatggtggttgcaacacaccatatggacgcgaagcgaagggatttggttccggcgcggcggccggaaccggaggcaagcttacagccggcgcagattgctgatgcccatcagcatgcccatgccgatgaacagcgtgacggtggcggtgccgccgtaggacatgaagggcagcggcacgccgaccaccggcaggatgccggacaccatgcccatgttgacgaaggcgtagacgaagaaggacatggtgatcgacgccgccatcagccggccgtacagggtctgggcgctggcggtgatcatcatcgcgcggctgaggatcagcaggtacagcgccagcagcaccacgttgccggccaggccgaactcctcggaatacacggcgaagatgaagtcggtggtgcgttccgggatgtagtcgaggtgggtttgggtgccgttgagccagcccttgccccacggtccgccggagccgatggcgatcatcgactggatgatgtggtagccggtgcccagcgggtcggtggtggggtcgatcagggtcagcacccgcttgcgctggtagtcgtgcagatggttccacaccaggggcaggctggcggcgaacatcaccgcgccggccaggatcaccttccacggcaggccggcgaagaacagcacgaacaggccggcggcggcgatcagcagcgtggtgccgaggtcgggctgcttgagcaccagcgcgctgggaatggcgatcagcagcgccgcgatcaggtaatgccaccagcgcaatgacagttcgtatttctggaagaaccaggccagcatcatcggcagcgcgatcttgaggatttccgacggctggatgcgggtgacgcccaggttcagccagcgggtggagccgttgacggtgatgcccttgaaatgcaccgccaccaatagcagcacgcccagcacgtagatcggcggcgcgaagttcatcacgctttgcggccgcatgcgggcgatcagccacatcaccagcagcgacagcacggtataggccagcttgttgtctatcttgtcgaaggactggttgttggcggagtacagcagcaccatgctgaccgcgaagatcagccccaggaacagcatcatccagccgtccagcggctccttgatctgcagccagatgcgcttaatcaggggtgtcttcatgcgtgtccccgttttccatcggtacggtcttgagcaggccggccaggtcggtcggcaccttgcccagcaggtagtaatcgaacaggccgcgcgccaccggcgcggcggcggcggcgccgaaaccggcgttttcgacgatgatggccaccgcgatcttgggtttttccaccggggcgaaggcgatgaaccagctgtggtcgcggtattgctcggccagcgcggcggcgttgtacttggcgccctgcttgatcgccaccacctgcgcggtgccggtcttgccggccatcgaatacttcaggccgacgccgacgcgggcgccggtgcccgagatcatcacgttgtgcatgccttccttgatgtagtcgaagtactcctgcggatagggcagctgccggaccggcgccggttcgatctggcgcacctggccggttttggagtccaccacctgctgcaccaggtgcggtttgaacacctggccgttgttggccatgatggcggtggcgttggccatctgcagcggggtgtaggcgttgaagccctggccgatgccgatgctgaccacgtcggccggataccagcgccgcacctcgggcttgtagcgggcgaaacgcttggccttccattccttgctcggcagcacgccgctggcctcgccatccaggtcgatgccggtcttgctgcccaggccgaaggagccgaccaccgggtggatcttgtctatgcccatgtcccaggccagcttgtagaagaaggtgtcgctggagacggtgatggcgcgctgcaggttgaccatgccattgccgcccttcttgctgtcgcggaactggtggctggagccgggcagcgtgaaatagccgggcgccggacggatgtcgtgcaggcctatgctgtgggtggtgagggccgccatcgccatgaagggcttgaaggtggagccgggcggataggtgccgcgcagcgcgcggttgaccagcggcttctgccagtcgctgttgagcgcggcccaggtctggctgtcgatgccgtcgatgaacaggctggggtcgaagccgggtttggacaggaaggccagcacgccgccggtggacgggtctatcgccaccagcgcgccgcggcgctcgccgaacagcttgtcggccatttcctgcagccggatgtccagcgccagcttcagcgtgttgccgttgactggcggcgtgcggcgcaggctgcgcaccgcgcggccgccggagtcggtttccatttcctcgaagccgacctggccgtgcaggtcttcctcgtacaccgcttccaggccggtcttgccgatgtagttgctgcccttgtaattggtggtcttgtcctcgtcggcgaggcgttcctggtctttctggttgatgcggccgatgtagcccagcacgtggctggtcatttccttgtacggatagtcgcggaacagcctggccttcacttcgacgccgggaaactgccaggcgttggccgccacccgggcggcttcctcgtcggtgagcttcaccttcagcggaatggcttcgaaattcttgctttcggccagcagcttcttgaacagcttctcgtcgcgcgggctgacgtcggccagcttcttcagcttgtctatggtggcggcgaggtcgggaatcttgctcggcgtcagctccagcgtgtaggcggagtagttctgcgccagcacgatgccgttgcggtcgaggatcaggccgcggttgggcaggatgggcaccagcgaaatgcggttgttctgcgccagcgtggagaaatggtcgtgctgcagcacctgcagccagacgaagcgggccagaaggagcaggaacatcaggatgatcaggccgtaggcgatgatcagccgcagctgaaactcttcttcttcagtttgcggattcttgaaacgggcggggcggcgcatggatcaggcgggtctcataccgagtggtggcgatagggaatcaacatcagcttggtcaacagcggccacagcagcgcccctatcagcggcggcaggaaatagctccagccgacgaaagcggagccggtcagcatccgcaccaccaccatgatgatctggttggtcagcatcaggcccagcaccaccagcgcctgctgccccaggttgaacatcaccagctggcgctggcggctcaaggcgagaaaggcggtgaccgaataggccagcgcgtgctggccgaacaggccggcggtggacacgtcggcgatgatgcccatcatgaaggcgatgccgatgttgacgcggcgcggctggttgatcacccagtacaggatcaagaggccgatgaaatcgggcagccagcgggtgctgccatgcggcagcggcaccagttcgaccagcaccgcggcgacgaaggtgagcaggatgaagcggcgcttgaccggcttgagcaattccttgggacggtccaacgacatcggggtctactcctcggcggcggcctttctgccgcccctggtctttttctctacaatcgccggcgcctcggccgggcgggcgcgggtttcgcgggcctgcagcaccagcacgtagcgggtttgctgcacgccggccagcggcacggtgctgacgcgggtgaaggcggcgccgggattgcgctccaccttgctcaccaccgccaccggaatgccttccgggaacagcccgtccaggccggaagtcaccacctggtcgttttccttcacatcggagctttgcggcagatagcgcagctcgacgccgccaccataaccatagaggatggcgcgctcgccggtgcgggcgatcatcaccggcaccatctggttcttgtcgatgaccagcgtcacctcggcggtcagcggctgcacccgcgtcacctggcccaagaggccgcgcgggtcaaccaccggctggccggcctgcagcttggcgtcgtcgcccttgtcgatgatgatcttgtacgagaacgggtcgcggccggtgtacagcgtctcggcgatctgcgccgagtcgtcgcgctgggcgcggatggcgttcaacgcgcgcaattcgttcagctcgcgctccagcgtctgcagccgcgacagctgcgccgacatctgcagctggcgggtgcgcagctcggtgttttcctgcttcagctcggtctgggaggtcaggtagtcgccggcgtggcgcaccgcctgcgccggcaggttgaccgcgcgctgcaccgggtacagcgccagcgacagggcttcccgcgcttgttccatcaggccgtagtggctgtcgcctatcaatagcgcgatcgaggccactgcgctcatcgccaggcgcgcagccggaggcggcccggagcggaaaaagctgggggtgttggcgaaatccatggccacaaccgccgcgccttgacggcgcggcgttcgctcggttggttaaggtccgttgctgaagtttaaggcacgttggtgaaaatggtgccgatcttgtccattttctccagcgccttgccggagccgcgcaccacgcaggtcagcggttcttcggcgacgaacaccggcaggccggtttcctcggcgagcaggcggtcgatgtccttcagcagcgcgccgccgccggtcagcaccatgcccttctcggcgatgtcggcgcccagttccggcggggtctgctccagcgcgatcttcaccgcggagacgatctgattcaggggctcggtcagcgcttccaggatttcattggaagacacggtgaaggcgcgcggaatgccttcggccaggttgcggcccttgacttccatttcgcgcacttcggcgccggggaaggcggagccgatggttttcttgatttcctcggcggtggtttcgccgatcagcatgccgtagttgcggcggatgtagttgatgatggcttcatcgaacttgtcgccgccgactcgcacgctgttgctgtacaccacgccgcccagcgagatcacgcccacctcggtggtgccgccgccgatatccaccaccatcgagccggtcggctcttccaccggcaggccggcgccgatggcggccgccatcggctcttcgatcagctcgacgcggcgcgcgccggcggccagggcggagtcgcggatcgccttgcgctccacctgggtggagccgcagggcacgcagatcacgatgcgcgggctggcggcgaagaagcggttcgggttcaccttcttgatgaactgcttcagcatctgctcggtgacggtgaagtcggcgatcacgccgtctttcatcggacggatcgcctggatgctgcccggggtgcggcccagcatgcgcttggcttccaggccgacggccaggatggacttcttgttggtgggcgcgtcgttgtggatggccacgacggagggctcgtccagcacgatgcccttgctgcgcatgtagatcagggtgttggcggtgccaaggtcgatggcgaggtcgttggagaagtatccggtcagcgaacgaaacattgggcgatcctggtcagttttcgtcaggggcggacgccggcggcgcccgtgaattccagtttatctgtcataggcccaagctccacccgcaggcgggcaaaaagcgctgctgtcagcgtcgcgtgagggcgggatgtgcgcccaatcggctggccttgagcagttcttgcccggtggtccgggggggtggaaactggcctgcgttgcttggccccggcgcgcattgccgaggcggcggaaaatgccgtcagcgcgcgtcgtggcgcaatctcgatcttgggagaatcaaacggggtatgataccctataaagcttgaaatattaaaggttttaacgaggacgccatgtcgctgacgcaccaggatgtcgcacggattgccaagcttgcccgcatcgatgtgaacgaggcggaaatcgccgccactgcggacaagctcaacgatattttcagcctgatcgagaagatgcaggcggtggacacctccggcatcgagccgatggcccatccgcaggacgtgtccttgcggctgcgcgacgacgccgtcaccgaaaccaaccggcgcgaggccttccaggcggtggcgccgcaagtggaaaagggcctgttcctggttcccaaagtgatcgagtaagccctctgatcggccccggcgcgcttggttccccatcgcggcgccgtccgggccagactatccggatagcaagaccaaatcgaaatgacacaagccaccctcaagcaattgtcgcaacagctggcggccaaggaagtttccagcgtggaactggccggccagtatctggaccgcatcgaggcgctgaatccggcgctcaacgcggtgatcacggtagaccgggacaagaccctggccgaagcccgcgccgccgacgcgcgcatcgccgccggcgacgcccacccgctggccggcgtgccgctgctgcacaaggacctgttctgccagcaaggctggaagaccagctgcggctcgaagatgctggacaacttcgtctcgccttacagcgcccacgtggtggagcaatgcgccgccgccggcatggtgacgctggggcgcgccaatatggacgaattcgcgatgggctcgtccaatgagaattccttctacggcgcggtgaagaacccgtgggacctgaacgccattccgggcggcagctccggcggctccgccgcggccgtcgccgcgcgcctggcgccggtggccaccgccaccgacaccggcggctccatccgccagccggccagccattgcggcgtcaccggcatcaagccgacctacggcgtggtgtcgcgctacggcatggtggctttcgcttcctcgctggaccagggcggcccgatcgcccagaccgccgaagactgcgcgctgatgctgaacgtgatggctggcttcgatgcgcgcgactccaccagcctggagcgcgcccgcgaagactacagccgcgatctgaaccaatccttggccggcctgaaggtgggcctgcccaaggagtacttcgcagccggcctggatggcgaggtggcgcgcgcggtcgacaacgcggtggccgaactgaagaagctgggcgccgaggcggtggaagtcagtctgcccaacaccgagctgtcgatcccggcttactatgtgatcgccccggccgaggcctccaccaacctgtcccgctacgacggcgtccgctacggccaccgcgccaaggactacaaggacctggtggaaatgtatgaaaagacccgcgccgaaggtttcggcgacgaggtcaagcgccgcatcctggtgggcagctacgtgctgagccacggctactacgacgcctactatctgcaggcgcagaagatccgccgcctgatcgccaacgacttcaaggccgcgttcgaccagtgcgacgtgatcctggggccggtggcgccgacagccgccttcgatttgggccagatgtcttccgacccggtagagatgtatctgtccgacatttataccttgtcggtgaacctggccggtctgcctggcatgagcgtgccggccggcttcgccgccaacggccgcccgatcggcctgcagatcatcggcaactacttcgctgaagccaagatgctgaacgtcgcgcaccagttccagcaggcgacagactggcacgccaaggcgcccgcgctgtaagccggcggctgcgcgacgcgaatgcggcgttgggcgcgcttgccgtaccaaacccgtctgcgcgtgcccgccttgtcttcgcgccgcttgcgagcaggctaagagtttacgtttccaagagcgcggctgagcttgcgttctggcatgaataaggattttccgaccatgaaatgggaagtcgtaatcggtatcgaggtgcacgtgcagctcaataccgtctccaagattttctccggcgccagcaccgccttcggcgccgaaccgaacacccaggcttccgcggtggagttggcgctgcccggcgtgctgccggtgctgaaccgcgcggtggtggacaaggcgattcgcctgggtttggcgctggacgccaacatcaaccagaagaacgtgttcgcccgcaagaactacttctatccggaccttcccaagggttatcagatcagccagatggacctgcccatcgtcgagggcggcaagctcaagattctggtcggcgatcaggaaaaggtcatcggcgtgacccgcgcccacatggaagaagacgccggcaagagcctgcacgaagacttccagggcctgtccggcatcgacctgaaccgcgccggcacgccgctgctggaagtggtgtccgagcccgacatgcgctcggtcgacgaggcgctggcctacgtcaaggccttgtacacgctggtgacctggctgggcatctgcgacggcaatatgcaggaaggcagcttccgcatggacgtcaacgtatcggtgcgcccggaggggcagaaggaattcggcacccgccgcgagatcaagaacctcaactccttccgcttcctggagcaggccgccaagtacgaaatccagtggcagatcgacaccctggaagacggcggcaaggtgcagcaggccaccgtgctgttcgacccggacagcggcgagacccgcatgatgcgcagcaaggaagacgcgcacgactaccgctacttcccggaccctgacctgctgccggtgcgcatctccgacgagcagatcgcccgcatccggggcgagatgccggagttgccggccgcgatgcaggcccgcttcgtggaaagctacggcgtgtccgcctacgacgcggcgctgctgacttccagcctggctcaggccgagtatttcgaagccgtggccaaggcttccggccagggcaagctggccgccaactggatcaacggcgaaatcgccgcgcggctgaatcgcgacggcaaggacatcgccgattgcccgatctcggtggcgcgcttgtccggcctgatcgtccgcatcgccgacaacaccctgtccagcaagctggccaagcaggtgttcgaagcgctgtgggacagcgaactgtccgccgatgacatcatcgagcgcgacggcctgaagcaggtgtccgacgtcggcgctatcgagaagatggtggaagaggcgatcgccgccaaccccaaggcggtggaggaattccgcgccggcaaggaaaaggcgctgaacgcgctggccggccaggtgatgaaggcgtccaagggcaaggccaacccggcccaggtccaggatatcctgcgccagaagctgggctgagctgatttactcaaacaacatgcggctggtttaagccgcatgttgttttttaaatacaaccctgaaactgctagcgggtaaagtgtttcttttattgaagatacttgtgcgtcagagagttccatcggcaattattgccgccatgttgcatcccctatgatccgcaatgttcacgtcccacttttattggtgattttaagtcactgatttatcacggattccatttttacacccgtccgtaagtcattgtcgcaaaaggcgaattagagaattcctatgttgaccgtggggcggttctttcttatagtggcgaaaagtgggataaagtgggtgaaagtggggcaaatgccccccggggcgacggctccgttttctcggtcagcgggttcaaatcatgattggtggcgtcagtatcctgtctctcgatagcaaggggcgtttggctattccggccaaacaccgcgagacactgctgtccgcgtttggccacaagctgatcgtcaccctggaatcccaagaccacctgctgctgtatcccgaacccaactggcgcccggtcgaggcccgcctgcttgcccttcccaccggcaatcccactctgaaacgctatcaacggctggtgcttggccacgccgaaaccctggaaatggattccgccggccgcgtgctgctgccggcccgcctgcgcgaactgaccgcgctggacaaggacgtcgccctggtaggcatgggcaaccgcttcgaattgtggaatgccgaggaatgggacagccagaccgccgacgcgctggccatcgaccaggccgacctggcccaacaccttggagacttcacgctgtgagcacccccaccttcgtgcatcgcacggtattgctgaccgaagcggtcgacgcgctggccatccggcccgacggcgtctacgtcgactgcaccttcggtcgcggaggccacagccgtttgatcctgtcgaagcttggcccgaacggccggctgatcgccttcgacaaggacccggaagccatcgccgtcgccgaccggctggcggcggaggattcccgcttcaacatcgttcacaacggcttcgagacgctgtcgtcggaactggcgcgcctgggcgtggccggcgtcgacggcgtgctgatggatctgggcgtgtcctcgccgcagatcgacgacggcagccgaggtttcagcttccgtttcgacgcgccgctggacatgcgcatggataccactcgcggcgtcaccgccgccgaatggttggcaacggccgacgaggccgatatttctgaggtgatcaagacttatggtgaagagcggtttgctcgcaagatcgcagcagccattgttgcgcaacggggggaacaccccatcacgaccacgcgcgagctcgctttgctcgttgggcaaaacgtccgtactcgggaaccgggtcaagacccggctacgcgcaccttccaggcgatccggatctttgtgaaccgcgagctggacgaattgaagtcggtgctgccgcaggcggcgcgcctgctgggcgagcgcggccgcctggcggtgatcagcttccattcgctggaggaccgcatcgtcaagcagtacctgcgcgacgtcagcagcgaggaaaagctgccggcctgggcgatggtgcgcgcggccgacatggccaagccgcctatcgccctggtgggcaaggcgatacgcgccggcgacgaggaagtgcacgagaatccgcgcgcccgcagcgccatcatgcgcgtggccgagcgcaccgccgcgccgtggcgggaggcggacgcatgaacaagctcaacgcgatgctgctggcgatgaccgtcttctccgcctggtcggtggtgacgtccacccacgtgtcgcgcaagctttacagcgatctgcagaaggaaaccaagtccgggcagcagctggaggtggaatacggccagctgcagctggagcaaagcacctggggcgcgcacgcggtgatcgagaaggccgcgtccacccgtcttgacatgcataccccggatccgcgccagatccaggtgatatcccccggagggaagatttgatgcgagccggcagcaactacagcgttcgtcagcggccgatgtcggccagtccgtccctgcgcatgaccagcacccgcgtgcgctgtgtgctgttgatgctggcgttgctgtttttcgcgctggtctgccgcgcgatgtatctgcaggtggtgcagcaggacttcctgcagaaccagggcgaggcccgttttcgccgcgcgctgacgctggaggccaaccgcggcgtgatcaccgaccgcaacggcgagccgttggcgatcagcaccccggtgcagaccatctgggccagccccgccgacatggagccggtgccgccggccaagctgcgcgaactggccgccttgctggatctgtcgccggaagagctgtcggccaagctgtccgaccgcaagaaggaattcgtctacatcaagcgccagatcagcccggagcaggctgacaaggtgatggcgctgggcattcccggcatcgccaagcagcaggagttccgccgcttctacccggccggcgaaatcgtgtcgcacatcatcggtttcaccggcgtggacggcaagggccaggaaggcgtcgagcttgcccgcgaaaagatgctggcgggcaaggacggccgccgcgtggtgttgaaggaccgccgcggccacatcatcgaagacgtcgccgcgatcgagccgccgcgcgacggccagaagctggcgctggcgatagaccaccgcatccagtacctggcctaccgcgagatcaaggccgcggtggaaaccaacaaggccaaggccggcagcgtggtggtgctggacgcccataccggcgaactgctggccttggccaactacccgtcgttcaaccccaacaaccgcgtcggcgtgacgccggaaatgatgcgcaaccgcggcgtgatcgatctgttcgagcccggctccaccatgaagccgctgtcgatcgcgctggcgctggagcacggcaaggccaatctgaacacggtgctggatacccacagctacatgataggcccggccaccatccgcgacgtgtcgccgcaggccagcctgggcattctcggcatcatccagaagtcgtccaacgtcggcaccagcaagctcgcgctgatgaacagcccggaagagttctggaagcactacgacgcgctgggcttcggccgcgcgcccaacaccggcttccccggcgaggccagcggccggctgcgcgactggcaccactggcggccgatcgagcaggcgacgatgtccttcggctacggcgtgtcggtcagcctgatccagatggcgcgcgcctacaccattttcgccaacgacggcgtgatgctgccgatcgcgctgtacaagaccagcaacccgatgccgggcaagcgggtgatcgacgtcaagaccgcgcacgagatgcgcgatttgttgatcgccaacagccagccgggcggcggcgccgtcggcggccgcatcatcggctacagcatcggcgccaagagcggcaccgcgcgcaagctggaaggccgcacctatgtggccaacaagcaccgcgcgctgttcatgggcttcgcgcccggccatgcgcccaaggtgatcgtggcggtgatgatagacgagccctccgccggcaaatattacggcggcgcggtgtcggccccggtgttctcgcaggtcgccggcggcgcgctgcgagtgctcaatgtgccgcccgacgagccatccaataacactttattgccggaatcgacccccgttccggcggatttctgaaccatgaagagtcgtctgatcgccttgccggactgggatccggccgcgttgaaccagctgggcctgaccatcaagcgagtggaggccgacagccgccgcgtgctgcctggcgacgtatttctcgcctgccgcggcgagttcgccgatggccgcgatttcatcgccgccgcgctggaaaaaggcgcggccgcggtgctgtgggacgacgccgacggcttcgcctggaatccggcctggcaagtgcccaacctggcggtgcccaatctgcgcgagcgcgccggcatcgtcgccgcccacgtgctgggcgagccggcgcgcgacctgaccgtggtcggcatcaccggcaccaacggcaagacctccatttcgcactggctggcgcaggccttttcgctgctgggccgcaaagcggcgttgatcggcaccgtcggcaacggtttttacggccaactgaccgaaaccacccacaccacgccggacccggtgacggtgcagcagaagctggccgaataccgccgccagggcgcgcacgtggtgacgatggaggtgtccagccacggcctggaccagttccgcgtcaacggcgtggccttcgcgaccgcggtgttcaccaacctgacccgcgaccatctggactaccacggttcgatgcaggcttacggcgaatccaagaagaagctgttcttctgggaaggcctgaagcaggcggtgatcaatgccgacgacgctttcggccgccagctggccgccgagatcgatcccaagattacgcaagtggtgacctacggcctggagcagggcgatgtccgtccgctggcgctggccgccacgctggaaggcctgcaaatgaccgtgaccacgccgtggggcgtgaccgacgtgcgcaccggcctggtcggccgcttcaacgccgccaatctgctggcctgtctggccacgctgtgcgtcaacggcgtcagcctgcaggacgccgccgcggtgatggcgcgcatccagccggcgcgcggccgcatgcagagcataggcggcacccatgagccgctggtggtgatcgactacgcccacacgcccgacgcgttggagaaggcgctggcgacgctgggcgaaatccgcccggccggcggccggctgttctgcgtattcggctgcggcggcgaccgcgatccgggcaagcgtccgatgatgggcgccatcgccgagaaacacgccgacgtggcggtgctgaccagcgacaacccgcgcagcgaggacccgcaggccatcatccgcgacgtgttggccggcatggacgccgcccgcgcgcacgtggaggccgaccgcgaggccgccatccactgggcggtgagccaggccaaggtgggcgacgtggtgctgatcgccggcaagggccatgaggaataccaggacgtcgccggcgccaagcggccgttctccgacttccgcgtcgcggaagaggcgctcaccgcctgggggcagcaagcatgatgacgctgagccaagccgccgactttgccaaaggccgcctgatcggcgccgacggcgaagtgctgcgcgtgatcaccgacagccggctggcgcagccgggcgacctgttcgtcgcgctgaagggcgagcgtttcgacgcccatgacttcgtcgccgaagtgacggccaagggcgccgccgcgctggtgcgcgacggcttcgagctggcgggcgccagcctgatccaggccggcgacgacacccggctggcgttgggccgcctggccgccggctggcgcgccagccagcccgcggtttgcgtcggcgtcaccggctccaacggcaagaccacggtcaaggaaatgctggccgccattttgcgcgcgcacgccggcgcggacgccgtgctggccaccgccggcaatttcaacaacgacatcggcctgccgctgaccttgctgcagctgaagccgcagcatcgttacgcggtgatcgagatgggcatgaaccatcatggcgagctgcgctacctgaccggcctggcgcggccgcgggtggcgctggtcaacaacgcgatgcgcgcccacttcggccatttcggctccaccgctgaagtggcccgcgccaaggcggagattttcgaggggctggaagacggcggcgtggcggtggtcaacgccgacgacgccaatctgcccttgttccgcgccgccgccggcccgcatcgccaattgagcttcggcttgggcgcggacgcccagatcggcgcgcgcgcgctgcggatggatgcgctgcaaagccgcttcacgctggtttccccgcttggggagatcgacatcgcgctgccggctccgggcgagcacaacgtgcgcaacgcgctggcggcggctgccgtcgcgctggcgctggaggtgccgctggcggccatcgccgctggcctggcggccttcggcggcgccaagggccgcctgcagatcaagcaaggtccgcgcggcctgaccgtgatcgacgacagctacaacgccaacccggattcgatgaaggccgggctggacgtgctggccagccagccggggccgcgctgtttcgtgatgggcgacatcggcgagctgggcgaggccgcgccggccttgcatgccgaagtcggggaacatgcgcgcctgcgcggcatcgaacagctcttcgcgctgggcgagctgtcgcgcggagccgtcgccgctttcggcgccggcgcgcagcattttgattcgattgacgagttgttggagtgcctggatagccggctggcgtcgggtaccgccgttctggtcaaggggtcgcgcttcatgcgcatggaacgggtggtggaacacctgatgcacgcaaacacagagggagtataaggtgctgctttggttggctgatctgttgggctcgcacatccgggccttcaatgttttcaattacatcacgctgcgcgcggtgatggcggccctgacttcgctggcgatttcgctgctgctggggccgtgggtgatccgcaagctgaccgaattgaaggtcggccaggcggtgcgcaacgatggtccgcaaacccacctggtcaaggccggcacgccgaccatgggcggctcgctgatcctgctggccatcaccatcaccacgctgctgtgggccgatctgtccaataaatacgtgtggctgctgctggcggtgatgctgggcaccggcgcgctgggcttttacgacgattggcgcaaggtggtgtacaaggacccgaaaggcgtgtccgccaagttcaagatggcgtggcaatcggccatcgccatcggcgccggcgtgttcctgatcgccaccgccaagctgccggcgtccaccgaattcatcgtgcccttcttcaagaccgtcgcctatccgctgggcgcggtgggcttctgcgtgctgacctacctggtgatcgtcggcacctccaattcggtcaacctgaccgacggcctggacggcctggccgcgctgcccaccgtgatggtgtcggccggcctgtcgatcttcgcctacgccgccggccacgcggtgttctccaagtatctgggcgtgcccttcattcccggcgcgcacgaggtggtggtgttctgcgcggcgatgtgcggcgcctgcctgggcttcctgtggttcaacgcctatccggcccaggtgttcatgggcgatgtcggcgcgctggcgctgggcgccgcgctgggcaccgtcgcggtgatcgtgcgccaggaagtggtgctgttcatcatgggcggcctgttcgtggtggaagcgctgtcggtgatgatacaggtcggctcgttcaagctcaccggcaagcgggtgttccgcatggcgccgctgcatcaccattttgaattgaaaggctggaaggagacgcaggtagtggtgcgtttctggattatcaccatgatgctggtgctggccggcctgtccacgctgaagctgcgctgaggatagcgacgatggattacgccaatcgacaagtgatggtggtggggctgggaggctcggggctggcggccgcgcgctacctggccgcccacggcgcacgtgtcagcgcggtcgacgccaatccgtccgccgagcggctggccgagctggagcgctggctgccgggcacgccagtgtcgcgcggcgagttcaccgccgccaccttcgccggcatggagctgctggtggtcagccccggcgtgccgctggtcaacccggccatcgccgccttccgccgcgccggcggcgaggtggtgggcgacatcgaactgctggcgcgagcgatccagggcgacggcagcaaggtgatcgccatttccggctccaacggcaagagcaccgtcaccagcctggtcggccatttgtgcgaagccgccggcctcgataccgtggtcgccggcaatatcggcctggcggtgctggaggctcagctggcgcgcgagcaaagcggcaagcggcccgacgtctgggtgctggagctgtccagcttccagctggagtccaccttcagcctgcgcgccgacgccgccaccgtgctgaacatttccgaggaccacctcgaccgctacgccgacctgttggactacgcccacgccaagaccgcggtgttcaacggcgacggcctgcaggtgctgaaccgcgacgacccgctggtacgcgccatggtccgccccggccacgaggtgaagtggttctcgttgcagggcgaggccgactacgcgctctcgcgcggcgacggctaccggctgagcgtggccggcgaagcggtgttcgactgcgccgacatgcagctgcaaggcctgcacaacgccgccaacgcgctggccgcgctggcgctgtgccagggcataggcctgccgctgaacacgctgctggacgggctgaagactttccgcggcctcgcgcatcgcgtggagctggtagacgaattcgacggtgttgcgtttatcgatgattccaagggcaccaatgtcggcgccaccgaagcggcgctggacggcatgacccgtccggtggtgttgatcgccggcggcgacggcaaggggcaggatttcgcgccgctgcaggcggcttgccggcgcgcggcgcgcgcggcgttgctgatcggccgcgacgccggccgcatcgaggccgcgctggaaggcagcggcgtcgcggtggaacgcttcgacacgctggaggcggccacgcgccgcgcggcggctttggcccggccgggcgacgtggtgctgctgtcgccggcctgcgccagcctggacatgttccgcaactacgcgcaccgcgcccaggtgttcatcgacaccgtcgcggcgctgaaggcggagcggcgatgaaccgcaacccggcgcgccattacgtggcgatcaccccgttggacgaagcgctggcctgggcgctggcgctgttgctgtcgatcagcctggtgatggtgtattcggcgtctatcgcctacgcggaagccgacgcggcgacgcagaaccgctacttctacctgatccgccacgtggtattcatggtgatcggcctggcggcggcgtacatggcgttccagattcccaccggcttctggcagaagtattcggggaagatcttcctgatcggcttggtgatgctggtgctggtgctgattcccggcatcggcaaggtggtgaacggttcgcggcgctggatcaacctgctggtgctgaatctgcagccgtcggaggtgatgaagttcgcggtggtgctgtacgcggctgactacacggtgcgcaagagccacctgttgcacagcatcaaggaaggttttctgccgatgttcatggcgatggtggtggtggctttcctgctgctgcgcgagccggacttcggcgcgctgatggtggtgatgagcatcgcgatgggcctgctgtttctcggcggcatcaatatgcgcatcttctccgggctggcggtgatggcggtgggcgcgatcgtggtgttgatcatttcctcgccgtaccggctgaagcgggtgctgggcttcatggacccgtgggacgatccctacggcaagggttatcagctgagtcactcgctgatcgcgatcggacgtggagaatggtttggcgtgggcttgggcggcagcatcgaaaagctgttctacctgccggaggcgcacaccgacttcatcatggcggtgatcgccgaggagttcggtttcgccggcatctgcgttgtggttggcctgtacgcctggatcgtgcgccgcgccttccatatcggcgtggagtcgaaaaagctggagcgctactaccaggcgctggtggcgcagggcataggcatttggctgggcatccaggtgttcttcaacatcggggtgaacatgggcctgttgccgaccaagggtttgacgctgccgctgatgtcgttcggcggttcggcgatgttgatgaatttgatcgcggtggcggtgctgctgcgggtggactacgaaaaccgaaggattatgcggggctataaggtttagccccgcataaagaaaggctgcaagcctttccaggcgccttggcgccgtgtcctttggtttctgcgagcccgaagggcgaagcaagaaccggcgcatgatgcgcggcaacaagatttaacggaacggatagaaatggcgaatcgcacggtcatggtgatggcggcaggcacgggcggacacatcgtccccggcctcgccgtggccaaagagctgcaacagcgcggctggaaagtggtgtggctgggcaccagccgcggaatggagaacaagctggtgccgccgtccggtatcccgttggaaaagctgaatttccatggcgtgcgcggcaagggcctgctgggctcgcttacgggcgcggcgcaactggcggccgcgtttgtccgcagcctggcgctgatgctgcgccatcggccggacgcggtgctggggatgggcggctatgtctgcctgcccggcggcgcggcggcggctctgctgtggaagccgctggtgctggtcaacgccgatgccggtctgctgctcagcaacaaggcgctgctgccgttcgccagcaagctggcctgcggtttcgacggcagcgccgcgcggcaggccaaggcgctggtcaccggcaatccggtgcgcggcgagatcgagaacatcgcgccgccggccgagcgcttcgccggccgcagcggtccgctgaaagtgctggtggtgggcgggagcctgggcgcgaaaatattgaacgaaacgctgccgcaggcgatggccaagttgccggccgacaagcggccgcaactgacgcaccagaccggcgaggccaatttcgccgcggtcgaggcggcttatcaagcagcgggcctgcgcgagcaagtggagctgctgcccttcgtcgacgacatgccgaagcgcctggccgagtgcgatctggtgatttgccgcgccggtgcgatcacggtcagcgaattgtgcgcggccggcgtgcctagcgtgctggtgccgctggtggtgtccaccaccggccatcagcgcgacaacgccgagtggatggccgaggccggcgcggcctggcatctgccgcagaaggaattgaacgccgacgggctcgcgggcctgctggcgagtttggacagagaccagttgctggaaaaggccgggcgcgcgcgcgcgctggcccgctccggcgcggccggccgggtggccgacctgtgccagcagctggccggggatagaccggacgccgtagaagcgtcccagtagagacacagacatgaaacacagggtcaaacacatacatttcgtcggcataggcggcgtcggcatgtgcggcatcgccgaggtgctgcacggcctgggctataccgtgtccggctccgacatggccgacggcgccaccaccaagcggctggcggcggaaggcgtgcgcgtgttcttcggccacgacgccacttatatcgaaggcgccgacgtggtggtgacgtccaccgcggtgaaggccgacaacccggaagtgctggcggcgcgcgacaagcgcatcccggtgatcccgcgcgcgatgatgctggccgagctgatgcgcttcaagcagggcatcgccatcgccggcacccacggcaagaccaccaccaccagcctgaccgcgtcggtgctgggcgcggccggcctggacccgaccttcgtcatcggcggcaagctgaccgccgccggcaccaacgccaagctgggcttgggcgaattcctggtggccgaggccgacgagtcggacgcctccttcctgcacctgtccccggtgatggcggtggtgaccaatatcgacgccgaccacatggacacctacgaccacagcttcgacaagctgaagcaggctttcgtcgatttcctgcagcggatgccgttctacggccgcgcggtgctgtgcgtggacgacccgaacgtgcgcgagatcaaggagcgcatcaccaagccggtgaccacctacggcctcgacgattccgccgacatctacgccgaaaacgtgcgcgcggcggccggccagatgcatttcgacgtggtggtgaagaacggcaccatcacccgcttcccgctggtgctgaacctgccgggccgccacaacgtgctgaacgccttgtcggcgatcgccatcggcttggagtgcggcgccagcatcgaagccatccagcaaggcctggcggaattcgccggcgtcggccgccgcttccagcgctacggcgaggtgaaggccaaggacggcggcagcttcacgctggtggacgattacggccaccacccggtggaaatggcggccacgctggccgcggtgcgcggcgccttcccgggccgccgcctgttgttggctttccagccgcaccgctacacccgcacccgcgatctgttcgaagacttcgtcaaagtgctgtccggagtcgacgcgctgctgttgggtgaggtgtacgccgccggcgaagcgcccatcgtcgccgccgacggccgcgcgctggcgcgggcggtgcgggtgggcggcaaggtagagccgctgttcgtcgagagcatcgccgagctgccgcaggccatcgtcgatgccgcccgcgacggcgatgttgtggtgaccatgggcgcggggtcggtgggcgcggtgccgggcaaggtgctggcgctggtttgaccagggattttccgctcgcgccgcgggcgcgggcctgttgagggtagatagatgaagcagtacggcaaggtggcggtgttgatgggcggtcgctcgtccgagcgcgaagtgtcgctgatgagcggcgccggcgtgctctcggcattgctggccaagggcgtggacgcccacgggttcgatccggcggaaaagccgctggcggccttgaaggaagaaggtttcgcttgcgtgttcaacatcctgcacggcccgttcggcgaggatggcacgctgcagggcgcgctggaagcgctgggcatgccgtataccggctgcggcgtgatggcctcggccatcgccatggacaagtggcgcaccaagctgttgtggaagggcgccggcctgccgattccggctttcgagctgctggatgaagacagcgatttcgacgccatcgaaaagcggctgggcctgccgatcttcgtcaagccgtccagcgagggctcgagcataggcgtgaccaaggtcaagcagccgggcgagttgcgcgcggcgtttgcggaagcgcgcaagtacgacgcggtggtgatcgccgagcagtttatcggcggcggcgagtacacctgcgcggtaatcggcgacgtggcttacccgaccatcaagatcgaaccggccaccgagtactacgactaccaggccaagtacttccgcgacgacacggtctaccgctgcccgtccggcctcgcgccggaagtggaagcgaaggcgcgcgaattggcgctgaaggcgttcaaggtattgggttgccgcggctggagccgggtggacttcctgatggatgaagcgggcgagatctacctgctggaagcgaataccagcccgggcatgaccagccacagcctggtgccgatggcggcgcgggccgagggcatcgcttacgaagacttgtgcctgaaggtattggatacggtgcatgtgggataaccatcggctgctccggagcctggccaatctgatgctgggcgctgcagcgctgatgttgctgtacgcggggggattctggctgacgcacgcgccggtattcccggtgaagaagatacgcatccagggggatatgaaccgggtgacggccgagcagctgaagttcatcgcggagcatgaactggccggtaccttcttcacgctggacatcgacaagacgcgcgcggctttcggcaaattgccgtgggtgcgcgacgcgcaggtgaggcggcgctggccggacgcgctggacatcaccgtggaggagcatgtggcgctggcgcgctggggagaaaacggcctggtcaacacccgcggcgagcgcttcgacgccgccagcgacgccaagctgccggtgttttacggtccggccggcgctgagaaggacatgacggcgatgctgacgcagatgcgtcagtccttgcagccgtcgggcctggcgccgcgcgagctgtggctgtcgtcgcggcgggcgtggaaggtggtgttggacaaccagctgcagctggagctgggcagaaatgacgtggtggcgagggcggaacgtttcgccacctactggaagagcgaattggcgcggttgccgtatcacatcgaatacgtcgatctgcgctatccaaacggattcgccgtgcggatgcccgattacaaggcgccgccggtaaagggaaacaagtgattaggcgttggagcgacaggtgagcaaaccaaaggaaagcaagaacatgctggtcggcctggacatcggcacctctaagatcgtggcgatcgtcgccgaggtgctggaagacggccagcttaacatcgtcggcatgggacacacgccgtcgcgcggcttgaagcgcggcatggtggtgaacatcgagtccaccgtgcaggcgatccagcgcgcgctggaagaagccgagctgatggccgactgcaagattcacgaggtgttcgtcggcatcgccggcagccacatcaagagtgtgaactcgcacggcatggtggcgatcaaggatcgcgaagtcaccaagatggacatcgaccgcgtgatcgaaaccgcgcgcgcggtgaccattccgcccgaccaccaggtgctgcacatcctgacccaggaatacagcatcgacggccaggaaggcgtgcgcgagcccttgggcatgagcggcgtgcggctggaagccaaggtgcacatcgtcaccggcgcggtgtcggccgcgcagaacgtgaccaagtgcgtgcgccgctgcggcctggaagtgtccgacctggtgctgcagccgatggcctcggccatcgccgtgctgtccgaggacgagaaagacttgggcgtgtgcctgatcgacatcggcggcggcaccaccgacatcgccgtgtacgtgggcggcgcgatccgccacaccgcggtgattccgatcgccggcgaccagatcaccaacgacatcgcgatggccttgcgcaccccgaccaaggaagccgaggacatcaagatccagcacggcgtgtcgctggtcgcgatggccgatccggcgcagatgatagaagtgcccggcgtcggcgagcgcggtccgcgccagatgtcgcgcgcgacgctggccgaagtgatcgagccgcgggtggaagagctgttccaactggtgcagcaggagctgcgccgcagcggcttcgaggagctgctgtcgtccggcatggtgttgaccggcggcgccagcctgatgccgggcatggtggagctggccgaagaggtgttccacctgccggtgcgcgtcggcgtgcccaagtatgtaggcggcctggcggaagtggtgaagacgccgcgcttctccaccggcgtcggcctgctgttgtacggcaaggaccagatccagggttatgccggcccgcacagcaaggccgagtcggccggcgtggggcaattgttcggcaagatgaaggcctggttcgccgggaacttctaaatggcgggaaagcgccggccgcatgggcggcggcgcgaggattcgggcgtagtaaacacggttagtggctcatcttatgttgaggagaggaaaatgagcggaatggtattcgaagtgatgcaggaaacggccaccacggccgtgatcaaggtgatcggcgtcggcggcggcggttgcaacgccatcgacaacatgatcaccggcaatgtgcacggcgtggagttcatctgcgccaacaccgacgcgcagtcgctgcagcgcaaccgcgcgccgcagaagctgcagctgggcaccaacctgacgcgcggcctgggcgccggcgccaatccggaagtgggccgcagcgcggcgctggaagaccgcgaacgcatcgccgagatgctgcgcggctccaatatggtgttcgtcaccgccggcatgggcggcggcaccggcaccggcgcggcgcctgttgtcgccgaagtggccaaggaaatgggcatcctgaccgtaggcgtggtcacccgtccgttcgagcacgaaggcaagcgcatgaaagtggcgcagaacggcatcgaagacctgaagaaacacgtcgattcgctgatcgtgatccccaacgagaagctgatggaagtcctgggcgaggacgtcaccatgcgcgaggcgttccgcgccgccgatgacgtgctcaagggcgcggtggccggcatcgccgaagtcatcacttgcccgggcctgatcaacgtcgacttcgccgacgtgcgcaccgtgatgtgcgaaatgggcctggcgatgatgggctccgcctacgcctccggcatcgaccgcgcccgcgtggcggccgaacaggcggtggccagcccgctgctcgacaacatcacgctggaaggcgcgcgcggcgtgctggtgaacatttccaccgcgccgggctgcctgaagatgagcgagtaccgcgagatcatgggcatcgtccgccagtacgccgacgaagaggcgcagatcaagttcggcaccgccgaagtggaggacatgccggaagacaccatccgcgtgacgctgatcgccaccggcctcggccagaagaagtccgcccgcaacgaagagcgtccggagtacatcaagatcgtcaagaccggcaccgacgaccgcgcggtggaaatggtcaactacgaagacctggacgcgccggccatcatgcgcaccggccgccgccgctcgtcgccgtcgctggacttctccaatccggaagtgagcgagagctacgacatcccggccttcctgcgcaagcaggccgactaagcggagagacaggatagagaaacgctattcttgcaagcgaatcaatcaataaagcatagcttgccgctatgctagaatcgggttttcccgtctggttgagtagcctgaaatgatactgcagcgcacgctgaagcaagcgatcagcgccacgggcgtcggtctgcattccggcgagcgggtgaagctcaccctgctgccggcgccgcccgataccggcatcgtcttccgccgcaccgacttgcccgagccggtcgacgtgaaggtggatccctcgctcgtcaacgacacgcgcctctcctccacgctggtgacggacaccggcgtgcgtgtcggcacgatcgagcatctgatgtcggcgtttgccggcttcggcatcgacaacctggtcgtcgaggtgacggcggcggaaatgcccatcatggatggttccgccgcgcctttcctctatctgctgcagacggccggggtggtggatcagcccaagaaaaagcgtttcatccgcgtcaaacagagcgtgatggtggaagaaggcgacgtgtgggtccggctggacccgcacgaaggcttcaaggccaagctcgccatcgtgttcaaccacccggcgttcaatcgcgcgccgcagacggtggaggtggatttcgcccgccattcctacctagacgaaatcagccgcgcccgcaccttcggcttcatgcacgagctggaatacatgcgcaaccacggcctgggccgcggcggcagcctggacaacgccatcgtgatcgatgacgagtacgtgctcaatccagagggcctgcgcttcccggacgagttcgtccgccacaagctgctggacgccatcggcgacctgtacatcgtcggccatccgctgatcgccgccttctccggccacaagtccggccacgcgatgaacaacaagctgctgcgcaagctgctggcgacgccggaggcctgggagtacgtcagcttcgacgacccgctggacgcgccgtccagcttccacttgctgccgccgcaggaataagcatgttcggcttctggcggctgtggctgctggcgaccatcctggccataggctgggcgctgttgtgcttcgccctcacccacgacagacgccatctgcgccgggtgctggccatcgtccgctggagcgccggcctgttgatcattgtgtcctgtttctggctgattttctgcctgctgcgttgagcgccgcgggcgttttcatttgaaggattcgttatgacccgactcacgcatttcgatgacggcggccaggcccacatggtggatgtcggcgccaaggcggccaccgcccgccgcgcggtggcagagggcgtcatccgcatgctgccggccacctttgcgctggtgaagggcggcggccacaagaagggcgacgtgctgggcatcgcccgcgtcgccgccatcatggcggccaagaaaacctgggacctgatcccgctgtgccatccgatcgcgctgacgcggctggcggtggatttcgcgctgctggatgccgagtccgcggtgcggatcgaggtgaccgccgaatgcaacggccagaccggggtggagatggaggcgctgacagcggtcaatgtcggcctgttgaccatctacgacatgtgcaaggcggtggaccgcggcatggagatcggcggcgtgcggctgctggagaaagacggcggcaagagcggcagctggcgggcgccggactgagcgattacttgccggtctgcggatccagctcctgcgggccgggcgcgccgccggcatcgaacaccggcggatggatttcatgccagcgctggcggcggttccactcgtagaggccgcggccggactgcagatgcaaatagacgtgctggtagcgcgagcgcgccagcatgtcgtgggtgagctggttcagctcctgcaccgacacatacagcagcagggtggccgccacggcgccgtgttcgaaggtgctggcggccagcagcaattgcagctggtgcccgggcggcacatggtagtccttgcccaccttggcctcgatgcggcaggcgacgtcgctggcgtttgccggcagcgcgaacatcgaataaatgcccaccgccgcctggcgggcgagatgggcttccttctttttggcggtgcgccggacatgctcgccggccagcacctcggtgacttctatcgccagcaggcggccgtctggcaaccgcacgccgacatcgggagcgggggttttcagcgacttcagttcgagcggatgcatgcctttttgctcgagcaatcgcctgacccactccctttcgcgattttcctgttgggtttgctgatccatcggcgcttacgcaaatgcaaggacagatgattcattctagaacatcatccatccgcattcgcggccgcctcaggaacccttgcgcagcgacttcagcgcttcggcggcgtcgcgcggcgcgctgtgcgacgggcacagcagttcgcgcagttcgcgcctgagcttgtcgccatagacgatgtcctgccatatgggccgcatcggctcgatccagcggtggttgacgctgtcgccgaagccgtaggcgcggtagcgggcgtccttgcacagaatgccttccacgctgaggttttccacgccgttggggctgagcaccttgctgatgtagcgcaccacgccgtcctggcccacgctcagcgttttgccatcgacgaagaaacggttgctctgcagccagtcaggcttcacttccacccagtcggcggcttgcgggtagtcgggcagcgcgtaggcttgctcctcccaggctttttcgtcctcgaaggtgatgtttttcttgatcctgtcgttgtcggccagcgccggcaggctcaggcacaaggccagcgcggccggcagggtgaggaatgctttcaagttcgatgctccggatcagcgcgccgtgccggcgcgcaggttgtaatggcggcggccggtttcgcggccggccaggccccagctcaattcggaaaaggcgatgtcgccgcggctggacaccgtcagcaacatcgaggcgcgggtgccgtaatcgcggccctggatgaagatcggcgacaaggttttttccagcgccaggccgatacgggtgttgggcagctggccggggccggccggggtggggtcggacagcgccgcgtaggcctggtcttcgttgggcacccgctggaattcgcgcaggtattcggccagccgctggctcttgaaccacggcgtatccagcgtggcgttggacagcgtgtggatgccgggcgtgacgcgggcgatctgcgcggtgcggctgtggaagaagaacaggtcggaggtatggccgaacagcagattgaacggcgcgtagcggtgatgctcggcgcgcagccagtcggcaaaagcgaaggcgtcgtcgtcgccgctgacgaagcgctccaccagttcgccgcgcgagcgctcggccttggccggaaaaccgtcgcggaagttggtgatggcggcgaagcggttgcgtccgtcgaccatcatccagctgccgccggattgcaggtcgcggccgcccagcgtatgcgggtactccggccaccagtccagcggcgccgacgggcgggcgtagtattcgtcgcggttggccaagagggccagctggcccatgcccggcgtcttgtaggcaaaagcgatgatgcacatagtgaagaccgatttggggaaggcttgacgactggcgtaaactatacggccagaaggcccgccgcagcgcgcgggcccataccccattcattgtaacgcgatatggctcaggacaccggcccatgactcccgacaagcagattgatctttccggcctcaattgcccgctgcccatcctgcgcgcgaagaaggcgctggccgatatggcgagcggcgccgtgctggaggtgatcgccaccgatcccggcgcgcccaaggacttcgaggcgttttgccgccagaccggcaacggcctgctcgaatcgaccaccaccggcgagggcaagttccggatggtgctcaaacgcaaataagcatgcctggcgacggtgttcccgtcgccattcttttatctctagccacgccaagccccgaccatgcagacactcaccctgatccgccccgatgattggcacctgcacctgcgcgacgacgccgcgctggccgcggtgctgcccgacacctgtcgccagatgggccgcgccatcgtgatgcccaacctgaagccgccggtcaccacggtggccgccgccgccgcctaccgcgagcgcatcctggccgcgcgcccggccggcagcgccttcgaaccgctgatgacgctgtatctgaccgacaagaccagcgccgatgaaatccgcaaggccaaggcctgcggcttcgtccatggcgtcaagctgtatcctgccggcgccaccaccaattccgaccacggcgtcaccgacatcgcccaggcgatgccggcgctgcaggcgatggccgaagtcggcatgccgctgttggtgcacggcgaggtgaccgacgccgacatcgacgtgttcgaccgcgaggcggtgttcatcgaacgggtgatgaagccgctgctggccaaactgccgaatttgaaggtggtgttcgagcacatcaccacccgcgaggcggccgaattcgtcgccgccgcgccggccaatgtggccgccaccattaccgcccatcacctgctgatgaaccgcaacgcgctgttcgtcggcggcatccggccgcaccattattgcctgccggtgctcaagcgcgagcaacaccgccaggcgctggtgaaagcggccacttccggctcggccaagttcttcctcggcaccgacagcgcgccgcacgccaagggcgccaaggaggcggcctgcggctgcgccggcatgtacaccgccaacgcggcgatcgaactttacgccgaagccttcgaagccgccggcgcgctggacaagctggaggctttcgccagcctgaacggcccggccttctacggcttgccggccaacggcgggcgcatcaccctggccagggaaagctggaccgtgccggccgagctgccgtatccgggcgacgcgctggtgccgctgcgcgccggggaacagataggctggcgtttgctggactgacgggaaaaaacgcttgaaaagccgcctgtgggcggcttttttcatttggtgcgattttttaatgtgaatggaaatccatcgcgctttctgcaaatcagggggcgatgatatgtaaggctggcgcggtggcggcgcgggtttttgccatgaaatttgctcggatcagctaatagcatttcacatgtcggcatgtcgaaagtataaaaaacagcgtgtaatcaagccattgatttgcatgagtagtctattgtctgacaaagttgcgatgttgagaaaaatgaatagcatattatgggtcttggggcttgaagtattcaaaaacctctgcgcataatctgcggacccactctggatacaatcgagtgaaaaaaatccgccgtcttgcgatagacaggacggagacagaacaaggagagtagaagatgactgacaagcaatcgctgaaggcgatcgccgccgccgtcgcgctggccatggcttccggttccgtgctggccgccaaggtgcccgccggcgtcaagctggctgccaagcaggagttcacccgcaataccggcgccgagccggaaacgctggatccggtagtggcggaatccgtgccggccaacaccatcaccgccgacctgttcgagggtctgaccacgctggatgtctacggcaaggttctcccgggtgtcgccgaaagctggaaggaagtcgaagccaatacttgggtgttccacctgcgcaagaacgccaagtggtctgatggcactccggtgaccgccggcgacttcgtctacggctggcagcgtttcgtcgatccgaagaccgcctccccgtacgcgtcgacctacggcatgttcatcgtcaacggcaaggaaatcgccgagggcaagaagccggcctccacgctgggcgtcaaggccgtcgacaagtacacgctggaagtgaagacgccttatccggtgctgttcctgccgtcgctggtggccaacacccagctggcgccgctgccgaaggccaccatcgacaagtacggcaaggactggaccaagccgggcaagatggtcagcaatggtccgttcctgctgaaggactggcaagtcaacagcaagatcgtcaccgccaagaaccccaactactgggacgccaagaacgtccagctgaccaagatcacctatctgccgatcgaagacagcaacgccgacgtcaaactgtttgaatccggccagaacgatttcgtctaccagttgccgccgggcaccttcgacaagtacaaggcgcagtacccgaaggaaatccgcaacaccgaattcctggccctgcgctactactcgttcaacaacaaggatccgctgctgaaggatgtgcgcgtgcgcaaggcgctgtcgatggtgatcgaccgcgacattctggccaagaaaatcaccgccgacggccagacgcctgcttatagcgtgatggtgcgcggcatttccggcgccgacgcctccacctacgactgggtgaaatggccgatggccaagcgcgtcgacgaggccaagaagctgctggccgaagcgggcgtcaagccgggcaccaaggtgaccttcacctacaacaccaacgactatcacaagaagatggcgatcttcgccgcttcggagtggaagtcgaagctgggcctgaacaccgagttggaaagcctggagttcaaggtgctgctgaagaagcgccatgacggcgactaccagatcgcccgcaacggctggaacgccgactacaacgacgccaccaccttcttggcattggtgcagtgcaataacgatcagaacgaaaacaagaactgcaatcccaaggcggaagagctgatcaagcagggcagccagtcgctggacccggccaagcgcaagcagttgttcacccaggccaccaagatgatcatggacgactacccgatgctgccgctgctgcaatacaccgcgccgcgtctggtgaagtcctatgtgggcggctacggcaagagcccgctggatcgttaccagggcaaggacctctacatcatcgcccactgagcgtgatgcaagcggccagcgttcgcgctggatgaacagaggccggaggcccgcctggcggactccggcctgagatgtagattggcggcggcacggcctcgcgcgttggcgggcggccgcgctgcgcccgccaagcggagttcgatatgtggtcttatactttccgacgcattctggcgacgatccccaccttgctggcggtcatcacggtctgctatctgttgctgcacttgacgccgggcggcccgttcgacggcgaacgcaaggtctccgccgcggtgctggccaatctgcaggccaagtaccatcttgacctgcctccgtggcaacaatacctgtattacctcaacagcctgctgcacggcgatctgggggcctccttccgctatgccgactggagcgtcaacgatctggtgagcaaggccttgccggtgtccgccaccataggcggcggagccatcctgatctcgctggtgctgggcgtgctgctgggcaccatcgccgcgctgcgccagaacagcgtcgtcgattatctggttatgttgttcggcaatatcggcggcgccttcccgtccttcgtgctggggccggtgctggtgatgatcttcgccatctggctgccgctgctgccggccggtggctgggacaacttcaagctgaagttcatgatcctgccgatttcgctgttggtgttcatcaacgtctccactatcggccgcgtgatgcgcggcagcctgatcgaagtgctgaacagcaacttcatccgcaccgcgcgcgccaagggcctgccgctgcgcgccatcgtgctgcgccacgcgctgaagccggcgctgatgccggtggtgtcggtgatcggcccgctggccatctcgtccatcacctcggcggtggtgaccgagacggtgttcggcctgccggggctcggcaaactgatcgtcaacggcgcctccaaccgcgactacacgctggtgctgggcctggtggtgctggtgacggtgatcacggtggtgttcaacctcctcgtcgacctggcttatgccttgctcgaccccaagatccgctactgagggggcgaaggaaatgatgaagagcaaacaagcggctgcggccgtagcgctggaaaacggcctgagcgaggcggcggtcgaaggccgcagcctgtggcgcgacgcccgcatccggtttctccgcaacaaggcggcggtggtcagcctggtggtgctcagcctgatcacgctggcctgtatcttcggccccatgctgctggccaacggctatgccgataccgactgggacgcgatgagcgaggcgcccacgctgcataatatgcactggttcggcaccgacgcgctggggcgcgacctgctggtgcgctgcctggtcggcggccgcatctcgctgatggtgggcctgctggccaccatcgcctcggtgatcctgggcatagtctggggcgccaccgccggcttcctcggcggcaagatcgactcgctgatgatgcgcatcgtcgacatgatgtacgcggtgccctacctgctgatcgccattctgatggtgacgctcttgggccgcgagttctacctggtggtgctgaccatcaccgtgttctcgtggatggacatggcgcgggtggtgcgcggccaggcgctggcgatcaagtccaaggaatacgtcgaggcggcgcacgcgatcggcgtgtcgacgcctgtgatcattttccgccacatcgtgcccaacctgctgggcatcgtggtgatctacaccacggtgacggtgccgggcgtgatcctgaccgagtcggtgctgtccttcctcggcctgggggtgcaggagccgatgaccagctggggcgtgctgatccaggacggtgccggggtgatggattccacgccgtggatcctgctgttcccggccgggatgttgtcgctgacgctgtattgcgccaactatatcggcgacggcctgcgcgacgcgctggacccgaaagaccgctgatcccgcaggatagatgaggcaagccatgagcattctgaaagtaactaacctcggggttcagttccagaccaacgacggcgtggtcaacgccgtcaacggcgtgaatttcgagttgaaaaagggccagaccctgggcatcgtcggcgaatccggctccggcaagagccagaccgtgctggcgatgatggggctgctggccaagaacggcaaaaccagcggcgaagcgctgtaccacggccaaaacctgctggcgatgggcgcgaaggatctgaacaagatccgcggcgaccgcatctcgatgatcttccaggacccgatgacctcgctgaacccctacctgacggtggagcggcagatgagcgaggtgctggagctgcacaagggcctgagccggcgcgacgccaaaaagcgcgcgatcgagcttttggacgcggtgcgcatcccggaagcggcgcggcgcatcaatatgtacccgcacgaattctccggcggcatgcgccagcgggtgatgatcgcgatggcgctgctgtgcgagccggaagtgctgatcgccgacgagccgaccaccgcgctggacgtgacggtgcaggcgcagatcctgacgctgctgaaggacctgcagcgcgatttcggcacctcgatcatcatgatcacccacgacctgggcgtggtggcgggcctgtgcgagaacgtgctggtgatgtacggcggccgggcgatggagtacggccgcgccgacgacatcttctaccacccgagccatccctacaccatcggcctgctgggcgcgctgccgcggctggaccacgacggctccgagctggtcagcatccccggcaatccgcctaatatggccaatatgcccaagggctgtccgttcagcgagcgctgcgtgcacagcagcgagcgctgcgtcggcgagctgccgccgctggccgccagcagcctgaatccgcagattctgcgcgcctgtcacaagccggcggaagaactggtcaaagccgccgaggaggtgacgcatgtctgaaaccgccaagcagccgatcctgtcggtacgcaacgtcaaggttcatttccaggtcaagggcggcgacgcctggccgtggagccccaagaaaacgctgaaggcggtggacggggtcagcttcgacctcttcgccggcgaaactttgggcgtggtcggcgagtccggctgcggcaagtccaccctcagccgcgccatcctcaacctgatcccggcgacggaaggcgaaatcgtctggatgggcaaggacctgcgccaaggcagcgccaaagactggctcagcgtccgcaaggacatccagatgatcttccaggatccgctggcgtcgctgaatccgcgcatgaccatcgcccagatcatcggcgagccgctgcgcgtgcacaagcccgagctgtcggccgacgaggtgatgaagcgcgtcaaggccatcatgaagcgggtgggcctgcgcgagcagatgatcaaccgctacccgcacgagttctccggcggccagtgccagcgtatcggcatcgcccgcgcgctgatcctggagcccaagctgatcatctgcgacgagccggtgtcggcgctggacgtgtcgatccaggcgcagatcatcaacctgctgaaggaactgcagcgcgagatgggcctggcgctgatcttcatcgcccacgatctggcggtggtcaagcacatctccgaccgcatcctggtgatgtacctggggcgcgaaatggagctggcgcaaaagcacgcgctgtacgacgtgccctcgcacccgtacacccgcgcgctgctgtccgccattccgattccggacccgcggcaggaaaagaacaaggtgatccagatcctgcagggcgatctgcccagcccgatcaacccgccgtccggctgcgtgttccgcacccgctgcccgcaggcggtggagcgttgcgcgcaggaggtgccgaagctgcgcaagctgtcgagcgaaacgcaatcgtcctgcctgctggcctgacgcggacccgttccgtcgcgccgccgccacgctttgcgctggcggcggtttttgtttgcgcggcgctggctgcggcgcgcgtcaacgattatgcttgtaagccaatggccaaaggagcggagcgatgagccaacatctcgcggtttccctgagctgccgtttcgacgtcggctcatggagcgagcaattgctgcagcagaccgaaggcgccggcgagctcaagcgcgccagcatcgtcaacgcgctgagcggcagcctggagggacaaggctggctggagtaccagctgctgtatccggcggacgagggcggcgaggtgagcttcatcggctacgagcgcgtggtcgcgcgctggggcgagcggcagggcagcctggtgctgcggcatgacggcgtgtattccgccgcggccggcgtcagcggttcgctgcgggtgatgccgggcagcggcagcggcgatttcgccggcttgagcggcgacgggcgcatcgtggcccgggcgggggagcatggcggagagtatctgctgacgctgcaataccgcgactgaatcacaggcatcaccggcttgtcatgctgccgtggcagtgtttgcggcgcagtactggaaaaccatcagtgacgccgccatcagccttcaagggctggtggcggttttttcgtacagagggaatgatgtatcaagggcagcaggaatacgatattgggctggaatggggcctgccgggcgtgcgtcggctggatgggcaggcggcgctgtgcgtgattgtcgacgtgctgtcgttcagcacctgcgtcgacatcggctgcggctgcggcgcggcgctgctgccttttcgtcccgacgacgagggcgccgcagccttcgccgccgagcgcaaggcccagctggccggcaagcgcagccgcaacaagctgtcgttgtcgccggtctcgatgcgggcgctgagcgccggcagccggctggtgctgccctcgccgaacggcgccgccttgagcctggagtgcgcggcgggcgaggtggtggcgggctgtctgcgcaatgccgccgcggtggcggcatacgccggcagccagggcgcgccggtgcggctgatcgccgcgggcgaacgcgcaccggacggcgagctgcgtttcgccttcgaagacttcatcggcgccggcgccatcattcaccggctgactggcagcaagtcgccggaggcgcaggcggccgaagcggcgttcttgctggccaggcatgatttgctcagccatctgcgccagtgcacgtccagcctggaactgatcgagcgcggcttcgccgacgatatcgaactggcggcgcagctggatgtcagcacctgcgtgccgcgtctgcaggcaggcgagtatcgcgcgctgtgaggcgcggcggttcccgattcgtttccggcccgcatcgggcgggccgacttgaggagaatgcgatgttgccggcaaaaatggtcagcacgactttcgatctgcccggctaccgggtggtggccaatctgggcgtggtgcgcggaattacggtgcgctcgcgctcggtggtgggtaattttctcggcggcttgcagtcgctgttcggcggcaacatcaccatctataccagcttgtgcgagcaggcgcgctccgaaacctacgcgctgatgtgcgagcacgcggcggcgctgggcgccaacgcggtgatcggcatgcgctacgacgccaccgacgtgatggccggcctgaccgaggtgctgtgctacggcaccgcggtgcgggtggagccgctggacgcggcccgtccgtcttaagccgccggctgcaaatccagccggtatagctgttcggcgccggcgtcgcagaagcggatggcgtcgccgcgctggccgcgcagaaacaacagcagccagccgccgccggcatcgggcagcaggccgccgaagcggaagcccgcctctgccagccgcggacgcagcgccagcgcgtcggcgcttggcgccagcttcaggtagatcagctggccggccggcagggcggcgatttccgccagccgcgccgcgctgggctgcggaacgacgacttccagccgctggccgtggcgcgccaggctgaggccgggcaagcgcgtcggcgccgccgccggcgcgccgggaccgaaggcctggcgcagcggccgcagccattcctcccattccgccggccaggccagttcgggcaacggccgcggccgcagcggcaggcaacccagcacgatgctttccggctcgggcttgccgaacggcgaatccacgtagtccagcatcagcgcgctggtgtggaagcccagcgtttgcgccaggtattggctttgcgggtgcgagcagacttgcttgatggtgagcaggccgcagcccaggctgccggccgcggcgcgcagatggcgtcccagcaggctggccacgccgcgtccgcgcgcgtccggatgcaccacgttcaaggccagctcggcctggccgggccgcgccgggtccagccacagcgtggcatggccggccagacggccgtccagcagcgccaccgccgaatgccattgcccgctggcgttgcgttgctcgatctggctgggcaggtagacgtccggatacacgtagtggtcgccgtagaccgcgcggaacagcgcgctgaccgcggcggcgtcgccggcctggtagtcgcgcgcccaggcggcggcgggatggcgggcgctcatggctgcgcctcctcggcttggtagtcgcgcagatccaccacccgcatcagcttgccggagcgcggatgggtgcgcatccgctccgggctggtctggacgatgtccaggcgcagctggccggccgcgcacagcgcggcgatggccggttgggcggccagcaagtcctggcgcagcgccgcgcaatccagctggcggcggctggccagcagcaggctgagcgcgtcccggccgtcccggcgttctatcgccagctgccaggccaacagctcggcatgcctttccagcagcggcgccagttgcgccggaaacagcgacagcgtgccgacgcggacgcggtggccctggccggagcggccctgcagcgcgaacttgcgcgccggccccggcggctcgcgccagcaggccaggtcgccggtgggatagcggatcaccggcatcagtcggcgctgcagattggtcagcgtcagcacgccgcagcggccggtttcgctgatcggctcgccgctggcctcgtccagtatctccaccaggctgtcgtcgtcgaacacccggtgctcgccgtggcggcagccgggctcggcatagcctatcaggccggcgtcgacgctggcgcagcccaccgaggcgatgcgggcctggggaaaagcctgtttcagcagcgccagttgctcgccgaacaggctttcgccgccatacagcacggtatcgacgccggccagcgtctggccggcatgcgccaggtggtgggcgaagcgcagcagctgcgccggcactccggtcagcgcgttgatctcatatcggcggatggcgtcggccagcacggcgtcgtcgacatggcaggtgaacgggaattccaccagcggcagcggcgcgcgcgacagcgcgccgtggatgaacagcaggctggtgtagaggtcgccggcgaaaaacaggttggcgacgcggtcgccggcccgcagctggcgggcgacgccgccgccgaaggcctggacgaaggcttgccactcggcgcggctgaagaccgacagcttgccctcgctggtggagccgccggtcttgaagacatggccgtcgtccagcggcgcggtcagcaccggccagtcgcgcagcgtttgcgagccgcgccagtagtggtcgggatcggccggcggcaggtcggacagccgccagccctcggcgggcagcgcgcggtacagctggcgatagaacggcgaatggcgccgggcgtggtcgacgagtgatttcagctttggattcatgattgcggcttcggcgccggcgtccgcggacggccggcgcaaggtttaacggcgcaggtccagcaccagcggcgtcttgccgctgtgcggatggcggcggaattcggccgccggcgtcggggagatttccagtttcagcaggccgccgccgacgacttcgctcagcatcgggtcctgcagcaattgggcgcggatgcggttgggctcgccgtcggccagcaggcggatgcggtcgcagccgctgtccgcctggtccacaagccattgcagcggcaggcctatttgccggctcagctcggccggattgacgaagatggtgccgacccgcagcagcgcgccgtggcggccggtgagctggaagcggggcgttgccaggccgcaggcgcagcggccgggcagccagcggcccaggtcgcccaggtcgtagcgccgcacccgctgcgcttcgcgctcgcgcgaggtgaacaccaggcggccgatttcgccggcggcggcggggcggtcgctgtcctgctccaacacttccagccattgggtttcggccagcaggtggaattcgccgtcggcgctgccggggcagccgtggccgagcgggccggcatccaccgatccatacagggcggagcggatcagctccaccccgaagctgccgatgtaggcgcgctggccgtcgctgatgtgctcgccgccgaagaacaccttgcgcacgccgccgtagccgcgcagcagcttgttctcgcattcgaacagccggtgcaaggtgccgggcatgccgaccaaggtgttgatgttctgctcgacgatgaagcgcgcgatctcgctgaaatcgtcgtcggacgggccgcccatcgggtattgggcgacgcccatgtggtcgaggatagtgaagaagctgagcatgccgccgtacagtttgccgccgtacagcaggttcatcacccggtcggcggctgggtcgagcccggcggcgaacagcccgtcggcggcggcgcgcatctggcggtggtagtcgcgatagctgaagccggccagcttgggcgcgccgctgctgccgccgctgcggaagaacagctgggccttggcgttggcgccctggcgctggaagtcggccttgtccatcaccggcagcgcggccaggccctcgggctcggccggcggcgcgtccaggtgggcgtggccgggcagcgcggcggcgtccagcgtggccgacacccggcgcgacagccgttgcagcgcgtagacgccgtcgtgtggctcgccgtcgtagccgtcgtgcatgcggccggccggcgcgacgcggctgaccccggccgccagcagcgcgcggctcagttccggtaggcgcgccgccggggcgatcaggccgcagctttgcaggcgggtgcgccaggggcgcaggatggcggagagttcggcgcgcggcgccggccgcaactgcagggtgcggaacagcggcgacggcgccagttcatggcgggcgttccaggccagccgccagccttcgccgtccagcacttcgccgtccaggccggcgaaggcctggtccagccgtagaaaggccatctggctgctgatctcggcggcttcctgcaggtcgggccgcagcgccggccactgaggcgcgcggcgcgccagcgcggcggccatccgcgcggcgacgccgcgcagcgtttccgcgtcgtcgcagtccaccagcaggcattgcgggctggagcaggcctgctggtcgtggcggcagacatcgtcggccagcgcgtccagttgtgcgtcgccggcggccgggtcgagataggcgaagctgacgcggtggccccagtctatccagcggcagccgggcggcaattgcgcgcggatggcggccagcgcggcgtcgccgccccaggcggacaccgcgtcggcctcggccagcagcggggcgagccggtcgctggcgatgggcagcacggcgacgcgccgggccagccggccgctgtggtcgtggcgcaggaattcggccagcagccgcgcgctcaggccctggtcgctggcgctggggcgcagccagttgacgttgccggccaagaggccttccagcgccgccatgaagggcagcagcgccgcgttggacggggtgatgtgcagcaccaggcccagcgggcgccaggcttcgaagcgcgcttcgcggtagtcgtgacggcgcagcgagaacggccgctcgtccagttcgcgctccagcttggcttgcagcgcttcgcggcggcagaagcgcgccagggcgaggcggccggcctcgtccagcagcgggtggccgccggcgcgcgccagcgcgtcggcgaaacgctcggcgcaggacagtacggcctcgacatccggctccgcggccagggtgtcggccagtcgggcgcgcagcgcggccagcgcgtcgtccgccgtgagctgggcgcgcaattctccatcaatcagatacatgttcaggactccttgatcagttcggacgcggccatcgcgcagctgcggctcttgctggtgccggcgcggcccaatagctcgaaccagtcggtggccaggccgcagccgcagctggccgccgggtgcagcgccgccaggtcgctcaacgccaggctatgggccgggcttgaggtgatgtagggcgaaaccaggtgcaggaagccgggctcgccgtagggcagccgcgctagcgtcgcggtgtcgcgcgcccaggcgcgggcccaactgggcacgtggaaacggtggttcgggcattcgacgtagggcactggatgctcgaccgagccgtagccgtcgcggcaacgttcgtccggcagacccagctgttcgcccagccggcggtacagctccagtttgggaatcgcctggtcggcatgggttttccagccgccgccgaggaagaccagcgattgcggatgcagggcgagcggcggcaggcccatgtcgcgcatccgctccagcgtgaaccacagaaaggccgggaagcctaaaatgcgcaccggcaggccttccgcggcgaattcctgcagcgcgcgcatcgcgccgaagggatcgaactcgttgcccttgccggtgtggcgcagcgcgtagacggcgcggttgaccggcgcgtacttgcacaggaactggtcggtgtaggcggtgcccagcgtgatggcgcccgccggctcgtagctgagcagcaggtagttggccggttggtccggggtatgccagccgtagtggtcgaagatgcggtccaccatgcgctgggcggcgccgatgctgcgttcgtcgtagcgcatccggcttttctggccggtggtgccggacgaagtcagctccagcgcgtcttcgccgcttgcgctcagcagcagccggcgcttgaaatagttggcgaagatgggcggcagctgcgaccagtcggccaggccggccaggcgcgccggcgtgaagccgttctgctccagccattggcggtagccggggctgcgctcgcagtggtagtccaccagctcgcgcatcgcggcgtcgaacaggcagtcgcattcggcgtcggcgcggtagggatcgtccagatggcacagcgcttcgacatgcttgagtgaggtcatggtgctttacggtatcgatggggaaacgagtgtcaggcggcgctggcctgcggctgcggcgcgcgcagcagcagccacagcggcggcgcggccagcagcgcggcggcggtggcgccgacggcgaagctttgcgggctgtcgccggcgttcagccaggccagcaaggccgcgccggcgcccagcgtggcggtggacagcatgcccagcaccgcggcgacgctgcccttggcgctgtcgctggcgtacagggtgagccggtacagcgtggcgttgcccaggcccaggccgaaggcgtagatggcgaggccggcggccagggtcggcagcgtcggatgcagcggggtgaggatgccggtcagcagcaggccgcaggccatcggcgccagggagaggcgcagcagccgcgccaggctctggcggccggccagccggttcagcgccaggttgccggcgatcacgccgccgaacaccggcagctgccacaggccgtattccaggttgctgtagcccagctggcggatcagtagcagcggtgacaggccgatccaggcgatcagaggcagcgtgatcaggcccagcgccaggctgccgcacagcacggtgcggtggcgcagcaggccgaggtagttggccagcgcggccttcagccgcaatggcgtcggcggcagcgcggggccgtcgcggcgcggcgcgcccaccgtctccggcatcagccgccacaggcccagcgccaccagcaaggcggcggcggccagcgcggcgaacagctggcgccaggacagcagcttcagcagcaggccgcccaacagcggtccggccagcggcgacagcagcgcgatattggccaatagcgccatcaaccgcaccgcgtcctcctcggcgaaggtttcctgcagcgccgggtagctgacgacgatgacgaagccgagcgcggtgccctgggcgaagcgcagcaggttgaagctttcgatctgctgcgccccggcggcggcggcgcaggcggcggcgaagcccaggacgccggccagcagcagcggccggcggccgaagcggtcggacagcgggccgatcagccattgcagggcgatgccgcccagcaggaaggcgttgagggcggtgggcacgtggcggctgtcggcgtccagatcgcgggtcacttgcagcatggccggcatcaccatgtcgctggcgaggtaggtcagcagttcgaaggcggtgagcagcaggcagaagcacagcgcctggcggcgggaaatggcgagcagggggcgaaacttttcggcgggcatggcgaacggctttcttgctgcggcggcaaaaggcggtgggcgggcatgaggggagcggcgctgcggccggggttgtcatgcgatcggcgcacaggataggtcaataatgcagatgcaaaccctgtacttaagtatggtttcatcatgtttattgctttgaatttatttttattggaattaagcgtcgcttatttgtatttttttggaggcaatgattttccgttgtcgccttgctgatcaggcggagcaggccgcgcggcggcggttcgggccgtgacgcgacgacaagcttgctgcgacgccggccgggctcatgctattttgcggaagccgcgccagcctggccggcgggcttaaccatggaatgcgatccgcgatgaagaaaagattcatgttgcgcgccgctttgtgcggcctgttgctggccggcgcggcctgttacgcgatggccgacggcgacgctttgtggcgcatcgtcggcgagcagtgcctgcccaatcagcaaagccaaggcaaacccgacccctgcgttgaagtggggcaggcggtggcggtgctgaaagaccgctacggcgcgctgcaatatctgctgattcccaccagccgggtcagcggcatcgaaagcccgcagctgctgcgggacggcgcgccggcctactggcgcgaggcgtggcgcgcgcggcgctacatggcgctgaagcgcggcggcccggtgccgcgccaggcggtggcgctggcgatcaactcgcagtacggccgcagccagaaccagctgcacatccacatttcctgcatcgaccccaccgtgcgccagcaggtggacgatctggacgacagcctgccgcggcgctggcgcccgctgccggtggagctgaaaggccacgcctactgggcgcggcgcgtggacgccgaccgggacggcaatccgcaaggcgatccgttccgcctgctggccgacgagttgcccggcgcagccgagcagatggggcgctacggtctggcgctgctgccggccagcttcgccgacggcgacggcttcgtgctgctggcaggccgcgccgacctgctcagcgcgaaccgcggctcggcggaggagttgcaggaccacgactgcaaggtgctggaccgctaggcgcggtacggtatcatcgcgctgcgatcgcgctgcgatcgcgcgcggccatgtcggcggcgcggccaagcggggagaaacggaaatgcagcagagcctggggctggtgtcgctggtggtgagggattacgacgaggccatcgatttttacgtgaatacgctgggtttcgagctgaccgaggacagctaccagccggagcaggacaagcgctgggtggtggtgacgccgccgggctcgcaggccggcctgttgctggcgcgggccagcaacgaggggcaggccgccttcattggcaaccaggccggcggccgggtgtggctgttcctgaataccgacgacttctggcgcgactatcggcgctaccaggcggccggggtggagttcgtccgcccgccgcaggagcaggattatggcacggtggcggtgttccgcgatttgtacggcaatttatgggatctgctgcagcgcaagggctgaggcaggccaagcgcgcctggcttattcggcgcaggcgctccttagcggccgcctaggcatcgcttatttcttggccttggccagatcggtcagcacccgcgacgcggcgaacaggccgaagctggccgtcaccaccatgccggcgccgaagccggcgcaggacaggccctgcggaccgcgcgcgtcgtcggcatcgcaggcctgggcctgcgggtagaccagctgctcggtggagtagacgcagggcacgcacatcttcttgccgtcgcgggcgaagccgtggtggcggcgcaggttgtagcgcagcttggacaagagcgggtcctgtgtcacttcggacaagtcggccagcttgatcttgctaggatccatctggccgccggcgccgccggagacgatgaagcgctggcggtggcgcgcgcaccaggcggccatcgccgtcttcaccttcaggctgtcgatgcagtcgacgaggtagtcgtagccctggcccagcatcgcgtccatattctcttcggtgacgaaatcctcgatttcaatcacctcgcaggccgggttgatggcccgcgcccgttcggccagtgccgtgaccttggccatgccgtacaaaggatccagcgccggcagctggcggttggtgttggattcggcgacgttgtccaggtcgatcagcgtcagtttgccgatcgcgctgcgcgccagcgcctccaccgcccaggagccgactccgccgacgcccaccacgcagacatgggcgttctggaagcgcgcgagcgcgtcgtcgccgtacaggcgggcgatgccgccgaagcggcgggcgaggtcggctgagtggtccatcgggataacctgttgcgcaaaaacggccaaggataaccaaggcggcggccgggtgccagccccgcggccggccgccgcggcatcgcttgcggattggatggtcctagtgtggcgttttcggccggcatgaaaatttttttacaatccaactgcttgattgcgtggaaccttttcgctgttggccgtatcttgatccatacgcgtccggttgccggtgggcgcgcgtcagggaccggcaagaagcgccgacggcgcctcctctgccggccaactctcagcattggggagattccgatgaagcagcaaagattcgatatcgatctggacaaacactacaacgccaccgtggtgatcgcctgcgaagaatgcggccgcgaaacccgccagcatctgcgaaccatcgtcccggaccacccgctgcagtgcagctgcggcgccgacatctccatggccgcgcccgacatccagaaggccgaacgccaggccgacgccatcaggcaatcgtatcggatacattgatcccggcttcctacaattgattccgcagcacccgccggccatggcgccggccatctcgggcctgggcccgaatccgtgaagcaccgatagacgcggcggccatctggccgccgtttcgcttagttcgccagttgggcgtcgtattcgcggaaaccgtcctccaccgccggaatgatgtcgagaaactcgaagtagggctcggtggcgatcttgctgtcgcgcagcgcgtcgatcaggtagtagaactcgcggatcgactcggtttcgaacagcgcgatgtcgctgcagcggccggtgaaggcttcggcgtcgaaccagcgcatgcgcaccgccgggtagcgctcgtagatcggccgcagcgtttcggcctcgaagcggcggcgctccgggcggctcagccgcagccagttggggtggacgcgcagcagcgcgaagaaggcgtaggtttgttgcatggccagaactcctgtggtgtttggatagccgctccactttaagccggtttgcatggggcaaaaactcgtgtttcactaggcctatgcccgccattccccaagcccgaaaacagccgcgccaggcgcgttcgcgccatgccgtcgccgccattcttgaggcggcggctcgcattctggcgcgcgacggctacgctggcctgaccaccaacaagacggccgagctggccggcgtcggcatcggctcgctgtaccaatacttccccaataaagacgcgctggtggccgcgctgcaccgccgccacggcgaggaaacgctggccgcggtgcaggatgcgctgcggcgcggcgcgggctggccgccccggcggcagttggcggagttggtggcggcggtgctggcgctgcatctgcgcgaactgggcctgcaccgggtgctggagcgcgaatggccggccttcgacgagccgccggccgtcaacccgcaggacgccgcgctgcgcgactgcgtggccgcctggctggccggcatcggcgccgacgccggccgggcggaggtgctgctgaggatggccgacggcctgatccacggcctgctgctggacgccgagccgccgccggacgcggcgcgactgattaccgacgcgctggcggcctgtctgggcctgccggcggaaacttgataccacctgggagtgcgaatgatgaagtggatagacctgcgcagcgataccgtcacccagccgacgccggcgatgcgccaggcgatgctggacgccgaactgggcgacgacgtctacggcgacgatcccaccgtgatccggctggaagcgctggcggcggacaagctgggcaaggaagcggccctgctggtgcctagcggcaccttcggcaaccagctggcgctgttcacccactgccggcgcggcgaggaggtgatcgtcgaggacaacagccacatcgtctggcacgaagccggcggcgcggcggtgatcgccggcgcgcagctgcgcaccatcgagggccgcgacggcgtgatggcgacggcggacatcgagcgtcgcatccgcgtcggcgatgacatccacgagccgcgcaccggcctgatctgtctggaaaacgcccacggcaacggcaaggtgctgcctttggcggcgatggccgacaccgcggcgctggcgcgcgcgcacggcgtgcccatccacctggacggcgcgcgggtgttcaacgccgccgcctacctgggttgcgacgtgcgcgagatcacccgtcatgtcgacagcgtgatggcctgcctgtccaagggcctggccgcgccgatcggctccgtcctggccggcagcgccgacttcatcgccgcggcgcggcgcaagcgcaagctgttgggcggcggcatgcgccaggccggcgtgatcgccgcgccgggcatcctggcgctgaccgagatggcggcgcggctgccggaagaccacgccaacgcccgctacctggccgagcgtctggccggcctgccgtgcatcgacatccgccccgacgacatccacatcaacctggtgtggttccgcttcaacgccgacatcgacagcgccgagctgatggcggcgctggaggaggccggtttcctggccaatccgccgcaccagggcatgatgcgcctggtcacccactggcaggtggggcgcgacgatctcgaccgcctggtggaagcgatgcggcgggtgctttgcgactgagccgccagaggcggctataaacaaagcatgatccgacgggagctggccgcatgtggcgacgcctgttgtccggcgcgctgctggcggccggtttgtgcaatgcctggtcccagcccgcgcgcgctgccgggctggacgcggtgagaatctacaccgacgacgatccgccctacgtgatggtgggggcggacggcaaggtggccggcggcaccacggtggaaaaggtgacgcgggtgatgcgcaagctgggcctgccgttcagcgcgctggaggcggtgccgtgggcgcgcgcctaccaggaggcgaagacccggccgtacgcgatggtgtttcccatcgccaaaacccgcgaacggctgaagtacctggatttcaccttcaagatcatcgacgcagaagtctatttctactggctgaaaacccgttccgacatccagctggcctctctggaagacgccaagaagcattcggtgtgcgtggtgcgcaacgactaccggcaggaatacctggaaagcgaaggctttctgcggctggacgtcgccggcgacaccaccgacaacgtcaagaagctgctcagcgggcgctgcgacctgatcgtctccaccgaaaccggcatggtgagcaaattgaaggcgctgaacgccgaccgggcgctgctgacgcgcggcatgcggctggacaagctggacagcgcgctgtacgcggcgttcaacaagggcacgccgcccgacgtcatcgcccgtttccgcgccgccgccgccgaagtggagtaagcggccgcgcctggccattcacctgaggaggagggcagccatgatccgacgtctgctgtgcctggcctgcatgtgcctggcagcctggagcgcgcgcgccgagcaactggccagcgtgcagagccgccccggcgtcatcgtgcgcttcctgctgctggagccggccggaccggcgcgcgccaacctgatcctgttcagcggcggcgaaggcctgctcaagctgtcggatgccggcgaactgggcgccggcaaaggcaattttctggtgcgcacccgccaggggtgggccgacatgggttttcgggtggcggtggtggatgcgccgtccgacatgccgcgcggcctgctgggcgactttcgcgccagcgccgagcatgcccgcgatgtcgccgccgtcgccgattacctgcggcgcggcgcggcgctgccgctgtggctggtgggcaccagccgcggcaccacctcggcggtcgcgctgggcttgcagttgccggagcgggtccacggcctggtgctgacttccagcctggacagcggccgcggcagcctggcggacttcgaactggagcggctgcggatgccggtgctgatgatccagcaccgccgcgacgactgccgcgccagccgcgcctacaacctggggaccatcatagaccggctgcgttccgagcagccgcgccagctgatgctgatggacggcggcaagaacgagggcgacccgtgccagccctgggcctggcatggctacaacggcatcgagggccgggtgctgaagctggccggcgcctggatgctgtcgcatggcggcgcgccctagcccaccgatttggcagccgccgccgccggtgctaccctcgccgccatccttcattccggtatcgccatgaatccgtcccacgacccccatctctggctggaaagcctggactccaaagccgccgccgactgggtggccgcgcagaacgcccgcaccgaggccgcgctggacgccgatccgcgcttcgccggcttgcgcgccgacatcctcggccatctgcgcgacacccggcagatcccgtacttcgccgagcacgccggctggctgtacaacttccaccaggacgaggcccatccgcgcggcatttaccgccgcaccaccctggacgcctaccgcgccggcagccaggactggcagacggtgctggacatcgacgcgctggccgacgccgacgagcgcgactggtatctggacggcgtgtcgcactgcacggtcaagccggagcgggcgctggtgcacctgaccgacggcggcggcgacgccagcgtggcgcgcgaatacgatatcgaggcgcggcgctgggtggagcatggcttcagctttccggaaggcaagaaccacatcgcctggcgcgacccggacagcgccttcgcctgcccgggctggaagggcgcgccgctgacccgcgccggctacccgcgcgaggtgtggctggtgacgcgcggcgaagacggccagcatggctggactcagctgttcgccgcgccggaagacgcgatgatggtggcggcctggcgctttctcgacagcgacggcagcgcgctcgacctgatcgaagcctccgacggcttctaccgcaagacctaccatctgctggacggcgcgctggagacccacgcgctgccgttgccggccaaggcggagatcgaggcctacatagccggcgatttcatcgtcaagctggcggaagactgggactggcgcggccaacgctatctcaacggcagcctgctggcggtcagtctggccggtctgctgggcgagggggcggcgccgcagttgctgcaggctcccgagccgcggctggcggtggcggcggtggaaaccacccgcagccggctgctggtcaatctgctggacaatgtgaagagccgcatgctgtgcttcgccaagcaagacggcgcgtggacgccgcagccgctggcgctgccggaagacggcgtgatcgagatcgccgaccagccgtggcagagcgacatcctctactacacctacagcgacttcctgacgcctagcggcctgtaccggctggacgcggccagcggcgagggcgaatgcctgcgccgccagccggaggccttcgatccggcgccttatgtcgccgagcagtggcaggccaccgcgccggacggcgaacagattccgtatttcgtggtgcgccgccgcgacgcgccgttcgatggcacgacaccgacgctgctgtacggctacggcggtttcgaggtgccgatgctgccgtactacatcgaaaacttcggcccgcactggctggccaagggcggcgccttcgtgctggcctgcatccgcggcggcggcgagttcggcccgcactggcaccaggcggcgcagggggccaggcgccaggtcagcttcgacgatttcctggcggtggcggaagacctgatcgcccgcaagctgaccgcgccggcccggctggggatagagggcggcagcaacggcggcctgttggtgggcgcggcgctggcgcagcggccggagttgttcggcgcggtggtgtgcgaagtgccgctgctggacatgctgcgctataccgagctgttggccggcgccagctggatagacgaatacggcgaccccgacgacgcggccgagcgcgcggcgctggccgcctactcgccgtaccaccatctgcgcgccgacgcccgctacccgctggccttgttcaccaccagcggcagcgacgaccgcgtccaccccggccacgcccgcaagatggcggcgcggctgctggagctgggccacgacgcgctgttctatgaaaccgacggcggcggccatgccggcaacgccggccaggaggaaaccgccagcgaattggcgcgggtgctggtgtatctgtaccagcggctgatgtgaaaacggcccgcccatttctgggtgggccgtttttcgtcgagccgctgactcggcgcttaagccggagacagttcttttaaaagattctgggcatggtaagccttgtccagcagatgtaggatggcgcggctgtccacggcgatggcgcgggccttggcgtcgctgtagatatggccgccggccaggccttccagattgctgtcgaagatcaggccgaccagctcgcccttggcgttcaccaccggcgagccgctgttgccgccgatgatgtcggcggtgttgacgaagttgaacggcaggtcggggttgatggcgcggcgttgtttcgccaaagcgtcggccagttggaagggcgggcgctggtcgaaggcgctggcgcgggcgtagacgccgcctatcaccgttttccacggcgtggcgacgccgtcggcgtcatagccggcgactttgccgtagctcagccgcagcgtgccggtggcgtccggcggcaggctgtcgccgtatagcttgaagcgggcctggcccaactgggcggcggcttggcgcagcggcgtgtggacatgggcctcgtcgccgcgttccagttgacggcgcaacgggtagagctggcgcgccgcagcgatgagcgggtcggcgctggcggcgatggcggccgcgccgccgtccagcagcttttgcctttcgcccgccagattgagcttgctgccgccgatcaggcggcgcgccgccgccgccggctcctcctggcccagcagaatgcgcacggcggggtgcgcagcgcccagcttggcgcgcatctgctccagctggccggtcagccgagcgacttccagctcgggatagatgggcgtatcggcgcggatccagcgctcctgatccggcaggtcgctgtcgctatagccgttcagccgttcgccttcgggcagctgccgctcggccgccagctccaccagcgcgccggcgcgggacagcagcgtgcggtggccatagccgacgaaatagctttccaggaaatggccgcgctggtagtcgacggcttgctcgaccgattgccaaggatcgcccgccagacccgcctggcgataggcggcttgcagctcggtttcttcctggcgcttggcggcttccagctcgggctggcgcagcgctttatattcgccgctcatcgacttgagccagttctcggcgccgaacagggcgtcattggcctggcgcgccgcttcgggcgagcgtgccgcatagcgatgcaacagcgcctgctgcattcgggcatccgccaactgcagcggcaaggtcacgtcgcggcgcaattgcagctgggccagcgtttccagccggctggtgcggccgggatggccggcgacgaacaccgcctcgccctctgccacgccctggcgggatagcttgaggtaatgcggcggccgatagggtttgccgttttggtaaacgcgcagcagcgccatgtccagcgcgtggcgcggatagacgaaattgtcggcgtcgccgccgaagaaggcggcctggtattcgggcgcgaaggccagccgcacgtccttccattcgcgatagcggtacagctggtaaaccgcgccgttatacaggctgacgacctcgcatttgagcccgctggccttgtcgcaggcctgttcggctgcggcgatggcggttttgcggcggctggcctgttgctccggcggcaggctggcgggagaggcggcctggatgccggcggtgacgtcctgccacgactccagcacgcgggcggtgccgttggggcatttcagctcctgccgccgctcgcgcgccagatatcccttggccaccagatcgcgctgggcgctggagagctggttcaggcagccgagcgcgacatggtggttggtcagcagcaagccgtccggggagacaaaagaagcggacgcgccgaaatcgactgccgcctggcgcagattgtccagccaggccggcgtcagctcgacgccgtagcgctgcttgacctgcgcgatgggaggatggtcgaaagtccacatgccttcgtccgcgcgggcatggccggcggcggccagaagcaggggcaagaggattgctgttcgcatgatttcgcaatgaatgatgggctgattgtcatcatatctgaattaaatgctaattgaatatggcgggattgtcgcgtccccagggggcgggtactatcgcttcaccgcattgtcatgtccggcgccccggggcggggtgccggcatggccagaagaaatagaggaaacccatgcaaatgaagcgactgttgccgttgagcctgctggtgtgcctgcaggccgcctgggcgggccccgccgaagaactgaattacggcgcgtatggcatagatctgaagggcatcgatcattcggtgcgcatccaggacaatatttcgctgtacgccaacggcgcctggatgcggcgggcgcagatcccggccgaacgctcgtccaccggcatcgcggaatatctgtatgacttgaaccagcagcgcgtgcgcgaaatcatcgagcatgccgccggcgacgcctcttccccggaagcgggcaagatcgccgccttgtaccagagcttcatggatgaagccgccatcgccaagctgggcctggcgccgctgcgcgcgcagctggatgagatcgccggcctgtcctccgccggccaggcggtcgcctatatggccaagctgcaaggacagccggtggatacgccgttccgtttctatgtgcagcaggaccccaagaactcctctgcctacctggcgggcatcagccagtcgggcctgggcatggaccgcgattactatctgggcaaatcggcggatttcgccgccgcgcgcaaggcgtatcagcgctatctggccaagctgctgacgctggccggcgaaaagcgggccgatagccgcgccaaggcggtattcgcgctggaagacaagctggcgcggatgcaatggagcaatgtcgaaaaccgcgacatccagaagacctacaacaaggtggccgtcgccgatctgggcaagcgcctgcccggctatgactggccggggattttcgccgccgcccaattgtccgccgccaaggatgtcaatctggatcagcccagctacctcgccaaattgtccggcgcgctgtcgcatgcgccggtggcggtgttgaaggattacctgaccttgcgcacgctggacgcgtatgccgcctatctggacaagccatgggtggccgcgcacttcgatttctacggcaaagtgctggatggccgcagcgccgaccgcccgcgctggaaaaaggcggtgtcgctggtgaatgagggcatgggagaagcggtgggcaagctgtatgtggccaagtacttcacgccggaggcgaagcgccaggcggatgagctggtgcgcaatttgctcaaggcctacgaccaaagcatcgataccttgtcctggatggagccggccaccaagcgcgaggcccacgccaaactggccaagtacacgcccaagatcggctacccggacaagtggcgcgattacggcgcgctggagatcaaggcggacgatctggccggcaacgtggcgcgcatcagccagttcaattaccagcgcgacgcgaagcggctgaacgagccggtagaccgcgccgaatggggcatgacgccgcaaacggtgaacgcctactacaacccggccaacaacgagatcgtgttcccggccgccatcctgcaatcgccgtatttcgatcccaaattcgatctggcggtcaactacggcagcatcggcgccaccatcggccacgaaatcagccacggtttcgacgatcagggccatcagttcgacggcgacggcaatatgcgcaactggtggacgccggcggacgagaagcacttcaaggaagtgacggccaaactggtcaagcagtacagcgctttcgagccggtgaaggggcatcatgtcaatggcgagttgacgctgggagaaaacatcgccgacaacgccggcctggaaatcgcctacaaggcctacaagatcgcgctgggcggcaaggaagcgccggtgatcgacggcatgagcggcgatcagcgctttttcctggccttcgcccagtcgtggcgcagcaagagccgcgacgcggcgacggtgaagcagatcgtgtccgatccgcacacgcccgacctgtaccgcccgatcggcacggtcagcaatctggacccgttctatcaggctttcggcgtcaagccgggcgacaagatgtatttgccgccggcgcagcgcttccacctgtggtggtgagcggcggcaaaaaaaacggcagcgcgagctgccgtttttcatggcggggccggcgcttagaagctcaggccggcgcccagataggcgccgtcggcaaggcggcggctgcggctggcgtcatcgcggcggatgtcgaagtagcggtagccggcttccacgctgaacgggccggccacgttccagcgcacgcccgcggcgtagtcgctgacgcggtcgacgctgccgctggcgaagctgctcggcgcgtagtaggcctggccgaacaccttgaccttgggcgccacgtcgaagctggcgcggccgcctatcatcgccgcggtggcggagccgctgtccggcgacagcgccatcagcttgccgccggccgccacggtcagcgggcccagcggcaatgcgaactccaggccggcgccgccggcgctgcccttgtggtcgtggcgcaggtagtcgaggttgaggccgatgccgaaaccgtccgacgtgcgggtgagctgctgggtgccgttgccggcgccgaagatgtagtcggcggcatgggcgccgccggccaggctggtcagcgccagcgcgaaagccagatgtttcttcatgggtcacattccttagtgggatcaaaccagaacagatagtgaccaattgctaaaaaacaagttcagccggccagatgttgttccagcgacagcagcctggctttcagcgccgccacctcggcttccagcgcggcgacgcggccggtgaggcccacgtctatgatttcgcagggagccgcagcctcggcctgctgcggctcgccgctcagcagatggcaccagcgcgcctcgcgctcgccgggctggcgctccagcttcatcgccagcggcgggtatttgtcggccagcgccgccagcgcggtttccacttcatccacgccggcaaagccgtagatgcggccggcgcgggtgcggatttcggcgccggtctgcggcccgcgcagcatcagcagcgtcagcgccgctagccgcgcgccgtcgatattccattcgtagttgaggcggtgctcgtacttggcgacgcggctgccggccggcagcctctcgcccactagccgcttggcgatcagcgcgtccagcgcggcgctgatgtcggcgtcggacagctgcagcaccggctcgcggctggtcagctggttgcaggcgctggcgaggccgttcagcgtcatcggataggcgtccggcgtcagcgcctgcttctccaccagcgcgcccagcacgcgcacttcgatcgggtccagttggtgcgtgtccatacatcctccactgcgagattcaatacgcacatcatcgcaccaaagccgcgccgggcctaggcattcagcgcgtctcgcggcgctccagcgcttccagctggcgcaggcggcggatttcgcgcttgcggccgtcgcgctcttcctcgtccagcgcccggtacagcgacaccgccatgcctatcatgatcagcatgaagggcagcgcgctgacgatcagcaccgcctgcaggcccttgagcccgccgctttgcagcaggatcagcgccaccgcggccagcagcacgccccagaccagcttgacgcggtggctggggttgagattgccgccgctggtgaacatgcccagcacgaaggtggcggagtcggccgaggtgacgaagaagatgatcaccagcgccatcgccagcagcgacagcgcatggccgcccggcagctgctcgaacatcacgtacagcgcggtggatacgtcgctcttgaccgcggacaccaggtcggcgccgccgaacagctgcaggtccagcgcggcgccgccaaaggcggagaaccagacgaagctggccagcgccggcaccagcagcacgccgacgatgaattcgcggatggtgcggccgcgggagacgcgggcgatgaacatgccgacgaacggcgcccaggtcacccaccacgcccagtagaacagcgtccagttggccatccaggtgccctgggtgaacgggctcatccgcaggctggtgctggtcagattgcctagatagtcgcccagcgtggtggtgaaggtgtcgaagatgaagccggtggggccaagcaccaccaccgccaggaacagcaggatggccagacagatgttgaggttggacagccacttgatgccgcgcgacaggccggtcagcgacgacagcaggaacagcgcggtggcgatcaccacgatggccacggtcagccagtcggacggctggacgccgaacagcatctgcagcccgctctcgatctgcagcgtgccgaagcccagcgtggtggcgacgccgaacacggtggccagcaccgccagcacgtcgatggcgatgccgatcgggccgttcacccggtcgcccagcagcggacggaaggcggcgctgatcaggccgggctggccgcggttgaacttgaagtaggccagcaccagcgcggtcaggctgtacaccgcccacggatgcaggccccagtggaagaagacatggcgcatcgcggcgcgcgcggcgtcggccgactgcggcgcggtgccggcgctggccggcgcggcgaagtgcgagatcggctcggcgacgccccagaacaccaggccgatgcccatgccggcggaaaacagcatggcgaaccaactcagccgcgagaattcgggctcctcgtcctccttgcccaggcggatgtggccgaaacggccgaaggccaggtacagcgcgaacaccaggaagccgaacaccgatagcaggtagaaccagccgaagcgggagatggtgaagctcagccactggccggtggcggcggccatgtgttcgggggccagcgcgccccacagggcgaacaatacggtgaataacagcgatagtcgtaaaaccatctgcgctccttgcgatggcggcgacgccgaagccccgcgcggggcgcgtcgccgtaagggatgggaagatggcggctctaaggcgagcgccgctggcggggccggcttgggccgggctttccgcgccgcccggcggtgcgggcggatgatggatggagccagcctgttggcatgatcgactgtcgcgagatggcgaatggcggtcgatcatcaggctgcatcctgatgaataattgaataaaatcaatcaattgttatttagactaacattattagcattttcttgtaaacctttgggcggcattttttcgccgcgcggcggcgcggcggcgccgcttgacagggcggggcggcttgtccaacctgtcgcgtttcattgccaagccgccgcggggagcacggatgatccgaatcgatattttgctggtggaacaagggcttgccgcgtcgcgcaccgccgcgcagaacctgatcgccgccggccgcgtcagccatcagggcgcggtggtggccaaggccagccagaagtttccgccgcatgccgaattcgcggtggtcgccgacgcggccgaccgctatgtgtcgcgcggcggcctgaagatgcagggcgcgctggcgcaggccggcatcgcggtggacggctggtgcgcgctggatgtcggccagtccaccggcggcttttccgactgcctgctgcaatacggcgcgcgccgggtggtgggggtggatgtcggccacgatcagctgcatcagcggctgcgcgacgacgcgcgggtgcgctacttcgagggcgtcaacgcgcgcgcgctggaccacgccgcgctgctggccgccaacgacggcgatggcttcgacctgatggtctgcgacgtgtccttcatctcgctgagcctggtgctgccgtcggcgctgccgctgctgaagccgggcggccgcctgctcagcctggtcaagccgcaattcgaggtggggcgcgaggggctgtccaagggcggcatcgttcgcgacgccagcttgtatccgctggtgcaggacaagatcaaccgggtgctggccgagcagaacatgaagacgctggcctggttcgacagtccgatcaagggcggcgacggcaaccacgagttcttcgtccacgccgcgcgccgctgaaaaagacaaagcccgcgccaggcgggccggatggcggttttactcgacgcggatgtcgtcgtcgtcggtgctgcgcacgatcagcagcgggcagtggctgcggcgcagcacgtcctgggcgaagctgcccatgaacaggtgggccaggccgctgcggccatgggtgcccagcaccaccaggtcggcctgctgcgagcgggcgtagcctatcagcaggtcggccaggtcgtggccgccttcccagcttttttccagatggctcagcacattgtgcaggccggcctcgcgcgccagctgctgcgcgcgcgccagcgcctcctggccttgctgcagcgccaggtcgtagccggggtcgccggcgtagacgcccaggctgtcgacggccagttcgcgcaggctggcgatatggaccagggtgagccgggcgtcgctgaatttggcgacgcggatggcttcgtgcagcgctttgtcggaattgttgctgccgtctatcgcggcgatgatgtggcggtacatctgcagctccttcgaaaaacaccggctaggtgggatgccttcagcataccgcgccgggcaggcggcgtctcgccgggcgagcgctggtgttgatccagggcaatgaaacaaaggctgctgcatgagacgggacgcatatcgatggcgcggtatgtcggcagccgaccgaatcccccttcggcccgtgccggcaaaacagttttgtaccaggagttgttgagccgccgttttttgatcggcggcgcctggcgcaagactgttttgtcggggtttctcgggccgctggggtcgcctggagtggtcagggggctggcgagacagcctcctgacccgttcggcgggcggaaccgccgtgaaaatcattgtccgcgtagcggactccgcagcgttgttgtcgtggcttacccaggcaggactaggatctcgatcagaccagaaaccccaggtactgccgctcccaggtggtgacttggcgatggtagtcggtcaactccacctccttcaccgccagataagcgcggcagaagtcggcgccgaacagcttttcgccgatttccgccgccgccatcgccgcgcaggcggcgtccagcgtggtcggcaggctggcggcctgctgcttgaacacattgccgtgcgccgcttcgtccggcgtcagtttctgttcgatgccggccagaccggcgcccaggctggcggccagcgcgaggtaggggttggcgtcgcagccgggcaggcggttttccacccggcgcgcctccgggccggataccggcaccctgaggccgaccgagcggttgtccagcccccagctgaggttgaccggcgccgccatgcccttgacgaagcggcggtaggagttgggattggggcagaacagcggcatcagctccggcaggaagcgttgcaggccggcgatgaagccgaagaacgccgggctggcttcgccgccgtcgccgctgaagacgttgcggccgcggcggtccaccaggctttggtggatgtgcatcgagctgccgggctggccgggcagcggcttggccatgcacacggcgctgaggccgtggcggtgggcgatttccttcagcgcggtcttgaacaggaaggtgtcgtcggccagcttcagcgcgtcgccgtgcttgaggttgatctcgaactggctggggcccatctcgtgcacgcaggtgtcggtggcgatgcccagcgtctcgcaggcctggtatagctcgtcgaaaaaggcttccagttcgcccagcgcggaaaagccgaaggcgtcgaagccggtttcgcgccggccgcagggcagttgcggcggctggaacggctgcgccgggtcgccgtgggcggcgaacaggtagaactccagctccggcgcgacgatgggagtccagccgtgggcggcgtagcgcgccagcagctgtttcaggatggagcgcggcgccagcggcgacaggccgccgtcgtggtcgacgcagtcgcagatcaccagcgcgcgcggcgtcttggcccaggggacgagacgcagggtgtcgtagtccggcgtgagggtcacgtccggatcgtgttcgccgtataagctgtagtcggggaattccccgacgcagctttgcagcggcaccgcgcgggcgatgcgcagctgctggccctggatgaaggccgaagcgggcagggtcttgccacgggcgaagccgtggacatcggcgaaggcgagttccacatccctcgccttgctgtgttgcagccattcgatgcggcctgccggcatgcgggcatcagacatacgtttctccactgaagcgtgctggggttcctgtctgtcctcagttttttttcttgctttcatggagcgtgcgcccgcagccattatgccagccgcaacggcggcggcaagtgccgcgatgggtttacaggcggaagcggccgacggtctgatgcagattggcggcttgctggtcgatgtcgcgcaccgcctccaccgcgttgctgaccgagttctgcgtttcctccaccacgccggccacctgttcgacattgccggcgatattggtgccggcctggctttgctcgcccatcgccaccaccacgttgtggacgttttccagcgcgctgctggcctggcggctgatcgaatccagcgtctgcgccgcctgctgcacctgttccacgccggcctgcaccgccgggcggatttcgtccatctggctggagacgttgccggtttcgctgatcaccgcctgcacgatggtgctaatctcgtcggtggcgctggcggtgcgctcggccagtttgcgcacctcgtcggcgacgacggcgaagccgcggcccatctcgccggcgcgcgccgcttcgatcgccgcgttcagcgccaacagattggtctggttggcgatgtcgcgtatggtttcggcgatgctgctgatgctgcggctgcgctcggccagctggccgaccatgtcgctggcgctgtggatctggtcggcgacctggcggatgccgtcggcggcgttgccggccagcgtcttgccttcgctggccagctgggcggtgtcgcgcgcgccgctttcggtgtcgcgggtgctggcgctgacatggtctatgctgaccgacagctgctcgatggcggcggcggccgaggtggtggacgagctggcgatgccggacacctcgtgcaccttgtccatgtcgctggagagctggcggcaggagtggttgatgctctgcgtggcgtggccgatctcttctatcatccgcctgagcttgccctgcatgtcctgcatcgcgcccagcaggctgccggcgccgcccttcacttgaatggctaagctgaggtcgccgtcggcgatggccttcaccacctcggcggcataggcgggctcgccgcccagcgactgcaggatggagcgcgacatccagcccaccagcgcgcccagcaccacgatgcagagcaccgccactagcagcagcgtgcgcgcctcgctccagaacagctggtcgatgtcgtcgatgaagatgccggtgcctatggtccagccccaggggtcgaagcggaacacgccgttgagcttggggaattcctcggcgccgctgccggcgcgcttggtctggatggtcagcacgccgtagtggtcctgctgcatcgcgtcttcgtaggcctgcacggtggtgcggccgtccggcagcttgctgcccatgtccaccttgccgacgcggtccttgctggggtggaacagcaccaggttgtcgcggttgcggccgaagaaatagatgtcgccgaccttcagcgccgacagcgcggcgatggcctgcttttgcgcctccggccgcggcatgccctgggtttccagctgctggaagtggctgaggctgttttccgccattttcagcagatggacgatctgttcgcgtttttcctggtgcagggtggcgcgggtggagaacagggcgaccgtggagatgccgagcagcgcgatcatgctggcggcgatgatgatgatcaggcgggtattcagctgcattttcaatactctgatgggtgaggaacaagccgccgcaaggcggcgacgcccgctgggatgcagcggcgggcgccgactggattatgcgtttctgttgttacagtctagttcagagcaagaaaatcaatattggaagtttccctgattcagcgcgccgccgccgcgcacggcaaacggccgctttggatcgcggcgtcgaatagccggtagtcggcttccacctgatcggcataggcctgcgcgtagtcggccagcgcctggtcgaacttgtcgctgtcgcccaggtagccggcgatctcggcggcgcagccgcccgatttggcgtgcgcgcgcgccagcgtccaggcgcaggcctggccgtagctggccagctcttcggcggcggcgaaggtttccagcgtcggcgcgcctttcatgtcgcgcagctggcgcatgtagaaatggcggccgtcggcgctgtgggtccagccgaggaacaggtcgctggtggcctgcatcagccgctggccgaacaccacccgcttgccctggttgccgtgcacgcagtcctgggtgaaggcttccagcactgacggccgcgcttctttcagctgcaggaacagcggctggtcgtagtcgtcctgcagcagcagcgccaggcagcgggtgccgacgctgccgacgcccaccaccttgaacgccgcgtccaccagacggaagcgccgcagcagctcgcggcggtcttccttcagcgtggcgatgtaatgctccagcatgccttgcaccttggagaggctgtcggcgcccagccagtcgtcgcaggcggccagcgggccgccggcctcgtccaggtggaagatcaccggcgggttgtcgcgcagccgcagcgcgccgtcctcgctttcggtcatcttgggcagcaggcgctcctgggtctggctgcgcgccttgtcggccactttctgcaattgctggcgcatcgccgggtcgggcgcgtgcgacagcagctcctcgaagcccacccggcagtaccacaggtcgagctggctcatctgcgagaaggcgagcaggcggcggcggtaggtggctgccagctgcaatacggtgtcgcgggcgtcgccggcgccgaagccgcggctgcgcgaggccagcaccaggctgaccgccagccgcttgacgtcccactcccaggggccggggtgggtttcgtcgaaatcgttgatgtcgaacaccaactgccgctccggcgaggcgaagaagccgaagttcatcaggtgggcgtcgccgcagatctgcaggcgcaggccgctgtccgggccggcggcgaggtcggcggcctggatcatcgccatgccgcggaagaaggcgaacggcgacgcgtgcatgcgcgcgtagcgcagcggcgccagcgccggcacccggccttgcgaggtggactccaccagcgccaccacgtcgcggtcggcggccagccggcactcagcctggctggcgcgtggacagttctggcggcgggctttgccgtcggcgtaatgctggtcgtacatcgggtgggaaacggcaggcataacgggcatccatggttgcggcggttgccgttagtgtaaacgcagccggcgcgccgcgccgactgaccggcgtcagggttatccacagcttgttgtcgaactatccacactattcacaggtatttgtggatgtttttgcttgcccacagccgcgtcacgaatcgtcacgatttgccgtggcttacgcacagggttatcccgacttatccaaattacccacaggcgggtgaggattttccgacttgttcacagcctcttgccgctgcagctgtggatcagctttttccaggccgggctcagcggcaggccgttcagctccacttgcagccggctgccgtcggcctgcggcaggatttccacccgggtgccggaggcgtcgctggcggggttgcgcatcgccaggctgtggctgccgtcgcgctcgtcgcggcgttcgatgaaatcgtcggggatgtgcagtttctgcagcccttgctgcaggcaatcggtcagctgtgccggcgggcgggaggagtccagcgcggggccgccggcgggggcggcgcgtagcggcgtggtgcaggcgagcaggggcagggacagggcgagggacagcagcaggcggaacttcggcatcggcgcggcgcttgtggcgtgagtggaagatgccttgttggtggcacggggcggccggtggttccggccgtcccgccgccaaaatgttaagcgatattacgcgaaacgctcgccggcctggcagccgcgcaggaaagccagcatgtcggcgacgcgggcgtcgccttcggccggggcccaggcggcctggtcggcgctgtccagcggcaggtaggggccgcgtttgacttcgaacaccacgctgcctggttcgagcgacaccaccgagtgccaggtgtttgccggcatctcgaacacgcgcgcgccgccctctcccagccggtggcgggcgaccacggtttcgccggcggcgtcgaattcgatccagtccagcgcgccggccagcacgatcagcagctcagggctgcccggatggcggtgcgggcggacataagtgtccggctccatggcgatggccaggcgctggatggcgtcgtccagctgctcgtggagattgtggtgggcgcgcaggcgcggcgcacaggcggccttggcggacatggcggccaggtctggattggtcagggttttcatatttttggcaaaacgagcttatgaggcaaagggggattatcgcgtgaattgagagggttgtctgatatcgcgatggcggaggcggcggcgagaggagggcgtggaagtttcatttaatgattttggcattgaaaatttcaattgcaggacaatttgaatgctttccgcttcagctccgcgaggcgagaaaattccacgcaggcctgaacaggggctagcgtgccaataaaaatgaagaggaacatcaagtgaacgcaaataaaaaagtagcgctggcgctgttggctggttctttcggtttcggctccccggcgcagtccgcgccaagcggagccgattcgtcgccgactccattcagcgtgcccttggcgaagcaagccaatggctttgtcgcggtgaaggcgcggctcaatggcgtggatggccgcttcttgctcgacagcggcgcgtcgatgacttgcgtagaccgcaagcaggcggcccggtttggtttggaaaatcaagggacaacgcgcacctcgcatgggtccgccggggcaaccgagatcaagcgggtagccgacaagcggctggaatggggcggcagattggcggcagacaagttggctgtgtatttgacggatttcgacgcgatcaaccaaggtttggccgaagaaggggttgccgcggtggatggcgtcatcggcatggatgtgctggccgagcaatatgcggtgctggattatgggcaacagcagttgcgcttgggaaagggcgccacgccggcagcggcttttgatcgcttgcctttgacgtcgctgggcggcagccaattgatgctggagggggtgatcaatggcgtgaaagggcgcttcatcatcgacaccgccgcgggagggacgttcgtcaccgacgatgcgcacgccgccaggttccatctggtccgccaacctggagcgaatcaggtccatggcgtcggcggcagcgtcgaaagtcatttctacttattggacagcttgcagctaggcccgcgtttcacgctgcggcagcagaaggtggagaccatggatctggccggcgtgaacgcctcgctgaaagccaaagggctggaggaggtggatggcttgcttggcgccaatgtgctgaatcagggggcggccgtctttgacatcggacaacaggttttgcagctcaagccattgatttgattttgagcccgagccagccggaccgcatgatcaacagctccgggctgccggggcggcggtgcgggcggacgtaggtgtccggcgcgatggcgatggccaggcgctggatcccgtcttccagttgttcatgcagattgtgatgggcgcgcaggcggccttggcggacaggtcttgattggtctgggtttttgtcggcaaacgagcgtgtgaagcgacagccaattatgatgcgaaatgaagagggttgtctgttgttgtgggggaaggggatagttgagcctatcagtgaaatgatcaactaaacgcttaagaaagaaattggcaagtggtagaagagctagttaatttcttggataagttcaataagagcggcagagaacttggcaacatctaaatcatgaacccatttttcatttttatggtttccttctaatgtgatgatgcctgataggtgtgaccaatccgttggtttgaagtctatgaggttgaactggcaggaggataataattcatcctgatcgattcggtgtgcatttgttgattttatttttttggaatcatcttttcagcgtgaatgatcttgttgcatgctgtccttataaggtttttattctcatctctacttagattttgagtattgtttaagaactctcctgatctgtgtttattgttgattctatctctaacggatctgtaactttctatgtccgcgtgaaggttatcaagcgtacgtatagtgatagcgatgttgagtagtagatgtgagatctcccgcgtataaagttcgtcacctagtttcttttctaagctgggattggctgggtcagaattgtaagaaataattgaatctgcgtaaaatatgcaaagaagacgataaatattgagttttatcgtctctttgtcgagcgcgtagcggtctggctggctcatggcatgaagtaaaacttactgcctgatctgcccgtcgcccagcacgatccacttctggctggtcaggccattgaggcccaccgggccgcgggcgtggatcttgtcggtggagatgccgatttcggcgcccaggccgtattcgaagccgtcggcgaagcgggtggaggcgttgaccatcacgctggccgagtccacctcgcgcaggaagcggcgcgcgcggccgtagtcttcgctgacgatggcgtcggtgtggtggctgccccagtggttgatgtgctcgatcgcctcatcgatgtccttcaccactttcaccgccagcaccggcgccaggtattcggtggcccagtcgtcttcgctggccggcaccaccttgtcgcccagtatcacccgggtgcgctcgcagccgcgcagctccacgcctttttcccagtaggcgtcggccaggcgcggcagcatgaattcggcgaaggcgccgtgcaccagcagcgtttccatggtgttgcaggtgccgtagcggtgggtcttggcgttgagggcgatgttgaacgccttgtccggattggcggtgtcgtcgatgtagacgtggcagttgccgtccaggtgcttgatcaccggcacccgcgcctcggcgctgatgcgggcgatcaggcccttgccgccgcgcggcacgatcacgtcgacgtattccggcatggagatcagttcgcccaccgcggcgcggtcggtggtttccagcacctgcaccgcctcggccggcaggccggccaggcgcaggccctcgtgcacgcaggcggcgatggcctggttgctgtggaaggcttcggagccgccgcgcaggatggtggcgttgccggacttcaggcacaggccggcggcgtcggcggtgacgttggggcgggcctcgtagatgatgccgaccacgcccagaggcacccgcatcttgcccagctggatgccggacgggcggtagctcatctcgctgatttcgcccaccgggtcgggcagcgcggcgatctggcgcaggccgtcggccatcgccagcgcgccgtgggcggacagggtcagccggtccagcatcgcggcgtcgaggccggcccggcgcgcggcgtccagatcgcgccggttggcggccaggagcaggtcctggtcgcggacgatggcgtcggcgatggccagcagcgcggcgttcttctgttgggtgtcggcgcgcgccagcaggcgcgaggccttgcgcgccgccttgcccagctgctgcatgtattcttttatgttcatggcggaaggtcccggtgatctcggtgtcggattggctagagcttaaaccaaagcgcagcctgcatccagccgcaaggccgcgccggattggctattgtccggcaggcggttcgcgccagcgctgggccggcaccgtgaccggtttttccggctgttcgacgaagtgcggcgacatgatctgcacgccgaattcgttgaaggcgtccaggatttcgccgtgcagcgcgtcgcgcgcgccgggcggatcggcgtccggcagcagccgcagttgcagctcgtactcgatgtagaaatcctgcagcgccagcttgcgcacctgcggcgcgtacgccggatcggcgccggggctgcggcgcgcggcgagctccagcagcgcggtcacctgtcgccacggggtgtcgtagcctatggtgacgcggctggcgatcatcgcgccgccgccttcgccatggcggctgaagttgctgatccggccgcccaccgccaccgcgttgggcagggtgatttcatagccctggctggtggcgagcttggtggacagcgccgacagttcgatcaccgtgccctccacttcgcccacccgcacgtagtcgccgcgccgcagcgcgcgggcgtagatcagcaccaggccgctcatcgcgtggttcatcagcccggcggagcccagcgtcaccatcaggccgaagaacacgctgacgcccttgaaggcgtcgctgccggcgccgggcaggtagggataggcgacgatcagcgcgaacagccacagcgccaccccggccagccggcgggtggcgccgacggtctcggcgtgcaggccgggcagcgccagctggccacgttccaccgcgccgcacagcagcgtcaggccgcggcccagcagccgggtcagcaggaagatcatcgccaccgtggccaggccgggcagcgccgacaggatgtcgtcggccagggtggcgagcagctggtagaacgaatctcccagtttgcggcccagcggccgggtatagggaaacaggcccagcgcgtagctgagccagacatagccggcgaacagcgcgcatagcagcgcggtgacgtccaccagctggcattcggcggcgcgcaggaaatggcgcaggtcgaacttgccgcccagccagggcagccggcccagcggctgccgctgcaggcggcggcgcgaggccgcgcgcaagcgcaggatcagcgccagcagaacggcgaaggcggcgctggccagcagcgccagcaaggcggccttggccatctgttccggcgagcgctgctccagcgcggccagccgctgttcgttcagccggtcgcgcacccgggccgcagcctgctccagcgtcaattgatcgccggggtccaggtcgtccgccaacagcgtgaacagcggtttgccgtggatgctcagcgcgatgccgcgcaggctggagtcggccagcggcgcggcttgcaccggctggctcaggtcgtccggcgtcagctcgcggatgcgctccagcgtgcgccgcagccgctgctccgggctcagcctggcctggggggccagaaacaggaagatcgggcggttgtccagcaccagggtgcgggcgctgtcggccggcgacgggttggcgcgcggttcggcggccagcgccggcaggcatagcgcaagcaatagcaacaggcgaagcaggggcatgcggactccatgacgggcgggtttcgcccatcatcgcacagccgcccgccgccgcgcatccactcaggccaagcgcatcgccagccgatagcgttgcggggcgaagcgcgcggtgagcagcagcaacaggaccaccgcgccggagagcgccagccaggccagctggaagctggcggtgacgtcgcgcagccagccggcggcgaacggcgcgcaggcggcgatcaggtagcctattccttgcacgaaagccgtcagcctgccggcggcccggctgtcgtccaggtgcgacagggtcaggatcatgctgagcgggaacaggccgcccacgcccaggcccagcaaacccacccacagcagcatcagccggtcttgcggcagcgccaccatgccgagcagccccgccaaggtgaagcacagcgccagcgccagccagccgcgcaggtcggggccgcgcgccgacagcgccggcaaggtcagcccggccagcacctccatgccggtcatgtagctgagcatcagcccgccttgctggccgctccagcccaactgcacgaaaaacggcggcagccaggccagcgagcaggtgtagacggcagtgcccaggccaaagtagccggccagcagccaggcgcgcggcaggcggcccggcgaggcggcggagtgggagtgggaggcgtggccggccgcggtcggcgcgtgccgccaccacagccagcagcccagcgcggcgggcagcgcccataccgctaggcccagatgccattggccgctggcttgggccagccacggcgcgccggccgcggccagcgaagcgccgcccatgatggcggtcacgtacaggcccatcagcagcgagaccttatcggggaaatgctgcttgatcaggccgggcagcagcgcctgggccagcgcgatgccgcagccggccagcaaggcggtggcgagcagggcggggtagccgggcggcggcaggcgcagcgcgcaggatagcaggatcagcgccagcgccagcagcacgccgccgcgcgcgcccagccaggcttccagccggccgccggcgaaagcgcccccgcccatggcggcgatgggcagcgtggtgagcagggcggcgtcgctgaagcggatgccggtggcgtggcggatcggttccagcaaggggccgatcgcggccaggcaggggcgcagattgagcccggccagaatgatggcgcaggccagggcgagagaggagcgggtggtgccgggactcatcgtgttctccgcatcagtgttggcgcaagaaggcgagcagggcggcgttgaaggcggcggcgctgtccacattggctacgtgggcggcgccgggcagcgttgcaaagcgcgcgccgggcacctgggccgccatccattggcttagcgccggcggcgacacctcgtcgcattccccggccagatagagcgctggcgcggcgatggcggacaggttctcggctaggtggtaatcggctagcccttcgcagacatgggcttgcgacgcgccgtccgcctgcgccgcctgcgcctgccactgccagtacagcgcctgcccggcggggctggcgcggaaggcggcgttgaggttgcgcggccagctttgctccagccgtttcagcgggccgtccggctcgcgcagcgtctgcgcccagccggccagcatctgcctggcttcgtcggtggcggtggaggggaagctgcaggccacggtcaggctgcggacccgcgacggtgcgtccagcgccagctgctgcgccgccatgccgcccagcgacaggccgacgatgtgcgcttgcgccagatccagctgatccagcagcgcgacgcagtcggcggcgagattggcgacgccgtacgaggcgtccagccgcggcgaggcgccgtggccggcgaagtccggcgcgatcacgcggtagccggccgcggccagcgcctccagctgcggcagccaggcgcggccgctgttgcagatgccgtgcagcagcagcgcagccgggccgtcgccgtgagccaggtagtacagccgtcgattccggtgggtgtagtaagccatcgcggtctcctaagtgagcctggcggcgggcgagccgggggcggctggcgccggcggcgtcaggggtgggaaagcgggaaaagagaggggcttagccgggcgattcgccggggaagccctgcagccagagcttgagcaagccggccagttgagcgcgctgctcgggcgcgagcggcgagagcgcgtcttccatggcggcgacgtgtccttccagcgcgcggtctacccgttcgagtcctgccggggtcaacaagatgcgcagcgcgcggcggtcgtcgggattgggttggcgcgtcacccagccagcggcttccagccggtccagccgtttgctgacggcgccggaggtcagcatcaggctggtgtagaggtcggttggacagaggccgtcggcgccgccggcgcggcgcagcgtggccagcacgtcgaattcgccgtctttcaggccgaaggcggcgaagttgtcggccagccggttttgcaggtggatgaggaggcggcccagccggccgaccaccgccatcgcggagcaatcgacatcggggcgggcctgccgccattgctcgagtatgctatctagcttgtccatgaatgcatcatggcacaaatttatcttccttggaagttatttccttggaagatagtttcagtgctgctccggcagcagcttggccagttcggcggcgcgcgccgcggtggcggccagcgcgcagtcggcggcggccaatgcggcggcggtgccgccgtccgggtcggcgtagagacggcagttggcgtcgcggtattgcagccacagccgttgcgctgccagcaactgcggctggcgcggcttggccagcgcggccatcagcttgcggtagttgtcgttgagcgttttgtcctgcttgccatgctcggcggcgatgcagtcctgcatggcgacggtggagacggcggcgtccatgcactggtcgtaggcgcggctgtacagcgcggcttcgtcgccgcaggcgagtgcggaggaggatagcagcgccagcgacagggcggcgcagaggcgggcgtgggttttcatggcggacctcttgaagcggtgaaggctgggaatatagcagaaaccagcaaaaagcccggcatcgccgggctgtggtacgggatggagcgcttagagctgcagcgcgccggtcaggtcgcccggcggctgggcgccgcgctgatggaaggcctggttgcgcaccttgacgccctccagctccggcaggccgtgcaggcggctgatgaagcggatgatggaggtggtgtcgtagaaggtgtggtcgacatggcccttcttggcgaatggcgacacgatgatggccgggatgcggctgcccgggccccagcggtcgcccttgggcggggccacgtggtcccaccaaccgccgttttcgtcgtgggtgatgatcaccaccatattcttccactgcgggccgctcatcaggtgctgcagcacgttggcgacgtggcggtcgccgctttccacgtcggagtagccggcgtgcatgttgaggttgccctgcggcttgtagaaggccaccgccggcagcttgccggccaccgcgtcggcgatgaagcggttgctgatcgggctgtcgcccaggccgccgtcgcgtaggtgttcggcgcgggcctgggtgccgggcgcgaagttcttgaagtagttgaacggctggtggtggtactggaagttgggggtgtccgggccgcccttgccttccagcgccgcctgccagctgccgccgtaccaggcccagctgacgccctggcgcgacagcagatcgccgatggtgtcgtaggtttgcggcggcagggtattggcgtcggccgggtcggcgtagcgttggtcgccgccttgggccggcttgatgtagctgggttggaacggcggcgccatggtgttgaccgcatagccgtccggggtgatggcgccgttgttgacgaactgcggcgggccgtccatcgccgatgtcgcttgcttcaccttcagctggtagccctgcgggccgtcgtccagcacggcgatctttttggccgccgcggtgtccttggcgttgaagtattccggcgtgcgggcggaaatcaggaactggtggttcaggtaggagccgccgaaggccgccatgaagaagttatcgcacagcgtgtattgctgggcgattttccactggttgaggtttttcgcggtttcgctgtagtggcccatcaccagcgcgccggagtcggcccaggcgacgaactggtcgttcttgccgccgttgatctgcatctggttctggtagaacagatgccacaggtcgcgggtgatcacggcctccggcagcggctggccgtcggcgtccttcagcgggaaggggccgttgggcaggttctggatcgcgttttcgtctatcaggtagtacttgccggcgatggtctggccgcgctgcaccatgccgccccagatcttgggcagattcttcagtttggagccgtcgcggtccagctggatacaggtttcggccggcgcttgcgccagcggatgcttcacgccggggaagttgccgtacagattgttgaagctgcggttttccaggtagatcaccacgacgttcttcacatggtggcgcagcttggcgtccagcgggccgtggacggccggcgcggctgcggcgctttcgctgatggcggccggcagcgccgcggcggcgccgatggctgccaggccttcgaacaggcggcggcgcgacgggtcttgcggcgcggcatcggtcgggggatggaggggatcgtggtctgacatggcggctgtcctgtttccgttcgcaggggtcaaggaaaaacagccgccactttactccgcttccatggcaatttgaaagcgttcagcccttttgcatggcggcgcgcgcctcggccagcgggccgcggatctcctcgggcaggaattcggtgaagcgcgcctggccctgggccgggccgcgcagcagttcgatcggatcgcggccgtccacgctgccgaggttgggcgcgtggacgaagtagccgagcagccgctgcagccgttccggcagctcgctcgccagctcccgcggcaccgccaggtagtggttttccgcctggcgcagccagcctaggttgtagctgagcaccacgccggtgcgcggcgccgcgctgcggttggcgccgccggcgtggatgaccgagcccaggtagatcagcaccgagccggcctgcatcgcggcgcgcacgatttcgtcttcttgcgcctcgcgcccttccggccacaggtggctgccgggcgcgacattggtggcgccgttgtcctcggtgaagtcgtccagcgcgtacatgcagttgatcatgctttccgagcctggcaccttcactgggaacatcaggccgtcgctgtgcaggaattggcgcggctcgccggggccgatgcgtatcgcctgggtcaggttgagctggtattcgcggcagcccttcagcaggaaggcgtccatcacctgcaggatcagcgggtggatggccagctcgcggcaggccggcacgcgggcgatcaggccggacagccggcgggtggcgtagccgtagaaatcgccctggcagtcgggcgaggcgtccagcagcgggttcagctgctggcggaagcgtgccagcgcggccggttccagcaatcggtcgatgacgacgccgccgtcgcgctccagcgcggcgatgatgtcggcgggagaatggtcgggctggaaatgttgcagggcgggcacggcggctccttctattttattttgaaggggactatttgcgtcgaaatgaccttggcttgaaactggctattcgtacagtcagccgcggcgctgatgtgcgatcagcctggccaaggcctggcgcaccaccggattgtctatgctttcggcggcttgctccatgccgtccagcgcgttttcgctgatggccagggtcttggtttttttccgccgcgccagcttcagcatcaccttgaccttcaccttggcggccgggtagccctgtctggccagctgcggcagcaggccgggcgcgctcatgcgcagccgggcggcgacgatgccgttgtcggcgtacagcaccagctcgtcgtcgcggatgcgcaccgcgcggcaggcttcggccatggcttccgggatcagcttcttgaaggcgcggtccagcgccatcagctcgttggcggcggcggtgaggcgggccaggtggctgtcctggcgggtgatgtcttgtagcgggcgtccggacatgggatggggaggaaacggtcgatgccgcattgtagcaccgcgcggcgcgggcaaagaaaacgggcgccgttgggcgcccgtcgtgttcttggcggcgggagggtttactggccgccctccacatcctccaggctgaaggtttcggtgtggtcgttgtaggagaagatctcggcgtagcggccccagctgatcacggtgtccagcgtttcttccgccgcctggtcggacagcgagtcttccagctcctgggcgaagcgcaagcgcggcgcgcgctggccggggcgctcctgcagcaccttgcggatgtgggcggccatcggcacgtggcgcagcaggtgttcggcgaactgcaccttgcgctcctgggtgccgtagtcggcgaacagcttgccggcggcggtcagcaggatatcgccgtccttcagttcgacgaagcccaggtgttcgaggatttccgccaccgggaacagatcatccacctccagccgcagcttctcggcgatttccggcatgtcggctttgccgaagtaaggcgcctgcgccacttcctcgatcaggccggccatcaggttggtggacacctcgccgaggtggctgccgatttccagcggcagcttgtgcagcgtgtgggcgctgcggcgcgcggtcatcagcgcgtagatgtcgtccaccatcttgcggaaggccgggtccagccgattgcggcggtgcgggaacggcaccttgatctcggccaccacgcggccggggttggacgacagcaccaggatgcggtcgcacatgaacaccgcttcctcgatgttgtgggtgacgatcagcaccgacttgatcggcaactgcttgtcgctccacaggtccagcatgtcggtgcgcagcgtctcggcggtcagaacgtccagcgccgagaacggttcgtccatcagcagcagcgtcgggttgaccaccaggccgcgggcgaagccgacgcgctggcgcatgccgccggacagttcgcgcgggtaggcgttttcgaagccgtccaggccgatcaggtcgatggcggccagcgcgcgcttgcggcgctccttgggctccacgcccagcgcttccaggccggcctcgacgttttgcagcacggtcagccacgggaacagcgcgaaggtctggaacaccatcgccacgccttcggcggggccggtcagcggcttgccgcgatagttgacctcgccgctgctttgctggatcaggccggcgatgatgcgcagcagcgtggacttgccggagccggagcggcccaggaggccgacgatctcgccctcgtgcagcgtcaggttgacgtcgtccagcacctggatctcgtcgctgcccttggcgaagccgcggcagacgttcttcagcttgaagatttcttgtcccggggtggtggtgtcgtgagtcatgcttgccccttagttgagacggagtttgttttcggcgatggcgtacatcggacgccacagcaggcggttgaacagcaccacgaacagcgacatggtgacgatgcccagcaggatcttcgggtagtcgccggcggcggtggtctgcgcgatgtaggcgcccaggccgtgcgcgaccaccttgtcgttgccccaggacacgaattcggaaacgatgctggcgttccaggcgccgcccgatgccgttatcgcgccggtgacgtagtaggggaagatgccgggcagcatcaccttgcgccaccattgccagccgcggatgcggaaattggccgccgcctcgcggaagtcgttggggaaggcgctggcgccggcgatcacgttgaacaggatgtaccactgggtgcccagcacgatcagcggcgacagccagatgtcggggttcagcttgaaatggacgatgaacaccacgaacaccgggaacagcaggttggccgggaaggcggccaggaactgcgccagcggctggattttttccgccagcgccggacgcaggccgatcagcacgcccagcggcacccagaccaccgaggccagcacgatcagcaggctgacgcgcaccagcgtgatcaggccgaggccgagcacccgcagcacctccgccacgcccacttcgcgggcgatgaagtgcaccaggatgttggcgctgtagatggccagcatcgccacgccgaaccaccacaccacatcgatgccgcgcgacaccggggtgtgggcttcggaatggatgcccttgggcaggctgacattcagccgcagccgggcgatggtcttgatcagcttgccgaagggcttgagcagctgctggatgaaatgggtgcgctggatcaggttcagcacccacgattccggcgcggattggctggcggtgtcctccaggcggaatttgtcagcccaggccaccatcgggcggaacaggaactggtcgtagaccaagatcaccacggtcatggtcaggatcacccagccgacggcggccaggttcttgtcctggatcgccatcgccaggtaggagccgacgccgggcagggtgacggtcttgtcgccgacggtgatcgcctccgacgccaccacgaagaaccagccgccggacatgctcatcatcatgttccaaatcatgcccggcatcgagaacggcacttccagcttccagaatttctgccacggcgacaggcgcaggttgaccgagacttcctccaggtcgcgtggcacggtgcgcaggctttggtagaagctgaaggtcatgttccaggcctggctggtgaagatggcgaagatggccgcgcattccgcgcccagcacccggccggggaacaaggccaggaagaaggtgacggtgaacgagatgtagcccagcaccggcaccgactgcaggatgtccagtatcggcaccaacagcaggccggcgcggcggctcttggccgccagcgtgccgtaaatcagcgtgaacaccagggccgccgccatggcggccagcatgcgcaaagtggtgcgcagcgcgtattccggcaggttgccggggtccagcgtgatcggcacggtctgcagcgcggtgatcggcgcccaggtttcgcggatgccgctggtggccagcaacagaaaacccaggatcagcggaaacgcgatcagatcccagcggttgggtatcagcctccgcgcggtggcgggcatgaaatggcggacagcggtggtcatctggcctctccggtttaggggattgcgctggccgcggccggctgggcggcgggcggcccgcttgtattatgacaactctggaacgggaggcggcgccatggcggccatatccggtcccggcgggagagcgcggtgtcggttcgttgccgggaacgccccggttcagggcatggatgctaccagagaaggtataaaacggatgtgaaaaaccggggcgtatcgtgggtattttgtgacgaaatgtactagggcaaacggttggggagggcgccgccgcgccggctgtcgccgggcggcggcgcggccgcgtcacagcacgttgaccaccggggcgccggccagcacttccacggtctggacgctggcggtggcgggagatggcgcgacgccgccgaccagcttggccatcttgtggaaggcgcagctgagcttggccggcgtcagcgtcaccaccgcgtagccctgggcgtcgctgtcggcgtatttcagccaggggttgaaggtttgcagcgtggcggtgaaggtgttgaccgtctggccgttcgcggtctggtagatcagcggcttggccttggcgaaggccggcaccgtgtccaccacgttcttgaaatagctgaagaaggagttgctggagatgccggcggtcaccaggtccaccatcaccggggtcgggctggcggcgtcgaagtcgtccatcacctggccggcgaaaaaggcgtggatgtcgccggtgatgcccaccacattgccgatgttgttggttttcaggaaggccatcagcgccttgcgctcggcgttgtagccgtcccactggtcggcgttgaggatgtattggttcagcagcatcgacggcggcagcgcggcgtccagcgccggcttcagcgcggcggcgaataccggcgcggaaatggcggcgctgaagccggcgagcaagggctgggtgttggcgtaagtcagcgccggggtggcgccgctgacgtcggcggctttcaggtccaggtacagcgcgccggccagctgttgcagctggggggcgcttagattgagggcgaagttctgcgccagcgccggggccaggccctgcgccagcatgccggccaccgcctgggtgccgtccacgcccattctcagcagcgacacttcgttgccccacagcttccaggcgccggcggcgccctgcatctgttgctgccaccaggcgcgctggctgtcgcccaggatggacaccggctgcaggtcgccgccggctgcggcgatcttggcggcttcggtggccgacagcagcgcctgcggcacgaaatagcggctgccgatattggccagaccggtattggggactgagtcttcggagatgatgtggtcggcgcggtacagccgctggtcggtcatcaccagcgtggccagcttgccgaaatcgaagctacggtagatctggatgttctggaacgacggattggccagatcgatgctgacatcggccggcgtgtactcgaaccaggcctggttggcgctgcggcggcgcggtgtgttgggggtgtcgtcttcgcccggatagtagacctggcggtcctgccagcagtcgtcggagaattcgtggtcgtcccagatcgagatcaccgggaagttggcgtgcaccgcctggatgcgcggatcggcgcggtagctcttgtacaggtagcggtagtcggccagcgtggtggcgtagatcgcgccgtcggcgcgccgggtgccgttgggcagggtcagcggcggatggcgggtttcgttgccgccggtctggaagccggcgccgacggtttcgtagatgtagtcgccgacatgcatgacgaagtccaggtccagctgggcgatttcatcgaaggcgccccagtggttgacgctccagtcctggcaggtgatgtaggcgaatttcagctgcgccggcgagctgccggccgccggcgcggtcttggtgcggccggcggcgctgaccacgctgccggtgaggaagcggtaatagtagaaggtggcggcggacaggccggtgaccttgtggcgcaccgtatagtcccagccgggatcggcgctcaggctctgattgaccagcagattggagaagtcggccttgtccgacagctgcacggtgacggcgagcgggttgctgccgtcgccgccgtcgacgcgagtccacagcacgacgctgtccggacgcggatcgccggaagccacgcccaggtcgaagcgcttgccggcggcgttcaggtttctgccgcccgcgctgctgccgctgtcgtcgcctatgcatccgctcagtccggcgctggccgccgacaccgtcaggaaactgccccacttcagaaattgccgcctgtccatcgtttctccagagaatgtatgccgcaggtttcgcaaaatcgcgcattatcgccggcaaatatttaagcagcatgaatggttcggtcaattgaatcgagcgtttgctctatttgcgtggcggacggcgtagcctaaaaccaacagttgtttgttaccctgctcttgatgtggcgcatggatgcccccataaccttgtctgcgaatgtgctacacttttcagcattttttgcggacacactttccggcccgctggtttctggattcgattacatgatctcctcgctactcaagaaggtattcggcagccgcaatgatcgtctgctgaagcagttccgccagacggtggtacgcatcaacgccctggaacagggcctgcaagcgctgtccgacgaggcgctggccgccaagaccgatgaattccgcgcgcgcctgtccaagggcgagacgctggacgacctgttgcccgaagccttcgccgtctgccgcgaagcctcgcgccgcgtgatgggcatgcgtcacttcgacgtgcagctgatcggcggcatggcgctgcactacggcaagatcccggaaatgaaaacgggcgaaggcaagaccctggtggcgacgctggcggtgtacctgaacgcgctgtccggcgacggcgtgcacgtggtgaccgtcaacgactacctggtcagtcgcgacgccggcatcatggcgccgctgtacaacttcctcggcctgtcggtgggcgtgaacctgtcgcagatggcccatgacgacaagcaggccgcctacgcctgcgacatcacctacggcaccaacaacgaattcggcttcgactacctgcgcgacaacatggtgttcagcgtcgaagaaaaggtgcagcgcaagctggccttcgcagtggtggacgaggtggactccatcctgatcgacgaggcgcgcacgccgctgatcatctccggtccggccgacgacaacatcgacatgtaccagcgcatgaacgcggtgccgccgctgctcaagcgccaggaaaccgaagaaggcgaaggcgactactgggtggacgaaaaagcccacagcctgctgttgtcggaagccggccacgagcacagcgaggacatcctcacccgcatgggcctcttgaaggaaggcgacagcctgtactcggccaccaacatcacgctgatgcaccacctgatggccgcgctgcgcgcccacgcgctgttccacctggaccagcactacgtggtgcaggacggcgaagtggtgatcgtcgacgaattcaccggccgcctgatggccggccgccgctggtccgatggcctgcaccaggcggtggaagccaaggaaggcgtggagatcaaccgcgagaaccagacgctggcctcgatcaccttccagaactacttccgtctgtacggcaagctgtccggcatgaccggcaccgccgacaccgaggcctacgaattccagagcatctacaacctggaaaccgtggtgatccccaccaacaagcctatggtgcgcaaggacgcgcaggacaaggtgtaccgctccgccaaggagaagtacgacgccatcctggccgacatcaaggactgccacgagcgcggccagccggtgctggtgggcaccaccagcatcgaaaactccgagctggtgtccgagctgctgcacaaggccaagctgccgcataacgtgctgaacgccaaggagcacgcccgcgaagccgacatcgtggtgcaggccggccgtcccggcatgatcacggtggccaccaatatggccggccgcggcaccgacatcgtgctgggcggcaatccggaaccggaaatcaaggcggtgcgcgctgacgacagcctgtccgacgccgagaaaaacgccaaggtagaggccatccgcgccgactggaagcaacgtcacgccgcggtgctggaagccggcggcctgcatatcgtcggcaccgaacgccacgaatcgcgccgcatcgacaaccagctgcgcggccgttccggccgccagggcgacccgggctcgtcccgcttctacctgtgcctggaagacccgctgctgcgcatcttcgcctccgagcgcgtcgccgccatcatggaccggctgaagatgccggaaggcgaggccatcgagcacccgtgggtgacccgctcgatcgaaaacgcccagcgcaaggtggaaggccgcaacttcgacatccgcaagcaattgctggaatacgacgacgtcgccaacgaccagcgcaaggtgatctaccagcagcgcagcgaaatcctggtggaagaggacgtgtccgacgtggtggtgaacatgcgcgaaggcgtgatctccgatctggtcgacctgcatctgccgccggaatcgctggaagagcagtgggacctggccggcctggagaagacgctggccgccgacttcctgctggaggcgccggtggcggcctggatgcaggctgaaaccaccctggacatcgaacatatccgccagcgcatcatcgatctggccgccgcggcctaccaggccaaggtggagcaggccggcgacggcgtgatgcgccagttcgaacgcagcctggtgctgcagatgctggacaaccactggcgcgaacacctggcggcgatggaccatctgcgccagggcatccatctgcgcggctacgcgcagaagaacccgaagcaggagtacaagcgcgaggccttcgagctgttcgccgacatgctggagcgcatcaagcgcagcgtggtgcaagtgctgatgacggtgcagatccgcggccaggaagacgtggaggcggtggagccgcacgcgctgccggagtttgaaatgcagcatgccgagccgggttcggcgctgggcgacgacgaggacaatccgctgtcgccggaagcgctggcctcgcaaggcctgcgcatcaaccgcaacgacctgtgcccgtgcggcagcggcaaaaagtacaagcagtgccacggccgtctggcttgatggcctgagtggcaaagcgaaaagccggcgcgtgtgcgccggcttttttcatgggtggatgatcggagccaatggcgacgaggctacggggcgtcagcggccagagagcgagagtggcgggctgaggttggctagtgcgtgttagagccgtggcgaatgggcttgggaacgagggcctaggcaggccctgcttggcgggtgctgttgggagagtgttgtcgggaggggcggagagagatggcggagaccatccgctctcctggatgcgcgtcaggagctgcgctgtggattggccgcggtactggcgccgaccggcgattgctgcttgatctgctcattgatcatgatccagcgcggggtgcggaagcggacgatcgatttgtacagataggtgtagctgagcacgaagagcgcggcgaaagccatcagcacgtacttttggttccagaacagcatcgctggcaagacggagctggaggatagcgcccacagatacggcgaagtcatgctgttgcgctgggtcaggtgcttggcttctttggacgccaccatccacagcaccactcttttgtagatgatctggtgcaggtgcagcgcatccgggtggccgatggagcgcttctgcaggaacttgcggcggtaaatggtgaacacggtctcgaagaccggataaatgaccaccagcagagggaaccacggcgagacattgggatgcctggcgatcagtaggatggaaatctccgcgacggcgaatcctgtgaggtaggcgccgccatcgccggcgaaaatcaggccgcgagggaagttgagcagcaggaagcccgatatcgcgcctatcatggcgaagcaaagcgcgatcaggaatgagtcgttgaccttgaaggccacgtaagcgagcgccagcagggtgagaatggccaccgtgccggacaggccgttgtagccgtcgatgatgttgaacgcgtgagccacgccgccggcggcgaaaatcgtgaacaggaaggccaagggcgcgtagttggcgagcaggtggtccagccaggggatctcgacacggttgatgctgccgtgcagcaggtaaaagactagcgccgcggagacgaaagtggcgagcaggcgaggcagcggaccgattcttttggtcaagtcctccgtcaggccaaatgcgaaggcgggcagggaggcaagcatgaagtacagcgcctcgacggaggcgtggagtacgccggcgaccgtcagtccgaccgaaaagcccaggaagatcggaatgccgccgatgcggggaacaggacaggcgtggaatttctggatgcctgccatatcgctgtcagccgagtatttgctgtgcaggtagttgtagcgcaccaccagtatcgccaagatgaacgaggtgaatagggcggagaagagaataagcagcatagtgttctgtttcgatatccaactcgggggccaggcggaccgctgggccttggcataaccaaaaacatcgctaatctgaaaactgccggcgcgccggaccgggtacgcggatggatgtccaggcaacttccccgcttgggcgcttcaacggtttggaatggggccagacgccattggttccataggcgtcatggcattaccatcggttggtctcgcttttcacgcagcttgcgcggcggcgccatggcaaagccgtgggcgacacagacgctcgatagcgaatggcggcgccatccccgttgattttcaattgtatcgtaaaaatcctgttgcaggatggcgcatgccggttgtttggagcgatctgtggcgcaattcttacagataaggcttgatggcggtttccagccgcttttcatccagttttcctgtcaacgcggcggcgactttgccactgcggtccagcaccagcgtgtacggcaggccgccggtcttgttgcccaggctgcgcatcagatccagcgtgtcgtcgttgcccagcaggatgggatagccgatcttcagctgcttgacgaagggttccacctgctccttgctgtccagcgccacgcccaccacttccacgcccttgggcgccagttttttgcgcaggccgttcagcatcggcatctcttcgcggcacggtccgcaccaggtggcccagaagttcagcaccgtcaccttgcccttgtaggcggcggtggtggcgggcttggcgttcaggtcggtgaagcggctttgctccagcgtgggggcggcgtgggcggccagcggcagcgcggcgatcagcaaggcggcgaacaggcgttttgatttcatcggcttatcctgtgatgtcattggaattgtcttgcgtttccgccacttgcggcggacgagactgctgcaaaaattaactttatgttaaaatggtcgattgattcttttgcggagtgggcatgtctatcctcgtctgcggggcgctcgcatacgataccctgttctcgttccatggccgttttgacagccagatcctgccggatcagctgcacaagatttccaccacctttttggctcccaccatgcgccgcgagttcggcggcatggccggcaacatcgcctacagcctgtgcttgctgggcgagaagccgattgtgatgggcgtggtgggcgaggacttcgaaccgtaccggcagcacctgaaacgggtgggcgtggatgaccgcttcatccgcctgatccgcaagcagtataccccgcaatgcttcggcattgccgacaaggacggcaatcagctgatggccttccacccgggcgcgatggatttcgctaccgagaaccacgtgtccgacatcccggatccgatcgagttggctatcctgtcgccgggcggttacaccgccttcatccagcattcgcgcgagctggcggcggccgggatcccgttcattttcgatccgggccaggagttgccgctgttgtcgcgcgacgagatccacgagatcgtcgatctggccagctatgtggcgatcaacgattacgagagcgagttgatgcgcgaacgcgccggcctgacggtcgacgacctgcgcaagaaggtgaaggcgttgatcgtcacccgcggctccaagggcgccgagatctatgtcgacgataccgtgcacctgattccgcgtgtgcagatgcccatcaagccggtggatccgatgggctgcggcgacgctttccgcgccggcctgctgtggggcatcagccgcggcgtggattggaagatcactggccggctggccaatgtgatcggcgcgatcaaggtgaccacccatggctgccagaaccatttcttcgattgggattcgctgaaggatttgtatctgcaggcctatggcgacgaatggccgctgtaagctgttttttgctgaaaaagcgccgcgttcgcggcgcttttttcattttccggcgcgatgccggcggtgtccccgatttgggtttcaggtaaggctgctgacctactagagtataagcatggtctgctctactggcatttatgtcagcgtattattgcggggtcgcgcgcagccccgcgcggggcgctcggggtaaactgcaggcccggaacattccggactcgtcgcatcggcaatggatgcgcattggccagccgccgcgcgcggtgggtggcgttgcgcaatttctgtaatgacgatgggttaaagtgacgctgggcaatgcttttccacgcaggtggtcgatgcctggcccgcttcgggcctgggcggcgcgcgcccctgacgtcgatcgttgcgcggcaagagtgagagggtggcttgaatatgccggccgccatccccaccattaatcaattgatcctgatgatcgtagcttgcaaggggaagtcatgccacccgttccgcacctggccaccgcacttaccggccctctttacgagttggaaagccgcattctggcggcccaaccgcagatcgaacactggttccgcagccagtggcacgcccacgccacgccgttctatggttcggtcgatctgcgcaacagcggcttcaagctggcgccggtggacatgaacctgttcccgggcggccataacaacctgaatccggaattcctgccgctggcggtgcaggcggcgcagagcgcggtggacaaggtctgcccggaagcgcgcagcatcctgttgattccggaaaaccacacccgcaacactttctacctgcagaacgtcgccaccctggtgcacattttcgagcaggccggcctcaaggtaaggctgggttcgctgaacccggaaatcaccgagatcaccgaactggtgtccgccaacggcgacaagctgacgctggagccgctggagcggcgcggcaaccgcctggtgctgtccgacggcttcaatccctgcgtggtgctgctcaacaacgacctgtcggccggcatccccgatctgctgcaaaatctggagcagacgctgctgccgccgctgcatgccggctgggcggtgcgccgcaagacccatcatttcgaagcgtacaacaaggtgtgcgacgacttcgcgcggctgatttccatcgatccgtggacgatcaatccctacttctccagctgcggcggcctggatttccacgcccgcaccggcgaggagcaactggcggagacggtatcgcagatgctggacaagatccgccgcaaataccgcgaatacggcatcgacaacgaccccttcgtcatcgtcaaggcggacgccggcacctacggcatgggcgtgatgagcgtgaagagcccggacgaggtgatcggcctgaaccgcaaggcgcgcaacaagatgtcggtggtgaaggaaggcctggaagtgtccgaggtgatcgtccaggagggcgtgtacacctttgaaaccgtcaacgaggcggtggccgagccggtggtctacatgatggaccgctatgtgatcggcggcttctaccgcgtccacaccggccgcggcatcgacgaaaacctcaacgcgccgggcatgcacttcgtgccgctgtcgttcgagacgccatgtttgccggaccgcaagggcttgccggactgcgcgcccaaccgcttctacgcctacggcgtgatttcgcgcctggcgctgctggcggcttcgctggagctggaagccaccgacccggacgcctgatgccgcaaggctccgccggcgcggcgggccatgccattcgtattggggtaaaatatccgcagggaaagcatgcagcggtcccgcataatattttcaaccatggatggcggtccgccggcggcggacaagcagaggcaatatgaaaaaactggtttttgcaggtttgatggcgctggcgaacgtgtgcctggcggatggcgtggtggtgaaggtgtcgccggtggcgcaatatggcgacccggtgcgcatcagcagcaatatccgcaacgagtgcgcgctgccggaagcgcaggccgccgccagcctgaaggggctggaggaggccggcatcagcgccgaagccgcgccggaagaccagctgaaacagtccggctattacctgaagctgcggctggagaacgtggtgtcgatgggcaacgccttcatcggccaccacaagtcggtctccatgatcgccaagctgtacaagaacggcaagctggtggataccttcaccggctcgcgcgactcgatgggcggcatcatgggcggcttcaagggctcctgctcggtgcttgagcgctgcacgcaaaccttgggcaaagacctggccgcctgggtgaaaggcaaactggacgcctgaaccgcgcccgcggcgcttacgccctccataactggaaagattccatcatgagaatactgttcatcgccgacccgctggagcacttcaagatctacaaggacaccaccttcgcgatgatggaggaggcgcatcgccgcggccacgccatcagcttcgccgaggcgcaccagctgtcggtggagggcgagcgcatcctggtggacgcgcacgatctggcggtaaccgacgagcgtcccaactggtacaagctggggcaagtgcagcgccagccgctgaccggcttcagcgcggtggtgatgcgcaaggatccgccgttcgacatggagtatctgtacgcgtcgcagctgttcacgctggcggagtcgcacggggtcaaggtgttcaccagcggccaggcgctgcgggatttcaacgagaagctggcgatcctgaatttcccggagctgatctcgccgacgctgatcagcggcgaagcgcaccggctgcgcgccttcgtcaagcagcaccaggacgtgatcctgaagccgctggacagcatgggcggcgacagcatctttcgcgtcaagccggacgatcccaacctgtcggtcatcattgaaaccatcacctggcgcggcaagcgcaccatcatggcgcagcgctacattccggaaatccgcgatggcgacaagcgcatcctggtgatagacggcgtgccggtggaccactgcctggcgcgcatcccggccgccggcgaaacccgaggcaacctcgccgccggcggccgcggcgaagccaggccgctgtccgagcgcgaccgccagatcgccgagacggtagggccggagctgaagaaacgcggcatcctgctggctggcctcgacgtgatcggcaactacctgaccgaggtcaacgttactagccccacttgcttccgtgaaatcatggaccagaccggcatcaacgtcgccggcctctacatcgacgcgctggagcgccactgccagcactgaggccgggcgcggtctggccatccggcccgccgcgcgttaccatgcaccccgtttgccgttaacggcgcatgcaggctgaggatgggagtgtgacgatgggaaagacgcaggaaagcccgttcaagggcaagaccggcctggccaggctgatcaacgcctttggttattcgctggacgggctccgggccgctttccgccacgaggacgcgttccgccagttggtgctgctggcggtcatcctgatcccgatggccttcagcgtccacgccgcgccgctggcgcgcgcgctgctggtggccagcagcctggccacgctgatcatcgagctgctgaactcggccatcgaggcggcagtcgaccatacctcgctggaacgccacccgctggccaagcgcgccaaggacatgggcagcgccgcgcagctgctgggcctgatcaatctggcggtggtgtggggcctggtgctgttcggctgagtccgggaaccccggcgcctgcgccggttctgaacaataaggaagccccgctcgcggggcttttttcatgatccgaacaggaggggcgacgatggtgtctccgcaacaggctggcgcggaagaggcggtggcgaatctggtgctgtggctgaagctggcggtggaggccggcggcgcgttggtgatcgcagccggcgcgctgttattggcgatgcgctatttcacgcagcggctggccggcggcccgcccgactacaaccggctgcggctgggtttcgcccgcatgctggcgctggcgctggaattgcagctggcggccgacatcctgtccaccgcggtggcgcccagctgggaccagatcggcaaactgggcgccatcgccgtgctgcgcaccgcactcaattatttcctggcgcgggaaatccgcgaggccgaagccggccgtgccgccggctgatcagggcaggcggcggtacaagtagccgggatagacgcggatgcagccgggctcctcggccacttcgccttgctcgcccaggaattgccagcgcgaatcgcgcgcgatcagcatgcggtacaccgggctgccggcgcggtagaacatcaggccttggccgcggaaggcgtccagcggcagcaagggccgctgtgaggccgggatcagcatcgcggtggcgtgcaacgtcatgtcggccaactgctcgcggtcggcggcggacaggccgatgaaggcgatcaggaaggccacgggcaggatcaggtattgctgatcggccagaccgaacaaggtcaggatggtggagccggtgaataggaagtggctgctgattttcatgcgcggcgatctcaaaaacaaaacgccgccggccgatcattcccggcggcggatgcgttgcgatgatagcgcagactgcttgtcttaacgcaataaaatcagtatgttgaccatgatgccggcttgagtccttgcaagccgcggcttggcgcgcgcaggccaaaaacgcaacggcagccgtaaaaaaaccgcccctgggggcggttttgccgtcgcgctcaggcctcttcggccggcgcggcttccttgccttccggcggcgcgatctgctcggcgtagccgcattccttctgcgggcacaccttctcggtgccgcggcgcttggtcaccttgatggtcaggatcggccagccgcactgcgggcacttctccgcgatcggcgggttccaggtggcgtacttgcacttgggataggtgttgcagctgtagaacagcttgccgtagcggctcttgcgttcgatcaggctgccggtcttgcattccgggcattccacgccggtgtcgcgcggcttttccagcggttcgatgtgcttgcacttcgggtagttggcgcagccgatgaacttgccgtaacggcccttcttgatgtgcagctcgccgccgcagtccgggcaggagcggccttcgatcaccgtcggcgcctcagcctcttctgccgcttgttccgccgtttcgcccaggttgcgggtgtaatcgcattccgggtagccggtgcaggcgatgaagcggccgcgcttgccgaacttgatcgacagcggcttgctgcatttcgggcaggcttcgtccaggctttcggtggtgacttcggcgcgggagatgctttccttctcgtcgatctgcttcttgaagcctttccagaagctgtccatcaccggcacccactggcggttgccgctggcgatttcgtcgagctggttttccagcttggcggtgaagttgtagtcgacgtactgggcgaagtgctcggtcaggaacttgttgacgatgtcgccggtgtcggtcggcaggaagcgcttcttgtccaggatcacgtactcgcggtccttcagcgtcgagatgatgctggcgtaggtggacgggcggccgatgccgaactcttccagcgccttcaccaggctggcttcggagaagcgcggcggcggctgggtgaagtgctggtcgccgtagagcttgtccaccggcagctcttcgccttcggccagcagcggcagcttggcgttgtcttcgtcctcggcgtcgtcgacgtcctcctcgtacacggcgaggaagccggcaaaggtctgcacctggccgctggcgcggaacacgccttcccccaccaggatgtccacgctggtggtgtcgaacttggccggcgccatctggcaggccagcgtccgcttccagatcatgtcgtacagcttgaactggtcggtggtgaggaagggcttcaccatctccggcgtgcgcaggatggaggtggggcggatcgcctcgtgcgcctcctgggcgttcttggccttgctcttgtagacggcggggttcttcggcaggaagtcggcgtcccatttcaggccgatgtagccgcggatttcctccaccgcttcattggccagcgccaccgagtcggtacgcatataggtgatcaggccgacggtgccctggccgatgtccatgccctcgtacagctgctgcgcggtgcgcatcgcgcggtcggtggtcatgcccagcttgcgcacggcctcctgctgcagcgtcgaggtggtgaacggcgcggccgggctgcgggttttctttttcttctcgatggcgccgacctgggccggcttgccggccaggcgcgccagcaccgaagcttgctcggcctcgttgggaatggcgaactggtccagcttgacgccggcgagggtggtcagcttggcggagaatttggtgcggctcttgtggctgtcgagatggaccgaccagtattcctgctggacgaaggccttgatctcgttctcgcgctcgcagatcagccgcagcgccggactttgcacccggccggcggacaggccgcggcggatctttttccacagcagcggcgacagattgaagcccaccagatagtcgagcgcgcggcgggtctgctgggcgtccaccaggtcctgggcgatctcgcgcgggttctggatggcttccagcaccgcgttcttggtgatttcgtggaacaccacgcgctgggcggccttgtccttcaacagttttttcttgttgaggatttcgaccaggtgccaggagatggcttcgccttcgcggtccgggtcagtcgccagatagacgtggtctaccttggcgacggcgtccacgatggcgtcgacgtgcttgctgttgcgcgcgatcagctggtacttcatcgcgaagtctttttcgggatcgacggcgccgttcttcggcaccaggtcgcgcacgtggccgtaggaggccaggacttcgaagtccggacccaggtatttcttcagcgttttcgccttcgacggcgattcgacgatcaagaggctggtgggcatgttatcttttcaatttcaagccggggtgaccggcggacacatcttgttatatccgtcaaacaaaacaagagcgcaagggcgctcttgatcacggaaagccgcttggccgaacggcggcatgttaagcctcgccgcctggcctgacaagttattgcatggtgggctcgccgtgcaccgcttccagcagcgcttcgccgagcagtatcggcagttccgcctgttgcgcccacaacaccatcagcaccagcagtttggcgttggcgacgtccaggtcttcgccgtccagctccagcaggcggtctatcaccatctcgcgctgcgacggggtcaacgcgccgttgtcctccagaaactggatcaggccgcgcacgtcggcgggcaggtgctccagctcgctgtcggcgtagacgcgcaggccgctgccttcgtcggcgccggcgtaggcttccacgctggtttcgccgacgctgtccagccagtccagcgcttcgccgatgtcgtcatcgtcgaagccgacggcgttcagctggcgggtgagggcgttgcggtcgccgaaggcggcggggtcgctgtattgctcgaataaataggtgagtacgtcaaacatcggtatttttcattggagaacggcatgcgttcaggttcgagccagcctttgaaagcggccgccggcgaggctggccacctggccgtccagctccagttcgagcagcatcgcgtaaacctccccggcagtcaacccgagcgcgtccgccaggttctcggccagcgccggttcccaacccatggcgtccagcagcggcgcggctttcccgccgtccggcgcggcttgttcgacctgccgcgccgacaggcggccgacttcgtccagcacgtcgtcgacgctttccaccagccgcgcgccgtccttgatcagctggtggcagccgcgcgcctgcgggttgtggatgctgccgggaatcgccatcacgtcgcggttgctttccatcgccagccgcgcgctgatcagcgagccggaggcggtgccggcctccaccaccaggcagccgcgcgccaggccggcgatgatgcggttgcggcgcgggaagtgcccgggcagcggccccatgcccagcgggaattccgacagcagcaggccttcggccgcgatgcggtgggccagcgcgcggttgccggccgggtagacccggtcgatgccggtgccgaccaccgcgatggtggacgcggggtgggcgagcgcgccctggtgggcggcggcgtcgatgccgctggccaggccgctgacgatggtatagccgtgcgccgccaggccggcggcgaagtcctcggcgttgcgcttgccctgcggggtggcggcgcggctgccgaccaccgccagcataggccgcgccagcagctcgcgccggccgcgggcgaacagcaagggcggcggcgacgccgcttcggccagttgcggcggataatcggggtccagcagcgtcagcaggtggcagccttcgccttcggaccagacctgcgcggcctccaccataggcgcggccaggtcctgctgcagcgcgtcggcggcctcgcggccgatcagcttttccgtctgggcggcgcgggcggcggcggcgtgctcggccgagccgaaggcgtcgatcagcttgagaaagccgaccgggccgatgccgggagtcagcgccagcttcagccagggggcgctcattcggcctccggcgcggcgatgccgtcgccgacatagatggcgctggtgctgtccagcactagcgcgtaggaaaccttgtcgaacacgcggtagacgaacagcttgccggcctgttcggtcggcagctgcgtgcggcggggcttgccgtccggaccgtcgatcatgatgtcgccgcctttcttgtagatgccgaacaccaggccgggctccatgccggcctggctgcccaggttgaccgcgacggttgagtattgcgccgcgccgtctatgccctggtaggtgctgatgatcttgccgcgcaggcctggcggcggcgaatgcggcacgtagttgacgaactgctcgcgcggcgcgcgcaccagatggtcgccgatcaggatttcaccggccacgcgccggacccgcagcgtctgcacgtcgcggcccagcttgtccgccaccaagtcgccgctgtaggcggcctcgacgcccagcaccgcctggctgtcggggtcgagcagcggtttgcccagccggtaggcctgccaggtgccggtttcgccgacgccgctggcgtagaccttgtcgccctggctgatgctgatgcgctcgtcggggccggccaccagccgcggcgcggtggcgaattgcgccggatccaccaccagcgggcgggcgaggaagggttctatcgcctcggccgggatgctggcgatggcctggtcctgttgctcgggccgcgcctgcggcgacagcttgacctcgcgcaggctgtcgccggccagcgacaagcgcgggcggccgtcgacgtaatccagcgtcagcacgtcgccgggatagatccagtgcgggttcttgatgtcggcgcggttcatccgccacagctcgggccattgccacgggcttttcaggtagcgggcggaaatgccccacaaggtgtcccctctggccaccgtgtagcgggccggcgcgtcgggtttgaccgtcagttcgtcggaaaaggcgggaagagccagccctagagccagagcaagcgatataatgcggttacgcatgaatgaatcccaatcttggtgccggcaggcccggggcccggagcggggacggaacgaaagctgcgtcggatggctgtattatcggcgcgggcgcggcaatacgacaacttggagtgaataaataccaatggcgctgttgaacattttgcattacccggacgatagactgcacaccgtggccaagccggtggaggttttcgacgccgcgttgcagcagcagatcgacgatatgttcgagaccatgtacgaagccaagggcataggcttggcggccacccaggtcgactaccaccgccgcctggtggtgatggacatctcggaagagcgcgacgagcgccgggtgttcatcaacccggaaatcgtcgagaagaacggcgaaaccgtttacgaggaaggctgcctgtcggtgcccggcatctacgacaaggtgacccgcgccgagcacgtcaaggtgaaggcgctggatcgcgacggcaagccgttcgaactggaggccgacggcctgctggcgatctgcatccagcacgagatcgaccacctgaacggcgtggtgttcgtcgagcggctgtcgcagatgaagcagacccgcatcaagaccaagctgaaaaagcgcgaaaaacagaatatgtaagccaggccggatggccaggagcaggcggcgccgcgcgacggcgccgctgtcatttagcggaaagccctgacgatgaaactgatttttgccggcacgccggaattcgccgccgccgcgctgcgcgagctgatcgccgccggccatgagatcgcgctggtgctgacccagccggaccggccggccggccgcggcatgaagctgaagcccagcccggtgaaggaagtggcgctggcccacggtctgcgcgtcgagcagccggaaaagctgcgcggcaacctggaggcgcagcagatgctgcgcgacatcggcgccgagctgatggtggtggctgcttacggcctgatcctgccgcgggatgtgctggagattccggcgcgcggctgcctgaacatccacgcctcgctgttgccgcgctggcgcggcgcggcgcctatccagcgcgcgatcctggccggcgacggcgaaaccggcatcaccatcatgcagatggacgtcggcctggataccggcgacatgctgagcatccatccgctggcgatcgccgccgacgaaaccgccgcctcgctgcacgacaagctggccgcttgcggcgcgcaagccatcgtcgagactctgggccgcctggacgcgatcgcgccgcaaaaacagccggaagacggcgtcacctacgcgcagaagctggccaaggccgaggcggaggtggactggacgctgccggccgaggacgtcgcccgcgccatccgcgcctacaatccggcgccgggcgccttcaccacgcttggcggcgagccgctgaagctgtggatggcggttgccgaggccggcgccgcggagccgggcgcggtggtgtcggccgacgccgacggcgtgctggtgggcgccggccagggcctggtgcggctgaccgtgctgcaggcggccggcggcaagcggctggcggcgcgcgatttcgtcgccggcaagagcctgccggcgggaacccggctgggcgtttgagtttccaagcctctggaccacaaagcagataagggtagaacatgaacgacaactggctgaagaccacggtgctgatggccgcgatcatggccttgttcgcgttgataggcggcatgataggcggcaaggcggggatgctgctggcgctgctgttcggcggcggcatgaatctgttcgcctggtggaattccgaccgcatggtgctgtcgatgtacaacgcgcaggaagtggacgccaatagcgcgcccgagttctacggcatggtggcggagctggcgcagcgcgccggcctgccgatgccgcgcgtctacgtgatccacgaggagcagccgaacgccttcgccaccggccgcaatccggaaaacgccgcggtggccgccaccagcggcatcatgcgcatgctcgactaccgcgagctgcgcggcgtgatggcgcacgagctggcccacgtcaaacaccgcgacacgctgatatccaccatttccgccaccatggccggcgcgatctccgcgctggccaacttcgccatgttcttcggcggccgcgacgagaacggccagccggtcggcctgctgccgcgcctggcgatggcctttctggcgccggtggcggccagcctgatccagatggcgatctcgcgcgcgcgcgaattcgaagccgaccgcggcggcgcggagatttccggcgacccgctggcgctggcgtcggcgctgcagaagatcgagtactacgcgcagggcatcgcgatgccgacggccgaggcgcacccggaaacggcgcagatgatgatcatcaacccgctgtccggcggcgggggcctgggcgacttgttccgcacccacccgcacaccgccgaacgcatcgagcgcctgaacgcgctggcgcgcggcgcgtattgaacgtttatatttgaaacagccatgagggccagttccgcgcgggactggccttgttttatcgaaagacacgccatgcatcatatccagcagctggccgcggacattctgggccgcgtcgaggccggcaccactctgaccgaggcgctggccgccgcccaccgccaggcgcccaatctatccgccgccgagcgcggcgcgctgcaggatctcagctacggcagcctgcgccacctgggcgcgctgcggcaccatttgcgccagctggtgcccaagccgctgcccgagccgcagctggagcgggtgctggtcatcgccttctatcaattgcagcacacccgcgccgccagctacgcggtggtcaacgaggcggtgacgctggccggcacgctggccaagggcaatttcaagggcctggtcaacggcgtgctgcgcaatttcctgcgccggcgcgacgagctggtccagctggccgagcgcgatccggtggccaactgcaaccatcccagctggtggctgcagcgggtgcaggccgcttatccagagcaatggcggcaggtgatggccgccgccaactcccacccgccgctgacgctgcgggtcaaccgccgcgacggcgccgcggccgactacctggcgcggctgcgggccgccggcatggaggcggaagcgctgggcggcgaggcggtgcggctggccaagccggtggcggtgcgcgagctgcctggcttcgccgacggcgcagtgtcggtgcaggacgagggcgcgcagcgcgccgcgcactggctggacctgcagcccggccagcgcgtgctggacgcctgcgccgcgccgggcggcaagaccggccacatgctggagctggccgacatcgagctgacggcgctggacatcgacgccgcacggctggcgcgggtggcggacaatctggagcggctgggcctcaccgcccagctgcgcgaggccgacgccgcccggcccgacagctggtgggatggccagctgttcgaccgcatcctggccgacgtgccgtgctcggcctccggcgtggtgcgccgccatcccgacatcaaatggctgcgccgccccggcgatttcgccgcgctgggccgccagcaggcggcgatggcggacgcgttgtggcccttgctcgccagcggcggaaaaatgctatacgctacctgctcgatttttcccgaagaaaaccaacagcaattggaaagcttcctgcagcgccacccggatgcggcgtgcccgaggcaggagcaactgctgccctgtgagcgtcatgacggcttctattacgcgctgcttgagaaacattagcctgctgctgggcctgctgtgctgtctgattccggcggcgcaggcggacgccatcgcgccgcgccgcgccgaagccgaagtgatggctgacggcacgctgtcggtcagcactcggtttctcaccaagctcacccccagcctcagcgaagcgctgcagcagggggtgtcgctggggtttcggctggagttccagctgatcaagccgcgcaccaccgcctattacctgagcctgcgcgagtggttcgacccgcacgcgcagctcagcttcaaactgtcctaccagtcgctgaccggccgctaccgcgtcagcatcggcagcctgtccaattactaccccagcctgcgcgaggcgctggcggctatcggcgcgatccagggctggcgggtgctcaatcccggcacgctggaccccagaaagccgggccaggtggccggccaggtgcggctgctgctcgacatcggagatttgcccaagcctttccagatgaatgcgctgggctccgacgactggtcgctggattccgactgggtcaagctcgacatcaaggacggcggctgatgcgctacgccaccatcgcgatggcgacgctgggggcgatcctgctctacctgctggccgtggccaccggcaacgcctcaaagctcaacgactactactggtgggtgttcggcctcaacagcctgctgctgctggccctgctcagcgtggtgggccgccagctgtggcgcttgcgccagcgggtgaagaaccgggtgttcggcgccaagctgacccagcggctggcgctgatgttcgccggcgtggcgctggtgcccggcctgttggtgttcaccgtgtcggcgcagttcctcacccgcagcattgaaagctggttcgacgtccgcgtcgaggcggcgctggaccgtggcctggtgctgggccgcagcgcgctcaactacgtgctggacgatgtcggccgcaagagccggctggttctggacgaggtggagccgctgccggacagccagctgccggcgcggctggagcgcctgcgcgaacaactgggcctgcgcgaggtcgccatcttcaaccgcggcagcggccagatgctggccttcgcttccgcgtccgcccggccgcaggggccggcgccgacgcgcgaggccctgcgcgcggtcaagctgcgctcgccgcagcaaagcatagaaaacgacggcaacagcggcctgatgctgcgggtgctgctggcctaccggatgccggacgagcaggtgcgcgtgctgcagctgcagcaggccgcgcccgccgacatcagccgcgacgccgagcagatcgaaagcgcccgttccgaataccgccagctgctgctggcgcgccacggcctgcgcaccttctacatgctgacgctggcgctggtggtgctgctggcgctgaccgcggcgctggccttcgcgctgttcctgtcggaacggctgtcggcgcccttgtccgagctggcggccggcacccgggcggtggcgcagggcgacttctccaagcgccatccggtgtaccgccgcgacgaattgggcatgctgaccacgctgttcaaccgcatgacgcagcagctggacgaggcgcgccaggtggcggacaagagccgcggcgagctggagggcggcaagctgtacctggaaagcatcctggccaacctgtcggccggagtgatagccttcggccgcgactggcagatccgcgccgccaataccagcgcctcgcgcattctgggggtggagttcaatcatctggcggagcaccgcttcccggagtggggcgaggtgatgccggcggtggagccgctggtggcgaccgtgatggagcataccgacagcgatgtggaaagcgactggcagacccagctgaactatgaaaccagccagggcgagcgcacgctgctggtgcgcggcgcgcggctgccggagcactccagcgacggctacgtgctggtgttcgacgacatcaccgaactggcccgcgcgcagcgcgacgcggcctggggcgaggtggccaagcggctggcgcacgagatccgcaacccgctgacgccgatccagctgtcggccgaacggctggcgatgaagctggcggacaagctggaaggcaacgacgccgacatgctcaaacgcgccaccgacaccatcatcaagcaggtcggcgcgctgaaaagcatggtggacgcttttcgcgattacgcccgcgcgccgcggatcaaactggtcaaacttgatctcaatcaggtgatccgcgaagtgatgaccctttacgaatccaatcctgctgttaagattgcgctggacgaggttccgccgatgatcatgggcgacgccgccctgcttcggcaagtgttgcacaacctgatgcagaacgcccaggatgcagtccttgacgttggcatcccgatgattcaaattagcagccgacaagaagaaggaaacgtgctcgtttgcgtcgaggacaatggcgcgggcttcagccccgacatcctccggcgcgcgttcgagccttatgtgaccagtaaagccaagggaaccggtcttggactggccgtggtcaagaagattatggaagaacaccatggacaggtcattttggggaatgccgaacagcaaggtgcgcgcgtccttctctccctgccattgctggaggcctaatgcgtagcagcgatattttgattgtggacgacgagatcggtatccgagaactgctctccgagatcctgcaggacgaaggttataccgtggccctggcggaaaatgccgaagtagcccggcagttgcgcaaccagacgcgtcccgcgctggtgctgctcgacatctggatgccggattgcgatggcgtcacgctgctgaaggagtgggccaagtccggcctgctcaacatgccggtggtgatgatgtccggccacgccagcatagacaccgcggtggaggccacccgcatcggcgctttcgacttcctggagaagccgatcgcgctgcagaagctgctgaccaccgtgcagcgcgcgctgaaatacggcgacatgcaggccaacacctcgttgaacctggacaagctgggccgcagcgagcctatccaggagctgaaacgccagctggaacgcgtggccaaggtcaagtcgccggtgctgttgaccggcgagtccggctccggcttcgaactggtggcgcgctttttccaccagggcaacacgccgtgggtgacgccggccaagctggaacagctggccgacgcgccgctggaactgctgcagaaggccaacaacggcgtgctctacctgccggagatcggccagtacagccgccgcgtgcagcagggcttgctgttcctgctgtccaagctcgatcgcttcaacgtgcgcctgctgtgttcgtgcagccgtccgctgcaggagctgctggtggatccggagtgcgacaaccgcctgctgacggcgctgtccagcgtgatcgtgccgattccgccgctgcgcgagcactcggaagacatcaccttcatcgccgagcagatcctggtggagctggtggagtccaagcaggtgccggcgcgcaagctgaccaccgccgcgctcaacgcgatgcgccagtatgactggccgggcaacctggagcagctgcgcagcatcatcaagagcctggcgctgaccgcggagtccgacgaagtggacgccggcgaggtcaacaaggtgctggcgcagttccgccatgaaaagccggtggaggagtcgggcttcgacttcaacatcccgctgcgcgaattgcgcgaacagctggagcgccgctatttcgagtaccacatctcgctggaaaacggcaatatgagccgggtggcgcagaaagtgggactggaacgtacccacctgtaccgcaagctgaagcaactgggcataaagttcgcccgcaaggtggcggaggagtaaatccgccgccggccatcgacgccagcctgccggctggcgttttgcattttggagcgccatgacatggaatacccgcgcgaactggacgacgaggcgctgctgcgctacggccgccacatcctgctgcccgagattgatatcgaaggccagcgccggctactggcggcgcgcgcgctgatcgtcggcgccggtgggttgggatcgccagctgccttgtacctggccagcgccggcgtcggccgcatcaccatcgccgatgacgacgcggtggagctgtcgaatctgcagcgccagatcgcccatgacaccgccagcctgaagcagggcaaggccgagtcggcggcgcggcgcatgctggccttgaatccatcgatagaagtccggccgctggccgagcggctgtccggcgagcgcctgatcgaggaggtggcggcgcacgacctggtgctggattgctcggacaacttcgccacccgccacgcagtcaaccgcgcctgcgtggctgcgcgggtgccgctggtgtccggcgcggcggtgcgcttcgccggccagctggcggtattcgacagccgcgacgccgcctcgccgtgctaccactgcctgtttcctgaggagggcgaggcgagcgacggcccgtgcgcgaccttcggcgtgctgtcgccgctggtgggcgtgatcggcagcctgcaggcggcggaggcggtcaagctgctggccggcatcgcgcccagcctggggcggctgaccctgtacgacgcgctgcgcggcgatttccgccagatccgcgtgccgcgcgacctggcttgcgcggtgtgcggagagtagggcggaagcccggctttgccgggcgttccgcctgaagcgtgggggtgttggtagcggcgaaacgccccgcaggggcttccgccctaccatggtctacagctgctgctcgatcagctggcgcacttcggggaagttcatcaccccgacatagcgcttgatgatgttgccctgcttgtcgatcaggaaggtggtcggcgccagctggatgtcgccgaaggccttggccacctcgccttgcgggtccagcgccacgaagaagggcagctggttgtgggcgacgaagctttgcacgtagttgggcgggtcgtagctcatcgccaccgccaccacgttcagccccttgccggcgtattgctggtgcagcttcttgatttccggcatttcttccacgcagcccgggcagctggtggcccagaaattcaccaggaccactttgcctttcagcgccgcagtgctggtgctgacgccggcgagcgaggtcagcttcacttccggcgccggattgcggctaaacagcagcgaataagcgatgccggcgatggccagcagcgccagcgccgcgatcagacccttcttcatgtcgcgtccccgtccaaggttcaggccggttgggccatcatcttttgcaattgttcctgcagcgggccttccagcgccaccgccttgttctgcttggcgtcgaacaccacgaaggtgacgtcggcctcggccaccacggtgtcgctgccttccagcagcacgcgctgatggatgaccgcgctgcgcttgcctatcgactgcacgccggtctccaccagcagctggtcgcccatggtggccgggtggcggtagtcgatgttgatgttgaccaccaccagcgccaggcccgattccaggaacagcgcgaggttgccctcgtcttcgaactggttccagcgcgcctcttccagaaattccagatagcgggcgttgttgacgtggccgaacaggtccaggtggtagccgcggaccttgatccgggtgtgatgcgccatgtgtttccccttttgtcgtggtgctgcgttattcggcgtcgccgtccaggttcagcggcacgaaagcttcgcgttccagcggctggtccaccaggtcggtcagcacgccgtggatttccagcttgaaccattgttggaacaggttgggactgagattctgcggccaaaggctgtcgtcctcgcaccaatcggccagctcagcttcgaacagctggcggtattgcgccagcacgaaggcgcgcgcgtcgtcgtagtcgtcgacgggcgggatcagcagcgcgttgcagttggcggacagctgctccaggctcagattgtggtccaggccgccgggcaggcttttcagccaggcgaggaagggcgcttgcgggcggagcagcgcgacgctgcggttgacttcgaacatgatggatccttgattcaatggctggataacagattatcgcgggtgaagacgaaacgctggctgatccgcagcgccggtccgcgcgaaagcgccgcgggaaacggcggaaatggcgaggccagctcgacaatgcggcgcgcggcctcgtccagcaccgggctgccggacgagcgggtgacccgctgcgcctgcaggctgccgtcggcgcctatggtcacttccagcgtcaccgcgccgtgcagccccaagcggcgggcttcggccgggtagttgaggttgccgatgcgctccactttcagccgccagtcggcttgatagcgcgcccaggggtagccgcgggcggcggcgccgatgtcggcgccggcctggccactttccaggtcgctgtcggcgacggcgttgtcgccgccgctgcgggccagttctccgacttgtgccagcagcgagccggcgctgggcggcctggcgctggcggccggggcggccgtcagcttggccggagcggtttcaggcttgactatcggggcgggcttggcggctggcgctgacggaggaggcggcgcggcttgggcttcggcggcgcgggccggcatggcgctgcggctgagcagatgcccggcctcggcggtattgccggcgccctgatggtcgttttcggccacgcgcgtgatgtccggcggcgccggcgcgggcgtggactgcaggcggatgctgatctgtggcgcgctttccggcgcgggcgccgatgcgccggacggcaggccggccaggctgagcagcaacaggtgcagcagcagcgacagcgccgccatcagccatagcaggcggctgttgggcgcggagaggcgggtgcggtacaggtggtcggccatggcgtattccggactttggcggattttagcacggctgcaatggcaaacgccgcgcaaggcgcggcgttgccgattcggcgcaggccggatgccggattatttctccagcaggctgcgcagcatccaggcggtcttctcgtgcacctgcaggcgctgggtcagcaggtcggcggtgggctcgtcgccggctttctccaccacggcgaagatgccgcgcgcggtgcggcacagcgtttcgtggccttccaccagctggcggatcatgtcgtcggccttgggcacgccgttggcttccgggatggaggtcaggcgcgcgtagtcggcgtagctgcccggcgcgtaatggcccagcgcgcggatgcgctcggccaccaggtccaccgccagcgccatttcgttgtactgcgcctcgaacatcaggtgcagggtgttgaacatcggtcctgtgacgttccagtggaaattatgggttttcaggtacagggtgtagctgtcggccaacaggcgggacaaaccatgggcgatgtcctgcctgtcttgttcgttgatgccgatatccatgactaagctcctgagtggcggctctgctgcctggccgcgttttggactacactttccgttttgagcggaaaatggcgatgaaaacctggttgcgatgcgatgagggccgggtgaggctgacgctgcacgtgcagcccggcgccagaaagaccgaagccgccggcgagcacggcgattgcctgaagatcagattggccgctccgccggtggatggcaaggccaatgccgcgctgctggcctggctggccgagcgcttcggggtggccaggcgggaggtggcgctgctgtccggcgacaagagccgccgcaaggtggtggaaatcggctgcgcgctggacgcggccgcggtgctgagcctgttcggcgttcattgaaggtggcggcctggccgcggcttgtcgtcgacgcggctgtattcgccttcgatcacgtcgccggcgccggcgtccgggccgtgggtcggccgcgggccgccggtcggaatctggatgtcggggccttttatcggcaacagcaacagcaccgccaaggcgtcgctgagcaggccgggcagcaggaacagcaggccggccagcgcgtagcgcagcggccacagcagcgagtacagcgaaaccttttcgccctggcgcatcacgctgcccagcgtcagcagcgcgcccagcttctggttgcgcagcatccacaggcccagcatggacgacagcagcaccagcaggaacactgccaggccgccgatgtggtcggccagcgccaccagcacggcgatttcggcgaacgggtagatcagcaacagcaacaggagcgcgcgcatcttgaatacttttccatctagcgattgtttattggtcgtctgcaatgtacccgatccgcagttggccggacagattgcggcgacgctggtggcggaacggctggccgcctgcgtcaatatcttgccgccttgccagtcggtataccgctggcaggaggcggtggagcgcgccgaggaaaccccgcttttgatcaagaccgtccgcgccgcctatccgcggctggagcggcggctggccgagctgcatccgtaccaggtgccggagatcgtcgcgctgccgctggagcgcggcttgccctcctacctgacatgggtatcttccagcgtggtttcaagtggcgacgtttgattcggctgtattgcgactgtttggcggcggatttcgttcccgccgccaggcatgcgctgaaaatatttttcacagaatggcttgacgctgcggaaggatttcattatagttgcggactctcgtgggtcgttagctcagctggtagagcagcggacttttaatccgttggtcgcaggttcgaatcccgcacgacccaccacgagaagcttgtattgcatgttccggacgggtcgttagctcagttggtagagcagcggactcttaatccgtaggtcgagtgttcgagccactcacgacccaccatccagacatgcgccgtacgttgtgcgggtcgttagctcagttggtagagcagcggactcttaatccgtaggtcgagtgttcgagccactcacgacccaccaccatccctgcatctccccgacacgcatcccccatgggtcgttagctcagctggtagagcagcggacttttaatccgttggtcgcaggttcgaatcccgcacgacccaccaatcaagcgcttatctgttgtcaatgcagttcaggatgggtcgttagctcagttggtagagcagcggactcttaatccgtaggtcgagtgttcgagccactcacgacccaccaccatccctgcatctccccgacacgcatcccccatgggtcgttagctcagctggtagagcagcggacttttaatccgttggtcgcaggttcgaatcccgcacgacccaccaatcaagcgcttatctgttgtcaatgcagttcaggatgggtcgttagctcagttggtagagcagcggactcttaatccgtaggtcgagtgttcgagccactcacgacccaccaccatccctgcatctccccgacacgcatcccccatgggtcgttagctcagctggtagagcagcggacttttaatccgttggtcgcaggttcgaatcccgcacgacccaccaagaattcatgcatctggcccgatcgatccgatcgggccttttgcgtttccggcgcgcacgctgcgtgtgcctggtggctttccgctttcagtattaaataaaaatggttatcattactatttatttgcgcgacggctgacaggccgccgcgcatgtctttccgccgcccccgcgcggcgggattccattggaagcgccgcaatgaacaccataatcgacaccacccgcacccaggacctgaaagcccgcacccacgccacccacgaccagctggaccagcgcatcatggccaagcagccgttcgccagccgcgacaactacgcccgtttcctggacgcgcaataccgcttcctgcgcgacgccgacgcgctgtacgacaatccggagctggccgagctgttccccgacctggccgagcgccgccgctatcacagcatcgccgccgatctggccgatctgcagcggccgctgccgcagctccgggacgcgccgatcagcgaaaccctggacgtcgccaccgcgatgggctggctgtacgtggtggagggttccaagctcggcgccgccatcctgtacaagctggccggcaagcttgggctggacgagaattgcggcgcccgccacctggccggccatccggacggccgcgcccgccactggcgcgccttcaccgcggcgctggatggcctgaatctggacgaggcggcggaagcgcgcgtcaccgccggcgcggtggcggctttcgcctgcatgaacgcgcatctggaccaggtgtacgcttgaacgaagcccgccatcccgccgtgcgctggctgtatctggcgggcggttgcctgatggtggcgctgggcgtgatcggcgccgtgctgccggtgatgcccaccaccatcttcctgatcctggcgctggcctgcttcagcaaatcctcgccgcggctggaggccaggctgctgaaccaccccagatacggccccgggctcaggcgctggcgcgagcagcgcatcgtgccggtcaaggccaaatgcttcgccgctttcggcatgggcgtcggcttcatcgcattgctgctgtcgcggccgccgcattgggtgccgtggctggtggcggcgatcgagctgtcggtgctgctgtacctgctgagccggccgtcgcggccggccgatgcctaagggacggccagcgtgatgtgttcggccaccggccccagcgccagcgccggcagataggtcagcgccgtcgccagcaggatggcggcgatcagcagcagcgcgaacagcgggccgtggctgggcaaggtgccggcgccgggcgcgcgcctcggcttggcggccagcgaacccgccagcgccagcaccggcacgatcacgccgtagcggccgaaccacatcgcgatgcccagcatgaggttgtagaacggcgtgttggccgatagcccggcgaaggcgctgccgttgttgttggcggccgatgtgtaggcgtacagcacctcgctcaggccgtgggcgccggggttgccgaggccggccagccccgccggcacgctgacgctgatggccgactgcagcaatatcagcgccggcgccagcagcaacaccgccgccatcatcttggtttcgaacgcctctatcttcttgcccaggtattccggcgcgcgccctatcatcagcccgacgacgaacaccaccaggatggcgtggatcacgatgctgtagaggccggcgccggggccgccgaacaccacttccccggtctgcatcatcaccatcggcaccatgccgcctatcggcgtgaaggagtcgtgcatggcgttgaccgcgccgtcgccggaactggtggtgacggcggcgtacagcgccgaaccggccgcgccgaagcgcgtctccttcccttccatattgccgccgctttgccgcgcgccatggctctggtccaccagggccggactcagtagcggattgccggctatttcgctgcgcatgcaggccgccgcgcccagcgccatcatcaggctcatcgccgcgacgatggtccagccctggcgggtgtcgccggccatcaggccgaaggcatggcacaggccggcgggcaggatcagcagggtcagcagttgcaggaagttggtgagtggagtgggattttcaaacggatgggcggagttggcgttgaaaaagccgccgccgtcgccgctcatgatcttgatcggctcctgcgaggccaccggccccagcgccaggtattgctggcgcgcgctcaactgctgcagcagcggccggccatccgcgtctttcagcgcgttgccgcgcgcatcctgcagcggcacccggtagtggctggcttccagcgtggcgacggttcggcctgccgccagcgtctgcggcacgccttgctggacgaaaatcagcgccaggatgaaggatagcggcagcaggatgtacagcgtgcagcgggtgagatccacccagacattgcccagcgtcgcgctcgactggcgcgtcaggccgcgcagcagcgccagcagcgccgccatgccgctggcggcggagaggaagctttgcgcgttgatgcccagcatctggctgaggtggctcaaggtggtttcgccggcatagccttgccagctggtgttgctgacgaaactgacggcggtgttgaaggcggaatcgggagcgacggcgcggaaggattggggattgaggggcagccaggcttggcagcgttgcagcaggtagaggaacaggacgccgacgagttggaacagcagcaggttgatcgcgtagtttttccagcccatctctcgctccggttccaccgccgccagccggtagagccgagtctccagccagcgcccggggccggccagcaatggcggcttgccggccatggccaggaacatgtaatggccggcgggtttgatcaaggccagcagggccagcaggaacagtccgagttgcagcagcgaatatgtcggcatgggtgggtctcgcggcgaaatggggggcggtggccggcaggactgccggggcgccttcttgccgcgtactgtaagaaagcgcctgttaaagtgagctaagaatttgccggcgggatgtaagaatgtcatcaaggcgcggcttgccgcataatacggcgattgggcgatgtgccccggaggaatgcgatgagaatagataaggcgggcgcgctgttggcggcggcgctggcatccggcgccgcgtgggcgcagacggcggacgagcagctgctggcgtcgcagatggcttttcagcaggcgcaaagccagcagacgcaggcggacgccaggctgaaggcggcgcaggacgccaagacgctggccgagcagcggctggccggcgcccaggcggcgctggacaaggcgaatgcggatctggccactgcagccgcggcgcagaacagcgcgcagcaggtgctgcaaggcgcgacgcagggcctgaaccaggcctggcagcgcaaggacagcgggcagtaggatggcgggtcagcgggcgttcagctgctggtagcgctggatgtcctgctgcatcttgcggcggaaggcgtccaattcgccgcgtttggcgcggatcagcgcgtcgagatccagctgttcgtggcgcaaggcctgcagattgtgcgtggtggaaggatgcggcggctggcgcagcttggcgctcaggtccaggtctttttgcaggtcgcgctgctggagcagcaggccctgggcgcgcaactccagcgcgtgataggcggattgcagcaccgacagctgcctttcccggtcggccttcaggtcggccagcgaggggtagctctgaatcagcgcctggtcgtggcgggcggcgtcctgctgtctttgctgcagcagcagggcggcggcggcggacgcttcgcgcgccttgcgctgcgcgtcgctctctgccggtttcctgacgctgccctgctggttcagttcggccacgccgccgctttggctttgcagcggcggagaatcgctgtaatgcacccggccggcgtcgtccacccacttgtacagcgcgccgccggcaaaggccgccgcgcacgacaacagggtgaaaaggccggccagacgcgtcatcagtcgttgactccgtattgagcgcggtaggcgcgcaccgcatcgaggtgggcggccagttccgggctgtgttcgaggaaacccagcaggtctttcagggtggcgatggccaccaccggcaggccatgctgctgcgccacttcctgcaccgccgacaattcgcccaggccgcgctccatccggtccagcgcgatggctacgccggccggttcggcgccggcggcgcggatcagttccaccgattcgcgcaccgaggtgccggcggagatcacatcgtctatgatcagcaccttgcccttgagcggcgcgccgaccagggtgccgccttcgccgtggtccttggcttccttgcggttgtaggcgaaaggcacgttgcggccctgttcggccagcgccatgccggcggcggcggccaggatgatgcctttataggccggtccgaacagcatgtcgaacgcgatgccgctttccgtgatggatttggcgtagaagcgcgacaggctcagcgtggaggcgccgtcgttgaacaggccggcgttgaagaagtagggcgacttgcggcccgccttggtgatgaactcgccaaacttcaaaacctgcttgtcgagcgcaaaacgaataaaatcctgacggaaatcgctcatccttactcctttatcaaatcgttaactgtttgaacggctgaaaaaaatcgccgcaagcatagcacaggagagtctcttgcttcgaatcgtttccgccaacctcaatggcatccgctcggcggacaagaagggctttttcgactggctggccaccatcgacgccgatttcgtctgcgtgcaggaattgaaggcgcaggcggccgacctgtccgagcgcatgcgcgcgccggacggcctgaccggctatttccattacgccgagaagaaaggctacagcggcgtcggcgtgtatgcccgccgccagccggacgcggtggtggaggggcttggcgtggactggatcgacgccgaaggccgtttcctgcagctggatttcggcaatctgtcggtggtgtcgctgtatctgccgtccggttccagcagcgacgagcgccagcaggtgaagttcgacttcctcgacgtgttcatgccgcacctggaacagctgcgcgccgccggccgcgacatcgtgatctgcggcgactggaacatcgcccacaacgagatcgacctgaaaaactggaagggcaacctgaagaattccggcttcctgccggaagagcgcgcctggatgaccgacctgctgggccgcgtcggctggcgcgacgcctggcgcaatctgtacccggacgcgcctggctacacctggtggagcaaccgcggccaggcctacgccaaagatgtgggctggcgcatcgattaccatatcgtcacgccgtcgctgatggagcaggccgagtccgccagcatctacaaggacgaaaagttttccgaccacgcgcccttgatcgtcgattaccgccgggagctgtgatgtgggacgacgatgatgtcacgctgctgacggcgccgggctggggcaattccggcgacgcgcactggcagagccgctgggagctgacctatccgctggcgcgccgcgcggagcagcgcgactggctgtatccgtcccgcgacgagtgggtagccggcctggcggcggcggtggccgccgcgcccggcaagctggtgatcgcggcccacagcctgggttgccatgccgcggccgcctggctgctgcaagcgtcgctgctggagcagcgccggctgaagggcatgttgctggtggcgccgccggcgctgccgatcggcgcggacatcgcgcgcgccagcggcgaactgccggcgggcgcgcccttgccggatttcgccggtttcgcggctgccgacgagcggcggctgccggttcccgtcatcgtcgccgccagccaggacgacccgttctgcgatttcgccgtcgccaagcgaatggcggcggattggggcgcggagctgttcgacgccggccgctgcggccatatgggcagccatgccggcctgggcagctggccggcgggccagcggctgctgcagcggttgatcctgggctgatcccgccagagacgggggggtcagcgttccaccggccgagccgggtcgctgcaccattcgctccacgagcccgggtagagccggctgccggcaaagccggcgatctccatagccagcaggttctggcaggcggtgacgcctgagccgcactggtggacgatggcggccggatcgaaaccggcgcccagcagcgcttcccattccgcgcgcagctgtgcagccggcttgtagcgctggccggcgtccagattgttcatgaagaagcggttggccgcgcccggaatgtggccggcgaccggatctatcgtctcgcccacgccgcggaagcgctcggcgctgcgggcgtccaccacggtgaagtcccggcttgccagattggcctgcaccgcgccggcgtccaccgcctgctgcagcggcgggcggatggcgaagcggcaggagcggcgctgcggtgtttcggcgtccaccgcgccgccgccggcctgccaggcggcgaagccgccatccaataccgccactttctcatgtcccagccagcgcagcagccaccaggcgcgcgccgcgtattggccggcgccgtcgtcgtaggccaccacctgggtgtcttcgtccacgcctatcgcgcccagatccaccgccagccgctggccatccggcaagggatggcggccgttgtggccgtttttgctgccggacaggtggtagtccagatgcaggtaatgggcgccgggaatgtgcgcggcggagtaggcggcgtggccgtagtcgggctggtccagctggaagcggcaatccagcaccaccagccgttcggccggcaggccggccaactgggcgggggaaatcagcgtggtgtacatggcgtgtccgtatcgatgggagagcggccagcctagccgctggagccgggcgctggcaagtgtgctagaacgttaacattgatcattcaagcgcggacattacgaaggtatgcttcactccggcgcgccatcgcggcggccgacaataattcaagacaatgcgtaaacggggaaacaatatgttcagtgcatttaccataggccagcgcatcctgctgctggcctgcagcctgttgctggcgctgtgcctggtgggcggcggcggctggtggtcgctcaacggcataggccgcgaactgacggtgctgttcggcgaaaagatcgccttccgccaccatctggacagcatgcagcgcagcatgctgcgcgtgcgccaggacgagaagaacattttcatcagcatcggcaatccggcgaataccgaccaaagcatccagaccaacaagcagctgctggacaaggaaatcgcactgttcaaggagctggccggccaggccaagacgatgccgatggcggccgagcaccaggcggagttcgatagcatggtgcagggcatagacggctaccagcagggcatggaaagcctgtaccagcgcatcgccaagggcgagatcaccgcggccaacgccggcgacgccgccatcatcccgttcaaacccaagctgtacgccgcgcgcgacgcgctgaacaagctgaccgacctggccgaccagacctccaaggagtccgaggagcagatggcggcgacgatggcgcgcacgatacaggcgatgctggcgctggtggtcttcgcgctgctgctgggcggcggcctggcctggctgatctcgcgctccatcacccggccgctggcagcgatgcaggagcggatgcgccatgcggcggccaataacgacctgacggtggaaatagaccagaccggccgcgacgaagtcagcgagaccggccgcgcgctggcgcaattgctgggcaatctgcgcgctttcatcgagcgcacgcgcgaggactcggcccaggtcaccagcaccgcccgctcgctgtctcaggtgtcgcagcgtatcgccgacgcttcgcgggtgcagaccgacgcctcgtcgtcgacggcggcttcggtcgaggagatgacggtcagcatcaacctggtggccgaccactcgaatgaaatggccggcgaggcgcaaagcagcatgcgcgaggcggtgagcggcagccaggtggcgggggaagcggcgcgcgagatgcaggagatcgcgcgggtgataggcgaatcggaggcggtgatcgatacgctgaaccagcgctcggacgaaatcggcaatatcgtcgaagtgatccacgacatcgccgagcagaccaatctgctggccttgaacgcggcgattgaggcggcgcgcgccggcgagatgggccgcggcttcgcggtggtggccgacgaggtccgcaagctggccgagcgcaccgcccaggccaccggcgagatctcgtccaagatccaggcggtgcagggcgacaccaccaccgcggtggccagcatgcgcgaggccgcccagcgggtgggcagcggcgtggcgctcagcgcccaggtcagcgagcggctggcgcagatacgcgagctgtcgtcgcggctgctggagaaaaccagcgagatcgccgccgcgatgcgcgagcagagcaccgccagcaacgacgcggccaagagcgtggagcgcatcgccagcatgggcgcggaaaacggccagtcggtggaggcgtcgtccgacatggcgcagcagctgtcccagctggcgcacggcctggatcaggctatcagccgcttccgcaccgcctgacggcgcttagcgcgccagcgcggcgcgcagcaggccggccaggttcgcctggccgtggtcggcgccgtcgcggcgcggcgcggcccagatcgggctggggaagtgggcgtcgtcctcgaagcggggaatcacgtgccagtgcaggtgcggcaccatattgcccaggctggccaagttgatcttggccggccgcatcaccgcgcgcagcgccgcctccacccggtagacccagtccatcaggtggttccgctcggtcggggacagatcggtcatttcggcgacgtggccgcgccagattacgcggcaaaagcccggatagccgggctcgtccaccagcatcacgcgcagcgcgtcgtcctggtgcagcagttcgcccttggcttgttcacatagttcgcaatgcatggtccgcccctgttttttgaatagacctttgattttactccctgcgccgccgccggggcagcggcgcggctctgttatactcaaagggtcggcgcggctaaagcgccatgccggtgggcaatttcaaccataacagccaggaatccacgtgagtttcgccaacagtcttttcgtcatcgcccttctgatcgcggccagcgcctttttctcggtatcggaaatctccctggccgccgcgcgcaagatcaagctcaggcagctggcggacgagggcgtggccagcgccgagcgggtgctggagctgcagcagcagcccggccatttcttcaccgtggtgcagatcggcctcaacgcggtggcgattctggccggtatcctgggcgaagccgccttcaccccctacttcgccacgctgctgcacatggtgacgccggcgcagtgggtcgagcacctcagtttcatcctgtccttcgtcaccgtcacctcgctgttcgtgctgttcgccgacctgatgccgaagcggctgggcatggtggcgccggagcgcatcgcgctgttggtggtcgggccgatgctgttctgcgtgcggctgtgcagcccgctggtgtggctgttcaacggcctggccaatgtgttcttccgcctgttcggcgtgcccaccggccggccggacgacctcacctccgccgacatcgtggcgatgatggacgccggcgccgaggccggcgtgctgcagcagcgcgaacatcatctgatcgaaaacgtgttcgagctggagagccgcaccgtgccttcgtcgatgaccgcgcgcgaaagcatcatctacttcacgctgcacgaggacgaagccagcatcaagcagaagatcgccgaacatccgcataccaaatttctggtgtgcgacggcgtgatcgactcggtgatcggctatgtcgactccaaggacatcctgatgcggctgatcaaccagcaaagcctgtcgatgaagcgcgagctgacgatacgcaatgtgctgatcattcccgactcgctgacgctgtccgaactgctggagcgcttcaaggcttcgcgcgaggatttcgcggtggtgatgaacgagtacgcgctggtggtgggggtgatcaccctcaacgacgtgatgagcacggtgatgggcgacctggtcagccagttccaggaggagcagatcgtccagcgcgacgagcgctcctggctggtggacggcgcgacgccggtggaggacgtgctgcgcgcgctggacatcgaagccttccccgacgacgagaactacgagaccatcgccggcttcatgatgtacatgctgcgcaagattcccaagcgcaccgacagcgtcgagttcgagggctacaagttcgaggtggtggacatcgacaactaccgcatcgaccagttgctggtgacgctgattccgccggcgccggcggaaatcgaatcggcgcgctgacattacgattggttacacccccttacacatgcctcacagacgggccatcggcggcctgcctaagatgaattcaaggacgcgccaaacagcgcgccagacagcaaaaacatctcagacacgggagcatgaccatgaaaaaactgaccgccctcctgctggccgccaccctgggcctggcctccgtcgccacctacgccgccgacgcgtccgctccggctgccaaggccgccgcgccggcgcatcacaagcatcaccataagaaacaccacgccaagaaggcaagctcggctccggccgcgcaaaaggcccaggccgccaagaagcacggccatcatcaccatcatcacaaaaaacaccaccgccacgtgaagtaaggcggctctgctgccgggtcggtccggatgtggaaaaaggaggctgaggcctcctttttttattgtccggcgggaggcgggcagggtggtctttttctgtcattatggattgtcaaaacctgtactaaatgacagatgtttaaatttcctcttgtatttttcagcagagatttcgattctaaataccaatgtaataccacatgaggcgctcatgtcggtgattgcagtggcaagagcgagccctctgccgttatccatcacaagaggagaaccaccatgctgcacttccccctgtcgcgcgtactgctggccgtcggcacggcccttgcgttgacccaggcggcgtacgccgcgccaagctgctcgccgtgggccagcggccaggtttacaacgccggcgactacgccacctacggcggcaagacctggcgcgccagctggtggacccagggcgaaacgcccggcagcagccagtggggcgcctggcaggagcgtccggccagcgagtgcacgcccggcgatccgagccagcccggccagcccggcaacggcgtgccgccggaaccgaagccgacggtgggccgcaatgtcggctcctacttcacccagtggggcatctacgaccgcaattacaaggtcagcaacctggtgcaggccggcggcgacaagcagctgaccttcctcaactacgcgttcggcaacgtctacgccaacggccagtgcggcatggtcaccaaggccgagagcggcaacggcgacggcggcgacgcctgggccgactaccagcgttccttcgccgccaacgagtcggtggacggcaaggccgacaactggaacgatccgctgcgcggcaacttcaaccagctgcgcaagctgaagctggccaatccctcgctgaaagtgctgatctcgctgggcggttggacctggtcgaagaacttcggcaccttcgccgccaccgacgctggccgcaaggcgatggtcagttcgtgcatcgacctctacatcaagggcaacctgccggtgggcgaaagcgccggcggacagggggcggcgctgggcgtgttcgacggcttcgacatcgactgggaatacccgggcggcggcggcctgccgaccaatagcgtcgatcccaacgacaagcagaactacacgctgctgatggccgaattccgcaaccagctgaacgcgctgtccaccgccaacaagcgccgctactacctgaccgccgcaataggctccggcgtcgacaagatccgcaacaccgagccggccgcctacagcgcctacctcgactggatcaacgtgatgacctacgacttccacggcggctgggaagccaagggcccgaccaacttccagtccaacctctaccgcgatccggcggcgccggtgactggcgaccaggtctactacaccgtcgacgacgcggtgaagaccctggtgaacgccggcgtgccgcgcgccaagatcaacgtcggcctgccgttctacggccgcggctggacaggcgtggcggcgggggccaagggcgacggcctgtaccaggtggccaccggcccggccaagggcacttacgagcagggcatcgaggactaccgcgtgctggtgaaccgcagcaccaaacagttcaacagcccgatagccaagcagttgtggacttacgacggcaacgagttctggagctacgacgatccggccaccatccgcggcaagctggactacgtgcgctcgcagcagttgggcggggtgttcagctggtcgctggatggcgacgacgcgcaggcgacgttgctgaagaccagcgcggaagtgcggctggacgccgccaccgccgccaagcgcaaggcggcggccgcagcggccaaggccaaagccgccaagaagcagtaagcggcagacggcaaaacggcggggctgcggccccgccgttttcattgcgccgtctggatccggtttacagttcggcggcgggcttgaccagcagcggctgcggcgtggcgctggtggcgcgccaggcggcggtgaagtggtcgaccacttgctcgccgctcagcgcgaaggcgctgacggtggtgtggccgtcggcgatcacggtggcctgatagccgcgcgacaccgcgttgcgcagcgtgctgtcgacgcagaaatcggtggcggcgccgcctatccacagcttgctggcaccgtgcgccgacagcagctgcaccagatcggtctcgcagaagctgtcgccgtagcgcttgtagacgatgggatcgccgtcctggcgggcgagggcgggatgcagctgccaggcgtcggagccgcgcggcaggtcgtcttcctcgtgctggacgaagatcaccggcatgccgcgctggcgggccttggcaatggccaggttgagcttgtcgagcacgctgtcgaggcgggcggcgcgcagttcgccttccacgacgccgacttgaacgtcgatgatcagcagggcggtatcggacatcggttttctcctgggtggggggcggcggtccgcggtcggcaccggccgcgaatgccatgtcaggccaaggcttccgggttcagcacatgggaggcgtcgccctcgaagaagcggacagcgttgcgatgggcgatctccaggtactggcggtagctggcctgctcggcgtagcccaggtgcggcgagcacagcacgttggggcgcagcagcagggggtggcctgggtcgtagatcggttcttgctcgaacacgtccagcgcggcgaagccgggccggccggcgtccagcgccgcttccagcgcgccgggcgcgatcagttcggcgcggctggtgttgaccagcagcgcgtccggcttcatcgcggccagatcggcctgcgtcacaccgcccgcggtggcgggaaccagccgctgatgcaggctgacgacatcggcggcggcgaaaaaatctgcgcggcaggcggcggcgcggtagcccagttccagcgcttctgcgcgcgcgcgttcgctgccccataccaacacgtccatgccgaaagcttggccatagccggccaccaacttgccgatcttgccgaaacccagaatccccagcgtttggccgcgcacggcccggcctatcggtccctgccaatggccggcgcgcaggctgtccaggttttccgccagccggcgccgcgccgccatgatcagcagccaggccagctcggccggcgcgtagggcgagccgctgccttccaccaccgcgacgccggccgcgctgcaggcggcgatatcgatattgcgcgccagcttgccggtctggctcaccagcttgagcttgggcatgcgcgccagcaacgccgcgtccaccaccgtgcgctcgcgtatcaacagcagcccctgagcttgcgccagcagcgcgtcggcttgcgggtcgcgcgcgagatcggccagcgcgcggcacgggtagctcgggttctgatgcaaggcggcgatctggcggctggccagttggtagtcgtcggctaccagcagggatatggcggtcatggcggctggcatgcggtaaaagtccgcattataacccagcgtcatctttctgcggaggctgcctgcccggtcgccggggcgggaatggcctggcagacgcggttgcggccggcctgcttggcggcgtacagcgcctggtcgacgcggtcgatggcggcttccaaggtctccggcggctgccacaggccgatgcccacgctgatggtgatggtcagcttgtccggcgcgccctgcatgagatggcgcgcgacgatgctgcgcaaccgttcggccagcgagtcgtccaggccgtggctggccaccagcaccatgaattcttcgccgccccagcgtatcagcaaatcgttgccgcgcagctgcgaacgcagcagctcggcggtttcctgcagcagccggtcgcccacctggtggccgtagcggtcgttcgcctgtttgaagtggtcgatgtccagcatcagcagttgcgggatcgcgccgatgcgctggcaatggcgcagccagccgggcagcaggtcgagaaaggcgaggcggttcaggcagccggtcagctggtcggtggtggccagttggcgcagcttgcgctgatggcgctgcaaggtggccagcaccgccatcaccaccagcagcaggatcgcgctgttgatcgccagattggccagcaatgaggcgcgcagcggctgcagcgcgcggcttgcgttctgctccaccagcaaatgccagcccagttccggcaggaagcggctggtcagcaggtagcggttgccgtccaggctgtattccagccgctgcggcgcttcccggccggacaatatcgccgggctcagcgcggacaggcccggcagctcctgcagccgtttgccgcttggaaaggcgcgcgagctgctcagcatgacccggccggcgcggtcgatgaagtagatgcggcggcggaagcgctgctcgtgcgcggccagttgcctggccaactgatccagcggcaggccgacgccgatcacgcccagcaggcggccctggtcgtccagcatccggtggttgatgaacatggtggcctggccgccattggtcatgtcgcggtccagattgatctcatggtcttgccgcatgccgcggcagcggaaataccaggcgtcgtgggggttggcggcggagacgatcttgtggatgccgccggcgtagtagtagcgtcggctgcgctcggaaaccaggaagctgccgctgatgccgttgccgccgttgatcgcgctcagatagcggctggcgcgttcggggctgatctcgccgttttgcatccagtcggccagaaaggtatcgtgcgccatcagcgcggccaccgacagcggccgcaggatgccctggtctatctgggaaaaaatggtatctccggtcagcggcaggccttgctcgacgatgctgcggcggatctcgtcgctgctctgccggtagtacaggcaggcgttgacgacgatgccgcccagcagcagcaaggtgacgatgatgactaggcggtagcgggcgagtgggccggacacgcgcttcccttcagggtggaaatggcggattgtcctatgaaaatagaatgccgcgcggcgcgcggcaatgccatctccggatgggacggccgggaggctcagcgaatggggatgtacagctcggtcagcgagtccgggtggtcgggcgcgaggaagcgctgatccatgtattcgaactcgatgccgtccatcgcctccaggccggccgccggcagccagctgccgtggatggcgcggaaggtgtcgggcaggccggccaccgggccgcggtgctggaagcgggcgtagcgctgcgccggcacgtccacggcgtccatgccgtcagggacgggcgcatccggcgcggtttgcaatgcggccaggtagcgccattggccgtcggccagcggctggcagatgccgtagctgctgccggggcgggcgtcggcgatttcatgctcgcgcagcaggaagcggccccagagttcggggatgccgtattcgtcctgcgggctccaggcgaggccgatgacgcggaaggcggggagggtgacgatgtcgggggtctgcatggcgggaaggctccagtcggcttggttgagatagcgcgcgatctgcgcgatctgcccgcgcttttcctcgatctgctgctgcaggcgggcggcatgggcgcgcaattgctcgcgcagcgcgccgccatcccgcaggccgccttcctggcacagccggcggatgtcttccagcgacaaacccagccggcgcagccggacgatcaggcccagctcctccacctgcgccggcaggtagtagcggtagccgttgtccgcgccggtgaaggcggggcagaacaggccgatgccgtcgtagtggcgcagggtcttggtgctgaggccgtggcagcgggccagttgtccgatagtgagcatgcgatggtttcgcgggcagatgcggccagtctggaccttgccccaggggaaaggtcaagaccggccgtttgccgatggagatggggcggttacagcagcactcgctcgatgccgccgtcgcgcgcccgagccacgtattccggcagccagttctgccccagcaggtgcttggcgatttccaccacgatgtagtcggcctcggtgccggtgtcgtcgttgtagcgcgacaggccctgcagacaggacgggcaggaggtgaggatcttcaccggcagggccggcggctggccgccggtcagcgcctgcaggttcttgttgatctcctcctccttgcgcgcgcgcacctgggtggcgatgtcgggccggctggcggcgaaggtgccggcctcgccgcagcagcggtcggacagcggcacgccgccgcccatcagctcgttgaccactttcagcggctggtgggtcttcatcggcgtgtggcaggggtcgtggtacaggtattgctggccgctgatgccgtccagcttcacgcctttctccatcaggaattcgtggatgtcgatcacgcggcagccggggaagatgtcctcgaagcggtagtgcgccagctggtcgaagcaggtgccgcagctgaccaccacggtcttgatgtccaggtagttcagcgtgttggcgacgcggtggaacagcacccggttctcggtggtgatggcgtcgcccttgtcctggtagccggcgctggtctgcggatagccgcagcacaggtagccgggcggcagcaccgtctgcacgccgacgtgccacagcatcgcctgggtggcgaggccgacctggctgaacagccgctccgagccgcagccggggaagtagaacaccgcttcggcgtcttcggccaagcgcgggttgcggatcaccggcacgatgttggcgtcctcgacgtccagcagcgcgcgcgcggtcttcttcggcaggccgcccggcatcggccggttgatgaagtggatcacctgctgcttcaccggcgccgggccgacggtggacggcggctgctttttctgcccgccgatcaggcccagccgcttgccgacggcgttgcccagccgctgcgccttgtagccgacgccgaccaggccggcgcggatggtcttgatggtggccgggtccttggcggtgaggaaggccatgcccagagcggtgccgggattgaaggttttgttgccggacttgcgcaggaaattgcgcatcgccaccgacacgtcgccgaagtctatcttcaccggacagggtttgacgcagcggtggcagaccgtgcagtggtcggccacgtcggacagctcctcgaagtgcttgaggctgacgccgcggcgggtctgctcctcgtacaggaaggcttcggtcagcaggccgacgccgaggatcttgttgcgcggcgaatacagcaggttggcgcgcggcacgtgggtggagcacaccggcttgcacttgccgcagcgcaggcagtccttgatcgagtcgttgatcgcgccgatgtccgactgttccaggatcagcgattcggcgccgagcaaggaaaacgacggcgtgtaggcaagcgccaggtccgcgcccggcagcagcttgccgcggttgaagtggccgttggggtccacttgcgccttgtagtcgcggaaaggctggatttccgcttcggtgaggaattccagcttggtgatgccgatgccgtgctcgccggaaatcaccccgcccagctcccgcgccagcgccatgatgcgcaccaccgcgcggtgggcggtctgcagcatctcgtagttgtcggagttgaccgggatgttggtatggacattgccgtcgccggcgtgcatgtgcagcgcgacgaacacccggccgcgcagcacgtgctgctgcaattcgccgatagcggcgcggatgccggcggcggcggtgccggagaacagctgctccagctcggccagcacttcgcgcttccagctgacgcgcaggacgaagtcgcgcagcgcgtggaatacggtgtcgggctgggcggcggagtcttcgcgcggggcgtccggccaacgggcggcgtagtcgggatagggcgcgtccatgtggtcgagcagccactgccagcggtcgcggctgatcgccaatagcgacagcgcggcggcgcgcctgtcgccgatcagctcttccgacggcaggttggtgtccatcttgtccaccggcagccggccgtggaagtactcggtcagcgtgtccagtagctcaatcttgttggcgatggacagttcgatgttgatgcgctcgatgccgtcgctgtagtcgccgaggcgcggcagcgggatcaccacgtcctcgttcaccttgaaggcgttggtgtggcgggcgatggcggcggtgcggctgcggtccagccagaaggtcttgcgcgcttccggcgtcaccgcgatgaagccttcgccgtggcgggcgttggcgatgcgcaccacctggctggcggcctcggcggcggcgttctcgtcgtcggagacgatgtcggcgatcagcaccatcttcggccggccgcggctcttggccttggtggcgtagccgaccgcgcgcacgtagcgccagtccagatgctccaggccggccagccggacgccggcggccaggcaggcgccgcccggctggaacaagtcggtgatctcgacgatggccggcgtggcctcggcgacggtgccgaagaattccaggcagacggtgcgggtatgttgcggcatcttgtgcagcacgaagcgggcgctggtgatgatgccgtcgcagccttccttctgcacgccgggcaggccggccaggaatttgtcggtgacgtccttgcccaggcccactttgcggaaggcctggccgggaatcgccagctcgcggctggacaccgcggtcctgccgtcgtcggccagccgcgacacgcggaagcgcgcctcggccacgtcgtggatcttgccgtagttgtggcctatgcgctccaccagcagccagtggccgtccggatccaccattttccaactggccaggttgtccagcgtggtgccccacagcaccgccttcttgccgccggcgttcatcgcgatgttgccgccgatacaggaggcttcggccgaggtcgggtccaccgcgaacaccaggccggcggcggcggcggcttcggagacgcgggcggtcaccacgccggcgccgcattgtatcgtcgcctgcgggccggacaagccgggcagctcgatatgctctatgcccaggtggcggtccagcttttcggtgttgatcaccgcgctcatccggtccagcggcaccgcgccgccggtgtagccggtgccgccgccgcgcgggatgatggtgaggcccagctcgatgcaggcgcgcaccagcggcgccatttccgcctcgctgtccgggctcagcaccacgaacgggtattcgacgcgccagtcagtggcgtcggtgacgtgggcgacgcgcgacaggccgtcgaacaggatgttgtcgcggcgggtcagccgggtcagcttcttcaacacccgggcgcgcagctcgcgggtttcatcgaactggcgggcgaactgttccaccgcctggcgggccgaagcgatcatctcgccgacgcggccgttgccgtcgcggcgcttttccacttcgttcaggcggtggcgcatcgcctccaccagcgcggacagccgcttggggttgtccagcaggtcgtccaccaggtaggggttgcggtccaccacccagatgtcgcccagcacctcgaacagcatccgcgccgagcggccggtcttgcgctcgccgcgcaatgcatccagcaatttccacatcggctcgcccagcaggcggatcacgatttcacggtcggaatacgaggtgtagttgtacgggatctcccgcaggcgctgttcgctggtgatggctgtcatttgtccgcaagctttgatttattagaggaatgcctgccagtgtagcccaatgttgcggcgcgaaaaacccatcccggatggggtcttgcttcttgatttgaagaattttcgtgtgaatggatattgttggacagcctggcggcgggcgccgccgggccggggctcagcgcgcggccagctgggcggccagttgcaccgcctccaccaggctgccgggattggcgaggccgctgccggccaggtccagcgcggtgccgtggtcgaccgaggtgcggatgatgggcaggcccagcgtgatgttgatgccggcgccgaagctggcgtgcttcaaaaccggcaggccctggtcgtggtacatcgccaataccgcgtcggcctgggccagcttgtcgggattgaacagggtgtcggctggcaaggggccgatcagctcgatgccttcggcgcgcagcgcgtgcagcgccggctcgatgacgtcgatctcctcgcggcccatgtggccgctctcgccggcgtgcggattgaggccggccaccaggatgcgcggcgcggcgatgccgaatttgcgcttcaggtcggcgtgcaggatgcggatcacttcgaacagcaacggcgcggtgatggcgtcggccaccgcgcgcagcggcaggtgggtggtggccagcgcgacgcgcatgccgccgccggccagcatcatcaccacttttttcgtgccggtgcgctcggccaggtattcggtatggccggaaaacggcacgccggcctcgttgatcacgcccttgtgcaccggcgcggtcaccatcgcggcgaattcgccggccaggcagccgtctatcgccgcgtccagcgtatccagcacgtagcggccgttggccgggtccagccggcccggcgcggccggcgccgccagcggcacgtgcagcacttccagcgcgccggcggggccgatctggccggcgcggtagtcggccaggctgacatccaggccgagcaggccggcgcgctgggccagcaggccgcggtcggcgatgacgacgcagcgccgctcgggcagcaagcgccgcagttgcagcgcgaggtcgggaccgatgccggcgggctcgccggcggtcacggccaggatgggccgggccgtcggcatcacttgtcgtccaggtgttcttcgacgaaggcggaatcgcgcagctggcgcacccagtcggcgtaagcctgctccatcttgcgggcgcggatctgctgtttgatcgccatcttctcgtggtcgctggaaacgtcctggttgcgcttgccttccaccaggatcaggtgccagccgaacggcgagcgcaccggctgcgacacttggccgaccggcaaggccaccatcgccttctcgaagtcgggcaccaggtcgcccaggctgacccagcccaggtcgccgcccttggcgttgctgccgtcttccgagtacagcttggccatgtcggcgaacttggcgccgcgcatgatgcggtcgcgcacctggtcgatgcgggccttggcgtcggcttcggacaccgcttcattggtgcggatcaggatgtggcgagcatggtattgctcgatcagcatcggcgcgccgccggcgcgcttctcctgcagctggaagatgaagaagccttgctgggtgcggatcacgtcggtgtgggcgccggttttcagctgctccagtatctgcacgaactccaccggcagcgaggtggcgctgcgccagcccatgtcgccgcccttgagcgcgttgggcgcgtcggagtaggcggcggaaaccttggcgaacggctggccggcgtccagatcggccagcgccttgtgcaccttctgcgacagcgcgtcgatctgcttggcgtcggcgcgttcgggcacgccgaccaggatgctggccagatggtattcggtgcggttggcgctttgcgcgctcttcagcacctggtccacctcgctgtcgctgaccatcacccgcgagcccacttcgctgtcgcgcaggcgcgagatggtcagctcgcggcggatgtcgccgcgcaggcgatccatcgtgatgccgtccttggccagctgcgccttcatgccggcctcgctcagcttgttctgcttggccagattggccaccgcttgatcgaccgccgcgtcgtcgatgcgcaggccgccgctggcggcgtattgcagctgcacttcctcggtgatcatctgctccagcacctggtgctccagcacgtcgcgggcgggcggcgccactttctgcgcctccagctgcttgatggcctcgtcgacgcgcgccttcagctcctgccaggtgatcacgttcttgttgaccacggcgacgatgcgatccacttcgcgtaccggggtggcgggagcggccagcgcggcttgcatggcgctggcgaacaacagggcaagcagggtctttttcatggtcaggctttattgctcgttagtcttggtgtaacccgggatggccaggcgcagcgcgctttgcaggctgccgctgcccaatgctcccagtcccttcagttccagctggaagaataccgcgttcttggtggtggtcaggtcggtggcgtagcgctggctgtacagccgcgccgaccagcagccatcgttgtactcgaagccggccagttgctcaatagggcgctgctggatcagcgagtaattgtagcggccgatggcgtaccagcgcttggcgatcggccattgcgccgccacgtccacctggcgcagcgggccgtaggtgccgttgtcgtcctgcagctcgtagatgccgtagcggtagcggatgctggcgaccttgcccggctccgggttgtagcgcagctgaacgttgtagcgttgggtggcgttgatggtcgggttgtactcgtagctgctgtccaaccggaaggtcttggtcaggtcgccgccggcgctcagcatccagtcattgccggtattggtcacctgcggcggcgtgccatctagaacaatactttgctggctgaagtagtagcgcttgccgatggcgatgcgcaggcgctccaggccgttgctctggtcgatgaagcggctggtcagcgcggtggtgatctcgttggcgccgttgatgcggtcgtagccggagaagcggttttcggtgaacagctgcgcgaagttgaagtcgttgaccgaggtgtcgaagttgggaagcttgctctgatccttgttggggatgttgacgtagaacaggcgcggttccagcgtcatcaggtgatcgcgccccatgaaggtggtgtcgcggtcgaaatacaggccggcgtcggtgctgaagatcggcagcgtgcggctcagcgtgccttgggcgttgccctggtaagcgttcagattgtattcggtgtagttgacgccgaacttgggccggatgaagccccagctgcggtcgaagctccaggtcacgctggggtaggcgacgaagcggtcgccggtttgcagcgtgggatggtcgaagcgggtcaggtcggtgaccaggttggcggaaaatccgctgggcagcgactggttggcgttgaaggtcagctgcggcatccgcgcgtaggggatgtcggtcggctgcgggttgatggtcaggttctggtagtgctgggtgcgcagcgtgacgttgccgccgccgccctgccagcccagcgcgtagttcagccaggcttcgcggttgaggttgatgttggaggcgatggcgacttggtcgccgaagtcggtgaagtaattgttgtccgatacctggttgtagtcgaggccgaaggtcaggccgtggccgaaattctgctgatggcgcgcgctccaggcatagcgcgaggtgttggtgaccttgtcgttgggcaactgttcggtgtagatgctgccgttgtaatcgggttccagatagcggaattcgccggccagcatattgccgtgcttgtcgttgaagtgcggcgtgatggtggcgtcgaggttgggggcgatgttccagtagtacggcaccgacagctcggtgcccgacgagccggtcttgaaggtgggcgtcaacaggcccgacttgcggttgccgttcagcgggaagtccagccacggcgtgtacaggatgggcacgccgtagaattgcatccaggcgttgtgcgccacgcctacgccgctggtgtagtcgaggtcggtgctggcggcccgcagataccaggcgtcgtctcccggatcgcaggtggtcatccggctgccgtagatcttgtactgattctggccctggaagtccacctggctgccgttgccgcgcatggtgacgggtttggcgggctggccgccgggcgttttggccgccggcgggttctgccgcgacatcgaaaacaccggatccatgccggtgccggtgtagtcgtcgacgttgtagtctagggtgcttccgtcgatcacgtcgctgccgcgcgtcatgtggaagcggtcgccggccttgacgcggtttttggcctggtagtagtccagccagtcggattccaccttttgatcgtcgcgggtgaccaccacattgcccttggcgtgcaggatcacgttcatttcgccgtcaagctggtcggcggtgactacggtctggccttgttgtttgggcggggcgggcagcgcgatcggcgcgtcgtcgtcggcgcgggcggtctgggcgttcagggcaaaggcggtggcgacagccagggccagcggagtcagtttttgtctgtgcatgcacaaagccatatcgtgggggctagtgggcggtatagaatcgcccaattctatatcagtaccacgacaaagcgacatgcaaagactggaacagctcaagaaatggctggcgcagcaatatcctggtgttgaaatccaggtcgagttcgccgccgcagacgccgacttccgccgctatttccgcgcgatctggcccgacggcgccagccgcatcgtgatggacgcgccgcctgatcggatgaacaccgacgcctacgtcatggtgcgcgacgtcttcgcgatggtccgggtgccgcagatcctgctgcgcgaccgcgagcagggcttcatgctgctggaagacctgggcaagatcacctatctggccgcgctgcagcacgacgagcggccgcaggtgcaccagcatctgctgctggaggcgctggacacgctggtggatatccagaaagccagccagcccggcgtgttgccggaatacgacgaagcgctgctgctgcgcgaactgaatctgttcccggaatggtactgcgcgaaagaactgcaaaagccgctcaatttcgcgcagaggcaattgtgggacgccggcgtcaaggcgctgctgccggcgttgctcgcccagcccaaggtatacgtccaccgcgacttcatcgtgcgcaacctgatgctgagcgccggcgcgccgggcgtgctggacttccaggacgcggtgtacggcccgatcagctacgacctggtgtcgctgctgcgcgacgccttcatcgagtgggaagagccggtcgtgctcgacatcgccatccgttactgggagaaggcgcgcgccgccggcctgccggtgccggaggcgttcgacgatttctaccgcgccttcgaatggatgggcgtgcagcgccacctgaaagtggccggcatcttcgcccgcctgtaccaccgcgacggcaaggacaagtaccgcgccgagattccgcgcttcatcaaatacctgaagcgcgcctgccgccgctaccacgagctggcgccgttctaccagttgctggtgcagctggtgggccaggacgaaaccgacgccgagctgcagtccagctacccggtgttgggcgtgaagggcggctgatgcgggcgctgggagccggcctgttgctgatgtccggcctggccggcgcggccggcttgcaagcgcgcgtctgcctgccgtcgcaggatttgaaaatctgcctgtatcaggacgcgcggctggccggcgagcgcaacggcggcatcggcagcggcggcggcgagggcggcgactggtcgccgccgctggcgccggccgaattgcgtgtgtatacgcgcggcggcgcccaactgagccggctgcgggtggggcggctggcggatatccgccgcagcgcgctcgccgacgccggcaagccggtgttcctgctggacgaagatcattccgccggcttcggctcctattccggcgtggagacgcggccgttcaccgtgagcgcgcgcggcctgcgcttcgcccagccgccaggcggcgatccggccaagcccttcatcctggcccaggcgctgaaaagcggctggaaggagagccgtgatggtttcctgctggtgtcctgcgcgccggactttccggccaagggcaagtgggacggcgaaactttccgcgtccgctatgcccggctgacgctgcgggacggccaatggcggctgagcgagcgcagcgaacgcggcttctgggagaacgaaggcgctttcccggccgagcgcctgttcccgaaatgagcgagaagaacatgaaggcaatgatactggccgccggccgcggcgagcggatgcggcccctgaccgaccatacgcccaaaccgctgctgacggccggcggcaagccgctgatccagtggcacgtcgagcggctggcccgcgcaggggtgacggagctggtgatcaaccacgcctggttgggcgcgcagattgaagacgcgctgggcgacggctcgcgcttcggggtgtccatcgcctactcgccggagggcgaggcgctggagacggccggcggcatcgccacggccctgccgctgctgggagacgcccctttcatcgtgctcaacggcgacgtgttgagcgattttccggttcagcgtctggtcgaggcggctggccgtctggatggcgaatcgatgctggcccacctgacgctgacgcccaaggcaggctataagaccggccgcgacctgacattgcgcgccgacggccgggtggcggcctgcggcgacggcgacacgccatacaccttctgcggcctggccgcctatcatccggccttcttccgcggcgtggcgcccggcgtggccagcccgctgctgccgtggctgctggccgcgatggagcaaggccgggtccgcggcgaggtgcagtccggcctgtggctggacgtcggcacgccggagcgcctggccgaggccgaccgcatcgccgccggctggaccgcatgagccggcgcatcctcggcatcgaccccggcagcctgatcaccggcttcggggtgatagacgtggtcggcaaccagcgccattacgtcgcctccggcgcgatccgtaacaagagcggctcgacgctggcggagcgggtcaaggtgctggttgacggcattcaccaggtggtcgacacctaccagcccaccgaggcggcgctggagcgggtgttcgtcaacgtcaacccggcggccacgctgatgctgggccaggcgcgcggcgcctgcatggcggcgctggtgctgaaggacctgccggtggcggaatacaccgcgctgcaggtcaagcagtcggtggtcggccagggcaaggcgcccaaggagcaggtgcagtacatggtggtgcggatgctgaacctgtccggcacgccgcaggccgacgccgccgacgcgctggcggtggcgctgacccatgccaatcatagcggcggggcgataggcaagctggcgctgagcggcctgaaggtgaagggcgggcggctggtgtaggccgatgcccggctgcgccgggcgtgccgccgcggatagcccgaagcgggctacagccgaatcacaacgaattcacaggaaagaatcatcatgatcggacgccttaccggcaaattgatcgagaaactgccgccgcaggtggtggtggacgtgggcggcgtcggctacgaagtggacgtgccgatgaccaccttctaccaattgccggcgctggggcagaataccacgctgttcacccacctggtggtgcgcgaagacgcccacctgctgttcggcttcgccagcaaggaagagcggcagaccttccgccaactgatcaaggtgaccggcatcggcgccaagatcgcgctggcggtgctgtcgggcatgacggccgacgagctggccgtcgcggtggccagcgaggacatcaagcgcctgtcgtcggtgccgggcatcggcaagaaaaccgccgagcggctggtgctggaattgcgcggcaagctcgccaccggcggcaacctgacggtgccgggcggcctgcctttcgccgccactccggatgagaagagcgacatcgtcaacgcgctgctggcgctcggctacaacgacaaggaagcggcggcggccaccaagagcctgccggcggacgtcaccgtcagcgagggcgtgcggctggccttgaagagcctgatgaaggcctgaggccgcggcatgaaaaagcccgccgggaaggcgggccgatgcggatgcggagcggcttagccggccggcagcaggctgacctggctgcgcacgctcttcacgccgggcacccgcgacacttcctcggcgatgcgggaaatcgcctcctggctcggcgcggtgccgctcagcaccacgtcgccgttgctgacctgggcttccaccttggcgcccagctgcgctgccttggccagcacttcattgacctggcggcccagctcggcgtcggccggggcggctgcggcgtggcgttccgccgccggcgcgctggcgggctggctctgttcggcgaagctggcgccggcgtacagggcggggatcaggctggcgaggatcagggttttgcgcatggcaagagtctccttggactgggtgaaggtcactgccgcggtttggcggatctgcctgtccgcggcgcttgccggatattcagcaagccccgtgccagcctttggtttttatttaaaatcaagtatttatggtttttttacggggcggaatcccgccgccgggctggcttttgtcgcctggcggcgacagcggcggcggcgagatccggaaaagcctgtcccatcaatggtttgggcctgtcgccatctggcgacaagctcaatcgtcctggaacgcggcggcgttcagctcatgcttttgcagcagccggtagaactcggtgcggttgcggtcggccagccgggcggcgtcgctgacattgccgccggtcagccgcagcaggcgttccaggtaatcgcgctcgaattcgcggcgcgcgtcggccagcgtcggaatggcctgcgcctcgcctgccaccgccttctccacctgggccagggtcagcaaggggccggtggccagcacgcagcactgctccaccacattggccaactggcggatattgcccggccagcgcgcggcggcgaggaaggcgagggcgtccggggcgaagcccgtcaccgtcttgccgtagcgcgctgagacctgttgcaggaaatgctgggccaacagcgggatgtcttcgcgccgctcggccagcggcggcagcgtcagcgccaccacgttcaagcggtaatagagatcctcgcggaactggccgtcggcgatgcgggccggcaggtcgcggtgggtggcggacagcaggcggatatccaccggcagcggccgggcgccgcccaccggcctcacctcgcggtcctgcagcacccgcagcagcttgacctgcagcggcagcggcatgtcgccgacctcatccaggaacagcgtgccgccgtcggcctggcggatcaggccctcgtggcggacggcggcgccggtgaaggcgcctttttcgtggccgaacagctcgctttccagcaggttttccggaatcgcgccacagttgacggcgacgaagggccggccggcgcggcggctggcctggtggatggcgcgcgccaacacctccttgccgctgccgctttcgccttgcagcagcacgctggcgtcggtggcggccaccatccgcgcttcgctcagcagctcctccatcgccgggccgcggctgacgatgccggcgcgccaagcgtcgccggcggcgccgtcgcccgccgacagcgtcaggccctgcgccaccttgtccagcagcagctggccgtcgaacggtttctccagatagcagaacacgccgcggctgaccgcctccaccgcgtccggcacggtgccgtgcgcggtgaacaggatgaccggcagcgtcggatagcggcggcgcgcggtttcgaacagctgcaggccgtccatgcccggcagccgccagtcggtcagcagcaggtcggcgcggcgagcggccagcgccgtcagcgcggcttcggcgctggagagcgcctccacctcgtggccggcggcttccagccgcagccgcaccaggcacagcaggtcgggatcgtcgtccaccaggacgatgcgggcgggggcgttcatcgcttgcttccttcactcaggccattgggtttgggcagatccagctccaggcggcgcagcgcgtccagtttggcggcctggtcgtcgatgcgtttttgctggtcgcgcaattgctgttgctggcgctcgttttggtcctgcagccggaactgtgtctgggcctggcgcagctgcagccgcgccagcgcggcgctggccggcgacaggctcttgtcggccagcagtttgtccagctcgctggccaggcggcccggctcggcgcgattggcgcgcaggattcgcagcaggcggtagctgtcgcaggcttcgtaggcctgccagcgttggcgcagggcttcgtccggccaatccagcgcgatcagcagcgcgtcgccgccggggcagtagcggaccggcgcggccggcggccgcagcgcgcaggcggaaagcagcggcagccataacagcggcagccagcggcgcggaaaaacgggtggggtcatatcggctccggttctggccagtggaggcggaagcgcgcgccggggccgtggtccagcaggctaagttctccgcccatcagctgcgcgtagccgcgcgccatggtcaggccgaggccgctgccggggcgctcgccgtcgggcgcggggccgctccagaaaggttcgaaaatcttgtcccggcatgctttggccacgcccgggccctggtcggccatctccagccagacctggccgcgctcgcggccgcagcgcagcgtcagccggccgccgggagggctgtggcggatggcgttgagcaacaggttgtcgacgatggtttccactttggacggatcgccgtgcacttcgcccggcatgccgtccagcgccacgatcagccctttggcctggcacagcggctggcagctggcgagcctggcctccagcaagcggcgcagcgaaaatgcggaaacgttcagcgtggtggacagccaggggccggcgtcccgcttcagcagcgcctcaactctttgccgcagcgccagcgcattgttgcccaggatgtcgacgatgcgccgctgttgcgggttgagcgggccggccacttgttcgcgcagcagcgccgcggcttcgtgtatcgacgccagcggcgttttcagctcgtgcgacgcctggcggaagaagcgggtctgctgctgctccagctccaccagccgccggtccagctgctccaattcccggcccagccgctgcaggtcggcggggccggcctggcgccagttcaattggcgggcgccgccggccagccgggcgatgcggcgctgcaggccgcgcaagggggcgtggatcagcagggtgacgatcagcgccagcagcacggcggcggccagcgccagccaggccaggcggttggcttgcagccgcatccgctcgatgtcgccgcgccagctcgcttgccgtttctcgccggcctggaccaggatttgctgttgctgttccagcacgcggcgcagttggcggaagcgcgcctcgcgctgttggctgtgggccggcgtctgggcgcagagggcgagcgcggcgtcgatgccgggcagcgcctcggccggcgcatcctgccgcagcgtccgttgcgcgctttgcaattcggcgcgggcctggctggcggtttcgtcgagtttgcggtcgcgcaggatcgcagcctggcggctggcgcgctcgtactgcagcgcctgctcctgcgacaagcgggcgatgtcttgccagcgctgggtttggcgctgttggcgctgggcgctgtcggcggcctggcccaactcgtggcgcagttgcatcagcgccgcggcggggatcagcgcgacgccgaggaagccggccagcagcaggccgcggaaggaaaggaagcggagcatggcatcggggatgaaaaacagggacgcggatgcgcccctgttcagcagacaggcgggcggccgattggttcgcggccgccgcccgggttcagcgcgccgccagcgccggctggcggcgcgcagccggcagcagcgcgggggccaagtcgtccagcctggcggccaggagcggcgccagcgccgcgaacttgtcctccagcgcctcgcgcatggtgtcgaccagcacctgggtctgccgctcgatttccaggttgatccggtcgcccgcttgcttgccgcccaaggtggtggcctggcgcgtttccgggatcagccacacttcgaaccagccttcgcgcttgtcgatgtcggcgatggtcaggctgacgccgtccagcgccgcgtagcccttggcgaacaggtagcgcaaggcgcccggcggcacgctcagccgcaggcgcaggttgtcgccgcatgcctctcgttgggcgatggtggcttgatagtcgacatggccggatagcgcgtggccgccgttctccgcgccgtcggccagcgcccgctcggcgttgaccgcgtcgccggcctggcagcgggccagcgtgctggtgaccagcgtcggcaggatcaggtcgaactcggcgttgtctgcctgcggcggcgccgccacggtcaggcaggcgccgtttacggcgacgctggcgccctgccgcaagccgtcgcaaaagcccggcgggaaagcgagggtgagccgccggctgccgtcgccatcctggacggcaatgatgcgggcgatggcctgggtgatgccgctgaacatggcgtcctcctcaggcgtcttgccgttgcagccattcggccagctccgccaccgtcagctgcggcaggccgtgccgtgcggcataagcgtccagctgggggccgcgcatcatgctgccgtccgggttcatcagctcgcacagcacgccggccgggctgaagccggccagacgcgccagctccaccgaggcttcggtgtggccgcgccgctcgcgcactccgccggcgcgggcgacgatggggtagacgtggccggggcgcaccaggtcgccgggcttggcgtcgggggcgatggcggcgcgcatggtggtgacgcggtcggcggcggagacgccggtggtcacgccctcggccgcctcgatggcgacggtgaaagcggtgccgtagcggctgccgttgtcggcggccatcggcggcagcgccaactgcgcggcgcgctccggcgtgatgcacaggcagacgatgccgctgccgtcgcggatcatccgcgccatttccggcacggtgagcatgtcggcggccaggatcaggtcggcctcgttttcgcggtcggcgtcgtcggcgacgatcaccggcaggccgcggcgcaaggcgtcaagcgcggcgtggacgcgcagggaaaggatatcggtgtgggcgttcatggaaacggtcctcaaataatggattgagaaacacgtcccgtgggcgtgaagcggatagcgtacggctatccggcgcgataaacgcgcggatacgacacagttttcccgccgcgggcgcggacggaaagctggcgtcgtcttctttcatccggactattaccgtcggctctggcatttcaccagatctgctgacccctcgccgtgcggcgaaggcgctcgcgggctcggcgcttgcgcgccataccgccggtggggaattgcaccccgccccgaagacgttggccgcacagcgcggccagcggcgagtatagcgcggtgttagaatgtcggcagcaagatttcccccaagagtccccgatgatagaaaccgacaagctgttcggcgccgcgccggagcgccgcatcgtcaccgcgcaacgcgcgtccgagcaggaagaggcgctggagcgcgcgctgcggcccaagcagctggacgactatgtcggccagaagaaggcgcgcgagcagctggagatcttcatcgaagccgccaagcgccgcggcgaggcgctggaccacgtgctgctgttcggcccgccgggcctaggcaagaccacgctggcccacatcgtcgcgcgtgagatgggcgtcaacctgcgccagacttccggcccggtgctggagcgcgccggcgacctggcggcgctgctgaccaatctggagccgcacgacgtgctgttcatcgatgaaatccaccggctgtccccggtggtggaggaaatcctctacccggcgctggaggattaccagatcgacatcatgataggcgaaggtccggcggcgcggtcggtgaagctggacctgccgccgttcacgctggtgggcgccaccacccgcgccggcatgttgaccaatccgctgcgcgaccgcttcggcatcgtcgcccggctggagttctacaccgccgatgagctgacgcgcatcgtcagccgctcggccggcctcttgaacgtacagctgtccgatgacggcgccttcgaagtggccaaacgctcgcgcggcacgccgcggatcgccaaccgcctgctgcgccgggtgcgtgactacgccgaagtgaaatcggacggcgtggtgacgatggcggtggccgacgccgcgctggcgatgctggacgtcgatccggccggcctggacgtgatggaccgcaagctgctctccgccatcctggagaagttttccggcggcccggtgggcctggacaacgtcgccgcggcgataggcgaatccaccgacaccatcgaggatgtgatcgaacccttcctgatccagcagggctatctgcagcgcaccccgcgcggacggatggccacctcccaggcgtatctgcacttcggcctgccggcgaaagacgcctgagtttgcccgcgcgcaagcgcggccgccggtgggcggcatgcggatcgcgtacaatgccattatctgcaccgtaagcgagaaatcatgttctacgtgttgttcgccaccatcctgatcgtggtggttgccgcggccgtcgccgccgcgcgtttcttcgacccggccgtggccaagatcctcggccgcaccctgggccaggagctggccgacgcctggcgcaagtatgtgttcttcgccattgtggtcagcggcgtgtccggcggcgtgcggccgtggtcgctggagcgctatctggcgccgctgccgggcaagggcagcagccagctgcaactgggcggcgagcgctggatgctggagctgtacaccgccggcatcgaaacgctgcgctccatcgcctgggtggtgctgctgttcttcctgtgcgcgatgctggcctatgtgatcatgcgcgcggtggaattccgccgcctggaagcggaagaacgccgcagccatccggaatagtgccggcatgctggaagagcggctgcgggggctggttcgcgccagcccctggctgatggaggctttgcgcgcggcgcgggcgctgcatctcgccgactggtgcataggcgccggcgcgctgcgcagcctggtgtgggatgcgctgcatggcttcgcgtcccagccgtcggccctgtccgacatcgacctggcgcatttcgacgccagcgacctttcccccgggcgcgacgccgcgctgcaagcccgtctgcaagcctcccatcccggcctgccctgggaagtgaccaaccaggccgccgtccatctgtggttcgccgattatttcggctacgcggttgagccgctgtcttcgctggaggatgcggtggcgacgtggccagaatacgccaccgcggtgggcgtggcgctgaacgccgacgacagcctgcgcctgatcgcgccttatggcctggacgacctgttcgccatgcgggtgcgccgcaacccggcgcgggccagcgtggagatctatcggcagcggctggcgcagaagcgctatgccgagcgctggccgcgggtgagggtggtggagtcggcctgacgacttttcatggcggttccgccagccggacgggccgggggggctgcgcggccagccccccggcacccccaggccgcccctgcggcccgagaaaccccgacaatacaaccttgcgccaggaagccgccgatcgaaaaaacggcggcttaaacccactggtccaaggcggttttgtcggcacgggccaaaggggaggagcggctgccgatccgcctgtcaggcccagcaggcagcgcaagctcgcttaagcgcttcctagcgcccgatcttcacctgcgtccacaagcggttcagctcgcggcgcgatttcgcgtccagatccttcaaggccacgtacctgcccttggccgggtccagcatgatcaccggattggccttgatctgcggcttgaagaaagcttcggccgccttcaccggattggtggcgccgatctggttggagatctccgcggcgttcttgccgtccagcatgaagttgatgaactggtaggccaggtccgggcgcggcgcgtccttcaggatggtcatattgtctatcgccagcacattgccttccttctgcggctggtaggccagctcgaacgggcgcttggcggctttcacatcctgttgcgcctggtagaggtcgttggaatagcccagcgccacccagatgttgccgacggtcagctccttgatgtagctctggttgttgaacgccgcccagtagggcttggccttgcggatgacgtcggcggcggccttccagtcggcggggttgacggagttggcgtcgcggcccaggtacatcagcgcggcggccatcagttcgcgctggctgtccagcaccgtcaccttgcccttgatcttggccagcagcgccgggtcgaagaccagcgcccagctattggccttgtcggctaggccggcttttttcagttggctggcgttgtagcccagcagcgtcagcgacaccacggtcggcgcggcatagcggttgccggggtcgaagggctggttgagccgcaggtagccggggttcaggttcttccaattgggcagcttggctctatccagcgcctgcagcttgccctgcttcagcagcgcgttcaccgcgaaggcggtggggaacaccatgtcgtagcccttggcgccggcggccagcttggccagcatttcctcgttgtcgccgtagtagtcctgcaccaactggcagcggcacgcttgctcgaagcgcttggcggtgtcaggcgacagcgcgttgttccagttgtagacatgcagcacatccgcggcggatgccgagccccaggctagtgtcatcagcgccgcgagagccagcttgttcataccttgtcatccttgtgtcagataaaaatgaaaccccggccagacactggccggggcgggaaaacgcgtgtggagccgggacggcgcttacagcgccaccatattgtcgcggtggatcagctcgggttcgacgatatagcccagcgcgccctcgatctcgcgggtgctcttgcgcatgatctggcgcgcctcgtcggaactgtagttgaccaggccgcgcgccacctcgttgccggcggcgtcgacgcaggccaccgcctcgccgcgcaggaagtcgccctccaccgcgctgacgcccaccggcagcaggctggtgccgcgctcgcggatggccagcgccgcgccgtcgtccagcagcaggcggccggacagcttcaggtggtcggccagccattgcttgcgcgccgccatgcggctggtggcggccaccagctgggtgccgatggcttcgccgtcggccagccgcgacagcacctgggcctcgcggccgcaggcgatcacggtggcggcgccgctgcgcgcggcgcgcttggcggccagaatcttggtgatcatgccgccggtgccgacgctggagccggcgccgccggccatctcttccagcctgggatcgccggcttcggccaggcggatgaattcggcgtccggatgcttgcgcgggtcggcgctatagaggccttgctggtcggtgaggatcaccagcgcgtccgcttcgatcaggttggtgaccagcgcgcccagcgtgtcgttgtcgccgaagcggatctcgctggtgaccacggtgtcgttctcgttgatgatgggcaccacgttgagattgagcaggctcaccagcgtggagcgggcgttcagatagcgggtgcggtcggccaggtcttcgtgggtgagcaggatctgcgcggtctgcaggccgaaagcgcggaaggcgctttcataggcctggcacaggcccatctggccgacggcggcggcggcctgcaattcgtgcacgcccttggggcgcacggtccagcccaggcgctggcagccttcggcgatggcgccgctggaaaccagcaccacctgcttgccgcggcgcttgagttcggcgatttcggcggcccagcgcgccagggcggcaaggtctaggcccttgccgtcgttggttaccagactggaaccgaccttgaccacgatgcggtcggatgcgtgtatcaccgaatccatcaacagacctcgctatgaaagcaaatgattatagagaggtcagtgtacccgaaaaagcgccgggcttgagccaggtcaaaagtactcgctgggccggtattcgatcagttgaaagtgaggggattgctgcagcagtttggcggcgcgtatcagtttttccccggcgtcgtcgcgcaggcggaattcgcgcagctggctgaactggcgtccgggcagcaacagcaggtcggggcggccggcggcggccggcagccgcaggccgcgcaggaagctgtcgccgctatgggtgatgctgggcatcgccagcaccggctgcggcaggccgccgaggatttccacgccgcattccacttccttgccggtgggttgcatcagcacccagcgcaccgcgcacagctgcgccgcttccggctggtcgggcggatgcagcagcagcgcttcgccggcgcgcagcgtctgttcgcgcggcaggccgcgcagcagatagccggattcgctgcggttgaccagggtcagcaggcaggaggacggcgggctgcgcaggcgggcgttctcctcttccgagccggcgccggccagctgccagctgccgtggttggccaggtgccagatcgaggagagggtggagacgacctcgaccactgcctggctgtcttcccggccgtgcttgcggcggcgcggatgctgccattcttccaccaggccgctcagcagctgcacgacatcgcccagctgcgcggcggcgttgccgctggcgctctgcagctgttccaggctgcggcgcatggtgtccaccgcgccgctcaactccagcatgctgcaatggccgtgcagcgagccgggggtgatcagcaggtggcgcggcggattgtcttccagcgggtccagcagatagccgtggcggttgtcgttcaagcccgccaccggcagcagcgatacttggcgcgccaggtcgtagatcagctggcgcgccaggtgcatgtcgacaaccgacaggcggttggtggaggtcaggcccagcagcaggatctggcggtagatgacggccagcgagtcgtcgccggacagcgccttgtcctgccagccgcgctcccgcgccagcgcgtagagctggtggcagtccagccagaagcccgccggcagcgggcagtaattctgctggctgacgttcaggtactggcgggcggccatcatggtgtacagcagcagttcgatcttgggctgctctcgctccagcagcgcgtggcggcccagcttttcgttcaaggtctgtttgaaggcgatgtacagattggcgaacagtttgacgctgagcaccgccagcagccgggtcttgggcgaggacaggatatcgttgtgctgcgattcggcttccagcagcgggtaatagcgatccagcgccttcagatagagcagcagcagcttgaagcgctgcgtcggctccagcggcgtgcgcgccagctggtacagcgcctggctgagcagccggccgcattccggcaggtcggtgtagggaaggcgttccagccaggccgcgacgctggctggctgggtgtcgacgagttgcgggtccatatccttcttcggcaaggcgagtggcggcatccggacagggctccgaggctgtgtcgcgggacggcgcccggcgcgccgcgcttcagggcagcggcgtttccgcgcctgccgtctgcgagccgccggccaggacttcgtccagcgctgagcagctcgactcgaccagccaatccatttcttcgttgttcagggtatagggcggcatgaagtagacggtcttgcctatcggccgcaacagacatccgcgtttcagcatggccgaaaaaaaggccaatgcaaagtcggcgcgctcggtggccacgtcgaaggcccagatcatgccggtgtggcggaagtggcggatgtcggggcgggaggacagcggccgcatgcggcgggtgaattcggcggccttctcccggttggcggccagcacgtcgtcggcctcgaagatgtccagcaccgccagcgcggcgctgcatgccagcgcgttgccggtgtagctgtgcgaatgcaggaagccgcgcgccacatcgtcgtggtagaaggcctggtagatttcgtcgcgggtcagcacgcaggacaggggcaggaagccgccggtgatgcccttggacaggcacaggaagtccggcaggatgccggcctgctgataggcgaagaaggtgccggtgcggccgaagcccaccgcgatctcgtcggcgatcagatgcacctggtggcggtcgcacagccggcgcagttcggccagataggccggatcgtgcatcgccatgccggccgcgccctgcaccagcggctcgacgatcaccgcggcgatctcgccggcgcgcttggccagcaggttttccagcgccacggcggcgcggcgggccgggtcggcggcggtttccccgggcgcggcctggcgggcgtccggactgggcgcccgcaggccaggcttgagcaggtcggcgtaggtggacgagaacagcggcacatcggtgacggccagcgcgccgacggtttcgccgtggtagctgttctccaggctgacgaagcgggtcttgccgggctggccgcggtttttccagtagtggaagctcatcttcagcgcgatttcggtggcgctggcgccgtcggagccatagaaggcgcggccgaggccggacagcgccgccaggcgttccgacagctccaccaccggctggtgggtgaagccggccagcatcacgtgctccaggctgtccagctggcgcttgatcgcctgcttgatgcgcggctcgccatggccgaacaggttgacccaccaggagctgacgccgtccagatagcgtttgccgtcgaagtcggtcagccagacgccgtcggcgctggcgatggggacgatgggcaggctttcatggcgcttcatctgggtgcagggatgccagacggcggcgaagctgcgctccagccaggcttggttgctcatgcgatgggctccggtagggggatggcggatgctagcatagtccgcgccgcggttccgatgtgacgaaaaacgtcagtttctgcccagcggcgacagccagggccgcgcaggggcgcgccagggcgggtccgcgaaggcctggcatgctttctgctggataaggcggacatgcgtcgggcggcacgcgcccggaaacccgcagacgaggctggcggccgcggccgccgccattccatttggcgaagcttggcaatccgggagttcaatcatgaagagacagcagatccagcagggtttcaccctgatcgagttgatgatcgtggtggccatcgtcggcatcctggcggccatcgccatcccggcttatcaggactacaccaagcgggcgcgggtgacggaaggcctggcgctggcggattcggccaaaaccgcggtcaccgagtactacgcatccaacaatgcttttgtcgcgtcaggcaccgcaccgtataacactagctatgggcttgccacaaccatcaccggcagttcggttggcagcctgtcggtgctggccagcggcgtgatccaggtcgcctacaacagcacggtgtccagcggtgccctgctggatctggtgcctactgttacttccggctcggtttcctgggtctgcacctataccggcaccggcggcggcaccaccgccatcgcagccgccaaccaactgtcggccaactgggtgcccagcacctgccgccagtaagcgtggcggcgacagtcgcggagcaagaggcactgcggtgcctcttgatttttgcggcgggcccgggtttgagcatcaggagatgcggaagatgcggaacagaacgacgcagcgcggctttaccctgatagagctgatgatagtggtggcgatagtcggcatcctggccgccatcgccatcccggcctaccaggactacgccaagcggtcgcgggtggccgaggggctggcgctggccgacgccgccaagaccgcggtggcggagtactacgccagcaaaagcgcgttcgccagctccacgccgtacaacagcgcgtacgggctgtcgacggcgtcgtcgatcaccggcaacgcggtcagcagcgtgtcggtgctggccagcggcgtgatccaactgacctacaacaacacggtctccagcggcgcgcagctggatctggtgccctcggtcacctcgggttcggttacctgggtttgcacctataccggcaccggcggcggcaccacggccatcggcacgcagttgcaggccaactgggtgccgaccaactgccggcagtaggcctatgctgcgccatggcatccccgtgcgcggggccgctgggtataatcatgtcattcgatagccggtggcgcagatgcaaggatcaagccagttgagcgacaagacctggtggcgcgatgccgcgctgtatctgtttttttgcggctgtttcgtctttccctttttcaatttcgcccgctacacgccgctgcaggactggtggaccaatgccggcgtggtgctctgcgtcggcatcgccggcttgttcgcgctgcgccgcgggcaaagcggcgtgcgggtgccattggcggcggcggcgctggcggcgctgctgctgttgctgtccttcagcaatggcttgctgctggagaattaccagcccgccattctgatcctggccagcctggccgcgatgctggtgctggcggtattcctcgtcaaccggctgcggccggacctggcgcgcgtctgcgtcatcctggcctcctgcctgttgctgggcagctgcatccagatcgtgctgggcagcatccagctgctggacctggcccggtattgccgcggcctggtgacgttgaactatctgaacccgaccgaagtgatgggcaatgtcggccagcgcaaccagtacgcgcagtacttgagctggggcgtggcggcggcctgttacctgtatgggcgcggccggctgcgcgccggcttctgcgcgccgctggtgttgttccagctgctgttgattacctggtgcggcgcgcggctgccgctggcctacagcctgggcatttgcgggctgtgctggttctggcaccgccgcgcgcccggcgacgaggcgttgctgcgcatgctgaaggccctggcggcggcgatcatcgtgctggcgctgctgcaattgttcaatgaagagatcgtctggctgctcaaccggctgggcttgcccatccatgtgcaaagcggctccgaacgcctgctggacgccggattcggcgcccgccgccgcatcgagtggaccaaggcctggatggtgtttcagcagcacccctggttgggggtggggctggcgcgctatccggcgcagtcggtctggctggaggcgtttggcggcctgcccaagtacccggaaggggtgttgttcacccaaagccataatctgattttccagctgttggccgaaaccgggctgtccggcgcgctggtcgcggggctgggcttgtgcggctgcctgctgccgtttttcgcccgcggccggcagagcccggaaaacctgctgctgatctgcatcgcgatgatgctgctgacccacagcatgttcgagtttccgctgtggtacctgccttttctggcgatgctggtgacggtgtgcgcgctgggtccggcgccggtttggcaggtgcccacccgcacgatgctgttgcggctggcctgcgccggcggcggggcgctgatgatcgcgcatatcgtcagcggggtgttcatcttctggaatctggtggcctacagccggcccagcctgtcggcggcggaaaacatccggcgggtgaactacatcgaaaaagtggagcgcaatcccttgtggatagacgcggcctcgatggtgatgggcaattacctgctgccgggccggcggcagctggcggtggtgctgccgttctacgagcaactggcgcgcaaccagccgtatatcgccgtgctgcagcggctgagcgtatgccaggcgctggccggccagcccgaggccgccagacgcacgctggtgatggccatcgccagctatcccgacgaagtgttgaagttggacgccagcctgcagccgtggcaagagcccgaggtgcgcgcgctggccgaactcaccagccgggtgaaggccatctatttgcggcacggcgcgtataccgacgccgcgcggatggcggcggtgacggcggtggcgtcgccggtcacgcgcaaaccgttgttttgacgggtttgtaacgcgcggacacatttgaccggttttgccggctgtgcgcatgcggtatgctgccggctttgctgttttcgatatctggtccgccatgacttttcagaaaatatccgaacgcctggccctgctggcattgtgcctgatcgccatcgtgccgttcgcttcccgcgtccatttcgtgccgctgccgcagtggttcggcgaaatcaacgtgatctggctgctggtggccgccggcgccttgctgctgcccggcggcaagctgttcgacgcggtgccgcgagccggttggtggtgcctgctgctggcgggggtctgggcgctgcagccgcagctggtcagcctgatgttccccggcatgagctacgccaccgcgctgggctggttggcgctggcgttgctggcctcgatcaccgcctccttgcgcggcgctttcggcgaacgcgagttcgcggtatggctggcgcgcgccgtcatcgtcggcggcctggtgcagtcgctgatcggcgccgcccagctcaccggcctggccgcgccgctggggctgttctacgatggctcccaccccaccaccaacattttcggccacatcggccagcgcaatcagtacgcccattacctgatgtggtcggtggtatccggcgtctatctgttcgcggtgggcaggctggggcgcaactggctggtggcgctggtgctgtggatggcgctgatgctggcctgggcggggtctcgcaccacgctgctgtatctggtggcgatttcggcattggccgcgctgtggcactggcgcagccgcaatgaggtttcgcgccggctgatgctggcgatgtgggcttgcagcggcgcggtgctggccggccagttcgccctgccgctgttcaatcacctgatttcgctgttgacccattccgacgtggaaaacgcttccggcgtggcgcggctggcggccaacggcgacgacatgggcgcgcgccgcttcgccgagatgcacaaggcttggctcaccttcaaggcgcatccgctgtggggcgtgggctggtcgcagtatgcggcggaaagcgtgcgcctgcagccgctgccgcagttcgccgccgcaggctacaacagcggcctgttcaccaatgcccacaacctggtgctgcaattgctggccgaaatgggcggcgtcgccaccgcgctggtgctgggcggcttcgtctgggcggtatggccgttcttccgtcgccaggccgagccggaaggcgtgctggcgctggcttgcatcgcggtgacgctgacccacagcatgctggagtatccgctgtggtatttctatttcctggcaatgctggtgctgttcatggcgatggcgccgcgcggcgagtccaggtccttgccgttgccggcgcgactgccgttgctggcggcgctggcatgggtaggctggctgtcgatcagcaccacgccgatgttctgggagctggtcaacctgtacacccccaccggcaacgcgcagaaggacgccaagcgcgccgagcggctgatcgaaatcgtcaagaccaagccgctgttcgcctaccacgcgctgtacacgctggacgactacctgccgatcacccgcgacaatctgaagcagaagctggcgctggaagaccggctgaccgagttccgcccgtatccggacgtgatgctcaagcgcgcgcagatggaagttttggccggcgagcaggccaaggcggaacagacgctgcgcaccacgctggcctcgttcccgacctatgccggccagttcctggaaacgctgggcgacgccaacccggaatgggagccgctgcgcaagatcagccgcgaggcctacgacaagctgccggccaagttccgcactttgccggagtaagcccatccccggctagcgggggggatgaaaaaagccgctctttcgagcggcttttcgtttgccggcattcaggctgcctgcgcgcggctggcgatccaggctgggaatgaatgcgccgctcctgcagcagatgcgccaactcccggtggcgggcaataaaaaagccgctcattcgagcggctttctgcatgggggcggatcagttgtccagcaccacgccctcgctgagcgcggccttcatcttggtcagcgccttggcctcgatctggcggatgcgctcggccgacacgccgaattcggccgccagctcgtgcagcgtcgagccgctgtcgtcggccagccagcgcgcttcgacgatgcggcggctgcgggcgtccagcgtcgacagcgcgtattcgaggccttccgactgcaagtggtcgaaagcgcggcgctccagcgcgcgggtcggctcgctgtgcgagtcggccagccagtctatcggcgcgtagctgtcctcgtcgtcgctgtcggccagcagggacacatcctggccgttcatgcggatttccatttcgcggacttcctcgggcttgacgcccaggtcggcggcgatggacttggcttcctgttcggacagcgcggagaagccgctcttcatgctgcgcaggttgaagaacagcttgcgctgcggcttggtggtggcgatgcgcaccaggcgccagttgcgcaggatgaattcgtggatctcggccttgatccagtggatggcgaacgagaacaggcgcacgccgcggcccggctcgaagcgcttcaccgccttcatcaggccgatattgccttcctggatcaggtcggcctgctgcaggccgtaaccggcgtaaccgcgcgataccgacaccaccacgcgcaggtgcgacagcaccatctgccgcgccgcttccaggtcgttttcctgctggaaacgggtcgcgagctcggtttcctgctccggcgacagcatagggacgctgtttaccgcctggatgtactgctccaggctaccgctggtcgacggaacgggcagggcaaatgttgtgttcattgcgatggctacctccttgggtagtgctatgttagcactcgtatatggagagtgctagcaatgaaaggttcccgcgtcaatgattttaacaatcgatgcgatagctgaaacctttcacttggcatatctatttcggctctaccttgcgcaggtgatggtcggcggcgaggcgggcgcccagcatcgccaggaaggcggccacgccgatcagcgccgccagctcctgcagattaaggccgcgcagctccacccgctcgccgtacagcatggcgaattcgcggatggccggattggccagcgccgccagccagctcgacaggccccaggccagcagcgcggcgaacacgccctgccacagcgcgtggtagaggaagggccggcggatgaagctgtcggtggcgccgatcagcttggacacctcgatttcatcctgccgcgccagaatctgcatccggatcgcgttgtgggtcaccagcaccagcgccaggcccagcgcggcggccaggaaccaggtcagcttcttgcccatgtccaccatgccgtacagccgcttggcccaatgcgcgtcgaactgcgccatttccaccatcggcaggccggatagctccttctgcagcatttccatttcgcgcggttcgagcgaaatcggggtgacgacgaaggcgtccggcagtggattgccgtccaagccgtcggacaggccggacaggccgttgcgctgctccaggtcctgcagcgccttgctcttgctgataaaggtgaagctcttcaccttggggtggtgcgacagggtgctgttgacggcggcgatgtcggcctcctcggccgattgctccatgaacagcgtgatctgcggcgtggcggtaaggcggccgacccagtcctgcacgctgctgaccgacaggtagaggcacagcggcagcgccagcgccaaggccagcatcagcagggtcagcaggctgccgaacggttggcgcaggatcttgatcagcgcctgcttggcgctttgccagttcagatagagaaagtgtttcatgcggcgaactgtccttccctcaggcggatgatgcggcggccgtagtcttccatcagggtttcgtcgtgggcggagatcagcacggtgacgcccacctggtggaaggacttgaacaactccatgatgtcgagcgcgtaggcgcggtcgaggttggccgacggctcgtcggccaagaggatgctggggcggtgcaccaccgcgcgggcgatgcacagccgctgctgttcgccgcctgacaggcggatgggcatcatcttttccttgctgagcagccccaccttgtcgagcgcggcgcgcacgcgcttggctgcgtcgcggcggtcgaagcctatgatgtccagcggcagcatcacgttgtcgaacacgctgcggtcgaacagaatcttgtggtcctggaacaccatgcccagatgctggcgcacataggggatctggctgccgcgcagtttggacaggttctggccgttgaccagcacgccgccgctggtggcgcgctcgatgccggcgatcagtttcagcagcgtcgacttgccggcgccggagtggccggcgagaaacaccatttcgccggtttcgatggtgaaggacaggttcttcagggcttcgttgccgcccgggtagcgcttggttacctggtcgaactgtatcatggagaggtttcccgcttattggctgagaaaagcggccgcctggcgcggccgcgggcgtgtcttattcgaacagcgcgtcgatgtagtcgcggctgtcgaacggccgcaggtcgtctatgctttcgccgacgccgatgaagcgcagcgggatcggccgctgcttggcgatggcggcgatcacgccgcccttggcggtgccatccagcttggtcaggatcaggccggtcaggcccagcgcgtcatcgaaggctttcacttggttgacggtgttctggccgatattggcgtccagcaccagcaccacttcatgcggcgcgtccggcaatgccttctggatcacccgcttcacctttttgatttcctccatcaggtgcagctgcgtcggcaggcggccggcggtgtcggccagcacgatgtcgatgccgcgggcgatggcggcctggatcgcgtcatagcagacggcggcggagtcgccgccctgctgcgcgatcacggtgacgtcgttgcgctcgccccaggcgatcagctgttcgcgcgcggcggcgcggaaggtgtcgccggcggccaggagcacgctcttgccctggctttggtagtacttggccagcttgccgatggaagtggtcttgccggcgccgttgacgccggtcatcatgatcacgaacggcttcttgccttcgacgtccagcggcacttccagcgggccgatcaggtcctgcagcgaatccttaagcgcgcctttgagttcggaagaatccttcaggcccttcaacgatacccgttcgcgcacgtccttcagcagatgcacggtggcgtccatgcccatgtcggcggtcagcagcaccgtttccagctcttcgtacagctcttcgtctatcttgccgccgccgaacaggccggccagctgcttgcccaggcggtcgcgggtcttggccaggccggccttcagccgctcggtccagctcattttcttcagcggcgtcggcgcggcgtcttcggacggtaccggcggggcaacagcggcggcggtttcggccggcagatcgccgacggcatcaggggccggcgccggagcaggcgcttcaagcgcggcggcggccggactggcgggctcggcgatgagtgccggagcggcatcgacgacggctgccggcgtttcggtttgcggtgtctccaccggcttcggttttttcttgaagaagctgaacatgcgtaatcaggccagagatttcggtaaacggctaaattgtatcctcaaatgccctcgcgcaccgaattggcgcgcatggcattgactgcggatggttaacaaatataaggaatatgatgccgtttgttggctggcgcgcgacactaatgcggcgcgagcccgcatgattgaggcggtaaagtcctgatcaggttaaactctggcgcttgtttcaagagtcaagagccatgagtcagtcacgtaacaaggtcagaatcatcggcggcgaataccgccgccgcctgctgccgtttcccgacgccgaaggtttgcgtcccacgccggaccgcgtccgcgaaaccctgttcaactggctgggccaggatctgtacggcaagaactgcctggatctgttcgccggcagcggcgcgctgggcttcgaggccgcctcccgttccgcccgtcgcgtggtgatggtggagaaatcgcgcaaagcgcacgaatcgctgcaagccaatcgacagctgctgcaggccggcgcgctggacgtgcagtgcggcgacgcgctgctgtacctgaagaacagccgcgaacagttcgacgtgatcttcctggatcctccctatgattccgacctgctggagcaggcgctgccgctgctgctgccgcggctggcggaggagggcatggtgtacctggaggccaggctatggccggagcagctgccggaaggcctggaactggtgcggcgcgacaaggccggcctggtgcagtacggcctgctgcggcgcgtcgcggccgcccccgttttgttgtgatccatggccgggtcgccgcataaggttataaccagcgcgaacttgcgacccgccgccgcgggtgacagaattcatgttgtggaatacttgaggaatttactatgtctttgataattaccgacgaatgcatcaattgcgacgtctgtgagccggaatgcccgaacaacgcgatctcgcagggcgaagagatctaccagatcgatcccgacctgtgcacccagtgcgtcggccactacgacgagccgcaatgccagcaggtctgtccggtggattgcattccgctggatccgtcccatcaggagagcgaagaacagctgcatgccaagtatctgaagatttccggcaaggcctgaaaatcgcaaggtattgaaagcaaaggaaacgccccgccgcttgcggggcgtttgccgttttgacgcgaaataattcaaattttttcgcgaaaggtgttgacggcgggggagggcatctataatattcgggtctctcacggggggggttaccccagcggtcaacgggtccggactgtaaatccggcggcttagccttcgaaggttcgaatccttctccccccaccagaatttgtaagacgtttggcaagtggcagtgttgtggtgtagtgaccaggcgggtgtagctcaatggtagagcagaagccttccaagcttacgacgagggttcgattcccttcacccgctccaagcgtttgatagcctgttttaagggcccatgtagctcaggggtagagcactcccttggtaagggagaggtcggcagttcaattctgcccatgggcaccaccaatttactttgcttgtttcgtattcaggaaatttgccatggctaaggaaaagtttgcgcggactaagccgcacgtaaacgtcggcaccatcggtcacgttgaccatggtaaaaccactctgaccgcagcgatcaccaccattctgtcgaagaagttcggtggcgaagctaaagactactcccagatcgatagcgcgccggaagaaaaggctcgtggtattaccatcaataccgcgcacgttgaatacgaaaccgaatcccgccactacgctcacgtagactgcccgggccacgccgactatgtgaagaacatgatcaccggcgcagcccagatggacggcgcgattctggtttgctcggccgctgacggtccgatgccgcaaacccgcgaacacatcctgctgtcccgtcaggttggcgtaccgtacatcatcgtttacctgaacaaggctgacctggttgacgacgccgagctgctggaactggttgaaatggaagtgcgcgatctgctgtcttcctacgacttcccgggcgacgacaccccgatcgtaaccggctccgctcgtctggcgctggaaggcgaccagtccgaaatgggcgagccgtcgatcttccgtctggccgacgcgctggactcctacatcccgactccggagcgcgcggttgacaagccgttcctgctgccgatcgaagacgtgttctcgatctccggccgcggcaccgtggtgaccggtcgtgttgagcgcggcatcgtgaaagtcggcgaagagctggaaatcgttggcctgaaagaaaccgccaagaccacctgcaccggcgtggaaatgttccgcaagctgctggaccaaggtcaggctggcgacaacgtgggcgtgctgctgcgcggcaccaagcgtgaagaagttgagcgtggccaagtactggtgaagccgggctcgatcaagccgcacaccgagttcagcggttcggtatacgtgctgagcaaggaagagggcggccgtcacaccccgttcttcgctaactaccgtccgcagttctacttccgcaccaccgacgtgactggcgcagttacgctggccgaaggcgtggaaatggtaatgccgggcgacaacgtggaaatcactgttaagctgatcgctccgatcgcgatggaagagggtctgcgtttcgcgatccgcgaaggtggccgtaccgtcggcgccggcgt

SEQ ID NO: 2 - DNA, 822 bp, Chromobacterium substugae
atgtccacgcaatggaaacgatggctgtccggcgccgcgctggcggcgctgttggcggcttgcgcccaggtcagcaccaccggcggcggcgcggtcggcgtcagccgcagccagagcatgctgctgtccagccaggaagtggcgcagatgtcggccaaggcgtacgcgcagcagctgggcgaggcgcgcgccgccggccggctcaacaccaacgccgcgctgaccgcgcgggtgcggcgcgtgtcgcagcggctgatcgcgcagacgccggccttccgcgccgacgcccggggctggccctgggaggtgaacgtgctcgctaccgacgacatgaacgcctacgcgatggccggcggcaagatcatggtctactccggcctggtcagccagctgaagctgaccgacgccgagctggcggcggtgatcggccatgagatctcgcacgcgctgcgcgagcacacccgcgagagcatgagccaggaatacgcgcagcaggccggcctgtcgctggtgggcgcgctggccggcttcagcgccgaccagctgaaactggcttcgctggtgaccgacgtgacgctgagcaagccgcatagccgcaccatggagtccgaggccgacatcatggggctggaactgatggcgcgcgccggctacgaccccaacgcggcggtgaacgtgtggcagaagatgcaggcggccggcaacggcggcggcatggagtttctgtccacccacccgtccggccccacccgcatccgcgacctgcaggcccacatcccgcaggtatggccgctgtacctggccgcgccgaaaaagggctga

SEQ ID NO: 3 - DNA, 1470 bp, Chromobacterium substugae
atgagaaaacagcaattgatgttgcgtggtttggtcctgtccgccctggctgtgttcagctcggcggcgctggcggccgagcgtatcgacctggaaaagctgggcaagatccaggccaacggcgcggtggcgttcaccggcgtgaaccaggctgatctgaagcccctgcgcagcacccaattcgccaccggcaaagtggtgacccgcttccagcagtactaccagggcgtgccggtatggggcgaagccgtggtcgaggaaaaacaggccggcgccgtggccaagaccagcggcaaactatccggccaatacatcgccggcatccagtccgacctggcttccgccaagccgacgttgagcagcgcccaggcgttgagccaggccaaatcgctgaaggccaacggcaatcccacctacaacgagaaagccgacctagtggtgcgcctgaacgagcgcaacaccgcccagctggtctacctagtgtccttcgtggtcgacggcaaggagcccagccgcccgcacctgatcatcgacgccaacaacggccaggtgctgaagcagtgggaaggcctgaaccacgccgaagccaacggccccggcggcaacgccaagaccggcaagtatgtctacggcaccgactacggtccgctgatcgtcaccagcgattgcaagatggatagcggcaacgtcgccaccgtcaacctcaacggcggcaccagcggcaccaccccgtacaagttcgcctgcccgaccaacacctacaaagcgatcaacggcgcttactcgccgctgaacgacgcgcactacttcggcaacgtggtgttcaacctgtacaaggactggttcaacctgaagccgatcaaccagaagctgctgatgaaggtgcactacagccgcaactacgaaaacgcgttctgggacggcaccgcgatgaccttcggcgacggcgccagcaccttctacccgctggtgtcgctggacgtgtccgcgcatgaagtcagccacggcttcaccgagcagaactccggcctggtctacgacggccagtccggcggcatcaacgaggcattctccgacatggccggcgaagccgccgagtactacatgaagggcaagaacgacttcctggtgggcgcggaaatcttcaagaagaccggcgcgctgcgctacttcgccgatccgaccaaggacggccaatcgatcggcaacgccaaggactactacgacggcctggacgtgcactattccagcggcgtgtacaacaaggccttttacctgatcgccaccagcccgaactggaacacccgcaaggcgtttgaagtgttcgtcgacgccaaccggctgtactggaccgccaacgccacctacaacagcgccgcttgcggcgtggtcaaggcggccgacgcccgcggctacaacagcgccgacgtcaccaaggccttcaccgcagtcggcgtgacttgcaaataa

SEQ ID NO: 4 - DNA, 552 bp, Chromobacterium substugae
atgcagcaatttgacggaaccaccatcgtttccgtccgtcgcggcgagcgcgtggcgctgggcggcgacgggcaagtgaccctgggcaacatcgtgatcaaggcgacggcgcgcaagatacgcaagctgcacggcggcaaggtgctggccgggttcgccggcggcaccgccgacgccttcaccctgatcgagcgcttcgaagccaaattgcagaagcatcagggcaacttgctggtgtcggcggtggaactggccaaggattggcgcaccgaccgcatgctgcgccggctggaggcgatgctgatcgtcgccgacaaggaccacacgctgatcatcaccggcaacggcgatgtgctggagccggagcagggcatcgccgccatcggttccggcggcgccttcgcgcagtcggccgcgcgcgcgctgttcgagaataccgatctcgcgccggaggtggtggtgaagaagtcgttggagatcgccggcgacatctgcatctacaccaaccacaaccacctgatcgaaaccctgggcccggacgacgaggcctga

SEQ ID NO: 5 - DNA, 1347 bp, Chromobacterium substugae
atgacgcaaatgaccccgcaggaaatcgtccacgagctggaccagcacatcatcggccagcacgccgccaagcgcgcggtggccatcgccttgcgcaaccgctggcgccgccagcaggtggccgagccgctgcgcagcgagatcaccccgaagaacatcctgatgataggccccaccggcgtcggcaagaccgagatcgcccgccgcctggccaagctgtccggcgcgcccttcatcaaggtggaagccaccaagttcaccgaggtcggctatgtcggccgcgatgtcgacaccatcatccgcgacctggcggaagtggcgatcaaggaaacccgcgacgccgccatcaagcgcaaccgcgtccgcgccgaagacgccgccgaggagcgtatcctcgacgcgctgctgccgcgcgtgcatcagccgcaaaccggcttcttcgccggcgaaccggcggtcgaggacaagcatgaggacggcgccacccggcagaaattccgcaagatgctgcgcgagggcaagttcgacgacaaagagatcgaactggaaatcgccgcccccatcgcccagatgaacgtgatggcgccgccggggatggaggatttcgccagccagctgcagggcatgttccagggcctgggcgcgggcaagaagcaggccgccaagatgaaggtggccgacgccttcaagcaattggtcgacgaagaggcggccaagctggtcaacgaggaagagctgaaggcggaagcgttgaagaacgtcgagcagaacggcatcgtgttcctcgatgaaatcgacaaggtcaccagccgcggcgaaggccagggtggcgccgacgtgtcgcgcgccggcgtgcagcgcgacctgctgccgctggtggagggcaccaccgtgtccaccaagtacggaatggtgaagaccgaccacatcctgttcatcgcctccggcgccttccagttgtccaagccgtcggacctgattccggagctgcagggccggctgccgatccgcgtcgagctgtcgtcgctgtcggtggacgatttcaaggcgatcctgaccagcaccaacgcctgcctgacgcgccaataccaggcgctgctggctaccgagggcgtggagctggcgttcgaagagtccggcatccagcgtctggccgagatcgcctggcaggtcaacgagaaaaccgagaacatcggcgcgcgccgcctgtacacggtgatggaaaagctgctggaggaggtggctttcgacgccaagtccggcgagcgcaagatcgacggcgcgtatgtggactgcaagctgggcgaagtggccgagcgcgaagatctggcgcgctacgtgctgtga

SEQ ID NO: 6 - DNA, 1446 bp, Chromobacterium substugae
atgatgaaacgccgcctgctgtgcgcgctgctggcctcggtgctggcgcagccgctgaccgtccgcgccgacctgcccgacctgggcgagatttccgacgcctccctgtccctgtccgacgagtcccgcatcggccgcgacgcgctgcgcgcgatgcgcgaggccggcgacgtgctggacgacgccgagatcagcgcctacctgaacgacatcggcggcaggctgtcgtcgtcggtgacgctgcccggcatccatttcacctatttttgcgtcgccgacaccggcatcaacgccttcgcgatgcccggcggctacatcggcgtcaacatcggcctgatcctggccacccagagcgagggcgagctggcggcggtgatgggccacgaaaccgcccacgtcgcccagcgccacatcgcgcggatgcaggcggccaacagcgccaccagcccgctgctgctgctgggcaccatcatcgccgccgcgctggcggccaaagccggcagcggcgacggcgcgatgggcgcggtgtcggccggcatgggcttgtcgatttcgcgccagctggcgttctcgcgcgatttcgagcgcgaggccgaccgcgtcggcatgcagttcatgagcaacgccggctacgacgtgcgctacatggccaccttcttccagcggctggagcaggcgggccgctacagcgacaccatggcctacgccttcctgcgcacccacccggtgacggtggagcggatcagcgaggcgcagaaccgcgcgctcgactacccggtgcggatgcgcgccgacagcatcgactacctgctggtgcgcgaaaagctgcgcacgctgaccatgacgccggaagaggcgctgttctactacaacagcacgctgcagcgcggcctgtacctgaacgaaggcgccagctggtacggcctggcgcgcgccaagctgctgcagcacgaccgcaagggcgccgaggaggcgctggccaaggcgcgcgccaagctgctggacaacccgatgctgcacgggctggaagtggagatcgcccgcgacggccgcgactggagcgcggcggcggcggcggcccgcgacggcctggccgccttcccgcgcaacgtggcgctgcaattggcgcagatcgacgtggcgctggacagcggcgaccgcgccggcgcgcagaagctgctgcgccagcaattgaacgaccgcagcggcgacccggcgctgtaccggcgcgaggccaagctctacgccgaccgcgacccgctgcgctaccacgaggcgctgggcaacgctttctattacgagcagcgctattcgtcggcgctggagcagtaccagctggccagcaaggccaagggcgacgacttctacctgcgctcgatgctggaggcgcggctgcgcgaggtggaaaaactggccaaggacgagcgcaaggctgcgcggaattga

SEQ ID NO: 7 - DNA, 1794 bp, Chromobacterium substugae
atgacccagtccctacccgtgcattattcgctgcgcccggtttcgccggccgcgcacctgtttgaagtgagccttaccgtgacgcacccggccaagaacggccaggtgttttttttgccggcgtggattcccggcagttatatgattcgcgagttttccaagcacattagcggtttgtccgccgcgtcggccggcaagccggtggctttgcggcaattggcgaaaaaccgctggcaggccgacccggtcaaggggccgctgacgctgagctatcaggtttacgcctacgatctgtcggtgcgcggcgcctacctcgacagcgagcgcggcttcttcaacggcaccagcgtgttcctggcggcggaaggctacgagaacgacgcctgcagcgtggatatccatgcgccggaaggcaagtcttatgctgaatggaaagtggccaccagcctgccggccgccgacgtgaagaagaaatccggcttcggccgctaccaggcgtccagctatgacgaattgatagaccacccggtggagctgggcgatttccacaaggtcagcttcaaggcctgcggcgtgccgcacgaattcgtcgtgtccggccgcttccagggcgacctcaagcgcctggctgacgacaccaggaaaatctgcgaataccagatcggcatgttcggcaagccggcgccgttcgaccgctacgtgttcatgctgttcgtcggcaaggacatctacggcggtctggagcaccgcgcgtccaccgcgctggtggccaaccgcgacgatctgccggcgccgggcgcgaccgaaatcagcgacggctacctgaaactgctgggcctgatcagccacgaatatttccacagctggaatgtcaagcggatgaagccggcggttttcgcgccgtatgatctgaaccaggaaggccatacccgcctgctgtgggcgttcgagggcatcacctcgtactacgacgacctggcgctggtgcgcagcggcctgatcgacgagaaacgctacctgggcctgctggccgaaaccatcaccggcgtgcaacgcggcgcgggcagaatgaagcagacgctggagcaatccagcttcgaagcgtggaccaagtactaccgccaggacgagaacagccccaacagcatcgtcagctactacaccaagggctcgctggcggccttggcgctggacctgctgatccgccgcgacagccagggcaagcagtcgctggacgacgtgatgcgcgcgctgtgggccaagtggctggccgacggcaagggcctggaagaggacgagtgggagaagatcgccatcgaaaccaccggcctcgacctcaagcccttcttcgacctggcgctgcgctccaccgcggagctgccgctggctgaactgctggccagccagggcatcgaactgcaattcgaggcggcgcaaggcggctccgaccgcggcggcgtggtggaggctttcgccgccaagccggcgccgctggcgctgggcgtcaagaccgcgcccgatgccgctggcgtcaagctggcccatgtgctggacggcggcgcggcgcaagcggccggcctgtccggcggcgacgtggtggtggcggtggacaagctgcgcgccgtggatctggacaagcagatcgcccgctaccaggccggcgacaagatcaagctgcacgcttttcgccgcgacgaactgatggctttcgagctgacgctgcaggcggcgccggcggatacctgccgcctcaagccgcagccgcaggccggcaagtggatagccggccgttga

SEQ ID NO: 8 - DNA, 630 bp, Chromobacterium substugae
atgcctcgccacaaccccgacgcggacgacgacgacaagcccgtcccgctgtatcgccaatatgaaacccagggcacggtgcggcagatatcgttttacctgtccgacgagatcggcgccgccatccactacaccgacctcttgtacacgctgcgcaccgccagcagcaccgacatcgtgtttctgcacctgaacaccccgggcggcaatttcgacgccggcctgcagatcatcaacaacatcaccgccagcccggcccacgtggtcaccatcctggaagcgcgcgcctattcgatgggcgcgctgatcttcctcgccggcgacgagctgatcgtccacgacacctgccaattgatgttccacaactactcgtcggcactgataggcaagggcaatgagcaacaggcccaggtgatggccagcggcaagtggttcgagaaggtgatgcgccacatctgccgccccttcctcacagacgaggagctggaccgcatccagaaaggcgaggacatctggctggacagcgacaacatccgccgccgcctcaaccacatccgcaagggcgagccggccgcgcagccgcgcaaaccagccaaacgcggcggccgggcagagccggacgccggctga

SEQ ID NO: 9 - DNA, 711 bp, Chromobacterium substugae
atgaaaaacgccagcgtctggcaccgcctgcctctgcctgacggcgaggtgccggtgctgctcacccgccgcgcgcgcaagagcataggcatcaaggtgcacggcggcgtggtggagctgatcgccgcgcccggcgtcagccagcagcggctgcaccaggtgctggagctgcgccgcgactggatagtcggccacgtgctgcgccagcgcagccagctggctgccggcgccgagctcactcacctgactctgctgggccagccgctgccgctgcaactggccggcggcctgcgcaaaacggcgcgccgcagcggcgacgcgctgctggtgggcggggtggccgccggcgaccgcgacggcctgaaggcggtggtggccaaattcctgaaacgcgaggcggctacgctgtttcccggccgcctggccttgctggcggcgcgctgttcgcgccagccgtccagcctgcagctgtcgtccgcccgcacccgctggggcagctgcagcgccgatgggcggatccggctgaactggcgcctgatgcaggcgccgctggcggtggtggactatgtgatcgcccatgagttggcccacttgctgcacatgaaccattccccggcgttctgggccgagaccgagcgtctgtgccccggctggcgcgatgcacgccgctggctgcgccaatatggcggcgccttgtttgcttttgattga

SEQ ID NO: 10 - DNA, 630 bp, Chromobacterium substugae
ttgattcagcaactggcgatctccatcctgccgattcttttcgccatcaccgtgccggccggcgcgcaggcctatatggccgaccatctgggcgaccgcaccgcctacatgaccggccgccgcaccttcagcccgctggcccacatcgacccggtgggctccatcctgctgccgctgctgggcgtggcgctgggcggcttcatcatcggctggcccaagtcgctgcaactgaacgccggcgccatgcgcaagccgcgcagcgcgctggccaaggtggcggtggtgacgccgctggccaatctggcgatggcgctgctgtgggcgggcttgatcctggcatccgcccatgtgccggcctatttcgccgagccgctggcgctgatggcgctggtgggcgtcaagatcaatgtggcgctgatgatcttcactctgatcccgctgccgccgctgccgggcggggtgattttgcaggcgctgctgccgcagcgcgcggcctggcagttttcccgcatcgagccctatagcttctggattttgctgctgctgatgttcagcggcctgctcggcaagctgttgctgccgctggtgcaagtgattttccagctgatcgtgggcgtggcggcgggctga

SEQ ID NO: 11 - DNA, 639 bp, Chromobacterium substugae
ttggaaatagaccagctggtccggcagatcaccatctacgcgctgccgctgttgttcgcgattaccctgcacgaagcggcgcatgcttatgccgcgcgccgcttcggcgacagcaccgcctacatgctggggcggatgacgttgaatccgctcaagcacatcgacccgatcggcacggtgctgctgcccttgctgctgttgatgaccggcggcttcatttttggttgggccaaaccggtcccggtgaacttcagcgctttgcgcaagccgcgccagcacgggcgctgggtggcggcggcgggcccgctggccaatttcgcgatggtcatcctgtgggcgagcctgcaaaagctggcgtctgttggcgtgggcgaattcagcgagccgctgtggctgatgggccgcgccggcgtcgccatcaatatctcgctgatgctgctcaatctgctgcccatcctgccgctggacggcggccgcatcgtcgaaagcctgctgccgccgcgctgggcctggcgcttcgcccagaccgagcgctacggcatgtggctggtgttgatcctgctggccaccggcggcctgggtttgatcctgcagccgttttaccgcttgatgtatgatctgatccgactgtttttctag

SEQ ID NO: 12 - DNA, 1443 bp, Chromobacterium substugae
atgaacattcggcaggcgatattgggcggtttgatcggcggcatggctgcgggaatgggcggggcggcctgggccgcggagcgcgtcgatctggcggcggccggggcggcgtttcccggcatcgagcaggcggggctgaaggcgcagcgcagcgcgcagtttcccgacggcaaggtggtgacgcgctaccagcagtactaccagggagtgccggtatggggcgaggcggtggtggaggataagcgtcccggccagcccgcgcagtacagcggccgttatatcgcggggatagaggccgatctggcttccgcgcagcccaccgtgaagcgcgacgccgcgctggcgcaggccaaggcgttggcggcgaacggctatcccacccgcaacgacaaggctgagctgtgggtgcgcgtcaacgaaagcggcgtcgcgcagctggtctacctggtttccttcgtggtggaaggcggccgcggccccagccggcccaatttcttcatcgacgcgcatggcggccaggtgctgcagcgctgggaaggcctggcccatgccgaggccggcgggccgggcggcaacgtccgcaccggcaaatacgtttacggcaaggactacggccccttgatcgtcaccagcgattgcgcgatggacagcggcgaggtggcgaccgtcaacctggcgggcggcacccgcggcgacgcgccgttcaagttcgcctgccccaccaatgattacaaggcggtcaacggcgcgtactcgcccttgaacgacgcgcactttttcggcaacgccgtggtgaaaatgcacaaggcctggttcggcgccgcgccgctgcggcagaagctgtacgtcaaggcgcattacggcaacggctccgaggcggcgttctgggatggccaggcgctgaatctgggcgatggctccagccgcttctacccgccgacggtgctggacgtgatcgcgcacgaggtgcatcacggcttcaccgagcaaaattccggcttggtctaccagggccagtccggcgccatcaacgaggcgttttccgacatggccggggaggccgccgagtattacctgcggggccggaacgactggctggtcggcgcggaaatctacaagcagggcggcgcgctgcgttatttcatcgacccggcgcgcgacggacactcgatcggccatgcccgcgactaccgcgacggcatggacgtccactacgccagcggcgtgtacaacaaggcgttctatttgctggccactcgtccgggctggaacacccgcaaggcgtttgaggtgtttgccgacgccaaccggctctactggacggcgaatgccactttcaatagcgccgcttgcggcgtgagccgcgccgcggaaacgcgcggctacggcaagcaggacgtggcgcaggctttcgccgcggtgggggtggtttgcgccgcttga

SEQ ID NO: 13 - DNA, 939 bp, Chromobacterium substugae
atgagcgacacccccaactgggaacgtcaattgctggaaaaactggccaccgcagccctggtggagcaacgccgcgcccggcaatggaaaatcttcttccgcctggcctggctattgatcatcggcttcgtcgtcgccagcctgttcatgcgcagcgaagacaaggccggcgccggcctgtccggcagcggacacagcgcggtgatcaagctggatggcgtgatcagcagcgacaacgacagcggccagaaaatggtggacgcgctcgaccacgccttccgcgaccgcaacaccaagggcgtcatcatcgacgccaatagccccggcggcagcccggtgctgtcgggcatggtctacgacgagatccgccgcctgaagaagaagcacgccgacattccgatctacgtggtggtgagcgacgtctgcgcgtccggctgctactacatcgccgccgccgccgacaagatcttcgtcgacaaggccagcatcgtcggctcgatcggcgtgctgtccgacggtttcggcttcaccggcgccatggaaaaactgggcatcgagcgcagactgaagaccgccggcgaaaacaaggcgatgggcgaccccttctccccggtcaaccccaagcatgacgccatccgccagcagttgctggacgacatccaccagcagttcatccaggcggtgcgcgacggccgcggcaagcgcctgcagaacgatccgcaaatgttcagcggcatggtatggctgggcgccaaggcgattccgctgggcctggccgacggcctgggcaccgtgccgtcggtggcccgcgacgtggtcaaggcggagaagaccgtcgactatactcagcaggacgacttttccagccgggtggcgcgccgcataggcgtgcagttcgccggcggcgtcaagtcgctgttcgacaccgccctgttctag

SEQ ID NO: 14 - DNA, 1350 bp, Chromobacterium substugae
atgatcaaagctcccgaactgctgctgcccgccggcacgctggataaaatgcgcgccgcctacgactacggcgccgatgccgtctatgccggccagccgcgctacagcctgcgcgcccgcaacaacgacttcaagctggaagaactgaaaatcggcatcgacgaggcccatgcccgcggtaagcagtttttcgtcgccagcaacatcctgccgcacaacagcaagatcaagacctatatggccgacatggcgccggtgatcgagatgaagccggacgcgctgatcatggctgatccgggcctgatcatgatggtgcgcgaaaaatggccggaagtgccggtccatctgtcggtgcaggccaataccgtcaactacatgggcgtgaagttctggcagaagctgggcgtgtcgcgcatcatcctgtcgcgcgagctgagcctagacgagatcgccgagatccgccaggaatgcccggacatggaactggaagtgttcgtccacggcgccttgtgcatcgcctattccggccgctgcctgctgtccggctacttcaaccaccgcgatcccaaccagggcacctgtaccaacgcctgccgctgggactacaagatgcacgacacccagggcgacgacgccggcgatgtgcaggtgatccagttcgacttcaacaaggcgatggaagaggccaatcagagcttctcttcctgcggcagccagcagcgccatcctttggccgacaagacctatctgatcgaagaaggcagccgtccgggcgaactgatgcccatcatcgaggacgagcacggcacctacatcatgaactccaaggacctgcgcgctgtcgagcaggtggagaagctggtgaagataggcgtggattcgctgaagatcgaaggccgcaccaagagcctgtactacgtggcgcgcgccgcccaggtgtaccgtcaggcgatcgacgacgcggtggccggccgcccgttcgacctcaagctgctgtccgacctggatggcctggccaaccgcggctacaccccgggtttcctggagcgccatcagacccaggaataccagaactacctgaccggccactccaaggccaagcaaagccagtatgtcggcgatgtgatcgaagtggacgccgacggctgggcgctgatcgaggtgaagaaccgcttcggcgtcggtgacaggctggaggtgatccacccgtccggcaaccgcatcatcgaactggcggaaatgacccgcaacggcgagtcggtgcagcttgccgccggcaacggcatgcaggtgcgcatccccggcctgcagggctatgacagcaaggcgctgattacccgcctgatgtga

SEQ ID NO: 15 - DNA, 1620 bp, Chromobacterium substugae
atgtcgttgaaaaatcaaacccttgccatgctgctgggcagcgcgatcagcctggcagcccatgccgccggcggctgggccgccaccggcacccaagcccacccggtacggcagttgatccccagcgcgacagataatggagagatcgccagcggcgagctggtccaaatcgcggtgagtctggcgctacgcaaccaagccggactcgacgcgctgaccgccggcatcctggccggccaggggcagccgatcagcgacgcccagttcatggcccaatacgcccccaccgccgcccaggtgcagcaggtggtcagccatttgcagcaaaacggctttcgcaacatcagcgtcgatcccaataatctgctgatccacgccgacggcagcgccgccaccgtctacagcgctttccaaaccaggctgcaccgctacaacgtcaacggccgccaggctgtcgccaacgtggcgactgctcaggtgccggccagcctggccggcatcgtgctggcggtgcacggcctgcagaatgtccaccagttccacgcggccttccgcgcgcaggccgtcgccaaatccagcgccggcgtgatggcccacaagcccgccgatttcgcatcgatctataacgccgccagcctgccggcagccaaaagcggcgtggccggcatcatcgccgaaggcaatctgaaccagacggtggccgacctgaacagctacgccaggagcgccggcttcgccgcgcccagcgtcgccatcgtcaacgccggcgcgcccagcggcgacacctccggcatcgtggagtggaatctggacagccaaaccatcctggccgccagcggcggagccttgaaacagctgcaattttacgcagcgccgtcgatgagcaatgccgacatcgcagcggcgatcaacaaggcggtgagcgccaacagcgccaaagtggtgaatgtctcgctcggcgaatgcgaactgggcgcgcaagcttccggcatgaccgccagtgtcgaccagatgctgcaggctgcagtcgcccatggccagaccttctcggtatcgagcggcgatgccggctcctacgaatgcggcggcggcactgcctatcagagctaccccgcggtatcgccctatgtggtcgcggtcggcggcaccacgctcgccaccaacggcagcgccgcctacggcagcgagcaagcctggagcggcggcggcggcggacccagctataccgaagccgcaccggcatggcaaaccgccgccggcgtgctgagcgtcagcaaaacccgccgcggcgtgcccgacatcgccttcgatgccgaccccaacagcggcgagctggtgctggtggccggcgccgcctaccaagtgggcggcaccagcctggcggcgccgctgttcaccggcttctggaaccgcatccaatcggcaaacggcaacaaactaagctcgcctgccaccgccatctacaaatacttcaaggccaatcccgcgctgtaccatgatgtgagcggcggcggcaacggcgctttcaaggctgccgctggctgggattacgccaccggctggggcagcctcaacgtcgccaatctcaacagcttcatcggcaagaccgccggcttctga

SEQ ID NO: 16 - DNA, 1629 bp, Chromobacterium substugae
atgtttgtaaaacagcacgctattgcattgatcatcgccggcatgttcggcgccggcgccaacgcagctgaagcttgggtcaataccgccactcaagcgcatccggttctggccacccttaccgccgccaaggccaccaccgaagtcgccgccggccaatccgtgcatgtcgccgtcacccttaaggtccgcaacaaggctcaactggacgctctgaccagcagcctgctggccggcaccagccacaaaaccctcagccatgccgaattcatggctcaatacgcgccgacccaggcgcaagtggacaaggtagtggcccacctgcaaaagagcggcttccgcaacatcaaggttgccgccaaccgcatgctggtcagcgccgacggcagcgccgccaccgccaagaccgccttcaacgccagcctgcgccacgtcagcgtgaacggccgcagcggcttcgccaactcgacggccgctcaggttccgcaatcgctgggcaatatcgtcctgtcggttcacggcctgcagaacgtgcatcagttccacaccaccctgcagaaggccggcgtgaagaccctggctgcggccaaaaccaacagcgtcaccggccacaacccgaccgacttcccgctgatctacaacgccagcagcctgccggccgctaccaacaccaccgtcggcatcatctccgaaggcgacctgacccaaaccctgcaagacctgcagcagtttgaagattccgccggctacagctatgtgcagaccaacgtgatcaacgccggcgacgcgtcgtccgacaccgatggcatcggcgagtggaacctggacagccaggacatcctggccgccgccggcggcgcgctgcagcaaatgaacttctacgtcgccacctcgatgaccaacgctgatatcaccgctgcctacaactccgcagtcagcgatggttccgccaaggtgatcaacgtatcgctgggcgaatgcgaaagcgacgcgcagagcgacggcaccgtcgcctccgacgaccagatcttccagaccgccgtagcccagggccagaccttctcggtctccaccggcgactccggctccgccgaatgcggcagcagcgcaggccaaagctacccggccacttcgccgtacgtgatcgcggtaggcggcaccacgctgtccaccagcggcaccaagtactcgtcggaatcggtatggaacggcggcggcggcggccccagcgttgtggaagccgccccggcttggcaaaccaaagctggcgtactgaccacctcgaagaccaagcgcggcgtgccggacgtatcgtttgacgccgacccgaacagcggcgcgctggtcatcgtgcaaggcagcagccagcaaatcggcggcaccagcctggccgctccgttgttcaccggcttctgggcccgcatccagtccgccaacggcaacaacctggtatcgccgaacaccgccttctatcagtacttcaaggccaacaccggtctgtatcacgacgtgacttccggcaacaacggcggctacaaggccgccaagggctgggactacgccaccggttggggcagcctgaacgtctccgcgctgaacaccttcatcggcagccattccggcttctga

SEQ ID NO: 17 - DNA, 1413 bp, Chromobacterium substugae
atgtcggttaaaaaactgatcatttccgtaatgctgtcggcatctttctttgccgcccagctgcctgccgccatggcggctgagctgccggatttcagcggtatcgtcgaaagcgagggcaaggcggtggtcaatatcagcaccacctcaatggtgaaggaggcgacggcggatgtgccggagggaatggagggcgatccgttcttcgaattcttccgccgtttcgcgccgccgcgtcagcaggaacgccaagagaattcgctgggctcgggcttcatcatctcttccgacggttatgtgctgaccaatgcgcacgtggtggcgcgcgcggagaagatcacggtcaagctgacggacaagcgcgaataccaggcgcgggtgataggctctgacgcccgctccgacgtggccttgatcaagattgacgccaataatctgccggtggtgcgccgcgccgaccccaagacgctgaaagtgggcgagtgggtgctggccatcggctcgcctttcggtttcgagaacaccgccacttccggcatcgtgtccggcaagaaccgccagctgccggacgagagctcggtgcagttcatccagaccgacgcggcggtgaatcccggcaactccggcggaccgctgttcaatatgcgcggcgaggtggtgggcatcaactcgcagatctatagccgctccggcggcttcatgggcatctccttcgccatcccgatcgacaccgcgatgaatgtggcggaccagctgaaggccaagggcaaggtgacccgcagccgcatcggcgtggtgatccaggagttgagcaaggacctggcggcttcgttcgggctggcgaagcccagcggcgcgctggtgaacgcgctggacccgaaaggtccggcgcagaaggcgggcctgaaggcgggcgacatcatcgtcaaggtcaacggccaggatgtgaattccggcggcgatctgcagcggctgatcagcgacatgccgccgggcaaggccatcgcactggatatctggcgcaaccgcgcgccgctgagcatcaaggtggtgccggaagagctgaaggcagaagacgcgcgggtggcgcagcgcgaataccgcaagccgggttcggaaaacgagcagagtctggcccagatcggcctgcgcctgcaggagctgagccccgcccagctgcagcgcgccggcattgcgtatggcctcttggtgcgccaggccaacggcgtggcgctgcgcgccggcatccagccgggcgacgtcatcgtcggcatcggcagcgatccgctgcaaagcttcgcccaactgaagaaggccttggagcaggcgaagaacggcggcacggtggccttgcaggtgatgcgccagggcatggtacagttcgtgcctttgacgataggcgaggccaagtga

SEQ ID NO: 18 - DNA, 1842 bp, Chromobacterium substugae
ttgattcggctacgccgaacaaaacaaaggaaatcagaggataaaaccatgcaccatcgcatctcaagcagcgcggttctgctggcgctcgcatcgctgtccagccatgccgccgccgaacaaccgcgcaacactccgttgcagccgggcgacccgctagccgcgcaacaatggcacttgcagaataccggccaaaacgcgttttccaaacgcggcggcgtcaagggcgtcgatctcaatctggccttcactcacttgcgcggcatccgcggagtcggcaccaccatcgccgtcatcgacgacggcctggaaatccgccacccggacctggccgccaacatcgtgccgggctccaaaaacctggtgaacggcagcaacgaccccactcccgactcgcccgacaacgcccatggcacctcggtggccggcatagcggcggcggtgggattcaacggcataggcggacgcggcgtggcgccgtccgccagcctgaaaggcttcaactggttgctggcgcaaacgctggacggctggctgctgtcgcacggcaaacaaccgggcggacggccactggaggccttcaccgattcacgcgtgttcaaccagagctacggctcctccgccgtccgctccaccccgggcaatcccgaccaggacatcgaactgaaaaccgaggaggaaacctacgaagacgtcagccgcaacagccactggggccgcggcgcgaccttcgtcaaatcggccggcaacgcctacagctacttccgggccggcaacggctacctgataggctacaagggcaatgaaggcctgccggtgcaggacgccaacctcaccaccgacaacagcaactactggaacgtggtggtatcggcgctgaacgccgacggcgtgcgctcctcgtactcgtcggtgggcgccaacgtgctgctgaccgcgcccggcggcgaatacggcaccgactcgccagccatgatcaccaccgacctgaccggttgccagcgcggctggaatatcgccggcagcagcgacaacgcgctgcacggcggcaacgcgctggaccccaactgcgactacaacggcgtgatgaacggcacctcgtcggcggccccggccacctccggcgccttcgcgctggtgatgtcggccaatccggccctcaacgcccgcgacgtgcgccacatcctgatcaccaccgcccgccaggtggatgcggccaaccccggcgtcgcgctggccttccaggacgccggcggcggcagccaccgctaccaggcgattcccggttggcagaaaaacgccgctggcctgcccttccaccagttttacggcttcggcctgatcaacgtcgacaaagcggtggaaaaagcgctgttctataaccgcccgctgccgccgctggaaaaaacccgctggcagaccatcagcgcgcaggcatccattcccgacgccgacgaaaaaggcgtggaaagcgtctacacccagccggacaatctcacggtggaggcggtgcaaatcctggtggatgccgagcacagccgcgccagcgacctggcggtggagctgatttcgccggccggcacccgctcggtgctgctatcgccgcgcaccgcgctggtggcggaagactacggtctcaatcagcagcgcctgctgtccaaccatttctacggcgaatcggccaagggccaatggcgcatccgcgtgatagacaccaacggcggcgactaccagttcatccaccgcgtcggcgccaagaacaccacttacaccctgcccaatgcggcgggcaaactgaaatcgtggtcgatccgcttcttcggccacaggagcgcaacatga

SEQ ID NO: 19 - DNA, 579 bp, Chromobacterium substugae
gtgcgcaagggcaatcagattgccatcgccgccgatagccagactacttttggcgacgaccagaagctgctggcgccgtacgactgcttccacaacaagatcttccgccacggcgacagctatctggctgtgtccggctcggccgcgcacgacctggtgctgcagggcgcgctgaaggatctgaagaagaaagacctgagcagccgccaaggcatcttcgacactttccgcaagctgcatcccaagctgaaggacgccttctatctgcgtccggaggaggatgaggaagatccgtacgaatccagccagatgatggtggtgatcgccaacgcccacggcattttcggcgtgtacccgatgcgcgagatctacgaattctcccgcatctgggcgataggctcgggccgcaaattcgcgatgggcgcgatgtacgcggtttacgatcaggacctgtccgccagggagatcgccgagatcggcgtgcgcgccggctgcgaattcgacgtcagctcctcgatgccgatgtctgtctataccgtagagttggccgcgagcgcggccggggaagtaaaagcatga

SEQ ID NO: 20 - DNA, 1230 bp, Chromobacterium substugae
atgatgaaacccgccattgcccgcctgtcctcctggatcgccatgttggcggcgccagccgctttcgccgcggccgagaccagcgacctgtcgctgcgccaggcagctatcgccgcgttcgcgccgcagccgtccttggccaaacaggtcctggaaccattagtggaagagagccgcgtcagcgcggaccgcctgtgggtgctgggcgcgctcacccagccgctgccgatgcttgccggcgacgcggcggcggacatggtgccgccatcccgccagttcctggcgcgccaaacgccgcaaggctggcaagtggcgccggaaggcagcgaggcattcgccgcgctgctggccgccgcgccggcaggttggctgagcaatgatgagctgcgcgcctggcaaagccaggctgcccgcggcaaacggctggcgccggacgccaccggcctgggcctgccctggcaggaaggcgccgcctggagcctgaccggcggcgcgcatggctacagcggcgaaagccagccctacgattcgatagatttcgccggcggcgatgggcgggtgctggcgccgctggccggcgtcatctacaaaagctgcgtgcgcaacggcagcgcgctggtcaagctggtgcacgacaacggctactcgaccacctactaccacatggtcaagctcagcgccgcgccggatggccagcgggtggccaagggcgcgtatctcggcacgataggcaacggcttgccttgcggcggcagcaccaccggcccccatgtgcacttttccctgatccatcagggacaggccgagccggtgcaccgcaagcagatcggcggctggcagtttttcgccggcaaccgcgcctaccaaggctacgcgcagcgcaatggcaaccgggtgaatgtcggcggccggctagtcaactacggcgctggcgactctactccagcaccgggaggcgtcagcggcatcgccacgcccggcaacggcgacagccgcgtcaacctgcgccgcgcgcccagcctgagcgccgacgtcgcgggctcggcggcccgcggggagcaggtggcgctgcaatgccatgtccgcggcgagatggtgaacggcgtatggggccgcaccgacatctggaaccgcaccgcagccggccactggatcagcgacggtttcctcgataccggcagcaacgccccagtggcgccgccctgcccttcggcccagcctctatggtga

SEQ ID NO: 21 - DNA, 909 bp, Chromobacterium substugae
atgaatcccatcacctcgttcattgtcgctgttttctttttatctggcctgctggcttatgcgtccagctatctgccgctggccattttgctttgggtatgcgccgcgatcgtggcgcaagccttgcgcatggccaacacctggcagaaatgcgtcgtgctgcgcgccggcaagctgcgcggcgtcaacggacccgggctgtttctgatcatcccggtcgtggaccgcgtggtggccaccatagacgaaagaatccagaccaccgccttcaatgccgagcaggcgctgacccgcgacacggtgccggtgaatgtggatgcgatcatcttctggcatgtgcatgatgcgcagaaggcggcgctggccatcaccgattacacgcaggcgattgatagaatcgcacagacttccttgcgtgaaatgataggcagctcgatgctggccgtgctgctcagcgaccggcaaggcacggtccaagcgctttgcgccaagatcgccgacaaaacggcggagtggggcatcaccgtgcgctcggtggaaatccgtgacgtcgccatcccggtggcgctgcaggacgccatgtcgcgccaggcgcaggccgagcgggaaaaacaggcccggatcatcctgggctccgccgaggctgaaatcgccggcaagtttgtcgaggcggcgaatatctacgcggaacatcccgccgcgctgcaattgcgggcgatgaacattatctatgaaaccaccaaggagcgcggcaccacgattctgatacccagcgccatggtggatagcctgaatccgctggccgccatcggcaaaaaggcttcgccccgccatgccgcggcagccgccgtggccaatcacgccagtccgctgaagatcgatttggccaaaacaggcggcacccgttaa

SEQ ID NO: 22 - DNA, 2415 bp, Chromobacterium substugae
atgtcccaacccgcagaaatcagagaagagaccacgctgccgctgttgccgctgcgcgacgtggtggtcttcccgcacatggtcatcccgctgttcgtcggacgggccaagtcgatccgtgcgctggagctggcgatggacgaaggcaagcagatcctgctggtagcccagcgctcggcttccaaggacgaaccctccgccgaagatctgtacggcgtgggcaccatcgccgctgtgctgcagatgctcaagctgccggacggcaccgtcaaggtgctggtggaagggcgccagcgcgccaccatcaaggaagtgggcgaggaggacggctgcttcgtcgccgaattcagcccgctgtccagcgagctggaagagtccaacgagaccgaggcgatgcgccgcgcgctgctcgcccagttcgagcagtacgtcaagctgaacaaaaagatcccgccggaagtgctgaactcgctggccggcatcgaccgcgccggccgcatggccgacagtatcatcgcccacctgccgctgaagctggagcaaaagcaggaagtgctggagatgttcgatgtccagacacgtctggagcatctgatgtcgcagctggaaggcgagatcgacatcctgcaggtggaaaagcgcatccgcggccgcgtcaagcgccagatggaaaagagccagcgcgagtactacctgaacgagcaggtcaaggccatccagaaagagctgggcgagatggacgaggtcagcgacctcgacgagctggagcgccgcatcaaggctgccggcatgagcaaggaaggccgcgacaagaccctggccgagctgaagaagctgaagatgatgtcgccgatgtcggcggaagccaccgtggtgcgcaactacatcgacaccctgcttgacctgccgtggaagaagaagaccaagatcagcaaggacgtggccgcggccgaggctgtgctagacgaggaccacttcggcctggagaaggtcaaggaacggattctggagtacctggcggtgcagcagcgcgtcgatcgcctgaaggcgcccatcctgtgcctggtaggccctccgggcgtcggcaagacctcgctgggccagtcgctggcccgcgccaccaaccgcaagttcgtgcgcatggcgctgggcggcgtgcgcgacgagtcggaaatccgcggccatcgccgcacctatatcggctcgatgccgggcaaggtgctgcagaacatgtccaaggtcggcgtcaagaacccgctgttcctgctggacgaggtggacaagatgggcgcggacttccgcggcgatccgtcgtccgccctgctggaggtgttggatcccgagcagaaccacgccttcatcgaccattacgccgaggttgagtacgacctgtccgacgtgatgttcgtcgccaccgccaattcgctgaatattccgccggccttgcttgatcggatggaaatcatccgtctttccggctacacagaagacgagaaggtcaacatcgcgctgaagtatttgctgccgaagcagatggaggccaacggtgtgcgcgagggcgagctggcggtgcaggagtccgccatccgcgacatcgtccgctactacacccgcgaggccggcgtgcgcagcctggaccgcgaagtggccaagatctgccgcaaagtggtgaccggcgccttgctcaagccgggcaagacgggcaaagtgacggtgtcggccaagaatctggacaagtatctgggcgtgcggcgcttcgactacggcctggccgaagaggaaaaccgcgtcggccaggtgacgggcctggcctggaccgaagtgggcggcgagctgctgaccattgaggcggtcacgctgccgggcaagggcaatatcgtccgcaccggccagttgggcgaagtgatgcaggaatccatcaccgcggcgatgagcgtggtgcgcagcagggccagaagcctgggcatcaagccggacttctacgagaagagcgacatgcacatccacgtgccggaaggcgcgacgcccaaggatggcccgagcgcgggcatcgcgatgaccacggccatcgtgtcggtgctgaccggcattccggtgcgcgccgatgtggcgatgaccggcgagatcacgctgcgcggcgaagtgctgccgatcggcggtttgaaggaaaagttgttggcggcgcatcgcggcggcattcgccacgtgctgattcccaggggcaatgagaaagacctggcggagatcccgtccaacatcaagcagaagcttgaaatccatccagtgaaatggatcgatgaggtgctggcgctggcgctggagcgtcagccggaagaattgtcgcaagaagaacagtccgcggacattcctcctgcgcaagatgcttccggcggagtgtcggttttgaagcattaa

SEQ ID NO: 23 - DNA, 1281 bp, Chromobacterium substugae
atggctgacaaaaacagcaacgagaaacttctctattgctctttctgcggaaagagccagcacgaagtgcagcggctgatcgccggcccgcaggtattcatttgcaatgaatgcgtcgagctgtgcaacgacatcatccgcgaagagctggagaagggtagcagcagcgaagtggtgggcggcgcgtccgccgaccgcccgctgccgacgccgcaggaaattcgcgcggatctggaccagtacatcatcggccaggatttcgccaagaaaaccctgtcggttgcggtgtacaaccactacaagcgtctgtaccagaagagcggcaaggacgacgtggagctggccaagagcaatattctcctgatcggccccaccggctccggcaagaccctgctggcgcagtcgctggcgcgcctcttggacgtgcccttcgtcatcgccgacgccaccacgctgactgaggcggggtatgtcggcgaggatgtcgagcacatcatccagaagctgctgcagaagtgcgactacgatgtggaaaaggcccagcgcggcattgtctacatcgatgagatcgacaagatctcgcgcaagtcggaaaacccgtccatcacccgcgacgtatcgggcgagggcgtgcagcaggcgctgctgaagctgatcgagggcacggtggcatcggtgccgccgcagggcggccgcaagcatccgaaccaggaattcatccaggtggataccaccaatatcctgtttgtgtgcggcggcgctttcgacggcctggagaagatcattcgccaacgctccgagaagggcggcatcggcttcggcgccgaagtgtcctccaaggacgacggcaagagcctgagtacgctgttcaaggatgtcgaaccgcaggacatcatccgcttcggcctgattcccgagctgatcggccgcctgccggtggtcgccacgctggaggaactggacgaagaggcgctggtcaccatcctcacccagccgaagaacgcgctgatcaagcagtaccagcgcctgttctcgatggagtcggtggaactggaggtgcgtccgtcggcgctgcgcgtcatcgccaagcaggcgctgatccgcaagaccggcgcccgcggcctgcgctccatcctggagcgcgcgctgctcgacaccatgtacgatctgccgtccatgcaggacgtggaaaaagtcgtggtggacgagaaggtgatcgagaagggcgacaagccgcttttcatctatcgcgaagagggcggtgtggcacaatccgcctga

SEQ ID NO: 24 - DNA, 633 bp, Chromobacterium substugae
atgaaatcgatgatggaaccgcaagggttgggcctggtgcccatggtggtggagcagagcggtcgcggcgagcgcgcctatgacatctattcgcgtctgctgaaggagcgcatcgtcttcctggtcggccccgtctcggacgaatcggccaacctggttgtcgcgcagatgctgttcctggagtcggaaaatccggacaaggacatccatttctacatcaactcgccgggcggctccatcaccgccggcatgtcgatctacgatacgatgaacttcatcaagccggacgtttccaccctgtgcattggccaagcggccagcatgggcgccttcctgctgtcggcaggcgccgagggcaagcgtttcgcgctggagaacagccgggtgatgattcaccagccgctgctgtacggcggcggcctgtccggccaggtgaccgacatcgaaatccacgcccgcgaactcgtcaaggtgaaagccaagatgaacgagctgatggccaagcactccggcaagaccatggagcagctggaggcggataccgagcgtgataacttcatgtcggcggaagaggcccgtgtctacggcctgatcgataaagtgctgtcttcccgcaaggatgtcacggcgtaa

SEQ ID NO: 25 - DNA, 1461 bp, Chromobacterium substugae
ttgctggcgctgccgggctgcgcgtgggcaaacccgacggccggtttcgatcgcgccgcctggcagcaggactaccaattgctgaaacagacgctgcagcagcgctactcccatctggcctggatggcttcgccgcaaagcggcatcgccctgcccgcgctggaccgccaggcgcaagccgcgctgcggcaagcccgcgacgacgccgaggctcgccaggccatcatcggttttcagcaaggcttccgcgacggccatttctcgctgctggccaacacgccaagcgccgcggaaagcagcggccgcgacgagccggcgccgcgcgacctggcgcgcgacaagccgctggacggctgcgccgccctgggctacgagcaggacagcaagatcgggttctcgctgccgttcgaaaccctgcccggtttccatctgacttcggacggcctgtctgagtccatgcgcagcggcctggccgacctgggccgggccggacaggcggcggtgctgcgcatccccacgttcagtcccaaaggctatccgctggcatgccagcgcgtctggcgcgcggcgatgccgcaaaccggggcgttcgactcggaaaaactgttccagctgacctaccggcaatggttcgccgacgtggcccagcgcctggccgaactgcgccaggccggcgcccgggtgctgatcctcgacgtgggcaacaatcccggcggcaacgacagcggcgacgcgatgacccggctgctcacccctggcgtggtccgctctccgtcgctgtggatggccaggagcccggccggcaaagcctatctggaccagtggattgaggacttgagcagcggccttcccgcctcggcgagcgccagcgacaaagccaagctgcaaggcctgttgcaggacttccgccaaaagcgcgccgagctggatagccggccggcgccggacatgagctgggtgtggcgcgaacagcgccgatgggaccctcaggccggctacagccggctgatcgcagccggctacgcgtccggcgcggtggctcacctggaacctggtagctattcgcgggaagtggcggaaacgctgttctggccagcgcagacggaaaagctgaaaggcgcctggcaagggccggtctatatcgtcgccgaccagaaaacctactccgccgccgagatgttcgtcgcggtcagccgcgacaacgggctggcgaaaatcgtcggcgcgcgcaccggcggcgatggctgcggcttcatgggcaagctggagccgctgctgctgccccactccggcctgcgtttgcgcattcccgactgcgtgcggctgcgcgccgatggcggcgacgaagtcgccggcatccaacccgacctgccggtgccggcgcagcctggcgaaagccggcgcgcccgcgcccagaaaaccctgcaagccatcgccgccgacttgctggcccagccctag

SEQ ID NO: 26 - DNA, 951 bp, Chromobacterium substugae
atggataccgccctgatccccctgatactgtttctggccgtcgtcgtcttcattttcaagtcgctggcggtggtgccgcagcagaacgccttcatcgtcgagcggctgggccgctaccacgccacgctggcgcccggcctcaacatcatcctgcccttcatcgaccgcatcgcctaccgccacagcctgaaggaaataccgctggacgtgcccagccagatttgcatcacccgcgacaacacccagttgaaagtcgacggcatcctgtatttccaggtgacagacgccaagctggcgtcctacggcaccagcaacttcatcgtcgccatcacacagttgtcgcaaaccacgctgcgttcggtaataggcaagctggagctggacaaaacctttgaagagcgcgacgacatcaaccgcaccgtagtcgcctcgctggacgaagccgccatcaactggggcgtgaaggtgctgcgctacgagatcaaggacctggtgccgccgcaggacatcctgcacgcgatgcaggcgcagatcaccgccgagcgcgaaaaacgcgcccgcatcgcccagtccgaaggcgtgaagatggagcagatcaacctggccaccggcgcgcgcgaagcggcgatccagaagtcgcagggcgagatgcaggccaccatcaacaactccgaaggcgacaagcaggccgccatcaacaaggccaagggcgaggccgaagcgctgcgcttggtggccgacgccacagccgacgcgctcaaccgcatcggcggcgcgatccagaatgacggcggactggaggcggtcaatctgaaagtggccgagcaatacatcgccgccttcggcaaattggccaaggaaaacaataccatcatcatgccgggcaacgtcgccgacgtcggcggcctggtcgccagcgccctaagcgtcgtcaaacaaactaaccgttaa

SEQ ID NO: 27 - DNA, 426 bp, Chromobacterium substugae
atgtctcaagccatcaccttctggtttgcctgcgcgctgatcgcgctgatcgccgaattcatgtccggcaccttctacctgctgatgatcgcgctggcgatgggcgcgggcgggctcgccgcctggcttgggctggctgaattcacgcaatggttgatcgccagcgcctgcggcgccgccggcgtgctgctgatccgccagcgcaaacggcgccatccctccccgccgccgccgcgcgacgaccccgactggggccagcaagtcagcatccgctcgcttacctcccccggccatgcccgcgtcttctaccgcggcgccgaatgggacgcccagctgctcgacgccggcctgaacgccggcgacgccggctacatctgcggccgcgaaggcaatctgctgaaaatctcctccacacaaccggaataa

SEQ ID NO: 28 - DNA, 3360 bp, Chromobacterium substugae
ttgcccagccgtttccccgcgcgccccgccatcctggcccttgcctttcccttcgccttgccggccctggccgccctcccttccggcccggaggccgtggatagccgggcgctcggttattaccgccaggccgcggctggtccggacagcatcgtgttcgtcgccgaaggcgacttgtggagcgtgccgtacagcggcggcatggcgcggcgcctgaccagccgcccggccgacgcctacagccccgccctgtcggccgatggccgctggctggccttcgtcggccgctacgacggcgcgcccgaggtatacgtgatgccggcgcaaggcggcgccaccaaacggctgaccatagacggcgaccgcggcgtcaaggtggaaggctggagccgtgacggccgggtgctggtctccagcagccgctacagcggcaaacccgacacccggctctacctgatccacccggacagcggcgaacgcacgccgctgccgctggccgaagccgccgaagcctgcctggacgcccagggcctgccgacgctgttcgcccgcgagccgcagccatcggacaacgtcgtcggctatgtcggcggcaagcgccaacagctgtggagctggcagcccggccgcgaggccaagccggccttccccggccaccccggcaccagccgccagccgatgtgcgatgacggccaggcctatttcatcagcgacaagggcggccggctcaatctgtggcgcgcccgcctggacgccgacggcgcgctggccgacagccagccgctcacccattaccaggacttcgaagtgcgcggcgccagcctggcccgcaccgccgccggcagccgcatcgtcttcacccgcgccggccagatccatgtgctcgatccgcgcagcggccaggaccagactctgtcgatcgcgctgaattccgatttcgaccagctgcgcgccaagatgatcaacaacccggtcaactacctatccgcgctggcgctgtcgcccaacggcgaccgggtggcggtgcaggcgcgcggctatgtctccatcttcccggtcggcgccggccgccgcgtcgacgcgctcgccgacagcggccagcgcgcgcgcgaactggccttcagcgccgacggcaaatcgctgctgctggtcagcgacaaggacggcgagcaggaattctggcgcgtctccgcccgcggcggcgatgccgccgagcaattgacccgcggcagcgactcgccgatctaccagcccaccccctcccccgacggccgcaagctggcctatgccgacggccgcaggcggctgtggctgctcaacctgggcagccgggacaagaagctgatccgccagctggagcaaggcgagctcagcgatttcaaatggtcgcccgacagccgctacctggcctaccgcgccgacgccgccaacgagttcagccagctgtggctgtacgacagccaggaaggccgcggccaaccgctgtccagtgaccgctaccacgcccgcagcccggcgttcgcgccggacggcaaaacgctgtacttcctcagcgaccgcaatctggactcccaggtttccagcccctggggccagcgcgaccccggcccctacttcaaccggcaaaccaagatctacggcctgatgctggacgcctccgcccgctggcccttcctccccaaagacgagctggccggcaagcgcgcggccgacggcgacgacaaggagcaggacgaggccaagggcaaggacaaagacgccgccgccaaaccggtgaagatagatccgggcctcggccagcggctgtacgaggtgccgctggaaccgggcaattacgacaatctgcaagtggacgccaagcggctctatttcacccgtgccgacacgccggaagcggaggtcaagcaactagccacgctggcgatagaggcgcccaacccgaccccgcccaagccggaaaccttcagcgaaggggtgcgcgaattccgcctgtccgccgaccgcaagcaactgctgctggtgaaggaggtcaacaagcaacccagcctgctggtgctgccggccgccgcccaggcgcccaaggagctggacaagtacaccgtcagcctgcgcgcgtggtcgctgccgctggacccgcgcgccgaatggcggcagatcttcaacgacacctggcgcatgcaccgcgacaaagtgcatgccgccaccatccgggcggtggactggcaggcggcgcgccgccgcttcgaaccgctgctggacaagatcaccagccgccaggagctgaatgacgtcctcgcccagatgatcgcccaagtcggcatccagcacagccaggtcggcctgcgcgaagctggcggcggcggcgagcccgaggtcggccagctggccaccgacttccgccgcgcgcccggcggcctgcaggtggccgccatctggaacggcgacccggaactgctggaagagcgctcgccgctggcgcagccggaggccggcatccgcgtcggcgacctcatccgccaaatcaacggccagccgctgaagagcgaatacgcgctcgccagcgcgctgcgcggccaggtcggcaagcaggtgctgctcggcatccagcgcggcgacggcaagccgcgcgacgtcatcgtcacgccggtcagcctcggccgcgaccgcgatctgcgctatctgggctgggagagccagcgcaaagcgcgggtggagcgggaaaccggcggccgcgtcggctacctgcacctgcaggcgatgggcaaggaggacgcggcgcgctgggcgcgcgaatactacccggtgttcgagcgcgagggcctgatcctggacctgcgccacaacaacggcggcaatatcgaccagtggctgctggaaaagctgctgcgccgcgtctgggtatggtggcaggacggcaatcagaccctggccagccccaatccgccgcacgccttccgcggccgggtggtggcgctggtggacggcgacacttactccgacggcgaaaccttcgcgctgggcctgcagcggctcggcatcgccaccctgataggcgaacgcaccgccggcgccggcatgtggctgagcgacgacaactggagccgggacaagggcatcgcccgcgccgccagctcgccgcagttcgtgaccgacgccggcggcagccgctgggtggtggaaggccgcggcgtgacgccggacatcgaagtggacaatccgccctgggccagcttccagggccaggacgcccagcttgaggccgccatccgctacctgaagcagggcctgccatcccaaccggccggccgcccccaggcgcccgccggcggcgcccagggctcgcgctaccagggcttctga

SEQ ID NO: 29 - DNA, 1461 bp, Chromobacterium substugae
atggccggcgccctgctcgcggcgtcgttactgtccggctgcgacaggatcgagcagttagtcaaaggcaacagccagccagcccccgtcgccattcccgcgcaacaggacggccgcgtggccatgctgctgcccgacttcacccagctggtcagccgcgacggcccggcggtggtcaatatccagaccacccgcgagaacgccgcgccgcaacaaagcagcaatatgccgttcccggtgccggaagacgacccgctgtacgacttcttccgccgcttcatgcccaatcagccgcaacagccggaccagagtccggaggaaagcatttcctacggttcgggcttcatcatcagcagcgacggctacgtgctgaccaacgcccacgtggtggccgacggcggccagatccgcgtgatgctcaccgacaagcgcgagctgcgcgccaaactggtgggcctggacaagcgcagcgacgtggcgctgttgaaagtggaggccgccgacctgccggtggccaaaatcggcaacccggccgatttgaaagtcggcgaatgggtggccgccatcggcgcgccgttcggcttcgacaacaccgtcaccgccggcatcgtctcggccaagggccgcagcctgccggacgaaaccctggtgcccttcatccagaccgacgtggcgatcaacccgggcaactctggcggcccactgttcaacctgcgcggcgaagtggtcggcatcaattcgcagatctacagccgctccggcggcttcatgggcatttccttcgccattccgatcgacctggcgatgcaggtggtggaccagctgaaaaccaagggcaaggtcagccgcggccagctgggcatcaacatccaggaagtgacgcaggagctggcgcaatcgttcggcctgcagcggccgtccggcgcgctggtggtgcgagtggatccgaaaggcccggcggccagggccggcctgcagcccggcgacatcatcctcaagctcaacacccaggcgatagacagctccaaagacctgccgatgctggtgggcgcgctgggccccggcacccggatcaagctggtgatctggcgcaagggcttcgaaaagacgctggaagccacactggtggaacaagcgcctgacgccggcagcccggccaagccggccaacgacaccgtgccgcaaggctaccagttcggcaaactgggcctgacgttgtccgagctgacccaggagcagcgcgccgacctcggcatccgcggcggcctcttgatccaaaaggcgcagggcccggcggcgcgttccggcctgcagcccggcgacatcatcatgggcctgaaccagaacgacatcaccagcatcaacgccttcgaaaaagcgctgtccagcgccggcggccatgccgcgctgctggtcaagcgcggcgaatcggtgctgttcatcgcgctgcgcaccgactga

SEQ ID NO: 30 - DNA, 1431 bp, Chromobacterium substugae
atgagcagccaaagaatgaagaaaatcgcctggttggtggcaggagccatggccggtggcgtactgaccatcagcatgcaggcgctggccgacaaggaagcgtcgccgctgccgctgggcgagctgcgcacctttgtcgaggtgttcagcctgatcaagcaaagctacgtcgagccggtgaccgacaagaaactgatagacgaagccatcaagggcatgctcaccggcctggatccgcattccgactacatggatcccgaggaattcaaggagctgcgcgaaggcacccagggcgagttcggcggcctcggcatcgagatcggcgccgaggacggcctggtcaaggtggtgtccccgatcgaggataccccggcgcagaaggccggcatcaagagcggcgacctgatcatcaagatcgacgaaaccccggtccgcggcctgtcgctgaacgacgcggtgaaaaagatgcgcggcaagccgggcagcaaggtcacgctgaccatcgcccgcaagagcgagaccaagccgctgatcttcacgctggcgcgcgcggtgatcaaaaccaagagcgtcaagtacaagatgctggagccggactacggctacgtccgcatcgcccagttccaggagcacaccgcggaagacttggccgccggcctgcagaagctgtacaaggacaacaagcagccgctgaagggcctggtgctggacctgcgcgacgacccgggcggcctgctcaacggcgccgtcggcgtcgccgccgccttcctgcccaaggacaagctggtggtgtacaccgagggccgcaccccggacgccaagatgcgcctgaccgccaccctgcaaaactacgccggcatcggcggcagcgacccgctggccaaattgccggccgacgcccgcaacgtgccgatggtggtgctggtcaacggcggctcggcctcggcgtcggaaatcgtcgccggcgcgctgcaggaccagaagcgcgcggtgctggtcggtactcaaaccttcggcaagggctcggtgcagtccatcctgccgctgggcagccagggcggcatcaagctgaccaccgcccgctacttcacccctagcggccgctcgatccaggccaagggcatcgtgccggacgtggtggtggaagacgccaccctcaccgccgccgaccaggcgctgcgcgtgcgcgaggctgatctggaaaaccacctggccaaccccaacggcgacgacaagccggccaaggccgccaaaccggcgcctaagctggtgccgcccccggccgcgccggaaaagggcaaggaagcgccggcgccggacgacgccagccagttcggcccgcgcgatcccagcccgaagaacgactaccagctgtcccagggcctgaacgtgctgaaagtgcagcagatcctgcaaaaacgcgccgactga

SEQ ID NO: 31 - DNA, 672 bp, Chromobacterium substugae
atgaaactgttagccctagacacctccaccacctatctctccctggcgctgagcctggaaacggaaacgctggtcttccacgaatgcgtcgcgcagaagcacgccgagcgcacgctgccggaggtgtcgcgcctgctcgccgaggccggcgtcgcgctgtcgtcgctggacggcatcgtcttcggccagggcccgggctccttcaccggcctgcgcatcgcctgcggcctggcccagggcctggcctactcagccgacctgcccgtcaccggcatcccgacgctggacaatctggcctggcaagctggagaaggccaggtgctggtctgcttcgacgcccgcatgcaacaggtctacaccgcgctctaccagaccggcgccgactggcggcgcctgtcgccgatcagcgtgatgtcccctgaagacatccgcctccccgccggcaccaccctgctcgccggcgatggcttcgacagctatccgcagctattggccgacagccgcgcgcaattgccgctgtcgcccttcccgcgcccccatgccgaagcctacatccgcctggccgaaagcggccgctatccggccggccacccgcgcgaggcggaactgctctacgtacgcaacaaagtggcgctgacctcggtcgagcagcagcaggtccgcagccgatga

SEQ ID NO: 32 - DNA, 1095 bp, Chromobacterium substugae
atggacaagagattgccagccgtggccgcggctttgctgttggcggcttccgccgctcacgccggcgacctgcaggtcagcctggggcagccggtggtcagcgcgggtcaggacgttgacgtcgctttgacttaccgcaataccggcaaggagaccttgcacgtgtaccgctggttcgtgcccggcaaggaactgcaggagcagtttctggcggtgaatgtgaacggcaagccggccgagtacctgggcccgcgctacaagcgcgtggtgccgtcgctgcgcgacaccgtggcgctggcgcccggcgccacgctgaacgccaaggtgagggtgtccgagtattacgacctgtccaagccgggccagctgagcgtccgttttgaaagcagcagcaacaaggtgctcaaccgcagcctgccggccggcgtcaatgccaagcaggcggccgcgccgcaggccgacgaggccatttcctccaatgtggtgggcgcctacagcgccggcagcgtcagccccttgctgaccaagtccaaggcggccaagcaggagtggcaggtgctcagccgcagcgcggtcagcggcgtcagctacgccggcaattgctcggtcagccagcagtcgcaatcgcgcgacggcgtgctggccgccagcgccatggccagcgaaacggcggcctacctggccggcacgccgtccggcacgccgcgcttcaccacttggttcggcaagtacagccaggccaactggaccaccgccaagtcgcattacgtcaacatcaaggatgcgctggacagcaagccgatcaagctggattgcagctgcaccgacggcggcacttatgcctacgtctatccggggcagccgtacaccgtctatctgtgcggcgctttctggaccgcgccgaccaagggcaccgactccaagggcggcaccctggtgcatgagttgtcgcacttcaccgtggtggcgggcacccaggaccatgtctatggccaggccggcgccaagagcctggccaagagcaacccggcccaggccttggacaatgccgacaaccatgaatacttcgccgagaacaccccggcgcagcagtaa

SEQ ID NO: 33 - DNA, 1914 bp, Chromobacterium substugae
atggcaaatgccttcaaaataaaaatggtggtcgccgccctggcggcagcggtttcttccagcgcgatggccgccgccgccctcgatctgggcaaggtggagcaagccgcgccatccaaaaccttgaccgtgaccgtagcgctcaacctgcgcgaccgtgatgccgccacccgttatctgcaggccgttcacagcccggcggacgccaactaccacaaattcctgaccccggccgaatttcgctcccgcttcgcgcccaacgacgccaccgtcaaccgcgtcagcgcccgcctgcaagccgccggcctgaccgtgaagcgcataggcagcaccctgctgcaagtcagcggcccggccgccaccgtgcagcaagccttcggcgcagaagtccacgtattccagaacaagaccgccgtgcagggcaccgcccgctacatcgccccggtgcgcgccggcacgcccaaggtcgacctgagcgacgtgcaggccgtcatcggcctggacagccgcccgcacttccgcccgcacctgcgccaggttcccaaccacctgcaaccgtcgctgagcaagggcgccagcgccgtcaccagcggcaacgcccccggccagtggaccgtgaccgacctggcgcgccactacgacatcaccccgctctacaacaagggcatccatggcaagggcagcaccatcggcatcgtcaccctggccagcttcaccccatccgacgccttccagtactggagcgcagtcggcctcagcaccgaccccaaccgcctgagcgtagtcaacatcgacggcggcccgggcgcgcccagcgatgccggcggctccgacgagaccacgctggacgtcgaacaatccggcggcatcgcgccggacgccaagatcatcgtctaccaggcgcccaacaccacccaaggcttcgtcgacgctttcgcgcaggcgattgaaagcaacgccgccgacaccgtatcggtaagctggggcgaatgggaatggttcgaccagcaaagccaagcggtggacccggtgaacggcaagaccaccaatgtgctgcaggcctaccacgacctgttcctgcaggccgcgctgcaaggccaaaccctgttcgcggcgtccggcgactccggcgcctacgatgtcaaccgcgccgcgccgctgccgcaatacaacaaggtattgtcggtggacagcccggccaaccagcaattcatcaccgccgccggcgccaccaccgtgcccaccaccctcaccttccaccccaacggcaaggaaatgaaggtgaagatctccagcgagcgcgcctggggatgggactacctgagcggcctgtgcaaggcgctgggcaaagaccaagtagcgtgcggcatcttcccggtgggcgatggcggcggcgtcagcggcttcatcagccgcccgttctaccagaactggattcctggcatgcagaacaccccggccggccagcaactggtggataccagccagaccccgccgcaggtgataggcagcatcccggccaacttcaagggccgcaacctgcctgacatctcgatgaacggcgacccggagaccggctacgtggtgtactacacctccgacaagaccggcttctccatccagagcaacagcggcggcaccagcttcgtcgcgccgcagctggccggcatcaccgcgctgctcaaccagtcgatgggcggccgcctgggcctgctcaacttctcgctgtacagcctgctggcgactggccacgcctaccatggctccggccaccacggcgcgccgctgcgcgacatcaccgccggcggcaactggggctacaacgcgcatcgcggctacgatcaggccaccggcgtcggcgcgcccgacgtcgccaacctcgatgcggcgctgcatcgctacttctggttctga

SEQ ID NO: 34 - DNA, 876 bp, Chromobacterium substugae
atggacgccttgcaggatttcctgcgccgcgccgaagcggtgctgacccggctggaaccgatgctgccgccgccgcggcgcgagccggactggagcgcgcaagccttccgctggcaccgccagggcctggccggctggctggaggcggtgtgcgatccgcatacggtggagctggcgcggctgacccaggtggacagccagcgcgagcagctgctggccaacacccgccagttcgtcgccggcctgccggccaacaacgcgctgctgaccggcgcgcgcggcaccggcaagtcgtcgctggtgaaggcgctgctgcccttgttcggcgccgatggcctgcggctgatcgagatagaccgcgaacacttggccgacctgccgcagctggtggagctggtggccggccggccggagcgcttcatcctgtattgcgacgatctgtcgttcgaacacggcgacgccggctacaaggcgctgaagagcgcgctggatggcggcctctcgcgccgctgcgacaacctgctggtgtacgcgacgtcaaaccgccgccacctgctggccgagcagatggccgacaaccgcgagggttggctgaaggacggcgagatccacccgggcgaggcggtggaggagaaggtgtcgctgtccgaccgcttcggcctgtggctgtcgttctacccgttcgaccaggacgcctatctggcggcggtgaaggagtggctgggccatttcggcctgaaatacggcgacaaggccgagcgcgcggcgctgcaatggagcctgacgcgcggcagccgctccggccgggtggcctggcagttcgccagccattgggccggcagccagaggctggccaagcaggccggcaagaaatga

SEQ ID NO: 35 - DNA, 243 bp, Chromobacterium substugae
atgtataaggtgttgttattgaacgatgattttaccccgatggacttcgtggtgcaggttctccagcagttcttccacatgaaccgcgagaaagccacacacatcatgctgcaagtccacacgcaaggtcacggcgtgtgtggcgtttataccaaagacgtggctgcaacgaaggtcgagcaggtgttgcaatatgcgaaagcgcatcagcatccgcttcagtgcgtaatggaggaaaactga

SEQ ID NO: 36 - DNA, 2280 bp, Chromobacterium substugae
atgattgcccaggagcttgaagtaagcctgcacatggcgttcatggacgcacggcgcaagcgccacgagttcatcagcgtggagcatctgctgctcgcgatgaccgacaacccgtcggccgcagaagttttgcgagcttgcggcgccaatatcgaccaactgaagaagcaactatccgacttcatcgacgagcacacgcccaccgtgcccggcgaaaccgaggtcgagacccaaccgacgctgggattccaacgcgtgatccagcgcgcgatcctgcacgtgcaatcgtccggcaagaaggaagtgtcgggcgccaacatcctggtcgccatcttcggcgaaaaggattcgcacgcggtctactacctgcaccagcaaggcatttcgcggctggacgtcgtcaacttcatctcgcacggcatcaccaagcagcggtcgcagcagccgccgcaggaaccgcgcgacaacagcggcaacgatgtcgagaacgaagagcagagcaccggtccgggcggggcgctggagaattacacccagaacctcaaccagatggcgcgcgacggcaagatcgacccattgatcggccgcgagcacgaactggagcgcacggtgcagatcctttgccgccgccgcaagaacaacccgctgctggtcggcgaggccggtgtcggcaagaccgccatcgccgaagggctggcgcggcgcatcgtcggcggcgaagtgccggaaatcctggccaagtcgaccgtctacgcgctggacatgggcgcgctcttggccggcaccaagtatcgcggcgatttcgagcagcggctgaaggcggtgatcaagcagctgaccgacgacagcaacgcgatcctgttcatcgacgagatccacacgctgatcggcgccggcgcggcttccggcggcacgctggacgcctccaacctgctcaagcccgccctgtccaacggcagcctgcgctgcataggggcgaccacctacaacgagtaccgcggcatcttcgagaaggacaacgcgctgtcgcgccgcttccagaagatagacgtctccgagcccaccgtgcagcagacggtggaaatcctcaagggactgaaatcgcgcttcgaggcgcaccacggcgtcaagtacacgcagtcggcgctgtccaccgcggccgagctggcggcccgctacatcaacgaccgccatctgccggacaaggccatcgacgtgatcgacgaggccggcgccgcgcagaagatcctccccaaatcgcggcagaagaaggtgatcaacaagtcggagatcgaagagatcgtcgccaagatcgcccgcattccgccgaagacggtctccagcgacgacaagaacgtgctgaagaacctggagcgcgatctgaagaacgtggtgttcggccaggagaaggcgatcgaaggcctggccagcgcgatcaagatgacgcgctccggcctcggcaatccgcaaaagccgatcggatcgttcctgttctccggccccaccggcgtcggcaaaaccgagctggcgcgccagttggcctacatcctcggcgtcgagctgatccgcttcgacatgtccgagtacatggagcgccacgcggtgtcgcggctgatcggcgcgccgccgggctatgtcggcttcgaacagggcggccagttgaccgaggccatcaacaagcatccgtacgcggtggtgctgctggacgagatcgaaaaagcgcatccggacatctacaacgtgttgctgcaggtgatggaccacggcacgctgaccgacaacaacggccgcaaggcggacttccgcaacgtggtgctgatcatgaccaccaacgcgggcgcggagtcgctgtccaaaccggcgctgggcttcacccagaccaaggtggccggcgacgagatgggcgacatcaagcggatgttcagtccggaattccgcaaccgcctggacgccatcatcccgttcggcgtgctggacgagcagatcatcctgcaggtggtggacaagttcctgatgcagctggagcagcaactggcggagaagcacgtcgacatccacttcaccgacgagctgcgccgcttcctggccaagaacggcttcgacccgctgatgggcgcgcggccgatggcgcgcctgatccaggacacgctgcgcaaggcgctggcagacgagctgctgttcggccgcctggtcggcggcggcgaagtgaccgtcaccgaagcggacggcaaggtggagctgctgttcgaccagcccgcgctggccgccgagcccgcctga

SEQ ID NO: 37 - DNA, 1929 bp, Chromobacterium substugae
atgacgccggaggcggcgggcgagcgccgctggccggcgctgctggcgctggcctggtgcgcgctgccgctggcctggcacttgccgccgtggctactggcgctattctggctggcgctggccggccgggcctggctggaggcgggagggcgcggcttgccgtcgcgctggctgttgctgccggttctgctggctgctgtcgcggtgttgtggctcagcctgcgcacgctggtggggcgggaggggggcgtcgcgctgctggccttgctgatcgcgttcaaggctttcgaaaccgccagcctgcgcgactggcgggtgctgctggcgctgggcttcttcctggcggcgatgccgctgttgttcgaccagtcgccgctgatggctggctggctggtggcctgcctgttgctgctgacctgggccaccgcggcgctggccggccaattgccgcgcggcagctggcgcagcgccgcgcaggcgctgctgttgtcgctgccgatgatgctggtgctgttcgtggtgatgcccaggctgccggagccgttgtggagcatgccgggccaggagggcgcggccgccagcggcttgggcgacagcatggcgcccggcagcatcagccagctcatcctcaatcgcgagccggcgttttcggcggtgttcgccggcgccgcgccgccgcaggaccagctgtattggcgggtgatgctgctggatgatttcgacggccggcgctggctgaatgtcggcggcgagcgcggcgaatccttgccgccagcgctgggccgccgggtggcgtacagcctgacgctgaaaccggaccggggccggctgccggcgcttgatctgccgcagcaggccggcggcgacagtcatctggaggccggcgggctgttgcgccaggacgagaaacgggacgagttggcccgctacgcgctggccagcagcctgggagggcgttatccggctgccttgtcggccgccagccaggcgttctaccggcgcttgccgccgggcaatccgcgcagccgggcattggcgcagcggctggcgcgccaggccggcggcgagcgggctttcgccggcgaggcgctgcaatatctgcggctgggcggcttccgttacaccttgaggccgccgctgttgggagagcaggcggtggaccagttcctgttcgatacccggcaaggtttttgcgagcactatgcctcggcgttcgcctttctcgcccgcgtggccggcatcccggcccgggtggtggtcggctatcagggcggcgaatacaacccggtggggcgcttctggcaggtgcgttcgtccgacgcccacgcctgggtggaaatctggctgtcagatactggcgaatggcagcgggtggatcccaccgccgcggtgtcgccggcgcgggtggagcaggccgcggagcaggcgctgcccgggctgagcggcggagcgggagtttcggccatcttgccgccgggctggctgcgcagctggcgcctgcaatggacggctgtcaatttcgcctggcagcagtgggtggtgggttacgacgccagccggcagcagcggctgttccagcgcttgggcctgggcgcgcgggtggatgccggcagcgtggcgcggggggtgtccgcgggcatgctgctggcgacgctgcccttgctgctgtggtggcgcaggcgtccggcgcaggcgccgatggcggagggctggcgtctgatacgggctgggttggcgcggcggcaaattccgaccacggccgcgcagggaccgttggaggtgctgaaggcggcgcggggactgccgctggacgattaccgcgggctgaagcggctggtcgacgactacatggcgctgcgctatcgccgcagcgagccggatgcggcggaggagcggcgctggctgcggcgggcgcggcgctggaaatga

SEQ ID NO: 38 - DNA, 759 bp, Chromobacterium substugae
atgcgccggacgcttgacttgctgccgcgcgccgagcgccaggcggcggcggtgctgctggtcagcagcctgtgcatggtctggctgcagtatccggccaaccgctactggatgctggaaaccctggcgctggcgcagccccgggcggcggacgccttccgcgccgccgtgatcgccaatccgcataccgagctgttccgcgccgcctactgggcgctggccagcatcgccggctatgcgctgctgccgctgctgcacatcaagttgaaaggcgagcggctggccgactacggcgtagcctggccggaccgcgccgcgctgaaaaccgacctcaagctgtttccgctgttttacgcgctgatgctgccgctggtgtggtgggcgtcggcgcagcccggctttctggcgatctacccgttcttccgcctgagcccgggcgagacgctgtggccgcactggctgctgtgggagctgctgtatttcgcccaattcgccgcgctggagttcttcttccgcggctatatggtgcacggcctgaagccgcgcctcggctggctggcgattttcgtgatgatcattccttattgcatgatccatttcgaaaagccggcgctggaaagcctggccgccattctcgccggcgcggcgctgggctggctcagctaccgctataaatcaatctggctgggcgtcgcgctgcattgcagcgtggcgctgaccatggacctgatggcgctatggcgcaagggcctgctgtaa

SEQ ID NO: 39 - DNA, 837 bp, Chromobacterium substugae
atgaagctgccacgccttgccctctgcctgtccctgctatccacgctcgcccatgccgctccgctcagcaaggagcaccgcatcctgtttttcggcaaggacgaccgcgtgctcgaacatcccgaccacatgccctggcaaaccgtgggccagctggaaacccgctcccgcaccatctgcactggcaccctggtggcgcccgacgtggtattgaccgccggccactgcttcgtcgacgaaaagggacgcttcgaccccgccgtcagcttcaccgtgggcctgtggggcaatgaataccaggcgctcagccgcatcaaggaagtgcaggtggacaaggccttcctgaaaggattgatccacaaacgcgatggcctctacatcccgccgcgcatcgcgccgcgcgatttcgccttcgtccggctcgccacgccgctgggccacagccagggcaccgtgccggtattctccggcgacgcccaggcgctgaagacgctgttggccaagcaaaactggaccatcacccagggcggctacccggtggacgaccagcgccacctgcgcgtgcaccacggctgcaaggccaccaaactgcgcgacgacggccgcctcacccatcgctgcgacacgctggaaggcaatagcggctcgcccatcttcgtcatcgacgccaagggccaggccaccatcgtcgcggtgcaaagctcggcgccgccggcctcccgccgcaagctggaggacaatatgagcgtctccgctccgatgttccgccaggcgctgcaggccttcatcgccaaatcggccaagcccgccaagccggcaaaatcggcccgcccatga

SEQ ID NO: 40 - DNA, 420 bp, Chromobacterium substugae
atgagctccagcaccaagccctacatgatccgcgcgctgcaccaatggtgcggcgacaacggctacaccccctatgtggtggtgtgggtcaacgagcgcaccgacgtgccgctcgaatacgtgaagaataacgagatcgtgctgaacatcgccgaaggcgccaccaagaatctgcggatcgacaacgactggctgtcgttctcggcgcgcttcggcggcgtgtcgcgcgatatctgggtgccgatcggcaatgtgatgtcgattttcgcgcgggaaaccggagagggcatggggttcgaggtcgagccgtcgcccgaggccgagcaggacgccaaaccggtggacgccgatccgccgaagggcggcgacccggggccggatcggcccagcggcaggcccagcctgcgcatcgtcaaataa

SEQ ID NO: 41 - DNA, 1017 bp, Chromobacterium substugae
atgcctgccagtcagcgactgccggaactggtgtgcccggcgggcagcctgcccgcgctgaaggccgccgtagacaacggcgccgacaccgtgtatttcggcctgaagaacgataccaacgcccgcaacttcgccgggctcaacttcgacgaccataccgcccgcatcggcatccgctacgcgcgcgagcgcggccgccaggtgctgatggcgatcaacacctatgcgcagggcggcgatatcagccgctggcagcgcgcggtggaccaggccgccgacctgggcgtcgacgcggtgatcctggccgacctcggcctgctggactacgcccgccgccgccatcccgcgctgcgcctgcacctgtcggtgcagggctcggccaccaatcacgaagccatccggctggcgcatgagctgttcggcatccgccgcgcggtgctaccgcgcgtgctgacgctggaacaggtgcgccaggtgatcgcgcgcagcgaggtcgaaatcgaggtgttcggcttcggcagcctgtgcgtgatggtggaaggccgctgcctgctgtccagctacgccaccggcgagtcgcccaattcccacggcgtctgctccccggccaaattcgtcgaatggcggcacacgccggccagcctggacgcccggctgtccggcatcctgatcgaccagtacggcccggaccagcctgccggctacccgacgctgtgcaagggccgcttcgcggtgcagggcgatacctattacgcgctggaagagcccaccagcctgaacgtgctggccatgctgccgcaactgctggatgccggcgtggccgccatcaaggtggaaggccgccaacgcagcccggcctatgtcgcccaggtcacccgcatcatgcgcgaggcgctggacgccgccggccgcgaacgccagcgcttcacgccgcagccggcctggcagcacggcctggccaaggtcgccgaagggcggcagcagacgctgggtgcctacgaccggccatggaaatga

SEQ ID NO: 42 - DNA, 897 bp, Chromobacterium substugae
gtgctgtttttctggagccgcgacgagatcctgcgcttttacgccgaggccgccgaatggccgctggacgccatctatctgggcgaagtggtgtgcggccgccgccagcaactgcgcggccaggactggatcgcgctggccgccgacctcgccgccgccggccatgaagtggtgctgtcctgccaggcgctgatagagagcgaatccgacctcaagcggctggccagattggcggacaacggccagctcacgatcgaagccaacgacctgggcgcggcgcggctggccagcgagcgcaagctgcccttcgtcgccggccatcacctcaatatctacaacaccgacacgctggcgctgatgctccgcctgggcgcccgccgctggctgccgccggtggaaatgggccgcgacgcgctggcggccatcctggcagaagccgcgcgtcggcaactggacatcgaaaccgaggtgttcgcctggggccggctgccgctggcgctgtcctcgcgctgcttcaccgcccgccactacaacctcaacaaggacgactgccgcttccgctgcctggagcacccggacggcctgcggctagccacccgcgacggccagggctttctcgccatcaacggcacccagacgctgtccgacggctgccaggcgctgctgccgcacctccccgccatgccgcccctgggcgtggaccgggtgcggatcagcccgcaggcgcagggaaccgccgcggtggtcagcgtcttccgccgcatgctggacggccacggcgacgccgcggcgttgatggccgaactggccccgcaggcccccggcgcgccggtggacggctattggcgcggcctggccggcatccttcccctggagacttccgatgcgcatccctga

SEQ ID NO: 43 - DNA, 2739 bp, Chromobacterium substugae
atgcgaatccaaaccctgggcctgctgctggccctggccgtgagccaggccgctcccgcccgcgccgccgcattgcccgccccttacgccagcgtggaaggcgtcagcgaataccggctggacaacggcctgcgcctattgctggcgccggacgcctcccaggccgccatcaccgtcaacctgacctacctggtcggcagccgccacgaaagctatggcgaaaccggcatggcccacctgctcgaacacatgatgttcaagggcaccacgcgcatcgccaacgtgatggacgagctgtcgcgccgcggcatgcaggccaacgccaccaccttcctcgaccgcaccaactacttcgaaaccttccccgccgacgacgacaacctggcctgggcgctgcggatggaggccgaccgcatgacggacagccgcatcgcccgcgcagacctggaccgcgagttctcggttgtgcgcaatgaaatggagatgggcgaaagcgacccgttccgcgcgctgtggaagcagctgacggcggtcagcttcgactggcacaactacggccacaacaccataggcgcccgctccgacgtggaaaaggtgcgcatcgacaatctgcgcgccttctaccgcaagtattaccagccggacaacgcggtgctggtgatcagcggccgcttcgacccggcgcgcgcgctggcgctgacgcgtgacagcctgggcgccgtgccgcgcccggcgcgcgcgctgacgcccacctggaccgaagagccccagcgcgacggcgcgcgcaaggtgacggtccgccgcgccggcgacaccacgctgctggccgcgctctaccacgcttcggccggcagccatccggactgggcggcgctgcaggcgctggaccacatcctgaccaacgcccccagcggccggctgtaccaggcgctggtcgacggccgccacgcggtcaaggtgtcggcgctgagcccggcgctggccgagcccggctacgtgtcgtactgggccacgctgtccaaggggcaaaagccggccgaggcgcgccgcgtcatgctggccacgctggaagacatccgccgccatcccatcgtccaggccgagctggaccgcgcccgcgccgcctggctcaaccagttcgagcaaacggtcagcgacccgcaggcgctgagcctggcgctgaccgaagccatcgcgctgggcgactggcggctgttcttcctcgagcgcgaccgcatcgagcggctgaccgtggccgacgtgcaaagggtggcggagaactacctgaagcccagcaaccgcacgctgggcgaatacctgccgaccccgcatcccgaccgcagcgtgattccgcccgcgccggacgtcgccgcgatggtcaaggattaccagggcaagccggcgctggcccaaggcgaaaacttcgaccccagcccggccaatatcgagcagcgcagccgcaaactgacgctggacaatggcgcagaggccgcgctgctgccgaaacaaacccgcggccacgccgtcagcggctatttcagcttcgccttcggcgatgccgaaggcctggccggccaacgcctggccagccggctgaccgccgccatgctggacaagggcgcggccggcctcagccaggccgacatcgccaaccgcatcgaacagctcaagtcctcgctgcagatcagcggcagcggccaggaagtgcgcgtcggcttcaccagccagcgcgacaccctgccgcagctgatagacctgatcgcccggctgctgcgcgagcccagcttcccgcccgccgaattcgacaagctgcgcgaggccaaccgcacccggctggcggcgctgcgcgacaacccgcaggcgcaggcggcgcgcgcgctaggccagcggctcaaccgctaccccgccggcgacatccgccatgtcccggcgctggacgaagagctggccgagctgaacgcggtcggcctggagcaactgcggcgcttccaccgcggcttctacggcgcgggccaggcgcggctggcgctggtcggcgatttcgacgccgacgccatcggccgccagcttaaccagcgcttcggcgactggcgcagcgcggcgccttatcgccggctggacgacaagctgccgcaaccgcaagccggccggcagctgctgcagatcgccgacaaggccaatgccgcttacctggccgcgctgccgctggcggtgcaggataccgacgacgactacccggcgctgctgctggccaaccacatcctgggcggcgaaagccagtcgcggctgttccagcgcctgcgccagcaggacggcctgagctacggcgccggcagcgcgctgagcgtcgacagccgccagccggtggccagctggcagctgtacgcgatctacgcgccgcaaaacctggccaagctgcagcacggcgtcggcgaggagctggcgcggctgctgcgcgacggcgtcagcgcgcaggaagtggccgacgccaagcgctcgctgctgcaatcggcgcaactggcccgggcgcaggacgacaccctcagccgcatgctcagccaacagctggaccaagggcgcgacatggcgttccaggcggcgctggagcggaagctgcagcaggccacgccggccgacgtcaacgccgcgctgcgccgttacctgaaaccggcaagcctggtggaggtctacgccggcgatttcgccgccaaggcgccggcggcgctcaagcgcgactag

SEQ ID NO: 44 - DNA, 603 bp, Chromobacterium substugae
gtggtggcggccgaataccggctggcgccggaaaacccctacccggccggcctgaacgacgccgccagcgtggtgaagggcgtgtgggatgtgctggatgaacgccggctgccctatcgcaggcagctggcgctggccggcgattcggccggcggcgcgctatgcgccagcctgagcggcaaggctgcggctgacggcgccgagccgggcatcgcccgccaggtgttgatctacccttgcgtcgattacacgctggcccagccatcggtggccgagaacggcgacggctattttctcaccgccaatcgcaccgagtggtatttcgaccagtacttccagcatgacgaggatcgccgccaagcctcgccgctgtattggccagccgcgccgaatccgcccgccacgctgctgatcaccgccggacgcgacccgctgcgcgaccagggcctgcaatacggcaaccagctgaaagccgccggcgcccaggtcgagcagctgcacctggacgaccagatgcacgcctttctcaacatggaggcgctggtgccggaggtgtgccagctggtctaccgccgcatcggtgcctttctcaacgccgaatga

SEQ ID NO: 45 - DNA, 585 bp, Chromobacterium substugae
atgaaatcacatatccacgccagcctcagcgaggccaagtcggcgctcgacaacctgctggacaatgccgaggcgttggccggcatcgaggccgcgggcgcggccatcatcgccgcgctggaagcgggcggccgggtgttttcctgcggcaacggcggctcgatgtgcgacgcgatgcacttcgccgaggaactgaccggccgctaccgcaataaccgccgcggcatggccgccatcgccatcagcgaccccagccacatcagctgcgtgggcaacgactacggttacgacgagatcttcgcccgctacctggaaagccacgcccgcgccggcgacgtgctgctggggctgagcaccagcggcaacagccgcaacatcgtccgcgccgccgaaaccgcgcgcgaattgggggtcaaggtgatcatcctcaccggccgcgccggcaccaagctggagccgctggccgacgtttacgtcaacacccccggcggccagtacgccgaccgggtgcaggaactgcacatcaaggtgctgcacatcctgatcgagctgaccgagcgccacttcttcccggaaaactattga

SEQ ID NO: 46 - DNA, 765 bp, Chromobacterium substugae
atggagttctatatggaaaattccttgcagcagcccgacttccggcaacggctggaactgctgatcggtgcggaaaagccttatgcctgggcggcccgcatgggcatcaacaagggttcgttcaccaatatgtggtacaagggcggcgtgccgcggctggccacggcgcagaagatcgccagcagcagcggctgccggctggagtggctgctccatggcgaggagccggcccaggccgatgccgctgccggcgcggcggcggaagagatcgcggtcgaggccgcgcgtttggaaccgatgcgcgggtcggaggacgagcatttcgttccggacggcgtgcgcgaggagttctgtttcatcccgcgttataacctgagggcgtcggccggctttggaaccgccgcctgcgacgaacagccgctgttctatatggcgtttcgccgctattgggtgaaaaaccacctgaacgcctcgccgcgcgacctggcggtgatcagcgtcaagggcgacagcatgagcggcgtgctggaagaccgcgacaccatcctgatcaacaccgcggaacgccatcccggcgaaggtttgttcgtgatccgcatcggcgaggacatcttcgtcaagcagctgcagcggctgccgggcggcgcggtgcaggtgaagagcgccaatccgctgtatgaaacctttaccgtggacctggcgcgcgccgccggggaattcgaggtcatcggccgggtggtgtggttcggcaggcagatcgcctga

SEQ ID NO: 47 - DNA, 420 bp, Chromobacterium substugae
atgaacgctactgcgcactttcccgctcttcccgccaccatgcaactggtcgcccagctgataggcatgccgcgcaccctgcaattggtgcaggcgctgggcggcaccaccctgccgttttccaagaaccagagccgcgccggccagttgcgcttcgccgcgctggtggacgtgatcggccaggacgccgcggaactgctgacccgccacttcggcggcgacatcctctacatcccgcgctgcagccaggcgctgcgccaggcgcgcaaccagcagctgatccgcgacttcgacgcgctgctgatcgacggcctgggcgccaacgaagccgtcggcctgctggcgatgcgctaccgcctcagcgaccgcatgatctggcgcgtgctgaaaaccccgccggccccgcacgaggtgcactga

SEQ ID NO: 48 - DNA, 405 bp, Chromobacterium substugae
atggccagccgcgccatttccgatctgcacccgcaactgcaaccgctggccgaagcctttctgcgccgctgccgcgaccagggagtcgacccgctgctcacctgcacctggcgctccccggccgaacaggacgccctgtaccagcaaggccgcagcaagcccggccccatcgtcacccgcgcccgcgccggccagtccgcccacaacgccatgctgcacggcagcccggccgccctcgccttcgacgtggtgccgctgcaggccggcaagccggtatgggacgccgaccaccctcactggcaagtcatgggccagatcggcctggcgctgggcttgcgctggtacggcgccgccgacgcgccgtttcgcgagtatccccatttccaactgacgcaggagacatga

SEQ ID NO: 49 - DNA, 222 bp, Chromobacterium substugae
atgcgcctttccgacctggtccgcggcccgcacagccgccgtctcagccatagccggctttgggccaacgtggcctgcgccgccgccaccgcgatgttcgtcgtcgacggctggcgcggcaccctcacgcccgatctgtggctgatctatctgggcgtggtgggcggctactccgcctcgctgcggctgatctccgcctatcgcggccggagcccggcatga

SEQ ID NO: 50 - DNA, 564 bp, Chromobacterium substugae
atgatgcccgccgccgccctgcggctgggcgcctgtctgctcttgccgctggccgccggcgccggcggctacgcgctgggcagccagcgcagcggccaatattggcaggcccggctgcaagccagcgtttcccaactgcaagccgacgacagccgcgccgccgaacagcggcagcaagcggcgctgatgcaacagcagcaatggcgccagcgcatcgatcagctggaagacagcctgctgcggcagcaacaggcgcggcaagcgcagcaacgccaacaagcgcaaaggatagacgatgtcactcgccacgatggttccgcttttaccggccttggccctgacggcctgcgcctctaccgccagctcctcggctatcccgccgagctgcccggcgcccagcccctacctgctggaaatgccggccaagccgccggcgccggcggcgggctaccggcgcccgacctcctcgcccacgccgccgattacggcgcctggtgccaacaactggaacagcgccttgccgccctgaaacaactttacgccccacaggagcccacgccatga

SEQ ID NO: 51 - DNA, 198 bp, Chromobacterium substugae
atgaccgacttcttcgaccgcgccagcgagctggaaaccgaattccgcgaacaagcgctcgcccgccatttccagcagctgcaacacggcggctacagccactgcgaggactgcggcgatcccattccgcaggcccgccgcgtcgcgctgcccagctgcacccgctgcgtgatctgccaacagttggcggaacgctga

SEQ ID NO: 52 - DNA, 216 bp, Chromobacterium substugae
gtggaacacgacaatctgctggccctgggccgcatcgaaggcaagctggacatgatcgtcgcccacctcgccaaacaggataaaaaactggaagaactggacggccgtctgcgcgacgtggaagtccaggccgccaaaagcggcgcgctgtccggcgccctgtcggcgctgctggtcaccctggccggcgaactcctcaagcgcgcgctgcactga

SEQ ID NO: 53 - DNA, 696 bp, Chromobacterium substugae
atgctgatctccgtgcaaaccgccatcgccgaccgcctgcgccaaggcctgggccgcatggtgcgcgaagtggcggccgacctcgacgaaaccgcgctgtgcggcctgcagctggcccacggcgactacgccagccgcctcacccccggccaggccagccccgtcatcaacacgcaggcgctggccaggctgccggcgctgtggaccgtggccggcggcatcgccgccagcacgccgcaggccagccagcgccaacgctacaaagccaacgcgcagttcaccgtcatcgtcggcgaccgcctgcaagccgatgccggctacgccggcgccggcgtctggcaactggtatacgcggtgcgccgcctgctggcctcgcaggatttcggcctggccatccagccgctgcagccggaaaaagtccgcccgctgggccagaccccgcgcgacggccagccctggagcttggtggcctgcgacttcgccacctactggctggacgaagcgctggacaacggccgctggccggcgccgcaaggcgacgccgacccggacgcgctgttccgatcctttggcggccgcctggaagacccggccaaggattggcaaagcacccagctcaactacagcctggccggcaatcccaccctcaaggcccaggacaccctcatccagcccgctcccaagccggctccgtaa

SEQ ID NO: 54 - DNA, 1446 bp, Chromobacterium substugae
atggccagccccaacatcagcttcgaccaaattccggcatccatccgcaaaccgggcaaatacttcgagttcaacaccaagctggcggtacgcaccctgccgggcaatccgcagcgcgtgctgctgatcggccagcgcctggccgacgatccggccaatccgggcaagaacgccacccagccggcgctgtcggcgctggacgtgttcagcgacgaacaagccgcccaggccttcggccgcggttcttacgcccacctgatggcccgcgccgcgatcaacgccaatccctatctgcaactcaccgtgatcgcggttgacgacgccgccgccggcgtgccggcagccggctccttcaccttcagcggcccggccgccgccgccggcgtgatgagcctctatatcggcgccgtgcgcgtcgacgtggccgtcgccgccggcgacgacgccaccaagatcgccgccaacgcccaggccgccatcgccaagctgaccgacctgccggtaagcgccgccgccgccaaggaagtgctgaccctcaccgcccgccacaagggcggcatcggcaacggcatcgcgctgaaggcgcaggaacagatcgccggcctgaccgtggccatcgcgccgatgaagggcggcgccggcgacccggacatcgccccggcgctggccgcggtggtcagcggcggccaccagatcgtggtcaatccgttcaacaccgacgccgccctggccgcgctgcgcacccacctcgacttcgtttccggcccgctggaacagcgcggcgccatcggcgtgatcgccaccgtcggcgcgctggccgacgcggcagccctgtccgccaaactggacagcggccgcatcaccgccgcctggtatcgcggctcggccaagctgccgggcgacatcgccgccgcttacgccgcggtgctggccagcgaggaagatccggcccgtccgctcaacacgctggagctgaaaggcctggacgtggtggacctggcgtcccgcaccagccgcaccgagcaggaaagcgcgctgtacagcggcgtcaccccgctggaagtggccgccggcaaccgcgtgcagatcgtccgcgccatcagcacctacaccaaggacgcgcaaggcgtggacgacgtgtcgctgctggacatcaccaccatccgcacgctggactacgtccgccgcgcctgccgcgagcgcatcgcgctgcgcttcccgcgtgaaaagctgtccgaccgcacgccgtccaaggtgcgctccgaactgctggacgtgctgtacaagctggaagagctggaaatcatcgaacaggttgacgccaacaaggacggcctgatcgtcgagcgcgacctgcaggacgccaaccgcctggacgccaagatcccggttgacgtggtgaacggcctgcacgtgttcgccggccgcatcgacctgctgctgtaa

SEQ ID NO: 55 - DNA, 372 bp, Chromobacterium substugae
atggctttgaaagaatacgcaggctccatcgtcctggaagtgaacggccaggaaatcgacgtcatcgacctcaacgtcagcagcaagaccggccgcaagctggtgaagacgatgaactccagcggccgcgccaagggcttctcccgcggcgtcaccgagtacgacctgtccatcaccgtgtccatcccgctgaccggcgatctggactgggaagcgatcgaaggcgccaagctgaccgaattcccgctggccggcggcaaacgcaccagctacctcgactgcttcacgatggaagtcggcgagaaatacggcgtggaaagcgaagcgcgccgcgatatcaagctgatgtcgctgcggaaggtggtcgaataa

SEQ ID NO: 56 - DNA, 1686 bp, Chromobacterium substugae
atgccaattgaaaaaaaaccacaaaaggcaagcattaaaaatacctactccagaggaaaagacaagagattatctaccgacaaaacatcctctcaaaaaatagcggagacgttattctcacaggaaaattccgatccatcccctcctgaaactaagagtattttttctaatcagcaagtatcagattccaaatcgatactggagggattcctagatgcaattaccaaagaacatggggagctatccgcaccaggcgccttggcaaaagcaggaaaagacagactgaaactacttgggaatattgataatgcaaccaaagtactccagcatgttatcgctggaaacgatgatgaagctatagtccaactctccagaattattggcgaatatgctggcgataagataggtggagaaattggtggaaaactaggagcagcaggcggatccttgattggtccggagggaacggttgcaggaggaatcgcaggaggcacctatggggccatgtatggctctcaaaaaatgggtgatattgcggagcggatcgccagggaacaactcaactatgtcgtttcaaatgatgacgtgcccccaacaatagaaaaaaaagatggtggaaagtacttccttgccaagcatggtgaaaactatcaatggtatgacgccccccctcaagaggctacgcaaagtcgcagcgttggttcgctagcatcaagcaatgagaaaaaatacaagccggtaaaagatgaaaaactcacagacgagctaactcaggaatatgctgagaaaactgggtatatcaatagaagaataaaagaacagaataaaaaaaatcaagaggacagaaggaaaaatataaaaaggggcctcgctcccgatggaaaagaattcaacaagcaatataccactgacggcaaaggagtccatgccagtcaaatatgggtagaagacaaaaagaaaaaccaattgattggtgtaaataccgttgacactcaaggaaaatcgataagctcggcggattattatgacaaagaaaccggccgccatttaggaacagagactgccatcaccgaaggagggaaaacaaccaaaagcagcacattaccttccgataaaaactcaccgccctcgccaaaaccccacaaaatcagcgcaaagcccaaaaatacacccaatagcgcggacaataaaaaagaaaaaacaaattcagcaccaaacatacaaaagagaacaccgcagaaaaatacagctctaggcttgaacgagcagcaatcccctgtgcagaagggaattgccaactcgatttcccctgcaaccaattcagccacagagccgaatgccatcgaaaaagacccgaacccaaacgtagcggcggcaaccgaagaacaggtagtcaaaacacatgcctcagggcagctctcaaccgttgccgatgagatgcccgataagacgaaaacaccggcgcaagacaccacgctatcgccccacggccagaccgataaaacacaaatcccggcgccatcaaccggcggcaattcagactctcagcttgccgctctaatcgcccagctcagctcagcgcttgcacaactcactcaacccatacgcgtcgtcgtcgacgtccagcacggcaacatcatcgccgccgtcaacgccgccaacagccaacaacaaaggaggagctga

SEQ ID NO: 57 - DNA, 1305 bp, Chromobacterium substugae
atgttcagcctcaatctgtccgccggcacggccgccggctccctggtggacgccagcttccgcggcgtgcgcttcgattgcctgaaaagccaggacagcgcccagcgcgaccaggcgatgcacgaatacccgtacaaggacggggccgatgtcgaggatctgggccgcaaggcgcgcaaggtgacgctcaacgcgatgttctggggcgagggctatcaggaccggctgcgcgaattcgtcgccgcactggacgccgccggcccgggcgagctggtgcacccggtgttcggcagcatgccgcaggcccaggtgctggactaccagatcagccacgacgccgacgcgcccgactcctgcgccgtggacatcaactgggtggaggccacgccgggcaatcccttcttcgcgcagcacaagccgctgcagcagagcgaagccatcgacgccaaggtggacgagctgcgcggcatggccggcgaagcctacgccaaagcccaggaactggtcgccaccgccaagggcgcgctggccaggctgggcgcgctgcgccagcagctggtcgccacggtgaaggcgctggccgacatggccaaccaggcggtggcccaggtcaacgacctgctggcctatccgcaagccttcgtcagcgaggtgaacggactggtggaccaggtggccgactggaaattcgaccaggcgctggacctgggcccgctgccggcgttgaaaaccgccgccagcctgcccgccgccaccctggccgactggaatgcgctgcggcgccggctggacggcctgccggagcggatacgccagaacaccacgccgctcaccgccagcgccgccctcaccgtgtggagcagcgaccagcagcggatagacgcgctgctgcagctgaacgtcgccaccaagctggccagcgccgccagcggcatcttcggcagcgaggccgagcggccgacgctgacgccgccggcgctggagcagatcgccggcgacgtgcgcggctcgctgcaaaccgccatcgaccaatggcgcgccaatatgccggccgacgccgcctaccgcgtggtggacagcctgcgcgagctgggcctgcaggtgcagcagggcgccgccggcctgatcgccgccaagccgccgctgatcgaacgcgcggtggaagccgaagccaacctgcgccagctggcccacctgtggtacggcgacagcggccgcgccgacgagctgctgcggctcaacccgcagctggcctatcccaaccacctgactccggggaccgtgatccatggctacgcccgctaa

SEQ ID NO: 58 - DNA, 1062 bp, Chromobacterium substugae
atggctacgcccgctaaacccgccgcggcggaccacgccgtcagcctgcagatcgccggccgccgccacagcgactggacccactattcgatcgactccgacctcgccgtgcccgccgacggctggcaagtggcgctgggcctgcccggcggcgtctttccgccggaagtggagccgggcgcgatgatccaggtgcaggtgggcgcggaaaccgtgctgatgggccgggtggacgacatcagccacagcgtcgccgccggcagccaccaactggcgctgtccggccgcgacctcgccggcatgctgctcgattgcagcgcgccgctgctcaccgccaagaacatgacgctgcgcgacgtgctggaaaacgtggtgaagccgctgggcatcgcccggatacgggtggacgccaaaggcagccggccgctggaaaaaatcagcgtggaccccggcaacagcgcctgggacgtgctcacccgcgccgcccaggccaacggcctgagcgcctggttcgacccggacggcaccctggtggtgggcggcccggactacagccagccggccggcgcgcggctgatcctgcgccgcgacggccagggcaacaatctgctcagcctggccgaaacccgctcgcacgcgcagcgctactccgaattgacgctgctgggccagggccacggccaggcgctgacgccgggccgccacgcgatgaagcaccacagcttcgattccgacgtctgctaccacaagccgcgcatccaggtggagccggacgccgccagcccggcggagctggcggcgcgcgccgacaagatgctggccgactcccgcctggccggctacaccctgtccgccaccgtggccggccaccgcgacagccgcggcatgctgtggacgccggggcagcgcatcgaggtggaaagcgagccgcacggcatcaacggcgtctatttcctgatggcgcgcaccttcgaaggcggccgcggccagggcagcgtcacccggctgacgctgaaagaagacaaatgctggattccggtgatgcgcgccggcaaacaatga

SEQ ID NO: 59 - DNA, 687 bp, Chromobacterium substugae
atgtggcatgaagtagaccaccgcatccgccgcgccttcagcaatgtgcgccagggcttccgcgccgcgctcacccacgtggacagcgcgggcgcggtgcagaccgcccaggccgaaggcctggccggcgaacagctgcaggacgccgagctgttccagcactacggctacacctccaacccgccgccgggtagcatggcgatggtgctgccgctgggtggccgcaccagccacagcgtggtgctggccaccgagcacggcagctaccggctgcaatcgctgcagccgggagaagtggcgctgtatagcgacgaaggcagcaagatcgtgctcaaacgcggcaagatcatcgaggccacctgcgaccacttcgtgctgaactgccaaaccatgcaggtcaaggccagcgacagcatcgccctccaatgccaaaccatgcaggtgaacgccgaccagcaggccgccttcgccacgcccacgctgcaaaccagccagcagctggtcgcccagggccagatcagcggcaacggcggcctggcggtgcagggcggcggcggcgccagcttcagcggcgacatcaaactgtccggcgcgatgaacgccagcggcgacgtgaacgccggcggcaagagcctggtttcccacatccacgacgcgccgaacggccccaccagcccgcccaagtaa

SEQ ID NO: 60 - DNA, 351 bp, Chromobacterium substugae
atggacccactgctggaccccgccaccggcgactacgccggcacttccaccgataccctcgccaacgccgtctacctgcgcctgatgacccctctgggcggctggtgggccgacccgacgctgggctcgcgcctgcatgagctgtcccgcgccaaggacagcggccgcgtcgacctcctggcctgccaatacgccgaacaggcgctgcaacccttgcgccaggacggccgcgccagccggatcgaggtgtcctccagccggcaaggcccgggccggcttctactccagatccgcgtcgccgaggccggcggccgcacccgacatttccaacatcaagtgaggatagcctga

SEQ ID NO: 61 - DNA, 1089 bp, Chromobacterium substugae
atgcccctgcccactcccgacttcgccagcatccgcgacacgctgctgcgcgacctgcaaaacctgcgcgccgacgccgacaccgggccggacagcgatttcttcgtccgcgccagctcggtggccagcgcggccgaaggcctgtaccagcaccaaagctggatcgctcgccagatcttccccgacaccgccgacagcgaatacctcgagcagcacgcccgcctgcgcggcatcgtgcgcaaaccagccagcgcggccgccggcaagctgcagctgagcggcaaccccaacaccatggtcaacggcagcctgcaagtgcggctgggcgaccagctgtacgccacgccggccaccggcggcgacggcggcccctacgcctttcagctggacgccaatggccaggccacggtcgacatccgcgccagccagcccggcccggccggcaaccagcccgccaatctgcaggtggacctgatgcaggcgccgcccggcgtcgccggcaaggcgctgctgctcagcatgggcggcgcggtggatgtggaaagcgaccaggccttgctggagcggctgctggaattgatacgccggccgcccgccggcggcaaccagcacgactaccggcgctgggcgctggaagtgaagggcgtcaccgccgcctacgtctacccgctgcggcgcggcctgggcaccgtcgacgtagtggtcaccgccaacaacgacctgccgtcggccgacaccctggccgcggtgcaagcccatatcgaagacctgcggccggtcaccgccaagagctgcctggtgctggcgccgaccccgcgcgcggtcgacatcgacctcgcgctcaatctgggcggcatcagcccggacgtcttcacgccgcagctgcagcaaacgctgcaagcctacttcgccggcctcgctccgggcgagcgcctggtcaaaagccggatcgaggcgctgatctccgatctgcccggcgtgcaagaccgccagctcaacgcccccgccggcaatgtcgcgccggtttccgacgccggcaaggtggaatggctgcggctgggcaaattgacgctgagggcgatgccatga

SEQ ID NO: 62 - DNA, 579 bp, Chromobacterium substugae
atgatgccgcagcccccctaccaggaactgctggcccggctgctgccgccggccagctacagccccgacggtccgcggctgcaggccgaactggccagcgagggcgcggcgctggaccgggcgcagaacagcgcccgccagctggccggcgccgtcaccccgctggcggccgaaacgctgctgccggactgggagcgggtatgcgggctgacgccgcccgccgacgcgccctaccagcagcgccagcaggcggtgctggccaagctggcggaaaccggcggcctgtccatctcttacttcacccggctggccgccggcatgggctaccggattaggatcgacgagccgcagccgttccgcgccggcgtcaaccgcgccggccagcccttgtggagcgccgacattccctgggtgtggcaggtgaccgtgtacggcagcaaggtccgcccctaccagttccgcgccggacaatcgctggccggcgagcgcctcaccactttcggcgaccccaggctggaagagctgttcaacgacctcaagcccgcccacaccttcgtctacttcgcctaccagccgtaa

SEQ ID NO: 63 - DNA, 1167 bp, Chromobacterium substugae
atgcaagatccgatcaagcctgtcccctcgccagaccagaaattccacgatggcaatcccgccaccggcgaactgggcaccatcgtctcggccgactggctcaacaccctgcaatccgccacccaatccacccagcaggaactggtgaccgtcatccagaacagcggccagaaaaccgaccccgcgcgccaagaccagttgctgcaagcgatgcagaacctcgcctggggcggcgcgcagcggccatccacgctggccggctatggcatcgccatcgccagccaagcggaagcggaggccgggagcgataacagcaaggcgatgacgccgctgctcgtggggcaggcgctgaacgccgtcggcttgtccggctatgccaagccccttgccgccggctcgctgcaaacagtgcgtcccaatgggctctatcacatcgacaacaacctggtcgacggaacgccggtgaaaagcaacggcatgttgctggccaacttcctgtctccgctctggggcagccagctttactcggcctggggcggcgccacctatgaacaaagactggaaaacggcaattggcagccctggatccggctgctgaaatccggccaacagagcacgatggcagattacggcatcgtcgatggcgcgaccttggcacaactgaaggcggcaacggcgtttgccggcgcggtcctgcacttcgccatgcccaacgcgccagatggctggctcaaagccaatggcgcagcagtcagccgcagccaatacgccgcgctattcgcggccatcggctccacttacggcgccggcgatggctccactaccttcaatctgccggatctgcgcggcgaattcattcggggatgggacgatatcggcaaaacagatcctgatagccccaaacgcaaagtcggcgatcgacaagcacaacaaaccgcgactcataaacacgtgattccctggggagagaacattgccgtcaacgccaccgccttcggcggcaccaacaacgtcggccgaatgggctctgttgcaaatgactacgacaaccgctggtattactcgaatgacggcagcgactttgacggcgtgctcaaccccccagacaccatcggctcggaaacccgcccccgcaacatcgctttgctcgcctgcatcaagtactga

SEQ ID NO: 64 - DNA, 366 bp, Chromobacterium substugae
ttgtggcgcaagcaaaccgctcaagcgatacaggcgcagataggcgacaccccggacagcctgcaagccaccgccttgtcgccgccgcccttcgctatctggcgtggcgatggctggagcgtggacgaggcgactcaattggccactcaaaccgtcgctgcgcaacagcaattgcaacggaagctggccgcggcctaccagagccgccgcccactggaagacgcctccgagctaggtgtggccacaacggatgagcaagcccgtctgatggattggaaacgctactgcgtggcgctctcccgcctgccgcaacaccccggctggccccggctggccgatgccgactggcccaatcaacccgcctga

SEQ ID NO: 65 - DNA, 1389 bp, Chromobacterium substugae
atgaagctgatcaacagcgccgacggcctgttccacgacggcaacccttactccggcgaactcggcaccgtcgtcacgtccgactggctcaacggcgcccagtctgccattcaggctacccaacaagagctgctgaccgtcattaaaagcaatggccagaaaaccgacccatctcgccaggaccagctgctgcaagcgatgcagaacctcgcctggggcggcgcgcaacggcccaccacgctggccggctacggcatcgccgacgcgatgaaagccagtgactggggcgtgcagggctacaccacgctgcaggttggccccggcaaagccttcgccggcatccaggacgcctgggacagcctgatcggcaaggttttgcaggccgatgtgctgatccagatagccgacggccagtacgccacgagcggcatcacgctaacccaccaaccgttcgccagccgcatccgcatccagggcaatgtcgccaacccgtcggcatgcaagatcatcctcgtgcccgacgccaacaagctcagccatggcgtgatcttttcccgcgtacaaggcgtcaacttctccggctttcatatcgtcggcgaggccggcgccaatcactggagtcatcgctgcctgcgggtggaagaagcgtcggtggtatacgccgacgccggctccatcgtgctggagggcgccggcaacgggctggaactggatcaaaatgcgcgcggcaacttcgagcggctacgcgtcctgaactgcaagaattgtgcggttctcgtcggcggcggcgcccatgcctggctgccgtccagcacgctgatcggcctgggcagatatgccgaaactgtcgttccagccttcgtcaacgtcgatactcccaaattccggcccatgggcttggaatgccaggaaggctcgaaggcctgggctagcgacagcagcatttccaatgtcgatatcggctacatgacaacgcggaacagctatctgtggtgcgatggcacagcggtcgatcaaagcaatatcggcatgtatgcgcaatatggcggggtttgctggagctgcggcgcgcaagcccggccatcgctgcctcagggcaggcgctccaaggtgaccaactcgggaaaaggctactacgcggagtttggcggcatcatcaatgcggacatggccgtagcggaaaactgcgaacacggcttttttgccacctggaattcggtcatgacagtcagcaatggctgggcgcgcaactgcaccaaagggggctaccatgccgagatggcatcaacgatcgccgcttacaatacagatacgacagggactgccacggcgtacgatcccaatcagaacttcagtaattggaacggcatcgtcgtaacaaaaatttga

SEQ ID NO: 66 - DNA, 1005 bp, Chromobacterium substugae
atgcaagatccattcaaacccatccacagcgccgacggcctgttccacgacggcaacccgaccaccggagaactcggcactgtggtcgccgctgactggctcaatggcatgcagtccgccatgcaggccacccagcaggaattgctgactgtcatccagagcaatggccagaagaccgaccccgcgcgccaggaccagctgctgcaagcggtacaaagcatcgcctggggcggcgcgcaacggcccaccacgctggccggctacggcatcgccgacggcgccagcaaaaccgatctgaagtccgccatcgacggcgtggtggccggcgcgcccggcgcgctcaataccctgcaggagctggcggcggcattgggcaacgatcagaacttcgccgccagcatcgccaagctgctggccggcaaggcggacaaggccaccacgctggctggctacgggattgctgacggcgcaacctcgactcaggtcaacgccgccgcgccagccggcatggtggcctatttcgcgatgaaagacgcacccgccggctggctgatcgccgacgggcgggcagtttcgcgcaaggactacccggcgctgttcgccgccattggcggcctttatggaaatggcgatggctcgacgacattcgcattgcccaacctatgcggcgaattcatccggggctgggacaatggccgtggggtagataccaatagaaattttggcacatcacaaaccgagggcattagagatcacaaacacgcaggtcttatcaatagtccatacggagataattggaactatatttacggctacaaaaataacggcccaaccgcaccatcgggtggggttggcgcatttcctggtaatcaaactctacctcaaatcacgcctgtttctcatgatggcaatccgaataacgccattcaaacttatataactttgaacgcagcaagcgaaacccgcccccgcaacgtcgccctactcgcctgcatcaagtgctga

SEQ ID NO: 67 - DNA, 891 bp, Chromobacterium substugae
atgatgctgtatgaccttgccgcggtcggcgccgccggctgctgggcgctgggcgccatgctcggcgccacgccgtcccgccatttcggccccttcgccttcacccggctgcgcttgacgctgctgacggttttgctcggcggctacagcctgctgtccggcggctggtacacgctcagcgccgccagcctgtggccggcgctgttgtccgggttgactggcatctttctgggcgacacggtgatgttcgcctcgatgaaccgcctgggcccgcgccgcaccggcttgttgttcgccacccattcggtgttttcggtgttgctgggcgtgttgtttctgtcagagcgcttgagcgcgggcgcgctgctgggcagcgtgctggtatttggcggggtgctgctggcggtggccttcggccgccgcgaggtggacgcccatgcctgggagcgcaacgacaagctggccgccggcgtcgccttgggactggccgccgcgctatgccaggcgctgggcaccttcttcgccaagccggcgatggcggccggcctggagccggtgaccgcgtcggcgctgcggatgggcgtcagctgcggcgcgcactatctgctgtggctcagcggctggaaactggcgaagagccgcgggccgtacacgccgcgcatgctgggccagaccgcgctgaacggcctggtggcgctgggcctgggcatgacgctgatcatgctggccttgcagcgcgccgatgtcgccaccgtggggatcttgtcggcgctgagcccggtgttgatcctgccgatgctgtgggtggcgctgaaacggccgccgccgccgctggcctggctgggcgcggcggtcagctgcgccggcaccgcgctggtggtgctgcgttga

SEQ ID NO: 68 - DNA, 642 bp, Chromobacterium substugae
gtgacgcgcaagcagttctggagtgatccctaccaggccgaactcgccacccgcgtcagccgcgtcgacggcgcgcgggtctggctggaagaaaccattttctacgctttctccggtggccaggagagcgacagcggcagcataggcggccatccggtgcggctggcggaaaagcagggcgcggacatcgcctacacgctggacgccggccacggtttgcaagccggcgacgcggtggcggtggcgatagactggccgcgccgctaccggctgatgcggctgcatttcgccgccgagctggtattggaagtgatttgccgcgcggtggcgggcgtggcgaagataggtgcgcacatcgccgcggacaaggcgcggatagatttcgcgctggatcagcccatcacgccttggctggcgggcatcgctgccgccgcgcaagcgttgatcgacgacgatttgcccatcaacagcgctttttccgacgaagcggccgggcgccgctactgggagctgcccggcttcgcccgcgtgccttgcggcggcacccacctcaaacgcagcggcgaggtggggcggatcgcgctcaagcgccgcaacgtcggcaagggcaaggagcgggtggaaatctatttactggactaa

SEQ ID NO: 69 - DNA, 462 bp, Chromobacterium substugae
atggcgtgggaagtggatacctgtccggagcggctggatcgcgacatgatccaccgctatctggcgcaggagtcgtattgggcgcgaagcctgccgcgcgaggtgctcgagcgctcgctggcgcactcgctgtgcttcggcgtttacgccgccgacggcgcgcagatcggtttcgcccgggtggtgaccgaccgcgccaccttcgcctatctggccgatgtgttcgtgctggacgcctggcggggccggggcgtgggcaagcaactggtgggcgcggcgctggcgcatcccgatctgcaaggcctgcgccgcatgatgctggccaccgccgacgcgcatggcctgtacgcgcaatacggctttgccgcgttgtcgcggccggaacggctgatggagaagctggaccaggacgtatacctgaggaaggcggcgggcggtgacgcgcaagcagttctggagtga

SEQ ID NO: 70 - DNA, 444 bp, Chromobacterium substugae
atgggccgaaacaagcatttggcatgcaaacaagtcacaactgccagacggccaatgttttatggcatttcattgccgaattgtttgcaactagccgttgccagccagagtaaaaactcgcaggatatcggtttgccattccgccgccgccgccatgaaccactgaccctgctgagaaacctgctgttcgcgctgctgctgctggcgatcgcgctgtggtgctacggcagctggcgccagcagccgcaactggtcgacgccgccctgtatctgggcgacgcgctggtgatgagcggcgcctacctgttgcccgccatcaccgccgcgctggtgaaaagcccgcgcctgaagaaggtggcgctgatcaatgtgctgggcggctggctgattctgccatggatcatcgcgatgggcctggcgctgaaacgcgacgacctggcctga

SEQ ID NO: 71 - DNA, 1194 bp, Chromobacterium substugae
gtgttccaacatgtagacgcctacgccggcgaccccatcctgtcgctggtggaagccttcggcaaagacccgcgccaacagaaggtcaacctcagcatcggcttgtattacgacgaagccggccgcatcccgcgcctgaaggcggtggaacaagccgaggcgctgttggccagccagccgcaaccgccatgcacctatctgccgatggacggcctggccccctaccgcgccgccatccagaccctgctgttcggcgccgagcatccggcggtgcagagcggccgcatcgccacgctgcagacgctgggcggctccggcgcgctgaaagtgggcgccgacttcctcaagcgctacttcccggcgtcccatgtctgggtcagcgacccgacctgggacaaccacgtcgccatcttcgaaggcgccggcttcacggtggaacgctatccctacttcgacccggccacccgcggcgtggacttcccggccatgctggccaagctgcagacgctgccggccaagagcgtcgtgctgctgcacccgtgttgccacaatcccaccggcgccgacctcagcgacgcgcagtgggaccaggtggtggccgtggccaaggaacgccagttgattccgttcctggacatcgcctaccagggcttcggcgccgatctggagcaagacgcctacgccatccgcgcgatggcggacgccggcgtggcctgcctggtcagcaactccttctccaagatcttctcgctgtatggcgaacgctgcggcggcctgtcggtggtgtgcgacgacgccgccgaggcggcgctggtggccggccagttgaaggccaccgtgcgccgcaactactccagcccgccgacgcacggcgccaaggtgatcgccgccgtgctgaattcgccggaactgaaggcgctgtgggtggcggaagtgaatgaaatgcgcgaacgcatccaggcgatgcgcggcgtattggttcaggtgctgaaggaagcgctgccgcagcgcgacttcgagtacctgaaggatcagcgcggcatgttcagctacaccggcttcagccaggcccaggtggacaagctgcgcgagcaattcggcgtctacctggtgggcagcggccgcatgtgcgtggccggcctcaacaccgccaacgcgccttacgtggccgaatccttcgccaaagtgcagtaa

SEQ ID NO: 72 - DNA, 1230 bp, Chromobacterium substugae
atgatgcaagagctgttgtccccgctgctggcgtattccggcagctatcgcgacggtttgtccaaccatttgccgatggagctgcaggcgctggcggaattgggcgcggacgaggggcgtctgcgccggctggcggcgcgtcatggccatctcgaacgtctgcgggacgacggccgagatatcgccgacagccgcggctggctgagcgaccccgccagcgaggcggcatggcgcagacgcctggcctgggagaggcggcagggcgagtggctgcggcattgggccggccgcctgcaactggcgctggccgcgccggccggggcgtcgttccatggcctgatccggctggcgtacgcgtggcggagcggggtggaagaggagatcgacgccgcgctggcatacgcgctgtcgcactggcggctgctggatttgccgggacggtcgccggcgatgcagacgctgcccgacctgctggccgattggaccgcttcgcccatcctgttgccgccgcagggcggcctgatttctgacgacatcgaacgcgcgctggccctgccggcgctgtccgcccgcctgccgcccggcttgctgggcagcgcgcgcgaacagcgccgccattgccgtctgctgttcctggccacccgcgatctggatgccctgcatctgatcaccgcctgggaggcggcgctgagcctggcgcgcgcgcaggggctggccgaggtggccgatggcacggcgttgcagatgcaggcggcgctgatcggggtattcgtctattgcggctgcccggcgctggcggcgcggccgccgcagccgcgacgcgacgcgacgcgacgccgcggccatccgccgcctggcgctggacttgtcggacccgcatggcgtcaagctggcgctcagcagcttgcgcctggcggggctggaaggcgacgcggcctggcttgggctggcgggccgccacgccggtgtagcctgggtcggaaatgcgaaacggcagcgcgaggctgccgtttttggctgggacgcggcggtttacagcgcgtcgctggagaaaatgtcgcgccaggccatgtactgcgacaggtatatcaccgggaacagcaccagcagcgccaggcccagcgtgaagacgctgagcatggccagcagcaggatggccaggaaatagaccagcaacgggcaccagttcttttgcacggcgcttacgctcagcttcagcgctggccatag

SEQ ID NO: 73 - DNA, 882 bp, Chromobacterium substugae
atgtcacatccgataccgcgccgcctgttcctgctgtccgccgccttgctgcctttcgccagcctggccgctcccgccatcgccgaccgccgcgccagcgccgccgcgcggctggccgccctggaggccgatttcggcggccgtctgggcgtgtgcgcgctggataccgccagcggggccgagctgggccaccgcgccggcgagcgctttccgttttgcagcactttcaaggcgatgctggttggcgcggtgctggcgcgttcggccaagcagccgggtttgcttgctgagcgcatccactatgcccggcgtgatttggtggagtactcgccgcgcaccgagccgcatctggccgacggcatgacggtggcggagctgtgcgccgccgcggtgcagtacagcgacaatagcgccgccaacttcctgctgaagttgctgggcggcccggccgcgctgactgcctacatgcgctcgatcggcgacgagagcttcttgctggaacgctgggagccggagttgaaccgcgcggttcccggcgaggcgcgcgacacctccacgccgcaggcgatggcgcaaagtttgcggcggctggcgctgggcgacgcgctggcgccgcatgcgcagcggcagttggtggaatggctgcgcggcaacaccaccggcgccgaaaagatccgcgccggcgtgccggccggctgggtggtgggcgacaagaccggcaacggccgctacggcagcagcaacgatatcgcggtgctgtggccgcctggccgcgcgccggcggtgctgacggtgttcaccacccaggcgctggaggacgccaagcaacgccatcaggtggtagcggcggcggcgcgcatcgcggccgactggctggcctga

SEQ ID NO: 74 - DNA, 765 bp, Chromobacterium substugae
atggcggacattttgcccaaaatgatcgacatccccgcgggagaatggcgcaccgacgcctgcccgggatggaaagaaggacgcgtctgcgccccggaaaaatacgcgcggcaaaccctgcagatcgcgtcgtttcaactggcggccaccgccgtcaccttcgcgcagtgggatgcctgcgtcgaggacggcggctgccaggagcctgataccggctgggcataccaaacccggccgaatcagccgccctgccaagccggcggcccgtgcaactacccctacgacgagggctggggacgcggcgatcatccggtcatccacgtcagctggaaagacgcgcaacgctacgtcgactggctcagccagaaaaccgggcagcgctatcgcctgccgacatccgaggaatgggaatacgcggcggcggcgggctcccgcgcccgcttcgcctggggcgccaagctggggaaaaaccgcgccaattgcgatggctgcggcagccgctgggatggcaaaaagaccgcgccggtcgcatcgttcgcgcccaaccgcttcggcctgtacgacatggtgggcaatgtcagcgaatgggtgtccacctgcgtgccgatccgctccaggcgaggcgaggacaaccaaacctgcatggcctacctgtatcggggcggcgcttggtcatatgacgccaaggcggtgggcgtcgacacctacaactggatagacgcggatttccgcgtcaattacataggtttccgcgtcgcgcgctga

SEQ ID NO: 75 - DNA, 1533 bp, Chromobacterium substugae
atgagcatcctcaacatcgtaccgggccggctgacgctggccgacctgcgccgcgtttcacgtgaaaccggcttgcaactgcggctggatccgtccagccacgccggcatcgacgcctccgccgccaccgtggcgcgcgtgctgtccgaaggccgcaccgtctacggcatcaacaccggcttcggcctgctggccagcaccaagatcgccaccgacgagctggagctgctgcaacgctccatcgtgctgtcgcacgccgccggcatcggcgcgccgatggaggacagcagcgtgcgcctggtgatggcgctgaagatcaactcgctggcgcgcggcttctccggcatccgccgcgaggtgatcgaggcgctggtgacgctgttcaaccgccagatctacccggtgatcccgcagaagggttcggtcggcgcttccggcgacctggcgccgctgtcgcatatgagcgcggtgctgatcggcgagggcgaggccttcgtcgacggcgtgcgggtgccgggctcggtggcgatgcgctccgccggcctcgcgcctatcacgctggcgccgaaggaaggcctggcgctgctgaacggcacccaggcatccaccgccttcgcgctggaaggcctgttcgccgccgaggacctgtacgtgtccgccaccgtggccggcagcctgtcggtggaagcggcactgggcagccgcaccccgttcgacgcccgcatccacgaagtgcgcggccaccagggccagatcgacgccgcccgcctgtaccgcgaactgctggaacacagccagatcgagcaatcgcatgaaaactgcggcaaggtgcaggacccgtacagcctgcgctgccagccgcaggtgatgggcgcctgcctgacccaaatccgcaacgccgccgaagtgctgcgcgtggaagccaactcggtatccgacaatccgctggtgttcgccgacgacaacgacatcctgtccggcggcaacttccacgccgagccggtggccttcgccgccgacaatctggcgctggccatcgccgaaatcggctcgctgtcggaacgccggatggcgctgctgatcgacagcaatctgtccaagctgccgcccttcctggtcaacaacggcggcgtcaattccggcttcatgatcgcccaggtgacctccgccgcgctggccagcgaaaacaaatcgctggcgcacccggcctcggtggacagcctgcccaccagcgccaaccaggaagaccacgtgtcgatggctaccttcgccgggcgccgcctgaaggacatggccggcaacaccgccggcatcctgggcgtcgagctgctggccgcctgccagggcatagacttccgcgcgccgaacaaatccagcgccaagctggaggcggccaagggcatgctgcgcgagcaggtgccgttctacgacaaggaccgttatttcgcgccggacatcgagaaagccgcggcgctggtggccagcggccgtttcaacggcctgatcgacggcgcggcgttgccgtccttgtga

SEQ ID NO: 76 - DNA, 1671 bp, Chromobacterium substugae
atgaccgacccccgccacgacccgtcgcgcgtgatccgcgcgccgcgcggcaaccagctgacgtgtaaaagctggctgaccgaagccgcctaccggatgatccagaacaatctggacgccgaagtggccgagcacccgcaatccctggtggtgtacggcggcatcggccgcgccgcccgcaactgggaatgctacgacaagatcctggagacgctgcggcggctggaagacgacgaaacgctgctggtgcagtccggcaagccggtgggggtgttcaagacccacgaaaacgcgccgcgcgtgctgatcgccaactccaacctggtgccgcactgggccaactgggagcacttcaacgagctggataagaagggcctgatgatgtacggccagatgacggccggctcgtggatctacatcggctcgcaaggcatcgtgcaaggaacctacgaaaccttcttcgccgtcgccaaccagcacttcggcggcaagccgcagggccgctggattctgaccggcggcttgggcggcatgggcggcgcgcagccgctggccgccaccatggcaggtttcagcatgatcgccgtcgaatgcgacgaaacccgcatcgatttccggctgaaaacccgttacgtggaccgcaaggccaccaccttggacgaggcgctggccatcgtcgaggacgccaagcaaagcggcaaagccgtatcggtgggcttgctcggcaacgccgccgacgtgttcgccgaactggtggcgcgcggcatcaccccggacgtggtcaccgaccagacttccgcccacgacccggtgcacggctacctgccgcaaggctggagcgtggcccagtggcgcgacaagcagaagaccgccgccgccgaaatcaccgccgccgccaagaaatccatggcggtgcaagtgcgcgcgatgctgacgctgcaagcgcgcggcgcggccacgctggactacggcaacaacatccgccagatggcgctggaagagggcgtgcacaacgccttcgacttccccggcttcgtcccggcctatgtgcgcccgctgttctgcgagggcatcggccccttccgctgggtggcgctgtccggcgatccggaagacatctacaagaccgaccagaaagtgaaggagctgatcccggacgatccgcacctgcacaactggctggacatggccaaggagcgcatcgccttccagggcctgccggcgcgcatctgctgggtgggcctgaaagaccgcgcccgcctgggccaggctttcaacgagatggtgaagaacggcgaattgaaggcgcccatcgtcatcggccgcgaccatctggattccggctcggtcgcctcgcctaaccgcgagacggaatccatgaaggacggctccgacgccgtgtccgactggccgctattgaacgcgctgctcaacaccgccggcggcgccacctgggtgtcgctgcaccacggcggcggcgtgggcatgggtttctcgcagcactccggcgtggtcattgtctgcgacggcagcgacgccgcggccgaacggctgggccgcgtgctgcgcaatgacccgggcaccggcgtgatgcgccatgccgacgccggctacgacatcgcggtggactgcgccaaggaacagggcctggacctgccgatgctgaagtaa

SEQ ID NO: 77 - DNA, 933 bp, Chromobacterium substugae
atgagcatagacatgagcggctggaccggccgcatcgacaagggcgagggcgacggcgcgcggcgctggcaccagctggtgcagccgctggccgaaggcgcggcgcccggcgtcgccatcatcggcttcgcctgcgacgaaggcgtgcgccgcaaccagggccgcgtcggggcggcgaacgggccgcgcgcgctgcgcaaggcgctggccaacctggcctaccatccgaccctgcccttgtacgacgccggcgatgtggtgtgcgacgccggcaatctggacgccgcgcagcgcaaactggcgttgaaggtgcagcaggcggcggaagccggccatctgccgctggtgctgggcggcggccatgaaaccgcctacggccactggctggggctggccgacgcccatcccggcaagcgcatcggcatcgtcaatttcgacgcccacttcgacctgcgccatgccgacgaggccaccagcggcacgccgttcgcgcagatcgccgccgactgcgcgcgccgcggccagcatttccgctacctgtgcctgggcgtggccgaaaccgccaacacccaggcgctgttcgacaccgcgcgcgcgctgggcgccgagtggcggctggacaccgagatgaccggctggcagctggccgacatccgcggccagttggccgaattcctcgacagcgtcgacgccgtctacctgaccatagacctggacgtgctgccggcggcgcagatgccggcggtgtcggcgccggccggctacggcgtcgacatcgcggtggtggagacgctggtcggccggctggccaagagcggcaagctgatcggcgccgacctggtggaattcaatcccgaatacgacatcgacagccatggcgcgaaagcggcggcgcggctggcatggagcttgacccgtcatttacgccgttga

SEQ ID NO: 78 - DNA, 1242 bp, Chromobacterium substugae
atgagccccacacccgcttcccgccccagcctgtggctgaacgccaggctggccaccatggatccggcgcgcgccgcgccttacggctgcctggagcagcacgcgctgctgttgcgcgacggcaacatcgaagcgctgctgccgcaggccgaggtcgacgccgccgcgttcgatggcgacgtccacgatctgcagggccgctggatcacgccgggcttcatcgattgccacacccacctggtgtacggcggcagccgcgccgccgagtgggaaaagcggctggccggcgtgccttaccagcagatcgccgccgagggcggcggcatcgtctccaccgtgcgcgccacccgctggctggacgaggaggagctggcgctggccagcctgccgcggctgaaggcgctgatggccgagggcgtcaccacggtggagatcaagtccggctatggcctgacccaggccgacgaactgaagcagctggccgcggccaggcggctgcaggattcgctgccggtggaagtggcggccacgctgctggccgcgcacgcgctgccgcctgagtacgccggcgacgccgacggctacatcgacctggtggtcgaatccattctgccggtggcggcgcgggccggcctggccgaggcggtggacgtgttctgcgagagcgtgggcttcacaccggcgcagacccgccgcgtgttcgaggcggcgcgcgcgcatggcttgaaggtgaagggccatgtcgagcagctgtccaacctccacggcgcggagctggtggccgaattcggcggcctgtcggccgaccacatcgaatacttggacgccgccggcgtggacgcgctcaaacgcgccggcaccgtggcggtgctgctgcccggcgccttctatttcctgcgcgagacgcagaaaccgccggtggcgctgctgcgcgaggccggcgtgccgatggcggtgtccaccgacctcaatcccggcaccagcccgttcgcctcgatacgcctggcgatgaaccaggcctgcgtgctgttcggcctgagtccggaagaggcgctggccggcgtcacccgccacgcggcgcaggcgctgggacgcggcgccagccatggccggctggcggccggctatgtggcggacctgctggtgtgggatatcgatcatccggccgagctggcctacagcgtcggcgcgccgcaactgaagcagcgggtgttccgcggcgcggcgcaaaacctcgaatga

SEQ ID NO: 79 - DNA, 717 bp, Chromobacterium substugae
gtgtcagactccccgctaccgcgttatcagcgcatcaaagactatatcctgtccggcatccgcgaccgccatttcctgcccggctgcaagattccgccggagctggagctggcgcgccagttcggcgtgtcgcggatgacggtcaacaaggcggtgcgcgatctggccgaggccggcatcctgctgcgcttcgccggcgacggcacttacgtcgccgagcgcaaggccgaatcgccgctcttggacatcaacaacatcgccgccgagatcgaggcccgcggccaccgccacagcggccaggtgatcgtgctggaggccttgcccgccagcgaagaagtggcgctgcggctgggggtgaaggcgggcgcgcgggtgttccattccttgatagtgcattgcgaggacgatgtggcgatccagctggaagatcgctacatcaatccggctttcgcgccggactacctggcgcaggatttccgcgcgcgcacgcccaacgactacctgatgcaaagctgcccgctgaccgatatcgagcatagcgtggaagcggtgctgcccggcgtggccgagcagacgctgctgggcatcgccgccggcgagccgtgcctgctggtgctgcgccgcacctggtcgcacaagaagctggtgagctttgcccggctgactcaccccggcctgcgctacaagttgcgctcgcagacgcgggtgaagaagtaa

SEQ ID NO: 80 - DNA, 447 bp, Chromobacterium substugae
atgatgacattgccgcaatggctggccgaatacgacgccagccaccgccatccgttcaatatcgccatgcacaagctgtgcgtgccgctgatcgcgctgtcgctgctcggcatgctgatcgcgctgcccggcccgctgccctgggcctggctgctatggctgggcgccgtcgcctggtactggcggctgtcgcgcccggtcgcgctggtgatggcggtgctgtgcagcctggcgctgctgctgctgaccatcgcccagagccagggcctgccgctgggctatgtgtcgctgccggtgttcgcgctggcctgggccggccagttcgccggccatgcccgcgaaggccgcaagccgtcgttcgcgcaggatctgcgctttttgctgatcggcccgctgtggacgctgcgcgcgctgtggctaaggctgggcctgttgccgcgcgattga

SEQ ID NO: 81 - DNA, 864 bp, Chromobacterium substugae
atggagcgcagcatgatctatccgcaagggctgtccctggccgaactagcgccccgcgtcggcctgatcgagctggccggcgccggcttctccgcccggctgtcactgctgggcggccagttgctggactaccgccgcgacggcgaggcgccgctgttctatctgtcgccgcaagccgtttaccagcctggcaaggcgatacgcggcggcgtgccggtgtgctggccgtggttcggcccgcacccgtccgatgccggccagggcgcgcacggcgtggcgcgccagcagctgtggacgctgcgcgaagccagccgcgacggcgaagtgttccacgtgaaactggacggcccgcgccacggcgacctgacggccagcctggcctgccgcatcggacccgacggcgtcgccatcgagctggtcagccgcaaccacggcgcgcagccgcaaaccgtcagcgccgccctgcacagctatttcgcggtgtccgacatcgacaatatcgcgctgcgcggcctggagggcgcgccggcgcacgacaaggtcagcggcgagcgcgtcgcgctgccgcaacagccgttccgcttcgccggcgaagtggacctggtggtctactccggccaggccgtcacgctagacgacagcggctggcgccgccggctgcgcatcgacagccagggctcggccacctcggtgctgtggaacccggcgccggccaaggcgcggcagctggccgacctgcccgacgaggactggcggcgcttcgtctgcgtggaaaccgccaacgccggcgaagacgcccgctcgctgctccccggcgccagccacacgctgggctgccgcctgcatttctctcgcgccgactag

SEQ ID NO: 82 - DNA, 546 bp, Chromobacterium substugae
atggcacgacccgacaagatctcccgcttcctcccgctcaccttcgccaacggcaacagcgtgcgccgtttcggcaagcactgtccgcagtgccgcgccatggtgggcgccgagcacatggaaggcatcgccagcctcaagcaaggcaagatctttctgtccgccgaagcctgctgcccgcagtgccgccagcgcttcccggtagcctgcgtcatcaccgacgacaagcgggtgcaccgcgtgctgctgcccttgtggatgttccgcatctggctcaactccgccacccgccacgatccgcagccggaaaaccaggacaactgggaaatcgaggccgaagagcccaaagggctgagcctgccggccgacgccgaggtggtgcgctccgaagaggtgctgggccgcttccagggcgagccgatctgcgcctggatcgagtaccagggccagcgcttcgttttcgaccgcgccgcgcccggcaacaacctgacgctgacgcccagcgaattgttgttcgagggccggctgatctaccgccagcagtaa

SEQ ID NO: 83 - DNA, 327 bp, Chromobacterium substugae
atgctcaacttcatcagcgccgagctccacgccggcagcgcccccttgttccagtccgacccgccgcgcgcggcgcgcgcgatgctccaggccaagttgagccagcgcctggactggctggacagcgtattgcggctgcgcgactacctgctgggcgacgcgttctccgtggccgacgcctatctgtacacagtgctggactggctgccgcgctttgccatcgacctggccggctggccgaacttgcgcgctttccacgcgcgggtggacggccgcgacgcggtgcgccaggcgctgcgggcggaggcggattcgacgccggcgtga

SEQ ID NO: 84 - DNA, 540 bp, Chromobacterium substugae
atgcgcaagcccttgatgaccctgctgttgtccctgccctgcgcgctggccagcctgccggccggcagcgcgcccgccgccggcctggccggcgactacggcgccagcatcggcgcccccggcaaccgcctgcagttgcggctcagctgccgcgacgacgcccactgcgagctcgccaccgccttcgaagcggccggcgcgcccagccagccggtccgccagcgcctggaccaggtgctggcgctgcaagacaagaccgaagcggagaacgcgctgcgcttcgccgtccagcaccgcggcgaccagccgctgccgccggatctcgccgaggcgatggccaagctcaaaccggttctgtccggccagccggccattcgccaatgctgggacctgaacctgccgcagcccggcgaaatgctggcctgcacgctgtccggcgccccggccggcagcgcgccgttgtatctgttcggcaccctgcaggccgacggccaggccggcttccggcgttacgtgatctatccgctgtcgcggcaatga

SEQ ID NO: 85 - DNA, 1518 bp, Chromobacterium substugae
atgaccagaatcgccggacagctcagcccggaacagctgaaggcggcgcaggaccaggccgccgccatccccgccgccgccaagcccgccatcgccgccgggcaattcgtctacttcgccgccttcgacggcaccagcaacgacaaggacaagctgtcgcgcggcatgcaaagcaccaatgccgcccagctctaccagcaagtggcccaggcggcgaaaacccgctccgacatcggcttccattatttctccggccccggcaccgccggcaccctgcccggttcggccttcctgccgccggcggtgaccgcggaagccgcccgcaccgccaatctcgcttacgacgactttcagaaacaggcgtcgacctggctgaaaagccatcccggcggcagcgtcgcggtggccgcggccgccttcagccgcggcaacgacgccgcctcggtattcgcccagttgctgtacgagcgcggcctgaccgatcccggcagcggcaagatgctggtgccgcccggccagctgggcctggcggccgcggtgctgtacgacccggtgatgaccggcatgtccggcaatatggccttcccgcccaatagccgcaatctgctgatcctgcgcgccgaacacgaataccgcagcatgttccaggccgccgatttctccgcgcagcgcggcgcggtcaacgccagcctgcccggcaaccattgcgacgtcggcggcggctacgacaacggcctgggcgcgctggcgctgcaagccggcaccggcttcctgcaaaaggccggcctcgctatcgccgacgtgccgcagacgcgccgcttcgatccgcgccagccggcgctggtgcacgacgagggcgtcaaccagtacggccagaccatctggaccacctacggcagctacgaccaggaccgggtggcgcgccgcaccgaccaggtggcgcgccaggctgaagtcagcaccgccaacggcgtcaccaccacccgcttcaacgacttctccggcaagcgggtgcagctggagcaaagccaggggccggccggcccgcaaggcgtgatgaccatccaggactacttcaacggcagcaccagccgggtggccttcccgcccagcgcggccgccgcgcccgccgccgccctcagcccggccaagcagacgctgctgcaacaggcgcgccaggcggtggaacagctatgccagcgcgacaagctgccgttcaacgccggccagcgcgacaatatcgccgcggcgctgggccacgccgcctggcagcaagggctgggcaaggccggcttcgcgctgctgcacgacggccaaagccggatcagcctgctgcacccggacagcgctcccggcgcgcgcccggccacgctggagctggcggccgccgcgctcaagccggcggcgcaatcgctgctggcgctggcccagtcgccggacgcggcggcgcatggcgccgaagccaagccgcagattctgccgacgcgccgtcccgcggccgccggcatgacgctctga

SEQ ID NO: 86 - DNA, 1875 bp, Chromobacterium substugae
atgaccacactggccgcgctgcgccaagaattcgacgcgctcaaccatgattacctggcgatacacaaagccaaggaagatttgttctgggacacctatatggcggtgtccgacgaccacgccggcttcgccgccgccgaagccgcgttcaaggacttcatttccagcccggcgcgcctggccgccgtgcagcaggcgctggcgcagctggaggcccagccggacggcgaggagaagcgggcgctgacgcatggctaccgcggctggctggcgctgttccagagcaatatcatcgagagcgacgaggcgcgccggctgatgaccggtctgatcgacctggaggcggcgctgttcgccaagcggcgcgaattcaagatgcagcatgtcaacgacaacggcgcgctggaaaacgccaccctcagcatgctgatgaccaatatgggcaccaaccgcgacgaggcggcgcgcaagagctcgcacgacgcgctgctgggcctggagcgttgggcgctggacaacggcttcatcgacatcgtcaagcagcgcaacgcgctggcgcgcagcctcggttacgccgactacttcgcatacaaggtggaaaagaacgagcagatgacgccggacgagttgttcgccatcctcgacgacttcgaagcccgcacccgcgacgccaaccagcgcgcgctggcgcaattgcaggccaagcacggcgacgacgcgctgaaggcgcacaatctgcgcttccacatgagcggcgacgtcacccgccagatcgacccctacctgccgttcgccaaggcggtggagcgctgggtgctgagtttccgccgcctgggcatccagtaccgcggcgccaccatgcagctggacctggtggagcgcgagggcaagtaccagaacggtttctgccacggcccgattcccgccttccaggacggcgcggcctgggtggccggccagatcaacttcaccgccgacgccaagccggaccaggtgggcagcggcgcgcgcgcgatcaacaccttgttccacgagggcggccacgccgcgcatttcgccaacgtcgcgcaaaattcgccgtgcttctcgcaggagttcgcgccgacgtcgatggcttacgccgaaacccagagcatgttctgcgacagcctgctggacgacgccgactggctgaagcgctatgcccgcgacagccggggcgaagtcattccggacgcgctgatccgcgcccgcatcgaggcgacgcagccgttcgccgccttcgccgaacgctcgatcgcggtggtggcttacttcgagcgcgcgctttacgcgctgccggagagcgagctgaccgccggccgcatcctggagttggcgcgcgcgtccgaacagcgcatcctcggcatcgcggtcagcccgcggccgctgctggcgattccgcacctgctgaaccaggagtcggccgccgcctatcacggctatctgctggccaatatggcggtgtatcagacccgcgcccatttcctgcgcgagtacggctacctgaccgacaacccggccatcggcccgcagctggcccgccactactgggcgccgggcaacagcatcaaccacaacgccaccctggtcagcctgaccggcgagccgttcaacgcccgctacctggccgaatcctgcacccagagcgtcgagcaggcctgggccgatgccgagacgcggatcgccgcgtccgccgcgcgcgactacccgcggcagtacccggacgcgctggatgcccgcatccgcctggtgcacggcgccgagctgatcgccgacaacggcgacggcgacgaggcgatgttccatcgctttgaagcctgggtggcgcaacgctaccccgccagcgtgcactga

SEQ ID NO: 87 - DNA, 120 bp, Chromobacterium substugae
atggtttccaccggcggacaagacgccgggatgcatgagcaagtctcattccacagattggagacagtcaagacatttcaatattttgtcgcgtttttcgccgtcgggacgcatgagtaa

SEQ ID NO: 88 - DNA, 495 bp, Chromobacterium substugae
atgctgaccctgccgctacgctcgccgcgtctggagctgcgcgaattccatgccgaagacttgcttgcctaccagacgctgcgcggcacccccggttttggccgctgctacgcgccggccgaggtgtctgcggcgttttcggccatgctgctgcggcgcttcatcgcgcagcaggacgagccgcggcgcgcctggcagctggccatcgcgcggcgcggcgacggccagctgatcggctcggtcgggctgcgcgaggcatgcggcggcgaggccgagttcggcatcgagctggcggaaaccgtctggggacaaggctatgcggaggaggcggcccgcctgatgctgggtttcggccgccagcggctggcatgctcgcgtttccgcgcgcgctgcgcgcccggcaatgtggcgatgctgatgctggcgatgcggctgggcttcgagatgcaaccgctgcgcgacggcagccgcctggatttgctgctggcggcctga

SEQ ID NO: 89 - DNA, 189 bp, Chromobacterium substugae
atggcatcgatctttaccctgtcgcgccatttgctgcgcgatgtgctcggcgacgagcgcgttcatttttcttccgacactctcatttccccgcgctgcccggcgcaggacgccgccgacgcgctgcgccgccagcaactggactcgcgcctgcaacagctgcggctggagaagggcggcctatgctga

SEQ ID NO: 90 - DNA, 297 bp, Chromobacterium substugae
atggccttgtacctgctcagcctggtgtttttcctcaccgatatcggcgcgcggctggccttgcgcgcgcagtcctggcgcacggtcgaattgaccctgctggcgggcctcttgctggcctggctgctgtatccgcggctgagcggctgggcggtgccgctgatgccggcggagcagggcatgctgttgtacgcgacgctggtcggcctgcagctggggctgatggacgccgcgctgcgcaccagtctggagcgctggcggctgcagcggcaaccggcgcgccgccgccgcggctga

SEQ ID NO: 91 - DNA, 972 bp, Chromobacterium substugae
ttgtcggtgggcaaagcggttaagctgtgtgctggaatattccgtcttgccgagtaccacatgtccgcatcttcttccgccggcgccagccgcggcgtgctgtataccctgggcgccttcatctgctgggggctgttcccgctctactggaaaccgctgcacgcggtgcctgccttgcaaattctgtgccaccgcatcgtatggtcggcattgttcgtcgccgtggtgctgactttcctgcggcaatggggcgatctgcgcgccgctttgcgccagccgcgccaattggccattttcggcctgtcgtcgacggtgctgtcgctgaactggctgatctacatctgggcggtcaacgccggccacgtggtggaaggcagcctgggctacttcatcaatccgctggtcaacgtgctgctgggccgggtgtttctgggcgagcggctgagccggccgcagagcctggcggtggcgctggcggcgctgggcgtgatctggctgaccgtcagcgcgggctcgctgccatggatcgcgctgtcgctggcagccaccttcggcgtctacggcctgctgcgcaagaaggcgccgctggcgtcgctgccggggctcgcgctggaaaccttcctgatgtcgccgctggcgctggcggcgctgctgtggttcggctggcaggggcagggcgctttcggccaaatgggcctggggcgcgatctgctgctgatgggcgccggcgtggtgaccgcggtgccgctgctgatgttcgccgccggcgcgcgccggctcaagctggccaccgtcggcctgatccagtacgtcggccccagcatccagctggcgctgggcgtgatgctgtacgacgagccgttcggcagcgaccgcgcgctgggcttcgcgctgatctggaccgcgctgctgctgtactcggccgtcggcctgcgcgccttgtggcgggaaagacgcatggccggcgcctga

SEQ ID NO: 92 - DNA, 3480 bp, Chromobacterium substugae
atgtcaatccgccatgcagacctggaagagaaatacaccgcccccaccggccaggtactgatgactggcatccaggcgctggtgcgcctgccgatgctgcagcaagaactggaccgcgccgccggccgccacaccgccggctatgtcaccggctaccgcggatcgcccctgggcaacgtcgaccagaccatgatcaaggccaagaaacacctggacgcccacaacgtggtgttccatcccggcctcaacgaagacctggccgccaccgcggtctggggcacccagcaggtgaatattttcgaaggcgccaaatacgacggcgtctacgcgatgtggtacggcaagggcccgggcgtcgaccgctccggcgacgtgctcaagcacggcaacgtggccggcaccagcccgcacggcggggtgctcttggtgtgcggcgacgaccacgccgccaaatcgtccaccttcccgcaccagtccgaccacatcctggccgccagcatgatcccggtgctgagcccgtccggcgtgcaggaagtgctggactacggcctgcacggctgggcgatgagccgctactccggctgctgggtgtcgatcaaggcgatcaccgacaccatcgagagctcggccatcgtcgacatctcgccggaacgcttccagttcaagattccccaggatttcccgattcccgaaggcggcctcaacatccgctggccggacaccccgctggcgcaggaaaagcgcgtgctgcaccaccgcctgtacgcggcgctggcctacgcccgcgaaaacaagctcaaccacatcacgctggattcacccaaggcccggctcggcatcatcacctgcggcaagagctacctggacgtgatgcaggcgctggacgacctgggcatcagcgaggcgcaggcggccgacatcggcctgcgcatcttcaaagtgggcatggtgtggccgctggagccggaaggcgtgcgccagttcgccgaaggcctggaagagatcctggtggtggaggaaaaacgccagatcatcgaataccaattgaaggaacaactgtacaactggcgcgacgacgtgcgcccgcgggtggtgggcaagttcgccgaaaaaggcgaatgggcgctgccgcacggcgactggctgctgccggccgccggcgagctgaccccggcgatgatcgcccgcgccatcgccggccggctggcgctgatcttcgacagcccggtgatccacgaccgcctgaagttctacgacgaaaaagaggcgcagctggtgaagccgcgcgaatccatcgcccgcgtgccgcactactgctccggctgcccgcacaacaccagcaccaaggtgccggaaggcagccgcgcggtggccggcatcggctgccactacatggcgcactggatccaggccgacagcaccaagaccttcacccagatgggcggcgaaggcatcacctggctgggccaggcgccgttcacctccacccgccacatcttcaccaacctgggcgacggcacctacttccactccggcatcctggccatccgcgccgcggtggcaggcaaggtgaacatcacctacaagatcctgtacaacgacgcggtggcgatgaccggcggccagcatgtcgacggctatctggacgtgccgatgatgacccgccagctggcggccgaaggcgtggcccgcatcgtgatcaccagcgacgatccggacaagtaccagaacgcccagggcctggccgccggcatcgacgtgttccaccgccgcgagctggaccgcgtgcagcgcgagctgcgcgataccgccggcgtcaccatcctgatccacgaccagacctgcgccgcggaaaaacgccgccgccgcaagcgcaacgagtttcccgatccggccaagcgcgccttcatcaacgaacgcgtctgcgaaggctgcggcgactgcagccagaagtccggctgcctgtcggtgctgccggtggaaaccccgctgggccgcaagcgcaagatcgaccaatccagctgcaacaaggactactcctgtgtcgagggcttctgccccagcttcgtcaccgtggaaggcggcaagctgaagaaaccggccggcgccagcgccgatctcgccaaaatgccggcgctgccggaaccgaaaatcccggcgctgcatgagccgttcggcatcatggtcaccggcgtcggcggcaccggcgtggtcaccatcggccaggtgctgggcatggcggcttatctcgacaacaagggcgtgaccgtgctggacatggccggcctggcgcagaagggcggctcggtgtggtcgcacgtgcgcatcgccgacagccaggaacaactgcacgcggtgcgcatcgccgccggcgacgccaacctggtgctgggctgcgacctggtggtgaccgcggccgaagaagcgctggccaagatgcgcgaaggcttcagccacgccatcgtcaacagctacgaatcgccgaccagcgccttcctgaagaacccggacgtgcgcttcccggccaaggcgatgaaggacgccatcgtcgaatcggtaggcgccggccgcttcaatgaagtcaacgccacccgcctctccacctcgctgatgggcgacgccatcgccgccaatatgttcatgctcggctacgcctggcaaaagggcctggtgccggtatcgctggaagccatcatggaggcggtgcggctgaacggcgccgcggtgaagttcaatcaggatgccttcagctggggccgccacgccgcccacgacccggcgcgcgtcgaagcgctggtcagcccgaccgccgtggtggccttcgttccacgtgaaacgcctgacgccgtggtccaccaccgcgccaccctgctcgccgcctatcagaacgagtcgctggcggagcgctacaaggcgctggtgcagaaaacccggcaggccgaagaggcgctgaatccggccagcggcgcgctgacgctggcggtggcgcgcgcctatcaccatctgctggcctacaaggacgagtacgaagtggcgcggctgtacagcgacggcgaattccagcgcgagctggccagccagttcgacggcgactacaagctgcgcttccatatcggcgtggcctggctgacccgcggccagccgcgcaagatcgccatcggcccgtggctgatgccggcgatgaaactgctggccaagctgcgcttcctgcgcggcagcgcgctggacccgttcgcctggcaagaggaccgcaagctggagcgccggatgataggcgaattcgaacagcagctggccggcatcctggcggcgctgacgctggacacgctgccgcaggcggtcgaagcggtgaagagctgggaaggcgtgcgcggcttcggccacatcaagctgaaaaactaccagcaggcccgcagcaggcagcagcagctgctaagcggcggcgcggcggctggcaaggcgtcgcgcaacgtggcctga

SEQ ID NO: 93 - DNA, 567 bp, Chromobacterium substugae
atgcccgccctgctgcgccgtaccctgctcgcctcgctcagcctgatcctggtcgcctgcgccacccaacccagcaagatcgcccaaaccgccggcggctgcgtcggccaggtgatgccgccgccggccggcatgagcgccgcgcaaaacagcgcgctgctggccaaggccgtcgccgcgcccggcaacggcggcctgtgcgaaggcgcggtctatcagcaggacgccgccgcgcccggcgtgacggtttaccgcgtctgggacagcgccaaacccaactcgcggctgggccgctggtggtcgttcagccagccgcaaggtccggtggccaaataccaggccgacaacgccatctgtccgtcctggagccagctcaacagcgtggtgcgctgccagctgaaggccggcgtgcaagtggcggtgggcaccggccagagcgccaattgcgcgcccgaccccgacttcccgccgtcgccggtcaaccagatttatgtgcccaacaccagcccggacgacatccaggtggaaaactgccaggacgaaggagccttcccgccggcgatgtga

SEQ ID NO: 94 - DNA, 954 bp, Chromobacterium substugae
ttggaaaaaccgggcaaacgcggatatattggaatcaatatggaaacaatcgagccaacctcgccgctggcgctcacttttctgacggtggcggaagccggcagcatcaccgccgcggccgagcggctgagcacctccaaatcgcaggtcagcaagcagttgaaccggctagaggcgcagctgggcgcgcagctgctgttccgcagcacccggcgcctggtgctgaccgaggccggccatgcttacctggactattgccgccggctgcgcgatttgctgcgcgaatcggcggcggcggtgcgcgaactgggcgacgcgccgcgcggccgggtgcggctgacggtgccgcagatgttcgccggcgctttcatcgccgatttattgttgtcgttccatcgacaatatccgcagatcacggtggagctggacgtcagtctggccgagcgcgacctggaggaggacggcttcgacctcgccatccgctcggcgccggcgttgccgccgcagctggtggcgcgctgcctgttcttcactcgcgactgggtggtggcggcgccggcgctgctggccgagctgggcgcgccgcggcggccggccgacctggcgcggcagccctgcgtggtgcacccgcgctaccagcaaggcgcgcgttggctgttcgagcgggagggcagggtggaggaggtggaggtgtcgcactggctgcaggccagcgactacagcctgaacgagcggctggccgaggccggcgccggtttcgcccggctgccggatttcgccgccacggccgcgctggccagcggcaggctggagcgggtgctggccgattgggaaacgcccagccacccggtctacctggcatatccgaagaaaacgccgcagccggccaaggtgagggcgttgatcgatttcatcgccggctggttcgccgccgcgccgccgggcggcaactga

SEQ ID NO: 95 - DNA, 618 bp, Chromobacterium substugae
atgaaaatcctgctgataggcggcagcggcaatatcggccgcgccatccgcgccgagctgtccggccgccacgaaatcatcgtcgccggccgcagccacggcgacgtgcgggtggatatcgaggacgagcgcagcatcgtcgaaatgtacagccggctgccgcggctggacgcggtggcggtagccaccggcggccgcaacggccatgtcgccccgctggccgaaatgagcgccgagcgctaccgcgtcggcctggagtccaagctgcttggccaggtcaacaccgtgctgcacggcgtcggccagctggccgacggcggctcgttcacgctggtgggcggcgcctggcagccgcaggccatcgtgcccaagatcagcaacgtctacatggccaacgccgcgctggaagctttcgtcaacgccgccgcggtggagctgccgcgcgggctgcgcatcaatctggtcagtccgctattgctgaccgagtcggaagccgaatacggcccgctgttccgcggcgtgccgctggtggacgcgcgcagcgtggcgcgcgcctacagcctgagcgtggaaggcgcgcagaccggccagacctaccggctgggccggctggactga

SEQ ID NO: 96 - DNA, 726 bp, Chromobacterium substugae
atgaagataggcatgttgggcgccgccgcgcgcagctggctggccggggcgggagagcgcgcggcggccgccggccgcggtctggccgccaggctgcgcggcgcgggcaatgcggacaagccgttctcggcggaacggccggcagcggcgcgcagcggcggttggcaacgtttcgccgcgtgttttcaaggcgggcgcgccgcgcccaggcagagcggattgacgcgcggcggcctgtcgcgcgcgccgattagccccggcgacgtcaaggcggtgatgcgccggcaggccgacgagctgggcaaggcgctggccggcgacgcggtgttctgccgccaggcgctggagtcgacttacgcggtgatgtacagcgaggcgaaaaacgccttccaccgcgccaatggcggcgtgatgccggaaggctacctgcgcgcgctgggcgagatcgcgcgcgatgccggcctgcctgggcgggaattccacggcgccttcattccggccggcgacggcgccagccctttcgtcaccagcctgctcagtccggtgcaaaagcaattcagccagcgggtgcgccatcccggccagcaggcgctgttccgcgaacacgccaaacagctgacgatagagctggtggcgccgcatgcgcagcgccacggctgggagccgccggccgccttccaggccaggctggaggcggtgggacagccatggctggggcagccgtga

SEQ ID NO: 97 - DNA, 306 bp, Chromobacterium substugae
atgcaaaacatcaattggaatcactggctggacctggcggcgaatttcgccggcaacatcgtcgccgccacgctggacacgccggacggcgcgcagactctggccggcaacaacaagatcttctccgacactatccagaacttcagcgccaacccggcgcggcgggtggacctgaaggcgcagctggccagccgcgccggccacgccgaagcgatccgcctgttggaattcagcgcgctggggccggtgctggcggcggccggcttcccggcgccggagcaggcgatggtggtgcggcaggggtaa

SEQ ID NO: 98 - DNA, 738 bp, Chromobacterium substugae
atgagcgtttccccccagcggcagttgccgtatctgcagcaattgctcgacgacgcccgccgcatcgcggtgttgaccggcgccggcatgagcaccgaatccggcatccccgatttccgttccgccaacggcgtgtggtcgcgggacatgagcttggccgaggcggtgtcggtcgactacttccgccgcgcgccgacggctttctggcaggcattccgcgacatcttccgcatcaagttggtgggcgactaccagcccaacgacggccacctgttcctcgccgcgctggaagcgtcgggcaaggaagtcaccatcctcacccagaacatagacggcctgcatggccgcgccggcaacagccgggtgctggaaatgcacggcaccctgcttaccgccagctgtccggactgccgcacgccgcatcctctggactatgtgcagcggcacgaggtgccggtctgccgccgctgcagcacggtgctcaagccggacgtggtgctgtacggcgaggcggtgcccttgatcgacgtggcgttccaggcggcgctgaacgctgacctgctgctggtgatgggctcatcgctggaggtgtcgccggtcaatctgattccggtggaagccgcgcgcgccggcattccctgcgcgctgatcaactacacccccactcgtttcgacgccctgttcgacctctgcgtccacgccggcatcggcgacacctgccgccagctgcgctgctga

SEQ ID NO: 99 - DNA, 333 bp, Chromobacterium substugae
atgacgcagcccaccttgctggatgccagccgacttgccgccgcgctgcagcgcttttccgacgagcgcgactggaaccgtttccactcgccgcgcagcctggtgctggcgctgatgggcgaggtgggcgaactggccgagatcttccagtggctggacgacgacgccgccgcgcggctgcgcgacgatccggcgcgcttcacccatctgcaggaggaaatcgccgacgtgctgctgtatctgacccggttggcgatggtgaccggcgtcgatctggacgcggcggtacgcgacaaaatggccaagaacgccatcaaatacccgccgctgtga

SEQ ID NO: 100 - DNA, 612 bp, Chromobacterium substugae
atgaaactgtacttttcccccggcgcctgctcgctggcttcgcatatcgccctgttcgccagcggcctggctttcggcagcgaaaaggtggatctgcgcgcgcagccgcatctcaccgccggcggcgcggatttctccaccatcaatcccaaaggctatgtgccggcgctgcagctggacaacggcgaactgctgaccgaaggcgtggccatcctgcagtacatcgccgaccaggcgccggacaagcagctggcgccggccaacggcacgctggcgcgctaccggctgcaggaatggctgaacttcatctccaccgaagtgcacaagaatttttcgccgatcttcttcggcaagaccgaagaagtgaaagacgacgcctgggcgcggctgcagccgcggctggcgctgctgcagcagcagctggaaaaaacgccgtatctgcaaggcggccagttcagcgtggccgacgcttacttattcacctgcttgtcttgggcgcagtacgtgcagcgctcgctggccgatttcccggcgctgctcgactacctgaagcgggtggcggccttgccggcgacccagcaggccttgaaggcggaagggctgggccagtaa

SEQ ID NO: 101 - DNA, 570 bp, Chromobacterium substugae
atggaagtggaaatcagcgtggaggcggagaagaagcgcctgaacagcctggtggcgcttaccgtggtgctgttgtcggtggtgatggggctgggcaagctgaaggacgacaatatcgtccaggcgcgccagttgctgaagaccgacgcgctggacagctggtcggaataccagtccaaaaagatcaagctgcatctgacggaagccagcctgcgccaggccaagatgctggagctggccaatcccgccagcgcggcggcgctcaagccgcagcagcgcgagctgcaggacgagatccagcgctacaaggcggaaggcgaggcgctgcagcgcaaggccgaagggctggaaaagggtttcgaggcgctgaaccagcgccacgacctgttcgacatcagcgatgccgcgctgtcgatcgcggtggccagcgcggcggtggcggccttgtcggccaacctgttgccgctgttcagcgcctgggcgttcggcgcgctgggcgtgctgttctggctggccggtttcgccggctggaacctgcgcatcgaatggctggtttcgctgctgggatga

SEQ ID NO: 102 - DNA, 273 bp, Chromobacterium substugae
atgaacgcagcgcagtccaacaacccgactcatggcgtcacgctggagacaatgctgatcgagctgcaggcccattacggctgggacgggctgggccaaagggtcaatatccgctgcttccagctggaccccagcatcaagtccagcctcaccttcctgcggcgcacgccctgggcgcgcgccgaggtggaggccctgtacgtccagttcaaaacccgctccgccgcgccggcggatagccgcccgcgcttgttcggcaagaaggccggttag

SEQ ID NO: 103 - DNA, 2271 bp, Chromobacterium substugae
atggctgaggcggacaaggcgggatggtggtcgctggggcagcactggatggattactggacggacgccgcccagcgcggcgtgttgttcttcgacgtgctgcgcgagcggggcgatacctatctggagcacgcggcttccggccatccgccggtgctggtgttcgatttcgacatcatcgtcgacggccgcgagctggcgcagccggtcaactacgcgctggcggcgatccgcccgccggacggctgcccggccgccgacgccggcaagcggcctttcgtggtgatagacccgcgcgccggccacggcccgggcataggcggcttcaagatggacagcgagatcggcatcgcgctgcggcagggccatccgtgctatttcgtgatgtttttcccggtgccggtgccgaaccagaccatagaatgcgtgtggcgggcggaaaaggtgttcctgcagaaagtgaacgagctgcatccgtgcggccgcgccggcaagcctttcgtcatcggcaactgccagggcggctgggcgctggcgatgctggcggcgtcggcgccggagctggtggggccgatactgctggccggctcgccgctgtcctactgggccggcgtggccggcaagaacccgatgcgttaccaaggcggactgatgggcggcacctggctggcctcgctggccggcgacctgggccatggccagttcgacggcgcgcaattggtcggcaatttcgagcagctggacccggccaacacctactggaaaaaagcctaccatttgtactcgcatgtcgacggcgagcgcgagcgttttctggaattcgaacgctggtggggcggccattacctgctgaacaagcaggagatggagtggatcagccagaacctgttcgtcggcaaccgcctcagccgcggcgaaatctatctggaagacggcgagcagcgcatcgacctcaggcagatccgctcgcccatcatcgtgttcgcctcctggggcgacaacatcacgccgccgcagcaggcattgttctggatcgccgacctttaccgcaacgtcgaggacatccgcagcaacgagcagaccatcgtctactgcctgcacgagcaggtgggccacctgggcatcttcgtttccgccggcgtcgccaacaaggagcacagcgagctggccagcgcgctggacctgatagacgtgctgccgcccggcctttacgaggcggtgatcaccgatacctacccggaaacccctggcctgcaatacttgcaaggccgctacatcatccgtttcgaaccgcgcgaggtggacgacatcctggcgctgggcgatggccgcgacggcgagcgcgccttccaggtggtgaagcgggtggcggagatcaaccagcagctgtacgactgcttcgtctcgccgtggctgcaggccttcggctcgccacaatcggcgcactggctgcgcgagtcgcacgcgtcgcgggcggagcggcgctggttttccagccgcaatccgctgttgggcagcctgccgggctgggcggacaaggtgcgcgcggcgcggcggccgctgggcgaggacaacccgttctggcaatggcaggaaaccctgtccagctggaccgccagcgcgctggacggctggcgcgaccagcgcgacgccttgaaggaaatgactttccgcgcggtgtacgacgcgccgctgaccgccgcgttggtgggcctgcatcccaagcgcgaatacagcgtgcgccggcagcagggcggctgggagcgcggcgagatgctgcggctgaagcggcgggagctggaggagtactactcgcagggcggcgcggtggacggctttctgcggctgctgatctatgtcgccatcggcaccggggtggtggatgtgcggccgttcaacgcgatacgccgcgtgatgcaggacactggcctcggcgaggagctgacgctggaggagttcaagcaggtggtgcggcgccagacctggctggtgcgcaacgacgagaagcgcgcgctggagacgataggcgatctgctgccggacgagcagcagcggcagatggcgctggagctggtgatgctgctgctggccgccgccgggccgatcagcgtggaaaagcagcagcggctgggccgggtggcgctggcgatgggggtggacggcggcggcacccggacggcagaccccggcgagctgtacccggcgccggacgccgcgccggccaaggctcccgccaagcgcgcccgccgcaaggccggcggcgccaactag

SEQ ID NO: 104 - DNA, 147 bp, Chromobacterium substugae
gtgctgccccagcgaccaccatcccgccttgtccgcctcagccatctggctctcccccgcagtcgtcgcgctccagacttcactctagcccaggcggaacggcttcactgcggccgggaaagatatcaacagggtattgcgggttaa

SEQ ID NO: 105 - DNA, 456 bp, Chromobacterium substugae
atgaccaagctgctcaagcccctgctgctcgccggattgctgatcgccggcagcggcgcggcctacgcccaggacgccggcgccgacggcgcgcccaaaggctggcacatggatccggccaagcgcgaagccatgatggccaagcacctgcagatgctgcacgacaagctgaagatccagccgcagcaggaagccgcctggcagaccttcaccgcgtcgatgaaacacgagaagatggccaagccgcctgtcgatgacaacgccaccgcgccggaaaaaatggagcgcatgatgcagcatcgccaggcggaaatgcagaagcatctggacgcgctgaaagccttctacgcccaattgacgcccgaacagcaaaaaatcatggaccacttgcaccgtccgcacggcaagggtccccaccacggcaagcgcgcggcttccgcgcccgccaacggctga

SEQ ID NO: 106 - DNA, 423 bp, Chromobacterium substugae
atgaaaggctacatccgcttgagcggcgtcatgctggctgccacgctggcagtggccgccgtggccccggccgaggcttattaccaccatggcggcccgccgcgcatcagcatcgacgtctggcgcggcggctactggaaccatggctactaccacggccgcatgggctggtggtgggtggtcggcggcgcctggtatttctacgccgcgccggtctatccctatcccagcctgtacgcgccgccggtggtggtggcacccatcgcgccacccgcgcccatggccccgcctgcgccgcccatcgccgccgcgccgccggaaccggcgcaggtctggtactactgcaaggcggtcaaacagtactatccgtatgtcagcgaatgccccggcggctggaaaaccgtcccggccaagccgcaatag

SEQ ID NO: 107 - DNA, 456 bp, Chromobacterium substugae
atgaagaaacgctattacgcgctgctgctgccgccgctgctggcagcctgcaccacactgcccaccggccccaccgtcgcggtgatgccggcgccgggcaagccgtttgaagttttcgcccaggaagagcagcaatgccgcgcctacgccgcctccagcagcggcgtcagcaacaacgaggccgccaacaccagcctggccgccaatatggcgctgggcaccgtggtgggcgcggcggccggcgcgctgataggcggcaaccaccagggcgccggggtcggcgccggcgtcggcctgctggccggcaccgcggcgggcggctccaacggcgcctatgccggttacgacgcgcaaacccgctacaacatctcctaccagcagtgcatgtacgcgaagggcaaccaattgcccggccagcgcatggcgccgtcctacctgccaccgccgcgcatgtga

SEQ ID NO: 108 - DNA, 189 bp, Chromobacterium substugae
atgaccagactgtacgcgccgttgatggcctgcctgttcctcgccactggcatcgccagcgcccaggacgccaattcccgccccttcgacacctcccgggtgcaacccagcgtgccgctgtcgctgcacgacatgaccctggtggacgcgccggccgcgcaaaccccgccgccgacaaccgcccagtaa

SEQ ID NO: 109 - DNA, 387 bp, Chromobacterium substugae
gtggccgacgtcaaccgcctggaaacctggatcaagtacaagaatggcctgtgcggcgactgcgtggcgtcctgttgcacgatgccggttgaggtgaggctgcctgacctgatccgcatcggcgtggtggacgagttcgagctggaagagccgatcaagaacatcgccaagcggctggaaaagcagcgggtgatccagcacttcaatttcaagaacagcctgttcacgctggcgcagcgcgccaatggcgattgcctgtacctggacgccaaaacccggctatgcaccatctatgaaaagcggccgaatacctgccgcaaccatcccaaggtcggccccaagcccggcttctgcgcctatacccgcaatcccgccgcgccgcgctga

SEQ ID NO: 110 - DNA, 303 bp, Chromobacterium substugae
atgtttccattgatcgtcacgcttgaagtcaccctgcccgaggacgtgccgctggtggccgacgcgctggcgcgcatgcgcccgctgtgcctggccgagccgggctgcttgctgtggcaggcctaccattcccaggcccatccgctgcgcttcgtgttggtggagcattgggagagccaggcgcactgggaggcgcacggcaagctgtccgccatccagggcatctatctgcccgaggtgctgccgcgcgtcagccgggcggcgcatccgtcggtgttgctgggcgatggcgacggcgattga

SEQ ID NO: 111 - DNA, 1020 bp, Chromobacterium substugae
atgtacaacaatgacgacctggacgccgcggcggcggccgggattttcagccagcaggcgatagacgacttccgcgcgctggcggcgcagcggcgccatacccagatggcggacgaggagcatttccgcctgctgtcgggcttcaacgacattttcgtggtgatcgccagcgtgttgctgctggtgtcggtgagttgggtggccggctcgctgtccaagctgctggcgccatggctggcggcggcggtgtcctggccgctggccgagtatttcgtccggcgccggcgcatggccttgccgggcatcctgttgctgggcagcttcgtgctgtgcagcggcggcggcatgatggcgctgtgcctggattggctgccgggcggcgaggaggcggtcaagccgatcactatgctggcttcaggcctgaccgcggcgctggcggcctggctgcactggcggcgcttcaaggtgccgatcaccgtggcgatgggcgtgggcgcgctggtggcgatgacggcgctggcggtcgcggcgctgctgccggaatcgctgggcttgtccaatgcgctgctggccgcgggcggcgcgctggctttcctgctgggcgtccactgggaccggcaggacccggcgcggcagaagcgccagtccgacgtggcgttctggctgcacctgctggccgcgccgctgctggtgcatccgctgttttccatgttgggcatcatgaatggcaacaccggcatggcgatgctgctggcggtgatcgcgttgtacgcggtgttcggcctggtgtcgctggtgatagaccgccgcgcgctgatggtgtcggcgctggcctatgtgctgtacgcgttcaaccagctgttgcagcatgccggcctggagagcgccggcttcggcgtggccgggctgttgatcgcgtcgggcttgttgctgctgtcggcattctggcaaccgtgccgcagcgccgcgttgcggcgcctgccgcccaagctgcgggcgtggctgccgccgttgaagtaa

SEQ ID NO: 112 - DNA, 1182 bp, Chromobacterium substugae
atgcccgatctcgccgcgctttttcccgcttccgcctggcccgactatcaaggcggcagcctgctcaacctgatgcagacgctgagcagcgagctaggcggcccggacctgggccacgcgccgctgcgcgttgacgcgctggacggcatcggccgccaccgccatgtctgcctgctgctgatagacgggctgggagacgcccagctgcggcggttggggccggacagccagctgcgggcgcggcagcgggcgcggatcgacagcgtgtttccgccgaccaccgccgccgccgtcaccaccgtgctgaccggctgcgcgccggctgaacacgggctgataggctggcaccagctgcacggcgaggagatcatcgcgcccttgcccctgtatgtgcgccatccggccggcagcgccagcgcgccgcaggcgctggccgacgcgctgtatcgcgcgccgccgctattcgaccgcctggcgcggccggcggcctgcctgctgccggatttcatcgccgattcgccatgcagccgcttccatgccggcggcagcgcgcgcttgccgtatcgcggcccggcggacgggtttgcccaactggccgcgcggctgcgctcgccccggcccgccttccattacctttacctgccgcagctggacacggcgatgcacgagcatggcccggccgcgccgcaggcggagatcctgctggcggagctggatgccggcttcgagcggctgctgatcgaagccgcccagcgcgacgccgcggtggtggcgatcgccgaccacggttttgtcgacgcgccggccgggcagtggctggacctggacgccgacgccgaactctacggcatgctggcgcggcccttgtccggcgagacgcggctggcctattgccacctgcggcccggcagcgccgcgcgcttcatcgaactggcgcggcgcaggctgggtcatgcctgttgggcggttcccagccaggttttgctcgacgcgcaggctttcggccccggcccgcggcatcccgacctggcgcgccgctgcggcgaggcggtgttgatcgccaagccgggctggaatattcgcgacacgctgccgtgggagaagccgctgcggctggccggcgtgcatgccggcgtccacccggacgagatggcgattcccttgatcgcgttccggccgtga

SEQ ID NO: 113 - DNA, 312 bp, Chromobacterium substugae
atgaaactcgcaagcctcactctcgccctggccctgtccgggctggccgccgcggcgcaggccgatacctccaccatagtcggcggcgccttgggcggcgcggccggcgcggcggtcggagaagcggtcggcggccgcaacggcgccatcatcggcggcgcggtgggcggcggcgccggcgcggccatcggccatgattacggccgcaaggccgacgcgcccaagcgcgactaccgcaagcaccgccaccatcacgcgcgcggcaagggccgttcctgcccgccgggccaggccaagaaaggccgctgctaa

SEQ ID NO: 114 - DNA, 399 bp, Chromobacterium substugae
atgatctacccgatgttcgcgttagtgctgttgacctttttcgtcggcgtccgtctgggggcgacccggctcgctcatgcccgctcgggcaaggtgaagggcagctattaccggctgatgcagggcgacgcgccgccagacggcgaattgaagctggcgcgcaatttctccaacctgttcgaaaccccggtgctgttctacgtgttcggcgccatcgtcatcgccaagaacctggcctcgccgctgcccttggcgctggcctggggctatgtcgcgctgcgcgcggtccatacggcgatccatctcggccacaaccacccgctgcaccgcttcctggcttttctggcgtccaacatcctgctgctggcgatgtgggcctggctggcgctggttttgtaa

SEQ ID NO: 115 - DNA, 219 bp, Chromobacterium substugae
atgcaaagctatcgattcacggtctacggccagatggtggtggcggagcggcgcgacgccggctggcaggctttcctgcccggcaacgacggcaagcgccggcccgccgatttcgtcattccggactgggtgacggaagacggattggcgcaatacctggaagacctgttccacgagaacgcgacgccgcgcaacggcggcgtggcgccgctggcgtga

SEQ ID NO: 116 - DNA, 1977 bp, Chromobacterium substugae
atgagcctgttgccgcaccaagtcgaactgctgtcacccgccaaaaccgccgaaatcggccgcgaagccatcctgcacggcgccgacgcggtgtatatcggcgggccgtcgttcggcgcgcgccacaacgcctgcaacagcatcgaggacatcgccggcctggtgcggttcgcccaccgctaccacgcgcgcatcttcaccacgctcaacaccattctgcacgacgccgagctggatgccgcgcgcgcgctgatctggcagctgtacgacgctggcgtggacgcgctgatcgttcaggacatgggcatcctgcagatggacctgccgcctatccaactgcacgcgtccacccagtgcgacatccgcgacgccgacaaggcgcgcttcctgtccgacgccggcttctcgcaggtggtgctggcgcgcgagctgaccattccgcagatcaagaagatcgccgaccgggtggccgattccgccaccatcgaatacttcatccacggcgcgctgtgcgtggccttctccggccagtgcttcatcagccacgccgacaccggccgcagcgccaaccgcggcgactgctcgcaggcctgtaggctgccgtacacgctgaccgacgaaaaaggcggcgtggtggccttcgacaagcacctgctgtccatgaaggacaacaaccagagcgccaatctggaagcgctgctggacgccggcgtgcgctccttgaagatcgagggccgctacaaggacgtgtcctacgtcaagaacatcaccagccactaccggctgttgctggacgaaatcttcgagcgccggccggagctggcgccggcggccagcggcagcagcgaaatctacttcacgccggatccggacaagaccttccaccgcggcgccaccgactatttcgccaccggccgcaagcaggacatcggcgccttcgattcgcccaaattcgtcggcgtcggcttgggcacggtgcataaggtcggcgacggctggctggagatcgccaccaccgagcagatgtccaacggcgacggaatcaacttcatgaagaagcgcgaagtggtgggcatgcagctgaataccgtcaagcaggtgggcaaggccgaaggcggactgctggtatggcgctgcgagccgaacgacccggcggcgctgcaagggctgaagcccggcgtcgacatcagccgcaaccgcgaccacgcctgggagctggcgctgctgaagaaatcggccgagcgccgcgtcggcgtctgggccgcgctaagggaaaccgccggcggcgggctggagctgagctataccgacgccgacggctgcagcgccagcgctagcgtggatatgccgcttgagccggccaaggacgccgcccgcgccgagcaaagcctgcgcgacgccgccgccaagctcggcaacaccatgttccaggcgcacgacgtggcgctgaacctgtcgcagccgtggttcgtgccggcctcggtcatcaacggcctgcgccgcgaggcggtggaaaaactcgaagccgcccgcgtcgccgcctggccgcgccagccgcgcaaggcggcggtggagccgccggtccgctttccgcagaccgagctgagctatctcgccaacgtctacaacgcgctggcctgggacttctacaagaagcacggcgtggaagtgatagagccggcctacgaagcgcaccaggaagagggcgaagtcagcctgatgatcaccaagcactgcctgcgcttctcctacaacctgtgtccgaagcaggccaagggcgtgaagggggtgatgggccaggtgcgcgccgacccgatggtgctgaagtccggcagcgaaacctacacgctgaagttcgaatgccgcccctgcgaaatgcacgtgatgggcaagatgaagaagcacattctgaaaacgccgccgccgagcgagattccggcttccgcgccgattaccttcttcaagcagcggccgtaa

SEQ ID NO: 117 - DNA, 1698 bp, Chromobacterium substugae
atgttcagccaactcaccatcagccagcgcctggccatcatggtcgtcgccctgctcatcattcccattctggtcggcctgtacggcctgcgcactcaggaaggcatactcggcgacttcgccaccacctacaacgaccgcgtggtgtgcctgaagcaactgaaagtggtcggcgacggctacgcggtgggcatcgtcgacaacgcgcagaagctgcgcaaccgcagccagacgccggccagcttcttcaacaatctgcaaaaggcgcaggccgacgtgaagcggcaatggggcgactaccgcgccacctatctgacgccggaggaaaaacagctggccgaccaggccgaaacggcgatggccgccgccaaccagagcgtggacaaacttagccggatcgtgcgcggcggcgacgcggcagcgctgcaagcctatgtggaccaggaaatgtattcggcgctcgacccggtggcgcagcgcatcgccgcgctggtcgacctgcagctgcgggtggcggcggaagagttcgcccaatcccagcagcgcgccgcgttcagccatgccgccaatatcgggctgatcgtcgccggcgtggcgataggcttcctgctggcctgggtgatcgtgcgcggcctgttggccgagctgggcggcgagccgcgcgacgtggtggcgctggccgaacgcatcgccgagggcgacctggggcagaagctgcaggtccggcccggcgaccagcacagcatcgtctcctcgatgtcgcggatgcagagcgcgctgatccagctggtgcgcaatatgcagtccatcacccttcggctgtccaacagcgccaccgaactggcggcggcggcggagcaggtggccaccagcgccgaggagcagacccgcgccgcgtcgtcgatgtccgcctcggtggagcagctgtcggtcagcatctgctcggtcaacgaccataccagcgacgtcgccaaggactcggtgtccagcggccagctggcgcatagcggcgaggccatcatcggcgagacgctgagcaccatcaaccacgtggcggagcaggcgcgcgcctcgcagcagcaggccgacctgatgggcagccgctcgcaggagatcgccaacgtgatccaggtgatacgcgacgtggccgagcagaccaatctattggcgctgaacgcggcgatcgaggcggcgcgcgccggcgagcagggccgcggtttcgcggtggtggccgacgaagtgcgcaaactgtcggaacgcaccgcgcaatccaccaccgagatcagcggcagcatccgcgacatgctggactgcagccagcacgtggtggaaaacatccacaacaccgtggaccagatggaagtgggcctgagccaggccacccgcgcccgcgaggcgatcgccggcatcagcggcaatgtggagcgggtgaaacagtcgctgtccaccatctccatttccttgaacgaacagcagcaggccggcaccggcatcgccgccaatgtcgagcaggtggcgcagatgtcggaagaaaccagcgccgccgcggtgcagaccgccgaagccgccagccaggtcgagcagatggccggcgcgctgcaagttgccatcagccatttcaagctgccggccggcggccagccgtattcggccgatgcgccgctgcccgccatttccgccacggcgctgcgcgcctga

SEQ ID NO: 118 - DNA, 1392 bp, Chromobacterium substugae
atgcacaagcaacgcgtcttactcttggccgtcctggccgccctttccggcctggccctggcggaagaagaaccctccgtcccgccttccagcgatggcccggcgctgaaaggcaccaagcaggccattccggcaagcgatgtctacgacctgatcaccaagtcggaaaccaccttcagcgcgctgtactacggccgcgaccgccaggaaaaacagccgaacaacagcaacggcggcgatatccgcgtcaacgcgctgaacctggggctgaacttcaagtccggctatgcctggaacgtgctgggcttcgacgccgccgcccatagttccatccgcctgaccaagggcataggtttctccgaagtgctgtaccacgactacaaggacatgagcaatccggccgaaggcggcggcggcaaggacaaaagcgacgcggtgctgagccaggcggcggtgaaattccgccagagcccggacggccagggcttttccgcccgcgccggctacaccccgatcagcatcggcaccatgggcacctccggcggcctgcagtcgcactcctaccgcggcttcgaaggcaagtacaagcttggcgacttcgaaatcggctacggctgggccgaccagttccgcaacgagtgggacaaccgcttccgcgacatgaccaattcctgggaacagggccgcagcaacggcagcgccgccaagcaggtggactacgtcaacagcctgggcctgcgttacgcgccggaaaacgccttcatcgacttcggcgtcggcgaaggcaaggactaccgccgcaccgcgcagatcgccggctcctacacctggaagctggccggcggcgacagcctgaccggcgtcgcctactacttccaaggcaaggatgaagcccagctcggcatgaagaactcccaaaccgcctggcacaccagcgccagcctggcttacaccaccggcggcctcaccgtgcaaggcggcctgggcaagagccataacccggacggcggcgaagtgaacttccgcatgacgccgtacggcaacagcgacaaccgcaacttcatccagacctggggccaggacgacgacttcgtctgggacggcacccaagtggtcaagctgggagtcaactacgacttcgccaagcaaggcctgccgggcttctcgctgggagccagcgccaactacgccaccggcctgaaaaacccgaacggcgcgccggacagcaaggcgcatgaaatcgacctcagcgccggctatacggtgcagagcggcccgctcaagggcgccagcatcggcgtttaccccgcttggtaccgctccggcgacttctacggcaagcgcgaccgcaacgacgtgaaagtgatcgcttcctacagcaaaaccttctga

SEQ ID NO: 119 - DNA, 1257 bp, Chromobacterium substugae
atgaagctgaagaccctgagcctttccctgctgatcgccgccggcctgtccgcgccgctggcagcccacgccgccgacaagccggtgctggaagtgtggacgatgagcctgtcgcccaagttcgacggctatttcaaggagctggtggccaagtacaacgcccagcatccgaatgtggaagtgaagtggaccgactacccgtgggacgtgatccaggccaagttcaccgccgcagtcggcgccggcaagccgccggccctggtcaacctgaacgtgccctggacctacgactaccagcagcaaaacctgatccagccgctggacggcctgatagacaagggccagtacgtgacgggcgcgttgaaggacgtcaccttcaacggcaaggtctacgccttcccgcactacaacggcgccaacgtcatcgcctacaacgccgcgctgttcaagaaggccggcctcgaccccaacaagccgcccaaatcgttcgacgaggagctggcctacgccaaacagatcaaggccaaaaccggcgtggccggcttcgcgccgacgctgggcccgaccaagatcgaggcgctgctgatgcaaaacggcctggatgtggtcaaggacggcaagccggcgttcaacagcccggcccacgtcgccttcgtcaagaagctggccgacgcctacaaggccggcgccttgctgaaggacaatctgttcgcccaggacaatttccaggtggcgatggccgcgtacaacggcggccggctggcgatgctggaatcgacgccgaccacgctgacccgggtgcgcgacgaagcgcccaagctgtaccgcgacacccgcgtcgccccggcgccgctgggccccaccggcatcgccgccggcggctggatgttcaatttcgcggtggcgcgcaatgtggacaaggcactgctgccggaagtcggcaaattcggcaactacctgaccaacgccgacaaccagctggccttcgccaagctggccggcaccttgcccaccgcccgcaaggcggcgctggatccgcacttccagaaagtgtccggcaacgccggcgccgccgagctggcggtcggcatcgccgccgccaacctggacaagacccgcaccctgttcctgtcggtgaagaacgccgacacgctgtcggccaggctgtcggccgcggtggaaaaagcggtgaccggccgccaggacgccaagcaggcgctggacgaggccgccgcctactggagcggcaagctgtaa

SEQ ID NO: 120 - DNA, 870 bp, Chromobacterium substugae
atgcgcaaaccacataaaaccaccctgcagacctatctgttcctggcgccggcgctcgtgctgctggcggcgttctcgttctggccggtgggcttcggctcctttctcgccttcacccgctataacctgatcgacgcgccgcagtgggtgggctgggacaatttccgcgagctgttcggcgatgagctgttcctgtcggcgctgaagaattcggcgctgtacctgctggtggtgccggcgatccagctgttggccatcctgctggcggtgctggtcaacaacagcctgcccggcatcaagctgttccgcgccgcctactacctgccggtggtcacctcggtgtcggtgatcggcatcatctggaatttcatgtacgccgaagacggcgtgctcaacgccgcgctgcgctggctgcatctgatcaacgatccggtgggctggctcaacgatgaccatatcgcgctgttcgcggtgatgttcatcaccgtctggcgcggcataggctggtatatggtgctgtacctggccggcctgcaggcgatgccggccgacctgcacgaggccgcgcaactggacggcgccagccgttggcagcgcttctggcgcatcaccgtgccgctgctcgcgcccaccatcttgctgtgctcgatcatgtcgatgctggcggcggtgaaggcgtttgaggaagtgcagatcctgaccaagggcgggccgatgcagtccacctacaccgcgctgttttacgcttacgagttcggcatcaagtcgctgaacttcggccgcgcgctggccgccagcctggtgatgtcggcgttctgcatcgtgctggcctggctgaatttccgttacctgcaaccgcgcgaccgctga

SEQ ID NO: 121 - DNA, 873 bp, Chromobacterium substugae
atgcattcttccaccaccctgcccgccgctgccgccgccatccgcgcgcggccgcggctggcgcgcctgggcaaccgcgccgtccattacctggcgctggccgccatcgggctgatcaccgtctacccgttctggtggacgctggtgaccgccttgtccggcgacggcgaagtgttcgcctttccgccgcccttgctgcccaccgcgccgacgctggccaacttccgcgaggcggtgtccagcatcgacatcctggccttctaccgcaactcgctggccatcaccgcgctgacggtggcaggcacgctcttggtcagcgcgctggccgcctacccgctggcgcgcatgcagttccccggccgccggctggtgttcggcgccatcctcgccaccctgatcctgcctagcgaggtcaatttcctggtcaacttcatcaccgtgtccaagctgcacctcaccgacagctacggcggcgtggtgctgccgacgctggccggcgcggtgggcatcttcctgatgaagcaggcgttcgaggcggtgccgcaggatctgatcgacgccgcccgcgtcgacggcgccggcgaatggcagatcttctggaaaatcatgctgccgctgtcgcggccggcgctggcggcgctgaccatcctcaccacggtgtcggcgtggaaccagtacatctggccgtccatcgtgatgtccagcccggaaaagtttccgctgtcggtcggcgtgctgtacctggccggcgccttcagcttcaagacgcgggtggtggcggccggcgcggtgctgaccgtgctgcccatcctgatcgtgttcctgttcacccagcgctacttcctgcgcggattcgatggagcggtgaaatga

SEQ ID NO: 122 - DNA, 1518 bp, Chromobacterium substugae
atgaccctgagcgacgaacaactggaccaactggccggccgctgtctgatggtggacgtggccgggccagccctgggcgccgaagaagcggcgcggctgaggaaaatgcgggtgcgcgccatctgcctgttccgccgcaacgtgccggacgcggcgtcgacgcgccgcctggtggcgggcctgaaagccgcgctgggcgacgacatcctggtgggcctggaccaggaaggcggcggcgtgatgcgcacgctgttcctgccgcaggcgccggcggcgatggcgctggccgccgtcggcgacgcggcgctggcgcgccaggtcggcgccgcggtggcgcgcgggctgaagagcctgggcgtcaactggaacttcgccccggtgctggatctgaacaacaacccggccaatccggtgataggcgagcgctcgttcggcgccgagccagcgcgcgccgccgccctggcccgcgcctggatggaaggccacctggccgaaggcgtggcctgctgcgtcaagcacttccccggtcacggcgacacccacaccgactcccatctggacctgccggtggtggacaagcctcaagccgagctgcgcgactacgagctggcgccgttcaaggcgctatccgcgcacgcgccggcgctgatgagcgctcacatccgcttcccggcgctggacccggaatggccggccacgctgtcgccggccatcctcaccggcctgctgcggcatgagctgggcttccagggcgtcgccatcaccgacgcgctgaacatgaaggcgatacgcgaacgctggggccaggccgccggctcggtgcagacgctgaaagccggggcggatctcgcgctggtgctgcagtttcccgatgaaatggaagccagcttcaacgcgctgcgcgccgcgctgcgcggcggcgagctggcgccggaacggatgcaagaagccgcggcgcgggtggacgcgctgacccggcgctaccccagcctcggcgatgacgactacgcggccgaacagcgcgccgccgacgaggcgctgttcgccgacgcctgggtccgcgcgctgaccgcccatggcgaggttcccctcttgcccgccggccagcggctgcggctagtggtgcaggaccaggcgccgtccgacggcgtgtccgaagccggtctgtccgccgaccggctgatcgccgcgctgtcgcgccgccacgcgctggaagtggtgcgcttcaaaaaccgggcgatgctcgactgggccacgctgccgcgcgacggcgccttcaccgtgctggcctccaccagccgcgaacgctaccgccggcgcgaacaacacagctggaagccggacttgcatctggcattatggaacccttacgccgccgccgacatcgccgcgccggccttgatcagctacggcttcgccgacgccgcgctggacgccatcagccgctgcctggccggcgagatcgacgccgccggccggctgccggtaccgctgggcggcccccaccaggagcaatga

SEQ ID NO: 123 - DNA, 1113 bp, Chromobacterium substugae
atgtcccgactgtcattgagcaatatccgcaaggtttacgacgacggcaacgccgtgatccacgatgtcagcctggacatccgcgacggcgaattcatggttttcgtcggcccgtccggctgcggcaaatcgacgatgatgcgcatgatcgccgggctggaggacatcagcgccggcgagctgcgcatagacggccagttggccaacgacatcgagccggccaagcgcggtgtggcgatggtgttccaaagctacgcgctgtacccgcacatgacggtgcgcggcaatatggctttcagcctgaagctggccggcaaaagcaaggccgagatcgacgccgcggtgaaccgcgccgcgcagacgctgcagatcgaacacctgctggagcgcaagcccaaggcgctgtccggcggccagcgccaacgcgtggccatcggccgcgccatcgtcaggaagcccggcgtgttcctgttcgacgagcccttgtccaatctggacgccgcgctccgggtgcagatgcgcatcgaactggcgcggctgcacaaggagctgggcagcaccatgatctacgtcacccacgaccaggtggaggcgatgacactgggccaccggatcgcggtgttcaacgccggccgcatcgaacaggtgggcacgccgctggagctgtacaaccgcccggccaaccgcttcgtcgccggcttcctcggctcgcccaagatgaacttcatcgcggcgcggccgctggacccgcgcgccgacggcgtggagctggagctgcccggcggctgccggctgacgctgcccttcgccgccgccggcggcgcggcgacgctgggcgtgcgcgccgagcacctgttcttcgccgaatccggcctgccggcgacggtgcagctggtggagcatctgggcgatcagcagatcgtctacctgcgccacgaaggcgaaggcgagcccatcgcgctgaggctgcccggccacgaggccgagccgcgcccgggcgagcgccgcttcctggcgccggacccgcgccattgccacctgttcggcggcgacggcgcggcgctgccgcggcgcgagccggcaagccagccggcggccgaactgatcgcctga

SEQ ID NO: 124 - DNA, 1623 bp, Chromobacterium substugae
atgaaccgccaaacctcgctggccgggcaactggccgccatcgtcggcctggtcatcgccatcctgctgatttcctcgattttctccttaagccagctatggggcagcatccgcgtgttccgcgaccaagtggtggccgaccagcgcagcgtgcagcaagtgctgaccatgcaggtggacttcaagaaacaggtgcaggagtggaaagacacgctgctgcgcggccaggacccggccaagctggccaaatactggggcaatttccagcagcgcgagcagcaggtgcgcgacgagggcaacaggctggcggcctcggtgtccgacccgcaggcgcagcagttgctgctgcaattcgtcgccgcccaccagaaaatgggcgacgactaccgcaaggggcttgacgcctacaagcaggccggcgccgacttcaaggtgggcgacaagcaggtggccggcatggataggccgccgaccgagttgctgacccaggccagcgacctgctggccaaacgcgcgcaggccaacaccgccgccgcggaagacagcgccaacgccgccttgtggcgggtgggcatcgcgatggccgtcggcaccgtgctgggcctggccttcttcctttactacgtcagccgcaccgtgatccagcgcgcccgccagctggcggacgacctggcccggctggccggcggcgatttcacccgcccgttccacgccgggcggatggacgagatcggccgcatcgccgccagcagcgaaacggtgcgcacccatctgggttcgctgatcggcgagctgatccacgccgccaagcaggtcggcgacaccagccaggagctgggacgctcggcgcaggcgctggcgcgcggcgccgaaacgcaaaacgacgcgatcgccgacaacgccgcctcgctggagcaaatggccaccagcgtggacaccatcgccgaccaggcctcgcgcatcagcgacgattcgcgcaacagcgcgcagaaaaccaacgacggcctcgacgaggtggcgcggctgcgccgccaggcggaaaccatagacacggtgatggggcaagtagaccaggcctcgcaggccttccgcgacagcacccagtcgatcagccatttgaccgggcagatccgcgacatcgccgagcagaccaatctattggcgctgaacgcggcgatcgaggcggcgcgcgccggcgagatgggccgcggcttcgcggtggtggccgacgaggtgcgcaagctggcggaaaactcggccaaggccgccagcgaaatcaagggcgtgaccgaacaactgagccagaacgcgcaatcggtgggctcgacggtgcaaagcggcctggacgccgcccagcaaagccgcgacaccatggagacggtgatggccaatctgcgcgaggccaacgacagcgtgcaagaagccagcggcggcgtcggccagatccgcgacgccatttccgagcagaaaagcgtctgcgccagcctggcgcagcgcttcgaaacggtatcgcagatggtggccgacaacacccaggccgccggcgaactgcacagcgcggtgctccgcctgaacggcgtggccgcccacatgcagcaaatggtgggcaagttccagctgtag

SEQ ID NO: 125 - DNA, 654 bp, Chromobacterium substugae
atgcgcgtcgaattgagccaagacctgttgggccgcctgccggcaatggaagtggagggcctgctggccctggatctgcaaacgtcggccttgccgacggcggcgccgagtttggcggaaggggcggataccgaagcgctgctgcagcgctggaaagcgctgtaccgcgagttgcccggcgacaagaaggcgcgctgttcgctggaatatctggtcaaggcggtgcaaaaggacaagctgcgcagcatcctgccgttggtggatctgtacaaccaggcgtccttgctcagcctggtgccgtttggcggcgaagatgtcgacaagctgggcggagagctgctgctggacctggcgcatggcgacgaagccttcgtgccgttgggccgcgccgaagcggagtggccgcaagccggcgaggtggtgtggctgaacggcggccgggagacggtttgccgctgcatgaattggctggagtcggaccatttcaagctgaccgaagccagccgcaacgtggtgttcgtcagcgaacgcccggacgccggcttcccgtccggcgcggtcggcatggattggctggcgcggcggctggcgccgcatgcggggacgctgctgcgcttccggctggatgccgcgaatcccgttttctccgcctga

SEQ ID NO: 126 - DNA, 1512 bp, Chromobacterium substugae
atggacgtatacgacttgatggtgataggcggcggcatcaacggcgcgggcatcgcgcgcgacgcggctgggcgcggcctgtcggtggcgctgtgcgaaaaggacgacctggcctcgcatacctcgtcggccagcaccaagctgatccacggcggcctgcgctatctggagtattacgagttcggcctggtgcgcaaggcgctgcaggagcgcgaagtgctgctgaaggccgccccgcacatcatctggccgctgcgcttcgtgatgccgcacgcgcgcgaccagcgtcctgagtggatgatccgcgccggcctgttcctctacgatcatctggccaagcgcgaagtgctgccggggtcggaaaccgtcagcttcgccaagcatccggcgggcgcgccgctgaaggacgcgttcaagcgcggcttcgtctattccgacggctgggtgcaggacgcgcggctggtggtgctgaacgcggtggacgccgccgagcacggcgccaaaatccacacccgcaccgcctgcgtggcggcgcgccgcgacgacggccactggatcgtcacgctggcgcgcgaggacggcagccgcttcgaggtccgcgcccgcgcgctggtcaacgccgccggcccctgggtgcagagcctgatcgaggacaagctggcgatgccgtccagcaagtccatccgcttggtcaagggcagccacatcgtggtgaagaagctgttcgaccacccgttcgcctacatcttccagaatccggacaaacgcatcatcttcgccatcccgtacgagaaggatttcaccctgatcggcaccaccgacgtcgagtaccgcggcgatccggcccgggtggcgatagacgcgcaggaaatcgcctatctgtgcgagatgagcaaccgctatttccacagccagattgcgcccgccgacgtgctgtccacctattccggcgtgcggccgctgctggacgacgctgcggacaacgccgccagcgtcacccgcgactacgcgctggaaatggacctcgccggcgcgccgctgctgtcggtgttcggcggcaagatcaccaccttccgcaagctggccgaggaggcggtggacaagctggcgccgctgttgggcaaccgcaaggccacctggaccgccgacgcgccgctgccgggcggcgacatgccgggcgccgacttcggccgcttcctgcagggcctgggccagcgctgcccatggctgccggcggcattggccgagcgctgggcgcgcgcctacggtacccgcgtcggcaagctgatcggccaggccgccagcctggcggagctgggcgaggaagtgctgcccggcctctatgcggccgagctggaatatctggcggagcaggaatgggcgacgcgcagcgaggacatcctgtggcgccgctccaagctgaaactgcatctgccggccaacgctgcggaggtggtggacgcctggctggcggcgcgcgcgcagtcgcggcgcgaggcgctgagcgcctga

SEQ ID NO: 127 - DNA, 714 bp, Chromobacterium substugae
atggatccattttacaaagcgttggtcggcgagttcatcggcacagcgctgttggtgctgctgggcaacggcgtggtggccaatgtgctgctgaaaaacaccaagggccacaacagcggcctgatcgtggtggccttcggctgggcgatggcggtgttcgtcggcgtgttcagcgtggcggcgatcagcggcgcgcacctgaacccggcggtgtcggtggcgctggcggtggccggcaaattcccgtgggacaaggtgccgggctatgtcgccgcgcagatgctgggcggcatggccggcgccggcctgatgtgggtgatctaccgcaagcactatgaaaccaccgattgcgccgacaccaagctggccaccttctgcaccggcccggccatccgcagcctgccgggcaacctggtatccgagatcgtcgccaccttcgtgctggtgttcgccatcctgtcgatggtcggcccgaaaatgtcgctgggcgccatcgaggcattgccggtggctctcttggtgctgggcatcggcgtgtcgctgggcggcaccaccggctacgcgatgagcccggcgcgcgatctggcgccgcgcatcatgcacgccatcctgccgattccgggcaagcgcgacagcgactggggctatgcctgggtgccggtgctgggctcgttgatcggcggcacgctggcggcgctggcttccacgctgtaa

SEQ ID NO: 128 - DNA, 1503 bp, Chromobacterium substugae
atgagcgatcagtacgtactggccttggaccagggcaccaccagttcccgcgccatcctgttcaaccgcggcggcgacatcgtgtcgctggcgcaaaaggaattccgccagatctacccgcaaccgggctgggtcgagcatgatccgcaggaaatctggggcggccaggtgggggtggcggcggaagccgtggccaaagccggcatcgacggtcgcagcatcgccgccatcggcatcaccaaccagcgcgaaaccaccatcgtctgggaccgcgaaaccggccagccggtgtacaacgccatcgtctggcaggaccgccgcaccgccggcttctgcgacgaactgaaggcgcgcggcctgggcgagctgatccgcgccaagaccggcctgctggtcgacgcctacttctccggcagcaagatcaaatggattctggacaatgtgccgggcgcccgcgaacgcgcgcaggccggcaagctggccttcggcaccgtcgacagctggctgatctggaacttcagccacggcaaagtgcacgtcaccgacgtgtccaacgcctcgcgcaccatgctgtacaacatccacacgctggaatgggacgccgagctgctggacatcatgggcatcccggcctcgatgctgccgcaggtgaagagctccagcgaggtgtacggccacacccacgccgcccacctgggcgtggaaatcccgatcgccggcgtggccggcgaccagcaggcggcgctgttcggccagcaatgcacccagcccggcatggtgaagaatacctatggcactggctgcttcatgatgctgaacaccggcgacaagccgatcgaatcgaagaacaatctgctgaccaccatcgcctgggcagtggacggcaaggtgcagtacgcgctggaaggctcgatcttcatcggcggcgcggtggtgaaatggctgcgcgacggtctgggcatcatccgccactcggccgacgtcggcccgctggcgcaggaagtgaaggacagcgacggcgtctacctggtgccggccttcgccggcctgggcgcgccgcactggaacgccagcgcccgcggcaccatcgtcggcgccacgctgggcaccaaggcggcccacatcgcccgcgccgcgctggacagcatcgcctaccagacccgcgacgtgctgaaggcgatggaagccgacgccggcatgggcatcgccgagctgcgcgtcgatggcggcgccaccgtcaacgagctgttgatgcagttccagtccgacatcctggcggtgaacgtggttcgccccaagatcaccgaaaccaccgcgctgggcgccgcctacctggccggcctggccgtcggttactggaagagcgtcgacgacatccagggccaatggcagctggaccgccgcttccagccggcgatgccggccggcgaagtggccgccaacgtcaagggctggcagcgcgcggtgaacgccgccaaggtgtgggccgacgatcaggcttga

SEQ ID NO: 129 - DNA, 1407 bp, Chromobacterium substugae
atgcttcgcaacaccaaaattctcgccacgctggggccctcatccagcaccccggaacaaatcctggagctggcccgcgccggggtgaacatcttccgcctcaatatgagccacggcagccatgacgaccaccgcgcccgcctggccgccatccgcgccgcggaaaaggcattggaccggccgataggcgcgctgatcgacctgcaggggcccaagctgcgcatcggcaaattcccgcagcccgccaccgtgcagaccggcgaccgctacgaattcgtgctggatgaagtggacggcgacgcccgccgcgccagcctgccgcacccggaagccttcgccgcgctcaagcccggccacagcatcctggtcaacgacggcaagctggcgttccacgtggaacatgtcgagccgcgccgcatcgccacccgcgtcaccgtcggcggcgagctgtccagcaacaaaggcttcaatctgccgcacaccgtgctgccgctgtccgccatcaccgagaaagaccgcaaggacgccgagttcgcgctggccgaaggcgccgactgggtggcgatgtccttcgtgcagaccgcgcgggacgtggccgagctgcgaaagatcgtcggcacaaaggccggcatcgtcgccaagatcgaaaaaccgtcggcggtggacgatctggaagccatcgccacgctggccgacggcgtgatggtggcgcgcggcgacctgggcgtggagctgccgccggaagacgtgccggtggcgcaacgccgcatcgtccaccagtgccgccacctgggccgcccggtgatcgtcgccacccagatgctggagtcgatgatcaccgcgcccacccccacccgcgccgaagccaacgacgtggccaccgccgtctacgagggcgccgacgcggtgatgctgtcggcggaaaccgccgccggccaatacccgctgcaggcggtgcagatcatggaccgcatcatccgccgcgtggaaagcgcgccggactaccgcaaggtgatggcgctggactacagcgccgccgacgagccgggccgcaccgacgccatcgccgcctgcgtgcgcaaggtggcgacgctgctgccggtgacggtctcggtcgccttcaccaccagcggctccacctgtctgtacctggcgcgcgagcgcccgtccacgcccatcctggggatttctcccagcctggacaccgcgcgccggctgacgctggtgtggggggtggtggcctaccacggtccggatgcggaaaacctggaagacatggtagtgaagaccaccttctgcgccaccaagctgggcctggccgaacagggcaagccgatggtgatcatcgccggcgtgcccttcggcacccccggctccaccaatctcttgcgcatcgtttacccgtaa

SEQ ID NO: 130 - DNA, 753 bp, Chromobacterium substugae
atgcggcagaagcttttccccaccatgctggcgctatggctggccctggccggcgtccccggcctggccggcgaaccgcccggactgatcgtcgacttcgacgccagcaatccgccgctgatgtacgccggccagcaaggcgccgccggcctgtacccggcgctggtcgccaaggtctgcgaacgcgccggcatcgccgtcacgctgcgcgccgcctcctggcgcctggcgctgcaggaattgggcggcggcagcgcagcggccggcggcatcatcaagaccgccagccgcgaaaaactgttcgacttcagccagccgctgttctacgagcgcgtggtgatggcttctccggccaaggcgccgcgctaccgcaagcttgaggacctgtacggcaaaagagtgggcgtgatggccggctggagctacggcgacgccttcgacctggccaggaagcaaggccggctcaccgccttcgacggcgacagcgacgagcagaacctgcgccagctgcgcctggggcggctggacgtggtgttgggcatacgcgagccgctgcagctggcgctacgcgacggcggctaccgcgacgtggcgctgtcgcaggaggcgctggtgaccaatccgtcctacctggccatcaacaagcacgcgcagcaagaggcgctgctgacgcgcttcaacctggcgctggaagcgatgcgccgcgacggcagctacgacagcgtgctgcagcgcgagctgtccaggcgctga

SEQ ID NO: 131 - DNA, 372 bp, Chromobacterium substugae
atgatcagccatatcgaccacatcgtcctgaccgtgcgcgacatcgaggcggcggtcgccttttaccagcgcgcgctgaagctggaagcggtgagcttcggcaatggccgccgcgcgctgcgtttcggcaaccagaagatcaatttgcaaaccttgggccaggaaacgcgcaaccacgccgccatcggttccggcgacctgtgcctgatcacccatttgcccttggccgaggtggctgagcatctgaagcgcgaaggggtggccatcgtcgaggggccgatcacccgcagcggcgcgatgggaacgatcacctcggtgtatttcaacgacccggacggcaatctgatcgaggtcagcacttatagtttttga

SEQ ID NO: 132 - DNA, 1209 bp, Chromobacterium substugae
atgaccgtgcacctgccgctgcaacaagcccgccacctgcaactggccgcccagggcctgctgaccgcgccgcgccgcaaggcgagcaaggccgacgcgctggccgccatccgccgcatggcgctgctgcagatcgacaccatcagcgtggtggcgcgcagcccctacctggtgctgtacagccgcatcggccagtacgacccggcctggctggaccagctgctggccgaaggcgcgctgttcgaatattgggcgcacgaggcctgcttcgtgccgaccgaggactaccggctgctgcgccaccgcatgctgaacgccgagggcatgggctggaagttttcgccgcgctggtacgcgcagcaccgcgccgacatcgaagccatcgtcgagcgcatccgcgcgcacgggccgatgcgctcggccgatttcgagcgccgggacaacaaaggcaatggctggtgggactggaagccggaaaaacgccacctggaggcgctgttcacgctgggccggctgatggtgaaggagcggcgcgccttccagcgcgtctacgacctggccgagcgggtgctgcccggctgggacgacgcgcgcgacctgctctcgccggaagccgcgcggctggaacaggtgcgcaacagctgccgcgcgctgggcctggtcaaaccagcctgggtggccgactactaccgcctcaagcgcgcgccgtacaccgagctgctgcatggcctggcggatgccggcgaactgctgccggtgaaagtggaaggctggagccacgacgccttcgtccacgccagcctggccgccgaactggagctggcgcgcaatggcatgctgaacagcggcaacaccgccatcctgtcgccgttcgacccgctggtatgggaccgcaagcgcgcgctggagctgttcgatttcgattacaagatcgagtgctatacgcctgcgccgaagcgaaagtacggctatttcacgctgcccatcctcaaccgcggcaagctggcgggccggctggacgccaaggcccatcgcgcgcaaggcgtgttcgaagtgaaatcgctgcacctggagccgggcacgcgcgtcagccagcggctggccgacgatctgaaaacggcgctggccagattggccgattggcacggcgcgccgcggctggcgataagccaggcgccgggcgacctggccgcgcgcatcctggcctga

SEQ ID NO: 133 - DNA, 360 bp, Chromobacterium substugae
atgatcgtcgtgtccgtcgtctatccgcatcggcccgccgcgcgtttcgatttcgactactacctgcagcgccacatgccgatggtgcagcaattgctgggccatagcctgaagggcgtgcgggtggaccgcggcctgtccggcgccgaggcgggcagcccgccgggcttcgtggcgcaggccctgctgctgtgcgattcggtgcaggcctttcagcaggccttcggcccggtggcggcgcgcatcatgggggatatcgccaattacaccgacatccagcccgacatccagttcagcgaagtggcgctgtgggacgagcgccagcccggcgtcagcggctggtacgccaacgcgcagtaa

SEQ ID NO: 134 - DNA, 294 bp, Chromobacterium substugae
atgcgcaccccgatactcctgatgagcgccgccctggcgctggccggctgcgaccagcgccaaaccgcccagctgcagcaggccgcctccgccgccatcggcaatgtgcaccagggcgtcgacgccgccagcgcgccgctgggacagctgaaggagcaagccagcgccgcgctgggggcggccaagcaggtgggcgcggccgccaccctgctcaatcccgaactgaaggaacaagtggaaaaactgaagcggcaggcgtccgacatccagggcgcgatccagcccaagccctag

SEQ ID NO: 135 - DNA, 570 bp, Chromobacterium substugae
atggaaagcctgcccgacttgtgccgcgtcagcgacatcctgctggatgtggacgttgactgcaaaaaccagctgttcgcctacgccgcccgccagctgggccaacgccacgcgctgaacagccagaccgtgcaaagcgcgctgcagctgcgcgagcaaaccggcagcaccgcgctgggccacggcctggcgctgccgcacgcccgcattcccggtctgagcgaagcccatgcgctgtttctgcgcctgaagcgggacatggagttcgactcgcccgacggcaagccggtgcgcagcctgctcttgctgctgctgccgcaggaagcgcatccgcagcacttgcagctgctcgccgccatcgcccgcatgtgcagcgaaaggccgttccgcgaagcgctggcgcgctgcgcccacccgcagcaggtgcaccagttgttccagctgtgggctgacccgcagcccagcaacgacccgcacttctggctggacagcaaccgctacttcctggacaccgaagccagcctgcggcccgattacagcatacggcgcaaagtggtggcgcgcttctga

SEQ ID NO: 136 - DNA, 1122 bp, Chromobacterium substugae
atgtccaatttcctgctcaccatgctctccctgaccgtcgccagcataggcgtgatcacctggcagcacagcgtgcgcgccgatttgctgcggccgcgccgccgctggctgcaggcctcgctgctgctggccaccgggatgatgctggaaggggaactgctgggtctgcacccggcggcgctgtcgctgggcagcggcatgagcaacgccggcatcacgctgcagctgatgatcatcgcccggctgtgcaatctgcgcctgcccgatacgctgtggctgtgggtgggcgcctattcgatcctggacaagtgggtgccgcagccgctgctgagcgccgcgctgtcggcgctggaaatcccgttgctctacctggccgccgcctggctgtaccaacgcgccgaacagcagatctgccacaaccgcttcagccccaccgcgctgctgttcctgctgggggcgctgctgttcatctggcgcgacgcgcccgacctgctgcggctgtaccacggccagccccacctgtcgcacgagcacacgctggcccaccagctggcgctgaccgtggccgccgccgcccaggtatgcggcgcggtgggctttctcaacatcgtgctgcaacggcagaacagccggctgcaggacgccgccaacatcgacccgctcaccgccgccggcaaccggcgcgcgctgcaatactggctgcgcacgctggaagcctcgaccgagcgggtctgcgtgatcatgctggacatcgaccatttcaagtcgatcaacgaccgcttcggccacccggccggcgaccaggtgatccaggcgctggccagcctgctcaacaacggcgtgcgggaaaacgatttgctgatccgctacggcggcgaggaattctgcctggtgatgccggacaccggcatcgaaaccggcctggcggtggcggaccggctgcgccagcaattcagccagctggcgctgttgccggcgcagccggagcagcgctgcagcttttccgccggcgtgcacgaatggcaatgccggcagcaggatttcgccagcgcgcagcaaaaggccgaccaagcgctgtaccaagccaagcagaacggccgcaaccaggtctgccggctgtag

SEQ ID NO: 137 - DNA, 1089 bp, Chromobacterium substugae
atgaagcagaccgaccagacgttgctggagcagttgcgcatcaccgagtttgaaatcgaccagcgcaagcagctgttcgatctgcagccgcgcgacgaattgctgcttcgcgccgccggcgcgctgatcgagccgcagctggacgatctggtggagcgcttttacgagcagcagaccagcaccccggaaatcgcgctgctgatcggcgacgccgataccctgcagcggctgcgcagcgcccagcgccgctacgtgatcgacctgttcagcggcgtctacgatctggaatacgtcaacaaccgcctgcgcatcggcctggtgcacaagcgcatcggcgtggagcccaagttgtacctggcggccatccatttcctgcgctcgctgttgtcggtgcaggtggccaggctgattcccgaccccgatgtctgcacgcagacgctgatgtcgatggacaagctggtgatgttcgacatcgcgctggtgttcgaaacctatatccgcagcctggtggcggaaatcgaaacctcgcgcaacaagtccgagcagtacgcgctggcgctggaggaaaaggtggcgatgcgcacccgccagctggaggagctgtcgcgcaccgacccgttgaccggcctgctcaaccgccgccacctggacgaaaccctgacccgggtgctgcgcagcgcgcagcggcgccatgaaagggtggcgctggtgtatctggacatcgacgatttcaaggcgatcaacgataccgaaggccatcagcgcggcgacgagatcctgcgcgtgctgggcggcatcatcaatcgcatttcgcggctggaagacggctgctttcgttacggcggcgacgaattctgcatcgtgctgcccaattgcggccgccgccacgcggagaacaatttcgtccagcgtctgcgcgccgagatggaaatcgcgctgtccggcgtgacggtgagcatgggctgcgtcgaaaccggaccggaggatttcgccagcccggaagcgctggtggggatggccgatcagcagatgtacgcggtgaagtcgcggcaccgggaggatggcgaggacaagcccgccggccgctga

SEQ ID NO: 138 - DNA, 240 bp, Chromobacterium substugae
atggataccagcagccacctgttgcccggattgttccgccagttgggcctggccgacgagccggcggcgatcaaggccttcatcgccagccatccgctgccgccgcgcgtgtcgctggccgacgcgccgttctggagcccgtcgcaagcggcctttttgcgccaggcgctggagtgcgacgccgaatggagcgaggcggcggacgagctggcggtgctgctgcagcaagccgaaggctga

SEQ ID NO: 139 - DNA, 1899 bp, Chromobacterium substugae
atgaacgcgcccgtaaacaaacagatggtggtggacgccgccgccatccagcctttgcccaattcccgcaagattcatgtcgccggcagccgcccggacatccgcgtgccgatgcgcgagatccgccaggccgacacgccgacccagttcggcggcgaagccaacccgccgatctacgtctacgacaccagcggcccgtacagcgacccggcggtccgcatcgacatccagagcggcctggcgccggtgcgcgccggctggatcgccgaacgcggcgactgcgagcagctggatggcctgtccagcgaatacggccgcgcccgcgaggccgaccccaagctcgccgagctgcgcttcaatctgcagcgcaagccgcgccgcgccttgcctggccgcaatgtcagccagatgcactacgcccgccgcggcgtcatcaccccggagatggagttcgtcgccatccgcgaaaacctgaaccgccgcgcctatgtggaagcgctgcaggccaccggcaacacccgcttgctggagctgatgacgcgccagcatgccggccagagcttcggcgccaatctgccggaagagatcacgccggagttcgtccgccaggaagtggccgccggccgcgccatcatcccggccaacatcaatcacccggaaagcgaaccgatgatcatcggccgcaacttcttggtgaaaatcaacggcaacatcggcaatagcgcggtaacctcgtcgatatccgaagaagtggacaagatgacctggggcatccgctggggcgccgacaccatcatggacttgtccaccggcaagaacatccacgaaacccgcgagtggattttgcgcaacagtccggtgccgatcggcaccgtgccgatttaccaggcgctggaaaaggtgaacggcaaggccgaagacctgacctgggaaatcttcaaggacacgctgatcgagcaggccgaacagggcgtcgattacttcaccatccacgccggcgtgcgtttgcagtacgtgccgctgaccgccgggcggatgaccggcatcgtgtcgcgcggcggctcgatcatggccaagtggtgtctggcgcatcaccaggaaaacttcctctacacccatttcgaggaaatctgcgaaatcatgaaggcctatgacgtggccttcagcctgggggacggcctgcgccccggcagcgcctgggacgccaacgacgcggcgcagctgggcgaattgaaaacgctgggcgaactgaccgaaatcgcctggaggcacgacgtgcaagtgatgatagaaggccctgggcacgtgccgatgcagctgatcaaggagaacatggacaaggagctggagtggtgccgcgaagcgccgttctacaccctggggccgctcaccaccgacatcgcgcccggctacgaccacatcacctcggccatcggcgcggcgcagatcggctggtacggcacggccatgctgtgctacgtgacgcagaaggaacacctgggcctgccgaacaagaacgacgtcaaggaaggcatcatcacctacaagctggcggcgcacgcggccgacctggccaagggccatcccggcgcgcagatccgcgacaacgcgctgtccaaggcgcgtttcgaattccgctgggaagaccagttcaacctgggcctggacccggacaaggcgcgcgacttccacgacgagaccctgccgaaagatagcgccaaggtcgcgcatttctgctcgatgtgcggtccgcatttctgcagcatgaagatcacccaggacgtgcgcgatttcgccgccaaacagggcatcagcgcgcaggacgcgctgaacaagggcatgcaggaaaagtccatcgagttcgtcaagggcggcgccaagctgtacgacaaggtgtga

SEQ ID NO: 140 - DNA, 171 bp, Chromobacterium substugae
atggccggctgcggtgggatggcggggctatcttcggcaggtgacgcttccctacgccgggattatccgggtcaggttccaagggtatttctcacccgcgccgccgctttcaacccgatgtcctacactttggtagccgatcaagccaaacgccaggcgcaggacccctag

SEQ ID NO: 141 - DNA, 660 bp, Chromobacterium substugae
atggatttcgaaaaaacccgtttcaacatggtcgaacaacagattcgcccgtgggacgttctggataccaacgtgctggatctgctgtttcacgtgaaacgcgaggacttcgtggccgacaatcagcgccagatggcctttgtcgataccgaactgccgctgcccaacggcagcaagatgctacagcccaagatggaagcccgcctggtgcaggacgcctccatccagcccaccgacaagatcctggaaatcggcaccggcagcggctatctgaccgcgctgctggccaagatgggcaagcaggtggtgagcgtggaaatcgacgcggcccagaaagcgcgcgccgccgaaaatctgaaacaggccggcatcgccaacgccaccctggttgagggcgacggcgtgctgggcctgccggcgcaagcgccctacgacgtgatcgtggtcggcggttcgctgccggtggtgccgcaggaactgaaagaccagctggccgtcggcggccgcctgatcctggtggccggcgacctgccggtgatggcttgcaagctgatccagcgcgaaaccgaaaccagcttccgcgaaaccgcgctgttcgagacctgtgtcgagcggctgcagaaattcgaagccgtcgaaccggctcgtttcagcttctga

SEQ ID NO: 142 - DNA, 327 bp, Chromobacterium substugae
atgctgcgcgaaatcaccgctccgcaactggcggcgctgctggccgatccgcaggccgcgcgcccggtgctgctggacgtgcgcgaaggctgggaataccagctggcgcacatcgagggcagcgtccacattccgatgaacctgatcccgatccggatgagcgaactgccggacgacgccgccatcgtcgccatctgccatcacggcatgcgcagcgcccaggtggcgatgttcctgcagaacgccggcttcgacgacgtgatcaacctccagggcggcatcgacgcctggtccgcccaggtggatccggccgtcgcccggtattga

SEQ ID NO: 143 - DNA, 723 bp, Chromobacterium substugae
atgcaagctctgaattatctttcctccgccctcgcccgcgtccatccggcctgggaagcggtgctgcgccaagccgacatcgccgcgcggctggccgacatcgaccgccagctgagccagcaaagcgaggccggcaagacgctgttcccgcccgcggcgcagatcttcaacgcgctcagcttcgcgtcgccggccgacgtcaaggtggtgatcctgggccaggacccgtaccacggcgccggcgaagcgatggggctgtcgttttcagtgccggaaggcgtgcgcgtgccgccgtccttgcgcaacatctacaaggaactggcggccgacctgggcctgggcattcccgccaacggcgatctcagccactgggcgcagcaaggcgtattgctgctcaacagcgtgttcaccgtcgagcaggaccaggccggcagccacggcaagctgggctggcagacggtcagcgacgcgctgatcgacgccgtcaacgcgcaaagccccggctgcgtgttcctgctatggggcaactgggcgcagaccaaggccgagcgcatcgacgccagccgccacctggcgctgaaggccgcccatccgtcgccgctgtcggccagccgcggcttccacggctgccgccatttctcccaagtcaacgcctggctgatcgcccgcggccgccagccggtgcgctgggccgccgccgccgcgcaaaacagcctgttctga

SEQ ID NO: 144 - DNA, 1311 bp, Chromobacterium substugae
gtggaaatcctgctgctgctgggcctgatcctgttgaacgccgtattcgcgatggccgagatcgccatcgtctcctcgcgcaaagtccggctgctgcaaaaggccgaagacggccaccgcggcgcccgcgcggcattggcgctggccgccgaacccacccgcttcctgtccaccatccagatcggcatcacctcgatcagcatcctgtccggcgtctacggcgaggcggcgctgtccgagcatctgcgcgccgcgctgctcgaggtgccgctgctggcgccttacagcaagccgctgtcggtggcgctgatggtggtgttcatcaccacgctgtcgctaatcctgggcgaactggtgcccaaacggctggcgctgctcaatccggaacgggtggcgatggcgctggcgcggccgatgctgctgctgtcgcgcgccagcgcgccgctagtgcaggtgttcagccgcgtcaccgacggcctgttgcgcctgttgggcgccaaaaagagcgacgagccgtcgatcaccgaggacgagatccgcacgctgatggaacaaggcgccgacgaaggcgtgttcgaccgcgccgaacaggagctggtggaaaacatcttccgcctggacaaccgcaaggtggcggcggtgatgacgccgcgcaaggacgtggtgctgctggacctggaagacggcccggagcacaaccgcgaactgctgctgcggcacaacttcagccatttcccggtttgccgcggcgacagcgaccaggtgataggcatactcaacgccaagcggctgctggaccggttgctcaccggccagccggccgacttcgccgccgacctggcgccgccgctgtacgtgccggccacctcatcgctgatgcagctgctggagcagttcaagcaggcgcgcagccacagcgcgctggtggtggacgaatacggcgagctggaaggcctggtgtcgatcaacgacgtgatggaagccatcgtcggcgatatgccggccatcggcggcgaagacgacgaaatcgtgcagcgcgaggacggcagctggctggtggacggcatggtgtcgctggacagcttccgcgaattcttcgagctggacagcccgctgccgggcgaggccggcggcaatatccacaccctgggcggcgtcatcatgttcaagctgggacgcatccccagcgtcaccgatcgtttcgagtggaacggcttcagcttcgaggtggtggacatggacaagacccgggtcgacaagatcctggtgcagcgccgccatctgccgcaaccggagttcgagtcgatttga

SEQ ID NO: 145 - DNA, 465 bp, Chromobacterium substugae
atgaccccagccctgcccgatcgccgcgtcgtccaggccgacgcgcgccgcctcgccgactggcttcgcctgcgcgcggcgctgtggccggattgtcccgccgacgaccatcgcgcggatatctcccgccaactgacgcaaaccggccgctacgccgcctttctggcgcttgatgccggcaacgccgtcgccttgctggagattgcgctacgcaacgattacgtcaacggcgcccgctccggctcgccggtggccttcatcgaaggcctctacgtggcgccgcggcatagacgcgccggactgacgaccatgatgcttgccgcggccaaggcatgggcgctgacgcgaggctgttccgaaatggcctccgacaccagcctggacaacctggcggcgcaggccgcgcatcgggcgctgggcttcgaggaaagcgaacgcgtggtgttctaccgcatggcgctgtga

SEQ ID NO: 146 - DNA, 1434 bp, Chromobacterium substugae
gtgcggcgatctggattacccgagcagcgcggaagaggtgggccggcgctacgccgcggtgcgcgcctttcccgacaacgagatctgggtggcggaaaaggacggccagctggccggttgggcgcatggccatggcggccatctgctggaagcggagtcgtatgtggaaatcggcggcatcgtggtggcgccggaacacaggggattggggataggcaggctgttgctggcggcctgcgaggcctgggcgcaagaacgcggctatccgcgcatccgcctgcgctcgggacaacagcggctggacgcgcacgcgttctaccgccgtatcggctaccagcagaaaaacaccggcatcacgttcgcgctggatctgccgcggcgcgcttgaaggcgcggcttatccacaggcgggagtccaggctggaaggaaatccacagatgcagacccgttttccggcgccgttgcaggttggcgacgccatcgccgtcaccgccttttcctccggggttcctgcgcagctgcacaaccagctggatgatgcgctggccatgctgcgcgcgcgcggctaccgggtggtggagggcgagtgcctgcgcgaggagaaatgcgacgccagcgcgcccgccgccgcgcggttggccgaactgaagcgtttcctgttcgatccgggcatccgcgccatcctgccgccctggggcggcgaactggcgatagagctgctggcggggctggatttcgccgcgctggccaagctgccgccgaaatggctggctggcttctccgatgtctccacccttctggcgccgctgaccctgctgtccggctgggccacgctgcacgggcccaacctgatggattcgccgctgaaagaaaggcaatccggctacgaggcgctgctggcggcgttggaaaccggcatgccggcggcgcaggagcaatacgcgcgttactggcgctgggacgagcctggccagacctttgccaaccaagtgcggatgctggacggcggagcgggaaaaatggcaggccggctgatcggcggctgcctggacgtgctggcatcgctgcagggcacgccgtatttcgatctggcggccttcaagcgcaagccggccatcctgtacctggaaaactgcgaactcgcgccctgcggcgttttaagggccctggcgggcctcaggctgtccggaacgttcgatggcctgtccgggctggtgttgggccgcagcacgggccctgaggccgccaacgcgggggctttgtcgtatcaggcggcggtgcgcgccgcgctggatggcttgggctgtccggtggcgatggacgcagacatcggccactcgccgccacagtggagcctgctgaacggcgcctgggccgtgttggaagttttcggcgaaggccgggccaggctcagccagcggccggcgccgtag

SEQ ID NO: 147 - DNA, 963 bp, Chromobacterium substugae
atgatgaatgtgctgattgtgcgcacctcgtcgatgggcgaccttatccacacctggcccgccatcaccgagctgaaaacgcattaccccaatatccggctgagctggctgaccgaggaaagcttcgccgacatcgcccggctgcatccgcaggtcgccgaagtgctgaccctgcgctggcgcagctggcgcaagcgtttgctgcagcctgccgcctggcgcgaactgaaggcgctgaagcggcaactgcgcgacacccatttcgacctggtgctggacagccagggcttgctgaaaagcgcgatcccggcgcgctgggccgccgcgccgctggccggcctggactggagcagcgcgcgcgaggcgctggccagcctgttttacgacaagaaacattcggtatcgcgccggttgtcagcgatagaacgcaaccgccggctgttcggcctgagcttcggctaccagccgcaaggcgagcctagcttcggcgtggcggccggagagcggccgtcgtggatgctttccggccgttacgcggtgctgctgcatgccaccagccgcgcctccaaggaatggccggaggcgaattgggtggagctgggcgaacgcctgtccaatcagcacgacatggtgatggtgctgccctggggcaacgacgctgaaaaagcccgcgccgaaaggctggccgggcggatgccggccgcggtggtggcgccgaagatgagcctggtggaagccgccggcttgctgggccatgccagcgcggtggtcggcgtggataccggcctcgcccacctggccaacgcgctgaacgtgccattggcggcgatctacaccgataccgatccgcagcagaccggcgtggtggaaacgccgtgggcgaccaatctgggcaatatcggccagtgtccgcaggtggatgaggtgctgcgggcgctgcgatcgcggcgggactggacgtga

SEQ ID NO: 148 - DNA, 1266 bp, Chromobacterium substugae
gtgagctggcagcgctgcttgtacggcgcgctgtggcggacgctgacgccgctgatccgccgttatctgagaaagcgcgcgaaacaggcgccggcctatctattgcactgggacgagcgtttcggccgggtcttgcagccgcgcgccgtcggcgcgatctggatccacgcggtgtcggtgggcgaaacccgcgccgcgcagccgctggtggcggccttgcgccggcagtggccggacgcgccgctgctgctgacccagatgaccccgaccggccgcgccacagccgaagcgctgtacccggacgccgaggtgcgctacctgccctacgattatccacaggccgccgccgacttcctcgccgcctaccggccgcgctgcggcgtgctgatggaaaccgagctgtggcccaacctgatccacgccgccgccgcccagcgggtgccgctggttttggccaacgccagactgtcggacaaatcgctgaaaggctatcgccgcatcctggggctgattcgcccagccatgcgggatttggctgctgttgccgcccaaacggcagctgatgccgatcgtttccggaagataggcgcggaaaacatcacggtttgcggcaacagcaaatatgatatagagattccggcagaacagatgcaactggcggatggcttccgccagcgcataggcgcgcgccaggcgctgctgtgcgccagcacccgcgaaggcgaggaggcgctgattctggacgcctggctcgcggccggcgacgcggtcggcgacgcgctgctggtgttggcgccgcgccacccggagcggctgcaggcggtggcggagctggcggccgagcgcggtctgaagctgcagcgccgcagcgacggcgccgcggtggcggcggacacccaggtgtggctgggcgacagcatgggcgagatgttcggctatcttggcgcttgcgacgtcgccttcatcggcggcagcctgctgcctttcggctgccataacctgatcgagccggcgatcgccggcgtgccggcgctgttcggcccgtcggtgttcaatttccagcaggccgccgccgacgcgcaggcggccggcgcggcgcgccaggtggccgacgccgccgaaatggtggcgctggcgctctcgctgctggccgaccccgagcggcgcgcggcgatgcgcgaaggcgcggcggcgttccgccaggcccatcgcggcgccagccagcgcatgctggaagtgatccgcgcgacgctggacgcgagctaa

SEQ ID NO: 149 - DNA, 723 bp, Chromobacterium substugae
atgaatcatgacggttttcgccggccgcgcgccggcttctccccgctttggcccctggtcctgttgctgccggcggttctctccgccgccgcccgcgccgacggctggccctatccgggctggcgcgacgacgccgacacccgcgtcaaagcgctggcgctgctgcaaaccgtcaacgccaccttgctgagcaacagcagcgccacccgcacgctgcagcaatggtgcgccgatcaccggctggccgccgagccgcgcatccgcgcgctgcgcgaccgcgacgtgcgcaagccggccgacgccgacatccgccgccagctgcaggtgggcgccgccgaaaccataggctaccgccgcgttcagctggcctgcggcgaccatgtgctgtccgaagccgacaactggtatgtgccgtcgcgcctcagcccggaaatgaaccgcctgctggacaccaccgacacgccgttcggcgcggcggtgcgggcgctggacttcacccgccgcaccgagcaggccagagtgctgtggtcgccgctggcgccgggctgggaaatgcggccgcaggcgccggccgccgcgcaacgcgcgctggacatccccgaacaggtgatccagcacattgccgtgctgtaccgcgacggcaatgtgccgttcagcctggtggtggaaacctaccgccgcgacctgttcgccttcgcgctgacgccgcccgccgcgccgtaa

SEQ ID NO: 150 - DNA, 603 bp, Chromobacterium substugae
atggctaacgattttcaacccttgcccaccctgactctgccacgcaccaccgacctggtgcaactggagcagcgcccccaccccccgatccatgcgcacagcccggccctggccgtgatgaccgacctgcggctggtcaatccggtggggatttccgccgacgccggcctgcgcgaggcgcaccagcgcatgatcagccacggcatccgcctgttgttcgtccatgacggcgacggcagcctgctgggactggtgaccgcggtggacctgctgggcgaacggccgatccagtgcatgaaggagcatggcaagcaccacgccgatgtgctggtcggcgacgtgatgacgccgcgcgacaagctggacgcgttgcggctggacgacgtggcggcggccaatgtcggccagctggtggcgacgatgaagcagctgggccgccagcatgcgctggtggtggagcagaatccggccagcggccatcacgaagtgtgcggcctgttctccaccagccacatggcgcgcttgctgggcatgccgctgtcgttcatccgggtgccgcaggccttgtcggaaatccagtactcgctgctgtacaccggctga

SEQ ID NO: 151 - DNA, 477 bp, Chromobacterium substugae
atggactggcagatcgaaaccctggcgcccgccttcatccagcgggcgcggcgcgaaggcgtggacgcgctggggcagccggtgcggcgtctggccgcgcgaggaggcgaaccgctgcgcgacgcgctgcggcgcgcccgtccgggcgaggcgctgatcctggccagctacagtccattccggctggatggcccgtaccgcgagttcggcccggtattcctggcggccgagccgcaggcggaaagcctgccgtcgctggacgccttgctggccggacccggctatttccgcgacgcccccgcgctgcgcgcctacgacgccgggcaatcgatgctggaggcggcgttgccggcctgggaccaattggccgagcggctgcggcaatggcaggcgcgcgccgacatcgctttcgccatgctgcgctttcccgcccacggctgctacgcgctgcggctgaatcggggggaactgacatga

SEQ ID NO: 152 - DNA, 888 bp, Chromobacterium substugae
atgagcgaaaccctgcttgccggcgccgaagccggccgcgactaccaccgcatggccgacgcgatccgctacctggtggcgcacgccggccaacagccgcggctggccgacctggccgccgcgctgcatctttccgaatcgcggctgcagcgcctgttcacgcagtgggccggcgtcagtcctaagcgcttcatccagcaactcacttgcgaggcggccaaggcgcggctggcggccggggtgccggtgctgccgctggcgcatgaactgggcctgtccggcggcagccgcctgcacgatctgttcgtcacgctggaggcgatgacgccgggcgaataccagcgcggcggcgccggcctggacataggctggagcgtggaggccagccgcttcggcccgctgctgctggcgcagaccgcgcgcggcgtctgcgcgctgcagttcgtcgccgacgaggccgcggccgaggcctggctgcatgggcaatggccgcaggcgcggctgcgctatcagcccggcgctgcgcgcgcgctggccgagcggttgttttcgccgctatcgccgcgcgcaggcccgccgctcgcgctgcgtgtgcagggcagcaatttccagatccaggtgtggcgcgcgctgctggccgtgccatacggcagcctggtcagctatggccagttggccgccggcatgggccggccgcaggcggcgcgggcggtcggcggcgcggtgggcgccaatccggtggcctggctgattccctgccaccgggtgatccgcgccgagggcgcgctgggccagtaccgctggggcgaaacgcgcaaggccgagctgctgggttgggaaagcgcgcaactggccgcgcggccggagccggcggcgtggttggcctga

SEQ ID NO: 153 - DNA, 861 bp, Chromobacterium substugae
gtggttggcctgaggcgcgaagcggcctggctgacgctgctggccgccatctggggagcgtcctttctgttcatgcgcatcgccgcgccggtgttcggcccgctggcgctgatcgcgctgcgggtgggcctggctgcctgcgcgctgctgccgctgatggcctggcgcggccaattggcggtatggcgcgcgcattggccggacatcgcgctgaccggtatcttccttaccgcctttcccttctgcctgatcgcctgggcgcaattgtcgttgccggccggcatggcgtcggtgctgaacgccaccacgccgctgatgaccgcgctatgggcctggccgctagccggggaaaagctgacgccgccgcggctggccggcctggcgctgggtttggccggggtgctggtattgctgcgcggccgcggcgccggtttcgacgccgctgggccatggccggtgctggcgatgctgggcgccaccgccagctacggctgggcgggacagatggtgcggcgccggctgcccggcctgccgcccttggctaccgccggcggcgggttggccagcggcgccctgctgatgctgccgctggcggcgtgggcgtggccggccgggccgattccggtgcgcgcctggctggccttgctggcgctggcctggctatgcaccgcgctggcctacctgattttctaccggctgatcgccaggctgggcgccacccgcgccagcggcgtcacttacctggtgccggtgttcggcgtgctgtggggcgtgctgttcttgggcgaggcgctgagtccggccatgctgctggcggcggcgctgatcctgggcggggtgctgttgctggggcggcgctag

SEQ ID NO: 154 - DNA, 1302 bp, Chromobacterium substugae
ttgttacgcaagctgttcggttcgctgttcttccggctggcgctgctgatggtggcggtggtgatcgccacccagctgttcaccatctcgctggccaaccacgagcggcacaagctgctggagcgccagctgtacatccaggtgctggacacgctgtcctatctggaagactcgatgaccggcatgagcaacgaggagaggcaggcctttctggacaattacaaccgtcccggcctgcccagcctgctgccgttcaacgccgaccacggccagaacttcgccgacgacctgcccaagatcggcgcgatgctggcgcagcggctgtcgcacgacctgaacgagcctatccaggcgcattacgcgcggcgcgaggaccacagcgaattgtgggtgcacgtgcacgtgctggaccagccgtactggctggtgattccgttcggccgctaccgcgaccgctggatcaacccgatgctgcaggcgtcgctgctggcggcgctgttcgccaccgtcctggcctcgctgttcgcctggcgcatcacgcggccgatcagccgggtggtgatggccagccgcgagctggccggcggctcgatgccgcaagccattccggaaaccggcccgcgcgaagtgcagctgttggcgcacaacttcaacggcatggcccaggcgctggacaacgccgcgcgcgagcggcggctgatgctggccggcctgtcgcacgacctgcgcacgccgctgacccggctgaaactgacgctggaaatgcaggaaaccagccacgaccagcacgacatgctgctggacatcgacgaattgtcgcgcatcgtgcgccagttcatcgacttcgcccgcgccgaggaaaccagccgccaggaaccgctggcgctggccgacctggccgccagcgtggtggcgcgcttccgccgcgaggacatggacgtgaagctggaggcgcgcagcgagcctgagctgcaagccgacgcgctggcgctggagcgcctgctgagcaatctgctggaaaacgcgcgccgctacggccagccgccggtggtggtcagggtggagcaaggcgacggcgaagtggtgctgagcgtgatagatcacggccagggcattcccgaggcgctgcgcgaaaccgcgctggcgccgttcgagcgcctggccgagcaccgcggcaccgacggcggcagcggcctcggcctcgccatcgtctcccgcatcgtcaagcagcacggcggccggctggagctggccgacgaggacggcggcttcaaggtggcgatccacctgccgcaggcctga

SEQ ID NO: 155 - DNA, 726 bp, Chromobacterium substugae
atggaacacaataaaatcctggtcgtggacgacgatgccaagctgcgcgagctgctgacccgttatctgacccaacagggttacagcgtggaaaccctgcccgatcccaaggacctggaccgcaagctggcgcgcaaccgccccgacctgatcgtgctggacgtgatgatgccgggcgaagacggcctggcggtggtgcgccgcctgcgcgcccagggcgaatcgctgccggtcatcatgctgaccgcccgcggcgaagacatcgaccgcatcctcggcctggaaatgggcgccgacgactacctgcccaagccgttcaacccgcgcgagctgaccgcgcgcatccagtcggtgctgcgccgccatcacaccaccccggcgctggccgcccagcacaacgccgacgacgtggtggagttcggcgaattcctgctcaacctcggccagcgcgaactgcgccgcagcggccaggccatcgcgctgaccagcgccgaattcgcggtgctgtcggtgctggtcaaccacccgcgccgcccgctcacccgcgaacaactgatggagctggcgctgggcaagggcaacggcgaatcgctggaccgcagcatcgacgtgcacatctcgcgcctgcgcaaggcgctggaaaacggcgacagccagctgcgctacatccagacggtgtggggctacggctacgtgttcgtgccggacggctcgcccagggagtaa

SEQ ID NO: 156 - DNA, 336 bp, Chromobacterium substugae
atgaagcgatatctgatcattctgctgtggggcagcctgtttgcgcaacaggcggcgctggcgcagggtttccatccgcgcggcccggcccgcagcgccgagggccggccggcgtcttgccaggccgatccgcaatgcccggaaaaccgccgcctgcgcaatctgcgccagcgcgaggcggcgaagaatggcgatatggcgttcgatccgatcaagcaccaatccaaccgcctgctgccgcccgctgcggatggccacgcgcaagcggttcccgccaagccgaatttttggcaggataagcgtagacaggaacaacagcagaaccagtccgaatga

SEQ ID NO: 157 - DNA, 375 bp, Chromobacterium substugae
atgtctggatggggtcggcgcgtctgcgccggggtcggcctgctgctgttctgcctgcaggctcgggcggcggccgatgaggattgcggccgcgccgtcgcgccgcagcgctgcttgctccatcagcagggcctgcgcagttgtcttgacctggccgagtcgcgccgccgcgcctgcctctcctactatacccccccattgagctgccagcgccagcgcgacgccaagcgctgcgaggcgttgctggcggcgcaggcctcctgcgaaggcatgactggcgcctcccggcgccagtgcatagacgagaggctgccggccggagactgcccgcgttcggcccagccctgcccgaaaccgctgccgctcgccgattga

SEQ ID NO: 158 - DNA, 975 bp, Chromobacterium substugae
atgagccacagcatcgtgttttccgcaaccggcggcccggacgtgctgcgcctggtcgaaacgtcgattggcgcgcccgcggccggcgaagtccgcttgcgccataccgccatcggcgtcaatttcatcgacacctaccagcgcagcggcctctacccgctgcctttgcccagcggcctcggcagcgaagccgccggcgtggtggaggcggtgggcgccggggtggactggctggcgccgggcgaccgcgtcgcctatgccggcggcccgttgggcgcttacgccgctgagcggctgatcgcggcgcagcacctgctgaaactgcccgacggcgtggcggacgaaaccgccgcctgcgcaatgctgcagggcatgaccgtggagtatctggtgcagcgcacctacccggtgcaagcggggcagaccgtgctgtggcatgccgccgctggcggcgtcggccagatcgcgctgcaatggctgacggcgatgggggtgaacgtgatcgccaccgtcggctcgccggccaaggcggaaatcgcccgccggctgggcgccgcccatgtgatcgactaccgcgcggaagacgtggtggcgcgggtgcgcgagctcacctccggccagggcgtgccggtcgcgtacgattcggtgggcaaggacacctttcagatttcgctggcctgcctggcgccgcgcggcatgctggtcagcttcggcaacgcgtcgggcccggtgccggcggtgtcgccgctggaattgaccaagcacggctccttgttcctcacccgtcccaagctgggagactacaccgccactcgcgcggaattggaacagtccagccaggcgctgttcgagcggctgctggacggccggatccggctggcgccgtcgcaccgctatccgctggccgaagccgcccaggcccaccgcgatctggagcagcgccgcaccaccggctccatcatcctgttgccctga

SEQ ID NO: 159 - DNA, 582 bp, Chromobacterium substugae
atgcacatcgtctatctgcacggcttcaattccagcccgcaatcgctcaaggccggcgaaaccgccgcctggctggcccgacacgcgcccgacatcacgttccactgcccgcggctgtcgccgcatccggccgaggccatccgccaggccggcgaactgctggcctcgctgccggcggacacgctcttgatcggcagctcgctcggcggcttctacgccggcttcctggccgaacagcaaaatcgtccggcggcgctgatcaatccggcggtgcggccggaccgcgatctggcacgtttcgccggcgagcagaccaacccgtacaccggcgaggtttacacgctgggagacgccgacctggccgcgctgcaggcgcagcgggtggaaaaacccagcccggcgcgctactggctgctgctgggcagccgcgatgaggtgctggattggcgcgaagccgcggcgcattatcgccacagccggcaaactgtattcaatggcgacgaccaccgtctgaacaactggccgaaggtattgccggaaatcgtcgcctgggcgcgccggcaattgtccatcccggcttga

SEQ ID NO: 160 - DNA, 408 bp, Chromobacterium substugae
atgaccaccctgcccgccgccgcgccgacagccgccccgcattcgctggaaagcctgatcgtggcctgcggctatctgcagcacagcgccctgctgttcgcgcaggatctggacagcgacctggcgctgatccgctccggcttctgtccgcgccatcaggtgcaatggaacgcccagggcgaaatgcgggcgtgcgccgaagttcacgacgaagtggacgctctgctgcaaggcagccataccttgcgtttcgcgctgcacgaaatgctgatgcagttcggtccggaagtttgcaacgaggcgttggcccgcatcatcctgcaaggcgtgcgcagcctgcccgactggcaccaggtgtgccagtcgctggcggacttggggcgcggcccggtgcgcgtggccgcctga

SEQ ID NO: 161 - DNA, 492 bp, Chromobacterium substugae
ttgcaaataaatagcgcgctatttattatcgagggcatggaaagcaaaccgacccttccctccgacgccgacgcgctgcggctggaccagcaattgtgcttcgccctgtattccgcctcgctggcgatgaacaaggcctaccgcgacagcctgaaaccgcttggcctcacctattcgcagtatctggtgttgctggtgttgtgggagcaggaccagcgttcagtgtccgacatcggcgcccggctctacctggattcggcgacgctgacgccgcttttgaagcggatggaggcggcgggctggctgctgcgcgaacggctgtccagcgacgagcgggtggtggtggtgaggctgagcgaggccgggcgcgatctgcgacgccaggcggaagcgattccgcggcagatgctatgccgcagcggactgccgctgccggaggcgcggcagttgcgcgcggcgctgggcgcgttgcgcgaccagttgctgccatga

SEQ ID NO: 162 - DNA, 429 bp, Chromobacterium substugae
atgaataccctgcaaaaagtgctgtataccgccgaagccaccgcgttcggcggccgcgatggccgcgccgagtccagcgaccaggcgctgcaagtgcagttgagcacgccgcgcgaactgggcggcctgggcggcgacggcaccaaccccgagcagctgttcgccgccggttattccgcctgcttcatcggcgcgctgaaggtggcggcgatgcaggccaaggtaggcttgccggccgaggtgtcggtcaagggacgggtctccatcggaccgatcgagcacggcttcggcatcgcggcgcggctggaggtttcgctgccggggctggagcgcgcgacggcggaagcgctggtgcaggcggcccaccgcatctgcccgtattccaacgccacgcgcggcaatatcgaagtggagctggcgctggcgtga

SEQ ID NO: 163 - DNA, 1494 bp, Chromobacterium substugae
ttgtggttgatactgagctcgctggcggccctgtcgattgccagccgctcgctgctgggcgcggaacagcaattcaacagccagtcccagcaattgtccgagcagttgaaacaacgcctgctcaccaatgaaaccgtgctcgacagctacgccaccttcagcgctctcgaccatcgcaacgaaacccgccgcaaacaccccttcgtgctgcaactgctgcgccgctatccgcagatcatcaccctggcccatatcgaacgcgtgccgcgctcgcgggtggacagctacaaccgctggctgcaacgcgagtacggcgccggctaccggctgcgcccctatgcgccggacgccgccggccagccgctgccgctgccgctgcaggacgactacttcccgctgatgttcgccgaaccgcaatcgcaggccaatctgcggctggcgggcatggacatatggcaacagccgctgttgcgccaaacgctgcaggacagcctcaacagcggccgcaccacgctgtcgcgccagctgcgcctgccgaacggcgaggccggctacgcgctgctgcgcagcatagacaaccaccagtccggcgcgctgctggagctgcagccgcagcatttcgccctgctgttcatccgcgccgactcgctgctgcccagcggcgcgccgctgccgccgggcatggagatcagcgtgcagcagcgcgacgacccgctgcggccgccgggcggacagcctctgctgctgggcagcgcccgcgccggcgcgctggagcgcctgctgtttccgcggctggaaaccagtcagttgctgggcggccccggccagccgctgcgtttcaccatcaactggcagcagggctggccgcagatcggcctgctggagtgggtggtgtggctgctgctgtcgctgctgctgggcaccggcctcgcgctggccggctacagcttcgtgcgcagcagcaacagccgccgccagcgcgaaaaccatctgttccatctggccaatcacgaccggctgaccggcctggccaaccgcaacctgttctacgaccggctgcagcacgcgatcagccgcgtcgaccgcagcggcaaacgcctggccttgctattcctcgacctagaccgcttcaagccggtcaacgacacctacggccacgtcgccggcgaccgggtgctgcagctgatcgccgcccgcattcaggacgtgatccgcaacgaggataccgtcgcccggctgggcggcgacgaattcgtcatcctgatggaagacatcgagtccaaccgcgaggccgacaaggtgatggccaggctgaagcaggcgatccagctgccctaccaggtggaccagcaccgcatcatggtgggagtgagcataggcatcgcctactatccggaggacggcctgctgatagacgaattgctggcggtggccgaccgcaagatgtacggcaacaagcagtcgcccagccaccagtccgaaaccgtcgcctga

SEQ ID NO: 164 - DNA, 747 bp, Chromobacterium substugae
atgggcgctctgagcgagctgcgggtggtggtggtggacgatgaggcgctggcgcgcgaacggctgcgccagctgctggccgattgcggcgtcagccaggtgcattgcctggccgacggccagtccgccctcgcctggctggcccagcatccggccgacgtgctgctgctggacgtcagcatgccaggcctggacggcatggcggtggcgcgccagctcaggcagcggccgctgcagccgcagctggtgttcagcaccgcgcacgaccacttcgcggtggaggccttcgagctgaacgccgccgactacctgctcaagccggtgcggcgcgaacggctggaacaggcgctgcaaaaagcgctggcgcgctgcggcggccaggccgaggcgcctagcttcaccgtgcgccagcgcggccggctgctgaccgtgcccttcgccgacgcgcgctacctgaaggccgagctcaaatacgtcaccctggtcacccccgacaacgaatacctgctggacgaagcgctggtgacgctggagcagcggctgggcggcctggcgctgcggatacaccgcaattgcctggtgatgcgccacgcggtccaggagctgcgccgcagcggcctggacggcgacgaacagtgggtgattcggctgcgcgacgtggccgatccgctgccggtgagccgccgccagattcccgccatcaagtccgcgctgagcgccgcgccactgttacgtactattacttaa

SEQ ID NO: 165 - DNA, 1737 bp, Chromobacterium substugae
atgccgcaagctgacgaaagccccatgagcgaatccactccccctccggccgcgccgaacggcccgacgcaccatgtgcgggccgccccccagcgcaacgcttacgacgatccctacgccaaacggctgttcctgatcatagacagcctgccgcagatgcagcgggcgctggcgatgacgctgtcgtcgttcggcgccaactcggtcgaatacgcggccaaggccggcgacgcactggccaagatggccaagtacgagttcgacgtggtgctgtgcgactacgatctgggcaacggctacgacgggctctacctgttcgaggaagtccgggcgcgcaatctgctcaagcaatcctgcgtgttcatgatcgtcaccggcgagcgccgctcgcagcgggtgatttccgctgccgagatggccccggacgactacctgctcaaacccttcaccggtgaggtgctgcgcgagcggttggagcgggcgatgcgcaagcgcgaggcgttccggctggtggacgaaaacatcctgcgtcacgagtatctggcagccatcgaagcctgcggccgcaagatagaggaaaacggcgagttcgcgttcgacttcatgcgcctcaagggctcgctggcgctgaaaatcgaggattacgacgccgcccgcgacgcctatatgcaggtgctgcgcctcaaaccggccacctgggccaagatgggcctggccaaatcgctggccggactcaaatcgctggacgaggcgcggctgctgttcgaggcggtgctggccgacaacagccaagtgatggaggcctacgactggctggcccggctctaccgcaaccaccacgatctggaacgcgcgcagcacacgctgcagaccgccgccgaaatgtcgccggcggtgttccgccgccagcagcagctggccgaagtggcgatgctcaaccacgacctggccaccgccgaggccgcctgccagcagacgctggacatcgccaagtacacctggcaccgcagccccacccattacgcggcgctggcccgcatccagctggcgcgcggcgatgccgccaacgccggccgcacgctggccagcctgcgccacgactaccgctacaacgaagaggcggagtggctggccaatgtggtggacagccagttgcaggccaagaacggcaacgccgacaaggccgccgcactgctggccgacgccaccgagcgcttcaagccgctggcggccaagctggaccaggaagcgcagctggaatacgcccgcgcctgctaccagcagggccgcgagccgcagggcaacgaagtgatggaatacctggtgcgcaaccaccacgacgatgaacagctgctggcccacttcggcgacatgttcgaagagctgggcatgggccaggccggccgccagctgatcgcgcagaacgtgaagacggtgctggagctgaacaaccaggcggtgcgcgaagcgcaaagcggcgagctggacaccgccatcgcccgcttcgccaaagcgctggaggaaatgccgcaaaacgtgcagatcatgctcaacctggtcaacgcggtgctggcccacgtcagccagaacggctggcatgaaagccatatgcgccgcgcctacgagctattgggcaaggtgcgcgacatcgcgccgaccaacaacaagttccagaagatcctgcaatcctggcgccagctggtggacaagatggacaagccgcaatgggcgctctga

SEQ ID NO: 166 - DNA, 2142 bp, Chromobacterium substugae
atgagcgatctgttagccggcctgaatcccgaacaactgcgcgcggtcacctggcccgccaagagcgcgctggtgctggccggcgccggcagcggcaagacccgggtgctgaccacccgcatcgcctggctgttgtccaccgctcagacctcgccggccggcattctggcggtgactttcaccaacaaggccgcgcgcgaaatgcagacccggctgtcggcccaggtgccggtgaatgtgcgcacgatgtggataggcactttccacggcctgtgcaaccgcctgctgcgcatccactaccgcgacgccggcctgccgcaaaccttccagatcctcgactccgccgaccagcaggccgcgatcaagcgcctgctgaaaagcctggagctgtccgacgagaaatacccgccgcgcgcggtgcagtcgttcatcaacggcaacaaggaagccggcgtgcgcgccgaggcgctgccgccggcgctgaacccgtacgaagccaagctggtggagctgtacgccgcctacgacgcccaatgccggcgcgaaggggtggtggacttcgccgagctgctgctcagaagctacgaactgctgtcgcgcaacgaggcgctgcgcgcccattacagcagccgcttcgcccacatcctggtagacgaattccaggacaccaaccgcctgcaatacgcgtggctgaaactgctggccggcgagcacggcgcgctgttcgccgtcggcgacgacgaccagagcatctacgccttccgcggcgccgaagtcggcaatatgcgcgcgctgctggccgacttccacgtggccgagccggtgcggctggagcagaactaccgctcgatgggcaccatcctcaacgccgccaacgcgctgatcgaaaagaacgacggccggctgggcaaaaacctgtggaccgacgccggcgaaggcgaaaagatccgcttcttccaggcgatgagcgacggcgaggaagccgagttcatcgtcgacgaagtcaaggcgctgcgccgcgacggcctgccgctgtccgacgtggcggtgctgtaccgctccaacgcccaatcgcggctgatggagcacgtgctggtcaacgcccagatcccgtaccggatctacggcggcctgcgcttcttcgaacgccaggaaatcaagcacgcgctggcctacctcaggctggtggccaaccccgacgacgacaacgccttgctgcgcgtgatcaacacgccggcgcgcggcatcggcgcgcgcagcgtggaaggcctgcaggccgtcggccgcgagcagggcgtgtcgctgtggcaggccgcctgccagagcggcggcggccgcaccgccgccaaggtaggcgagttcgtgctgctgatcgaacgcctgcgcgaacagagccgcgacttcagcctggccgaaaccatcagcctggtcatcgaccgcagcggcctgcgcgacatgtacgagcaggacaagaaggacggcgaggagcggctggccaacctggacgagctggtcaacgccgccgccagcttcctgccggacgaccccagccaggcgctgaccgaattcctcaccgccgccagcctggaagcgggcgagcaccaggccgacgccggcagcgaggcgctgcagctgatgacggtgcacgccgccaaggggctggagttcgacgcggtgttcgtcaccggcctggaagaaggcctattcccgcacgaaaacagcctgcaggacggcaagggcctgcaggaggagcgccggctgatgtacgtggcggtcacccgcgcccgcaagcgcctgtacctgtccagcgcgcaaagccgcatgctgcacggccagagccgctacccgatcccgtcgcgcttcatcgacgagattccggcggaactgatccactcgctgtctgctacagtgaaaacacccgcgtctcccatgccggcgcgcgccgcctccaggacgccgcgcctgcaggccgcgaacgcctacggcctgaacatcggccagtcggtcagccacgccaaattcggcgtcggcgtggtgatccaggcggagggcagcggggaggacgtgcgcttgcaaatcaacttcgccgaacacggggtgaaatggctggatctgcgttatgcaaaactgacgccggcctga

SEQ ID NO: 167 - DNA, 876 bp, Chromobacterium substugae
ttgcagttattttgtctaaaacgatatcaaggctacggcgtattcctgattcatcttaacatccgcatcccgcgcatcagacacccggtaatagaattaagagagagcatctatatggccagtttgcataaaaagtggctgcttccctgcctgttgctgttggcgccgcttccttcgctggcggccgccgagctgcgcatcggggtggccgataccgatgccgcccccatcgcggtgctatccgaagacggcaataccctgaccggcggcctggcgcgcgaactggggatgctgctggccgaagaaatggggatgaagccgcagttcgtcattctggcgcgccgccgggtggagtccgcggttgaaaccggcaaggtcgacatcgtctgcaatgccaatcccgactggtatagcaattcttcccggctgaactggagccgggaaatttacccgctgaccgagcgcgtgctgtcgctgaaaaacatgccggccatccgccagctcgacgatttgtccggcaagcgcatcggcacccagcacggctaccattaccccgagctggaatacctgtggtctagcaaccgcagcacgcgggacaccgaggcccgcttcgatctgatgttcaaatcgctggaaaaacggctgagcgatgtcgccatcgtcactgagttcatctatgtctggtgggcgcgctcccatgcgcaggaagccgccgccttcaagctgcacccgctagtggtatcgtcgcagccgaccatgtgcgcgctgtcgtcgcagtcgccggtcaagctggccgaactcaaccgcgccgtggatcgattgcacaagaacggcaagctcaagaccatgcttgcgcattaccaggcacaggagtaa

SEQ ID NO: 168 - DNA, 3711 bp, Chromobacterium substugae
atgacgaagccattaacccatcccgtttatcagcacctcgcccaacgcattctgatcctggatgggggcatgggcaccatgatccagcgccaccggctggaggaggccgattatcgcggcgagcgtttcgccgactggccttgcgatgtcaaaggcaacaacgacctgctggcgctgactcgtcccgatgtcatcggcggcatccaccaggcttacctggacgtcggcgccgacatcatcgaaaccaacaccttcaacgccacctcgatcgcgatggccgattaccggatggaagggctggtgtgggagatcaaccaggccgccgccaagctggttaaggatctttgcgcggcgcaaaccgccaaaaatccggccaagccgcgtttctgcgccggcgtgctcggccccaccaaccgcacctgttccatcagcccggacgtcaacgatcccggctaccgcaacgtcagcttcgacgaactggtggcgagctacaccgaggcgatagacggcctggtggccggcggcgcggatttgctgttggtggagaccatcttcgacacgctgaacgccaaggcggcggtgttcgccatccaccagtatttcgacgagcgcccggacacgccgcgcttgcccatcatgatttccggcaccatcaccgatcagtccggccgcacgctgaccggacagaccaccgaagctttctacaactcgctgtcgcacgccgacgccgccagcttcggcctcaactgcgcgctggggccggacctgctgcggccgtatgtcgaggaaatggcgcgggtgtcggccacctatgtctcggtccacgccaacgccggcctgcccaacgccttcggcggctatgatctcgaacctgagaagatgggcgagtacgtgcgcgagtgggccgagagcgggctgatcaacatcgtcggcggctgttgcggcaccacgccggagcacatcgccgccatcgcccgcgcggtggacggcatctcgccgcgcgcgctgccgcggatcgaggccaagtgccggctgtccggcctggagccgttcaatatcggcgacgaagacctgttcgtgaacgtcggcgagcgcaccaacgtcaccggcagccgcgccttcgccaagctgatcctcaacggcgactacgccaccgcgctggacgtggcccggcagcaggtggagaacggcgcccaggtgatcgacatcaatatggacgagggcatgctggacgcccacgccgcgatggtgcgcttcctgaatctgatcgcgtcggagccggatatcgcccgcgtaccgatcatgatcgactcgtccaaatgggaggtgatcgaggccggcctgaagtgcatccagggcaagggcatcgtcaactcgatctcgatgaaggaaggcaaggagaagttcgtcgagcaggcgcgcttgatccgccgttacggcgcggcggtgatcgtgatggccttcgacgagcatggccaggccgacacctacgcccgcaagatcgagatttgcgaccacagctaccgcatcctggtggacgaggtgggcttcccgccggaagacatcatcttcgacccgaacatcttcgccgtcgccaccggcatcgaggagcacgcccgctacggcctggatttcatcgaggccaccggctggatcaagcagcacctgccgcacgccaagatatccggcggcgtgtccaacgtcagcttcagtttccgcggcaacaacaaggtgcgcgaggcgatccacgcggtgttcctctaccatgcgatccagcgcggcatgaccatgggcatcgtcaatgccggcgcgctggaggtgtacgacgaggtcgacgcaagcttgcgcgagcgcatcgaggacgtggtgctgatgcgccatcccaaggacggcggcgacgccaccgaacggctgatcgagctggcggagaaattcaagggcgaggcggtcggcgagaaaaagggcgaagacctggcctggcgcgcctttccggtggaaaagcggcttgagcacgcgctggtcaagggcatcaccaccttcatcgtcgaggacaccgaagaggtgcggctgaagtgcgcgcggccgatccacgtgatcgaaggcccgctgatggatggcatgaacgtggtgggcgacctgttcggcgccggcaagatgttcctgccgcaggtggtgaagtcggcgcgggtgatgaaggctgccgtcgcccacctggagccgttcatcgaggaagagaaaatccgtctgggcctggccgacgcgccggccaagggcgtcatcatcatggccacggtcaagggcgatgtgcacgacatcggcaagaacatcgtcggcgtggtgctgcgctgcaataactacaaggtgatcgatctgggcgtgatggtgccgtgccagaccatcctcgacgccgcgcgcgagcaccaggccgacatcatcggcctgtccggcctgatcactcccagcctggaggagatgagccatgtcgccaaggagatgcagcgccagggcttcgacattccgctgctgatcggcggcgccaccacctccaaggtgcacaccgcggtcaagatcgcgccgcactaccagcacccggtcatctatgttcccgatgccagccgcgccgtcggcgtctgctccaatctgctgtccgataccttgaaggacgccttcgtcgccgagaacctggccgagcaagaacgcgcgcgcgaaggccacgccaacaaggccaatcgcaaggtggtttccctggagcaggcccgcgccaacaaagagaaaatcgactgggccgattatgttccgcccaagccgcgatggcttggcgtgcgccgtttcgagaattacccgctggccgagatcgccgcctatatcgactggacgccgttcttccagagctgggagctggccggccgcttcccgcgcattctgaatgacgagatcgtcggcgaatcggcgcgcgcgctgtatgaagacgcccaagtcatgctgaagcggatcgtcgacgagaactggctggccgccaacgcggtgatcggcttgttcccggccaatagcgtcaatcacgacgacatcgacatccgttccgccgacggccggccgctgatgacttgggtcggcctgcgccagcaattgcccaaaaccgacggcaaggccaactgggcgctggccgactacgtcgcgccccagggcagcggcgtcgacgactacatcggcgccttcgccgtcaccgccggcatcggcatcgagccgcatgtgaagcgcttcgaggatgccaacgacgactactcggccatcttgctcaaagcgctggccgaccgcctggccgaggccttcgccgagctgatgcacgcccgcgtgcggcgcgagttctggggctatgccgccgacgagcatatcgacaacgaaggcctgatcgatgagctgtaccgcggcatccgcccggcgcccggttatccggcctgcccggaccacacggtgaaggccgatctcttcaagcttttggacgcgccgtctatcggcatgacgctgaccgagggctacgcgatgctgcccaccgccgcggtgtccggtttctacttcagccatccggcgtcgcgctatttcggcgtcggcaaggtggaaaaggaccaggtgaccagttacgccgagcgccgcggcgtcagcatcgagcaggccgaacgcgacttggcgcccaatctggggtatgacgcctaa

SEQ ID NO: 169 - DNA, 534 bp, Chromobacterium substugae
atgacgcctaagccgcgccgcttacgggttgggttcttgctggccgcgctgctggccgccggcttgtcgtggcggcagtcccggctgcccgccgactgcttctggctgagccgcgcagcctgtctggcgcgccttggcgccggcatggacaagcagattagcgaggtttggagcagcggccagcggcatggcagcgcgcagttgctgctggcgcgcgacggccgctaccagatttattcgctgcgggacgatgtcgacggcggcatcgatgtggctgaggctggtcgctggcaagaagtgaacgccgaactgacgctgaggccgctgctgggcggcgcaggcgcggcgcgctgccatcggcagtgccaccaggggcgctattatctggctcaattcccccatccgacggacatggcgcgccaaatgcgggcctggggtgaggatcgctcgggtttgcccccggctccgcccagtgcgaagccggacgcaacagcgctgtggcagggcggccagaccagcgcttgtccgatatga

SEQ ID NO: 170 - DNA, 495 bp, Chromobacterium substugae
atgtcgggaccaaaaggcattttgccgaaggcggctgtcgccgccttgctcttcgttgtttgctgcgcgctgtgtgcctgccggccgaatgcgcaagtccgcagggatagcgtcaatcgtgaagctgaagaactgagccgcaaactaccagaagagggcagccaaatctggctgtactacggtttgacggtgatacagcagcggctgacgctggccgccaatggctattacgcttgggagtcggcgtccgatgacggcggcgcgccgccgccggatcgcgattatggccgttggcgcgaggaaaaggatcaattggtattggtttcgcaatttgacggcggcgaaacgcgtttgcaggcggggtgccgcgatggcgagtttgtctggctatatggttatgccgacgaggaacccgcctggcatggcaatggcgaacactcctgttcggaaatccagcatcccgctaaatccgataaacccttggcattccgatga

SEQ ID NO: 171 - DNA, 426 bp, Chromobacterium substugae
atgaagcaacggatttggctggtttggctgctgggcctgccatgggcggcgcaggcggcggtgcagagcgatacgcgctgttttgtcgccgccaacggcggcaagcccatccacctgcaattcacgacggtgggcgacgccgatgccgactggacggcggcttatgtgcgctatggcaagcgcggcaaagcgattaccttggtatggctgcgcaccgagcaagaagaaatggctgaggggcggccctatcaatttaccgacgaatggctggaaatcgtcgatggccgcatcaacggccgttacacgactatccatcagggcgccaattattacggctttcattaccgcggcgccaatggccgcgacatcgatttcgacgaggatctgggcgcgcgcgccgcatcgcaacacgcatgcaagtattag

SEQ ID NO: 172 - DNA, 411 bp, Chromobacterium substugae
atgaaaaagactctgctctccctgctgctgggcctgttggccgtctgccaccaagccggagccgaaaccatcaaaacccgctacggcgtggtgtccgacgaagaccggatcgagctgcgcctgggcaagaaaaccatctactccgactccgacaactccgtctacctgcaaggcggcagcagctatgcgctgcaagaccgcgacgtggtgctggtcagcagcgactgcggcggcagcgtcaagaaatatgatctgggcgacttcaaccccggcacgaatgccaccgccaagctggaaaacggccaactgcgggtgacgttcagcgccgaaggccgcaagcagggcgccgtgctgttcgacggcgacaaggttcgcaaagccgccgaaaaacgcgtaaaacccaagccgtaa

SEQ ID NO: 173 - DNA, 795 bp, Chromobacterium substugae
atgcttcgacgaatctccgccgtgatagccggctggcctttcctgatcgccctatgcctgctgctggccaacgactggtggctgaagtccgcccatccgggcctcagcggcaagctgtccgacttcgccgggctggcgctggcgggcctgctggcccaggcgctgtggccgcgccgcttcgccgcgaccagcgccgccatcgcgctggcctggctgtggtggaaaagcccgctgtccggccccgccatcgccgccgtcaacgcgtggctgccctttgccctgtcccgcaccgtcgattacggcgacctgctggcgctggcggtgctgccgctgtgccggctggccttcgagcgccgcgagcggctggcactgtccgcgccggcggcgcggcgctggctgaccccgcctttggcgctggccgctttgctcgcctgcgtcgcgacatcggcgccgcaactgaatcagaaatacggcatccgcagccgcgccgaatccgccgatcttgaccgcgccaaggcgatagaggcgttcaacgcggcggcgcaagcgttccagctgcaatgcctgcgctgcgacccggcggcgagcgacggcgaatacataggcggcgagccgcgcacccagctgtattaccacttcgtctccagccgggaagtccgtttcgatgttttctggaccgcgcccggcttgttcagcggcgacaagcgggagcaactgcaagcgctgcgcgaccgcatccgccgcgagatggcgctgcgcatcccgcatctggactacctggagccgatcagctga

SEQ ID NO: 174 - DNA, 798 bp, Chromobacterium substugae
atgcgcaaacgcctcgccgccgccgtctccggctggcccttcctgatcgccctatgcctgctgctggccaacgactggtggctgaaagccgcccatccgggctggctcagcggcaagctgtccgacttcgccgggctggcgctggccggcatcgtgctgctggcggcctggccgcgccgtttcggcgagatctgcgccggcctggcggcagcctggctctggtggaaaagcgcctgctccagctccgcgatcgagactttcaacgcgctggcgccgtaccgcatcggccgcaccgtcgactacagcgacctcttggcgctggcggtgctgccgctatgccgactggccgtcgtccggcgcaagaggctggcactgtccgcgccggcggcgcggcgctggctggcgccgcccctggcgttggccgccgtgctggcctgcgccgcgtccgccgtgccgtacagccagcagtacggcgtgcgcagccgcgccagcgccgcgcggatggaccgcgtcaaggtcgtggaagcgctgaacgcggtggcggcgcaataccagttgcgctgcgaaagctgcgatccagcgctggacaagggcgtttacgaaggcggcggcaaacacagcgtgctgctgcgctaccagttttcttcgaaccaggaagtgcgtttcgacatctggaccgtgttgccctgcgtattcaacggcggcgagcgcgagcggctggaagcgatgcgcgacagcatccgctaccagatggcgcagcgcatccccggcctggactacctggaaccgatcaactga

SEQ ID NO: 175 - DNA, 270 bp, Chromobacterium substugae
atggaatggctgaaccgcgaaagcctgcttggcctgatggaggatgtggaggcggaggacccgatagactacgccgatctgccgttcgacgaacgcaatctgcgcgaattgatcgtcgattcgttgctggagcgcgagttggtgttccgcgccgaggagccggacgcctcgcggcggatgctggtgtatctggcggctaccgcgcggttgacgctggagaacatggtgctgcatgcgcgcctgctgcgcgccggccgcgccgaagactga

SEQ ID NO: 176 - DNA, 486 bp, Chromobacterium substugae
atgaaaaaaatactcgcgctgtccgcttgcgcgctggccctgagcggctgcagcgccatgaccaccatgagcagctccgcgcccaagggcgcggtttccatctatcagcgccagcaagtgaccacgctggatttgcccaagaccgaaacctatcccaccaccagcttcggcaactatgaattcaaggccaccggcgaaggcaagcagccgctgtacggcttgctgccgttgaagttcaacggcggctatgtggccgccgacatcctgttcttcgctccggcgctgttcttcaacctgcgcgaagtctacccgctgtacgatttcgacttggacaagggcgtggtgcgctaccgcctgaaggacaccgacaactggaccgagtacaagccgacgcagccggaagccgaacgcgcccgcagccatatcgacttcgccgcctcccagccggcggccgaggccgcgccggtcaagaccggcagcaactga

SEQ ID NO: 177 - DNA, 618 bp, Chromobacterium substugae
atgctgcgtattctcggccgtaccagttccatcaatgtgcgcaaggtgttgtggacctgccacgagatcggcatcgactaccaacgcgaagactggggccgcggctttcagcccaccagcagcccggaattcctggcgctcaatccgcatgggttgatcccggtggtggtggacggcgataccgtgctgagcgaatccaacaccatctgccgctacctggccgccaagcacggccgccacgacctgttgccgcaaaacccggccgcgcgcgcccaggtggagcggtggatggactggcaggccgccgatctgaaccccgcctggatatacgccttccacgccctcagccgcaacagccccgaccaccaggatccggcgagcatcgccgccagcgtggcggcgtggaaaaagcagatggcggtgctggagtcgcaactgggcgatggatggatatggggcgatgcgttcaccttggccgacatctcgctgggtctgtcggtgcagcgctggctgctgacgccgttcgacaagccgcggttgccggcggtggaggcttattaccagcggctgcgccaacgcccggcctaccttacccacggcagcgacggcgtggcctga

SEQ ID NO: 178 - DNA, 669 bp, Chromobacterium substugae
atgtcggacaagcaatggaatgaagtggacgattatttcagccgcagcctggtccagcaggacgccgcgctggaagcggcgctggccgacagcgccgccgccggcctgccggccatcaacgtggcgcccaaccagggcaagtttctccatttgctggcgcgcatccacggcgcgcggcggattctggagatcggcacgctgggcggctacagcgccatctggctggcgcgggcgctgccggcggacggccggctggtgacgctggagtacgatcccaggcacgcggaagtggccgccgccaacctggcgcgcgccggccaggccgccaagacggagatccgccagggcgcggcgctggatagcctggcgcagctgatcgcggaaggcgcggcgccgttcgacctgatcttcatcgacgccgacaagcccaacaatccgcattacctggaaatggcgctgcggctgtcgcggccgggcaccgtgatcgtcggcgacaacgtggtgcgccagggcgaggtggccaacgccggcagcgtcgacccggcggtgcagggcacgcgccgcttcatcgagctgctgggcgccaatccgcgcctgtccgccaccgcgctgcagacggtgggcggcaagggttacgacggcttcgcgctggcgattgtggaggcctag

SEQ ID NO: 179 - DNA, 210 bp, Chromobacterium substugae
ttgatcgagctggccgcgcgcggcatgggcatcgcctgcctgcccgatttctccatccaccgcgagctcgcgtccggcgccttgctcaggctggacgcgccggcggtgcggcgcagcggcaatctctacctgctgtggccggccacgccgcggatgccgcccaagctgcgcgccttcatcgactacatggcggccaatgtgctcgcctag

SEQ ID NO: 180 - DNA, 780 bp, Chromobacterium substugae
atgcagcccactctcggcgcgcaggcgggcagcatgctgtaccgcgacgcttccggccgctactgcgccagcctggccggctaccgcctgttgagcgcgttccagcccattttctacaagggcggcagcctgttcggccacgaggcgctgctgcgcgtggtggacgagggcggcgaatggcacgcgcccgaccgttttctcgccgcgcaagcgccggagatggcgctggaggccgaccgcctggcgcggctgatccacgtgcgcaacttcgcccaaagcagccagagcggctgcctgtgcctgaacctgatgcccgccaccgtgcagcaggaccagagcggccgcacccatctgccgctgttgaacaatatgctgcaaagcgtggagctggacagcggcggcgtgatcttcgagctgccggagttcgaggtggaacaccacggccagccgctgctgaacggcatgcgccacgcggcggaaatgggcttcggcctggcggtggacgacttcggcgcgctgcccgcccgccgcgacaagatgggcgagctgtccccggacatcatcaagatagaccgcagcctgctgctcgatcacatggccggcgaaaccagccggctgccggcgctgctggaattcggctggcagatcggcagccgcatgctgatcgaaggaatcgaaaccgccgagcagctggaggcgatgcgcgcgctgggcgtcgagctatatcagggctattacctggggcggccgggcgagctggctgtggctcgccagctgtag

SEQ ID NO: 181 - DNA, 765 bp, Chromobacterium substugae
atgctgatcctgaatcaaagacaacaagaactgctggacatggtcaggcgcgacagctatgtcagcgtggagaagctggccgagcatttcgccgtcacccgccagaccatacgccgcgacatcgcgctgctggccgagcaccagcagctgcagcgctaccacggcggcgccagcgtgctatccagcgtggaaaacgtcgcctaccaggcgcgccaggtactgtgcatagaggaaaagcgccgcatcgccgccagcctggttcgccacatcccggacaacgcgtccttgttcatcaatctgggcaccaccaccgaggaagtggccaaggcgctgcaccgccaccgcggcctcagggtgatcaccaacaatctgcacgtggccgagcagatgtgcgattacccggactgcgaagtcatcgtgctgggcggctcgctgaggaaacgcgaccgcggcctgaccggcgaggcgacagtgcagatgatccgccagttccgcgtcgactacggcatcatcggcgtgtccagcatcgaatccgacggcacgctgcgcgactacgactaccgcgaagtgcgcaccaccgaggccatcatccagcagtcgcgccaggtgttcctggcggccgaccacagcaagttcgaccgcccggcgctggtggagctgggccggctgaaccagatcgccgcgctgttcaccgacaagccggtgccgccggccatcgcccggctgatgcaggaggccggcacccagctgcacatcgcggaatga

SEQ ID NO: 182 - DNA, 1092 bp, Chromobacterium substugae
atggacagaatcgataccgtggtggtcggcgccggcgtggtgggcctggccgtcgccaaggcgctggccgagaacggccgcgaagtggtaatcgtggaggcggagcaggcgataggccagcacgcgtccagccgcaacagcgaggtgatccacgccggcctgtactacccggccggcagcctgaaggcgaagctgtgcctggccggccgcgacgcgctgtaccgctactgcgccgagcgcgccataccgcaccagcggctgggcaagctgatcgtcgccagccatgccgggcaattggccaaactggccgcgctggagaagcaagcgcgcgccaacggcgtggccgacatccagcggctgacggcggacgaggcccgcgcgctggagccggcgctggattgcgccgccgcgctgctgtcgccgtctaccggcatcgtcgacagccacgcgctgatgctggcgctgctgggcgacgccgaggcggccggcgcgcagctggcgctggaatcgccactggagagcggcgagattacgccggacggcatcgtattgcgcgtcgccggcatggaaatcctggccagccgggtagtcaacgccgccggcctgttcgcgccggatgtcgcccgcgccctcgcgggcctgccgccggaggccatcccccaagcccattacgcgcgcggcgtgtatttctcgctgcagggccgcgcgccgttctcgcggctgatctacccgctgccggaagccggcggcctgggcagccacctgacgctggacctctccggccaggcgcgcttcggcccggatgtggaatggctggacggcgtcgattaccgggtggacccggcgcgggcggaagccttctaccgcgcggtgcgcgcctggtggccgcaactgccggacggcgcgctgtcgcccggctacgccggcatccgcgccaagatcgccggccccggccagccggacgccgacttcatcatccaggggccggcagtccacggcgcgaagggactggtcaacctgttcggcatcgaatcgccgggcctgaccagctgcctcgccatcgccgacgcggcgcgagcgctgatcgattag

SEQ ID NO: 183 - DNA, 519 bp, Chromobacterium substugae
atgctgattgccgatctcgtcatccgcccggcccgaagcgccgatttttcccgcctggccgagatagaaagcctggccgcgcggctgttctctccggccgacctgcccttggcgctgcgcgcgcgcacgctgcccgaggcggcgctgcgcgcggccgccgacgccggcctgctatggacggcggagcaagacggccgcgccgtcggcttcgccatggccgaaatcgtcgacggccagctgcatctggccgaaatggacgtcgacccggcgcacgcgcgccgcggcatcggcgccgcgctgctggcgcaagtcgccgcccacggcgaaggcgccggcttcgccgccgtcacgctgaccacctttgcccacctgccgtggaacgcgccgttttaccaccgccacggctacgccgagcacgcgccggcggccggctcggcgctggccgcgcggctggcggcggaaagcgcagccggcctgcggcagcgcatcgccatgcgccgcgcgctgcgcccggcctga

SEQ ID NO: 184 - DNA, 1425 bp, Chromobacterium substugae
atgccgcaataccaggacatcgcccgccaactgcaaacccggctcgacgccggcgagtttccgcccggcagccggctgccctcggtgcgccagctagctgaaaaccatggcgtcaacagcctgaccgcgctggccgcctaccgctggctggaacagcggcagcgggtggtggcgcggccgcgcgccggcttcttcgccgcgctgccgccggcctcggccgccggcaagccggacaaggcgctgccctcgccggccacgctggtggaggtggacagccgcatgtcgcagctggtggccttatccgcctccaatgtggcggtgcagctgcacatggccgaagcccaccactgtttgtacccgtcggcggagctggcgcgccggctgcaaaacgcgttgcagcagcggccggagctgatcggcgcctatctgccggccagccagcacgaccggctatgcgagcaactgcgccagctggccgccggctggcagttggcgataccgtcggacgaaatcctgttctgcaacggcatcaccgaaggcatcagcctggcgctgcgccacctggcccgccccggcgacacggtggcggtggagacgccggtgtacttcggcctgctgcagacgctggcggcgctggggctgaaggcgctggagattccctgcacgccggacgccggcctgtcgctggaggcgctggagttcgcgctgcaatacggcccgccggtgcgctgcctggtgacggtgaccaattaccagaatcccaccggcgccttgatgccggacgacaataaaaaacggctgctggcgctggcgcgccgccacggcgtggccattatcgaggatgacgtgttcggcgagctgcatttcgacgaggcgcggccgacgccgctgaaagcctgggaccgcgacggcgacgtgatctactgcgcgtcgttcaccaagagcctggcgccgtcgttccggctgggctggctgtccggcggccgccgccacgccgcgctggagcggctgcgcgccagcagcagcctggtcagcccggcgctgctcttgggcacgctgagcgacctgttggccagcggcgactacgcccgcatcagccagcgcctgcgcagccagctggccaggcagatggagcaagtggccgacgcggtgctggcggcctttccgcgcggcacccggctgcggcggccgcaaggcggactattgctgtgggtggaaggaccggagggcctggacagcggccggctgctggaggcggcgctgcgagaatcgatcagcttcgcccccggcatgctgttctctgccgagccgcgctttcgccactgcctgcggctgaacttcggccagccctgggacgcggcgcaacaacaggccatcgcccggctggggcaactggccgccgaacaattgaggagcccatgctga

SEQ ID NO: 185 - DNA, 330 bp, Chromobacterium substugae
atgcagctgagcggcattcccttcggcgtcaccgactgggcggatattcccgccgccgaacaccctggcgaacaaggccgcgcctactggcgcagccgccagttcggcgacatccgggtgcggatggtggaatacacgccgggctacctggccgaccactggtgcgagaagggccatatcctgctgtgcctggagggcgaactgcacaccgaactggacgatggccgcgtcttcatcctcaagcccggcatgagctaccaggtggcggaccacgccgaggcccatcgttcccgcgcgccgcaaggcgccaagctgttcatcgtcgactaa

SEQ ID NO: 186 - DNA, 1206 bp, Chromobacterium substugae
atgtggcaaaccttgcggcgcgacgctgccccctccgccttgctggccgccgttctggcgctgttggtcggcttttccggcccgtttctgatcatcgtccatgccgcgcagtcggccgggctgtcgcaggcgcagctggcgtcctgggtgtgggcggtgtccatcggctccggcgtggccgggctgtggctgagcctgcgttggaaaacgccggtgatcgccgcctggagcacgccgggcgcggcgctgctgctggccggcctgcccggcgtgccgtatccggaggcggtgggcgccttcctcgccgccgccgccatcgtcacgctggtgggcgcgagcggcttgttcgaccggctgatggcgctgttcccgccggcgctggcggcggccctgctggccggcatcctgtttcatttcgtcggcgaagtggtggccgaggcggccggccatctgggcctggtgctgacgatggcggggctgttcttcatcggccgccgctggtttccgcgctgggggctgctggccgccatcgccgccggcgcggccttgtcggcgggcgagctgcacgcgccggctgccagcgccctgtccatcgtcgcggtgccgctgttcacctggccggcgtggtcatggtccgctttcatcaacctggccctgccgctggcgctattggcgctgaccagccagttcctgcccggcatggcggtgctgcgcgccttcggctaccaggtgccggcgcgctcgccggtgaccgcgctgggcttggcctcggtgctcaccgcgccgttcggcggccatggcgtcacgctggccgccatcatcgccgccatctgcaccgggccggaggcgcatccggaccgcagccgccgctatgtggccggcgtgttctgcgggctgatctacatcgtcatgggcgcgctgggcggcgcgctggcggcgctggcgctggccctgcccaaggcgctgctggtgaccgcggccggcctggcgctgttcggcacgctggcgtcgtcgctgggcgcggcgctggccgatgccgagcatagggagtcggcgctgctcaccttcgtggtggcggcttccggcgtcagcttcgccggcctgggcgcgcccttgtgggcgatgctggccggcggcctgctgtgccggctgttgactccgggcaagtccccggcgcaaaaggcggaaacggcggcggcgcgctag

SEQ ID NO: 187 - DNA, 1389 bp, Chromobacterium substugae
atgttcgccccttccgtctatgcccagcgccgcgcccgtctgcaagcttccggcctgtccggcctgctgctgttcgtcggcaacgtcgattcgccgatgaactaccacgacaacaccctgcccttcgtgcaggactccagcttccgctacttcttcggtctgaacgagccgggcctggccggcgccatcgacgccgacagcggcgaagcgacgctgttcggcaatgacccggacgtggccgacatcgtctggaccggcccgctgccgtccctggccgagcgcgccgccaaggtggcgctgtcgcgcagccgtccgtacgccgagctggcccaggcggtggccgaagcccgcgccgccggccgtccggtgcgctacctggcgccttaccgcggcgagacgctgatcgagatgggccgcctgctggacacccatccggcgcaggtgaaggcgggcttctgtcccgagctgacccgcgcggtggtggcgctgcgcgagatcaagggcgcggaagagatcgccgagatggaagccgcgctgggcgtcacccacgcgatgcacatcgccgcgatgcagaacgccaagcccggcgtggtggaataccaggtggtgggcatcatggaaggcatcatgcgccgccatgactggcagctggcctacccgtccatcttctccaagcgcggcgaagtgctgcacaatcaccaccacgaccacgtgctgcagcagggcgacctggtgctgaacgacaccggctgcgccagcggcggcggctacgccagcgacatcacccgcactttcccggtgggcggcaagttctccacccgccagcgcgagctgtacgacatcgtgctggagatgcaggaggccgccatcgccgcggtcaagccgggcgtcaaataccaggacatccacaagctgtccgccgcggtgatggtggagcggatggccgcgctgggcttcttccagggcgacgtcgacgccatcgtcgaatccggcgcctacgccatcgccttcccgcacggcctgggccaccagatcggcatggacgtgcatgatatggaagcgctgggcgaagacctggtgggctatggcgacggcaccgagcgcagcaagctgttcggcctgggctacctgcgcctgggcaagacgctgaaggccggcatggcgctgacggtggagccgggcgtctacttcatcccggcgctgatcgaagcctgggagaaggaaggccgccacagccagttcatcaactacgccaagttccgcgaatacgccgacttcggcggcatccgcatcgaggacaacgtgctggtgaccgaaaccggcagccgcgtgctgggcgagccgatcccgaagacggtggacgaagtggaagcggtgatggccgtataa

SEQ ID NO: 188 - DNA, 855 bp, Chromobacterium substugae
atgacgccagtctatttcgcgccggccgccatgacccacccgccgctccctgcgctccatccgccgccgcccggcctggccgcgctgttgggcgacatgctggacatcgcgctgcccggcggcccgctgctgctgccggccaccctgcacccgatgctgctgttcatcgccggcggcgacatccatttggccaaacacggcgcgttggcgccggccggcttgttgggcggcagcgccggcgtcaggctgctggcggcctcgcccggcgcccgcatcctgatggcctggctcaagcctggccaattgccgcgcttgttcggcatcgccgccggcgagatattcgacgcctacctgcccttggacagcctgctgccgccggcttggctgtcgccgcttggcgatgccgttggcgacgactggctcccgccggcgcaggcgctgctgagccgcctggctggccggcacggccagcgcgcgcccacgctggcgctgccggccgactggccccggcgcagcgcggatcagctggccgcgcatttcggcctcagcctccggcagttcgaacgccgcttccgcgccggcgccggccagagtctgcgcgctttccggccgcaggcgcggctgaaccgcttattgctgcatgcccgctggacgccgtcgcccgactgggccgatgtggccgccgccgccggctacgccgaccaggcccatctgcaccgcgatttcgtccgcttcgccggccgcacgccgtcggcctatgtccagggactgggcgacgacccggcgctgcggctgtaccgcttgcccagagaggctattctgcggatgtgcgccgaacccggcctgcgcgcctga

SEQ ID NO: 189 - DNA, 504 bp, Chromobacterium substugae
atgtctgtccatcacgatttttccgccattccgccgctaaccgacgccgccagccgctatccctggcaagactgctgcagcgtcccgctgccgcccgatgcgccggcggccgacgccgccgacttgttgcgcgccttttcccgcgcgatgccgccctgggcccgcgcgctgatgcggctgcgcgaccggctggtgtcgccgctgggcctgaagattgaccaaaccaaccacactggcggggcgccggtcgagcccttccatgtcggccagcaactgggcgtgttccgcgtgctgtacctgggcgagcgcgacgcggtgctgggcgaggacgaccgccatctggatttccggctggtgttgcagtggcggccggggcgtttgcatgtgagcacgctggtgcggccgcataatggcttggggaggacgtatctggcgctggtgacgccgtttcatcatcttattgtggccgcgagcatgaagagaatggccgaggcattggggtga

SEQ ID NO: 190 - DNA, 627 bp, Chromobacterium substugae
atggatgctttgactgtactgcgccagggcccggtggttccggtgatcatcgtcaacgacgccgcggtggcggtggacctggcccgcgcgctggtggacggcggcatcaaggtgctggaagtgacgctgcgcaccaaggcggcgctggcggcgatgcgccgcatgcgcgacgaagtgccggaagccatcgtcggcgccggcacgctgcgcaaccgcgcccagctggaagcggcggtggacgccggcgcgcagttcggcatcagccccggcttctccgccgagctggcctcggcggcgcgcgcgtcgcagctgacgctgatccccggcatcgccaccccgtccgaagcgatgtgggcgcaagacgaaggcttcaacacgctgaagctgttcccggccgaggcggtgggcggcgtcaagctgctgaagtcgctggccagccccttcccggacctgcgcttctgcccgaccggcggcatcgacatcaagaaagcgccggaatacctggcgctgccgaacgtgctggccgtgggcggcagctggctgacgccggacgacgccatcgccgcccgcgactggggccgcatcacccagctggcgcgcgaagcgacccaactggcgcgcggctaa

SEQ ID NO: 191 - DNA, 1833 bp, Chromobacterium substugae
atggccttgcatcccaccctgtccgccgttaccgaccgcatcgtccagcgcagccaagcgcgccgcagcgcctatctcgcgcgcgcgcgcgccgccgcccagcagggccgggtggagcgggcccatttgtcgtgcaccaatctggcccacgccttcgcggcgatgccggacaatatgaaaatccatctgaaggaagagcaccgccccaatctggcgattgtgtcttcctacaacgacatgctgtcggcccaccagccgctgcaggccttcccggcctggctgaaagaagccgcgctggcggccggcgccaccgcccaattcgccggcggcgtgccggcgatgtgcgacggcgtcacccagggccaggccggcatggagctgtcgctgttcagccgcgacgtcatcgccatgagcaccgcggtggcgctgagccaccagatgttcgacgccgcgctctacctgggcgtgtgcgacaagatcgtgcccggcctgatgataggcgcgctgaccttcggccacctgccggcgctgttcgtcccggccggtccgatgaccaccggcatcgccaacgacgacaaggccaaggtgcgccagctgtacgccgagggcaaggtgggccgcgacgcgctgctggaatcggagtgccagtcctaccatggccccggcacctgtaccttctacggcaccgccaactccaaccagatgctgatggagatcatgggcctgcacctgccgggcgccgccttcgtcaaccctaacaccgcgctgcgcgaggcgctgacccgcgccgccgccgtccaggccgccaagatcgccgcccagggcgagcagttcaccccggtgggcgagatgatcgatgagaaatccatcgtcaacgccatcgtcggcctgctggccaccggcggctccaccaaccacaccatgcacatcgtcgccatcgcccgcgccgccggcatcgacatcaactgggacgatttcgacgaactgtcggccgtcatcccgctgctggtgcgcgcctaccccaacggcaaggccgacgtgaaccacttccacgccgccggcggcatgggcttcgtgatccgcgaactgctggccgccggcctgctgcacgaagacgtgggcacggtgatgggccgcggcctgtcgcattacacccgtgagccgtggctggacaacggcgagctgaaatggcgcgacgcgccggcggtaagcggcgacgacagcgtgctgcgcccggcttccaacccgttctccgccgacggcggcctgaagctgatggccggcaatatcggccgcgcggtgatcaaggtgtcggcggtgaagccggaacaccgcgtggtggaagcgccggcggtagtgttccacgaccagaacgacatgctggcggcgttcaagcgcggcgagctggaaaaagacttcgtcgcggtgatccgcttccagggcccgcgcgccaacggcatgccggagctgcacaagctgaccccggcgctgaccatcctgcaggagcgcggcttcaaggtggcgctggtgaccgacggccgcatgtccggcgcgtccggcaaggtgccggccgccatccacgtgtcgccggaagcgctatccggcggcgccatcggcaaggtgcgcgacggcgacctgatccgcgtcgacgcgcataccggcgagctggccgcgctggtgaacgccgccgaatgggcggcgcgcgaacaggttcaggccgatctgtcgcacaatgaatacggcatgggccgcgagttgttcgccggcttccgccacacggccgacgaagccgaggccggcgcgatgagcttccgccacccggcctggaactga

SEQ ID NO: 192 - DNA, 1479 bp, Chromobacterium substugae
atggagacccgttctacccctaccccggccttcgacatggtgctgttcggcggcgccggcgatctggtgatgcgcaagctgctgccctcgctgtaccaggcgcacgccgccggcctgctcaacgagcagggccgcatcctggcgctgggccgcaaggacctgagccgcgacgactacctggcttccgtcgagaaacaatcccgcatccacatcaagagccacttcgatgacgccgcctggcaaagcttctgcgcccgcatcgactacctgaaggtggacgcctcgcaggcggccgactttccggcgctggcggaaaaagtcggcgacgacagcggcaaggtggtggtctgttacctggccaccgcgcccaatctgttcgccggcatttgcgacaacttggcggcggtggggttgaaccgccccaatgtgcgggtggtgctggaaaagccgctgggcaccgatctggagtcgtccaacgagatcaacgacgatgtcgcgcgcttcttcaaggaagagcagctgtaccggatcgaccactacctgggcaaggagtcggtgcagaacctgatggcgatccgcttcgccaacgcgctgttcgagccgctgtggcgccgcgaatggatacacgacgtgcagatcaccatctccgaggagctgggggtgggcagccgcggcgatttctacgacggcaccggcgcgctgcgcgacatggtgcaaaaccacctgctgcagctgctgtgcatcgtggcgatggagccgccggccaatatggaagccgacgcggtgcgcgacgagaagctgaaggtgctgaaggcgctgcggccgttcagcgagcaggacgtcgccgccaaaaccgtgcgcggccagtacaaggccggcgccatcggcggccagccggtggtcggctaccaggacgagaacggcatcccggccggcagccagactgaaaccttcgtcgccctcaaggccgagatcgacaactggcgctgggccggcgtgcccttcttcctgcgcaccggcaagcggatgcaggagcggctggccgaaatcgtcatcaatttccgcgacgtgccgcaccagctgttcaccggcccgatgggcggcagccacaccgccaaccggctggtgatccgcctgcagccggaggaaagcatccgcctgtacttcctggccaaggagcccggcgacaccatgcgcctgcagccggcctacctggacctggacttctacaaggccttcaaggtgcgccgcgccgacgcctacgagcgcctgctgctggacgtgatccgcggcaagctggcgctgttcatgcgccgcgacgagctgatcgaagcctggcgctgggtggagccgatcatggatacctggagccgcagcaacaacgccccgcccaagcagtacaccgccggcagctggggcccggcggcctccagcgcgctgctgtcgcgcgacggcataggctggcacgaggagtgttaa

SEQ ID NO: 193 - DNA, 678 bp, Chromobacterium substugae
atgaactggttggaattccccgacgccgcgcagcaaaccgacgcgctggccaacagcgtggcttcgcggctgtccgccgcgatagccagccgcggccaggcggtgctggcggtgtccggcggcaagtcgccgatcccgtttttccagctgctcagcgaaatggcgatagactggtcgcgcgtcaccgtcaccctggtggacgaacgcttcgtcgcgccggaccacccggacagcaacgccggcctggtgcggcaacacctgctgcgaaaccgcgccgcgccggcgcgcttcttgccgctggtgcgcgccgccgccgacatcgacgccgaagtggcggccgattgccatgaattcatcgcgcccgacgtcgcggtgctgggcatgggcgaggacggccacaccgcctcgctgttccccgccgccgccgaactggccgccggcctcgacccggcaggcagccgcccgctgctggcggtgacgccgccggccgcgccgcaccgccgcgtgtcgatgagctacgccgcgctgctgcaggccggctgcctgatcctgtcgatccagggcgcgaaaaagcgcgaggtgctggaagccgccgcccgcggccgcgacgacgcgctgccgatcagccatttcctggcccaggacaaggcgccgctcgatgtctactggtctgcctga

SEQ ID NO: 194 - DNA, 1047 bp, Chromobacterium substugae
atgtctactggtctgcctgaagcctggccgcggctgctggccgacatcggcggcagcaacgcccgcttcgcgctggaaaccggccccggggtgatagaagacatcctggtgctggccaacgcgcagtacccgacgctggaagacgcgctgaaaagctatctggcccaggtgggcgcgcgccgcgtcgcccacgccgccatcgccatcgccaatccgctgaacggcgactgggtggcgatgaccaactgccactgggcgttttcgatcgaggccacccgccaggcgctgggcttcgccaccttgctgctgctcaacgatttcaccgcgctggcgctggccctgcccgggctgccgcgcgccgagctggagcagataggcgtcggcgcggcccgcgccgacgcgccgctggcgctgatcggccccggcaccggcctcggcatgtcggcgctggtgccgcatgccggcggctggcgcgcgctgtccggcgaaggcggccacgcctcgttcgcgccggccgacgagcgcgaagccggcatctggcgctacgccgccgcgcgcttcggccatgtctcctatgagcggctgctgtccggccccggcctggaattgctataccaggcgctgagcgcgcgcgacggcgaaagcgccgagccgcgcggcgcggccgaaatcagcgcgctgggcttgtcggcgcgctgcctgcgctgccgcgaagcgctggaaatcttctgcggcatcctcggttcggcggccggaaacctggccttgaccctcggtgcccatggcggggtatatataggtggtggtattgtgccgcgtctgagcggtttttttgaacaatccccatttcgccgccgtttcgaggacaagggacggatgtcggcctatctcgccgccatcccggtttatctgattaccagcgcctacccggccctgccgggcgtggccgcccatctggcggcccatctggcgtcgcgcagcgaccatgccccggtggatgcctccacccctcctcgaggcggctttgcaggagacatgcatgcttga

SEQ ID NO: 195 - DNA, 849 bp, Chromobacterium substugae
atgcttgatcgcatccgaggccaactggagacgctgtcttcggccgagcgcaaggtggccgagctggtgctggaacaaccctacaccgtgatccaggccgcggtggccgacatcgcgcgcaacgccggcgtcagccagcccaccgtgatccgtttctgccgcaccgtcggttgctccggcctgcccgacttcaagctgaagctggccggcagcctggtgaccggcgtgccctacgtccactccagcgtgcgtccggaggacccgacctcggaaatcgtcgccaaggtgttcgacaacaccgtgtcggcgctgctcaagtgccgcaacgacgtcaatccgcaggcgatagaagccgcggtgcggctgctgaccgacgccaaccgcatcgaattctacggcctgggcaactccggcatcatcgccgccgacgcccagcacaaattcttccgcttcggcattcccaccgtcgcctattccgacacccacatccagatgatggcggcgtcggtgctggggccggaggatgtgctggtggccatttccagctccggccgcaccatggagctcttggaagcggtggacgtggccatcgccgccggcgccaaggtgatcgcgctgaccaccagcggctcgccgttggcgcgccgcgccacggtgtccttgatcgccgacacgctggaagacaatgaaacctatagcccgatgatctcgcgcatcgtgcacctggtgcagatcgacatcctggcggtgagcgtggcgctgcgccgcggcccgggcctgatccgccagctggaaaagaccaagcacagcctgaagaaccgcaggctggacaatagacaaccggaatag

SEQ ID NO: 196 - DNA, 1644 bp, Chromobacterium substugae
atgagtgaactgaccgaactgccggcctggcaggccctgtgggaccatttcgccgaggccaggcacctgcacatgcgcgagctgttcgccgccgatccggagcgggccgagcgctattcgctggaagtgggcggcctgttcctcgactattccaagaaccgcatcaccgacgccaccttgctgggcctgatgcagctggcgcgcgaagccggcctgccggccaagatcaaggcgatgttcaagggcgagaagatcaaccgcaccgagaaccgcgcggtcctgcacgcggcgctgcgcaaccgcaccaactcgccgatcctggtcgacggcgaggacgtgatgccgaaggtgaactcggtgctggagcggatgggccggttttcccacgcggtgcgctccggcgactggctgggctacaccaatcagccgatcaccgacatcgtcaacatcggcatcggcggctccgacctcggcccgctgatggtctgtagcgcgctgaagcccttcggccatccgcggctgaacatgcacttcgtctccaacgtcgacggcgcgcagctgaaggaaacgctgaagaaggtgcatccggagaccacgctgttcgtggtggagtccaagaccttcaccacccaggagacgctgaccaacgcgctgaccgcgcgcgagtggttcgtggcgcgcgcgcgcgacgaaaaggcggtggccaagcacttcgtcgcggtgtccaccaaccagaaggcggtggccgacttcggcatcgacccggccaatatgttcgaattctgggactgggtgggcggccgctacagcctgtggtcggccatcggcctgcccatcatgctgtacctgggcgaggagaacttcaccgagctcctcaacggcgcccacatcatggaccagcatttcaagaacgcgccgttcgagcagaacatgccggtgctgctggcgatgataggcgtctggtacatcaactactacggcggcggctcgcacgtaatcgcgccgtacgaccagtacctgcaccggctgccggccttcatccagcagctggacatggagtccaacggcaagaagaccatgctggacggccagccggtcaatttcgagaccgcgccgatcatctggggcgaaaccggcatcaacggccagcacgccttcttccagctgttgcaccagggcacccacatttcgccgatcgacctgatcgcctcgctggaaaaccgttccagcctgccgggccaccacgagatcctgctggccaacgtgttcgcccaggccgaggccttcatgcgcggcaagaccgccgacgaggcgcgcgccgaactggccgagcagggcctgaagggcgaggcgctggacgaattggtgccgcacaaggtgttcgacggcaaccgcccgaccaacaccctgctgatgagccggctggacccgcgcaacctgggttcattgatcgcgctgtacgagcacaagatcttcgtccagggcgtgatctggcacatcaacagcttcgaccaatggggcgtggagctgggcaagcagctggccaagaccattcacggcgagctgaccggcaagctgccgctggcggcgcacgacagctccaccagccggctgatccagctgtaccgcaaggccaacgcctga

SEQ ID NO: 197 - DNA, 120 bp, Chromobacterium substugae
ttgtttgcctggcgccacagtcgggatttccccgattgtcggacaggatgccggctgctgaaatggcgggccaagtcagacaaaaacaacggactgaagaagaatcatcgggatgtgtaa

SEQ ID NO: 198 - DNA, 354 bp, Chromobacterium substugae
ttgctggccggcgtcctgctggctttcagcctggccggccatggcgccggccagcctgtccacccggccggcgacgccgccgctcccatcattctcagcggcaccgtggtcgggccgctgcacaccggcagcaaggccgagggcacgtttttccaggcttatcacctgaagctggcgcggccgctgcgcttcgacgacggcgcggcttgcggcggccagcgcctgtccagcctggcgctgagccagccgggcatggcccgcttcaagggccgcgcggtccgaatccaggcgcgggtgttctgccaggaagaccgcggcgccacctaccggctggcggatatcagcctgctgtag

SEQ ID NO: 199 - DNA, 573 bp, Chromobacterium substugae
gtgaagatcgagtccaaatccgcattcacttcccggaaaaagctgaatttcggcccgctgaccctgtatcgggtcagggacgcgcgcggcgcgatcaatctggtcgtatccggcaatccgggctacagcgtcggccaatgcgtgaccttgtggcgttccgtctcgggcgcgcagtgggagatgtaccatgactacagcaacgcctaccccaggttgacccgggccaatggcgattgctcggcgttgaagattgagcccagcggcaacgagcgctattactacacccagtacgactggaactggaatcagatcgagaccttcatccgcgacatccagctgggcaggaccgaggccgagctcctgtcggagctgggcgcgccagatgccagctacgtcaacggcaaaaccacttacctgagctacacccgcgcctcgacatccgtctacggcgacgtgcaaaacggctccggcggcttcagcagccggcagaacttctgcaaacgcacgttcatggtgcaggccgggatcatcgtcaattacacgctggaaggcaacgactgccgcctgaaatga

SEQ ID NO: 200 - DNA, 627 bp, Chromobacterium substugae
atggcaaaccggattgaggggctgtacgcggtcacgcccgacggctgcgacagcgaaaggctgctggaactggcggcggcggcgctggagggcggcgcgcgggtgctgcaataccgcgacaagagccgcgacccggcgcgccggctgtggcaggccaatctgctggccagcctgtgccgcggccgcggcgccgccttcatcgtcaacgacgacatcgaactggcgctggcgaccggggcggacggcatccacctgggccgcgacgacggcgacatcgccgccgcgcgcgcgcggctggggccggcggccatcataggcgcgtcctgctacgaccagttggagctggcgcggcgggcggcggcggccggcgccagctacgtcgccttcggcgcggtgtttccgtcgcagaccaagcccggcgcggcggccgcgccgctgtcgctgttcgccgaggcggccgcgctgcggctgccgcgggtggcgataggcggcatcaccgccgccaacgccggccaggccatccaggccggcgccgacgccatcgcggtgataggcggcctgttcgaccagctggacccggccgcggcggcgcgggagctggcggcgatgttcccgcaaccggcgtaa

SEQ ID NO: 201 - DNA, 819 bp, Chromobacterium substugae
gtggtactgaccctggccggttccgacccctccggcggcgccggcatccaggccgacatcctgacgctggccagcctgggctgccatccgctgtcggtgatcaccgccatcacggtgcaggacaccgtcggcgtcaacgacctgatggtgctggacgcggactgggtcaacgaccaggcccgcttcctgatggaagacatgccggtggccgcgttcaagatcggcatgctgggcagcgtggaaaacgtcgccgtggtggcgcagctgctagccgactaccccgacatcccggtggtgctggacccggtgctggccagcggcggcggccacgaactggccgacgaggacttgataggcgcgatgcgcgacatactgattccgcaggtgtcgatcctgacgcccaacagcctggaggcccgccggctggccagcaacgacccggacgacgacgaagaactgacgctggaccagtgcgccgagcgcatcctggcgctgggctgcccctatctgttgataaccggtacccacgaaaataccaaggaagtcgtcaacagcctgtacagcccggacggcgtggtgcgcgccgaccactgggagcggctgcccggcagctatcacggctccggctgcacgctggcgtccgccatcgccggcatgctggccaccggcctgctgctgccggaagcggtgcgcgaggcgcaggaatacacctaccagaccctgctcaacggcttccgccccggcatgggccaattcctgcccgaccgcatgttctgggcgcgcggcgacgacgaggacggcgatggcaaaccggattga

SEQ ID NO: 202 - DNA, 198 bp, Chromobacterium substugae
atgttcattttatccgaacacgagggcgaagcgatgcgtacttggatgtgtctgatctgcggtttcatctacgacgaggaagccggccggccggaagacggcatcccgcccggcacccgctgggaagacctgccgcccaactggacctgtcccgattgcgacgcgcgcaaggacgatttccagatggtggagatctga

SEQ ID NO: 203 - DNA, 348 bp, Chromobacterium substugae
atggtcctgtccgccgccttcctcgacgacatgctgggctacgcccgcgggctgcccggcgccgttttcgacgtcaaatggggcggcgtgcgggtggtgtcgatcggcggcaagatgttcctggcctgcggcggcgacggcctgagctacaaggtggccgacgacgacttcctgacgctgtccggcctgcccggcgcgcggccggcgccttacctggcgcgggcgcgctggatccaggtgttgtccaccgaggcgctgtcgccggacgacatccgcgcgggcatcgcccgctcgcgcgaactggcgctgagcaagctgcccaaaagccagcgcctggcctggcaatga

SEQ ID NO: 204 - DNA, 417 bp, Chromobacterium substugae
atgagttatctgtatctgaaagccttccatatctttttcgtggtgtcctggttcgccgggctgttctacctgccgcgcatcttcgtcaacctggcgatggcgcagcagccggcggaatacgaccgcctgctgcagatggcgcgcaagctgttccgcttcatgacgccgctggcggtgctggcggtgggcaccggcctcgcgctgtggctggatttcggcatcggcggcggttggctgcacgccaagatggcgctggtgggcgtgctggcggcgtatcacggctattgcgccaagctgggccgcgacttcctcacccacagcaaccgcaagagccatgtctggttccgcgtgttcaacgagctgccggtgctggtgttgctggcggtggtgatcctggtggtggtcaagccgttctga

SEQ ID NO: 205 - DNA, 456 bp, Chromobacterium substugae
atgaggcgcgcatggtttgccgggccgttgctggccggctggctggttcaggccgccgccgcggccgctttgccgccggcgctgctgctgagcgtggagcgcgacggcgaagtcgtgcggcaactgccgctgtgcctggccgccgacggcggcttcggcgccgatcagcagcgcgacggcgcggcgctggaggtgagcggccggctgcaggcgctgcgcaaccatccgcacccgctgctcagcttccggctgagctggcgcgacgaggccggcgcgcaacagctggacagccagctggcgctggagggcggccgccagctgctgggcggcttgccgctgctggtctacccctatggccatgcgcccggcgtggagccgcagcgcagcagcctcactttttacctggagccgcaggcggcttgcccgccggctgcgccggccaaaacaaaggaatga

SEQ ID NO: 206 - DNA, 462 bp, Chromobacterium substugae
atgggactggaaatcgaacgccgcttcgtggtgagcggcgacgcctggcgcggcctggcgccggcggtgcagtaccgccagggctatctgtcggtggagaaggagcgcaccgtgcgcgtgcgcgtggtgggccagcaagcctggctgacgctgaaaggcaatatcagcgatgtcagccgccatgagttcgaatacccgattccgctggccgacgcccagaccatcatggcggcgatgtgcccgatggtggtggacaagctgcgccaccgcatcgagcacggcggcttcgtctgggaagtggacgaattcttcggcgacaacgccggcctggtgctggccgagatcgagctgcctagcgaggacacgccgttcgccaagccggcgtgggtgggcgaggaagtcacccatgacggccgctacaccaacgcctatctgtccaagcagccctacacgcgctggtag

SEQ ID NO: 207 - DNA, 366 bp, Chromobacterium substugae
atggccaagttggctcgttggggtctgttttcgctgtttggcatctatgccttgatctccccgctttattttcgtcaggtctttcatctgaccgatctcggggcgatgtcggtgctgatgctggcgcgggagctgtttttgtacctgctcggttctttgagcttgctgatcgcgatatggcaaagccgctcaagccatgcgcggggcaagttctgctatctggcagccgctttgctgctaggggtgacggcgatcatgatagggctgtcttattatcgggcgatatatatgctgggaggatgctcgattgccgtgatgggctttgggctgagcctggcgcatcgaccggagcatgcgccggcctag

SEQ ID NO: 208 - DNA, 1278 bp, Chromobacterium substugae
atgtcccgcaatctggaactgttcgaacgtggcaagaaagtgatccccggcggcgtcaactcgccggtgcgcgcctttggccaggtcggcggcacgccgcgcttcgtcgcccgcgccgaaggcgcctatttctgggatgccgacggcaaacagtatctggattacgtcggctcctggggcccggccatcgtcggccacgcccatccggaggtggtgaaggcggtgcaggacgccgctgtcggcggcttgtccttcggcgcgccgaccgagggcgaagtggtgatcgccgaggaaatctgcaagctactgccgtcgatcgagcaggtgcggctggtgtcgtccggcaccgaggcgacgatgaccgccatccgcctggcgcgcggcttcaccggccgcgacctgatcgtcaagttcgagggctgctaccacggccattcggacagcctgctggtgaaggccggctccggcctcttgaccttcggcaacccgtcgtcgggcggcgtgccggccgatttcacccaacacacgctggtgctgcagtacaacgatgtcgagcagctgtcgcgcaccttcgccgagatcggcgacaagatcgcctgcgtgatcctggagccgatcgccggcaatatgaacctgatccagccgtcggccgagttcgtcaaaacgctgcgcagcctgaccgagcggcacggcgcggtgctgatctacgacgaggtgatgaccggcttccgcgtggcgctgggctgcgcgcagagcctgcacggcgtcaagcccgacctcaccacgctgggcaaggtggtgggcggcggcatgccgctggcggctttcggcggccgcgccgacatcatgggcaagatcgcgcccctgggcaccgtttaccaggccggcacgctgtccggcaatccgctgtcggtggccgccggcctcgccacgctgaagctgatccagcagcccggcttccacgacaccctgggccggcgcagcgcgcggctggcgcagggcctggccgaagcggcgcggcaggcgggcgtcacgctgtccagcgacagcgtcggcggcatgttcggcttttacttcagcgccgcggcgccgaagtcgcacgccgaagccacccgctgcgacatcgaggccttcaagcgcttcttccacgcgatgctggatgagggcatctacttcgcgccgtcggcctacgaggccggcttcgtctccatcgcccacagcgacgagatgatagagcagaccatcgccgcagccggccgcgccttcgcgcgcatctga

SEQ ID NO: 209 - DNA, 1290 bp, Chromobacterium substugae
atgtggatggaaaggaagaccaggctgcgcctggccgcgggcgcgtgcgcgctggcggccgcgaccctggccgtcggctggctgctgaggggcggcgaccagatcaaagtggaaaggctggcattggcggccgcgcccgggcgcgaactggcggccagcctgatgaaccgggcctacggcagcgagcagcatgacgcgcggcgggattgctggcattacctgcgcgaggacggcggcgactactgcctgcgcccgctggcgctggacagcgccgcgatcggccgcgagcgccggctgtacctgttcgccggcggcggcaaggatggcgcgcgcgacgaggagcgcggcggcatggtcggcgctttcgtcgccgacgccgataccctggcgccgatcgccggcagccgggagctggattttctcaaccagaaggccgccggcccggagcaggtgcagttgctgcaattgtccggagacggttatatgggctggttcgcggccggccgcgccggcgtcgaggagtttccgcagttttacgcgcccaggggcgacgaggtggtggcgataggcggcgaggtattcggccgcgacgccgatgccgtcgccgggctgaagttcgcctaccagctggacagcgcccagcgcggcggccgggtctacccgctgtcgctggtcgtccgcgacggcaaggacaagcagttggccagtttcgatttccgtttcgaccgccgccgctgggaatatgtttgcgccgatgtcgactgccgggtgcgcgccggtctgccgacgcggccggagcgggtggcaaacgcccagcaagcgccggcggccgacgccaacgaagcgctgttcggccgcggccgcaagttgtccgacgccgatctgcgagacgtgctgggccaattgggcatgcgctacgtcgccgaggacggcgcggccggcttcgtcggccagaacggctgcgacgcgccctatccgctggacgcccatttcgagcgcgacggcggccaggagcagctgtgggtgcgcggcggcgacggttgcacttcgggcgcggccggcgcgtcggtctgggtgtttgtccgcggcgacgatggccgcctgcgcgccaatctgggcatgccggccgccgatgtgcgccgcacccgcgacgtgtcggcgggcgtgcatgacctgcgcgtcggctcggccggtttctgcgaccggctgtggcgctggaacggcaaggccttcgtccatctgttgaacattcccacccagagcggcggctgcgacggcgccgatctctag

SEQ ID NO: 210 - DNA, 1326 bp, Chromobacterium substugae
atgggaaacaagaaaaaactcgcgttgctggcaggcggcgcgctattgctgatcgcagtcggcttcggcggctggaaatattggaaagcgcaccaggcggtgcaggtggagcggctggcgctggatggggagcccggaaagcaactggccgacgacatcatggacaagatgtatggccgggacgcgcgcgatggcaagcagggctgctggaacatcgacgccggcaatggcggagaagaaaccgtcgcctactgcatgaagccgttggccttggaccgtgtgcaggcagaaggcgaggagcggctctatctgttcgccggcggcagcttcccggatgccagccatgccgactcgcaggccttggtcggcgctttcgtgatcaatgccaagactcaggaattgatcgccggcgaccgggaattgccctttgccaacggattcgccagcgcgcccagcgaggtgaagctgctgcccttgtcggcgaccggctatatggcctggttcgccgagggcggcgacatgcatcagggaatttccgccagtttcccgcagctgttcgcgcccaagggcaagaaggtggtggagatcagcggcgacttgttcggcaagagcgaaggcatgtcggaggagctgagcttcgactaccggccggacgcgtccaaggccgatgccaaggtctacccgctgttgctgacggtgaaacaggacaaggacaagacggcggccagcttccgtttcgtctttgaccacaaagcgtggcattacgtttgcgccgaccaggcctgccgcaagcaacagggcattccggcatatcaggagccggcggccgacgacgatgacggcgagcagccggcgcagccgccggccgacgccaacgccgccttgttcgacgacggcaacaagctgtccgacgccgacctgaaggacgtgctggcggcgctgggcgcgagctatgtggtcaaggaccaggacaactggggcttcgtcaccgagcaatgccggcagccgttcaagctgagcgcttcctacccgagcgacgaaaaggacagccacaacgaactgtggctggaaggcggcagcgcctgcacctccggcaccaccggccagagcgtgtggctgttcatccgcggcgaagacggccacctgcgcgccaacctgggcgtgccggccagcaagaccgtggtgaccggcgacctcaacaacggccgctacgacctgcgcctgtccggcaacggcttctgcgaagcggtgtggcgctgggatggcagccagtacgcgcatctgaagaacatcgccacccagcccggcggctgcggcggcgagtaa

SEQ ID NO: 211 - DNA, 1341 bp, Chromobacterium substugae
gtgaaattcaacaagaaacactggatcgcgctggcgatcgtcggcgtgctgctgctgggcctgatattcgccgcctaccgcgtgctgcatcagagcaatggccgcgccgagcggctggacctgggcagcgagcagaatcgccggctggccgccgaactgatggacaagctgtacggccatgacgcctacgacggcaaacagcattgctgggccaataacgacagcgacgccgactactgcatgaagcccgtgcagctggaccgcgtcgacagcgccgccggcccgcgcctgtatctgctggccggcgccgacggccacactgtgcaaaccgagaccggcggcctcgatctctggagcgcgctgggcgcggccatcgccaatggcgacagccatgaactgatcgccagcacccggatggtgtccttcatcgacgacgcccgcaaggcgccgtccgatgtccggctgctgcagttgaatggcaagggcgacatgggctggttgctggagggcatgacgagccggcgcggcgagccgctgctgttggccgcgcgcaaggatcagatcgagaatatcggcggcgagctgttcggcaagctgccgagcgatgccgagcagcgtttcgactaccgcgtcgaagccggatccggcgacggctattatcccttgcaactgagcgtcggcggcgacaagcaacgctaccgtttcgtcttcgacgacaagaccggcctgtatcagtgcgccgatgacgactgccgccagcgctggcagagctggtccgacgccggcaatgacacttccgcgcagaacgatgacagcggcgatgagagcgcggcggccacgcagccgccggccgacgccaacgccgccttgttcgacgacggcaacaagctgtccgacgccgatctgaaggacgtgctggccgcgctgggcgcgacctatgtggtcaaggaccaggacacctggggctttgtcaccgagcagtgccggacgccgttccgcctgagcggctcctatggcaagacgcatgacgaggaccacaacgagatctggatccgcggcggcgacagctgcacctccggcgcgaccggccagagcatctggactttcgatcgcgacgacgacggccatctgcgcgtcagcctgggcgtgccggccaccaaggtggtggtggtgaccgacggtccgaacagcccggacgacaatccgcgcaacgacatccgcctgtccggcaacggcttctgcgaatcgctgtggcgctgggacggcaagcagtaccagcggctgcgcaacgaggccacccagcccggcggttgcgaccgcgagccggcggcgcagcagtaa

SEQ ID NO: 212 - DNA, 2733 bp, Chromobacterium substugae
atgactgaagcgcaatcctccacccggctgatctggcggctgcgcctggccgactccggcgtccagctgcaaccactgctgcaaagcgccggccccgacggctggagccgcggccgcgcctgcgcgctggccggcctgctgcgggacgaggcggcggcggtgcgtccgcacgatctgcccttgctgaaaccgttgctggcgctgtggcaggcgcatgacggcgatgccggcctgatcgacgccgcgcccttgctgccggccttggtcgaccatccgctgttgttcgacgccgacgcgccggcgcggcgcatccgcgtcgaagccggccagccggcgctgcagatggagcgtgtcggcgcggagttgcggctgaagctgctgccggaaggcctggccggctgtggcggcgtgttgtggcggcggccgcagccggagcggctgctggtctaccaattgaccgatgagttgaaggcgctggccgatctggtcggccacggcctgaccgtgccgtggcaggcgcggcagcgggtgctggaggcgatacgcgacgtcgcgcccggcttgcccttggtggacgccagcccgcaattcgacgcggcgctgccgagcgaggcggccgatgccacgttatacgccttgttgacccggcaaccggaaggcttgcggctgcagctgaaggtcaagccgcatccggcggccgcctggagcgcgccgggccgcggcgcggccgggctggtgctggacgtcgacggcgaatacaggcagttcatccgcgatctggccgacgaggctgcccggctgcgcgcgctgcgcgaggcctgcccggcgataggccgcggccagcgcgacggcgacggctggctgttttcagaccagcactcggccttgtccttgctggcgcagttgcaggcggccggcgaggagcgcgtcgcctgcctgtggccgcacggcgacaaaatccgcctggccgccgccgacggcatgccgcagctcaagctgaaagtgaagcggcgcggcggctggctgcaggcagacggcgaactggagctggatgatggccgcatcctgacgctgcgccacctgctggcggcgctggccaaccaaaagggcaagtatctgcagctgtccgacggcgactggctggccttgtccggcagtctgggcgaacgcttgggcgagctggcgcggatggtggaccacgccgggccggacggtttggcgatcagcccgctggccgggccgcgcttgcaggcgctgggcgaggaggctgggcagttcgacggcgacgacggctggcagcgacaggcggcgcgctggcgcgaggcggctgttttcgatccccaggtcccggcgacgctgaacgccacgctgcggccttaccagctgcaaggctttgcctggatggctaggctggcgcattggggcatgggggcgtgcctggccgacgacatgggcctgggcaagacggtgcagacgctgtcgctgctgctgacccgcgcccatctgggtccgcagctggcggtggcgccgacctcggtggcgctgaactggctggccgagaccgcccgtttcgcgcccagcctgcgtttgcgcgcctatcatcaacaacggcgattggacgatatcgggccgggcgacctggtggtggtcagctatggcctgctgcagcgcgaggccgaggcgtttggcgacgtgcattgggcgtcggtggtgctggacgaggcgcaggcgatcaagaacccgcaaagccagcgcgcccaggtggcgcaaagcctgcgcgccgatttccgcctggcagccagcggcacgccggtggaaaaccacctgggcgagttgtggagcctgttccgcttcatcgcgccgggtttgctcggcaacctggcgcagttcgagcagcgctacgcccagccgatcgccgacggcgacgaggccgcccgcgcgcagctgaaggcgttgatccagccctatctcttgcgccgcaccaagcgcgaggtgctgaccgagctgccgccgaagaccgagaccacgcggctgatcgagttgtccgagccggagcgccacgtctacgaggcgatgcggcaggaggccttggcccgcgtggccgaggctgatcccgcagccggcggccagcccatgcaggcgctggccgagctgacccggctgcggcgcttctgctgccatcccaagctggtacagccggacagcgcgctgccggccagcaagctggcggccttcgccgacatttgcgaggaactgctggacaacggccacaaggcgctggtgttcagccagttcgtcgatcatctggcgctggcggccgagcacctgcggcagcaaggcgtccgcttccattatctggatggcagcacgccgaccaagcagcgcaaggccagcatggacgccttccaggccggcgacggcgatctgttcctgatcagcctgaaagccggcggcaccggcctcaacctgacggccgccgattacgtgattcatctggatccgtggtggaacccggcggtggaggaccaggcgtccgaccgcgcctaccggatgggccagcggcggccggtgacggtgtaccggctggtggcggccggcaccatcgaagagaaaatcgtcgaattgcaccgcgacaaacgggccttggccgacagcctgctggccggcgccgacatcagcgcccggctggacggcgaggccttgctggcgctgctgcgcggcgatgccggctag

SEQ ID NO: 213 - DNA, 918 bp, Chromobacterium substugae
atgccttcctccccttcccgccagggttatctggcagccgccggcgccgtcgccatctggaccggcttcaacatcgtctcccgcctggcgggcaaaagcgcgctggccggcaccgacatcctggcgctgcgcgtcggcactgccgcgctgatcctgctggcctacggcggcctgccgcgcggcgccgtccgcgaccccaggcagtggctgctcgccctgctgggcggcctcggcgtcagcgttttcgcctattgcggcttcaaatacgcgccggcggcgcacggcggcttgctgctgcccggcctgcagccattcctgtcggcggcgttcgcctggctgctggccggcgaggctgtgcagcggcacaagctgccgggctacgcgctgatcgcgctgggcctggcgatcagcgcggcgccgatgttcggcgacgccggcggccataccctgcccggcgacgtgctattgctgctgtcctcgctctgctgggccagcttcggcgtgctggcgcggcgctggggcttccagccctggccgctgacgcgcgccatcaccatcctggcggcgctgatctacctgccgatctacgcgctgctcctgcccaagcacctggccgaggcctcctggggcatgctggccttccaggcgctgtaccagggcgcgggcgccgccatcggcgccatgctgctgtatctgcgcgccagcgccatcctaggcacggtgcgcgtcagcgccttgttcgcgctgattcccctgctggccggcctgctggcggtgcccatcctgggcgagccgctgaccggctacctggccgccggcctggtctgcgtcagcctgggggcctggctggcgacgcgccagggcggcgcgccggcaccggccgccaatctgccggcaccggcggggcgggcaggatag

SEQ ID NO: 214 - DNA, 909 bp, Chromobacterium substugae
atggagctggacgagttgcgcattttccaggccgtgctgcaagaaggcggcatcacccgcgccgcgcagcggttgaaccgggtgcagtccaatgtcaccacccggctgcgccagctggaagacaagctgggagtggaactgtttctgcgcgaaggcaagcgcctgctgcccaccgacgccgcccaccgcctgggcggctacgccgagcgcctgctggcgctggccgaggaggcgcgccaggcgatgcaggaccagaccccgcgcggccaattgcggctgggcgcgatggaaagcaccgccgccgcgcggctggcgccgctgctggccgactaccatcactgtcatccggaagtgcggctggagctgcaggcgggagagtcgcgcgcgctgctgcacgcggtgctggacggcaagctggacgcggcgctggtcagcggtccggtcgacgacgacaggctggagcagacggcggcgttcgaggaagaaatcgtgctggtggcggcggccggcctggcgcagctgtcattgcacttcctggccgactccacgctgctgaccttcggcagcggctgcgcctaccgccagcggctggaacactggctgaggcgccagggcgtgcagccgcggcgcatcgtggagctgacttcctaccacgcgatgctcagctgcgtggccagcggcatggggctggcgatggtgccgcgcagcctgctggactgcatgccgcaggtggccggacaggtgtcggtgcatgcgctgccggccgacctgagccaggcgcggacggtgctgatccgccgccgccagtggcgccagccggcgctggacgcgttgcagcggatgctgcaggaaaaataccaatcgcctaagccagttgaggaatttccatttatttcaaatagtttgtaa

SEQ ID NO: 215 - DNA, 825 bp, Chromobacterium substugae
atgaagaagacgatcgcgctgctgctggccgcgggctgcgccgccagcagcgccgaggcgctggcctggggccaggagggccaccgcgtcaccggctacatcgcccagcagctgctgagcgcgccggccaaggcggcggtggacaagctgattcccaacgccgatttcgcccagctggcgctgtacatggaccagcacaagcaggagttgaagcagactctgccgggttccgaccagtggcactacaacgacgagccggtgtgcgccggcgtgaccgaagacgagtgcccggacggcaattgcgcggccaaccagatcgagcgctaccgccaggtgctggccgacaaatccgccgccaaggccgaccgcgcgcaggcgctgactttcctgatccacatggtcggcgacatccaccagcctttgcatgccgccgacaacctggaccgcggcggcaacgacttcaaggtgcagctgccgggcagcaagaaggtcagcaatctgcacgcggtatgggacaccgcgctggtgcagcagcagttgaacggcgccaatgaaaagacctgggccgccgccgatttgcagcgctatcaacgcaatgtcgccggctggcagagcggcggggtgatggattgggtgcatgaatccaaccagtacgcgcgcgctgacgtctacggcccgctgtccggcttcgcctgtggcgcgtcgccggccacgccggtttacctcgacaacacctatctgcgcgccggcgggctgctggtggagcagcagctggccaaggccggcgcccgcatcgccgcggtgatcaaccaggcgctgaactga

SEQ ID NO: 216 - DNA, 642 bp, Chromobacterium substugae
atgtcgctcaatctcgccgatgtccgattggaatactcgaagaaggaattgtcgccggaagactgcctgccggatgcgatggcgcagttcgaggtgtggctgaacgaggcgctgaccgcccaggtgccggagccgaccgcgatgaacgtggcctcggtgggcgccgacggccgtccggcctcgcgcatcgtgctgctcaagggcgtggagaacggccaattgctgttctacaccaattatctcagccgcaagggccagcaactggaccacaacccgcatgtggcgctggcctttttctggccggagctggagcgccaggtccggattgagggcacggtggcgcgggtggcggcggaggtgtcggacgcctatttcgccagccggccgtacaccagtcgcctgggcgcctgggccagcgagcagagcagcgaaatcgcctccaaggcggtgctggtcacccgggcggcgatgttcggcgcgcgccaccccatcaatgtgccgcgcccgccgcactggggcggctacgcggtgacgccggagcggatcgagttctggcagggccggcccagccgcctgcacgaccgcgtggtgtacacgctgcaagacggcggcggctggcagcgctcccgcctggcgccctga

SEQ ID NO: 217 - DNA, 1260 bp, Chromobacterium substugae
atgttgaaactgcgtcaaagcgctctgctggtcctgctgggcctggccggcgccgcccaggcccagccggtctggatttcggtaggcgatcaaggctatcagctgctgcgcaagatcgatgccggcgccaagagccaggaaagccgcaagctggcggccgacggccgcctcgccaagggcgccgccgccggcgaaaccgtgcacctggtgcaggtggacgacgcgctgctgccccagctgtccgacgccatccatgaaaacctgcgccactgcggcggcttcatcgtccacggcagcctgaaggaggcgcgcgccgcgctgaacggcccggccgcgccgctggccgccctcgccgcgccgagctatgcgatagacaaccaggccacggtgaacaagctgctgccgcagctgcaggacagcaacatcctcggcaccatccagtcgctgtcgggctaccagaaccgcttctacaccaccagccacggcgtcaacgcctccaactggatcgccagccaatggaagcaactggccggcagccgcagcgacgtgacggtagagcagttcagccacgccggctggccgcagaaatcggtgatcctcaccatcaagggcaccgacaacgccgccgaaaccctggtgctgggcggccacctggactccacggtcggcaacggcaccggcgaaaacagccgcgcgcccggcgccgacgacgacgcttccggcgtggccagcctgaccgaggtggcgcgcgtgctgctggccagcaactaccagccgcgccgcaccatcaagttcatggcctactcggcggaagaagtcggcctgcgcggctcgtccgacatcgccaagcgcttcaagcagcagcaggtcaaggtggtgggcgcgttgcagctggacatgaccaactaccagggcgacgcgcaggacatcttcctgttcaccgactacaccaacgccgcgcagaacaccttcctggctaacctggccaaggtttatctgcccaacttgaaggtggcttacagccagtgcggctacgcttgctccgaccacgcctcgtggaacgcgcaaggctatgcggcgtcgttcccgttcgagtccagcttcaacaactccaacccctacatccacagcggcagcgacacgctggccagctccggcaaccaggcgcgccacgcgcttaagttttcgcagctggcgctggcctacgcggtggagctgggcagcgacggtccgtctgccaaggcggcgagtctgcgctga

SEQ ID NO: 218 - DNA, 2700 bp, Chromobacterium substugae
atgacgagcgaacacgacaaggatttgccgctgagggccgacctggcctgtctggaccggttgctgtccgaggtggtcaacgaacaggaaggcccggtggtgtacggcgcggtgcaagccatcgcccagcgccgcggcgacgagcgcagccatccgctgccgcagttggcgccggaagccgccgcctcgctgctgcgcgcctgcggcctgtacgctcagctgttcaacatcgcggaagacctgcaccacaaccgccgccgccgcgcccaccagctggccggttcgctgccgcagcagggcagcctggcgcgcgcgctgcacaagctgcgccaggacggcgtcagcttccacagcctgcaccagctgctcagccatgcccaagtgggcgccatcctcaccgcccaccccaccgaggtgcagcgccagagcgtgctggacggccaccgcgcggtgcgccgcttcctgtgccagctcaacgccgccgacttgacgccggaggagcgcgaagcgctggaggccaaactgaagcgggcgatcctggcgctgtggcaaacctcggaaatccgccacttcaagatgacggtgcgcgacgagatcaccaacggcgtcgcttaccacccgctggccttcttcgaagcgctgccggcgctgtaccagcggctggagcgcgaaatcggccagctgtggggcgaggcgccgtgtctgccctccttcgtccgcgtcggcagctggataggcggcgaccgcgacggcaaccccaatgtcgacgccggcttgctgcgccatgcggtgacgcgccaggcgcagcaggcgttcgaatactatctgcaggagttgaagagcctgtaccgcgagctgtcgatgtcgtcgcggctggtgacggcaagcgcagcggtgctggcgctggcggaaaactcgccggacggcgcggtcagccgcagcgaggagccctaccgccgcgcgctggccaccatgcagggccggctgcgcgccagcgcccggctgcgcggcatcgagctgaactgccgctgggacgagcgcgcgccttacccggaccaccgggcgctggcttcggacctggccgcgctgtccgattcgctgcacgcgcacggcagcgcgctgctggccgagggccgcctgtcgcggctgatccgcagcgtcgacgtgttcggcttcttcctgatgccgctggacctgcgccagcacgccgccgtccatgaaagcgcggtggccgagctgttcagcgccgccggcctggaggagtaccaggcgctggacgaaaccgcgcgggtgcgggcgctgacgcgcgaactggcgacgcccaggctgctgttctcgccctacctgcgctacggcgaaaccaccgagaaagagctggccatcttccgcgaggcggcggcgatccagcgcgaattcggcgtcgacgccatcggccagtgcatcatctccaactgcgccagcgtcagcgacatcctggcgctggcgctgctgtgcaaggaggccggcctgatccggctggaaaacggcgcgccgcgcgccagcgtcaacctggtgcccttgttcgaaaccatcgccgacctggaaaacagcgaaacggtgatgcgcgcgctgttcgcgctgccctggtaccagcagctcttggacagccgcgcgcgggtgcaggaggtgatgctgggctattccgacagcaataaggacggcggctacctgaccagccagtggcagctccaccaggccgagacgcggctggtgaaggcgttcgccgaggccggcgcgcggctgcagctgttccacggccgcggcggctcggtgggccgcggcggcgggccgtcgtacgaggccatcgtcgcccagcccgccggcagcgtggccggccgcatccgcatcaccgagcagggcgaggtgatcaccgccaaatactccgacccggccatcgccggccgcaacctggaggcgctggtggcggccacgctggaagccagcctgggccatgtctccggcggcgaaaccgacatccaggccttcgacgagctgtcggccaccgccttcgccgcctaccgcgcgctggtggagacgccgggcttcatgcagtacttcctggaggcgacgccggtggccgccatcgccaagctgaacatcggcagccggccggcttcgcgcaagagcctggccgccatcgccgatctgcgcgcgattccctgggtgttttcctggtcgcaatcgcggctgatgctgcccggctggttcggcgtcggctccgcggtggccgcctatgtgcaaaagcacggcgacgccgggctggcgcggctgcaaagcctgtaccgccattcgccgttcttccaggtgatgctgtccaatatggaacaggtgctggccaaggccgatctgggcatcgcgcgccgcttcgccggcctggtggcggaccccgcgctcgcgcagcggctgttcggcatgatagaggcggaatggcagaaaacccacgacgccttctacgccatcagcggccagaccgaattgctggaaaccaatccgacgctgcgccgcagcctggaaacccggctgccctatctggacgcgctgggcctgctgcagatcgacttgctggcccggctgcgcgccgagccggaggatgaggacacgctgcacgcgatccacctgaccatcaacggcaccgccgccggcctgcgcaacaccggctga

SEQ ID NO: 219 - DNA, 945 bp, Chromobacterium substugae
atgggacccggtttcatggacaagatcgtcatcgccagccgcgaaagccggctggccatgtggcaggccgaacacatccaggcccgcctgcaagcgctgtatccgcacctcgcggtggaaatcctgggcatgactacccagggcgaccagatcctggaccagacgctgtccaagatcggcggcaagggcctgttcgtcaaggagctggagcaggcgctgctggatggccgcgccgacctggcggtgcactcgctgaaggatgtgccgatgacgctgccggaagggttcgagctggccgcggtgtgcgaacgcgaagacccgcgcgacgccttcgtctccaaccgcttccacagcctgtccgaattgccggccggcagcgtggtgggcacctccagcctgcggcgcgaggcgcagctgcgcgcccgcttcccgcaactgacggtgaagccgctgcgcggcaatgtgcaaacccggttgaagaagctggacgacggcgagttcgacgccatcatcctggcggccgccggcctgaagcggctgggtctggccgagcgcatccgcggcgagctggcgccgtcggagagcctgccggcggcgggccaaggcgcgctggggatcgaaatccgcgccggccgcgccgatctcatggcgcttttggcgccgctgaaccacccggccacccgcgcctgcaccgccgccgagcgcgcgttggccaaggagttgggcggcagctgccaggtgccgctgggcgctttcgctactctgaatgagggcacgctgacgctgggcggcctggtcgcgcatccggacggctcggtggtgctgaccgccagcgctagcgcgccggccgactacgccgaggcgctgggccgggcggtggcgaagaaactggtggacgacggcgccaagccgctgatcgcggcggtgttggccgaaccgcgctga

SEQ ID NO: 220 - DNA, 531 bp, Chromobacterium substugae
atggagcactgcatcgcactgatacgcggcatcaatgtcggcaaggccaagcgcatcgcgatggccgatctgcgccagctggccgccgacctcggcggccaggacgcggtcaccctgctcaatagcggcaacctgttgtgccgctacccgtcgccggccaggctggccgccgatctcgaggccggcatcgccggccgtttcggcttctctgcgcgggtcatcgcgctgggcgccgacctcctgcccgccatcatcgcggaaaacccgctgcgcgacatcgccagcaatccctcccgcttgctggtggccttcagctccgcgccggcgtcgctggcggcctgccgcgatctgaccgagcggcagaccggcaccgagcgcctggcgctgggcaatcacgccgcgtatttctggagcgcggacagcatactcgacagcaagctgctgcaagctttcagccagcgcaccggcgacagcgtcaccacccgcaactgggcgacggtgctcaagctgcaacaggcgctggcgcgatga

SEQ ID NO: 221 - DNA, 732 bp, Chromobacterium substugae
atgacgcgcgtcctggtggccaggccgcggagccaggccgccggcctgctcgcgcgcctgcgcgccgagggctggcaggccgggcatctgccgctgctggagctggcgccgctggccgccggcctggcggcattgccggcccaggccgccggcgcggacgcgctgttctgggtcagccccggcgccatcgacatcggctggccggcgctggcgggacagaatctggccggcaagcggctggcctgcgtcggcgctgccagcgccgagcggctgcgggcgctcagcggcctgccggtgctgcatccgcgcgacggcagcgacagcgaagccttgctggccctgccggagctggccgaagtgcggggccagcgctggttgatcgtccgcggcgaaggcggcagggcgctgctggcgcagaccttggccgcgcgcggcgcggcggtggcgctggccgagatctaccgccggctgcccggcgcgcccgactgggacgacttcgacgccgcgccgccggatgccgtcgtcctcacttcaggcgaaatggtagagcaattgttccgactggctggcccgagccgggcggggacgctacaatgcctgctatattgcgtgccgcatccgcgcatcgccgagcgcctggccgcgttcggcgcgacacgcatcgtgacaacccgggccgacgatgccgcactggtcgccggcctcaaagaatggttccgtcgtcacccatga

SEQ ID NO: 222 - DNA, 1038 bp, Chromobacterium substugae
atgagcgaatcccagatcaacgaagccatccaggcgccagcgcgcccggcccgcaaacgccccggcctcgcgctgtggctggccgccgccgccctaggcgtcgccggctggcagttctactccacccagcagcagctggactccatgcgccaggaactggcgcgccgcctggctgaaggcagcggcgccggcaaggagcagcgcgccatcgccgagcaggcgatgctggcggcgcgcgccaccgacggcaagctggcgctggtggaggcgcgcgtcaacgaggccgccggccagtacgcgaccctcaacggcatgtaccaggagctgaccaagaaccgcaccgactggctgctgtccgagatcgagcacacgctggccatcgccagccagcagctgcagctggccggcaacgtgtcggcggcggtgtcggcgctggagatggtcgacgcccgcctcgccaagttcgaccggccgcagctgataggcgtgaagaaggcggtggccaccgatctggaaaaattgaaggcgctgccctatctggacagcgtcggcctcaccgtcaagatcgaccgcctgatgctgggggtggactcgctgccgttggtggtggacgcgcatcgcctgggcggagcccgcggcgcgcatccggcggcgctgccggccactgcgccgtggtgggagcggctgtcggctgagatcagcgccagcctgggcgagctgatccacatccgccggatggacaagccggaggcgttgctgctgtcgccggagcaggccttcttcctgcgcgaaaacctgaagatgcgcctgctggacgcgcgcctggcgctgttgcagcgcgacggcaagacctacgccgccgacgtcgccgccgcgcgcagctacgtgcagcgctatttcgaccgcgacgccgccgccaccgtccagtggctggcgacgctgggcgagctggaaggcgcgcctctggacatcagcttgccggacatggcctccagcctgaaggcggtgcgcgatgcccagggcgccagcggggagtaa

SEQ ID NO: 223 - DNA, 1197 bp, Chromobacterium substugae
ttgtggattaccggcctgttcgcgctggccgtgctggtggggctggcctccaccctgaataccggctacgccatcctgtttttgccgccgtaccggatggaagtgtcgttcaacctgatgatcgtgctggtgatcgcgctgatcgtcgccacccacctcgtcttgcgcctggtcgcgctggccaccgacctgccgcgccaggtgcagcgcttccagcgccagaaaaagttgaaagccgcccgccacgcgctgcgcgaagccggcatcgccttcttcgagggccgcttccagaaggccgagcgcgaggccgccaagtcgctgggcgacgagtacgcgccggagaaccgggcgctggccttgctgatcgccgcccgctccgccagcgcggccggcgcaggcgacaagcgagacgactacctgggacagctggaccaactgccggagcgcctgcagctggcgcgccacatgctggacgccgagctgaagctggaagacaaggacgcgttgggcgcgctggccgccatcgagcgcgcgcgcgcgctgtcgccgaatctgaccaacgcgctgcggctggaattgaaggtgcggttgctgcagaagcagcccgaggccatcctcagcttgaccgaaaagctgctgaaggccgacgcggtcgagccggagcaggcgcgccgctaccgcttggctgcctaccagcagcagctggccggcatgctgagcgagcgcgaggtgcgcgagtggctgcgccgcatcccggaagccgagcgcggcaacccgcagctgctgcagcaggtggtcaagcatctgatcaagctgcagcagtacgactacgccgccaccttgctggccggcgcgctggccagcgacgaaatggagctgccggaactgtcgcgcgaactgggccagctggccagccatctgagcgtggagaagcggctggagctgctgaaggacgcggagaattggctgaagctgcggccgcgcgaccactggctgctgctggcgctggggcgcctggcgcaagcgcagcaattgtggggcaaggcgcagaactatctggaagccagcgtttccatccagcccacgctgtgcgcgcatgccgaattggggcggctgttcgaggccaccggcaaggaggagctgtcgcagcagcattaccagaagagcctggaaatggcgctgaaccagggctattga

SEQ ID NO: 224 - DNA, 237 bp, Chromobacterium substugae
ttgatcccttccgggcattgccgcgatgccgcccgcctgattggctggcggcatttttcatggcggatcgaggcggcgcggcaaaaaaaatcggactccgcggggagcccgttcatgccaacgtggactggcaacaacaaatcgatacgagagtgcggacagacatcctgtcagacaataaggatgccgagcggcgaaagctgtgccagaatcaaccattatgcatggttggcgtga

SEQ ID NO: 225 - DNA, 921 bp, Chromobacterium substugae
atgaagctgcctccgctgaatgccctgcgcgtgtttgtcgtcgccgccgaacacctgtcgttcacccgcgccgcggccgcgctaagcctgacccagggcgcgatcagccgccatgtgcaaacattggaagagtactacggcgccacgcttttcacccgccaggcccgcggcctggcgctgaccgccgagggcgaggcgctgctgaagccggcgcgcgaagccttccagctgctcaacgaggcgagcgaggcgttgcgcttgcgccagagcgacctgcgggtgcggatgccgccgacgccggcgatgcgctgggtgctgcccaacctggccgatttccaggcgcgccacccggagtacacgctgcatctgctgacccagctgatccacaacaagccgttcaaccgcgccgagtacgacctggcggtggtcgggctgtccagcccggaggccgccgccgatctcaggctggaatgcatctgccgcgaaaagctgatcccagtgtgctcgcccagcctgctggccggcaagcatccgctgcacaccccgcaagatctcaagcaccacacgctgctgcacccatggcgcgaccagaacacctggaagcgctggctgaagctggccggcgtttccggcgtcaacccggagagcggcgtcactttcgacgcgctggaatacgcgctgcacgcggcggtgaccggcatgggcgtcacgctggcgcaggcatcgatggtgacccaggacctggacagcggccggctggtgattccgttcgacaccgtgctggaaaccgagtgggcctactacctggtctacccgcacgaactggccgagctgcccaaggtgcgcgccttccgcgactggctggtgggcaccgtcgcccgcagcgaggaagccagctggctgacccgccagggatactga

SEQ ID NO: 226 - DNA, 1620 bp, Chromobacterium substugae
atgattgacatagcaactattgccttgtcaatcatgaatgccccctctccttctcccgccgacatccaggcgctggatttccgccagcgcctgctggcgatgctgggcctgtgctgcgtgctgatcatggtggcgctggaccagaccgtggtcggcaccgcgatgccgacggtggtggccgacctgcgcggtttcgcgctgtatgcctgggtcggcaccgcctacctgctgacctcggttatcaccgtgcccatcttcggcaagctgggcgatgaccacggccgcaagcccttcgtgctgaccgccatcgtgctgttcaccgcggcctcggcgctgtgcggcctggcgcaggacatgctgcagctggtgctggcgcgcgcgctgcagggcgtcggcggcggcatgctggtggccaccaccttcgccagcgtgcccgacctgttcccgcatacccgcgaacgcttgcgctggcaggtgatgctgtcggcgtcgttcggcctggccaacgccatcggcccgtcgctgggcggcttcctcaccgaatacctgggctggcgctgggtatttttcgtcaatttgccggtcggcgcggtcagcctgtggttcgtctggcgctacctgccggtgatccgccatgccgcccaggcgccgtccaggctggactggcagggcgcggtgttgatcgcgctgttcctcggctccctgcagctggcggtggagtggctgccgcagcacaagtcgccgtggctgctggcgctgctggccgcgttgagcctggcttcgctcgcggcgctgatctggtgggaaaaacgcagccccaaccccttgctgccgcccagcatgctggcgcatccgggcctcgcgccgctgttcggtctgtcgctgctgatgggcttcggcatgttcgcggtgatgtattacgcgcccttgatgttccaggccggcttcggcctgtcgcccaaccacgccggcatcctggtgacgccgctggtggtgttcatcaccataggcagcatgctcaacggccgcatcgtgcagcgcttgcgccgccccacccggctgctgagcgtcggcttgctgatgttcgcgctgacggcggcgctgctcagccaggccggcccggccaccgcccactggctgatcatcgccaatatggtgatgggcggcctgggcctgggcctgctgatgcccaatctgaccatcttcgtccagcagctggcgccgcgccggcagctgggggtgtcgaccgccatgctgcaatcgacgcggatggtgggcggcatgctgggcaccgccgtgatgggcgcggtggtcagccaccagttccagctgggcgtggcgggcatgctggcggccggccacgcgcaagcctggctgcactggctgggcgatccgcaaaccctgctcaacgccgacagcctggcgcagttccgccatgccgccgccgcggccgatccggagcggctactggccgccacccgccagttgctggtggacgccatccatgtcagccagtggctggtggccggcggcctgctgctgggcctgtggctggtgcgcaaggtgccggccatcaccctgtcgtccgccgccgcgccgcgggagccgcaacatgactga

SEQ ID NO: 227 - DNA, 438 bp, Chromobacterium substugae
atgactgaaaccacgcccaatctgttgcagcagctgggccgcagcagccgcgccatgtacggcgccttcgaaagccgggtcggccacgcgctgccgcgctggcgcatcctgaaatcgctggaggagctggaagtggccagccagaggcagctggcctgccatttgcagatggacccgggcgcgttgacccgccagctgaagctgctggaggccgacaagctggtgcggcgcgacaccgacccgtccgacaatcgccagatccgggtgacgctggacgaggccggccgcgcgctgctgctggcggccgcgccgcagcggcaggccttcttcgcccaggcgctggacgggatagacgcggagcggctggcgacggcgctggaggtgctgcggcagctggaggcgcgctttcgcgcgatgtccgccgcgggcgcggactag

SEQ ID NO: 228 - DNA, 1542 bp, Chromobacterium substugae
atgcgcggcatcctttccgctattcctgcattccccaactggctgaattgcgcgctggtggcggcgctgtatttcgcgtccgcctggctgggcgaccactggctgatgctggagctggagatggacagcgtggtgtggccgcagcctggcctggcgctggcggcggtgctgctgctgggctggcgggtctggcctggggtgctgctgggggccttgctggccgaaggctggcagtggcatgggctggtggcgggcataggctggctgaagccggccagcggcatcgccgccggcgtgctggcgcaaacgctgctgggcgcctggctggtgcggcgccatatcggccgcggcaacccgctggacagcttcagccattgcctgctgtatttcgtcatcgtggcggcgatgacgctgctgggcgcgctgatcgccgtcgccagcctgtacctgtgcggcctgctgccgcaaaagctgctggtgatggaatgctgtctgcgctggctgagcgccggctgcggcgtgctgctgttcggcagcgccttcctgatcctgcaccagcatggctggccgcgggtggagcgcgaaacctggtacgagatgctggcctatttcggcatggtgacgctgctgaccgccagcatcttcgtctggtggcacccgaccatggacaccacctatccgctggacctgctggtgctgccgctggtggcgtgggcggcgttccgcttcaccccgcgcgaggtggtgctggcgctgctgctgatcatggcgctggcgctgtggggcacccgccacggcggcggcccctacttgggctattccgcctacagcacgctgatcatcgtgcagacctatgtcggcatcctgaccgtggtgtcgctatgcgtgggcgcgctgatgagcgagcagcgccggatcaagctggagctggggcgccagcaggaacagctggagcaacaggtgcgcatccgcacgctggcgctggaacagtcgcacgccgaagtgctggcactgtcgcgggtggacccggtgaccggcatcgccaaccgccgcagcttcgaggaaagcctggacggcgagtggcggcgcgcgcgccggctgggcacctcgctcggcatgctgatgatagacatcgactacttcaagctatacaacgaccactacggccacgtcagcggcgactactgcctgcgcgaagtggcgcaggccatccgcagcagcgtgcggcggccgcaggacctggtggcgcgctacggcggcgaggagatcgtctgcctgctgccggacaccaccgaggagggggtggcctgcgtcggcgaggcggtgctggaagcggtgcgcgacctgcagctgccccatgtcggctcggcgatttccgccatcgtcaccatcagcatcggcggcgccgcggtgctgccgcgcgaaaccccggacagccgccagctggtggaggcggccgaccgccagctgtaccgcgccaagcagcaggggcgcaaccggatggtgatcgccgacgacgagcaggaccgctccacaggctag

SEQ ID NO: 229 - DNA, 1026 bp, Chromobacterium substugae
atggcaaccctgccggaaaacgctgaatttccattgccgcgcaagcgcgccggcgccgggcggttttccaacagtcggcatgccgtcggcttggccgcctgtaatttagccgttacaatgcgcgcggccggcgaccgccccgatattgcatggcggcgccgggttcatcaggaaaaccgccccatgaacgtcagagttgtcgattaccgcgccccggacgccgcggaacagttcacccgttctctgcacgaaaccggcttcggcgtgctgaccaaccaccccatcccgcaagacctggtcgagaagatctacgccgaatggctggccttcttcaacagcgaggagaagttcgactacgccttctcgatggagaagcaggacggctggttctcgccggaagtgtcggaaaccgccaagggcgccacgctcaaggacatcaaggaatacttccacatctacccgtggggccgcgtgccggccgcgctgaaggccgacgccgaccgctactacgccatcgccaaccagctggcgcaggagctgctgtcctgggtgcagcagtacaccccggccgccatcgccgccaactaccgcgaaccgctgtcgcatatgatcgcagacagccagcagacgctgctgcgcgtgctgcgctacccgccgctgaccggcgaggagccggccggctcgctgcgcgccgccgcccacggcgacatcaacctgctgaccatcctgccggccgccaacgagccgggcctgcaggtgcaggacaagaacggcgactggatcgacgtgccctgcgacttcggcaccctggtggtcaacatcggcgacatgctgcaggaagcctccgccggcttctacccatccacccagcaccgcgtggtcaaccccaccggcgagggcgcgaagaagagccgcgtctcgctgccgctgttcctgcacccgcgcccggaagtggtgctgtccgaccgccacagcgccggcagctacctggacgaacgcttgcgcgagctgggcgtgaagatgtaa

SEQ ID NO: 230 - DNA, 783 bp, Chromobacterium substugae
atgagtgcctctctggttgatccgctgtggtcggccatccgcgatgaaaccctggccgcggtcaacgacgaaccgctgctggccagtttcctgcacatgaccgttctgcgccacgccacgctggaagacgtgctggccttccatttgtccagcaagctcgccagcccggtgatggatccgcgcgcgctgctggaattgttccgcgaagcgttccaggccgatcccgccgtcagcgccgcgatgcgcgccgacattcgcgcctgttatgagcgcgacccggcctgcgacagctattccacgccgctgctgtacttcaagggcttccacgccatccagagccagcgcatcacccactggctgtggcagcaggacagacgcacgctggcgctgttcctgcaaaaccgcatctcggaagtgaccggcgccgacatccaccccgccgcccgcgtcggccagggcgtgatgctggaccacggcaccggcctggtggtgggcgaaaccgcggtgataggcaacaacgtctcgatcctgcacggcgtgacgctgggcggctccggcaaggagcgcggcgaccgccatcccaagataggcgacggcgtgatgctgggcgccggcgcggcggtgctgggcaatatcctggtcggggaatgcgcgaaggtcggcgccggcagcgtggtgctggaagacgtgccgccgcacgccaccgtggccggcgtgccggcgcgggtggtggcgcaagcttgtcccggcacgccggcgctggacatggaccagcgggtctga

SEQ ID NO: 231 - DNA, 636 bp, Chromobacterium substugae
atgacacggtttgcggcggtgttgctggcgggatgggtcagcctgggcgcgctggccacgccgcccgatgtgccgggctggcgcgaataccaggacgggcggctggcggccgcccgcatcgccttctggcaggcggcggaaggcggcgaccgggtggcggccttcaatctggcgatgatggactggcgcggcgaggccggcaaggtggacaagccccaggccttgtactggctgcgccgggcggccgacggccagctggcgcaggcgcagtacgcgctgggcctgctgtacgaaaagggcgacgcggtggacaagtcgctgaccgaggcgacgcgctggttcgcgctggcggcgcgccagggctatctggccgcccagatcgaccttggcacccagtattttctcggccgcggcgcgccgcaggacgacaggctggccgcctactggtacgaggaggccgccaagcagggcgacgtgggcgcgcagtacctgatcgccagcatgtacgagcgcggcgagggcgtgcagcgggacatccccgccgccatccgctggtacgccaaggcggcggcgcagggcgacgtcggcgcccgcgccaaggcgctggacctggccaagacgctggcccgccactga

SEQ ID NO: 232 - DNA, 861 bp, Chromobacterium substugae
atgcccgcgcagatcgaaagcttttacgacgccgccaccggcaccgtcagccacgtggtctatgaccgggacggcggccatgcggcggcggtggacccggtgctggacttcgaccccaagtccggccgcacctcgcgccgctccgccgaccggctgctggaatgcctgcgcgcccggcggctgacgctgcaatggatactggaaacccacgcccacgccgaccacctgtcggccgccccctatctgcaacagcaggccggcggccgcatcgccatcggcgagcgcatcacccaggtgcaggacgctttctgccgggtatttaacctggagccggcgttccgcagcgacggctcgcagttcgaccacctgttcggcgacggcgaaaccttccgcatcggcgcgctggaagccaccgcgctgtgggtgccgggccacacgccggccgacatcgcctaccaagtaggcgacgcggtcttcgtcggcgacacgctgttcatgccggacgtcggcaccgcccgctgcgactttcccggcggcgacgccgccacgctgtaccgctccatccgccgcctgctggcgctgccggacgacacccggctgctgatgtgccacgactatccgcccgccggccgcgcgccggcctggtgcgcgacggtggcggaacagcgccgcgccaacctgcatgcgcgcgacggcgtggaagaggccgatttcgtggcgatgcgcgaggcgcgcgacgccacgctggcgatgccgcagctgctgctgccggcggtgcaggtcaatatccgcgccggccgcctgccgccgcccgaggacaacggcgtgcgctatctgaagctgccgctggacgcgctgtga

SEQ ID NO: 233 - DNA, 795 bp, Chromobacterium substugae
atgctgctgatgctgcttctgggcgcgctggtcggcgcggtgctgggcctgaccggcgccggcggcggcattctggccgttcccgcgctgatggccgcccaaggctggagcttgccgcaggcggcgccggtggccttgctggcggtggccgcgggcgcggcgctaggcgcttacgaaggctggcgccggcaattggtgcgttatcgcgccgctgcctggatggcggccagcggcgtgccgttcgcggcggcgggcgcgcgcgtcgcccacctgttgccggcgccgctgctgtcgacgctgttcgcgctggcgatgctgatcgtggcggcgcgttcctggcgcacggccggcggcgcggcaactcgcgatggacgcgccgcgccttgccggctggacccggagaccggccggctgcgctggagtccggccgcggcggcggcgctcgcgggcgtcggcgcggtcaccggttttctcaccggcttgttgggagtgggcggcggcttcgtcatcgtgccggccttgcgccggctcagcgatttgtccatgcacgccatcgtcgccacttctttgctggcgatagcgctggtgggctgcggcggcgtgctggcggcgctgtggcacggaacgcgggtgcccgcgctgcccagcgccgtgttcgtgctggcggcgataggcggcatgctgctgggccggcgcctgatccgccgcctgtcgccgccgcaggtgctgcgcggcttcgccgcgctgacggtggcggtggccgccgtggtgctgtggcgggcctggggcggctga

SEQ ID NO: 234 - DNA, 1236 bp, Chromobacterium substugae
atgcattcccccgcgattccgctcaacatcggcaacaccggcttcatgctgctgtgcgccagcctggtgatgctgatgacccctggcctggcctttttctacggcggcctggtcggccgcaagaacgtgctcaccatcatggcccagagcttcatgtcgctgggctggaccacggtgctgtggttcgccttcggctattcgatgtgcttcggccccagctggcacggcatcgtcggcgacccgacccattacgccttcctgcgcggcgtcacgctgcaaagcatgtacgccggcaacgacgccggcattccgctggtggtccatatcgcctaccagatgatgttcgccatcatcacgccggcgctgatcaccggcgccttcgccaaccgggtgacggtgaaagcctacttcctgttcctcaccggctggctggtgctggtctatttccccttcgtccacatggtgtggagtcctgacggcctgctggccaagtggggcgtgctggacttcgccggcggcatcgtggtgcacaacaccgccggcttcgccgcgctggcgtccatcctgtatgtcggccgccgctcgctggtggaaaacaagccgcacaacgtgccgctgatcgcgctgggcaccggcctgttgtggttcggttggtatggcttcaacgccggctctgaattgaaggtagacgcggtcaccgcttccgccttcctcaacaccgacgtcgccgcctccttcgccggcaccgcctggttcctgctggagtgggcgcacgccaaacagcccaaattcgtcggcctgctgaccggcgcggtggccggcctggccaccatcaccccggccgccggctatgtgtcgctgggcagcgccgccgtcatcggcctgatcgccgccgcggtgtgctacttcgccgtgcaattgaagaaccgcctgcaatgggacgacgcgctggatgtctggggcgtgcacggcgtcggcggcctgctcggcaccattctgctgggcgtgttcgccagcaaggcctggaacgccgccggcgccgacggcctgctgctgggcaacccgggctttctgtggaaacaggccgccgcggcgctgttgtcgggcgtgtgggcgttcgccttcacctacggcatgctgtggctgatagaccgggtcacgccggtcaaggtggacgccgccgtccagcaggccggcctcgatgccacgctgcatggcgaggaagcctatatctga

SEQ ID NO: 235 - DNA, 318 bp, Chromobacterium substugae
atgaccgaaagcgaatttctgcaactgagcgacgccatcttcgaccagatcgaagcggccatcgacgaccatggcctggatgccgataccctgcgccagggcaatgtgctggaaatcgagttcgacagcggcgaaaaagtgatcgtcaaccgccacgccgtcaaccaggagttgtggatcgcggcgaaaagcggcggctaccacttctcccgccagggcgcggcctggatcgccagccgcgacggctccgagttcttcgccacgctggccgaagccatccgcgccggcagcggcgaggcgttcggcttcggcgactga

SEQ ID NO: 236 - DNA, 357 bp, Chromobacterium substugae
atgtggcatggcggttccgattcgcagggtgacgacggccattctaggccaacgcgagttcagacaagcgattgcttggaaatatccttagcgcggaaagaagccttccggctagcgggcggccgaagccgcggcgggcgcggccgcctgcggggccggagcgacggcgtgggccggcggcgccttgggcaacaccagcggtcctttgtaaccgcaggccgccagggccagggtcaggcttgcacaagcgagcagggtacgcatactgacagcaatccgatatggcaaaatcagcatactagcaaaaccgcgccggcccgtgttgcgtccggccggccacacaggaaaccatcatga

SEQ ID NO: 237 - DNA, 1095 bp, Chromobacterium substugae
atgccacattacgcgcgccacctggaacatcacaccatcgtcaacccgtttccgggcatcgccaagctggaggcggcgctggggcacaaggtggtcagccggctgggcgccaacgagagcatgagcaagccggagtcgccgctgctggcgcagtggggcgaggcgctggccgaactggcgcggctgtatcccgacccctacgcgctggcgctgcgcgagcgcgccgcgcaacgccacggggtggagagcagccaggtgatcttcgactgcggcgccgacagcctgatcctgctggcgctgcggctgcgctgcaacgccggcgacgcggtggtgtgcagcgccggcacctacccggccttccgctatttcgccgagggcgtgggcgcgcgcatcctggaagtgccgtatcaggcgcagggcataggcctgcggccggatctcgcgcgcctgtgcgaggtggtgcaggccgaacgcgcggtggcgctgtacctggccaatcccgacaaccccaccggccattactggtcggccgccgagatccaggcgctgcgccagcagctgccgacgcagaccatgctgatcctcgacgaggcctatgtcgatttctgccaggacccgcaggacgcgccgccggcaggggtattgcccaacaccctgcggctgcgcaccttgtccaaggcttacggcctggccgggctgcgggtgggcttcgcgctggcgccggccgacatcatcgccaaggccgaccagatccggccgcagtacgcgctgtcgggcctggcccagcacgcggcgcagctggtgctggacgacccggactacgcgcgccaactggtgcaggccacggtgcagctgcgggacaagctggaggccgcgctgcgcgcgcgcgacctcgccgtgctgccgtcgcacaccaatttcgtcagcgtgctctaccccaacgcctcctgcagcgaggcgatccagcgcaagctgctggccgaaggggtggcggtgcaccggccgccgcatccggcgttgcgccatttgctgcgggtcaccgcgcagccgcaggcgctgtctagcaaggtgctggacgcgctggccggccattga

SEQ ID NO: 238 - DNA, 810 bp, Chromobacterium substugae
atgaaaaaatccttctatcccctgctcggcctgctgctgtcggcagcgggcggcgcgctggccgcgcccatcaccaacttcgacagcgatccggtgatcgacctggccggccagctgcgtggccagcagcacgccggccgcgccgtcgcggcgcaggcgctggacgcggccgccagcgcggccatcctgcgcgaagccggcgaccgccgccagctgctggatccgatgagcatcccgaagaacgacagccgcatggtcgccgcgcatccggaattcagccgccgccagggccagttgctgaccgtgtccaccccggccggccagcgcctgcagttcaagagctggaaaatcgccaagggcgacggcgacagctccaccttcctctaccagggcccgctggccggcaacgcgctgcagcgcgtcgacctgcagttcggccatgacgcgccgggcagcctgctgatcgacaaccgcagcggcaaggtcttttttacctacagcaccgagaacatggtgtccgcgtcgcccgacggcagcgcgctgctgcagctgcagaattcgcccgactggcgcctgcagctggtgtcgctgccgaacaccgagcagggcagcctgttctgcagcctgagcgacgcttcggtggaaaccgtcttcaaatcctggcgcggcaacagcctgggcctgcagctggagaagggcggccagaagctggcgctgcgcttcagccgcaacggcggcgactggcaggtcgccgccagccagcccgcgcagctggccaagctgggcctgcgctgcagccagtcgcgctaa

SEQ ID NO: 239 - DNA, 375 bp, Chromobacterium substugae
atgaaaaccaatcgcagttacctcctgaccgcgctgtgcctgctggcggccagccagctggcctgcgccggcaaggctatcgcggtgcgcgacgacggcgagacgccgatcacgctgcgcggcgccgtgatcgggccgatctcctccggcagcaaggccgacggcaccttcttcaaggcctaccacctgaagctggagcgggaaatgaccttcgacgacggcggcgactgcggcgagcaggccaagcgcagcctggcgctgaatcaggaaggcatgggccgctacaagggcaagaccgtgtcgctgaaggccaaggtgttctgccagctgagccgcaccggcacctaccacctcagcgacatcgtggtgcagtga

SEQ ID NO: 240 - DNA, 291 bp, Chromobacterium substugae
atgccctggatccatcccgaactgattcccctgatcgccttgctggcgctttacgccgcctcgctgctgtacgcgctgcggctggcctggcgcacccgcggcctgcgctggctggcttgcgcgtcgctgttgatcgccggcttcctggcgatgctgctggcgcggccggccacgcccgactccggcgagatgccgccgggcttcggcctgggcgcgctgctggcattggccggcatcggcgccgccgccggcggggcggtctggcgcgccttgcgccgccatcggcgctga

SEQ ID NO: 241 - DNA, 120 bp, Chromobacterium substugae
atggcgcaaattccggccatgccaaaggcattgccggccgcggccgcgcgcgtcggccgcccatcgcatccgaaggagccgcaaccatggatgacgccctgcgacggcgggcagtattga

SEQ ID NO: 242 - DNA, 1227 bp, Chromobacterium substugae
atggatgacgccctgcgacggcgggcagtattgaagggcggcttggccgccgctggcctgctggccctgtccggcaggctgcgggcggcagcctggctgtatcagggcttcgacaacggctggcgcgagctggtgccgtatccgcagaagatgccgctgctgcgcatcaccacccggccggtgcatctggagacgccgttttcccagttcgaccgcggcctgatcacgcccaacgaggcggtgttcgtccgctaccacctggccggccacccgctggacatcgacgccgccagccataccctgacggtgaaagggctggtccggcagccgctgacgctgacgctgcgcgatctgcaaacccgtttcgaaaccgtcagccaaaccgtggtgatgcagtgcgccggcaatggccgcggcctgctgcagccccgggtgcagggcgcgcagctgggcaacggctcgatggcctgcgtcgagatgaccggggtgaggctggccgatgtgctgaaggcggctggcgtgaaggacggcgcggtgcaggtggcgttccgcggcaccgaccagccggcgctggaggagacccccagcttcatccgctcgctgtacctggaggacgcgctgcggcctgaggtgatgatagcctgggcgatgaacggccagccgctgccggtgctcaacggctatccgctgcggctggtggtgccgggtttctacgcctcgtactggatgaagcatctgtcgcagctggaggtgctcgaccacgtgttcgacggctggttcgccgccaccgcctacaccgtgccggacacgccggactacggcatcgcccccggcgccaagccggagcggacggtgcggctgacaagaatgaaggtgcgcagcttcatcacccacccggccgacggccagaccgtggcggcgccggacggccggctggctttgcgcggcatcgccttcgacggcggcagcggcatccgccgggtggaagtgtccgccgacggcggccgcagctggctgccggcgcggcttggcgaggagcgcggccgcttcgcgttccggccatggacgctgacgctggatggcgtcaagccgggcgcgctgcagctgctggcgcgcgccaccgccaacgacggccagacgcagccgctggtccagccgtggaaccccggcggctacgcccgcaacgtggcggagcgggtggcgctggtcatcggggaggccggctga

SEQ ID NO: 243 - DNA, 330 bp, Chromobacterium substugae
atgaaacccgccctgctcgtcgcgctgcttctgctggccggcccggccggcgccgtctccatccagttgcccaacgaaaccgcgatgctgcccgacagcggccatcccggctatccgaccgcgctgcagcgctgcctgatctgccattcggccgactacatcgcgctgcagcccgacttcagccaggcgcgctggcaggccatcgtcgacaagatgcgcgccgccttcaaggcgccgatcgcgccggaggaggtggcgccgatcgccgcctatctcgccgacgcgcagcgccggcgcttgctgcagccgcggccgccggccaagccctga

SEQ ID NO: 244 - DNA, 822 bp, Chromobacterium substugae
atgcccctgccgccccccctgacgctggccgccttcgcgctgctggccctgggccttgtcgccgccagcctgcgccacgccgcgccgggctggatagccctggtcaccagcgcgatgctggcgctggccgccggcgtgctgcagccgctgggcgtggtggcgacggccgccgccgccggcctcacttgcagcctgcgccgctatccgcggccggagtggtacctggtgtgggtggccttgctgctggcgctggcggtgcacgcgctgcccggcttcgacaaccccttgctgtggcagggcaaggccagcgccgccagcgcgccgtaccggctgttctggagctacgacaagggcctggccggcctgttgctgctgctcaacctgtgcaatgccccgctgcccggccgcacgctgggctggccggcggcggcggtgggcggcctcgcgctgctgttcgtgctgggcatcgccgccggcttcggcatcatcggcctggcgccgaaatggccggcctggctgctgccctggctgttcgccaattgcttcctggtgtcgctggcggaggaggccttcttccgcgccggcgtccagcgctggctggaaatccgcaccgagcctttcgccgcgctgatggcggcgtccttgctgttcggcctggcgcacctggccggcggctgggcctgggcggggctggccacgctggccggcatcggctacggcctgatctacgccgcgcgccgccagctgtggctggcggtgctggcgcatgtggctttcaacaccgtgcatctgctgctgttcacctatccgaaaccggcgtga

SEQ ID NO: 245 - DNA, 489 bp, Chromobacterium substugae
atgattgaagtcggcatcgtgatgggtagcaacagcgactgggaagtgatgcagcacgccgcgagcatgctgaagcgcttcggcatcgcctgcgaaacccgcgtcgtctccgcccaccgcaccccggacctgctgttccagtacgccgaagaagccgcgccgcgcggcctcgcggccatcatcgccggcgccggcggcgccgcccacctgccgggcatgctggccgccaagacccacgtgcccgtgctgggcgtgccggtgccgtccaaatacctgcgcggcgaggactcgctgctgtccatcgtgcagatgcccaagggcattccggtggccaccttcgccatcggcgaggccggcgccgccaacgccgcgctgttcgcggtggcgatgctggccaccacccggccggagctggccgagaagctggtggctttccgcaaggcgcaagaagaaaccgtgctggcgatgacgctgccggaggccgaataa

SEQ ID NO: 246 - DNA, 1131 bp, Chromobacterium substugae
atggccgccatcctgccgccggcgatgctgggcatcctgggcggcggccagctgggccgcatgttcgccgtcgcagccaagaccatgggttaccgcgtgacggtgctggacccggacgaaagcgcgccggcggcggccttcgccgaccgccacatccaggcgccgtacaatgatccggccgcgctggccgagctggccgccagctgcgcggcggtcaccaccgaattcgaaaacgtcaacgccgacgcgatgcgcgagctggccaagcgcacccgcgtgtcgccgtccggcgactgcgtcgccatcgcccaggaccgcatcgccgagaaaagctggatccgcaaggccggcctcgccaccgcgccctacctggccatcgagagcgtcgaggacatccaggtggacctggcgccctatctgccgggcatcctgaaaaccgcgcgcctgggttacgacggcaagggccaggtcagagtgaacacccaggacgaggcgcgcgccgcctacgccaacctgggcggccaggcctgcgtgctggaaaagatgctggacctgcaattggaagtgtcggccatcgtcacccgggtcagcagcgcgcaaagcgcggtgtttccgttggcggaaaacatccacaagaacggcatcctcgacgaatccatcgtgccggcgcgcgtcgccccggcgctggccaggcaggcgcaggagatggcccggaagctggccgaggcgctcgactacgtcggcgtgctggcggtggagttcttcgtgctggccgaccacagcctggtggtcaacgagatcgcgccgcggccgcacaactccggccactacaccctcaccgcctgcctgaccgaccagttccagcaacaggtgcgcgcgatgtgcggcctgctgccgggccgcaccgacctgctcagcccggtggtgatggtgaacctgctgggcgacgtctggagggaagacggccgcgagccgcactgggacgtgctggccgaagcgcccaacgcccagttgcacctgtacggcaagaaaacggcgcggccgggccgcaagatgggccacttcaacgtgatggcggccacggccgacgaggcgctggagcaggccagggccttgaaggacaccctgtag

SEQ ID NO: 247 - DNA, 744 bp, Chromobacterium substugae
atgaatccttccgcattttccaagaccctgtcgcaagcgctgaggccggcggcgctgctgctggcgctggcctgcgcgcccgcgctgtccgcccatgccgagacgccggccgccggccagagccagccgctggcgccgcaagccagcgccaagccgatgggcgaccaggcttaccagctgatgcaggccggccagcaggtcaaggcccacgaattgttcatgagggccgccgagatgggcgaccgccgttcgctgtcgctgctggcggacagctatggccgcaatcctaacggctacctcaagtcgccagcggtgaagaaggactaccccaagctgatccagctgttggagcgcgccgcgcgctatccggagccggagggcagcggctacaggctgaagcaggacttcgccagactgctgattaccgcgcccgcgccctaccgcgacgcgccgcgcggcagccggctgctggtggcggccaccgggcaggatgacgatggcaccgagaattactacctgctgggccagatgtacgagcgcggcgaaggcgtgccggcggatggcaagcaggctgtctattggtacgagcgcgcggccagcgcgctttccggctatacgccgcccaaggtccagcgcgcgctggcgcgcatctacaagaccggcgcgcccaatctgcccgccgatcccaagaagtcgcgcgaatggtctgacaaggccaagcacaacccgggcttccagtcgtga

SEQ ID NO: 248 - DNA, 696 bp, Chromobacterium substugae
atggaaaacgcgctcgtcggactgccggagctgcgccgccggctggaggccgccgccgaccccgccaaacggccggcgatgcgcgactatatgcgcgggcagttcgatttcctgggattggcgacgccggccaggcgcaaggccgccggagcgtggatccgctcacaggacgcggcgggtcccgatggctggctggcggcggcggaaacgctgtggcgccagccggagcgcgaattccagtacgtggcggtggacctgctggcccgccatgccgccgaattgccggcggccgccctgccgcggctgctggcgctggttgccgccaaatcctggtgggacaccgtcgacggcctggcggcctggatcataggcgagctggtccgcgcccggcgcgaactgcaaaccgacatggacaggctgtccggcgacggcgatttctggctgcgccgcgtcgccatcctgcaccagctgtactggaagcgcgacaccgacgccgcgcggctgttccgctactgcgcggccaacgccgccgaccccgaattcttcatccgcaaggcgataggctgggccttgcgcgaatacgcctataccgatcccgacgcggtgcgcggctttgtcgccgccgctccgcttgcgccgctgtcgcggcgcgaagcgctcaaacgcattgaacccttgcctgtgaaggaagcatga

SEQ ID NO: 249 - DNA, 879 bp, Chromobacterium substugae
atgaccggactcaccaccaccaatctgaccagcctgaagaagatctactccggcaaggtgcgcgatctgtatcagatcgacgagcaacgcatgctgatgatcgccaccgaccggctgtcggctttcgacgtgatcctggatgaccccatcccggccaagggccagatcctgaccgccatctccaacttctggtttgaaaaactgaaggacgtggtgcccaaccacctgaccggcgaaaagccggaagacgtggtggcggcggaagacctgccgcaggtggagggccgcgcggtggtggccaagcggctgaaggcggtgccgatcgaggcggtggtgcgcggctacctggccggctccggctggaaggaataccagcagtccggcgccatctgcggcgtggcgctgccggccggcctgcgcgaggcggaccagctgcccgagcccatcttcaccccgtccaccaaggcggcggtgggcgaccacgacgagaacatcagcttcgcccagtgcgaggccatcgtcggcaaggaactggcggcccaggtgcgcgacaccgccatcctgctgtacaaaaccgcagccgcctacgcggccacgcgcggcatcatcatctgcgacaccaagttcgagttcggcctggacgaaaacggcgtgctgacgctgatggatgaggcgctgacgccggactccagccgcttctggcccgccgacagctaccagccgggcagcaacccgccgtcgttcgacaagcagttcgtccgcgactggctggaagcctccggctggaacaagcaggccccggccccggccgtgccgctggacgtgcgcgagaaaaccgccgccaagtaccgcgaggcgctggaacggctgaccggctga

SEQ ID NO: 250 - DNA, 582 bp, Chromobacterium substugae
atgaccgtcgtccaaccgatactcgacaccccccgcctgcggctgctgccggcccatccggacaaggcggccgcggtgctcgactaccagctgcgcaaccgcgcccacctcgagccgtggaacccgaccgccggaccgttgttctataccgaatcccattgggcgatgcagttgcgccaggccgcccgcaactgggaagagggcgccagcgcgcgcttcctgctggcgacgcaggccgagccggaacggatcatcggcaccgtcagcttcagcaacatcgtccgcggcgtgttccaggcctgccatctcggctacggcatcgactgcgcgcgcgaagggcagggcctgatgcgcgaggcgctgcagtcggccatcgccttcgccttcgacgagctcaagctgcaccgcatccaggccaattaccagccgcacaacgtccgcagcgccgcgctgctgcaaaggctgggcttcgccgtcgaaggccaggccagggattacctgtttctcgacggcgcctggcgcgaccacgtgctgactgcgctgaccaatccgcatttcgacagccggccgctgctgggctga

SEQ ID NO: 251 - DNA, 921 bp, Chromobacterium substugae
atgcaccgtacctttctgaccgccgccgacggcgaagccattccgctgtgcgaatggctgcctgacggcccgccgcgcgccgtggtgctgatttcccacggcatgagcgaatacgccgcgcgctatgaccgtttcgcccaaacgctgacggcggccggctgcgcggtgtacgcgcacgatcaccgcggccacggcgcctcccccgtcccgcgcggctttttcgccgctgaagacggctggcgcaaggtggtggatgatgtggaaaccgtgcgccgccacgcggcggagcggcatgccggcctgcccgtcatcctgctgggccacagcatgggcagcttcatcgcccgcgcctatttcctgcgctacggcggcctgctgtccggcctgatgctgtcgtctaccggctaccgccagcggccgctggcgcggctgttgggcgccgtcgcccgcttcctcgggcggcgcaagggctgggaccggcccagccggctgatggccgcgctggtgttcggcagcttcaatctgggctttccgccatggcggaccaagatggactggctgagccgcgacccggccgaagtggacgcctacctcgccgacccggactgcggcttcgaccctacgccgggtctgtgggccgacctgttcgccggcatcgtcgaaatggaaaacggcgaggcggcgggccagggcatccagcgccgctgtccggtgctgttgttcgccggcagccgcgatccggtcagcctgggccggctggcgctgggccagctggaaatccgctaccgcgacgccggcgtgctggacttgcagagccaggtctaccccggcgggcggcatgagatgctgaacgaaagcaaccgcgccgaggtggaaagcgatatcctcgcctggctggcgcgcgtcgcgcccgccgcctga

SEQ ID NO: 252 - DNA, 612 bp, Chromobacterium substugae
atgatagaagtccaccacctgaatcaatcgcgttcgcgccgcatcacctggctgctggaagaactgggccaagactatgccgtcgtgcgctacgagcgcgatcccaaaacccggctggcgccgccggcgctgaaggccatccatccgctgggcaaggcgccggtgctgcgcgacggcgacgcggtgctgatcgaatccggcgccatcgtcgattacctgatccgcacttacggcaacggccgcttcgcgccggacatcgcttcgcccgactacaaccgctacgcgcagctgatgcattacgccgaaggctcggcgatgctgcccatcctgctgcagctgtatgtcggcacgctgggcgaggccggcgcgccgctgcatccgcgcatccacagcgagctggacaaccatctgggctatctggatggcgaactggctggccgcgattacttcgtcggcgacgatctcaccggcgccgacgtgcagctgtccttcgtcgcccagatagcggtgcgcggcgagggccgccagcgctatcccaatctggcgcgcttcgtcgaccgcatcgaggcccgcccggcttaccgccgcgccgccgagcgccacggcgaataa

SEQ ID NO: 253 - DNA, 567 bp, Chromobacterium substugae
atgtgccaagaaacacaccacgctcacaccgattgcctgaccccgctgcaacagcgcccgctgggccgccgcggcttcctgcgcctggccgcgctgggcggcggcgccgcgctgctgggcagctttgtgccgcgtacggcctgggcggccggcggcaccgacgtgctgctattgtcctgcatggactaccggttggtggatgaaaccgccgccttcatggacagcctgggcctgcgcgacaattacgaccacatcgtgctggccggcgcggcgctgggcgcggtcaccgacaagttcccggcctggaacgccacattctggcagcacctgggcatcgcgctagacctgcaccacatcaagaaggtggtgctgctggaccaccgcgactgcggcgcttacaaggtgattctgggagaggatttcggccagcagccggccagggaaacccaggtccacgccgaaacgctgaggcgcttgagcggcatgatcgtcgccaagcacccgcaactgcaggtggagcgttacctgatggcgctggacggcaaagtggaggcgatcgccgcctga

SEQ ID NO: 254 - DNA, 2022 bp, Chromobacterium substugae
atgagcgtttacccgcacctgctggcgccgctggacctgggcttcaccacgctgaaaaaccgcgtgctgatgggttcgatgcacaccggcctggaagaatccccgaacggcttcgaaaaaatggcggccttctacgccgagcgcgcgcgcggcggcgtcggcctgatcgtcaccggcggcgtcggccccaatgccgaaggctgcgtcgccgagggcgcggcgcagctgtccgacgcgcatgaggtgcccaagcacaagctggtcaccgacgcggtgcacgccgccggcggcaagatcgcgctgcagatcctgcattccggccgctacagcttccaggaaaagtgcgtgtcggcgtcccccttgatcgcgccgatcaatttctacaccccgcgcgagctgtccgacgccgacgtctggcagaccatcgccgacttcgccaactgcgccaagctggcgcaagaggccggctacgacggcgtcgaggtgatgggctcggaaggctatctgatcaaccagttcatcgcccgcgccaccaacaagcgcaccgacgcctggggcggcagcttcgaaaaccgcatccgcttcgccatcgaaaccgtcaaggcggtgcgcgcggcggtcggccccgagttcatcatcatctaccggctgtcgatgctggacctggtgcaggacggcagcaactgggacgaggtggcgcagctggcgctggaaatcgagaaggccggcgccaccctgatcaacaccggcatcggctggcatgaagcgcgggtgccgaccatcgccaccatggtgccgcgcggcggcttcgcctgggtgaccaagaaactgatgggcaaggtgaagatcccgctgatcaccaccaaccgcatcaacacgccggaagtggcggaagagatcctggccggcggctgcgccgacatggtgtcgatggcgcgccccttcctggccgacccggacttcgtcaacaaggcggcggcaggccgcgccgacgagatcaacacctgcatcggctgcaaccaggcctgcctcgaccacatcttccagggcaagctgacctcctgtctggtgaatccgcgcgcctgccgcgaaaccgagctcaactacgaccaggccgccgcgccgaagaagctggcggtggtgggctccggcccggcgggtctcgccttcgccaccgtcgccgccgagcgcggccacgcggtgacgctgttcgacgccgcggccgaaatcggcggccagttcaatgtcgccaagcagattccgggcaaggaagagttctacgaaacgctgcgctacttcaagcgccgcatcgaaaccaccggcgtggaactgaaactgaacacccgcgtggccgcggccgatttggccggcttcgacgaggtgatcctggccaccggcatcgcgccgcgcctgccggccatccccggcgtcgaccaccccaaggtgctcagctatctcgacgtgctcaagcacaagaaaccggtgggcaagaaagtggccatcatcggcgccggcggcatcggcttcgacaccgccgaatacctgtgccacgaaggccagtccacatcgctgaacgccgaagccttcatgcgcgagtggggcgtggacatgacgggcgacaccgctggcggcctggcgccgcagggcgcgcagccgcacccgagcccgcgcgaggtctatctgctgcagcgcaagaccagcaagatcggcgaaaccctgggcaagaccaccggctggatccatcgcgaaagcctgaagatgaagcgggtgaagatggtgtccggcgtcagctacgaccggatcgacgacgccggcctgcacattacggtgaagggcgagcagcagctgctgtcggtggacacggtggtgatctgcgccggccaggacccgctgcgcgaactgcagcagccgctgttggacgccggcaagccggtgcacctgataggcggcgccgacgtggcggccgagctggacgccaagcgcgccatcgaccagggctcgcgcctggccgccgccatctga

SEQ ID NO: 255 - DNA, 729 bp, Chromobacterium substugae
atgacgcaaaacatctacgacacccccgaattcttccacggctacagccaattgaaccgctcagtgcacggtttggccggcgcgccggaatggcccagcctgcgggcgctgctgccggcattgcaaggcgccgcggtggccgatctgggctgcggctacggctggttctgccgctgggcgcgcgaggccggcgccagcgccgcgctgggcctggacgtttcggaaaagatgctggcccaggccgcggcgatgacccgcgacgacgccatcgaataccggcgccagaacctggaaaccttgcaattgccgcctgccgccttcgatctggtctacagctcgctgaccttgcactacatcgccgacctggccggcctgctggccgcctgccaccgggccctgaaaccgggcggccgcctggtgttctcgatcgagcatccgatcttcatggccgcccggcagccggcgtggctgcaggatgcgcaaggcgggcgctgctggccggtcagcggctaccaggacgaagggccgcgcgtcactcactggctgaccgacggcgtgatcaagcagcaccgcaccctcggcaccttgctcaatcaggtgatggccgccggcttcgcgctgcgccacatcgaggactggggccccagcgccgagcaggtggcggcgatgccggagctggccgaggaaagagagcggccgatgctgctgttggtgtcggcgcagcgctag

SEQ ID NO: 256 - DNA, 1260 bp, Chromobacterium substugae
atgactgttcccaccgccttacgccgcgccgccctggccgccgcgctcagcctcgccgcgctgggcagcgcccacgccgccccatcgccgctgctggacgccagccacccggtcagctggtggttcgccttcaaattcaacgccgcctcctttcccggctgcggcggcgcagcccaggtcaacagctgccagttcggcggcaacccgcaaagctataccagcggcagcagctacagccagcaatacgtctacgccagcagcagccagcccagcctgagccagggcggcggctgcatcggcgacacgccggccgatccggtcggcgccaccttcaaccagatctacaacggcaccttgaactacgtggtgtggaacgaccagttctacgacgacccgtccatcccctcctgctccggcaacgcctgcaacgcgccgtgggggcattccaagggcgtgctggcctgggacgcgcagggcaacggcgtggtgatgcaggtgagcacgccgtcgtggccggcttccggcagcgcgcaatatccgcgcagcagcgacggcaacaccctgggctgcgtgcaggacaacgatgtcgaagtcagccagcatttcttctcgctgaaactcagccatgccgacgtgttggcggtgctgcagggcctggccaacgccagcgcggtgaccgatccgggcaatccgcagatcgtcaagaacggcggcccggccgatatccaggcggcggtcagccaactgggccagcaatcggacagcgtgacgccgcaggtgagcaagctgtccagcggcgtcaccctgatcgccaagccttccgcgctgcaagtggcgccgtggcaactggtttcggccgagctgggcggcatttcgctgcgcgccgccacctggtgggaagccagcaagagctacgcgattccgacgaccaccaaggccggcgcgccagcctgctgggatagcagcctgccggcgccgggtccggtggccatcgccacctccggcagctgggccggccagaccttctcgctgaagggcgggctgggcaagaacttcaaccacgccaagatcggcgtcagcaccagcggcggcaccgcctacgcgattttcggcgacatgaaccaggaaggcgcgctgtccggcaattgcgccagcgcccagaacggccgcggcggcctgttcttcgcgctgcccaacgccgcgctggcgcagtccatcggcaagctgatcggcggcagcaccgccgccgccgcgcgctga

SEQ ID NO: 257 - DNA, 876 bp, Chromobacterium substugae
atgctggatctttgcagcagcatggcgatattcgtgcaggccgtggacaaaggcagcttcaccgccgccgccgacgcctgcggcctgtcggccaccatggtgggcaaacatgtccgcgcgctggaagcgcgcgtcggcgcgcgcctgctcaaccgcaccacccgccagcaatcgctgaccgaggtcggccgcatctactaccagcattgccgccagctgctggcggacatcgccgtcgccgacggctgcgccgacgccttgcgcgccgcgccgcgcggcctgctgaaaatccacgcgccggtgactttcggcagcctgcgcctggcgccggcgctggccgtctacctgcgccgccaccccgaggtggaagtggacctgacattggcagaccggatggtggacctggtggaggaaggctacgaggcggcggtgcggataggcgagctggccgattccagcctggtggccaggccgctgcagccctaccggatgtggctatgcgccgcgccggcctacctggccgaacgcggcgcgccctccgagccggcgcagctggccgggcacgattgcctgggcttcgcctactggcgccacaagaatcgctggcgcttcggctccggcgaaaacgtggcggtgcgcgggcgcttcaccgccaacaacggccaggcgctgcgcaccgccgccctcgccggcctgggcatcgtgatgcagccggaggcgctgctggccgacgacgtcgccgccggccggctgctgcgcctgctgcccgaccatccgctgcctagccgccccatgcatctgctctacccggccgaccgccggccgacgcccaagctggccagcttcatcgacttcatgctggccgccttcgcctga

SEQ ID NO: 258 - DNA, 384 bp, Chromobacterium substugae
atgatacgcaacgacgcgcaataccaaaaagggctggagctgatggcgtttctgcatggcggccacaccggcggcgcgcgggtggcgcagatccaggacatttgtccggacttcgccgacatggccatcgcctgggctacaggccacatcctgagccggccggggctggacctggccacccgcgagctgatcctggtggcgtcctgcgccacccagggcttcgcgcagacgcagctggtggcccatgccgaggctgcgctgcgcgccggcgccagccggcggcagatcatggagaccgtgctgcagctgactttctacgccggcgggccggcggtgagcaatgcgctgctggccttgaaggacgtgctggccgaggaggcgtga

SEQ ID NO: 259 - DNA, 1086 bp, Chromobacterium substugae
ttgattttcaatgcattatttgccatgttcatattttccggccgctaccggcatctcgccggcggggacggcctttcattgcgaggagcgttcatgagcatcaggcatgtgattctgctggcggccgccttggccttgccggcctgggcggcggagccgctgccggccttccacggcgacgcccgccagtcttcggtgtccggcttgtcgtcgggggccttcatggcggtgcagtaccaggtggcgtattcggcgtcggtggtgggcgtcggcgtggtggccggcggtccgtactattgcgcgctggacagtttcgccggcaccgccgcctgcatgagcggcccgccgcccagcgcggcgcagttgctggccgcggcgggcatcttcgccgccggcggccatatcgacccgctgcccaacctggccaggagccgggtctacctgttcagcggcagccaggacaacacggtgaagacgccggtggtcgacagtgccgccgccttcttccgcctggccggggtgccggacaggcagatccagtacgagcgccggctgccggccggccatgcgcagatcacgccgacctacggcaacgattgcggaaccaccgcctcgccctacatcaatcattgcagctggcagggacagggttacgaccaggccggcgtgctgctgcggcacatctacgggccgctgcagcccaaggcgcaggcgctgggcggccgggtggtccgcttcgaccagcggccgtatgccgccgtcggcagcagcctggccgacgagggcttcgtctacgtgcccaaggcctgcgagcaaggcgaggcgtgcaaggtccatatcgcgctgcacggctgcaagcagtacgccggcgcggtgggcgacgacttctacgctcacgccggctacaacgagtgggccgacagcaaccgcatcctggtgctgtatccgcaaaccaccacctcggcggcgaatccgcagggctgctgggactggttcgcctacaccgggccggcttatgcctggaaggaaggcctgcagatgcaggcgttgaaggcgatggccgaccgcctggtttccgcgcgctga

SEQ ID NO: 260 - DNA, 1065 bp, Chromobacterium substugae
atgcaacgccagaccgacgacgtcagaatccgcgagatcaaggaactcctcccgcctatcgcccacctgtatgagctgccgatcagcgaacaggcttccgagctgatctacaacacccgccgcgacatctcggcgctgctgcgcggcgaggacgaccgcctgctggtggtgatcggcccctgttcgatccacgacaccgacgccgcgatcgaatacgcgcagaagctggcgccgctgcgcgccgcgctggccggcgagctagtggtggtgatgcgggtgtacttcgagaaaccgcgcaccaccgtcggctggaagggtctgatcaacgatccgcacctgaatgagtcgtacgacatcaacgccggcctgcgcatcgcccgccgcctgctcttgacgctgaacaaccagggcatgccggccgccaccgaattcctcgacatgatcacgccgcagtacttcgccgacctgatcagctggggcgccatcggcgcgcgcaccaccgaaagccaggtgcaccgcgagctggcctccggcctgtcctgcccggtgggcttcaagaacggcaccgacggcaacctgaaaatcgcggtcgacgccatccgttcgtccagcgtgccgcaccacttcctgtcggtgaccaagaccggccattccgccatcgtctccaccggcggcaatccggactgccacgtgatcctgcgcggcggcaaggaacccaactactcgccggagcacgtgcgcgccgccgccgccgaactgaccgcggtcggcctgccgcacaagctgatggtggacttcagccacgccaacagccgcaaggactaccgccgccagatggaagtgagcgccgacgtggccggccagatcgccggcggcgaccgcaacatcttcggcgtgatggtggaaagccacctggtggaaggccgccaggaccagaagcccggctacgagctgacctacggccagagcatcaccgacggctgcctgggctggagcgacaccgagaagctgctgacccaattggccgaagcggtgaaggcacgccgcgccggcgcggccgagtaa

SEQ ID NO: 261 - DNA, 411 bp, Chromobacterium substugae
atggctaaactgaccgaacaggatatcctcaactgggaaggcgatgattacatgaacgccgaccatcttgagttcttcaaggaccggttgttgcaaatgcagcaggagttgctggtaaacgccaacgccactgccaaccatttgcaggaacaggaagcgacacccgatcccgccgaccgggccacgctggaagaagaatacgcgctggaactgcgcacccgcgaccgcgagcgcaagctgctgcagaagatccaggcgtccatccgccagatcgacgacggctcctacggcttctgcgaggacaccggcgaacccatcggcctgaaacgcctgatggcgcgcccgaccgccacgctgtcggtggaggcgcaagagcgccgcgaacgcatgaagcgccagtacgcggactga

SEQ ID NO: 262 - DNA, 306 bp, Chromobacterium substugae
atgaaaaagaccctgcttgccgccctgctgctgggcctggccgccgcgccggcgatggccagcctgcaactggcccagaagtacagctgcacggcctgtcacgcggtggacaagaagatcgtcggcccggcctacaaggacgtcgccaagaaatacgccggccagaaaggcgccgaggcgatgctgatggccaaggtgaaaaacggcggctccggcgtatggggcccgatcccgatgaccccgcacccgaatattcccgacgccgacctgaaggcgctggtcaaatgggtgctcagccagaaataa

SEQ ID NO: 263 - DNA, 585 bp, Chromobacterium substugae
atgtttgtcgataccctgcagttcctgatcaagaccctgtccggcctgttcgtgctggtgctgctgctgcgtttctacctgcaggtggcgcgcgcgccgttcaagcatccgctgtgccagttcgtgatggccgccaccaacttcctggtgctgccgacgcgcaagctggtgccctcggtgcggaattacgacaccgccaccctgctgctggcctggctggtctgcctgctggccaatatcctgaggctgttgctgggctcgctgcccgaggtgttcgctttcccgcaggtgtgggtttcgctgttcctgctgtcggtgctggaagtgttcaagcagtcgctgaccctgctgatgggcgcggtggtggtgcaagcggtgctcagctgggtcaacccctacaatccgatcgcgccggtgctggacagcctgacccggccgttcctgcgtccgttccgccgcgcggtggtgggcggcgtcgacctgtcgccgctggtgctgctgctgatcatccaagtcatcatgatgctgccggtgcaggcgctggaagcaggcttcttgacccaactcaaggtcgtactccagtaa

SEQ ID NO: 264 - DNA, 804 bp, Chromobacterium substugae
atgcgcatcacattcatcggcggcggcaatatggccggcgccatcatcggcggcctggcccgccagggcggccaccgcatccacgtggtggagcatcagcaggacaaaatagaccggctggcggccgacttcggcgccagcggcggccagaccttgcccgagcgtttcgacgccggcgacgtggtggtgctggcggtgaagccgcagcagctgcgcgagctgtgcctggcgctggcgcccgcgcttaacggcgcgctggtggtgtcgatcgccgccggcatccgcctggacgcgctctcgcgctggctgggcagcggccgcatcgtgcgggtgatgcccaacaccccggccatggtcggcaagggcgtgtccggcctgtacgccgacgccgccgtgcccgcggccgaccgcgccgccgccgaaaccatcatgcgcgccgccggcctcaccgtctggctggacgacgaaaccggcatcgacgacatcacctgcgtgtccggcagcggcccggcctacgtgttctatttcatagaaagcatgatagaggccggcgtgaaggccggcttcagcgaggcccaggcgcgcgagctggcattggcgaccttcgacggcgcggtggagctggcgcggcaaagcccgctgccggtagcgacgctcaggcagaacgtgatgtccaagggcggcaccaccgagcgcgccatcgcccgcttcgaagccgagggcgtcaaggcggccatcgtcgccggcgcgatggattgccgcgagcgttcaatcgaaatgggccaacaactcagccaggagtaa

SEQ ID NO: 265 - DNA, 696 bp, Chromobacterium substugae
atgacagacaccctttccacccggctgcgccaggtcggcgcgcggctggccgacgcctgccgccaggccggacgcgcgccggacgcggccgcgctgctggcggtgagcaaaaccttccccgccgccgacctgcgcgaagcctacgcctgcggccagcgcgccttcggcgaaaactacgtgcaggaattgcaacagaagtgcgaagccttggccgacctggcgatagaatggcacttcatcggcccgctgcagtcgaataaaacccgcatcgtcgccgaactcgcgcattgggcgcactcgatagagcggctgaaaaccgccgaacggctgtcggcgcagcggccggactctctgccgccgctgaacgtctgcgtgcaggtcaacgtgtccggcgaggccagcaagagcggctgcgcgcccgaagaggcggcggcgctggcgcgagcggtggcggcgctgccgcgcctgcgcctgcgcggcctgatgtgcataccggagccgaccgccgacgcagccaggctggcggcgcagttcgccgccttgcgcgcgctggccgaagggctgcgcgccgaaggcctgccgctcgacacgctgtcgatgggcatgtcggccgacctggagctggcggtggccgaaggcgccaccctggtgcgggtgggctcggccatcttcggccggcgcggccagccgcaataa

SEQ ID NO: 266 - DNA, 1038 bp, Chromobacterium substugae
atggaaatttccgagctcctggcttttaccgtcaagaacaaggcctccgacctgcacctgtcggccggcctgccgccgatgatacgggtgaacggcgacatccgccgcatcaacctgccgccgctcgaccaccatgacgtgcacgacatggtgtacgacatcatgaacgactaccagcgcaagatcttcgaggacgtctacgagtgcgacttctcgttcgagctgcccggcatcgcccgcttccgcgtcaacgccttcgtgcagaaccgcggcatggcgtcggtgttccgggtgatccccagcaaggtgctgtcgctggaacagctggcggcgccgaagatcttccaggagatcgccggctatccgcgcggcctggtgctggtgaccgggccgaccggctccggcaagtccaccacgctggcggcgatgatagactatgtcaacgaaaacgacttctcgcacattcttaccgtggaagacccgatcgagtttgtccacgaaagcaagaaaagcctgatcaaccagcgcgagctgggcttgcagacccagagcttcgccaacgcgctgaaaagcgcgctgcgcgaggaccccgacgtgatcctggtcggcgagctgcgcgacctggaaacgatacggctggcgctgaccgcggccgaaaccggccacctggtgttcggcacgctgcataccagcagcgccgccaagaccatagaccgcatcgtcgacgtgttcccggccggcgaaaaggaaatggtgcgctcgatgctgtcggaatcggtgcgggcggtgatcgcccagacgctgctgaagtccaaggacggccaggggcgggtggcggcgcacgagatcatgataggcacgccggcgatccgcaacctgatccgcgaaaacaagatcgcgcagatcaactcgatgatacaaaccggccagcagcacggcatgcagacgctggaccagtgcctggcggagctggtgcggcgcaatatggtgtcgccgggcgaggcgcgcgccaaggccagcaacaaggattcgttctga

SEQ ID NO: 267 - DNA, 1137 bp, Chromobacterium substugae
atggaaaaagaccaggcctccaaattcatccatgatctgctgaagcacgcgatcggcaagaacgcctcggacatcttcatttccgccgaatttccgccggcgatgaagatagacggcaagatcacgccggtggcgccgcaacccttgtccgcgcagcagagcaaggagctggtgcgcgccatcatgaacgaccgccagaccgaggagttcgaggcgaagaaggaagccaatttcgcgatcaacccgcccggcatcggccgcttccgcgtcagcgccttcgtccagcagggcatggtgggcatggtgctgcgcaagatcaacaccgacatccccaacttcgaccagttgagcctgcccgaggtgctgaaggacatcgcgctgatcaagcgcggcctggtgatcttcgtgggcggcaccggctccggcaagtccacctcgctggcggcgctggtggactggcgcaacacccacaaccaggatcacatcatcacggtcgaagacccgatcgaatacgtgcatacccacaagaagtccatcgtcacccagcgcgagatcggcgtcgacaccgaaaactgggaagtcgcgctgaagaacacgctgcgccaggcgccggacgtgatcctgatgggcgagatacgcgaccgcgaaaccatggcctacggcctgcagttcgccgaaaccggccacctgtgcctggccacgctgcacgccaacaacgccaaccaggcgctggaccgcatcctcaattttttccccgaagagcgccaccagcaggtgctgatggacctgtcgctgaacatgcgctccatcatttcgcagcggctggtgccgcacaagtccggccgcggccgggtggcggcggtggagatcctgctcaacagcccgctggtgtcggacatggtgttcaagggcgagatcgccggcctgaaggaggtgatggcgcgctcgcgcgaggccggcatgcaaactttcgaccagtcgctgttcgagttgttcgaggccgagctgatcacctacgaggacgcgctgcgcaatgccgactccatcaacgacctgcgcctgagaatcaagctctacagcgaaagcggccgcaaccgcgacccgctggagggcatcgaccacctggatattgtctga

SEQ ID NO: 268 - DNA, 1563 bp, Chromobacterium substugae
gtgcgccagggtctgcgcaccatgctgtccatggccggcatcacccgctcggaagccgtcagcaacgccagcgaggcgcgcaaccgcctgcgcggcaagccttacgacgtggtgctgtgcgactacaacctgggcgaaggcatggatggccaggaattgctggaagccatgcgcaagggcggcaacctgcccttggccaccatctggatcatgatcaccggcgaacgccactacgaaagagtggtggccgccgccgagatggcgccggacgactacatcctcaaaccgttcgcctcgcagctgctgctggaccggatgaacctggccggccagcgcaaggccttcctcgcgccggcgcacaagctattgtccgccggcaaagtggagcaagcgatccaggtgctgcagcaactggcgcgcgaaacctccaacccgcagtaccggctggacgcgcagcgcctggccgccgaattgctggtcaacgaaggccgccagggcgaggcgctgtccatctaccaggagctgctgacccagcgggtgatcccctgggccaagatgggggtggcgcgcatcgtcgccgagcagggcgaaagccaggaatccaacgcgctgctgcgcgagatcatcgccgaagcgccgcgctataccgacgcctacgacctgctggcgcaaaacctgatcgacgacggccagtaccagaccgccgcggtggtgctggagaaggcggtggcgatctcgccgcgcaacttcaaccggctgaagagctgcggcaccgcgctcttgcgctgcggcgacccgaccaaggccgccgactacctgcagcgggcggtggaagtcggccgcaacaacaatttcttcggccccgacgtgctggtggacctgctgcaggcctatagcgaaagcggccagacccagcaactggaccggctgcaggcggaaatctccagccgcatggacgagttgcccggcggccagctgacgatggcggtgtgccgggcgctgaccgcgctggcgcagaagcgccccagcgacgcgctggcccagttgcaatcggtggcggaagacctgcgcgcccgcgaaaccgacttccccagcgcccagcgcttcctcgccgccgcggtgcggctgccggcggaagtcaacagcgagctgccgccgcagtgggcgcacagcatcgcgctgcgcttcgccgacggccgccacgagctgggcacgctgctggagatcgcgcataagcacgaggcctgccacggcgccatcgaaaccgcctacgacacgctgcagaccgaaagtaacaaggcggtggagctggccagcaccggcaagctggaagaggccgccgccatgctctacctgctgtcgcagaagacgctgaacgagcgcatcagcatgaacgcctgcgcgctgctgctgcgcacctgcgaaagccgcagcaaggccggcaagccgtacccggaggaagaccgccaggtgctgcagctgatgcactggctgccgcaggacaacgagcgggtgcgcggcttcatccgccgccaccatgcgctggacccggaatgcgaatga

SEQ ID NO: 269 - DNA, 1614 bp, Chromobacterium substugae
atggctttcaaggcgaacaccacggtattgatcgtcgacgacgcgctgaccatggcccagggcatccgcgccatcctggccatggccggcgtcacccagtccgaaaccgccagccacgccggcgaggccagcaaccgcctgcgcgccaagcgcttcgacatcgtgctgtgcgactacaatctgggcagcggcatgaacggccaggagttgctggaactgatgcgcaaaagcggcacgctgccgctgtcgacgctgtgggtgatgatcaccggcgagcgcaattacacccaggtggtgaccgccgccgagaccgcgccggacgactacttcctcaagccgttcagctcgcagcagctgttggaccggctggagctggcgctgcagcgcaaggcttacctcgcgccggctcaccggctgctggagaagggcaagaccgagcaggcgatccagacgctgcaggaattggcgcagcaggccgacagccggcaaagccggctggacgcgctgcggctgcgcgccgagctgctggtgagcgaaggcctgtacgagccggcgctgcaggtttaccaggggctgctggcgcaggaggagattccctgggccaagatgggggtggcgcgcatcctggccgaacagggcgacagctcccgctccaatgtcctgctcgacgaggtgatcgccatcgcgccgcgctacaccgacgcctacgacctgctggcgcagaacatggtggacgacggcgcttaccaggaagcggccgcggtgttggaaaaggcggtgggcatctcgccgcgcaacttcacccggctgcacaactacggcaaggcgctgctgcgcagcggcgaggcggcgcgggcggccgaccagctgcagcgcgcggtggacatcggccgcaacaacgccttcttcggcccggaagtgctggtcgacctgatgcaggcgcgcagcgaaagcgggcagacccaacagctggaccggctgcagaacgacatctcgacccaattgggcaagcagcccggcggccaattgatgctggcggtgtgccgggcgatggcggcgctggcgcagcagcggccggagcaggcgctgggccagctggaggagggcgcggaatggctgcgggcggcggaaaccactttcgacggcgcgctgcgctttttggcggcgacggcgcggctgccggccggccaggccgccgcgcaggcgccggaatgggcgcgcgtgatcgccttgcgcttcgccgacggccgccacgagctgggcagcctgcaggaggccgcgcgccagcatccggcctgcctggcggcgatcaggaccgcctacgacgagctgcagggcaagagccaggcggcgctggaactggccaaccaggggcagttggaggctgccgccgacatgctgcgccgcgacgcgatggccaccctcaaccagcggctgggcatgtatggctgcgcgatgctgctgcgcatctgcgaaaaccgccagcaggccgcgcaggactacgccgacccgctgcaggatctgcgccagctgctgcaatggctgccgcaggacaacgaaagggtgcgaggcttcgtcaggcggcggcaggcgctgctgcgcccgcgcgcctga

SEQ ID NO: 270 - DNA, 522 bp, Chromobacterium substugae
atgcgcgtcttcctggcctgtctgccgccgcccggctgtctgccgcggctggcgcagtggcagcgggcgatgcagcgcgaggctggcggccgttgcctgcccttgccgcagctgcatctgaccctggcgttcctgggcgagcttggcccgctggccctgcagcgtgccgccgattgcgccgagcgggcggcggcggacctgccggccagcctgacgctggattgcctgggcagctgggaaggcggaataggctggtgcgcgcccgcggcggccgacgcggcgctgcaggcttgggtgatggcgctcaggcgggatttgcgcgcgcaggggctgcggctggacgcgcagccgttccggccgcatctgacgctgctgcgcaagctgcgacagccattgccgccgcagactgtgccgccgttgcggctggcgctgcgcgagctggcgctgatcgcgtccagcctgagtgccgacggcgcgcgctaccagcgcctggacggttggcgcggcggcgcggctcgctag

SEQ ID NO: 271 - DNA, 483 bp, Chromobacterium substugae
atgacgatcaaccacatccgggtgcaggccgaggccttcgacgtcggcgccgaggtgcggcgctggtcggccaacccggcctgcggcgcggtggtcagcttcaccggcctggtccgcgactacggcgaccgccaggacgtggtggcgctggaactggagcattacccgggcatgacggaaaaggcgctggccgacatcgtctgcgcggcgcgcaagcgctggtcgctgaagggcgtgacgctgatccaccgcgtcggccgcctggcgctgggcgaccccatcgtgctggtggtggcggccagcagccaccgcagcgacgccttcgaagccgcctccttcctgatggactatctaaagcagcaggcgccgttctggaaatgcgagatcctcgccgacggcagccggcattgggtggaggcgcgcgacagcgacgccgaagccgcgacgcgctgggatgccggcgcggcggacgcgtccgcctga

SEQ ID NO: 272 - DNA, 252 bp, Chromobacterium substugae
atgcaattgaacatgctgtatttcgcccggctgcgcgacacgctggggctggattcggaaacactggacagcgaggccgccaccgtggccgagctgctggccgagctgcgccaacgcggcggcgagtgggcgcgcgcgctggcggccgggcaaaccttccgggtggcggtcaaccaggacatggcgagcggcgacaccccgctggccgacggcgacgaagtggcggtatttccgccggtgaccggaggctga

SEQ ID NO: 273 - DNA, 876 bp, Chromobacterium substugae
atgtggcggtggctgctgttgctttgcctggcgccggccgtcctcgcggccgagccgatgcgcgtggtgtacccggtcggcgacagcgccgacgcgttccgttacgacgatatccgcgaactgctgcgcgccgcgctggacaaaaccgccgacgcctacggcccctacacgctgcagcccagcggctggccgatggacgaagagcgctcgctggaagagctgcgccgcggccacgccgtcaacgtcgcctggagctccacctcggaagcacgcgagctgagcctgctgccggtgcgggtggacctgcgcaaggggctgctcggctaccgcatcgcgctgatagacggcaagcgccagccggaattcgaccaggtgcatagccgcgccgacctcggccgcttcctgatcggccagggcaagggctggggcgacatcaaggtctaccaggccgccgccttgcgggtcagcaccggccgctacgacatgctgttcggcatgctaagccagcgccgcttcgacctgctgccgcgcagcgtgctggaggtgttcgacgaataccggcatttccacggcaaatacccgaatctggaggtcgagcagcgcctgctgttctattacccgtggccctactacttttcctgcaaccgcgacgatcccgcgctgacggaacgcctgcggctgggacttgcgcggatgcgcgccgacggcagcttcgacgccatcttctggaaataccaccgcgacgcgctgcgccaggcgcggatgagcgaacgccggctgatcccgttcgccaatccgctgctgccggacagcgcgccgctgaacgacaagtcgatgtggtacgaccccctgcgcgaccggccgcccaaaccctag

SEQ ID NO: 274 - DNA, 1065 bp, Chromobacterium substugae
atggcactcgtttctatgcgtcagctgctggaccacgctgccgagtacagctacggcctgccggccttcaacgtcaacaacctggagcaaatgcgcgccatcatggaagccgccgacaaggtcgacgcgccggtgatcgtgcaggcttcggccggcgcccgcaaatacgccggcgcgcccttcctgcgccacatgattctggcggcggtggaagaattcccgcacatcccggtggtgatgcaccaggaccacggcaccagccccgacgtctgccagcgctcgatccagctgggcttctcgtcggtgatgatggacggctcgctgaaatccgatggcaagaccccggccgactacggctacaacgtcgacgtcacccgcaccgtggtcaacttcgcccacgcctgcggcgtgtcggtggaaggcgagatcggctgcctgggcagcctggaaaccggcatggccggcgaggaagacggcgtcggcgctgaaggcgtgctcgaccacagccagctgttgaccgacccggaagaagccgcccgcttcgtcaaggacaccggcgtggacgcgctggccatcgccatcggcaccagccacggcgcctacaagttcaccaagaagcccaccggcgacgtgctgcgcatagaccgcatcaaggaaatccacgcccgcatccccaacacccacctggtgatgcacggctcgtccagcgtgccgcaggagtggctgcaaatcatcaacgaattcggcggcgacctgggcgaaacctacggcgtgccggtggaagaaatcgtcgaaggcatcaagcacggcgtgcgcaaggtcaatatcgacaccgacctgcgcctggcctccaccggcgccatccgccgcttcctggcgcaaaacccgaaggaattcgacccgcgcaaatacctgaaggtgtccaccgacgcgatgcgcgacatctgcatcgcccgctacgaagccttcggcgcctgcggccaggccagcaagatcaaggccatcaatctggacaccatggccaatctctacctgaaaggccagctcgcgcagatcgtgcgctga

SEQ ID NO: 275 - DNA, 630 bp, Chromobacterium substugae
atgccgctgcacacctggctgatgttcatcaccaccatgtttttcgtgtccgccacgcccggccccaacatgctgctggcgatgacccacggcatccattacggcgtgcgccgcacgctgatgacctgcttcggcctgatgagcgcgctgggcctgctgatgctggcctcggtggccgggctgggcgcggtgctggccacctcggaagtgctgttctccgccatcaagtacgccggcgcggtatacctggtgtatctgggcgtgaaaacctggcgcagcccgccgcaaccggtggccgaactgcgcgaggacgccgccggccagcacggcccctgggcgctgtaccgccgcggcttcctggtggcgatgagcaaccccaaggcgctgatcttcttcgccgcgctgttcccgcaattcatggacacccaccagccccaggggccgcagctggccatcctggcgctgtcgttcttcgtgatcgagtcgagctggcaactgacctacgccagcagcggcgccaagctggcgggctggatgaacagcgcgcgccggctgaagctggtcaaccgcttcagcggcggcgccttcgtcggcgccggcgtgctgctgaccagcctgtcgcgtcaatag

SEQ ID NO: 276 - DNA, 1176 bp, Chromobacterium substugae
atgaaattcaacaaactctccgaacagaaccttgccggcaagcgcgtgctgatccgcgtcgacatgaacgtgccgctgaaaaacggcgtgatcggcgacgacacccgcatccgcgccagcctgccgtcgatcgagctgtgcctgcaagccggcgccggcgtgatgctgatgacccacctgggccgtccgaccgaaggcgagccgaagccggaagacagcctggcgccggtggtggagcgcctgtccagcctgctgggcaagccggtgcggctggtagccgactggcaggccggcgtgccgctcgccgccggcgaggtggtgatgctggaaaacatccgcctgaacaaaggcgaaaagaagaacagcgccgagctgggccgcgcctacgccgcgctgtgcgacgtgttcgtcaacgacgccttcggcaccgcccaccgcgccgaggcctccacccacgcggtggcgcagttcgccccgctcgcctgcgccggcgtgctgctgtcggccgagctggacgcgctgtccaaggcgctgctggcgccggcccgcccgctggtggccatcgtcgccggctccaaggtgtcgaccaagctgaccatcctggaggcgctggccgacaaggtggaccagctgatcgtcggcggcggcatcgccaacaccttcctgctggccgaaggcaaggccatcggcaaatcgctggccgaggccgacctggtcgaagacgccaagcgcgtcatcgccaagatccgcgcccgcggcggcgacgtgccgctgcccaccgacgtggtctgcgcgaccgaattcgccgaaaccgccgccgcggccaccaagaacgtggccgaggtgagcgccgacgacatgattctggacatcgggccggattccgccaaagagctggccggcatcatcgcccaggccggcaccgtcgtgtggaacggcccggtcggcgtgttcgagttcgaccagttcggcaacggcaccaagacgctggcccaggccatcgcccaatccaaggcgttctctatcgccggcggcggcgacacgctggcggccatcgccaagtacggcatcaccggcgacatcggctacatctccaccggcggcggcgccttcctggaattcctggaaggcaagcagctgccggcggtggccatcctggccgagcgcgcgcagtaa

SEQ ID NO: 277 - DNA, 1086 bp, Chromobacterium substugae
atgcagcaagggcaggccttgtcccggccggaaaaaatggttcgcctggcctcgtggctggtggcgctggtattcgccgcgctgctggccggcctcggcgaactggtgatccgcgacctgttctacctgccggcaggcgggccgccgcaacaggaagctttccgacagcgcatcgggctggacccgctgaaacggcagcaggaacagctgcagcggcaaaccgaagcgcagcgcgccgaacaagagaagctcgccgccacccgcggccagctggagcgcagctaccagacccagcgccagggactggacaactggctggccagccgcgccgccaccgccgatgccggccagagcggcgaggtggtgcgacgcgcgcgcgcgctggacgcgctgcaggcgcagatcctgcaatggcagcagaaagaagaccaggccagctccggcctgctggcgctggcgcaacggcaacagacgctgcaagcccaggtcgaccggttggagcaacaagccggcgagcaataccagcaggccagcgaccgcttcgagttgaaagtgttcgcgctgcggctggtggtgatcctgccgctgctgctcttgggcgtgtggctgttcctgcgctaccgcgcccaccgctactggttcttcgtctacggcttcggcctgttcgccctgttcgccttcttcgtcgagctgctgccctatctgcccagcttcggcggctatgtgcgcttcctggtcggcatcgcgctcaccgtgttcgccggcatgcgcatgatccaggccttccagcgctacgccgagaaaaaacgcgcggagctgcagcaaagccagggccagcgcgccggccgcatcgcctacgccaaggcgctgctgtcctatcagaagcgcagctgcccgtcgtgcgaccatcaatacaatatcgccggcgacgacgccgactactgcatccattgcggcctgcagctgttccgcgtctgcgcctgcggcgcgcgcaatttcgcctttttcccgttctgcaagaaatgcggcggcgccgtgacccggcccgccgccttgcccgatcatcccgcatccaaacccgagtga

SEQ ID NO: 278 - DNA, 1092 bp, Chromobacterium substugae
atgaccatccgcctcgccatcaacggttacggtcgcattggccgccaggttttgcgcgccatctatgaaaacaagttgcacgacgatttcacggtagtggcggtcaacgcctccggcgaccttggcatcaacgcgcacctgacccagttcgacaccgtgcatggccgctttcccggcagcgtggagcaggatgagcgccacctgatcctcaacggcgacaagattccgttcttcagcacccgcaacccggccgagctgccgtggaaggaactggacgtggacctggtgctggagtgcaccggcgccttcaccagcaaggaaaagtgccaggcccacatcgacgccggcgccaagaaggtgctgatctcggccccgggcggcgacgatgtcgacgccaccatcgtctacggcgtcaaccacgacacgctgaagccggaaatgaccgtggtgtccaacgccagctgcaccaccaactgcctggcgccggtggccaaggcgctgaacgacgcgatcggcatcaagaagggcctgatgaccaccatccacgccttcaccaacgaccaggtgctgaccgacgtcaagcacaaggacctgcgccgcgcccgctccgccaccgacaacatgatccccaccaagaccggcgccgccaaggccgtcggcctggtgctgccggaactgaaaggccggctggacggcttctcggtgcgggtgcccaccatcaacgtttcgctggtggacctcaccttcaccgccagccgcgacaccagcaaggacgaggtcaacgacatcctcaaggccgcgtccgaaggcggcatgcagggcatcctgggctacaacacgctgccgctggtttccggcgacttcaaccacaccgacgaagcctccaccttcgactccacgctgaccaaggtcaccggcggcaatatggtgaaggtgctggcctggtacgacaacgagtggggtttcagctgccagatgctgcgcaccgcgcgcgcgatgttccgctgcgtccggaatcaggcgcgcatggcgacggggcgagcggctgttatgccattcgccctgttgttttgttacataaagcgcgcatga

SEQ ID NO: 279 - DNA, 1989 bp, Chromobacterium substugae
atggttacccgcaccgagcttgccaacgccatccgcttcctctccatggacgccgtggaaaaagccaaatccggccaccccggcgccccgatgggcatggcggacatcgccgaagtcctgtggcgcgatcacctgaagcacaacccggccaacccgtcctgggccgaccgcgaccgcttcgtactctccaacggccacggctcgatgctgatctacagcctgctgcacctgaccggctacgatctctccatcgacgacctcaagaatttccgccagctgcacagcaagaccccgggccacccggaatacggctacgcgccgggcgtggaaaccaccaccggcccgctgggccagggcatcaccaacgccgtcggcttcgcgctggcggaaaaaatgctggccgcccagttcaaccgcgacggccatcaaatcgtcgaccaccacacctacgccttcctcggcgacggctgcctgatggaaggcatcagccacgaggcgtgctcgctggccggcacctggggcctgaacaagctgatcgccttctgggacgacaacggcatctccatcgacggccatgtcgaaggctggttcagcgacgacaccccggcccgcttcgaagcctacggctggcaagtgatccgcaacgtcaacggccatgatccggtggaagtggccaccgccatcgccaccgccaagaagagcgccggcaagccgacgctgatctgctgcaaaaccaccatcggcttcggcgcgcccaccaagcagggcagccacgactgccatggcgcgccgctgggcgccgccgaaatcgccgccgcgcgcgaaggcctgaagtggccgcacgcgccgttcgaaattccggccgagatctacgccgaatggaacgcccgcgaccagggcgcggccgccgaagcccaatggaaccagcgcttcgacgcctaccgcgccgcccacccgcagctggccgccgagttcgagcgccgcatggcgggcgagctgccggccggctggcacgagacgctgaacgccgcgctggccaagatcagcgacgccgcccagaccgtggccacccgcaaggccagccagatcgcgctggaagcgctgtcgccgtccctgccggaattcgtcggcggctccgccgacctgaccggctccaacctgaccaattggtccggcagcaagtggatagacggcgaaggcaacggcaattacatcagctacggcgtgcgcgagttcggcatggccgccatcatcaacggcatgacgctgcacggcggcctgcgcccgtacggcggcaccttcctgatgttcagcgaatacgcccgcaacgcgctgcgcatggcgtcgctgatgaagatcaatccgatcttcgtgttcacccacgattcgatcggcctgggcgaagacggtcccacccaccagccggtggagcaagtggccaccctgcgctacatccccaaccaccacacctggcgtccgtgcgacaccagcgaaaccgcggtggcctgggcgcatgcgatcgaacagaaaaccacgcccagcagcctgatcctcagccgccagaacctgcccttcgtcgcccgcgacgagcgccagctggccgacatccgcaagggcggctacgtgctgcgcgacgccgcaggcgcccgcgccgtgctgatcgccaccggctccgaagtggagctggcgctgaaggcgcaggaagcgctggcggccgaaggcgtcgcggtgcgcgtggtgtcgatgccttgcaccaacgtgttcgacgcccaggacaaggcctggcagcacagcgtgctgccggcgggcctgccgcgcgtggccatcgaagccggccacccggacttctggcacaaatacgtcggcctggacggcgcggtggtcggcatggccaccttcggcgaatccgcgccggccggccagctgttcaaggaattcggcttcaccgtggaaaacgtggtcgccaagacccgctccgtgatacgctaa

SEQ ID NO: 280 - DNA, 132 bp, Chromobacterium substugae
ttgggaaaccggtacgacggctcgtccctgcgccaccatgctgctggagactggggtccaccgccgcaaaaccgccggattatcgccgatttcggcactttcaggcaaccggccgccgcgcgcgcaaattga

SEQ ID NO: 281 - DNA, 747 bp, Chromobacterium substugae
atgcagtcattcgacatcccgccacttccccgcaaggtgggcgccggccgcggctggcgctggtgcgtggaggcgttccacatcgtgcgggaacaaccgctgacctgggtgctgctgaccctggtctacctgctgatccatttcgccatcaacgcggtgccgatgatcggcggcctcgtcggcgccatcatcggcccggtgttcgccggcggcttcgtgatggccgcgcgcaagtcggaacgcggcgaggaactggagctggccgacctgttcgccggcttccgcctgatgcccggcccgttgctgcaggtgggcgcgctgttcttcgcgctgatgctggcggcgatgttggccttggtggcggtgggcgcggccagcggcgtgaccagcgggctgctgggcggccatctgcagctgcaggcgcatagcgatgcgctgttcggggtggtgctggcgctggtcggcctgatgacggtggtgatgttcatcgtcagcctgtgctactggttcgcgccggcgctggtggcgctgggcggcgtcgcgccgtggcaggccatccgcagcagtttctcggccggcctgagcaactgggcggcattgctggtggccggcctggccttgtccttgctgggcctgctggctttggtgccgctgggcctgggcctgctgctgtggttcccggtggtctacgtcaccgcctataccagctggaaggacattttcggccaagaggacgcggcgcgatag

SEQ ID NO: 282 - DNA, 768 bp, Chromobacterium substugae
atgagccgctctccacgtcacgacaagatcctgcaactggtccgcgaaaacggcttcatgccgatcgaagagctggcccgtctgctcgacgtcacgccgcaaaccatccgccgcgacatcaaccagctgtgcgaggccaacctgctgcgccgctaccacggcggcgccgcgctgggcaacagcgtggagaatgaggactactttgcgcgcaagggaaaattccagagcgaaaaggcccatatcgccgacatgatcgcacgcagcatccccgaccacgcctcgctgttcatgagcataggcaccaccatcgaagcggtggcgcaggcgctgaccgcgacgcacaaggggctgcgcgtgatcaccaacaacatccacgtcgcctcgatcatgtccaccaacccggacttcaccgcgatgatcacctccggcaccgtgcgcgcgtcggatggcggcatcaccggcgtggcgacgctggacttcatcaaccagttcaaggtcgactacgcgatcatcggcgtgtccggcatcgaatccgatggctcgctgctggacttcgactaccgcgaagtgcgggtggcgcaggcgatgatgaacaacgcccgccaccgctacctggccgccgaccacagcaagttcggccgcaacgcgctggtgcgcatgggccacatcagcgaattccacaccgtgttcaccgacgcgatgccgccggagccggtgagcaagctgctggaggagcacagcgtgcggctggtgctgtccgaagcctga

SEQ ID NO: 283 - DNA, 1011 bp, Chromobacterium substugae
atgcaaagctaccgtttctcccgcttcggccatctcgaccacctgcaacgccgcgacgacgccatgccgcgccccggccgcggcgaagtcctgctgcgggtgcgcgccagcgcgctcaactaccgcgatctggccctgctcaacggccgctatccgatgagccatcaagacggcctgatcccgctgtccgacgccgccggcgaagtcgtcgagctgggcgaggactgccgccgcttcgcggtcggcgaccgggtttgcaacacctttttcccggaatggttcggcggcccgtttccgccgccgcaggccgcgcgccagtacggcagcaacctggacggctggctgtgccagtacaaggcggtgagcgaggaggcgctggtgcgcgcgccggatcacctggactgggccgaggcggcgacgctaccctgcgccgcgctcaccgcctggaccgcgctgaccgggccgcagccggtcaaggccggcgacacggtgctgacccagggcagcggcggcgtgtcgctgttcgcgatccagctggccaagctgctgggcgcccgcgtgatcgccaccacttccagcgccgacaaggcgcagcggctgcgggagcttggcgccgacgaggtgatagattaccgcgccagcccggactggggcgcggcggcgcgcgagctgagcggcggccgcggcgtggaccgggtggtggaagtcggcggccaaggcacgctggagcagtcgctgcaggcgacggccatcggcggcgagatcgcggtgataggctttctggacgaaggcgcggccccgctcgacttcatgcgcttcttcctgagcggcgccaccttgcgccgcatcgccgtcggccaccgcgaaggattcgaagcgatgttgcgcgcgatagagcagcatcggctgcgtccggcgctggaccgcgtgttcgccttcgacgacgcccgcgcggcctgggagcatttcgccagccgccgcaacctgggcaaggtggtgatcgcgcactga

SEQ ID NO: 284 - DNA, 912 bp, Chromobacterium substugae
atggacttgctggaagacattttcaccgcgatgcaggtggagagcgcgctgtacgcgcagctggaggcgggcgcgccatgggggatcgcgttcagcccgcacgcgtcggcccgtttcggcatcgtcagccatggccgctgctggctgtccggcgccggcctggccgagccgctggcgctggccgccggcgactgcttcatcgtcagcggcggcagccctttcacgctgatggaccagccgggacggccggcggtgccgtgcgagacgatcttcgccggccgcaccgaaggggtgatccgtttcggcggcggcggcgaggaaaccgccatcgtctccggccgcttcctgttcgacgccgccggcggcgcgccgctgatggacctgttgccgccggtgctgcatctgcatctggacgacgagcacgcccgcctgctgcaggcgacgctgcagctgatcgcgcgcgagaacgccggccaggcgctgggcgcgcggctggcggtgcaaaagctggtggatgtgttgctgatccaggcgctgcggatcttctgcctgggcggccagggcggcggctggctggcggcgctgggcgaccgccacctggcgccggcgctgcaggcgctgcaccgcgatatcgccgcgccgtggaccgtggcgcagctggccgggctggccggcctgtcgcgctcggccttcgcccgccatttccgccaactggtcggcgacacgccgctcaattacctgaccggctggcgcgtctaccgcgcgcaaaccctgctgcggcaaagccggctgccgctggccgaggtggcgcagcgggtcggctacgacagcgacggcgccttccagcgcgcgttcaagcgcgtttgcggcgtgccgccgggcgaataccgccgcgccagccggacgggctga

SEQ ID NO: 285 - DNA, 696 bp, Chromobacterium substugae
atgcacgcaaaaaccataggcatcgccggcgtcaccgtgcccggcgccgtagactgcctgtccaagatgcaccggctgtgcgccggccgcttcgccgcccaccatcacccgcgcttcgcgctggaccagccggatttcggcgtggtgcaccaggcgcaggacgacgaccgctgggataaggtcgccgactccatcgtcggctcgctcgaacgcctggccggcgccggcgccgcactggcggtgattcccgccaacaccgtgcacctggtggtggaagacatccgcgcgcgctcgccgattccgctgatcagcatgctggacgtggtggccgacgcctgcgccgcccgcggcctgaagcgggtggccatcctcggcacccgctggaccatggcccggcatctgtaccaggcgccgctggccgcgcgcggcatcgaggaagtgattcccgacgaggcgcagcaggcggtgatccagcgcgccattttcgaagagctggtgcccagcggccgcgccagcgaggccacgctggccgcgctgctgcaggtagtggcggcgatgaaggcgcagggctgcgacggcgtggctctggcctgcaccgagctgccgctggcgctgaacgacgccaattgcggcgtgccggcgatagacaccacgctggcgctggccgaggccgcgatcgcccgggcctgcgcctga

SEQ ID NO: 286 - DNA, 1554 bp, Chromobacterium substugae
atgaaccccctgcacccgcgccgccaacaccggctgtcccaccagctgctggccctgctggtctgcctgactcccttgctgaccgccgcgccggcgctggtatggcaagaacagcaggacctgcgccagacggcgcagcagcaaacccggcacggcgtggccatggtggacgacatcctggacgaggccgcccgcgccacccgcgcgatcctgccgctggccggcggcgcatgcgccgacgccgaatacgcgctgcggcggcaaaccgccgcctcccccttcgtgcgcagcctgtcgttggcgcgcggcgacctgatgtactgcacctcggtgtccggccaggtcgccatcgcgatgccgcagcgcgacttcaccgacaagcggctgaacctgacccacggcaacaagatcacgcccggcgtgccgctgctgtactaccggctgcaaggcgcgggcggcgacgcgatggccacggtggacggccgctacctgcaactggcgctgcaagacgccagcgacagcaatccggtgttcatgcagataggcgacgaatggatagggccgcgcctcgccggcgacggccaggcgccgctggcctggagattccgcgccaccgcgcattcgtcggtttacccctactcggtggtgacaggctacgacatgccgccctggcacagcttgctgtgggacgaccacgccgcgctgaccgtgacgctggccttgctgggcctgctcgccggcgccacgctgtactggctgttgggccggccggcctcgcccaccgacgagctcaagcgcgcgctggccaatgatgaattcgaaggctttctgcagccggtggtgaagcccggcgcgccgggctggcagggcgcggaagtgctgatgcgctggcgccatccccgcgaggggctgatccggcccgacctgttcattccccgcgccgaggaaagcggcatgatcgtgccgatgacgcggcggatgatgaagcaggtggcgcgccggctgcggcaacagccgttgccggccggtttccatctgggcttcaatatcagccgcgcccacctgcatgacccccacttctacgccgattgccaagagctgcagcaattgctggctggcagccaggcggcgctgacgctggagctgaccgagcgcgaaatcgtcgaaatcacgcctgaagtggcggaactgttccagaagctgcacgatctgggcgtcaagatcgcgctggacgacttcggcaccggccattccagcctggtgtatctgcagcaactggcggtggacgggctgaagatagaccagggcttcgtcgccggcatcggcagcgacggcctgtccgcccacatcgtcgacagcgtggccgagctggcggccaagttgggcctggaaacggtggccgaaggcgtggaaacccaggcgcaattcgactacctgagccagctgggcgtgggctggctgcaaggctatcacatcgccaggccgatgccgctggaggagttcatccagcgcctgcgcgccggcgacacctggcaacaaggtacgagcaattga

SEQ ID NO: 287 - DNA, 1380 bp, Chromobacterium substugae
atgcaagaccaacacgcctggtccggccgcttttccgagccggtatccgaactcgtcaagcactacaccgcctccatcggtttcgactaccgactggccgaagtggatatcgaaggctcgctggcccacgccgcgatgctgaaccgatccggcgtgctgtccgacgccgacctggcggcgatccgccagggcatggccgaaatccgcgaccagatccgcgccggcgagctggcatggagcgtggacctggaagacgtgcacatgaatatcgagcgccggctgaccgaccgcatcggcgacgccggcaagcgcctgcacaccggccgcagccgcaacgaccaggtggccaccgacatccggctgtggctgcgcggcgagatcgacgccaccgtccacctgctggccgagctgcaaaagagcctgctcgacctggcggaacagcacgccgccaccgtgatgcccggcttcacccacctgcaggtggcgcagccggtcaccttcggccaccacctgctggcctatgtggaaatgctggcgcgcgacgccgagcggatgcaggactgccgcaagcgcgtcaaccggcttcccttgggcgcggcggcgctggccggcaccaccttcccgatcgaccgccgctacaccgcccagctgctgggcttcgacgacgtctgccacaactctctggacgcggtgtccgaccgcgacttcgccatcgaattcgccgcggcggcgtccttggtgatgatccacctgtcgcgcttgtcggaagagctgatcctgtggatgagcccgcgcgtcggcttcatcgacatcgccgaccgcttctgcaccggctcgtccatcatgccgcagaagaaaaacccggacgtgccggagctggtgcgcggcaagtccggccgcgtggtcggccacctgatcgcgctggtcaccctgatgaaggcgcagccgctggcctacaacaaggacaaccaggaagacaaggagccgctgttcgacaccgtcgacacgctgcaggccacgctgcgcatctacgccgacatgatgcgcggcatcacggtgaagccggaggcgatgcgcgcggcggtgctgcagggctacgccaccgccaccgacctggccgactacctggtgaagaagggcctgccgttccgcgacagccacgaagtggtggcgctggcggtgcgccacgccgagcggcagggcgtggatctggccgagctgccgctctcggcgctgcaaggcttcagtgcgctgatcgccgatgatgtctataccgtattgacgccggagggcagcctcgcccagcgcgaccatgtcggcggcaccgccccggcgcaggtggcggcgcagatcgcccgccaccgcggcaggctgggctga

SEQ ID NO: 288 - DNA, 810 bp, Chromobacterium substugae
ttgctgaaaacatttccaagcaaagccgccgtgaagacactgcttgccctgttgctgtcctgcctgggactgctggcccagccggcgctcgcctccgacaacggaccgcgcccgctggtgctggcctacaacgccttcgcgccgtggaaaaactacgacggccagggccagccctccggcccttacaccgaaatcgtccgcgagctggcgcgccgcctgcggctgccgctgcgcttcctcaactgcccgctgccgcgctgcctggccgccatgcagcagggccgggccgacctgatgataggcgtgcagcacagcccgcagcgcgcccgctacctggactacctggagccgcccttcgccagcggcaaccggctggcgctgtaccagcgcggcaacgatccgcgcgtgatccgccgctaccaggacctgctgccgctgacggtgggcgtggtggagggcgtgcaataccaggaagctttcgaccaggacgggcgcctgcgccgcgacaccgcgctgacgatggagtccagcttccgcaagctggccgccggccgcatcgacgtgctgatcggcaacgagcagcagaccggcctgctggcggccagccacgaattcgccggccgggtgcggcgcgccggcctgacgctggacgacctgcgcccgcaccggctggcgctggcgcaaaactcgccgttccacgccgaaaaggcccgcgtctcgcaggcgctgcaggcgatgctggacgacggcagcgtcgcccgcatcctggccgggctgccattgcggccggccgccgccgccccgcgctga

SEQ ID NO: 289 - DNA, 744 bp, Chromobacterium substugae
atgagcgcaatgatttcactgaaccaggtcagcaaatggtacggcagcttccaggtgctgaccgactgcaccacccaggtatccaagggcgaagtggtggtggtgtgcggcccgtccggctccggcaaatccaccctgatcaagtgcgtgaacgcgctggagccgttccagcagggcgagatcgtcgtcgacggcatttcggtcggcgatccgaaaaccgacctgcccaagctgcgtagccgcgtcggcatggtgttccagcacttcgagctgtttccgcacctgtccatcaccgaaaacctggccatcgcccaggtcaaggtgctgggccgcggccgcgaggaggcgatgtccaagggcctgaagctgctggaccgcgtcggcctgaaggcgcacgccggcaagcaccccggccagctgtccggcggccagcagcagcgggtggccatcgcccgcgcgctggcgatggacccgatcgcgatgctgttcgacgagccgaccagcgcgctggacccggagatgatcaacgaagtgctggacgtgatgaccgagctggcccaggaaggcatgaccatgatgtgcgtgacccacgagatgggcttcgcccgccgcgtggccgaccgcgtgatcttcatggaccagggccgcatcgtcgaggactgcaaaaaggacgaattcttcggcgacctggacgcgcgcagcgagcgcgcgcgccagttcctgtccaagatcctgcagcactga

SEQ ID NO: 290 - DNA, 666 bp, Chromobacterium substugae
atggatttcagccaaatcctcccggcgctgccgggcctgtcgcagggcatggcggtgactttgaagctgctggtcggcggcgtggccggcggcgtgctgctcggcatcctgctggcgctcgcgcgcctgtccggcaacaagctgctggccggcttcgccaccgcctatgtctactatttccgctccattccgctgctgctggtgatctcgtggttctacctggcggtgccgctgttgatcaactggctgaccggcagcctggagccggtgggcgcgttcacctcctgcctcaccgccttcgtgatgttcgaggcggcgttcttcgccgagatcgtccgcgccggcatccagtccatccccaagggccaggccgccgccgcctacgcgctgggcatgcgctaccaccaggtgatggcgctggtggtgctgccgcaggcgctgcgcaagatgatgccgctgctgctgcagcagtccatcatcctgttccaggacacgtctctggtatacgctgtcggcctgatggactttctcaacaccgcccgctccaagggcgacatcgtcggcctgccgcacgaattcctgatattcgccggcctggtctacttcgtgatcagcttcggcgcttcccggctggtgaagcgcctgcaacaaggattggctgtatga

SEQ ID NO: 291 - DNA, 741 bp, Chromobacterium substugae
atgaattaccactgggattggggcgtgttcttcaagccgaccggcgtcggcagcgagatctacctcaactggttcgtcagcggcctgggctggacgctggcggtggggctgaccggctgggtcatcgccctgttggtgggcgtggccgcgggcgtggcccgcaccctgcccaatcgctgggtggcgggcctcgccaccgcctatgtcgacctgttccgcaacgtgcccttgctggtgcagctgttcgtctggtacttcctggtgccggacctgctgccgcaagccgcgcaaacctggttcaagcaggacctgtcgccgaccacctcgcagttcctgtcggtggtggtgtgcctgggcctgttcaccgccgcgcgggtggcggagcaggtgcgcaccggcatcgaggcgctgcccatcggccagcgcaacgcggcgatggcgatgggcttcggcctgggccagacttaccgccacgtgctgctgccgcaggcgatgcgcatcatcatcccgccgttgaccagcgaatttttgaacatcatcaagaactcgtcggtggcgtcgctgatcggcctggccgagctgttggcgcagaccaagcagaccgccgaattctcggccaatctgttcgaggccttcacgctggccacggtgatttatttcgtcatcaatatggcgctgatgctgtcgatgaacgcgctggagaagaaactgcgcgtgcccggcacgatgggaggcaaatga

SEQ ID NO: 292 - DNA, 909 bp, Chromobacterium substugae
atgcgcattcgcacctccgtcatcgccggatgtaccatcgccgccctggcagcgctggcggcgcaaaccgcctccgccgccgaactgaccggcaccctgaagaagatcaaggactccggcgtgatcgtgctgggcaaccgcgattcctccatcccgttctcctactacgacaacaaccagaagccgatcggctattcggtggacctggccaacaaggtagtggacgaggtgaagaaagagctgaaaatgccgaacctgcaggtgcgctacaacctggtcacctcgcagacccgcatcccgctggtgcagaacggcaccgtggacctggagtgcggctccaccaccaataacgccgagcgcggccgccaggtggcgttctcggtcggcatcttcgagatcggcacccgcctgttgaccgccaagacttccggcatcaaggacttccccgatctgaagggcaagaacgtggtcaccaccgccggcaccacgtcggagcgcctgatcaaggcgatgaacgccagcaagaacatgggcatgaacgtgatttcggccaaggaccacggcgaatcgttcctgatgctggagtccggccgcgccgtcgccttcatgatggacgacgcgctgctgtacggcgaaatggccaaggccaagaatccggccaactggacggtgaccggcaaatcgcaatcgtatgagatctacggctgcatgctgcgcaaggacgacccggccttcaagaaggtggtggacaccgcgctggccaacaccttcaagtccggcgaagtcaacaagatctacgccaagtggttcaccagcccggtgccgcccaagggcctgaacctcaacttcccgatgtccgacgagctgaaggcgctgctggccaagccgacggacaagcccgccgaataa

SEQ ID NO: 293 - DNA, 789 bp, Chromobacterium substugae
atgagcaagcacattccacgcaagcgtttcgggcagaacttcctgcaggacgccggcgtcatcgccagcatcgtccatgcggtcaacccgcagccggacgacatcgtcgtcgaaatcggccccggcctcggcgccatcaccaagccgctgctgtccagcctcaagcatctgcacgtggtggagatagaccgcgacatcatcgagcggctgcgcgccgagcacccggccgacaagctgaccatccacgccggcgacgcgctggccttcgatttcggctcggtcagcgcggcgccgctgaagatcgtcggcaacctgccgtacaacatctccacgccgctgctgttccacctggccacttacggcaaccgggtgctggacatgcacttcatgctgcagaaggaagtgatcgagcggatggtggccgagccctccaccgccgattacggccggctgtcggtgatgctgcaataccgcttctacatggaaaacatcctgttcgtgccgccggaagcgttctggccgccgccgaaggtggactccgccgtggtgcggatgatcccggcgccgggccgctgcggcgtggcgcgcgacgaggcgctgctggaaaaactggtgatccaggccttcgcccagcgccgcaagacgctgcgcaacaacctcaagggcctggccgacgtcgccgacctggaagcgctggccatcgatccgggcctcaggccggagaacctggcggtggaagactacgtccgcctggccaaccatctgtccgacaagggcgtcaaggcctga

SEQ ID NO: 294 - DNA, 1299 bp, Chromobacterium substugae
gtgaacgattgtaagcgcccggcaagcctcgcccagcgattaaatgacaaaggaaacaatgcattaaccaaatattcaaatggcaaattagggtttggcgatggcatttgttatgatgagcgccttttccgccgcaggcccgccatgtcgcccaccagtctcgccgtccgccaggccaacccggccaccgccgccgccatcctgctgatcctgttcaatccgctgggcatagacttgtacctgccggcgctgccggcgatgcggcagttcttccaggccgacgcggcggccagcatcagcgtgttcgtgttcagcctggggctggggcaattgctgttcggcccgctggccgaccgcgtcggccgccgcccggtggcgctgggcggcctgctggtctacgccgccagcgcgctgctggccagccgctgcgattcgctgccactgttcctgtccctgcggctgctgcagggactgggcgccagcgccagcacggtcagcgccttcaccatcatccgcgactgcttctccggcaacgccgccggccagcgctacagcctgctcaacggcgcgctcaacatcgtgccggcgctggcgccggcctgcggcggctggctgagcgtcgcctatggctggcaagcctgcttcgtgttcctggcggcggcggcgctgctggccttcgccgcgctgtactggctgatgccggaaacccggccggagcggaccgacaaaccggccggccccggcttcgccgcggtgctgcgccatccggcgatgctgcgcaacggcgcctgcggcagcaccgcgctgggcctgatcatcagctacgtcacgctggcgcccggcgtgctgatcggccgcgaggggctgtccagccaaaccttcggcctgttgttcggcgccaacgcgctgctgatcatggcggccagcttcatcggcctggcgctgatcggccgcttcggccagcgcgcggtgctgcgaagcggcctggtggtgatgctggcggccggcgcgctgctgctgattctggccggccatgccggcgcctggcactacatgctgccggtggcggtgctgagcgtgggcttcgcctgcacgctggggccggccgccggcatggcgatggcgccgttcggcgaagccgccggccgcgccgccgccatcctgggctgcgtgcagatgctgttcgccgcggtgctgtcggccacgctggccgcgctgccggtggcgggcgagacggcgctgggcggcgcggtggtcgcgctgtcgctgctatgcctgttcctgcagcgcaaggcctga

SEQ ID NO: 295 - DNA, 597 bp, Chromobacterium substugae
atgagcaccaatgacacccgaatatacctggcctccggcagcccgcgccgccgcgagatactggaacagctgggcctgcatctggaacgcattcacgccgacatcgacgaatcggtgctgccgggcgaggacgccgtcgcctacaccgagcggttggcgcgagaaaaagccgaagccggctggaaagtggtttcttcctgcggcctgcccgaacgcccgctgttggccgccgacaccacggtgacgcaggacggcgagatcttcggcaagccggcagacgccgacgacgcccgccgcatgctgcgcgccttctccggccgcagccaccaggccatcaccagcgtcgccgtgatgcgcggcgccaggctgctcgtcaagacttcggtcaccgatgtgttcttcaagccgctgtccgacgccgagatcgaacgctacctcgccagcggcgagccgttcgacaaggccggcgcctacggcatccagggcaaggccggggtgttcgtcgagcatatcgaaggcagctacaccggcgtgatgggcctgccggtccatgaaaccgcgctgctgctggccgaattcggcttcgagctgccataa

SEQ ID NO: 296 - DNA, 1497 bp, Chromobacterium substugae
atgctgcatcaatcgatagccttgccgcgcgacctgccgcggccgcaagaacagatcctggtcaacatcacgccgcaggaaacccgcgtcgcggtgctggaagaaggcatcgtccaggagctgcatgtcgaacgcgccgccagccgcggcatcgtcggcaacatctacctgggccaggtgaagcgcgtgctgcccggcatgcaaagcgccttcatcgagatcggcctggagcgcgccgccttcctgcatatcgccgacgtgctggaacagcgccagcacccgaccgagccgcagcgcatcgagaagatgctgttcgaaggccagaccgtgctggtgcaggtgatcaaggacccgatcggcaccaagggcgcgcggctatcgacgcagatttcgctggccggccgcttcctggtgcacctgccgcaggaagagcacatcggcgtgtcgcagaagatagaaagcgacgccgagcgccacagcctgaaggcgcggctggaaaagctgctgccggacggcagcccccggggctacatcatccgcaccagcgccgagaccgcccgcgacgacgagctggcggccgatgtggaatatctgtccaagctgtggaccgacatccgcctgaagtcgcagacgctgccggcgcaaagcctgctgtacgacgatctgccgctggcggtgcgggtgctgcgcgacatggtcagcggctacaccgacaaggtgctggtggactccaacgagaactacggccgcatggtggagttcgccgagcagtacgtgcagatcgccgtcgacaagatcgaacgctacgccggcgagcggccgctgttcgagatgcacggcatcgaggccgaaatcgacaaggcgctggcgcgccgcgtcaacctgaagttcggcggctatctgatcgtcgaccagaccgaggcgatgacgacgatagacgtcaacaccggcggcttcgtcggcaaccgcaacttcgacgaaaccatcttcaagaccaatctcgaagccacccaggtgatcgcccgccagctgcggctacgcaatctgggcggcatcgtcatcgtcgacttcatcgacatggacaacgacgagcaccaggcggcggtattggccgagctggccaaggcgatggcgcgcgaccgcacccgggtgacgctgaacggcttcaccagcctggggctggtggaaatcacccgcaagcgcacccgcgagagcctggcccacgtgctgtgcgagccttgcccgacctgccagggccgcggcgagatcaagaccgcgcagacggtgtgctacgaggtgcagcgcgagatcgtgcgcgaggcgcggcagtacgacgccaagggctaccgcatcctggcggcgcagtcggtgatcgacatgttcctggacgaggaatcgcaaagcttggcgatgctggtggacttcatcggcaagccggtgtcgctgtcggtggagtccagctacacccaggagcagttcgacgtggtgttgttgtga

SEQ ID NO: 297 - DNA, 741 bp, Chromobacterium substugae
atgaaccgcatcgccatcagtagcgccctgctgttgacgctggccggctgcgccagcaacagcgacctggaagccacccgccgccagctggacctggtgaatcaacaggccaccaaccgcatcgccgcggtggagaccaagctgtccaacgacaagttgctggaaatggtcagccaggtggacagcctgaaggccgaagtcgccaagctgcgcggcgacatcgaagtgctgaactacaatctgcaaaccacgcagaagcgccagaacgacctctacaacgacctggacggccgcctgtcccatctggagggcgccggcaagcaggacgcctcgcaaccggccgccgcccggcaagccgccgccggcgacagccaggccagccccgactacgacaaggcgctgaacctgctgcgcgcgcgcgacttccccaacgccatcaacgcgctgggcctctacatccagcagaatccgcaggcgccgcaagcggtcgaggccagctactggctgggcgtcgcccataccgcgctgcgccagtacgacgccgccatcgacatccaccgccgcttcgtcgagcaaaaccccggccaccatttcgcgccggacgcgctgcgcaatatcggcaactgccagcgcgagctgggccaggtggaccaggcgaaaaacactttccgccgcctgatcaagctgtacccgaagagcgacgccgcgcaaaaggccaagcaacagctggcccgcatgtaa

SEQ ID NO: 298 - DNA, 522 bp, Chromobacterium substugae
atgaactggaaacaactcgtcctcggcagcgcggtcgccaccctgctcgccgcctgcgccagcaccaagcccgctgaagccccggcagccccggccgcccaggcgccggtcacccaggcgccggcagacacctccgccagcaaccagggccaagtggcgatggatccgctgaacgatccgaacagcccgctggccaagcgcagcgtctacttcgccttcgactcctccaccgtcgacggcgaaggcaagaacaccgtcgccaaccacgccgactacctgaagggccacgacaagaaagtgatcatccagggcaataccgacgcccgcggcagccgcgaatacaacctggccctgggccagcgccgcgccgaaagcgtcaagcacgcgatggaagtgctgggcgtgaaggagaaccagctggaagcggtcagcttcggcaaggaaaagccgaaggctaccggcacgtctgacgccgactacgcggaaaaccgccgcgccgacatcgtctaccagggccagtaa

SEQ ID NO: 299 - DNA, 1257 bp, Chromobacterium substugae
atgctgctgctggcgatgctggccgccggcagcgcccgcgccgagctgaatatcgaaatcatcggcggcggcaacagccgccacgccatctccatcgtgccgttcaaggacgaggcgcccacccagggcaacctcaccccggtgataggcaacgacctggcgctgtccggcgccttccgcctggtggacccgtccgccgtcgccaacgtgccgttcgagccggccgacatccgctacccgctgtggcaggccgccggcgcgcaatccatcgccatcggcaaggtggagcaggccgctggcggccagctgaagatcagcttccgcctgatggacgcgtcgcagcgcaagcagctgaccggcggcgaattcacagtgacgccggaccgcagccgccaggtggcgcatgcgatcgccgacatgatctacgaggcgatcaccggccagaagggcttcttcaacacccgcctcgcctacgtgctgaaatccggccgcagctacgcgctgcagatttccgacgtcgacggccagcgcagccagaccatcctgcgctccagcgagcccatcatctcgcccagctggagcccggacggccgctacatcgcctacgtttccttcgccagccagaaaccggtggtgtgggtgcaggatctggccaccggccagcgccgcgcggtggccaacttcaagggcagcaactccgccccggcctggagcccggacggcagcaagctcgcggtggtgctgaccaccagcggcaattcgcaggtctacatcctcaacgccgccggcggcagcccgcgccggctgatgtacaacggcggcatcgacaccgagccggcgttcagcccggacggctcgatggtgtatttcgtctccgaccgcagcggcaacccgcaaatttatcgcgtgccggtaaacggcggcgacgcgcagcgcgttacctgggaaggcaagtacaacgtgtctcccaagctgtcgccggacggcaagaccctggtctacatccgtcgcgaagccggaaatttccgcgtgatgtcgcaagatctcgcaactaatgacacgcgtctattgtcagatggtagttacagcgaacgccccagcttcgcgcccaatggccgcatggtgctgtactccagcgatatcggcggccgcagcgtgctgtacgcggccaccgcggacggcagcagcaaagtgaagctggcggtgctcaatggcgatgtgcaggacccggcatggggtccattcaacaatccttga

SEQ ID NO: 300 - DNA, 885 bp, Chromobacterium substugae
atgagttcgcaatcgccctcctccctgcgcccctggaccctgatcgcctcggcgctgttccacgccatcgtgatcggcctgttgctgtggggcggcctgcagaccacgccgccgcccagcccggcgccgctggcgctggagctgtggaccaccgcgccgccgccgcccgcagcgacgccggttccggttgagcctacgcctgcgccgacacccgcgccggtggtcgcggcgccgccggccgaggtgaacctgggccggaaggacgcgccgaagccgaagaaggaagaaaagcctaaacccgcggaagagcccaagccggaggcgaagaagcacgtggccaagccggaagagccgaaaaagcccgagcccaaacccaagccggcggagcaggccaagcccaagccggtcgaagagaaaaagcccgtcaaggccaccccgccgccgccggccaagcacggccataaaccggacaaaacctacaacaacgaggccgacgacctgctcgccagcctggacagcacccgcgtcagcggcaagcccaacgcccgcagcgaccaggccggcagcaagcacggcgtggccggcggcgcggtcaacggctccggagtcaacgccggctggatagacatggtcaaggccaaggtcaccccgctggtgcagattccgcccggcatccagggcaatccggcggtggtgctgcggatcacgctgctgcccaccctggaagtcaaaaccgtgcagctggtgaaaagcagcggccaggcggcctatgatgatgcagtgcaaagagcggtctgggaggcgaaaaccttccccaaactgcccgccggggccaacttcaacgacggctaccgaacctttaccctgaccttccgcccgcactga

SEQ ID NO: 301 - DNA, 387 bp, Chromobacterium substugae
atgaaccagatgaacgtcgtgccctatatcgacgtgatgctggtcttgctggtgattttcatggtcaccgccccgatgttcacgcccggcgtgatcgacgtgcccagtgtttcagaggcgccagccatcgacgtgcggccgatagaagtcacggtggacgccaccggcaagatcgagctggtggacggcgagcagaagagccgcgtcgattcgctagatgacctggccagccagctgcaggcgctggtgggcgagaacccgcgcccggtggccatctccgccgacgccaacctcaaatacgccgaggtggtgcggatagccgaccgcctgcaccaggccggcgtcaagcgcgtggcgttgaccgtcaagcaaacgccgaagcaatga

SEQ ID NO: 302 - DNA, 666 bp, Chromobacterium substugae
atgaccagccgcaccgtggcgctagaccgcgccctgcacgattacctgttcaacatcggcgtagccgagcacccggtgcagcgcgagctgcgcgaattcaccgccggccaccggctggccaagatgcagatcgcgccggagcaaggccagttcatgggctggctggcgcggctgatcggcgcgcgccgctacctggaaatcggcgtgttcaccggctacagcgcgctgaccgtggcgctggcgatgccggaagacggcgaagtggtggcctgcgacgtcagcgacaccttcaccgccatcgcccgcgaatactgggccaaggccggcgtcgccggccgcatcgacctcaggctgcagccggcgctcaatacgctgcaaacactgctggacgacggccgggccggcagtttcgacctggccttcatcgacgccgacaagccgtcctaccgcgactactacgaagcctgcctgcaactggtgcgtcccggcggcgtcatcgccatcgacaatatcttcctgtccggccgggtggtggcgcccaagccggaagacccgcccggcgtccacctggtgcacgcattcaacgccagcctgaaagccgacccgcgcgtgcacatgtgcgtgctgccggtgggcgacggcctgacgctgtgcacgcggcgctga

SEQ ID NO: 303 - DNA, 180 bp, Chromobacterium substugae
atgtaccagtccgaattcacccagttcatcaatggcttcctggagaaaaacccggaagtggacagccagcgccgcgaactgcgcctgaccctgtgggaccgccagcccaacctggaagaccagcgccgctggaaagaatcgcaagtgccgcaaaagccttacgtctaccagccggaataa

SEQ ID NO: 304 - DNA, 591 bp, Chromobacterium substugae
atggagaaaaaccgcctggaggcgttcagcgacggcgtgatcgccatcatcatcaccatcatggtgctggatctgcatattccgcacgacaccaccttcgccgcgctgctgcagctgtggccgatcttcctgtgctacctgctgagcttcgtctatgtcggcatctactggaacaaccaccaccacttctaccacgccacccgccgcatcgacggccgggtgctgtgggccaatctgcacctgctgttctggctgtcgctgattcccttcgtcaccggctggatgggcgaaaaccatttccagccgctgccggtggcgctgtacggcgcggtgctgctgatgtgctcgatcgcctggtggatcatgcagcaggcgctgctgtgcctgcccggcaaccgcacccggctggccgaggcgctgggcggcgacatcaagggcaagatctcgccggtctgctacctgctggcgatctgcctggcctggcgcctgccctggctgtccggcctgctgtacctggcggtggcgctggcctggctgattcccgaccggcgcatcgaatgcctgctgtacggcgacggccagccggactga

SEQ ID NO: 305 - DNA, 990 bp, Chromobacterium substugae
atgcccagccctattccgacgccgctgccggacttccgcaatctaggcgtgatgctgcgcatcctgctgctgccgctggcgctgttattcatctacggcctgctggcgccgccgacggcggagccgctatggcgctggctgcagctagcgctgctgctgctgcccggcagcctgctttcgctggcgctgctggcgctggccagcccctggctggcccgccggcggctgggcccgagctgggccaccgcgctgaccggcgccggcttcgcgctctgccaatggcggctgcagccggaagcgcctttcgcctggcggacgccggcgctggcgatgctggcgatggcgctgctgctgcactatctgtcgctgcgccagcgcgcgctgtcgccggcgctggccgaagcccggctggccgcgctgcaggcgcgcatccgaccgcacttcctgttcaacagcctgaacgccgccatcgcgctgatccgctctcagccgcagcaggccgagacggtgctggaaaacctggccgagctgttccgcgcccagttggccgaccccgaccgcgcctccacgctggcgcgcgagatcgagctggccggcatgtatctggcgatagaaagcgagcggctggggccgcggctgaagatcagctggcgggtggaggcgccgctggacgccgcgatgccgccgctgatcctgcagccgctggcggaaaacgcggtctaccacggcgccgagcaatcgggcggcgaggtggagatcgtcatcggcgcgcgcctctacggcggccagctggagctgacgctggacaatccggcgccggcctcgccgcggccaggcggcaaccggatggcgctgagcaatctgcgcgagcggctggcgctgttcttcgacgccgaggcctcgctgaccggcgagctgcgcggcgaccgctacctgacgcggatccgcctgccctaccgccgcgccggcaagccggagcggaacggctaa

SEQ ID NO: 306 - DNA, 762 bp, Chromobacterium substugae
atgctggcctgcgcgcgcgcgctgttgctgggcctgtgggccggctgggccggcgcggccgaactgctggtttccaccggcgaatacgcgccgtggagcggggcgcggctgccgggccagggcttcgtcaaccgggtggtgcgcgaagccttcgcccgcgagggcgtggcggtgcgcttccagtacctgccgtgggcgcgggcgctggaggcgctgcgcaacggcagcgtcgaggccagctctttctggttcgacgatccgggcaaggccagggagtttctctacagcgcgccgttgtcggagcaccgcgaactgttgttccaccgcaaggacctagcggtgccggcgtgggcgcggctgcaggacctgcacggcctgcgcttcggcgccacccgcggctattcctacaccgccgagttccgtcaattggcgaagcagggcgccatcgaggtggaggaagcggacgatgacaagaccaatctgctcaagctgctggccggccgcatcgagctgtttccaatagacgaattcaccggttggcagctgctggcgtccgacacctttccgcgcggcgcgcacgacctggtcaccaccgagccgcggccgttcagcactcagtacggccacctgctgatgctgcgctccgcccgcaacgagcagctgatgggccgcttcaacgccggcctggccaagctgcgcgccgacggcacgctggagcgcttccggctcgacctctaccgcggcagcggcctggggccgtga

SEQ ID NO: 307 - DNA, 1458 bp, Chromobacterium substugae
atgcatatcgtcatcccagccgaacggctggccggtgaacgccgcgtggcggcgacgcctgacacggtgaagaagctggtcggcgccggccatgccgtcacggtggagcgcggcgccggcatcccggccgccatccccgacgccgcctacgccgaagccggcgccaagctgtccgaccagcgccaggcgctgctggcccaggccgacatcgcgctgacggtgcgcatgccggcagccgccgatctggaggcgctgaaacccggcgcggcgctgatcggcatgctggcgccatacggcaaccccctgctgccggagctggcggcgcggggcatttccgccttcgcgctggagctgctgccgcgcaccacccgcgcgcagagcatggacgtgctgtccagccagaacaatatcgcaggctacaaggcggtgctgctggcggcggaatactacccgcgcttcatgccgatgctgatgaccgcagctggcacggtgaagccggcgcggctgctggtgttgggcgtcggcgtcgccggcctgcaggccatcgccaccgccaagcggctgggcgcggtggtggaggcctacgacgtgcgtccggccacccgcgagcaagtggagtcgctgggcgccaaattcgtcgaggtgccgatgacggacgaggagaaggcggccagcggcggcgtctacgcccgcgagatgaccgccgaattcctggcgcggcagaacgcgctgctggccaagcgcgccgccgcggccgacatcgtcatcaccaccgcgctgattccgggcaagccggcgccgcggctgctggatgccgccgcggtggcggcgatgcggccgggttcggtgatcgtcgacctggcggcggaagccggcggcaactgcgagctgacccgcgccggcgacgcctggcagaccgacaacggcgtgcacctggtgggtctggccaatctgcccgcgctgctggcggccgacgcctccagcctgtacgcgcgcaacctcctcgccttcctctgcctgctgttgggcgccgaggggctgcggatcgacctggccgacgacctcatcgccgccaccttgctcacccaccagggcgaacagcgcttcggcgccgcgccgaccccggccgctccggcgccggcacgacaggagccgcatcatcatggttccttcatcaccagcttcaccatcttcgcgctggcggttttcgtcggctaccacgtggtgtggaacgtcactccggcgctgcacacgccgctgatggcggtgaccaacgccatctccggcatcatcgtcgtcggcgccatgctgcaggtggtggacgtgggcggccagcagatcaccgtcacctcggtgctgggcgccgtcgccatcttcctcgccagcatcaacatcttcggcggcttcctggtgacccagcgcatgctggacatgttcaagaaaaagaacaggggataa

SEQ ID NO: 308 - DNA, 1374 bp, Chromobacterium substugae
atgcagaacatttccgcggttctttacctggtttccgccgtgctgttcatcctggcgctgaaagggctgtccagcccggcctcggcgcggcgcggcaatctgtacggcatcgtcggcatggccgtcgccgtgctgaccacgctgctgatcatcgacaagccggtgctggcgttgatcgccggcgccatcgccgccggcgcggccatcggcgcctggaaggcgcgcacggtggaaatgaccggcatgccggaactggtggcggcgatgcactcgctggtgggtctgtcggcggtgctgatcgcggtggccgccattttccacggcggcgtcgagcacacgccggtgcagaaggtggagctgttcatcggcgccttcatcggcgcgatcaccttcaccgcctcggtgatcgcctacggcaagctgtccggccgcttcggcgccaaggccatacacttcgctggccagcatccgctcaatctgttgctggcgctggcgatggtcggcttcggcctcgcctacttcgccaccgacagccaggcggccttcctcgccatggtggcggtggcgctggcgctgggcgtgacgctgatcatcccgatcggcggcgccgacatgccggtggtggtgtcgatgctgaacagctattccggctgggcggcggccggcatcggcttcacgctggacaatccggtgctgatcatcgccggcgcctgcgtcggctcgtccggcgccatcctgtcctacatcatgtgcaaggcgatgaaccgctccatcgtcagcgtgctgttgggcggtttcggcagcgaggccgccgccgggccggcggcgggcgacgcggcggccaaggcctacaaggccggcagcgccgaggacgccgccttcctgatgggcaacgccgaccaggtggtgatcgtgcccggctacggcctggcggtgtcgcgcgcgcagcacgcgctgcaggagttcgccgaattgctgcacgagcagggcgtcaatgtccgctacgcgatccacccggtggcgggccggatgccggggcatatgaacgtgctgctggccgaggccgaggtgccgtacgagcaggtgctggagatggaggagatcaacgccgacttctccaccaccgatgtggtgctggtgataggcgccaatgatgtggtcaacccggcggcgcaaaaggacaagcaaagcccgatctacggcatgcccatcctggaggcgcacaaggcgcgcaacgtgatcgtggtcaagcgctcgatgagcgcgggatatgccggactggacaacgagctgttttacatggataaaaccatgatggtgttcggcgatgccaaaaaagtggtggaggatctgctgaaaaacgcagcgcactga

SEQ ID NO: 309 - DNA, 666 bp, Chromobacterium substugae
atgcccatcctcagctccattctgatcagcggcagcatgatgctgccgacccaggccgaaccgaagctgcagaacaccgaatggctgctggaggcgccggcgcaggcagcgccgctgccgacgctgagcatcgccgacagccgcatcagcggcttcgccggctgcaaccgcttcacgctgggcatagacgacgacggcaaacatcaggtggcggccacgcgcaaactgtgcgcgccggaggtgatgcgccgcgaacaggcgctgctgaaattgctgtcggcgccgttccgcctgctgccggccgaggacggcaagcacctgaccctgctggcgggcaagaccggctaccgcttcgtccgccagaccgccgccgtcgcggcggagccgccggtgccggccgtcgccgcgctgcggccggtggccggcgagcagtactggtatgtcgccagccagccctgcggcgcgggcgccgccgcctgtctgcgggtgcgcagcagcgaggaccagccctggcgcagctacgccggctccatcgccggcttcgtgccggaggccggcagccgctattacctgaagctgcaaggcgtgccgtccgttgacggccagccggcgctgcaattgctgaaagtggtataccgcgaaaccgtgacgccgctggccgactga

SEQ ID NO: 310 - DNA, 669 bp, Chromobacterium substugae
atgctgcaacgcttgtccctattggccctgagcgcgaccctgctgagcgcttgcgccgcgccgagcgcgcccgccgtttccgccgcgcccccttccctggccgagctgcagggcgaatggaagcagaccaatggcggcgagcaggccatcttgctgcgcatcgaccagcagcggctgttcgccaaggccggctgcaacggcatgttcggtccggccgcgctggaagacggcaagctgcgcgccgaacggctggcctcgacgctgatgatgtgcccgcccgaggcgatgcagcgcgacgccaagctgtcgcgccagctggaggccggcatgacggccagcctggacggcggacggctgaagttgtccgacggcaaggacgcgttgatcttcgaacgccagccgcagggcgagatcaagttcatctatgtcgcgccgcagcgcaaggcctgcgtcggcgtcgcgcctatgcaatgcctgcaggtgcgcgacgacaagtccaagccgtgggagctgcattacggcgagatcgaaggcttccagcccgagcccggcgtcgcctaccggctgcggatcaaggaagtgaaggtggacaatccgccggccgacgctccttccatccgctggattctggatctggtggtcgagcaggaagtggtgaagaagccctga

SEQ ID NO: 311 - DNA, 822 bp, Chromobacterium substugae
atgagcctgattcccgaaatcaaaccgcagcagtcgctggaattgctcaaagagctgcacatcctcacccgcgacggcaagatcaaccaggacacccgccgcaagctgaagcaggtttaccacctgtaccagttcatcgaaccgttgatggccgacgtgctggccagcaagggcgcgatgacgctggccgaccacggcgccggcaagtcctacctcggcttcatcctgtacgacctgttcctgaaggacaagccgggcgcccatgtctacggcgtggaaacccgccaggagctggtggacaagtcggatgaattggccaggcggctgggcttcgccggcatgagcttcctcaacctcagcgtcgagcagtcgatcacctccgccgcgttgccggcgcaggtggacatcatcaccgcgttgcatgcctgcaacaccgccaccgacgacgccatccgcttcgcgctggccaaggacgccaagtacatcgtgctggtgccctgctgccaggccgaggtggcggcgacgctgcggcagaagaagaacgagaccttcggcaagacgccgctgtccgagctgtggcgccacccgatccatacccgcgaattcggcagccagctgaccaatgttctgcgctgcctgcagctggaggcgcgcggctaccagttgacggtgaccgagctggtcggctgggagcactcgatgaagaacgagctgatcatcgccaagaagaccggcaagggcaagagcagcgcccgcgagcgccaactggccatcctggacgaattgaacctgatggacctgcgcgagcgcttcgcctactga

SEQ ID NO: 312 - DNA, 741 bp, Chromobacterium substugae
atgaaaactacgctgcgtaacgccgcagtcctgctggccggcctggcgctgtgcggcgccgccgccgccaagaccctgcgtttttccggttacgactgggaagtgcgcaatcagggcagcagcggccccggccccaatgtctgggacgacgacaacgcctggctagacgcccagggccggctgcacctgaaaatcgccaagcgcggcggccaatggaccgccgccgaactctacctgccgcagcggctgggcttcggccgctaccagttcaagctgatcggccggcccgaccagttcgaccccaacatcgtgctgggcctgttcaactacccgacgcccgatgtcggccccgatggcagcaacgagatcgacatcgaattctcgcgctggggcagctcaagcaacccgatgggcaactacaccgtctatccggcccaggccggcctgcagtcgacctcgtacagcttcgatttcgccctcaacggcggctacagcacccaccgcttcgactggaacgccggccaggtctattaccagtcgctgcacggcttccaggacagcgaccagtacccgatcgccagctggcgcttcgccccgaccgacgccgcccggcgcgtgccgcagcaaccgctgccggtgcacatcaatctgtggctgttccagggcaagccgccggcggacggcaaggaggtggaagtggtgatccaggagttcaagttcgtcccggcggcggcgcgctag

SEQ ID NO: 313 - DNA, 1629 bp, Chromobacterium substugae
atgctgcaccaactctccgtcaagcagaagctgctggccggctacggcctgatgattctgatcctggcagccatcgtgctgacagccatcctcaagctgaacgccatccaggccaaggaagtggaaatcaccgaaaaccgctatccgaaggcggcgctgtgcaacaagatcgtgctggccaccatgggcgtggcgcgcgcggtgcgcgacgccatcatcgcccagagcccgcaggaaatcgaagccaatatcagcaaggcggaggagttgcgcgcgcagaacaccgccagcctggaacaactggacaagaccctggtgtccgccaagggccgcgaagtcttcacccgggtgcagcaggcccgcggcgcgctgtccgcgctgtacgcgccgctgtatgcgctgatccgcgccaacaaggacgcggagtcggtcgcctttttgaagcagcgcttcgtgccggccaacgcggccttcgcccagacgctggacgagctgaccgcctaccagaacgacaaggtgcagcaggcgctggacgacagcaaggccgcctataaccaggccgtcaccatcatgctgatctccgccgccatcgcgctggccatcgcggtgacggtggcgctgttcgtcgccaatctggtgaccaccccgctgcgcaaatcggcgcaactggtgcgcaacatccagcagggcgacctgtccggcgccgacgagtcgctgcccgattcccgcgacgaggcggtggaaatcgcccgcatcatccagcacatgcgccagggcctgcgcgaagtggtgtccagcatccaggacaacgccaaccaggtgtccgactcggcccatgagctggccagcatggcgcagcaggtggccggcggcgcccagcgccagtccgaggccaccgccgaggcggcggccaccatcgaacagctgaccgtcagcatcaaccatgtcgccgacaactcagaccaggcctcgcgccaggcgcgggaggccggcgacctggccgggcgcggcggccacgcggtgcaggcctcggtgggcaagatccagtcggtcagcagcgcggtggccgccacctcagaggaaatgcgcacgctgaccggcgaggtgcagcgcatcggcaatatcgtcaccgtgatccgcgacgtggccgaccagaccaatctattggcgctgaacgccgccatcgaggccgcccgcgccggcgagatgggccgcggcttcgcggtagtggcggacgaggtgagaaaactggccgaacgcaccgccagctcggcgcaggaaatcacccagatgatcaccgccatccagcagggcgtggagaaagtggtgggcagcatggagcagagcctggccagcgtcgacgcggtctccggcagcgcgcgcgaggccagcgactcgatggaggagatcgccggcagcacccattccatcgtcggcaccataggcaacatcaccagcgcgctgggcgagcagcgcaccgccagcctcagcctggcgcagagcatggagcaggtatcgcagatggccgaggccaacagcgccaccgtggaggagctggccaccacctccagcgagctgaacgcgctgtcgcacaatctgcagaacgtgaccgcgcgcttccggctgtag

SEQ ID NO: 314 - DNA, 822 bp, Chromobacterium substugae
atgcaagtggccgagatcttcgagaaggcgtcgggcaagctgcctatggtgcccaaggtggtgcaggagctggtggccagtttccatcgcaatgacgtcaagatcgacgaaatcaccgacaaggtcggccacgatcaggtgctgacggcgcgggttttgcggctggccaacagcgcgcgcttcggcagcagccgcaaggtgggttcgctggacgacgcggtggtgctgctgggcttcgacaacctcagggtgctggtgatcgcctccggcgtcaccggcgccacgctgggcatccacggcttcgacatgaaggcgttctggacgcgctgcttcgcgatggccaacaccgccaagctgctggccaagctggcgggcctggacgcgcagcttggctatacctgcggcctgttggccaatatcggcgaactggtgctgtacgtggcggtgccggagcaggcgcagcagatagacaagatcgtcgccggcggcgccgagcgcatcagcaccgaacgcatgctgctgggcatggatctgaccgagctgggcgcggagctggcgcggcgctggaatttcccggacgcgatccaggaggcgatctacaaccagcacgacctgctgaacgaagacgcgtcgccgtacgcgctgctgatcgggctgtccaccttcctggtggcgggcttccgcaatgagatgggcgtggccgacatgctggtcagcctgccggagcgggtgctggagcggctggggctgggccgggagcgggtggaggcggcgatggagccgctgcagcaggcctgcacccaggtcgacgacatgttctga

SEQ ID NO: 315 - DNA, 249 bp, Chromobacterium substugae
gtggcgcggcatccgggcgtgcgcgaggtagcctgcgtcggcgtgcccgacacgcgcagcggcgaggcggtgaagatcgtggtggtgcgccaggacccggcgctgacggtggacgagcggctgcgccattgccgcgacgcccttaccggctacaaggtgccgcgccatgtcgaattccgcgacgagctgcccaagtccaacgtcggcaagatcttgcggcgcgaactgcgcggcggccagggcgcctga

SEQ ID NO: 316 - DNA, 366 bp, Chromobacterium substugae
gtggtagccacgccgctgccgctgccgctgtaccacgtgttcgcgctggccatcaattgcctgttggtcaaccggctgggcggccaatgcctgctggacgacgccggccggccgatggccgacggcgaggccggcgaagtctgcgtgcgcggcccgcagatcatggccggctactggcagcggccggaagacagcgccaaggccttccatcccgacggcttcttcgccaccggcgacatcggcgtgcgcaccgccgacgccgcaagaaggacatggtgctggtatcgggcttcaatgtttaccccaacgaagtggaggacgtggtggaggacgtggtggcgcggcatccgggcgtgcgcgaggtag

SEQ ID NO: 317 - DNA, 150 bp, Chromobacterium substugae
gtgccggcgcgggcctctgccaccacctgggcgaagttttccagcgccatgatggagctggactgcgcggcggcgggcctgcggcgcttccagcgcgcgatggacgcaggccacggcgacaaggacatggcggcgtccttcctggtttga

SEQ ID NO: 318 - DNA, 1875 bp, Chromobacterium substugae
atgaacgttttttacgaagagagcggcagtttcaaggttggcagcatagtctcgcgcagcgacgccagcctgcaggtggatacccagcacggcaagcgcgccaagctcaagagcgccaatgtgtttctggagtttagctccccgctggcggattttctgcccgccgtggacgcgctggctgcggacatcgacctggacttcctgtgggaatgcagccaggacgacgagttctcctaccaggacctggccgccgactatttcggccacgcgccgtcggccgtcgaggccgccgcgctgatctgccggctgcacggcgcgccgatgtacttctacaaaaaaggcaaaggccgctacaagaaggcgccgcaggacgcgctgcaagccgcgctggccggcgtcgagcgcaagaagcgcgaacaggagcagatcgacggctgggtccgcgagctgaaaaccggcgccctgccggaagccatccgctcgcagctgatgactctgctgtggcgccccgacaagaacacgctggaatacaaggccttcgaccaggccagccgcgaaaccggcctgccgccgctgcgcctggccgacaaggtaggcggcattccctcggtgcctgattacctgatggccggcttccagatggagtacttccccaagggcgtcggcttcggcaagtacgcgccgccggccgcgctgccggagctgccgctggcctcggcccaggccttctccatcgacgacgccaacaccaccgaaatcgacgacgccttgtcggtcgaggagctgcccaacggcaacaagcgcgtcggcatccacatcgccgcgccgacgctgggcgtgccggtggattccgacatcgaaaagatggtgctgtcgcgcctgtccaccgcctatttccccggcgacaagatcaccatgctgccggacgacgtggtgcaggccttcaccttgcaggaaggccgcgcctgcccggcgttctcgctgtacgccgaggtgacgccggagttcgagccggtggcgttcgagaaccgcatcgagctggtgccgatcgccgccaacctgcgccacgccgaactggaacaggtgttcaatgagcagacgctggccaacgatccgggcgtagactatccgttcaaacgcgaactggtgtggctgtggcagttcgccgaagcgctggaaaagcgccgcggcaaatacgacccgacccgcccagtgcagcacgactacaacatcgacgtggtcgacggcaaagtgtccatcaccatccgcaagcgcggcgcgccgatggacaagctggtctccgaactgatgatcctggccaacagcgaatggggccgcatgctggccgaagccgacatcccggcgatgtaccgcgcgcaaagcatgggcaaggtgcggatgaccacccgccccgagccgcacatgggcctgggcgtggcccagtacgcgtggagcacctcgccgctgcgccgcgccagcgacttcatcaaccagcgccagctctcggcgatgatacgcggcgaaaagcccttgttcgcccagggcgacgcgatgctgttcgccattctgcgcgacttcgacgccacctacggcgcctacctgtcgttccaggacaagatggaacactactggtgcctgaagtatctgctgcaggaaaacatcaccgagccgaccgcttccgtgatcaaggaagacctggtgcgcatcgacggcctgccgctgcgcctgcgcatcccgggcctgccggaactggcccgcggcgaccgcgtgcagctgtcggtggtgaaggtggacctgctgacccaggaagtggagctgcgctacaccggccgcctcgaccacgtcgaagaggccggcgaggacgaagaaagctga

SEQ ID NO: 319 - DNA, 1587 bp, Chromobacterium substugae
atgaaaccggctgcgcccctctcccccggccaacgcacccagctggcgcgggaaatcgaccgcatcggctacatgctggtgtcgcgctgggagcgtccgctggccgcccacctgctgtcgctggccatgcggctggaggcgctggcgggttcggtggggcgggtcgacatcgccgccgaggcgcgcgagctggccgacctgctgcggcagtggttgcagcagcaggcggaaccgtccgagcaggaacgctatgggctgctgcgccatcatctgggagtggtcagccagctgggtttgatggagcggcaagcgggttcgagcagccaggacgcggcggagcgcagcggcaaccccctgctttacctatggctgcccggcggcatcgacgccgcgccgctgcaaaggcagctggcctgtttcggctacgaagcgctggcgctggcgcaggccgccaagctggccaaggcgctgcaggaggaaacgccggcggcggtggtggcgttcgccgacttcgccgacggcgaccccatcctgcagttggcgccggcgatcagcggcagctgtccgctggtgctcacctcgccgcggcgggattttccggcccggctggaagcggtgcggataggggccagcggctttctcgattggccgctgcaggtcaaccaattggtggacctgctcagcttcggcgacatcggcgagcggcgcgacccgctcagggtgctgatcgtcgaggacatggcgtcgctggcggggctgtattcgcgcgcgctggccgcccacggcgtggaggcggtcagcgagaccgacccggagcgggtgccggagctgatcgagcggctgaatccggacctgatcctgctggacatgtacatgccgcaatgcaacggcatcgagctggccaaggtgatccgccagcagcggctgctggacgggattcccatcgtgttcctgtcggtggagaagcgccaggcggtgcagctggacgcgctgatgctgggaatcgacggctttctgaccaagccggtggcgccggaagagctggtggtgacggtggtgaaccgcgcgcggcgctaccgcaaactgcgctcctacatcgccaatgacagcctgaccggcctgctcaaccattcccatctgcacggccagctggacagcgccgtcgagcgcgcccgccgcgccgggcagccgctgtcgctggcgatgctggatctcgactatttcaagcaggtcaacgacaactacggccaccaggtcggcgacgaggtgctgctcaatctggcgcgcttcctgaaggagaggctgcggcgcaccgatctggtgggccgctacggcggcgaggaattcgccatcgtgctgaccggcacgccggcggacaaggcgtgcaagatgctggagacgctgcggcaggatttctgccggctggagcagcaggtgggggagaggaccttccgccagactttcagcgccggcgtcagctcgctggccagcgccgaagacgccaccagcctggtgcagcaggccgacgagatgttgtacctggccaaggaaaacggccgcaaccgggtggagagccgcggcggctga

SEQ ID NO: 320 - DNA, 774 bp, Chromobacterium substugae
atgaaaactcgcaagtcgctgctggccctgtctctgttggccgcttccgccctggctcacgccggcggtgaatactccttcgcaaacgttagcgccaactggctggattggtcgaaccgcaccaccgaacaaagcggcaagcgcgacttcggttacctggaagccgaaggcggcctgggcgccaagtggggcgaagtctatggcttcttcgacctggaaaacccgggcaagggcaataacggcaccggcaccaaagaccgccgctacaccaccaaggtaatcggccgctacaacctgaccgacatcggcggcgtgccggtgcaactgtacgcccacatctacgacacccgcggcaacgagttcttcactcagaaccgcgtactgggcttgggcaccgatctgagcttcggcgcgctgagcatcaagccgttcttcggcgtgcacaacgagatggatgctcaccaagttggttccgcatccggctacaacggcttcatgaccggctacgtgatgctgtacccgttccaagctttcggccagaacctgatgatcacccaatggcatgaaaccgagttcaaccgccaggacaagtttatcagcgtgtacaagagcggcgaccgtccgcgcgtaggccagaacggtgccatcgcgctgtggtggaccccgaccaaggcggtcaccaccggcatccagtaccgctacgccgaccagaagctgggcagcaccgcgtaccagaacgccgtgatctactcgatcaaatacaacatcaagtaa

SEQ ID NO: 321 - DNA, 117 bp, Chromobacterium substugae
ttgcagaaaagcgacagaagcgtgacaaattgtttgcacaaggccatttctacgtctaatctgcgcgcgctcgccgacagcttgtcggacggttactacatgaaaatagtctggtga

SEQ ID NO: 322 - DNA, 318 bp, Chromobacterium substugae
atgccgcccgaattcgcccgccgcgtgctggcgctgctggccgacgtgccgccgggccgcgtcaccacctacggcgcgctggccgagcaagccggctatccgcgccactcgcgccatgtcggccgcctgctcggcaacctgccggagggggtgaccgcgccttggcaccgggtgctgggcgccggcggcaggctgtcgcgccccggtagccagcatgccgactggcagcggctgctattggaagaggaaggggtggaattcaatgccagcggcaaggtatgcctgcggattttcggctggcccgaccagatggtttga

SEQ ID NO: 323 - DNA, 651 bp, Chromobacterium substugae
atggccttgaagcatcacgtcatcccggtcaccccgttcgcgcagaactgcagcgtgctgtggtgcagcgccagccgcaaagcggccgtcgtcgacgccggcggcgacatcgggcgcatccgcgcctggatcgacagccaggggctgacggtggaaaagctgctgctgacccacggccacatcgaccacgccggcggcgcggccaagctggcggaagagctgggcgtggaaatcgaaggcccgcaacgcgcggaaagcttctggctggaccagctgcccacccagggcggcatgttcggctttccgcgcagcgagccgctaacgccggaccgctggctggaagaaggcgatacggtgacggtgggcgaagagacgctgcaagtcatccactgtcccggccacactcccggccacgtggtgttctacagcccggcggccagcctgctggtggccggcgacgtgctgttccagggctcgatcggccgcaccgacttcccaatgggcaaccaccagcagctgatagacgcgatccagcaaaagctgttcatcctgccggacgacaccaccgtcatccccggccacggcccgttcaccaccataggcgtggagaagcgcagcaacccctacgccgccgacccgcgctaccgctga

SEQ ID NO: 324 - DNA, 1911 bp, Chromobacterium substugae
atgtctgccagctccctgcgcgtgctgtcgctcatcccgccgatgacgcagctgaacacgccctacccgtccaccgcctatctgaccggctttttgcgttcgcgcggcgtcacggcctcgcaggaagacctggcgctggcgctggtgctgcaactgttctcgcgcgccggcatgcagacgctgcgcgagcatgtgcaacgcatccccatgcgccagcgcaccgactgcatgatgcagttcgacatctcgtacgaacgctacgcggcgacgatagacgcggtgatcggctttttgcagggccgcgacgccacgctgtcctaccgcatcgccggccgcaactacctgccggaaggcccgcgcttcgccgcgctggacgtgtatatggacccggacgatccggacggcggcgatccgctggcctgggccttcggcgcgctgggcagccaggaccgcgcccgccacctggccacgctgtacctgaacgatatcgccgacgtgctgcgcgaggcggtggacccgcgcttcgagtttgtccgctacgccgaatcgctggcgctgtcgcagccgaccttcgagccgctggccaaggcgctggcggcggcgcccaactgggtggacgacacgctggacgcgctgacccgcgaagcgatggcgacgcaccggccgcagctggtgctgatctcggtgcccttccccggcgcggtgtacgcggcctttcgcatcgcccagaccatcaagcgccactggccggaagtcaaaacctgcctcggcggcggctaccccaacaccgagctgcgcgagctggccgagccgcgcgtgttcgactacttcgactatgtgacgctggacgacggcgagcggccgctgctggcgctgatggaacacatcgagggcaaacgcggcgtcagccgcctggtgcgcaccttcctgcgccaggacggcgcggtgcgctatgtgaacatgcaggaagccgacgtgccgttctccgaggtcggcacccccacctgggacggcctgccgatagaccgctacctgtcgctgctggacatgctgaacccgatgcaccggctgtggagcgacggccgctggaacaagctgaccatcgcccacggctgctactggaagaaatgcagcttctgcgacgtgacgctggactacatctcgcgctatgagacggcgtcggccgagctgctggtggaccgcatcgaggccatcatcgccgaaaccggccagaccggcttccacttcgtcgacgaggccgcgccgcccaagatgctgaaggcgctggccgaggagctgctgcggcgcaagctgtccatctcctggtggggcaatatccgcttcgagaaatcgttcaccccggagctggcgcagctattggcggaatccggctgcatcgccatttccggcggcctggaagtcgcgtccgaccgcttgctcaagctgatgaaaaagggcgtgtcggtggagcaagtggcacgggtcactcatggcttcgccgaggcaggcatcctggtgcacgcctacctgatgtacggcttccccacccagaccgagcaggacacggtggacgcgctggaatacgtgcgccagctgttcgacaacggctgcatccagtcgggcttcttccaccgcttcgcctgcaccgtgcactcgccggtgggccagaatccggaagaatacggcgtcaagctggtgccgctgccgaaaggcgacttcgccaagaacgacgtcggcttcatcgaccccaccggcaccgaccacgagctgatgggccgcggcctgaacaaggctttgtacaacttcatgcacggcatcggcctggatggcgacgtgcgcggctggttcgacgtgcgggtgcccaagccaaaagtgccgcgccagttcatcgagcgagcgctgtacgcgtag

SEQ ID NO: 325 - DNA, 357 bp, Chromobacterium substugae
atgagcagcgaaatccactaccccgaactgacccacgccatctcccaacacctggccaccttgcgcgccgacgtgccggacgtgatgcaagccttcaacgacctgggccgcgccgccagccgcgacggcgcgctggacaggaaaaccaaggagctgatcgcgctggcactgggcgtggccgcgcgctgcgacggctgcctgggctttcacgcgcaggccttggtcaagctgggcgccagcaagacggaagtggaagaggcgctggcgatggccgtctacatgggcggcggcccttctttgatgtattccgccaacgccctggaggcctttgagcagttcagcgccaagaccgcctag

SEQ ID NO: 326 - DNA, 309 bp, Chromobacterium substugae
atgccgtctcccaccatcgccatgatgcgcgccgccgccggccaggcttgcggcctgctgcgcgccttgtccaacgaagaccggctgctgttgttgtgccagctcagccagggcgagcaatcggtcggcgagctggagcaggcggtgggcatccgccagcccacgctgtcgcagcagctgggcgtgctgcgcaacgagggcctggtcgccacccgccgcgacggcaagcgcattttctacgcggtggccgacccgaacgcgctgagcgtgctggccaccctctatcagttgtactgtcccaaggagtag

SEQ ID NO: 327 - DNA, 432 bp, Chromobacterium substugae
atgcagctggactggagtcatttcacgccctggagcgcgctggccggcggcatgctgatcggcttggccgccgcctggctgatcctgctgaacggccgggtggccgggatcagcggcattgtcggccagctgctctcgcccggcggcgacaagggctggcggctggctttcgtcgccggcctggttctgtcgccctgggcataccggctgtgcgccgcgccgccagccatcgctctggatcaccggccctggctgttgatcgccgccggcctgctggtggggttcggcagccggctcggctccggttgcaccagcggccatggcgtgtgcgggctggcgcggctgtcgccgcgttcgctggcggccacgctggccttcatggccgcggggttcgccgtcgtctggctgatgcgtgatggaggcgtgctatga

SEQ ID NO: 328 - DNA, 420 bp, Chromobacterium substugae
atgaaatcgctcgcaagcgcaggctgcgccggcctgttgttcggcctgggactgctgctggccggcatggccaatccggctaaggtgctggcctttctggatatcgccggccgctgggatccgtcgctggcgctggtgatggccggcgccatcgcgacagcgctgccggccttcgcgctggcgcggcgccgcgagcgcgcgctgctgggcgggccgatgcagctgcccgccgttcggcggatcgaccggccattgatcctgggcagcctgattttcggcgccggctgggggctggccggcatttgcccggggccggcgctggtattggccggcagcggcgccggcgccggggtgctattcgccgcggcgatgctggcgggcatggcgctgcatggccgctgggcgcggcgccggagctag

SEQ ID NO: 329 - DNA, 561 bp, Chromobacterium substugae
atggtgctgggatggatgtgggcggcggccgcgctggcggcgccgcggccggcggagctgtgcggcagctgccacggcgccgacggcaacggcgcttcgccgcagtttccgcggctggccggccagcaggcggtctatatggagcagcagctgctgctgttccgcgacggcaagcgcgacgacaaggcggcgcaccgcgcggcgctggccaagctggatgatgccggcatccggagcgcggccgcgtatttcgccgcgcgcgcgccggcggccaacgcggcggccggggccgatcccaagctcgtcgccgccggcgccaagctgttccgcgagggcaatctggcggtgggcacgccgccctgtttctcctgccacggcgaccgcggcgagggcaacgcgacggcgccgcggctggccggccagcatgccgcctatctgcaaagccagctgcgggtattcgacgtgtcgcagcggccggcggcggcggagatgcaggaaatcgtcaaaaccatgagcgaggacgacatcaaggccgtgctcgcctaccttccgggcatgtag

SEQ ID NO: 330 - DNA, 1077 bp, Chromobacterium substugae
atgaaagcgtctatcgcaaccaggctggcgcaactggccgaccgcctggaagaggtgacccacctgctggccagcgaaacggccacccagaacatggaggccttcaaaaagctcacccgcgagcacgccgagctgacgccggtggtggaggctttcgccgcctaccgccagtgcgaaggcgacatcgccgccgccgaagagatgctggccgatccggaaatgaaggaattcgcccaggcggaaatcctcgagggcaaggacaagctggcggcgctggaggtggagctgcagaaactgctgctgccgaaggaccccaacgacgacaagaacatcttcctggaaatccgcgccggcaccggcggcgacgaggcggcgctgttcgccgccgacctgctgcgcatgtacacccgctacgccgagcgcaaccgctggcaggcggagatcgtctccgccagcgagtccgacctcggcggctacaaggaagtgatcgtgcggctggtgggccagggcgcgtactcgcggctgaagttcgagtccggcggccaccgcgtgcaacgcgtgccggccaccgaaacccagggccgcatccacacctccgcctgcacggtggcggtgatggccgaagccgacgagatcgccgaagtggtgctgaacccggccgatctgcgcatcgacacgttcagggccagcggcgccggcggccagcacatcaacaagaccgactcggcggtgcgcatcacccacttgccgacggggatcgtggcggagtgtcaggacggccgctcgcagcacgccaacaaagccagcgcgatgcaggtgctggcggcgcgcatctacgacatccagctgcgggaaaagaatcagaaggaagcggccgagcgcaagagcctgatcggctccggcgaccgctccgagcgcatccgcacctacaactacccgcaaggccgcctcaccgaccaccgcatcaacctgacgctgtacaagctggaccagatgatggacggcgacatcgcagaattgaccgacgcgctggtggccgaacagcaggccgagctgctggcggcgctgggcgactga

SEQ ID NO: 331 - DNA, 1254 bp, Chromobacterium substugae
atgcatctgcttgccttcggactcaaccaccacacggctccgctgtcgatacgggaaaagctggcgtttccggctgaaaccctgccgcgcgcgctggacagtctggtggcctcgcaggccgcgcgcgaggcggccatcgtctccacctgcaaccgcaccgagatctactgctgcagtccggacccgcacgccgcgctgtcctggctgtgccagttccacggcctgagcctggccgaggtggagccctatctgtaccggatggaagcctccggcgcggcgcggcacgccttccgcgtggcctcgggactggattcgatggtgctgggcgaaacccagatcctgggccagctgaaggacgcagtgcgcagcgccgagcacgccggcacgctgggcaccatgctcaacggcctgttccagcgcaccttcgcggtggccaaggaagtgcgcagcagcaccgcggtgggcgcaagctcggtgtcgatgtcggcggcggcggtgaagctggccgagcagatcttcccgtccatcgccgagctgaacgtgctgttcgtcggcgccggcgagatgatagagctggtggccacccatttcgccgcccgcaacccgtcctgtatcaccgtggccaaccgcacgctggagcgcggccagcggctggcggaacagttcggcggcaacgccatcacgctgtcggagctcccagaggcgctggcgcgctacgatgtggtggtgacatccaccgccagccagctgccgatgataggcaagggcatggtggagcgggcgatcaaggcgcggcgccaccggccgatgttcatgctggacctcgccgtgccgcgcgacatcgagctggaagtcgcccagctggacgacgtgttcctgtacagcgtcgacgacatcgccggcatcgtcgaagtgggcaaggaagcgcggcagcaggcggcggccgaagccgaaaccatcatccaggcgcgggtggcggagttttccgactggctgaagaagcgcgagaccgtgccgctgatccgcgcgctgcgcgacgaggccgaccgcacccgccgccacgcgctggaagcggcgatgaagcaactggcgcgcggcgacgcgccggacaaagtgttggaggccttgtccgtccaactgacaaataaactcatgcacccgcccacccaggccctgtcctcgggcagcggcgcggagcacgacgcgcaggtgcaagccatcgcgcggctttaccgtttacatccggagtcgtaa

SEQ ID NO: 332 - DNA, 150 bp, Chromobacterium substugae
atgcatgggcggaaagtgccgcagacgaaaacaggacattttagcctaagtgggcggcggcgtcccgccgagcttgcccggacggcatggcggcggcgggcgcgcaggcggtatagcgccgacgcggcgcgcggcatgttgttttgttga

SEQ ID NO: 333 - DNA, 2661 bp, Chromobacterium substugae
atgaacaaagggaaaatgatgagaatcaagattctggcccaggcgatcgccgccttcggccttatggggggcggctttgcccatgccgcggacggtagcgacagccagctggagcgggtgaccatcaccggctccaacatcaagcgcatcagcaaggaaggcgcgctgccggttgaagtcctgaaacgggaagacatcgaaaaaaccggcgcttccaccacggtgcagctgctggacaacctgacttcttccggcagcgtgctgtcgggcaccaattcggccagcttcgccgccggcgcggccaccgccggcctgcgcggcatgagctccaagtatgtgctggtgctgatcaatggccgccgcctgccgaactacgcgatgttcatcagcggcaccgactctttcgtcgacctgaacacgattccgctggcgatgatcgactcggtcgaaatcctgcgcgacggcgcttcggcgatctacggctccgatgcggtggccggggtgatcaacttcaagaccaagcgcaatttccaaggggtgaaagccaccacccgctacggccagaccgaagacggcgacggcatggagcagggcgccggcctgatgggcggcatcggcgatctgagcaaggacggccagaacttcatgtggtcgttcgacgcttaccatcgcgagccggtgttcgccagcaagcatgagccgaccaagacgctggattaccgccgcttcggcggcaaggattcgcgcagcggcactttgtggggctcttggaaagactattccaacggcaagttctataaccctctgcccggctgccccaagtcgctggtgacgctgtccaacggcaacaccatctgccccagcgacaacgacgaactgggcacccagctgtcgccgcggacttcgcgctacggcctgaacggcaactacaccaagcggatcggctcggacagcgagctgttcgtcgaagccagcgtcaaccgcagccagacctccctcgacggcggctacgcctggatgagccaggtgcagatcaagaacggcaacgcggcctatcccaccaatccggccacgctggcggcgatgcaggcgctctatccgcagttcacccccggcgacacgctgcaagtgacgcgcagcctgtatgagctgggcaagagcatggtggatgtgacggccgacacctaccgcgtggtcgcaggcggcaccaccaccatcggcgattgggattttgaaggctcggtgaaccttggcgaatccaaggtgaccatgcagaccagcaatgccatcctgaacgcgccgttcatgaacatgctgcaaaacggcgcgcccgccggccagcccatgttcgatccgttcgcgcagaacaaccaggcgggcagcctgacgccatacgccaccaacctgaccaacagcgccaattccaagttgcagatgctggagttgaagaccagcaagagcgagcttgcccagctgccgggcggcccgttgggcttcgccgcaggggtgcaatggtggcatgagtcgatcgaaagctcgcccgacgcgctgatccgcagcggttctatcatgaactacgcggcgcagcagggcctgcagtccagccgctcggtggcggcggcgtatgccgagctcagcctgccggtgatcaagaatctggaagcgcagctggcggtgcgcgccgaccactacaacgatttcggcgatacggtgaacccgaagttcgccttctcctatcgtccgtggcagcaggtgatgttccgcggttcggccacttcggcgttcaaggcgccgtccctgccccagttgtacgcgtcgcgccaagcctaccagtcgatttacgactacgcgcaatgcgcggacaagggcatctccacggccaattgcacgtcggtcaagcagcagatccgcagcggcggcaacccgaacctgaaggcggaaaccaacaagagctacggcctgggcgtggtgctgcagccgatgaaggagctttccgcgtcgatcgactggtacaagctggaccagaaggacaccatccaggcgctgccggcgcagtacgtggttgaccacccggaattgttccccggctacgtggtgcgcaagccgtcgggcatcgccggcatccgcggcgacatcgactacatcagcaccccgtacgcgaacgccggcaagacgatcacctccggcatcgacatcgacgtgcagtacgatctgtcgctggggggctacggcaagctgagtttccgcgagcagcaaacccgctacctgacgtatcaggacacggtgctgccgaccgattcgctgctggagaacgtcgattacggcggcatgccgcgctggaagaacctcttcaccgtcgactaccgctacgacaagtacagcgccgcgatcaccgcgcgttcctatgccggttacaagaacgcggcgtccccgcgcgacaccatcgcggccaacgtgccgcagcgcgtgccgtcgtacacggcgttcgacctcaacttcggcgtgcggccgctcaagacgctggaaatcaacggcggcatccgcaacgtcggcaaccgcgtgccgccgtacgccgccggggccagcctggtgacgttctccggcccgtccaccgatctgtggggccgcacctactacatcaccgccgactacaagttctga

SEQ ID NO: 334 - DNA, 462 bp, Chromobacterium substugae
atggcaaacaggatagcgtggcattgccacggtttcgacggtttcaccccgctggcgctgtaccaggttctgcagctgcgggatcgggttttcgtgctggagcagcaatcgctgtacggcgacgtggacggcgtggacacccactgcctgcacctgtcgggccgcgacgaggccggccggctgctggcctatgcccggctgatcgcccccggcgagaaatacccggacgccgccgccatcggccgggtggtggtggaacccgccgcgcgcggccagggcctgggcaaggcgctgctggcgcaggcggtggcgcaatgccaggcgcgctacccgggccgcgccatcatgctgtcggcgcagcaggacgccagcgcgatgtatgccgccttcgacttcgaaccggtgtcggagccttacgacgacggcgggatactgcacctggacatgcggcgggaaggctga

SEQ ID NO: 335 - DNA, 2352 bp, Chromobacterium substugae
atgaacagcaacgacctcttcgccccgccgggttccgccggcgacccgccgccgcctcccgccgcgccggaagccgccagcggcgactggattccgctggacctgtacgccgagcgcgcctacctcgagtacgcgatgagcgtggtgaaggggcgcgcgctgccggaagtggccgacggccagaagccggtgcagcgccgcatcctgtacgcgatgcgcgacatgggcctggcgcacggcgccaagccggtgaagtcggcgcgggtggtcggcgaaatcctcggcaaataccatccgcacggcgacagctcggcctacgaggcgctggtgcggatggcgcaggacttcacgctgcgctatccgctgatcgacggccagggcaacttcggcagccgcgacggcgacggcgcggcggcgatgcgttacaccgaggcccggctgacgcctatcgccgatctgctgctgtccgagatagacatgggcacggtggatttcgtgcccaactacgacggcgccttcgacgagccctcgctgctgccggcccggctgccgatggtgctgctcaacggcgcttccggcatcgcggtgggtctggcgacggaaatcccgccgcacaacctgaccgaggtggccggcgcctgcgtggcgctgctggacgacccgacgctggacaccgccggcctgatgcgatacgtgcccggcccggacttcccgggcggcggccagatcatcaccccggcggcggacatcctggccgcctatgaaaacggccgcggcagcgtgcgggtgcgcgccaagtgggagatagaccggctggcgcgcggccagtggcgcatcgtggtgaccgagctgccgcccggctcctcggcgcagaaggtgctggcggaaatcgaggaagccaccaaccccaaggtcaagtcaggcaagaaggcgctgacccaggatcaggccaatctgaagagcctgatgctgtcgctgctggaccgcgtccgcgacgaatccgacagcgaaagcccggtgcggctggtgttcgaacccaagtccagccgccaggacccggacgaattcatgaacatcctgttggcgcagaccagcctggaaggcaacgcttcgctgaacatggtgatgataggcctggacggccggccggcgcagaaaggcctgaagtccatcctgactgaatggatagacttccgccgctccaccgtcacccgccgcctggcgcaccgcttgtcgcaggtggacaagcgcatccacatcctggaagggcggatgatcgccttcatccacatcgacgaagtgatccgggtgatccgcgagtcggacgagccgaagcctgacctgatcaaggccttcggcctgaccgaggtccaggccgaggacatcctggaaatccgcctgcgccaattggcgcggctggaaggcttcaagctggagaaggagctgtccgagctgcgcgaggagcgcgagggcctgcgccacgtgctggacaccccggacgcgctcacccgcctgatccgcgacgagatccaggccgacgccgccaagtacggcgacaagcgccgcagcgagatcaaggccgccgaacgcgcggtgctgacgcaaaccaccgccgacgagccggtgacgctgattctgtcgcaaaaaggctggatccgcgcccgcgtcggccataacgtcgacctggaggcgctgagcttcaaggatggcgacgcgctggcggcggcggtggagacccgcaccgtgtggtcggccatcgtgctcgaccacaacggccgcgcctacaccatagacccggccacggtgccgaccggccgcggcgacggcgtgccggtggcgtcgctggtggacctgcaggacggcgccaagccggcgcagctgatctcaggccccgacgccgcccgcttcatcgtcgccggttccggcggctacggcttcatcgccaagatcggcgacatggccggccgggtgaaggccggcaaggccttcatcacgctggacgccggcgagaaggtgctggcgccggtgccggcgccgcagggcgccggcctggacgcgctgcagctggtggccgccgccgacagcggccgcctgctggccttcccggcaggcgagctgaaggaattgtccaagggccgcggcctgatgctgatggcgctggacgagggcgcggcgatgacggcgataggcctggtggccggcgccaaggcgctgctgtccaccacctcggtgcgcggcaaggccggcgatgagaagctggcgctggaggaattcatcggcaagcgcggcaagaagggcaagctgatgccgaagaaatggctggtcagcgccatccgggagctgccgatgtga

SEQ ID NO: 336 - DNA, 1557 bp, Chromobacterium substugae
atgacacggaccagccagccgcaagccctcaccccccgcgccgcgctgttgttcgtcaacggctttcgcgcgctgctgctgctggtcctgttttccatgtcgctgctgccgggcagcgacggcctgtcgctgatagaaggcggcaggcatttttatttgtggtccggcgtctacctgctgctgatcgcggtgtggttcctgctgcgcgaaggcaagctcggccacacgctgcagctgacgctggccatcgccgccgacatcgcgatgatggtgtggctgatggcgatgaacgagggtatccgcggcggtttcggcctgctgctgctgccctacctggccgccgccggcctgctgtccaccggccgctacgcgctgttctacgccgccatcgccaccctgacgctgttcggctacgccggcgtcgagcattggctgggtctgccccatagcgccgacctgtcctatagcgcgctgctggcggccgcctgcttcatcacctccatcgccacctggcagctggggaggatggcgcgcgcgtcggaggcgctggcggccagccgcggcggcgagatcgccaacctcaaccgcctgaacgaattgatcctgcaaagccagcgcgacgcggtgatggtgctggacgaggacggctgcctgcgccagttcaacctgcaggccgagcgctacttcagccgcctctcccgcggccagtccatgccggagttgctgccgctggtgcggcgctggcagcagagcggctatccggcgctgcccaccttcatcgagcacagcgcgcgcggccgccagctggtggggcggctggcgccggtgccggtgcgcgagggcgaactgcgcggcgtggtgctgttcctgcgcgacatggcggacatggcggaagaggccaagcgggtgaagctggcggcgctgggccggctcaccgccaacatcgcccatgaaatccgcaacccgctgtcggcgatcagccatgccggcgatctgctggccgaggatgaggcggaccccgcgcggcggcggctggtccgcatcgtgcaggacaacacccgccgcatcaacggcatggtcgaggatgtgctgatgctgggccggcgcgatcgcgtcaagcccgaagccatcgcgctggcgccgttcgtcgccgagctgctggagcatttctccatggcgcagccggacgccgccggcgccgtcgcctgccagctgccggccgattgccagctgcgcttcgaccgcggccacctggcgcaggtgctgggcaacttgctggccaacgcctggcgccatagcagccgcgccgccggcgcggtgcagttgcacgccagcgtggctgaggattaccttatcctgcgggtgatcgacgacgggcccggcgtggcggaagccgagcagtcgcggttgttcgaaccctttttcaccacggaaaacgccggcagcggcctgggcctgtacatcgcgcgcgaactggccgaggccaacgacgcgcggctggattacagcccgcccggtggcgtgttccggctgatctgtcacctggcctatgactaa

SEQ ID NO: 337 - DNA, 1302 bp, Chromobacterium substugae
atgcgggtattggtagtggacgacgagccggacatccgcgagctgctggagctgactctgctgaaaatgggcttgctgccggtctgcgccggcagcgtggccgaggccaagggcatgctgggcgccgggccgttcgacctggcgctgaccgatatgcggctgcccgacggcgaagggctggaagtggtgcgccacatcggcgagcaggcgctggacgtgccgatcgcggtgatcaccgcctacggcagcaccgacaacgcggtgcgggcgatgaaggccggggctttcgactatctgcaaaagccggtgagcctggcgcagctgcgcagcctggtgaagaccgcgttgcgggtggagggcggcaagccggcgcagcagcagcggctggttggcgactcgtcggccatccaggaagtgctgcggctgatagaaaagttgtcgcgcagccaggccgcggtctatatccgcggcgaatccggcaccggcaaggagcaggcggcgcggctgatccacgagcagggaccgcgcgccgagcgccccttcgtcgcggtcaactgcggcgcgatccccgacagcctgatggaaagcgaattcttcggctacaagaaaggcgccttcaccggcgccgacgccgaccatgacgggtttttccagcaggcgttgggcggcacgctgtttctggacgaagtggccgacctgccgctggcgatgcaggtgaagctgctgcgcgccattcaggagaaaacagtgcgcaagctgggcggcagccaggaagaggcggtggacgcgcgcatcatctgcgccacccaccaggacctggcggcgcgggtggaggccggcagcttccgccaggacctgtactaccgcctgaacgtgctgccgctgcggatgccggcgctgcgcgagttgcgcgaggacattccgctgttcgcgcagcagttgctgcagcgctacgccggcgacggcgcggcgccgcagctggcggcggatgcccgccaggcgctgcaggactacggctaccccggcaatttccgcgagctggagaacattctggagcgggcggtggcgctggccgccggcccggtgttgagccgggacgatctgcaactgacgccgccgcgcgaatattgcccggagccgggcagcgccgaaccgctgcaggactatctggaccgggtggagcgcgaggcgatcgccaaggcgctggacgctacccattacaaccgcacccaggccgccaaacgcctgggcgtgaccttccgctcgctgcgctaccggatggagcggctgggggtgaggtag

SEQ ID NO: 338 - DNA, 1293 bp, Chromobacterium substugae
atgaatgaaaccatagagaaaaaagacgcaaccgctttcagcgaagcctggtgggcggatttcatggataggtcgcaaaacctcagcaagcccgtcgtcgtcaagaacgccatcccccaggaaaaattccgccaccaccagcaaaacgtcctcagcatcattgcggacctcgccaaattgaaaaccacgcaattcggctaccgcatttacatcgaaggacggctgctgggaccgaacgagatggacgatattttcgaaaaatccgcgccgctcgaaaacgaagaactggaaacgtgggccgccagggtatttggagaccagcgattcggcatcatcttgaactccggcgagaagttcaaccaggccttatcaaaagaaatcgccgtcgccctggcgcccttattcgacgagatcggctacccgcgcggcggcgtgcaattcaccatcttcatcggcaattacgacaaaaccccattgggcattcaccaggaccagcgcggcgaaagcgtgatccatttccacgtcggccccggcagcaaaaccatgtatgtatgggaccgagagcagtacaagaatctgctggaaacgcagaacctgacgcgcaaggatttcgccaagctgcggccgtatgcgtccgaattccactttgaaagcggcgacctgtatttcatgccggaaggcacctaccatatcggcatgcaggagggactatccgtcggcatcaccgtatggcgctacagccataccgacgatctgctggcgaaacatttgcaccagcgcattttcaaacagatcccggtggagaagaccgaagacttccagcacgacgagaactcgctggacgacaccagcggcctggacaaaatcatcgagaaatacagcctgaccgatgaatgcaagaatctgaactacagcgagctgctgaggaaaacctatcaggactggcgctactcggtgcacagcaacgccggctaccgcaacagcccgttcccgcgcgaagggctggaaaagatagcgctgcaggaccggatcgccatcgaatcgccctacaagattctggcgcgcgagtcggagaacaccgacaagatctacatttacgtccgcggccataaaatcgaattcaaccgcttcccctgcgtgctggcgttgatacagcgcctgaacgaaggccggacggaagcagtagccgatctgctgcaaattctggacaagagctggcccgcccaggtcggcttatacatattgaacgagctatatcattggcgcggcatcgacaaggtcgcccgccagtga

SEQ ID NO: 339 - DNA, 153 bp, Chromobacterium substugae
atgaccaaggaaaaccaagtcgcccaactggaaaaagaacaagacatcaaggactttctgggcattcaagtcctgactccggcggaagaaatctcggtatccggcggcggccagcaccaagaaaagcaacaagaacaacagcacgttgattaa

SEQ ID NO: 340 - DNA, 1158 bp, Chromobacterium substugae
atggaccatcatccctcccgcaaccaccatgtcgacaatctgcgcggcatcgccatttcctgcgtgctgctgctgcatttcgcgctggcctacggcgtcaaggacagcccgctgggcaccctgttgcccccctggctgctcaagagcctggtgtggaacggcaattacggcgtgaccatgttcttcgtggtgtccggcttcctcatcacctcgcagtcgctgcggcgctggggcagcctggccgccatcaacatccgcgccttctacgtcttccgcttcgcccgcatcatgccgatgctgctgctggccctggccatcatcgtggcgctgggctgcctgggactgccctacttcatcaacaaggaccatggccaggcgatgcccgcgtcgttcttcctggtcgccgccggctcggtgctgaccttctggcacaatctgctgatgcagcaggtcggctatttcaactacagcctgaatgtctattggtcgctgtcggtggaggaggtgttctacctggccctgcccttgctgtgcgtgtgcctgcgccgcgtcagcctgctgacgctgtgctgcgcgctgctgatcgtcgtcgccccgatctaccgcggccaacacgccgacaatgaaatcgactacctgtacggctacctggcctgcttcgacgccatcgccatcggctgcctggccgcgctgatcgcccgccgccggccgctgctcggccgcgccgcccgcctgctgcgctgggccggcgggctgctgctggccttcaactacctgcgcggcttttccggccacgaggccttcggcttcacctggctggccttgagcgccgcgctcttcctgctcggcgccgccgccgatccgacgctgcgcggcgggtccgaacggctgagccggccgctgcgctggctgggccggcacagctacgaaatctatctgttccacatcatcgtgctggcgctgctgcgcaatctggtgccgcgcgaggccgtcggctactggacgcggctgccgctgttcatcggctttctgctgctgaccgtgctggtagccggcctgatcggccgctacctggccgaaccgctcaatcgcggcatccgcaaccgctacctgaaccggcgcggtcccgccgccgccgcgtcgctgcccagccgctaa

SEQ ID NO: 341 - DNA, 1002 bp, Chromobacterium substugae
atgcctgagcggccgccagcgaaaccggcgcgccgcccggcccgcctcagcgtctgcatgatagtcagggacgagcaggcggtgctggcgcgctgcctggacagcttgcaaggcatccacgacgagctctgcgtcgtcgacaccggctcgcgcgacgacaccgtcgccatcgccgagcgctacggcgcgcgcgtccagcgctacgccggctgcaacggcccggacgggcgcatcgccgacttcgccgccgcgcgcaaccaggcgctggcgatggccagcggcgactgggtgttgcagatcgacgccgacgaggtgctgcgccaaggccacgcccagatcaagcggcatgtcaggagcgcccatccaggcatgataggcgtcggcctatcctccaacggcgcgcactgggtgtcggcccggctgttccggcgcacgccggacgcgcactaccgcagccgcatccacgaatacctggtgcagggcggcggcctgctgcccgacaagcggatccgcatcgaaaacctggaaaacaagcaaggcaaggaaagcgccagcgaacgcaatatccgcctgtgcctgctggcgctggcagaaaggccggacgaggcccgcacgctgcactacctggccaacgagtaccgcgaaagccagcgcttcgacgaagccatcgcctgctaccgccaggcgctggcgctgggcaatttcccgatcggccgcttccacagcgcctactacctggcggtctgccatctgctcaaagaggagtgggatcaggccatggactacgcgctgctggcgatccgcgccgatccgcgctacgccgaaggcccctgcctggtggccgacatctactccagcaccggccagcgggaatacgccgcccactggtaccggatggcgctggtctgcaagcggccgccggccgacgccgtgctgggcgtccagcactgggcctacggcgactaccccaggcagcggctggcgcggctggccgcggcctga

SEQ ID NO: 342 - DNA, 855 bp, Chromobacterium substugae
atgctttccatcatcatttcctggcgcaaccgcaaagaactggcgcaggccctgcccagcctgctggcagcggcccatggcgtcggcggcgacgtcaacatcgtcaactactccggcgacgccgcgcagctggcggcgctatgcggcgcttacctcccgcagctgaacatcatcaacgtcgacgggcaggaattcttcaacaaggccgccgcgcaaaacgtcggcgcctcgcaggcgcgccatccggcgctgttcttctgcgactgcgacatcatcctgcccgacccggcgctgctgcggcggctgtgcgcccacctggcggaaggcgccggccgcttcgtcaccctggccggcgtgcaggagtcggaagtcaattcgcgccaggcgcgccacgtggtgtccttcggctacgaactgaacatccgcaccgccgacggccgccgcctgcgcatcgtcgacaatgaggaagacggcgaaaccggcacccgccaggctcccggcctgctgctggcgcggcgcgacgacttcctggccataggcggctacaactccgacctgcacggctggggctgggaggatcaggacatgatctcccgcctgaccctgggccgcggcctggagcgcgtcaacgagggcgtggccgtgcacatctcgcacgacgaccacgcccgcatcgcccactacccgcaggtggcgtcgcgctgggaaagccgcgaccggatgttccgccaggcgctggccaactacgacgacgccaatttcagcggcagctacccgcgcgacctggccaggctggaggggcggatcgccatggtccgcggcgcggccgccgacagcggagccgtccatgcctga

SEQ ID NO: 343 - DNA, 921 bp, Chromobacterium substugae
atgagcatgaaactggcagactatctcggccacaccctggcgcgccgcgcggcggacgacgagcgcatcttcgtgctggacggcgacctggccgattccgacggcgccatgcacttcgccgaagcccatccgcagcgcttcctgatgaccggcatcgccgaacagaacatgctgtctgtggcggccggcatggcgtcctgcaagctccggcccttcgtcttctccttcgccgccttcctgtgctaccgcgcctacgaccaggtgcggatcggcctcagccaatgccggcaggccgtcaccatggtgggctcgcacgccggcggcctggccgcgcgcaacggcaagacccacgccgcgatcaacgatctggcgctgatgctgtcgctgccgaatatcgaggtctgggcgccggccgatttcgccgacgtcgagctggcggtgcgcgcctgcctgcaaagtccgtccgccaactacatccgcatgccgcgccgcgccttcggctacgacgagcagttgccgggcgaggccgcgccgctgcgctggctgctgccgccgcgcccgctcaccctggtgtcgaccggactaggcagccactgggcgcgggaagccgccgaacggctgcagcggcaaggcatggaagtcggcctgctgcactgcccctacctgggcgaccgcgacgccatcgcccgcgaactggcgggcgtcagccggctggtggcgatcgaggaccactgcgtgatgggcggcctggcctcgctgctggccggcctgcagctggaggcgccgatcgccgcctgcggctggccggcggactacgccggcaagtccggctccgacgaggcgctgcgcgcgcgccacggcctgtccgccgaggcgctggccgccaaggtggccgaattcgccgcgctccgcccccattaa

SEQ ID NO: 344 - DNA, 891 bp, Chromobacterium substugae
atgaccatagacatctccgcaccgctggcggccaggcatccggcctcggcccccatcctgcacgccgccgcgccggacggcctgacgctggccgccgaggccaaggcgctgcgcctggacatcatccgcgcgctgcacgccgtcggcggcggccattacggcggcagcctcagctgcatcgacctgctgctggtgctgtaccgccgctgcctgcgggtggcgccggccgcgcccggccacccggagcgcgaccgcctgatcctgtcgaaaggccactccgcggtggcgctgtacgcggtgctgcggcggctgggcttcttctccgagccgctggacaactacgccgacttcgactccatcctcgaaggccaccccgacatgctgagcgtgccgggagtggacttctccagcggctcgctcggccagggcctgtcggtgggcataggcatggccctggcgctgcgcggctcggcgcagcgcacctgggtggtgctgggcgacggcgaatgccaggaaggccaggtgtgggaagccgccatgctggccgccgcctgcggcctggatcacatccacgccatcgtcgactgcaaccgcttccaggagtggggctgggcgccgacgcccgacgcgccgcacccggagccggtgccgcagatggcagccaaatggcgggcgttcggctggcacgtgatcgaatgcgacggccacgaccaccaggcgctggagctggcagttcaagaggcgcaacgccacaagggccagcccagcgtgatcctggcgcgcacgcaaaagggcaagggcgtgccgctggtggaggcggcgccgtggcgcttccattgcgagacggtatccgacgaagaacacgacataatgctgaggagcctggcatga

SEQ ID NO: 345 - DNA, 1800 bp, Chromobacterium substugae
atgctgagcgccgaaccgatttacggcctgatcgccaaaaccgccgtcgcccgcgccgacttcgccggccactggcggcagcggctgcccgccaccttcccggccgccggcgccgactggttcgtgtcagccgccggcctggcgctgcacgcgccgcaaaccagcgccggcccgcatggcggccagtcggcgctgtgctgccgcggccgcacctacggcgccgccgcgctgtcgctggaggcgctgcagcgcgacggcgcgcgcgccttcgagcgctgcgccggcgagttcgcgctggcgttctgggacgaggcgcgcggccagctgctgctggcgcgcgaccagatgggccagcgcagcctgttcatccgcgaagacgcccatcattacctgttgtgttccgaactggagccgctgctggccgatcccgatttcgactgccagctcgacgccgaatccgcggtgcattacctgatgttcggcgcgccctatccgggacgcacgctggcgcgccgggtcagcaaactgccggccgctcactacttgagttggaacggcgccggcccgctgctcagccaccgctactacaccccaataggcttcgacgcgcccaaggtggtgggcgccgccgagcgcgagcagctggagcgcacgctggaccaggccatccatgcccggctcgccgacggcggccaggccatcctgctgtccggcggcgtcgactcctcctacatcgccgccaccgccgccatgcgcgccggcggcgaacgcctcgacgcctacaccatcgagttcaccgcgccctacccccacaacgaaagccaatacgcccgcatcgtcaccgacgcctacgggattcgccaccacgcggtggagctgggcccggagcaggccaccgccgcgctggccgacgtgttcgccgccgccgagccctgcagcgcctggagcagcatcacccaccgccacctgctggcgcggatcggcgccgacggccaccgcagcctgttatccggactgggcgccgacgaggtgttcggcggctactggaagttcttccagtcgtacgccaagctgcgcttcttcgaggaaagctggccggcggccgacgccgtcgactccatcgatggcctgatgtggcagccgacgccggcgcgctcgcgcctgttttccggcattccgcgcttccatcccgattccgcgctgcgggcggcgctgccgcagccgtacaagtcgtggagccatgcgccgcagctgatcgagttttaccgccagtgccgccgctacaagccggacgcccacctgttcgagctgatggtcgcccacgagtgccagcaccgggtgcccgacctgctgttcgccggcttcgagcctccggccagaagccagggcatccacaccgcctatcccttcctcgcgccggaagtggcggagcaggcctgcggactgggcgccgccgagcgcttctggcgcaaggacaaccgctggcgcaacaagaaagtgttgcgagagatcgccgccaagcgggtgcccgacgccatcatgcagcgcccgctgtacagctacaacgccccgatcgcgcagtggatgcaacacccggacttctccgccgccatctatgcgcaactgcgcgacgccccgctgtgggacagcggcttcgtccagcgcggctggttgtccgaagtcgaggcgcagatacgatcctacacaccccgggccaaggccgcgcacttcacctgcttcgggcagatgtgggtgttggcgacgctggccgcctggcaccaacgatgggtagcacgctaa

SEQ ID NO: 346 - DNA, 1068 bp, Chromobacterium substugae
atgaaacaagacaagatactcattctgggattgggcgatctgggacgccgattggctctgaccctgcccttgctgaatcgcgacctctccctgctgctcgccagccgcgaccgcggccgcggcgaatccttcgcccgcctgtcctccgcctgctcggcgacgccgcaacgcttcattccgctggacggcctggacgccgacagcctcgccgcgctgctggagcgcgaacgtcccgacctgatcgtgcaggcggccagcctgatgtcgccgtgggcgctgttccagcgcgatgacccgcaagcggtcgcgctgcgccaggccggcttcgcgctgcagctgccggcccagctgccggtgatccgcaacctgatgcaggccgtgcgcgacagcggcgtctcctgcccggtggtcaactgttcctacccggacgccacccacccgatcctggagcggctgggactcgccccgaccataggcataggcaacgccggcatgatcctggcgctggcgcgccggtgcgcggccgacgcctcccgcccgctgcgtgtcttcgcccatcacgcccatgtcggcgcggtggtgagggccgagccgcaagcggcgcgcggcctgccgccgccgctgctgtacctgggcgacgagcggctggacgccggcgaactgtaccgcggcccggccattccgcaagaccaggacctgaacgcgctatcggccgcccacgcgctgcagttgatcgacgcgctgctgcccggcgcgccggagttgctcaccgccgcgcccggtccgcgcggcttgcccggcggctggccggtgcgggtgggccagggcgccgtcgcgctcgacctgcctgccggcatccagccggccgacatgctgccctatatgcgcgaagcggccgccggcgacggcctggccgatatcgccgccgacggcaccgcccacttcaccgacgccttgcgcgccgcgctgccggcgccgctgcgggaactggcggaccccatgcatccggacgaggcgctgccgcgcttccaattgctgcaacgccacctggagcggccggcatgctga

SEQ ID NO: 347 - DNA, 165 bp, Chromobacterium substugae
atgaaccagcaagacctgaaaacactggatgccaccgaaatcagcgaagtcagcggcggcgccggcgaaatctccgccaagtacctgaaactgcgcgcggaaaacaccaaatccggcgaaatccaggctcaatacctgaagctggtttcggaaagcaccaagtaa

SEQ ID NO: 348 - DNA, 1338 bp, Chromobacterium substugae
ttgtcaacatattggactattcgcatagaaaaatctgccagccacgtgccaaatccacccactcctgaatccgcggccagcggcagccgcttgttccgcaaggaagcgctgcgccagctggatacccaccgctatggcagcatcgtgctgaaaaggccgatcagcctggcttggctgaccggcttgttcagcctgatcgcgctggccatcgtgctgttcttctgcctgttcagctatacccgcaaggcgcaggttgccggcgtgctgctgccgacccagggcttgatccgcctgctgccgtcgcagtccggcacggtggcggaggtgcgggtcaaggaggggcagcgggtgcaggccggcgaggtgctgttcgtgctggccaacgcgcgcgccagcgccaccaagggcgacgccgagggcgcgatcacccggttgctggagtcgcggcgcgacagcctggccggagatcagggcatgctgcggctgcaggcgcggcaaaagcaggcggccttgcagcgccgggtggaggatctggacaaggaagtgcagcgcatcgacgagcagatcgcgctgcagcggcggcgggtggcgttggcggaggaaaccgtggcgcgcaaccgcaagctgcaggaggccaatttcatctccgcggcggggctgcaggacaagcaggccgaactgatagaccagcaggcccggctggccgacctgcaacgctcgcgcgcggccacgctgcgcgaccaggacggcagccgcgccgacctgcgcgacatccagacccaggcgcagcgcgacgaggcggcggcccagcgcagcgtcgacagcatcgagcaggacctgaccgagaacgaggcgcggcgcaagctgctggtgcgggcgccgcaggccggcatggtcagcggcctgaccgcgcagccgggccagacggtggcggccaaccagccgctggccaatctgtcgccggcggggtcgccgctggaggccgagctgtacgcgccgtcgcgcgcggcgggcttcgtcaggccgggcatgccggtgctgatccgctatcaggcctatccgtatcagaagttcggccagttcaagggcacggtgcgcgaggtgtcgcgcagcgccttgcggccggaggagctgtacttcaccagcccgggggccagcccggacagcgaggcgctgtatcgggtgaaggtgacgctggagcggcaaagcgtcaccacttacggccagtcgcagccgttgaaggcgggcatggcgctggacgccagcgtgctgctggaaaagcgcaaattgtacgagtgggtgctggagccgctctacagcatcagcgggaaggtgtga

SEQ ID NO: 349 - DNA, 2154 bp, Chromobacterium substugae
atgagccatcagcaacccgtgctgcaattctggggccgcaagcgcctgccgctgctgctgcaaaccgaagccgccgagtgcggcctggccagcctggcgatggtggccggctactggggcctgcggatagacctggccaatatgcggcggcgtttttcggtatcgctgaaaggcaccacgctgaaaagcctgatcgcgatggcgcagggcctgggcctgcagccccggccgctgaagctggacatgcagcatctgccgcagctgcagctgccttgcgtgctgcattgggacatgaaccacttcgtggtgctgaaggcggtggccggcaagcacatcgtgatccacgacccggcggtgggcgagcgcaagctgccgctggccgaggcgtccaagcatttcaccggtgtggcgctggagctgacgccgggcaacacgttccgcaaggccgaggccaggcagcagttcagcctgctgtcgctgatgggccgggtggacggcttggggcgcggcatcggccagttgctgctgctgggcatcgccttgcaggtgtgcgcgctggcggcgccgttctatctgcagtgggtggtggacgaggcgctggtggcggccgaccgcaatctggtgacggtgctgggcatcggcttcctgctgttggtgctgctgcagaccgccatcggcgcagtgcgctcgtgggccgccacggtgctggccaccagcctcaatttccagtggctgggccatgccttcgcccatctgctgcgcctgccgctgccctggttcgaaaaacgccacctgggcgacatcgtctcgcgcttcggctcgatccaaaccatccagcgcagcctgaccacccagttcgtcgaaggcgtgatagacggcctgctggtgttggccaccttgggcgtgatgctgctgtacagcccgtcgctggcggcggtgagcctggtggcggtggcgttgtacgccttgctgcgctggagcatcttccgcgcgctgcgcgaggccaccgccgaacagatcgtccacgcctcgcggcagagcacgcatttcatggagtcggcgcgcggggtgcagagcgtgcggctgttcggccgccaggaggagcggcgcatcggctggatgaacgcgctggccgagcagttcaacgccgatctgcgcatttcccggctatccatcacctttcaaaccgccaataccttgctgttcagcgccgaacgggtggtggtggtgtggctggcggcgctggcggtgatggacaaccgcttttcggtcggcatgctgttcgccttcctcagctacaaggaccagttcagccagcgcatcgccgcgctgatcgacaagctgttcgaattgcggatgctgcggctgcacggcgagcgggtggccgacatcgtgctgaccgagccggagccggagttgaacgatgtggagctggacccggcccatgtgcagccgacgctggaagtgcgcaacgtcgccttccgctacgccgacagcgagccgtatgtattgaaggacctgaacctgaccgtgccggctgggcagtgcctggccatcaccggcgcttccggctgcggcaagaccacgctgctgaagctgatgctgggcctgatggagcccaccgagggggaaatcctggtgggcggcatccagttgaagcagctgggcctgtccaattaccgcaagctgctcgggacagtgatgcaggacgatcagctgttcgccggctccatcgccgacaatatctgctttttcgacccgcagcccgaccaggagcgcatccgccattgcgccgggctggccgccatccacgacgagatcatggcgatgccgatgacctacaacacgctggtgggcgacatcggctccggcctgtccggcggccagaagcagcgcatcctgctggcgcgttcgctatacaagcagccgcgcctgctggtgctggacgaggccaccagccatctggacgtgtggaacgagaaactggtcaacgccgccatccgcaatatatccatgacgcgcctgctggtggcgcaccggccggaaaccatcgccatggccgaacgggtggtggtgctggagcaggggcggatcgtgcaggatacgacggtggcggccgcgccggcctgcgcgtcggcaggcactgcgatctga

SEQ ID NO: 350 - DNA, 906 bp, Chromobacterium substugae
atggatccgcatcttcgcacgctatccggcatcatagattttgagtgcgccgccaggcaccggagcttccggctggccgcggccgagctgaacaagacgcccgccgccatcagccaacaagtcaagcaactggagcagacgctgggcatttcgctgttcgagcgccatccccgccacatttgcctgacgccgcaagggcaggagctatcccagctgatcacgcgcatgctgcacgacctccgcgccaaaatctcaatgctgagagtccccgagggcgcccagacgctgcatgtcaccgctacccattcgttcgccatcaaatggctgattccgcgcctgcagcgctataccgaacgctttcccggcttcgatctgcgcatcgactccagcgatgccctgcgcacgctgcaagagggcgtgtgcgacatcgccatccgtcatcacaagctgcaaagggacgcaatgaactcgctgctggtcagcgaagacctgatcgtggcctacagcccgaatctggtaacggaaaccgggccggtcaccctgcagcagctactccgctacccgctgctgtatgaagattcgcccgaacattggcacaccttgctgaatgtccatggcctagaccggcaccgctacgatctttcccatcagtacagccattcaggcctgctggtgcagtcggcggtggcgggcctgggcgtcggcctgctgccctactgcctcgcctacgaagatatcgtcgaaggccggctgatcatgctgccccatatcgccctgccgtccggctatggctacagcgtgttctgccgcgacgaccagcccaagatgcggcagttcgtcgaatggctgcaggaggaagtggcggcgatgcggctgatgccgcgcgcgccggccgcgaagccgtaa

SEQ ID NO: 351 - DNA, 303 bp, Chromobacterium substugae
atgcaaactgcggatgtgtttcatctgatcgtggccatttcggcccgcacgccggccgatatcgagcctatcgccgatgcgctggcgcgcatgcgccccacatgtctggcggagcccggttgcctggcgtgggaggcctaccactccgccgatgccgcggagaagttctatctggtggaaacctgggcgtcgcgcgccgcctgggaggcgcatggagaactttcggcgatccaggacatttacgtgccggagatcatgccgcggatcaaccgcgaagtgcatccctgctcccggatcggttga

SEQ ID NO: 352 - DNA, 705 bp, Chromobacterium substugae
atgtctgcacaaaaggtcgccctgattactgccgcggggaaggggatcggcgccgccatcgcgcgtgatctggcgtcgaatggttaccgggtggcgctgatgtcgcgctcgaacgcggccattgaattggcgcgcgaactcggcggcgtcggcgtttcgggctcggtcaccgagttcgccgatatgcagcggctggttcaggccgcattggacgcttatggccgcatcgacgcggtggtcaacaataccggccatccgcccaagggcgacctgctgtccatcccggatgaggaatggcatcgcggcttggatctgctgctgctcaatgtgtcgaaactgatgcgcctggtcacgccgatcatgcgggaacagggcggcggcgcggtggtgaacgtgtcgagcttcgccgtcgaggcgcctgagctcggcatgccggtgtccgcggtgatccgggctgggctgagcgtctggacccggctgtacgccgagcgccacgcggcggagaacattcgtatgaataccgtcttgtccggctttgtcgacagcgcgcctttcgatgaaaaacgcgccgcttccatcccgatgggccgctatggcgataccgccgaattggccgccgcggtgcgattcctgctgtcggcggaatcttcttatatcaccggccagaacatccgcgtcgatggcggcttggttcgggcggtttaa

SEQ ID NO: 353 - DNA, 924 bp, Chromobacterium substugae
atgacgaaacaagttctggtgatcggcggaacccgctatttcggcaagcggctggtcgcgaaactgctggcggccgggcatcgggtcaccatcgcctcgcgcggcaacgccgccgatgatttcggcgaccgggtcgagcgcatccgggtaaaccgttcggatcgggccgccatgacgcaggcgttcgccgatgcgcgctacgacttggtctacgaccaggtttgttacaacccggtcgatgccaagctggcttgcgatgtgtttgccggcaaggtggggcgctatgtgatggcctccaccatcgaggtctactatccgctgcggcgcgccgtgcagcggccgttccgcgagctcgatttcgagatgcggggcgagctgctagagatgggaacatcctggcacgagatggcgacgccggatcaaaactatgtggccgggaaaaggcaggccgaggcctgcttccatcaggacggccgcttgccgctggtggcggtgcgcatcgggcatgtgctggccgatggcgaggaggaatttctggggcgtgtcgccagttacgtcgagcgcgcgcgccggggcgaacgcctgcggtatgcggtggcgtcggggcgcagctcgttcatccacgccgaaagcatcgcggatttcctgttgtggacaggcgagcaggcattcctggggccgatcaacgcggctgacgatggcggcctgacggcgctggagattcatcaacgcgccgccgccgccctgggcgtgccggcgcatgccgaagccgacctggacgaggaggctgcgaccaggctgagcgtcttcgactttcctttcgagtatgagatggataccggcagagcgcgcgagctgggctaccggtttgcggatgtggagcaatggatcggcggcgtgttcgccgggcatgctcaagcctga

SEQ ID NO: 354 - DNA, 228 bp, Chromobacterium substugae
atggccgcgaccgatgtgaagccgtttttcaatatctcgcatcgaatggaagatcaaatgagtaatgaatgtctggtttgctccgaagccgtcaacatcagcgcggatgtgctggtaggcgaaatcatcgcatgcggcgcatgcggccaagaacacgaactgctgatggttgatggccagcccaagctggccctggcgccggaagtggaagaggactggggcgagtaa

SEQ ID NO: 355 - DNA, 921 bp, Chromobacterium substugae
atgtcgcaaataacggtactgctgattctgaccaagatgcggccggaagagaaggcgatcgtcgaggcgctggagcgccggggcgtcaaggtgatcgtcagcgtggacggcagggatctgggctggctgttgcagggcgagagcggagtcgggcatccgcaggttgcgatgctgcgttgcttgtcgcaatcgagaaacgtcgagttggctcggttgctgagggcttgcggcattccgaccatcaactcggtcgatgcgatcgacatttgttgcagcaaagtggcgcaggcgatgctgttccggcagtacgacattcccgcaccgcagtccgtgatcgccttccaagccgatgaaatcacgcgctatggacagcggcacggcttccacttcgtcctcaagccggcttcttcatcctggggacgcggcgtgacgctgatccgcgatgaagaggcgctggaggcgtggcggtcggcgtgggaaacacatgatgcgctctacaagcatttcccggtgctgatccaggcttttgtcgagaagcctggctacgatctgcgcgtggtgatcgtgggcgagcgtcccatcgtggcgttccgccgcgctaccgatcactggaaaaccaacacgcacctgggcgcgcaagtcgtgccttgcgaggtgaccgacgcgatccatgatctgacgacccaggtggtggaggcgatcggccccggcatctacgggctcgatatcttcgagcaagtggggtcggacgaattgctggtctgcgagatcaaccagaatccggaattctggcgttcgtcgcagattcaccaggtggacgtcgccggcgcgatcgccgactgggtcgcggccgacgccgccacctacaacctttctttccaagtcaattccgctacatcgcttgcaatggtggcttcatga

SEQ ID NO: 356 - DNA, 609 bp, Chromobacterium substugae
atgaacaacttccagcaatcgctcattctctcgcgcgtgatgaccagcggcgtggtgatgagcatcgagaaaaacgaccggcaattgcccggccttgaaagcctgattcgcagcaggacgggcctgcagcatgtcgcgctgttcaactccattaccggcgccattcatggcgctctgcatggccaaggcatcggccatggcggccgcgcggtattccccggcatttcggaacgcgagtacaagtttctgacctggctgggggtgacattcgaagaaacccgcgccgaaccgagaacctacggcctggcgagcgtggcctggcgcgatgagcagaccgacttcgccgccgctgcgacccggctggcggatgacaaggtgcaggtttatgacttcgcggcgctgggtttcgggccatgcgccgccatcgccaccaacgatgagcaggtgtggaaacgcgccgagcggctgaagatcttcggcgccttcgacttgcggaccatgtggtcccaagccgaaagcgagccggatatccagccgaccatccaattcaactaccgactgagcccgctggttgccgcgtgcgttcgtcaggcaatccaaggggactga

SEQ ID NO: 357 - DNA, 1353 bp, Chromobacterium substugae
gtgcgttcgtcaggcaatccaaggggactgatcatgcaaaccgattttccggcactgccgctgccgtggccgacagatagcgtcctgcgcgacgaactggcgcatcttggcggtccgcctgtcattggccaaggcttccgccgcaccctattcccggtgatcaccaaggaagatgtgctgcagatgcagatcagcatcctgcgcaatcattccacgtcggtggcgcagttcaccgaggactaccgccagtatgtcggcgcgccgttcgccatcgcgaccgccagcggcacgtcttcgctgcacctggcgctgatcggtgccggcgtggagccgggcgacgaggtgatcgtgccttgcttcaccttcatcgcgaccgctcaggccatcgtggccgccaaggcgattccggtgttcgtggacatcgacccgcagacctactgcgtcgacgttgccgcggtggaagccgcgatcacgccgcgtacccgcgtcgtgatgcccgtgcatgtgcatggcctgccggccaatatggcggcgttgcgcgacctctgcgaccgccaccagctggcgctggtcgaagatgcttcccacgcccactccgcctccatcgacggcaaggtctgcggctcgctgggcgatgctgccgggcagagcttgatggcggataaaaacttcccggtcggcggcgagggcggcatcgccttcttctccgacgaggagaaataccagcgcgcgctcaaattcctggaaacctcgggcatcgactacgcgatgtcgggcatcgtcgcctccttcggcatcagccagctcaagcggctgggctactatgacgcgatccgccagcgcaacgccgactatctgaccgcgcaactggccaccaccggcctattcagcggaccgacggtgccggccggctatgtccattcctacaatatgtaccggatcaagctgcatccggccgccgccggcctggacgatctgcccgtgcatgcggtgaaggccgcggtgcaggagctgctgctggccgaaggcgtgccggcgcgcgaatggcagaaccggccgattccgggccacctgcccttccagaaccgcaccggtttcggcaacggctatcccttctcgctcagcgaccgcgacttcagcgaataccagatcgagcgcttccccaacacgctggacatgctggaatcgaccctgaccctgtgccgcgaattgcgttctccggtagagaccgagcgcatccagtcgtacgcgctggcgttccgcaagatcgcggcgcgtcctgacgtgatccgcgagctggcgacgaagggcgagtttccgctgccatatcaacgcgatagccgcctggggtaa

SEQ ID NO: 358 - DNA, 855 bp, Chromobacterium substugae
gtggcgatggagtcgatgcagcctgtcgacatcgtgttttcctgcctgccgggcggtgcgctgcccggcatgctcgagcagattcgcggcaaggcgcgccggatcatcaatctcgccggcgatttccgtctgcgcgatccggagctggtcgccaagcactatccgcagacggccgcgctgggaatgccggcggatgcgcgctacctgattccggagttctggcaagccgagtatgccgatgcgccgctgcttaatttgccagggtgcatggcgatcgcgaccttctattcgctgtatccgctggtggcgcggggcctggtcgagtcagacatcgtcgccgaggccaagaccggctcgagcggcagcggcaaggagagcgcggagcacccggccgagcgcggccataactaccggccgtacaaattgtccggccaccggcacgagcccgagatcgtcgaggccctggccgaacacgccggacagcgggtcgacctgcgtttttccgccggcagcctggatagcccacgcggtatttcggtgtcgtctttcttcaccttgcgcgaaggcgtgcaggagctggatgtgcgcaaggccttcatgtcggcctacggcaacacgcgcttcatccgttacctcggcccggcccagggaccgtggaatatgccgatgctcaaaacggtggtcggctcgaacgcggtggaaatcgccaccgacacggttggccgccgctgcacggtggtcagcgcgctggacaacctgatcaagggcgccgccggccaggcgattcaggcgatgaatctcgccgaaggcttcgacgaggcggaaggactagcctatggaggaatgtggccatga

SEQ ID NO: 359 - DNA, 1929 bp, Chromobacterium substugae
atgacagcgcttttcaatccgggatccgttcccgcgcaggcgccggcgccgggagcggccattcccaaaagccggatgccgctttatgtcatcaaggtgggcagcgccacgctggatgccggcagcgcggtattcggcgaaatcgcggccttggctgaaaccgggtgccgcgtgctggtggttgtcggcggcggcagcgccatcgagcggcaatatgccgccgaaggcctgcccttgcgctaccacacgctggccaacggcgacgcggtacgcaccgccagccgcgaagatatcgacctgttggtgcggacctaccgcgaccaggtgatcccgtcggcgctcaagggcttcgccgacgcggggctgcgcgccttcgcggcgcccggccaccagttgagcttggtcaccgcccagcgcaaccgtccgatcaaagtacaggtggacggcaaggcgttggtggtgcgcgaacatctggtcggcacgccggtcgattgccagcgcgcgctgctggggcatctgctcgagcagtacgacgtggtctgcctgaccgcgccggtggccggcgccgacgacgccgccgcggtgctgaataccgacgccgatatgctggcggcctttctcgcgacggcgctgcaggcggaccatatccgcttcgtcacgtccacgccgggcatcctgcgggatatcgacgaccccgagtcggtggtcgccgatatcttccccggcgtcgaactggacttcgtcaagggacggatgaagcagaaaatgcgcgcggcgcggcatgtgatcgagaacgggatcgccgatgtggccatcgtcggcccgcactcgttcgcgcaggcggccggcgtgacccgggtatggccgctcccgccgccgcacccagcgctggccagcctgacgaaggcggtttccatcaattcggtgtcgagggacgaggccgagatcgcgaaatggctggtggcgtattgccggcagcagggcgtggacgcccatgtcgacgcggcgggcaatttcgtcgccagcaaggggaatggcccgcagcatctgctgttgctggggcatatcgacaccgtccccggcccgtggcggccgatcctcaacgccgacggccatttgagcgcgcgcggcgtggtggacgccaagggatcgctggtcaacttcgttgaaaccttgctggcggccagcgtgccggagcacggccgtctgacggtggtgggcgcggtcgaggaggaagtgtcctcgtccaagggggctttccatattcgcgacagcctgatcgccgacgcggtggtcatcggcgaacccagccgcgccgatacgttgacgctgggctactacggcttgctcaagatacgcatcatcgcctcggtccgccatgcgcactcggccggtaaaggcgtggtgtcggcgccggacctgatggtggaaacggtggccacactgcgggactgcgcggcccgtttcgatccggaaggcatcagcgcgctgatctcgaccaaaagctggagcgactccaaccggcagcacgccgaggggatactcaatttccgcgtgtcgccatcggcggatttgccggccctgctggcggcggtcgagacctgcgcgaacgaagaggtgcgctgcgatatcgagcgggcgacgccgggatacggcaccactcggacctgcgagctggcgcgctgcttcggcagggctttcgcctcgcaggggatcgcgccgcgctacgtggtgaagaagggcaccagcgacatgaacacgctggcgacgcgctggactggcgtggacatggtggcgtacggcccgggcgattccgcgctggaccataccgaccacgagttcgtgaccgccgaggagttcggccgggcgcgcgaggtgctggatgcggcggtggcgcagtggttcgcggtgcggggagggcggcaatga

SEQ ID NO: 360 - DNA, 822 bp, Chromobacterium substugae
atgagcgagatcatcgaaaccggcgcccagtccgccgcatgggacaaggtcgggctggacgaattgcagcgccgcgtgcggcgcaccatcgtcgacctggcggcgacgccgaccggctgccatatcggcggcagcctgtctgtggccgacatcctgatcgccgcctttgccagcgtagaccgcgcggcgggtgacgaggtgatcctcagcaaggggcacgccgctgccggcctgtacgcggtgatgcaccacctgggcatcatgccggaggacccggtcgccagctatggcgcggccggttccatcctgaccggccatcccaaccacaagatacccggcgtgcgcttcgccaccggcagcctgggccacggagtggcttacggcgtcggctgggcgctagcacgccggatcaagggcgaccggcgccgggcgatcgcggtggccggcgacggcgaattgcaggagggcctttgctgggaggcgttccagctggccagcggcaaagggctgggtaacttcatcgtgatcgtcgatcgaaacggcgggcagaacgacggcgcggtcgacgagatttcgccgatgccggatctgctcaggcgtttcgaggccttcggcttcgattgcgcgcaggccgacggccatgatccggcggcgctgggcgcgatcatcgatgcgcatgacgccaggggcgaccggccgctggccatcgtcgccgataccgtcaagggcaagggcgtcggcgcgatcgagaacaatcccgcctgccactatgcggtgctgaagccggcagtcgccaaaaaatggaaggagaccatcgcatga

SEQ ID NO: 361 - DNA, 945 bp, Chromobacterium substugae
atgagtctggctggtcgaattgcttatcgggaagaactgacgcggctggcggtggatgacgccgccatcgtctgcctggagggggatctgggtggcgccaagcatccgttccagagcgcccatcctgaccgtttcttcaatctcggcatcgccgaagcggccgccatcgattgcgccaccgcgctggccttcaacggcttgacgccgttcttcagtactttcgcgccgttcgcggtgctgcgcgcggcggaaagcatgaagctgtcgatgggttatatggcggccaacatcaaggtggttgcgccttacgccggcgtggccggcggctggttcggcaccacgcaccactgcctggaggatctggccatcgtccagtctttccctggcatccgcatcctggcgccttacggcgaggaggagacgcgtcaagcggtgcgcttgatggccgaaaccccgggcccgttctacatgcggctgggcagaaacggcgcctatgccagcctggacggagaacgagaccggcacggcatcgtctggcaggcggcctccggttcggccgcgccgacgctggcggtggtctccgccggggaaatggccacggcggcggtgttggcggcgcgggagcagggcgccgaattcgcgcacgcgcatttgtggcggctggatagcgaggcgctggcccaggccgcggcgggcttggccggcttcgatgccgtgctggtggcggaggagcatcgcgcgcaaggcggcatcggctcggccctggcgctgctgttgccggaagtccgcgtgcactccttcaattgcggcgagggctggcccggcgtcggcggctcgcacgaggaagtgctggcctcgctgggctttaccagcgagtcgctgcgccagcgcatagaacaattgctcccggccgctgctcggcgcgccggcgacctatctcattga

SEQ ID NO: 362 - DNA, 1254 bp, Chromobacterium substugae
atgcatatcttgatgatcgaatgcaatcccaatggcatcgccggcatcgcaaacgcgctggaactgggccatgacgtcacgctggtctcggcggacccggatttctacctgaacgtatcgccgctggccaaggccgctttcgagcatcctcgctgccgcgtgatcaagtccgacgacgctttcgtcatcgatgcgctgctggcgttggccaagcgcctgcatgccgagaagccggtgcacggcgtggccacctatagcgagtaccacactgtccacaccgccaccgtggcgcaggcgctgggcctgccgggcatgagcgtggaaggcgcgctgaatgcccgccacaagcaccgcacccgcaccaagctggccggctccggcgttcggcagccacgcttcgcgcatgtcagcgacccgcagcaggtggaggcggcagtgcgcgaaatcggtttcccctgcgtggtcaagccgtcggatggcacggccagcctgcatgtgctgcatctgaccaatgaaaaagacctggagcaatacctggccgagctggccaagatcaccgattacggccgcggcgtggtgcgcattcctgacatcctggtcgaggaattcgtcgagggcgagctggtgtcggtggaagcctgcgtgcagcagggcggcaaggtggtcaacctgggcatcaccgaccgcgcgctgagcggtttcccctacttcattgaaatgggcgccacctatttcaagggccatccgctgcaggacgagctgtttgcgatgaacgagaaggtgctgacgcatttgggcgtggacttcggcttcatccacaccgaatacctgctgagccaggatggcccggtactgtgcgaggtcaacggccgtctgatcggtggcgttgtgcccagcctgatgcaactgtccagcggcgtggatccgtacctggaagtgatccgccaggcgctgggcgagacgcccgagcatccggtgcccggcgatgtcgtcgccagcgtccggtggtttggctcgccggtggacggcacgctgtccaagatcgacttctcccaactgaagaccttgcccggctatcacgatgcgctgagctaccgggcgccgggccgtcccgtttcccgtctgtcgaagagcaatttcgattggctcggccacatggtcttcaccggcgatagccgcgagcaggtcaatcagcgctgcgaggccgcgctggacagcattcatctggaactggcggtaggggtggcgaagtga

SEQ ID NO: 363 - DNA, 1359 bp, Chromobacterium substugae
gtgagcgcagccgttgccgaaagcaggccggcgacggctgcgggcgacggcgcccgccgcgcgctgcgccgggtggcgattccggtgcttgactcgtcgcagctgttcgatgtggaggtggaggatgggcattttgcctccatccgggcggtcggcgaaacggcggccggcgccaagccggcggccagtctgtggccggggtataccgagtgccatgcgcatatcgcgctgcccgccaatttcgacgacagcatagacgagcctgaactggtggcgctgcaatacctctaccacggggtgacgcaggtggtggacatgtttgggtttccgttggtccggcagcgctggcaggacgcggcggcggcgtcctggctgccctatccggaggtggcgcactgcggctacgcgattaccgcgatgtgcggctatgacggcaagggcgcgcacggcaccgagtttccgtcgccggtgttcatgctgggctgcgagagcgacctggatacgattctggaggccaacgccaagctgggcgcgagcttcctgaaagtgatgttcaccgatggcgtcgagcagcctggctcgccggtcaagttcaaccggctgtcggcgccgctgctggaggcgctggccaaggcggtggcggcgcgcggcatcccttgcgtgctggactgcaatacgcgcgaggaggtgctgctggcctatcgcttcggtttccgctatttcgcccacgccgtgcgcgatgtcgaactgagcgatgccgactgggcgaacctgccgggggcatccttcgtctcgacgctgtcgggcttgcggccgatggtgatgagccgcgaggagtttctggacgaatatggccatgccggcttcgtgcagacgcaggatgcggcgaacctcgatttcgtggcgggcatcgagcagccgttcggcgtcgcccgcaactgtttcgaaacccggaccggcgcgctgcgcgccatgcggcagaacagccgcgccgcgctggcccgcggcgccctgcgagtgggaaccgacgccggcaacgccggcggcttccatggctacagcctgctggccgaattgaggctgctggcggagcggcggggccgggccgacgtcgcgctgcagaccaacgcctgtctcgacggccgccgctttttcgagctgctggctgggcgcgccgccactgagccgttcgcagtcggggccgccgcgacgttcaacctgtttcgcgacgccgatgcggcgaccggcgccttgccggatgagaccgtggtccgcggcatcgcggtggaccgcgcgcgcatcgcgcaattcattcactccagacgcgcttccgcgaccaaagggaaagtctcgctatga

SEQ ID NO: 364 - DNA, 1170 bp, Chromobacterium substugae
atgtatggcatcaatatcggcatcgcgttggcgggtattgggaatttcatctattttccgcacctcgtcgccaccttgggatcaagctacagcgggttctgggccggcttcgtcatgttcatgacctatgtcggccgtttgagcgccaccttcagctatgagggattttcggcgcgggtcggcaagcgccacggcatcgtcatcggcatcctggtggaggcggtggccctgggcctgatggctttcgcgcatgacgtcgtcgcctatagcgcgctggccttcttcgtgggcttcggctcgggcacctccttccccgggctgaagaacgtgctgggcgaatttccggaagcggctcgggccaaggcgttttccagcttccagctggcatcccagtccggcatcatcctcggcgccctggctggcggcctgttcagcaatgcccagatgccgctggtgttcctggtggtgttcctgctgttcatcggctactgcatcgccgcgtacttcgtgattccgggcgagacccatccgcccaagcgcgacgtgccgctgttcaacgccggcatcttgaaagggctggagttgggagaggggaccttctacttcctgttgtccagcttgttctggctgctgtctctcaacttcgtcgtctccatgcccttgcatatgcaggcttatgtcaaggagctgccgctgacggttccgttctggatcaccggcgtggcgatgctgttgctgcagatgccgatcttccgtttcttcaacggccgtttcccgcctggctacgtgatggcgattgccttcatcggcatgagcgccgcctatctgatgttcgggatgggcgtctccgcctattgggtggtggcgggctgcctgatcgtgatcctgggcgacatcctgttcacgccttcgtttgatatgtgggtttcggccaagatcccggccgatcggctatcccgcgcgatgggcgcgatgcacttcttccgcagcctaggcaacatgctgggttcgttcctggccggcttgctgttcgacctgtcgcgccatatgggacgcccgggcctgaactggctgattgtcgccggcctggccttgttgtgcgcggtggtgagcttcgccagcgtcaagaagcgcgtgccgctggccgagcagttgtccggcgccaaatag

SEQ ID NO: 365 - DNA, 1275 bp, Chromobacterium substugae
atgacggaattgaaatccatcaatcagcaacgtccgaccgtcctggtgatttccactggctttcacctctatcgcgaatacctgctgcggcaaatcgtagaggaggcgaatgtctggctgttcaccgatgctgcgccgacctggcagatcccctatctgaacggatacacgctggtgaacacgctggacgccgaggcgatggcgcgggaggcgttggcgctggcggccacgcggaagatcgatggcctgatctgctgggacgagatccggatggtgccgacatcgcgggtcgccgcggcgctgggtctgcctggcggcgaaacggacgcctacgcgcgctgccgcgacaagcatgaaacccgccaggcgttggccgccgccgcggtgccgcagccggagtcggtgctggtggccgacatcgggcaggcggtcgccaccgccgcccgcatcggctatccggtcatcgtgaagccgcgtggcctggggggcagctacggcgtcacgctggtgaacgacgaggcggaattgaccgccgccatgcagcatgtcgaccagcattgcgaactgctggccggcagcggctatacccgctatgaaagcagcgtgctgatcgaggagtacatgactggcgaggaggtcagcgtggacgtagcctgggtggacggccggatgcatcctctgttcgtcgcgcgcaaggaaactggctttttcccccatttcgaagagatcggccacgtgattcacggccacgatcccctgctggaggatgccgaattcctggccgtgctgggaggcgcgcaccgcgcggtgggtttccgcaacggcattacgcacaccgagctgatgctgaccgcgaaagggccgaagatcatcgaaatcaattcgcgtctgggcggcgacatgattccgtatattggtggcatttccagcggcatccgcgccggcgcggtggctgtggcggtggcttgcgggcgcgcaccggatgtggctcggacccgtcaacgcacggccgccgtccgtttcttgtatccggacggcgactgcgtggtccaggcgctggcggtggatcgcgacgcgttgccggagaatgtcgacgacgtgtgcctgctggtggagccgggacataccctgtatttcccgcgcgtctccggtcgttacgctttcctgaccgcctatggcgatagcgaggcggcgtgcaaggcggcgctggatcaggccgccgccgcggtgcgcttcgaagccgagccgttggccgaggcggcggaagcggtgtaa

SEQ ID NO: 366 - DNA, 222 bp, Chromobacterium substugae
atggcgaggccgccgcacggcgcgccccgaccttcgaaggtaacgcagccggcgacgcggcacaaaggaaggattaccgccggctaccagcgcgcgcgtttgaacaggctgagctggttgacgcggaacagccgcgccgggcgctggctgccccctggaacgggtcggtggccagccgcgagcggaagactttccactccggcgtggacggcgagacggtga

SEQ ID NO: 367 - DNA, 1983 bp, Chromobacterium substugae
atgattaccaccataaaaggcaagatactggccggttccggcctgctgatcctgatcggttttatcgtgctggcaggcgccaacatctacaacagctaccgcaacgccgaaaacgcggtgctggaccacgcccggctgctggccgacagcgaggccggccgcgtgcagcggatgctgggcaagacttacgattcggcgcaggcgatggccgaggcggcgaccggcgtgcgcgccgcgctgccggccaacggccgctcgctgctgtcggaagtggtgaagcggcagctgcccaacaacccggacgccgtcggctactgggtggactgggagccgaacgccttcgacggccgcgacgccgagctggccggcaagccggaaaacgaccataccggccgctacggcgtgtactggttccgcaaggccggcaaggtggacgtggtgtggggcagcgacggcgtcgacgaaagcgcttattacaccgagccgcgcaagaccggcaagccgatgctgaccgagccctatgtcgacccggatgtgaaaatcctgatgggcacgctgtccttcccgctgatcctgaacggcaaggtgctgggggtggccggctgcgacatcgcgctgggccatctgcaggaaatggcggccaaggtcaaaccgtaccaaaacggcttcatgagcctgtattccaacggcggcgtgcagttggcgggccgcgagccggcgctcaacggcaaggccgcgcccgacctgccggccgaagccaaggcggcgatcaaggaaggccggccggccgaatacgaaagcgccgacggctatcgccacttcatcatgccgatcacggtgggcgacgccggcgcgccgtgggcggtgcgcatctccatcccgctggacgaagccttcgccccggtgcgggccgccagctggcagtcggccttcatcagcctgggcatcctggcgctgatcctgctgctgctgggcgccacgctcagccagctgctgcgcccgctgggccggctgcagggcgcgatgaccgagctggcctccggcagcggcgacctcacccgcgaactggccatcgccagccgcgacgaaatcggccaggccgccggcgccttcaacaccttcaccggctctttgcgccacatgatgctggacgtgcgccgccacgccggcgacgtgctcggctcggtgcgccagctgtccggcgaagtggaccagatccgcggcagctccgcccgccaggcggaagccgccaacgccaccgccgccagcgtcgagcagctgtcggtcagcgtcagccacatcgccgaatcggcgcgggtggcagagctgcgcgcgcgcgaagccgacgccctgtccggccaggcggcggccaatgtcgacgccaccgcggcggaaatcggccgcatcgccagcaccgtgcgtcagctggccgatgtgttgggcggcatgcagcagcgctccgaccagatttccggcatcgtgtcggtgatccgcgacatcgccgaccagaccaatctgctggccttgaacgcggcgatcgaggcggcgcgcgccggcgagcagggccgcggcttcgcggtggtggcggacgaagtgcgcaagctggccgagcgcaccgcccaggccacgctggaaatctccggcgtgatccagaccatgcagcgcgacaccgcgcaggcgtccgacagcatgggcggcgcgctgcaacaggtggaccagggcgtgaggctggccggcgaatcgtcgcagtccatccagcagatcagcggccacgcgctgcaggtggtgcagtcggtgggcgacatcgccgcctccaccgccgagcagtccagcgccagccaggaaatcgcccgccacatcgaaaacatccacaccatgctgctgcagaccgacggctccatcgagcaggcgcaacaggccacggtggcgctggcgcggctgggcgaggagctggagtcgctgatcgggcgcttcaagctgtaa

SEQ ID NO: 368 - DNA, 906 bp, Chromobacterium substugae
atggagctgcggcatctgcgctatttcgcggcggtggccgaacacgccagcatccgcgccgcatcggagacactgcacatcagccagcccgccatcacgcgccagatccaggatctggagggcgagctgggtttcgcgctgttcgcgcgctcgccgcgcgggctgcggctgacgccggccggcgacagctatctgcgcgatgtccacgctatcctgacgacgctagacgccgccggccagcgcgcccgccgcgtcgccggcggcgcggccggacagctgcggctgggctatgtggaaaacaccggctgggatggcccggtgccgcaggcgctgcagcgtttccaggcggaagcgccggaagtcgccgtcgaactgtcggcgctgaacagcccggaacagctggccgccatcgcccgccatgcgctggacggcggcttcatctaccagctggagccgctgccggacggtttcgcctccctgccgctgcggcagcaggacgtggtgctggcgctgccgcgcgcctggcggatagaacatgacgagacgcagccgttcgacctgcgcgcgctggccgggcggcctttcatcgcctttccccgcgccgtctaccccgaataccacgaccgcctgttcagcgcctgcctgcaagccggcgtccggctgaacgtggtgcaggagcagccgaccgaggcggcgattctggcgctggtttgcgccggggtcggcgccgccatcgtcaacgccgccaacctggcgcggccgccggcgcaggcgcggttttaccggctgcgaaacctgtcggtgccgctgccgctgtgtttcgtctggcggcgcgaggccggcaatccggcgctggcgcgcttcgtcgacagcttgcggcaaaccatcgacagcgcgcggccatag

SEQ ID NO: 369 - DNA, 867 bp, Chromobacterium substugae
atgaacgcccacacttacaccatcggcaatgcccgcgtgacccgcgtgaccgacaccctgctcaccggcatcaccccggcctatctgtacgccgactggcgcgacgccgcgctggatgagcagccgcagctgcgcgagctgttcgatgccagcggcgagcacatcattctcagcgtgcatacctgggtggtggaactgggcggcaaggtgtatttgatcgacaccggcctgggcaatgacaaggagcggccgttcaacgcgctgttccaccggctgcgcacgccgtttctgcagcggctggccgcgctgggcatccagccggaggatgtcgaccatgtgttgctgacccatctgcacgccgaccacgtgggctggaatacccggctggcggagggccgctgggtgccgacttttccgaatgcccgctacgcgatgccgcagggcgagctggatttcttcgccacgccggaggccgacaagcgccgcgtggtgtttgacgacagcgtggcgccggtgctagccagcggccaggccgtcggcatcgccgcggccggcgccgattacgcagacgccttccattttcacccgacgcccggccactgcgccggccatatgtcgatcacgctgcattcggccggcgcaaccgccatcttcagcggcgacgccatgcactcgccggcgcaggtctaccacccggaatggaactcggccttctgccgggagcaggacggcgcgcgcacctcgcgccgctggctgctggactatgcctgcgaacatcaggccaccgtgttcaccgcccacttcggcgcgtcgtcggccgggcgggtcggccgctcggcaaacgggtatggctggcagttcctgtga

SEQ ID NO: 370 - DNA, 588 bp, Chromobacterium substugae
atgagcgtcagaggacgaccgcgcagcttcgaccgcgagcaggcgctgcgttcggccatgcgcgtcttttgggccaagggctatgacgccacccagctggcggagctgaccaaggtgatgaacatcaagccgcccagcttctacgcggctttccgctccaaagaagccatcttccgcgaagcggtggagctgtatctgcactcggaaggctccgccagcatgcgcgcgctggcgagcgcggcgacaacggccgaagcgatacatggcatgctgctggccagcgtggatacggtgctggcctccccgggggccaacggctgcctgctgatcctgggcctggtcaattgcgaaccggacaacgtcgcgctgcaggactatttgcggcaaatccgccaacacaccatccagctgatacaaagccggctggaagacggggtaggcaagggagagctgcccgcggacgcggactgcaagcaattggcaaacttctatttcaccgtgatacagggcatatcgctgcaggcgcgcgatggcgccgaccgcgccagcctgatagacaccgtcaagctggcgatgaagtgcaactaa

SEQ ID NO: 371 - DNA, 1122 bp, Chromobacterium substugae
gtgctgatcaatacggacaatctggccttgcgtccctggcgtgtcaaagaggtgcatgaattatacgcggcgatacaagacagccgctttcagcagtcgatgctccaggcagaccctttccatcaggccaatgccgcgatggccgccctgaaaagcgcgattgcccacccgcgggcgttgccggtggcggagttcgccatcacccgggtgcgcgacaacacgatagcgggttccgcgctggtcaagctgaccgatgcccgcaccgcggcggtggagatcgattacgccctgtatcccgcttttgccggccagggctatgaggccgaagtgctgggcgcgttggccggctggattctggagtgcggggccgcgcgggtggagctggtgtgcggactgggcgacatccatcgcgccaagaccgcgctggcttgcggcttccgctatgagggcgtgcagcgttgcgccatcgccacgctgcacgggctggagagcggcggcatgttcgccaggctgcccgaagatgccggcacgccattgcggcaggtttttcccgatttgcctcccgaggggctgagcgacggcgtcgtcaccttgcgggtcgcggcggtggccgacgtggaggccttgctggccgaacagaccaatgtcgaggccaggcgctggtcgctgatcgaaccgctgtcgcgctgcgatatcgccagccgggtcgagaaggccgcgctggaatggctggtcgggccgaatgcgtttttcagcattgtcgattgcgaaagcggagaggtggccgggcgcatcgtcctgcgcgcggtggtgccgccgcaggtggcggatgtcggctacggggtgttgccgtcgttccgcggccgccgttttgcctcgcgggcgctgcagctgctgtcgcaatgggcgttcgaacaagcgggctacgtgcggctggagctcggcgtcaaaccgggcaacgtggcgtcgcgggcggtggcggaagccggcggattccgcttcgacggcatgcgcaaatcccggctgcgcaatagcgacggcagcttcagcgacgaattgcatttcgttcgcgtcaatcccgcctatctggaaccggacgtgccgctggtcatcgccagctga

SEQ ID NO: 372 - DNA, 1431 bp, Chromobacterium substugae
atgctgacggcaggcggacaaccgttcaaaacctggctggcaggcctggtggcgcaggtcgccggcgacgacaacgtcggcatgtaccggccgcgctcgcggaagggcgtgatccgcccgaatagcgtggagcaggtgcgcgacgtgctgcgcctggcctcgcagagcgaggaatccgtggccctgcatgcgctcagcaccggccggaactgggggctgggctcgcgggaggcggcgcaggacgcctcgctcgcgctggacttgtccggcctgaagcaggtgcgggcgctggatctggatgccggctgggcggtggtggagcccggcgtcacccagggccagctggcggcattgctggcgggaagcccgcgcatgatcaatgtcaccgcctcctccgcccacagcagcgtattgggcaacggcgtggacaggggagtgggcttgcgccgccagcgggtggaagacctggtgggtctggaagtagtgctgcccgatggcgaggtgatgagggtgggttggtggcccgacgccgagcgcccctccccggtgtatccgtacgggcttgggccgtcgccgctgcagctgttctttcaatccaatctgggcgtcgtgacggcggcggtggtgaggctgatgccgcgccccgaggcgctgcgcgtggtgcgcctgagcttcgcccgcgaacggctggccgaggcgatcgatgtgctgcagcgctggagcgcccagggaatggtgcgcggcgtgctcaaggtctacgacgcgaccgccggcgcgctgtatggcggcggcatcggcgaatacctgacccatgtctgcgtggacggcaccgctgccgtggtggaggcgatgaccacggtgatcctcgacgaggcaaaccgttccggcctgttcctgcacgtatcgcattcggatcagcgcgatccgcggctgagcggcaacgtggtggccgagatggtcgccagcgcctacgccggcgatcccagccgcaacgacacgctgctgcaggccacgctggggcaggatgcggaaaatatcgacgccgcgggccgcggctggctgttcttcctgccgctgatccccttccacggcgaagccatcgaccgggcccagcggctgctggcccaggtatacgacgagaccggcgtgcattgcggcgccaccatcaacgcgttgaactccgacgtcatcgactacgtggtcgccatcaagttcgagcgcaacgccgacgaggcgcgccgcgcccaccaggcgctggaccgcctgtaccagctgttctccgccgccggcttcatcccgtatcggctggatgtggatcaccaggactggatagacggcctgagccccgatcaggcggcgcgcgacttcgtgcgcggcatcaaggggatgctggacccgcgcgcggtgatcgcgccgggccgctacgcgtga

SEQ ID NO: 373 - DNA, 1197 bp, Chromobacterium substugae
atggcttatctggaaaaagaaaacatgggtcaggcggccgccgacgaatggacggcggagcggattctgtcccgcgcccgcgaactggcgccggtgctgcgccagcgcgcggcggaaatcgagcagaaccgccacttgccggcggacgtggtggagctgctgcgcggcaccggcgtgttccgcatggcgatgcccaagtcctggggcgggcccgagctggattcgatgcagcagaccgaggtgatcgaggcgctggccatcggcgacgcctccgccggctggtgcggcatgatcggcgccgactccggcatctactccggctatctgcgcgaggaaaccgcgcgggagatgtttccgcggctggacatgatcaccgccggctggattcacccggaaggccgcgccgagcgcgtggccggcggttaccgggtgaccggcaactggcgcttcggcagcggcagcacccactgcgactggctggcggccggctgcgccgtttatcaggacggcgaacccgtgctggccgagaacggcaagcccgagtggcggatcatgtacgcccgtcccgatgaataccagatccgcgatacctggcataccaccggcctggctggcagcggcagccgcgactacgccgccgtcgatctgttcgtgccggaagagcgttccttctccttccgcgaaccgcgccgcgagggtccgctgcatatcgcgccggacgccatcctgcgcaagatgtccggcgtgccgctgggcgtggcgcgcgcggcgatagaccacgtgcgcgagctggcggcaagccgtttcgaccgggtgacgcagctgccgtggccgcagagctaccgcatccagactgcgctggcccagtccgagatggagctgcacgcggcccgcagcggggtgttcgccagcctggagcggcagtgggaaaagctgtcggccggacagccgctgagcaccggggagcgggtttcggccgcgctggcgcgccaccacgccttcggcaccgcgcgcgccatcgtcgccaggttgttcgacaccgtgggcggcgccgccatataccgcgccagctcgccgctggatcgctggctgcgcgacaccaacaccatgtgccagcacgcggtggcgcaggacatgattttgcagacatgcggcgaattgatgctgggcggccagccggacaatccgttcctgtaa

SEQ ID NO: 374 - DNA, 519 bp, Chromobacterium substugae
atgcaagacaacaccgacaacgatctgtcggcgcgacgcgccgacggccccggccacgcctacctgcctgccggcagcggccagcgcgtgtggatgagcggggacgagtaccggattttgctggatgccgcccacagcgccggaaccatgaccttgctggacgcgctggtgccgccggcgggcgggccgccggagcacgcccacgccgatgtcgacgagctgttcgtcgtgctggacggcgagctggagatcatggccgacggcgcgaagtaccaggtggggccgggggggcgcgtgttcgtccggcgcggcacgccgcatgccttccacaaccgcagcgcagacccggtgcggatgctgattttctataccccggcgggcgtggaggagttcttcctggcggccggggtgccggcccaggacggcttgccgccgccgccggcggatgaggaaagcaccgcgcgggcgatcgaggcgggattgcgtttccaggtgtcgcaagcggcgcagcccgcctga

SEQ ID NO: 375 - DNA, 1176 bp, Chromobacterium substugae
atgccattggcaatctatgtgttgggtttgagcattttcgccatgaccacgtcggagttcatggtagccgggatgatgccgtcgctggcggcgcagttcggcgtttccctgacggccatcgggtacctggtgtcggctttcgccgccagcatcgtggtgggggggcccatcctgacggtgatgctgctcaaggcgtccaagaagaacaccctgctgacgctggtggcgctgttcttcgtcagccagctgatcggcgccaccgcccacagctatgaagtgatgctggcgtcgcgggtgttgtccggcgtagccgagtcggcgttcttcggcgtctcgctggcggtgtgcgtcgacatcgtcggcccgcagcggatcggccgcgcctcctccatcgtgctgggcgggctgatggtggcgtcggtggtcggcctgcctgcggccacgctgatcgaccagcatctgggctggcgcgccagcttctggatcgtggccgggatgatgctgttctgcgggctggtgatcgcggtgcaggtgcccaaatcgccgaaggccgccgagatcagcctgaagcaggagttcgccgccttccgcaatgccgatctgtgggccgcctacggcaccagcggcctgatcatcggcgccactttcgccgccttcacctactttgcgccgattttcaccgaggtgagcggcttctccaccgctaccgtgccggcgctgttcgcctgctacggcctggccaccatcgtcggcaccatgatcaccggccgcctggccgacaagcacaccatgggcgtgctggccgtcgggctggtgatcctgatctcgctgctggcgctgttcgcgctcaaggccgaatcgcaggcggtgaccatcgtcgcggtggcgctgctgggcttggtcggcctgccgatgaatccggcgatggcgatccgcgtgatgcgcgtcgccaacaacggcccgctggtgaacaccgtgcataccgccgtcatcaatgtcggcatcgtggtgggctcctgggccggcggctcggtgatgagcgccggacacggtctgcgcgcgccgctgtgggtgggggtggcgctggccatcgccggtctggtcagcgtgctgcctttcctgcgccgtcacagcgcggaaggcgtgcgcgcaaggttggcgggcgcgacccgctga

SEQ ID NO: 376 - DNA, 759 bp, Chromobacterium substugae
atggatacgaaattcgcagggaaggtggcgctggtgacgggagctggcagcggcctggggcgagagctggcgctggaactggcgcgacaaggcgcggcggtggtgctggccggccgcaacgaggacaagctgaaggcggtgcagaacgaaatcgaggcggccggcgcgcaggcgctgtcgcactcgaccgatatttcgctgccgcatgaggtggacgggttgttcgaggcgatacggcgccgctatggccggctcgacatcgcggtcaacaatgcggcgatctgggaaaccggcctggtggccgaacaggacgaggccgcctggcgccgcatcatcgacaccaatctgaacggcacctggcgctgcatgcgggcggagatcggcttgatgcaggaacggggcgaaggggtgatcgtcaatttgtcgtccatcgtcggcggccattttgcgatgcccggcaccgcggcttacggcgccagcaaggccggtatcgaggcgttgacgcgcacggcggccaaggagtgcatccagcagggcatccgcatcaacaccgtcagcccggcggcgctggacaccccgatgtcgctgctggagggcgaaaccgaggaggagcgcggcaagcggctgggcggcatcatccccatcggccgggtgggacgcttgtcagaggtggtgcagaccattttgtggatctgctccggcgatgcctcgttcttcgtcgggcatgactttgtcgtcgatggcggcgtgaccgcctga

SEQ ID NO: 377 - DNA, 489 bp, Chromobacterium substugae
atggaagtcttgaaaaagcatcacatcgaatgtgacggccaacattggcaacaagagtacaagagcacgctggggcgcttcccgaccggcgtttgcctggcggtgctggaagagggcgacgacaagatcgccatcaccatcaattcgttcagttcggtttcgctggtgccgcccatcatccagttttcgctgaagaaccattcccgcttcctgggcaaggtgcgcgacgccaggcaattcagcgtgtatttcctggcccggccccaggccgaggaggcgctgatgttcgccaagcagccggccagcccggtgtcgccgcaagtgctgggggattccgcggccgccattcactgccggctggaggacacgtatcagaaaggcgaccacaccatggtattcggcgaggtgaaggcggtcgagcatggacgcggcgacgcgcttgcctactaccggtctcatttcacatcggtagagggctacgcatcgtga

SEQ ID NO: 378 - DNA, 1137 bp, Chromobacterium substugae
ttgcaatcgccgaacggcccggcgccgcgcctgccctcgttgaccggcatgcgattcgtcgcggcggcgctggtgtttctgtttcacgcctcgttgctggcagccgtcaaattcaacccttatcaggacagcggcgcggcgcagctgtttcagtccatcttcagcaaggccggctggctgggtgtgtcgttcttcttcgtgctcagcggattcgtgatgacctggtcggcgcgggcggacgactccgccggcggcttcatccggcgccgcctgctgaagatctaccccaaccatttcttcacctggctgctgatgatggtgtgcatggggaatgtgttcgtcgaccccagggtctggctcagcaatctgctgctgctgcagtcgtgggtgccgcgcccggaggtgttcatgggcgtcaacagcccgtcctggtcgctgtgctgcgagctgctgttctacctggccttcccgtggctgaaccagcgcatcgcgcgcattccggccggacggctgtggccgtgcgcggcggcggcggtgctggcgctgttcgcggtgcagctggcggtggacagctgggtgccggccacgcccaaggggccgggcctgccgatttcgctgcagcagtggtggctatcgtattttttcccgccgttgcggatgttcgagtttgtgctgggcatgctgatggcgcgcatcctgcgggccggcaaatggccggatctgggcctgctgcccgcggcgggcttgttgctgggcggttatctgctggcgcgggaagtgccgtttttgtacggactgagcacggccacggtgattccggtggccttgctgatcaccgcggcggcggcggccgacgcgcagcggcgccccaccggcttcaacggccggcgcatggtgtggctgggtgaagtgtcgtttgccttttacatggtgcatatgctggtgctggatctggctagcgcctggctggatggccgccgtttcgagcccgccgcggcgaccctggtggtgctggcggccttcctggccagcctgttggccggctggttgctgtacgcgctggtggagcggccggtgatgcggtactggagccgcccgcgcgccgccgcggtcaggctgcaatcggccgacgcctga

SEQ ID NO: 379 - DNA, 1170 bp, Chromobacterium substugae
ttgaagggacgtgtcgcggcgtcgttgctgccgctggccgccgcgctggcattggccggctgcggcaaggatctgggcgcggcgcaagcggcggcgcaggcgccggcgcctgcggtgccggtttcggtgcagcaggtggcgccgggcaatgtcgatgtcgcgtacgagtatgtcggccagtcggccggatcgcgcgaagtggaggtgcgggcccgggtgggcggcatcttgcagaagcggatgttcaccgaggggcagccggtgcggcagggcgatccgctgttccagatcgacccggcgcctttccagatcgcgctggagcaggctgtcgccgcgctgcgcgaccggcaggccgagctgacccgcgcgcagcagaattacgaccgcgtgcagccgctgttccgcgagaacgcgctcagccgcaaggatttcgacgaggcggccgccaatcgggaagccgcccgcgcccaggtgatggcggcgcaagccaaggtgaaggaggcgcagatcaacctgggctatacccgggtgtcggcgccgatttccggcctgaccagccgcgaggtccgctccgagggcagcctggtgggcggcagcgccgacgccagcatgctgaccaagatcagccagaacgatccgatctatgtcaatttcaacgtgccggaggcggatctggacgcgctgcgcggccagcagtcgtccggcgcgctgaaattccacggcggcggcttcaaggtgtcgctgcggctgtccgatggcagccgtttcgaacgcagcggctcgctcaacttcaccgaccacctggtggacgcctccaccggcaccgtgcgcctgcgcgccagcctggccaatccggacggacggattctgccggggcagttcgtgacggtgctgctgcaaggcgcttaccgcgcccaggccatcgccattccgcaacgggcggtgctgaccagccagcaaggcaaggcggtctgggtggtgggcgcggacaaccgggtgcagctccgcccggtggaggccggacaggaacagggcctcaatgtgctgatcaacaaggggctgaaggccggcgaccgggtggcgctggacaatctggtgaagctcaggcccggcgcgctggtgcagatcagccctgagccggccgcaaccggcgcgtcttcccgcagctaa

SEQ ID NO: 380 - DNA, 687 bp, Chromobacterium substugae
atgttttcctcctttttgatccgccgaccgatcttcgcctgcgtgctctcgctgatcatcatgctggcgggggtggcggcgatgggcgtgctgccggtcgagcagtacccgcagatcgtgccgccgcaagtacaggtggtggcaagctatcccggtgcctcggccgaggtgatcgccaataccgtggccgcgccgcttgagcaggcgatcaacggcgtcgacgacatgctgtacgtgcagtccatcagcgccagcaacggccagttgacgctgaacgccacgttcaagatcggcaccagtccggaccaggccaccatcaacgtcaacaaccgcgtgcagtcggcgctggcgcagctgccggaagaggtacggcgccagggcgtatcggtgcgcaagcagtctgcggcgttcctgcaggtgatcgcgctgtacgcggagaaggggcgctacgacaccctgtacatgagcaactacgcgctgctcaacgtggtggacgaactcaagcgcattcccggcgtaggcgacgtgatcaacttcgccggccgcgactattcgatgcggatctggctcaagcccgatcgtctggcgcagttgaagctgacgcccagcgacgtggtcgccgccatccgcgagcagaacgcgcagttcgccgccggcaagctgggcgccgaggatcgtagacgctga

SEQ ID NO: 381 - DNA, 876 bp, Chromobacterium substugae
atgcaagccagccgcgaactgctgaaaaccctgtatacgatggccatgctggtcgaagcccgcgacgcctacaccggcggccacctgtggcgcgtgtcgcgctacagccatctgctggccgaagacctgcatctgccgcagccggaagtggaacgcatcgcgctgggcggtttcctgcacgacctgggcaagataggcgtgccggacgcggtgctgaacaagccggaccggctcagcgacgaggaatacgaggtgatcaagacccatccgcgcgtcggcgccgatctgctgcgcgaccacccgttggccgaactggtgatggacgcggtgctatgccaccacgaaacccccgacggcaacggctacccgcagcggctggccggcaaggccatcccgctggtggcgcgcatcgtaggcatcaccgacgccttcgacgcgatgaccagcacccgcccctaccgccagggcatgccgctgccaaaagcgctggccatcctggaagaaaacctgggccgccagttcgaccaggaattgggcagccgcttcatccagctggggcgcagcggccggctggacggggtgctgggccacagcgagccgggcattccgatgcagagctgcctggcctgcggccccatcatcgcggtgcccggcagcgcggccgatggcgacgagatcttctgtcccagctgcgccggcggctaccggctgcgccgcggcaacggccagctatcgctcgccccgtcgggcaaccgcgacccggtcaaggcccggcagccgcgcgccgacagcggcctgatagacagcctgctgcagggcagcggcccattgcgcgcccgcagcaagcccggcttgctggacttgttgttcggttga

SEQ ID NO: 382 - DNA, 1353 bp, Chromobacterium substugae
atgaaatcgtggttgctgctgggtttgaccctgtcttcgctggctgtcgccggcaatgaacctgttcagccggatgcccgctacggccgcatcctgtcgccgtccggcccgctcagccgcgccgagctgctcaagcaaggcctgcccaaggccaagccggcggccgctcgcctcagcgccgccgcggtgcccggtccggccacctacacctatctgcgctgctactaccgcaccggcgccggcaatacccagccgaccaccgactacgtctgggcgctggatccctccagcggcgattactaccggctgaacggccactggtggtccagcagcatcctggactggaagaacatgttctacagcgacgcgacgcaggacgcgctgcgttcggtctgccagggcacgctggccaagaagggcatcaaccaggcgccggcgatggtgttcgccgccgacaacgccatgtccttcaactacacggtgtggagcaatgaccaggccgggcagggcagccgcatcaacaagatcatcgccttcggcgatagcctgtccgacaaccagaacgtctataacgcctcgcagtggacgctgcccaaccgcaacagctggttcatcggccacttcagcaacggcccggtgtgggtggagtacctggcgtcgcggctgcagctgccgctgtacaactgggcgataggcggcgcgggcgtgaccacgcagaagctggtgattccgggcgtggtgcagcaggtgcagtcctggcagcagtacatgcagcaggcgcccaactacaatccggccaccacgctgttcaccatgtggataggcggcaacgatctggtcaactacggcagcacgccggacaaggtgatcgccggccagcagcaggcgctgacgaatctgatcggctccggcgcccgcaacatcctgctgctgaagctgcccgacgtgtcgcgcgcgccggtgttccagctgaagagcggcggcgccacggtggcggcgcaggtgctggactacaaccagaagctggacgcgctggccgtttcgctgcgccagcagtacggcgtcaatatccaggtgttcgacagctacgcgctgttcggcgatctgctgaccaatccggccaagtaccaggtgagcaacaccacccagtcctgcctcaacatcaacaccgattcgtcgctgaactacatgcaaagccagtcgccgcgcgccaactgcggcaatgccgacaccttcgtgttttgggacacgctgcatccgaccacccatacccatctgctgctgggcaatgcggtggccgacttcctgaacgcgtccggcagcgccttcccggcgctgaagacgctgcgctaa

SEQ ID NO: 383 - DNA, 1014 bp, Chromobacterium substugae
atgtccaccctgaccgaactcctcagccgcgccgccgcggcgcgcgccgaattgatagagcgcctggccgccgaagacaccaactgctaccggctgttccacggcagcgtggaaggcgcgtccggcctgaccgtagaccgctacggcgagcagatcctggtgcagagcttccaccagccgctgagcgaggaagagctggccgagatccgcgcttactaccggcaaacgctgccggagctggcgctggtctacaacgaccgcagcgaatcccattcccgcatccgcaacgcgctgccgctggccgaacaggcggtagccgaacaggacgtcgccatccgcgagaacggcgtggccttccattaccaggcgcgccacaagggccaggacccctggctattcctcgacctgcgcgccgcgcgccgccgcgtgatgcagctggctgaaggcaagagcgtgctcaacctgttctcctacacctgcggcgtcggcgtggcggcggccaaggccggcgccagcttcgtgctgaacgtcgatttcgccgaatccagcctcagcgtcggccgcgccaacgccaagctgaacctgctggccacccggccgcgctgcctgcacagcgacgtgttcgccgcgctgcgccagctgtcgggcctgggccaggcggagcgggtgcgcggcaagaagatgccgcccttccccaagctggaggcgcgccagttcgacctggtgttcctcgacccgccgcgctactccaagagcccgttcggcgtggtggacctggtcaacgactatcaggcgctgttcaagcccgccttgctggccaccgcggccggcggcgcgctgatttgttgcaataatgttgcagaagtgaatggcgaaacctggctggaagccttgaagcgcagcgcggcgaaagccggccgcgaggtgcgtgcggcggagtggatcgctcccgacgccgactttcccagcgccgacggcaaacccccgctgaagatagtcctgctgcacgtttga

SEQ ID NO: 384 - DNA, 1335 bp, Chromobacterium substugae
atgaaaacaagcatcattttgtccctgctgttgggcgcgctggcttccggccaggcgctggcgcaggcggagcagccgcccagcgacgagctggacggcgtcgtctccgccggcaaaccgttgtcgggcagcgaggcgcgcgccgcggccggccaggccaagccgcagccgggcagcgccacctacacgtatctgcgctgctattaccgcaagagtccggtggccaaccagccgcagaccgactacgtgtgggccaccgatccgtccagcggcgactactaccgcgtcaacggctactggtggtcgggcagcttcgtcgcgctgaagaacatgttctacagcgataccagccaggacacgctgcgttcggtgtgccagcagacgctggccaagcagggcgtcaaccgtccgctggcgttgttcgccgccgccaacaacgtgatgtcgtacaaccacaccatctggacgctggacagcgcgagccaaggcaacgcgatcaaccgcatggtggtgttcggcgacagcctgtccgacacccagaacatgtacggcgcctcgcaatggcggctgccggtggccagcagctggtacgtcggccgcttcagcaacggccgggtgtgggtcgagcatctggccgaccagctgaagctgccgttttacaactgggcgataggcggttccgccgccgacagccatctggtggtgccgggcctgttgcagcaggtggactcctgggcccagtacatgcagaaggcgccgggctaccgtccggaaaacacgctgttcaccatgctgatcggcggcaacgacctgctcaactacggccgcgccgtcgatcaggtgatcgccgaccagggcaaggcgctggacaagatcatcgccgccggcggccgcaacatcgtggtgctgacgctgcccgacctgtcgcgcacgccgtccggctcggccggcggcaaggcggcgcagctggcgcagcaggtgaaggactacaacgccaagctggcgacgctggtggccaatctgaagcagaagcacggcacggcgctcaagctcagcctgttcgacgcttacggcatgttcaacgacctgctgacgaatccggccaagtaccaggtgagcaacaccacccagccctgcctgaacgtggcggccaacgccagcctgccctacatttcgtcgcagacgccgcggccggagtgcgcgaatgccgacgcctacgtgttctgggacaatctgcacccgaccacgcacacccatgtgctgttgggccagatggtggccgacttcctgcgccagcagaatctgaacctgtcggcgcaggcgcgcaagcgctga

SEQ ID NO: 385 - DNA, 1260 bp, Chromobacterium substugae
atgcgcgccggcgcttaccacatgaccacgaccatcctcgccatctttctcaccgtctatctcggcatgattctcggcggactgccgttcctgcagcttgaccgcaccggcgtcgcgctgctcggcgcgatcgcgctgatcggcgtcaacgcgctgagcctcgagcaagcggtggcagccatgcatctgcccacgctgatattgctgttcgccttcatggtgatatcggcgcagatgcgcctcggcggcttctacgactgggtgacccgcaaattggcgaccctgtcgctcggccccgccggactcttggcggcgctgaccgtcgtcagcgcggcgctgtcggcggtgttcagcaacgacatcgtctgcctggccgtcgccccggtgttgatcgacgcctgccggcggcgccggctggacccggtgccgtttctgctggcgctggcctgcgcatccaacatcggctcggccgcgacgctgatcggcaatccgcaaaacatgctgatcggccagacgctgcgcctggacttcggcggctatgtcctggccgccgccattccggtgggattcgggctgctggcatgttgggggctgatcatccgacagaccggcggccgctggctggatgccggccccgccgaggccgccgccgagccgccacgcgaagacacgcctttcgatggctggcaaaccgcgaaaggcctcgccatcgccgcgacgctgctggcggccttcctggcggcgccgtggcccaaggagcacatggcgctcatcggcgcgggcatcctgctgatgagccgccagctgcattcccgcaagatgctggggctggtcgactgggagctgctggttctgttcatgagcctgttcgtcgtcaaccatgcgctgcagcgcaccgggatccccgcggacgccgtcgccggcctggccgcgctcggcgtgcggctggagcagcccggccccttgttcgccgccaccttcctgctgtccaacatcgtctccaacgtcccggcggtgatgctgctgttgccggtcgcccatcacgagacgagcggcctgctgttggcgctggtcagcacgctgtcgggcaatctgctgattgtgggcagcatcgccaacatcatcgtcgtcgatgccgccgccaggcgcggcatcgccatcgactggaaacgccacgcccgcgtcggcgtgccgatcaccctggccagcctggccgtctccgccgcctacctggcgctgcggttccagctcgggctctga

SEQ ID NO: 386 - DNA, 969 bp, Chromobacterium substugae
atgacgcaccacagcatcgggcagggacagctgctggccgacctgaagatcggcatcgagataaaaccttggcatcggatattgaaagtcgctgttgataccggtattttgctaggtttgctccattcggcaaaccgcttttgcgccgcgacgacgcaaaccagcaggagaaacaggatgcaggtgcttgaacaggtaatgcgactggtgcgcgaagtggccgcccgcgaggtgatgccgcgctttttgcacgttggcaaaagccgcaaggaagacggcaccctgttcaccgaagccgacctcgcctgccaggccgccctgcagcgcggcctgccggaaatcttgccgcatccggtgctgggcgaggaaatggaccgcgaagagcaggacgcgctatgggacggcaaccaggacggcctgtgggtggtggacccgatagacggcaccaccaacttcgtcaacggcctgccctatttcgccatctcggtgggattgatggtgaacggcaagagcgagctgggcgtgatctacaacccggtgtcggacgagatgttctacgcccgccgcggccagggcgcctggatgaacggccgcagcctgccgctgaagaccatccacaactgcatcggcgacgccatcgccagcgtcgaggtgaaatacctgcgctccggcaagctggccgcccgcctgggcagcctggcgccgtgcggcagccagcgcaatatgggatccagcacgctggactggtgtttcctcgccgccggccgctacgacctctacctgcacggcggccaacggctgtgggactacgccgccggcgcggtgatcctggaagaggccggcggccgcatcgccagcctgaacagcgacgactactggagcgacgtgatctggaagcgctcggtgatcgccgccatcaccccggagctgttcggccagtggcaccgctgggtgcgggccaaccagtag

SEQ ID NO: 387 - DNA, 642 bp, Chromobacterium substugae
ttgcggctgaacgccggcgacgccatcaccttgttcaacggccgcggcggcgagtaccaggcctgcctcagcgcggtgcagaaacgcgacgcccagtgcgtggtggagcgcttcgacgaggtttcacgtgaaacgccgttgtggctgggcctggcccagggcatttccagcggcgacaagatggagttcacgctgcagaagggcgtggagatgggggtgtcggtgttccagcccatcgccgccggccgctcggtggtgaagctgtccggcgagcgcgccgacaagcgggtggcgcgctggcaggaaatcgtcgtctccgcctgcgagcagagcgggcgcaacctgattccgcaggtactgcccatcctgacgctgaacgaatggctgcaggcccgccaggaggccgacatccggctgatcctgtcgccgcgcggcgacaagagcttggccgaattgtcggcccggccggcgcgcagctggctgatggtcgggccggagggcgggttttccgcgccggaggaggacgcggcgctggccgccggctggacgccgctgaagctggggccgcgcatcctgcgcaccgaaaccgccgcgctggcggcggtggcggcgatgcaggcggtgtggggggattacagctag

SEQ ID NO: 388 - DNA, 1281 bp, Chromobacterium substugae
gtggttccaccgcttccggccttgggcccgatccatcccgcccaaccggctttcccgaaatacgcgatgatcaagtgcatagacgtcaacgacctcagggtcggcatgtacatccacgacctcaactgcgactggatgtcccacccgtttctggtcaaccgtttcaaggtcgcccacgagagcgagatccagaaaatcgccgaagccggcatccatgaagtctacatcgacacccgcaaaggcatagacctgccatcggcgccttctgccgtcgaagtgcgcaagcagctggaaagcgaattgcgcgccatcgcctcgcgcgagagcacggtggtgcgcaaggtggaaagcggcgaggagttcggccgcgcccaggtcatccaccacgaagccaaccagatcgtccgcgacatcctgcaagacgtccgcctgggcaaacaggtggagctggaacaggtggagccgcaggtggagaggctgaccgaatccatcctgcgcaacaacggcgcgctgctgtcgctgtgccggatcaaggacaaggataactacaccttccagcactcggtcagcgtcggcgcgctgatggtcagcttctgcaacgcgctgaacatgggcaaggacgtgatacaccacgccggcatcggcggcatgctgcacgatatcggcaagatgcgggtgccggacgaaatcctcaacaagccaggcaaactgaccgagcaggaattccaggtgatgaagtgccacgtggtggaaagccagaaaatcctgcacgccacccagggcatttccgaaaccgcggtgctggtggccggccagcatcacgagcgccacgacggcagcggctacccggccgggctgaagggcgatgaaatctcccaactgggccagatggcggccatcgtcgacgtctacgacgcgctgacctccaaccgctgctaccaccagggcatgccgcccaccgacgcgctgcgcaagatctatgaatggtcgaagttccacttcaacccggagctggtgcaggccttcatgcgggtgataggcatctacccggtcggcaccctggtgcggctggaaagcggccggctgggcgtggtggtggagcagaacgacagcagcctgatctcgcccaaggtgaaggtgttcttcagcatcaagagcaatgcccacatcccgccagaggtggtggacctgtcgcgccggatgggccacggcggcggcgaccgcatcgtcaagcacgaatcgccggagaaatggaagatagacccgctgcgcttcctgtag

SEQ ID NO: 389 - DNA, 222 bp, Chromobacterium substugae
ttgggcgggatggatcgggcccaaggccggaagcggtggaaccacgccggtgttcttcaagcatcagccgggatggcgggattttcaaggcccgatcgcaggcagggtcaaatcggccgcgccgcgatcggaacggatatttcgccgccgtccatcgcggccggcttgcccacaaggggcggatcgggatatattcccgcagttttgttcggaacacggtaa

SEQ ID NO: 390 - DNA, 921 bp, Chromobacterium substugae
atggccaatccactgtaccggaaacacatcatctccatccccgacttcagccgcgaagaactggagctggtggtggataccgccgctcgcctcaaacagaacccgcgcggcgacctgctgcaggacaagctggtggcgagctgcttcttcgagccgtccacccgcacccggctgtcgttcgagaccgcggtgcagcggctgggcggcaatatcatcggcttcgccgatggcggcaataccagcgccaagaagggagagacgctggccgattcgatcaagatcatcagctcctacaccgacgcggtggtgatgcgccaccccaaggaaggcgcggcgcggctggccagcgagttctcggcggtgccggtgatcaacggcggcgacggctccaaccagcacccgacgcagacgctgctcgacctgttcaccatccgcgaaacccagggccggctggagggcttgtcggtggctttcgccggcgacctcaaatacggccgcaccgtgcactcgctggcgcaggcgctgtcgctgttcggcgcgcgcttctatttcgtggcgccggaagcgctggcgatgccggactacatctgcgaggagctggatgagcgcggcatcgaatacacggtggtggacagcctggaagcggtgattccggaagtggacatcctgtacatgacccgggtgcagcgcgagcgcttcgacgaagccgaattcaagaagatcagcggcaagttcgcgctgcgcgccgacatgctgaaaaacgcccgccccggcatgaaggtgctgcacccgctgccgcgggtggatgaaatcgcagtggatgtggacgccacgccgcacgcctactatttcgagcaggccaagaacggcgtgttcgcgcgccaggccctgttgtcgctggtactgaacgaaaccgtgtaa

SEQ ID NO: 391 - DNA, 459 bp, Chromobacterium substugae
atgcaatacacccgcaccgtagaagcgttgaagcaaggcaccgtgatcgatcacattccggccggccagggcgtgaagatcctgcgcctgttcaagctcaccgaaaccggcgagcgcgtcaccgtcggcctcaacctggtcagccgccacatgggcagcaaggacatcatcaaggtggagaacgtggcgctgaccgaggaacaggccaatgagctggcgctgttcgcaccaaaggcgacagtgaacgtcatcgacaacttcgaagtggtaaaaaagcataaattgacactgcctgacgcagtggagggcattttctcctgccctaattccaattgcatttcgcataatgagccagtgacgagctttttctacgtaaaaaccctggcacatgacacaaaaatgaagtgcaagtattgcgaaaaggtgttcagtagggatattgttgcagaggtgcgctga

SEQ ID NO: 392 - DNA, 1281 bp, Chromobacterium substugae
atgccttcctccttgctcaagcgccatcccgccgtcctcaatctgctgctggccgcctgttgcggcgtgctgggcgcgctgctggtgttgtgtttccagggcgttctgcacgccatcgaaaatctgctgtccggccagagcggcagcctggtcggcatcgcccgccagttgccgccatggcagcgggcgctggcgccggtcttgggcggcctgctggccggcgtggtgctggagcaggggaggcatctgctgcgcggctccgccagcggcgactacctggaggcggtgcgggtcggcgatggccggctgggcctgcgccgcacgctggtgaacagcctgtcctcattgtgcacggtggcgtccggcggttccatcggccgcgaaggggcgatggtggcgctgtcggcccagggcggttcgctgctgagccggctggtgccgatgaccttgccgtcgcggcgcctgttggcggcgtgcggcatcgccgccggttgggcggccgcctaccacgcgccgttgtcggcggtggttttcgtcgcggaagtggtgtggcggcggctggattggcgcgcgctgccggcgctgctgctggcggcattgaccgccagcctcacggtagaccacctgttcggcctcgcgccgctgtaccgcaccgcgccgctgccggcgccggatcacctggccttgttcggttactgcctgctggcgctgccgctcggggccggctcgccgctgtttctcaagtcgatggaattgggccgggcggccttcgcccggctgcccttgcgcctgccgctgcggatggcgctgggcggcgcggtggtgggggcgctggcctggttttggccgcagatgtggggcaacggctacagcacggtgtcctggctgctgcaggccgaatcggcttggcagctggttttggtgctgctgttgtgcaagctgtgcgccaccgccgccaccagcggctccggcgccgtcggcggcattttcacgcccatgctgttcgccggggcggccggcggggcgctggccggccagttgctgaatctggtgctgccgggctggctgccggcgggaggggcggtgctggtgggcatggcggcgttcctggcggccaccgcgcaggcgccgctattggccgtgctgatgatgatggagctgaccgccgcctggcacatgctgctgccggtgacgctggcggcgctggtggcggcgcggctaggccgccgcctgggcggccgcgcgctgtaccaggacgagggcgggctcaggcgccgctag

SEQ ID NO: 393 - DNA, 528 bp, Chromobacterium substugae
atgcagattcgtgaagccaacctggaagacctggccgcgatactagacatttacaacgaagtgatcgccaccaccaccgccgtctacaacgacgacccgctgacgccgggcgaattcgcggtgtggttccaggatcgcgccgccgccggctatccggtgctgctggccgaagacgacgccggccgcgcgctgggcttctccagcttcggcgatttccgcgcccgccccggctaccgcttcaccgtcgagcacagcgtgcacctgaccgccgacgcccgcggcaagggcatcggcaccgcgctggtgcaggcgctgctgccgcgcgcccgggcgctaggcaagcacaccatcctgggcgcggtggacgccgacaatgaaggctcgatccgcttccacgagaaactgggcttcgtgcaggtgggacgcctgccgcaagtgggcttcaagttcggccgctggctggacctggtctatctgcagcgcttcatcgacgacgacgccagcagcggcccggctagcggcgcctga

SEQ ID NO: 394 - DNA, 873 bp, Chromobacterium substugae
atggaaaaccgcaaactggcggtactgatagacgccgacaacgcccagtcggcgctgatcgccgaactgctggccgaagtggccaagtacggcaccgcggtggtcaagcgcgcctacggcgactggaccaccacccagctcaagggctggaaggaagtgctgcaccaatacgcgatctcgccgatccagcagttcgcctacaccaagggcaagaactccaccgactcggcgctgatcatcgacgcgatggacctgctctacaccggcaatttcgacggcttctgcctggtatcctccgacagcgacttcacccgcctggccacccgcctgcgcgaggccgggctgatggtgatcggcctgggcgagcaatcgaaaaccccgcgccccttcatcgccgcctgcgacaaattcgtcttcaccgaaatcctgcggccgcccgcgccggccaaggccaagccggaagccccggccgacaagcccaagacccgcgcctcgcgttcgcgcgccaagccagcccctgcgaaagagcgccacccgctgcaggacatgttcacctcggcgatagaagcggtgtcgcgcgacagcggctgggccgaactgtccgccgtcggctcctacctggccaagaacgacccctcgttcgacccgcgcaactggggccacagccggctgtcgcaaatggtgaagaagctggacttcctgtcggtgcaggagaaccgcaacggctccaagctgcacagcgagatccgcctgcgccacgacagcgagcccgcgctgcaggaagcgccgcccgccgaggccgccgtggaagaatcggccgcgccggcgcgcaagaagcgcagcccgcgcaagaaacccgccgtctccggttga

SEQ ID NO: 395 - DNA, 819 bp, Chromobacterium substugae
atgcggctgccccacgcttgccacctcctgctcctgctgtgtccggcctgggcggcggctgatgtccagaccgtcaccatcctgaccgacaacggctacccgccctattcctacgaagccgccggccaggcgcaaggcatctacaacgacattctgcgcgccgcctccagccagctgcgcggcttccagatcgaactgaagccggtgccgtggaaacgcggactggccgaactggaaaacggcaaggcgctggcgctgtcgccgccctactaccggccgcgcgaacggccgtacatgcagccatactcggtgccgatgctgagcgagcaggtggtggcctattgccgggcggcggtcgcgcagccgccgcgcaaacgctggcccgacgactaccgcggcctgcgtttcggcaacaacgccggcttccgccccggcggcgacgcgttctggggcatggtgggccaggggcagatcgcgctggaggaggcggccgacgtgcgcaccaatctgctcaaggtcatccgcggccacctggattgctatctgaacgacaagctggcgatacagctggagctggcgcgcctgcagcagcagggactctacgcccccggcgccttgctgctgacggccaatgtgtccgaagagcaaggctatgtcggcttcaccgaccgcgaccagggccgcttcccctacaagcaggagtttctgcggcagctcaaccaggcgctcagcgacatgaagcgcagcggccagatcgaccgcatcatcagccgcgcgctggacgccgcccgcgcccagagcgcgccgccatccttttga

SEQ ID NO: 396 - DNA, 222 bp, Chromobacterium substugae
atgcaaccgcaagcgacggcgtcgggaaaaaccggcgagatggtgatgttcaattaccgccggccggtgcgggcgcgccaggtggaactgcagggcggcagccggctgtggctggtggagatgctggaccggcaaagccaggtctgggtgtggcaggacgagtggccgggcgccgacgccgcgctggagcgcgcgcgccggctcagcctgatgctggattag

SEQ ID NO: 397 - DNA, 543 bp, Chromobacterium substugae
atgtttgcttcccgctcgctcaaggccagcctcgccgccctgctgcttaccctgccgctgctggcgcatgccgacgccgcccaggatgccggagccaaggaactggccgccacgctcaacatcaacaacatgctgcccgacctggcgcagcgcaccaccgccagcgcgctgccgctgctgcaggaatacctggtcaagaacaagatccagctgaccgaagcccagcagaaaaaggcgcaggccggcctgaagggctatggcgacaacatccacaagctggccaccgattacttcggctccgccgcggtcaaggcccagttcgagcagaccgtggcgaagaacttcagcgcccagttcagcgccgacgagctgaaacagatcaacgccttctacaagacccccgccggccaaaaaatgctgaagcagcagccgcaggtcatcaacagcatcgccggcgacacgctgaagagcgcggaaaaggcgctgctgcccaaaatgcaggccgccgccgaagcctacggcaagaccctgaccaagaaataa

SEQ ID NO: 398 - DNA, 948 bp, Chromobacterium substugae
atgcccgcagcccgctccaccctgctttgcggcctcctgctgctgtgcggcccatcttgccaggccgccgcgctcgcccggatcggcatctcggtcggcgcgctggacaaccccttctatcaggccttggcgcgcggcgcggtgcaagccgcccacggcctgaacgcggcggtgcgcgtcacctcgatgtctgcgaatttcaccctggagcagcagcagcgccagatgcggctgctgatacaacagaaagtcgacctgatcctgctgggcgcggtggacagccaggcgatcgcgccgcaggtgcgccaggcccgcgccgccggcatcacggtggtggcggtggacgtcgacgcccccggcgtggacggcacggtgaagtcggacaaccgccaggccggcgagattacctgccgctatctggcgcagcggctgcagggcaagggcacgctgttgatccagggcgggccgcccgtcacttcggtcagcgaccgcatcgccggctgccacgcggcgctggccgcctaccccggcatcgccgtcgacaacgaccgcgccaacgccatgggctccagcctgggcggccagcgcgcgatgcagcgcgatctgcagcggctgccgcgcatcgacgcggtgttcaccatcaacgaccgccaggcgctgggcgccgagaaggcgctgcgcgccgccggccgccagcaggtgctgatcggctcggtggacggctcgcccgacatcgagcgcgcgctccgcctgcccggccagatcgtcgcctccgccagccagtcgccgtatctgatcggccgcgaagccgtgctgctggggctgcgcctgcgccagggcgatgccggcaagcggctggtgacagtgccggtcggcctggtcacccgcgccaatctagccggctatcagggctggcaaagccgccgcatgccgccggcgccgcgctga

SEQ ID NO: 399 - DNA, 597 bp, Chromobacterium substugae
atgctcgccacgctgcagccgttcgacctcatcatccagcccggctggaacaactccggcccgcgccactggcaaagccactggcagcgccggctgggcgcgcgccgggtggacaacgccgactgggcccagccgcagctggaagactggctggatgggctggacgccgcgctgtcgcgctgccgccggccgccgctggtgatcgcccacagcctgggctgcgtcacggtggcgcactacgcgcagcgccaccccggccgcatcgccggcgcgttgctggtggcgccggccgacgtcgagcggcccttcgtgccggcggaactgatgaatttcgcgccactgccgcgccggccgctgccctttccggccaggatagtcgccagcagcaacgaccccttctgcaagaccgcgcgcgccgcccggctggccggctactggcaggcgcccatcacctggctgcagcacgccggccacatcaatgtcgattccggccaccagcaatgggaagaaggctggccgctgctgcggcaattggccgagcgcgcgctcagccggctggaatcggacaccgccgcgccggaggcggcgatggtctag

SEQ ID NO: 400 - DNA, 498 bp, Chromobacterium substugae
atgccagcgctcaaatacctgctgaactacccgcccgccctggtgcagcaggcgcaggcgctgctggattccggccagctgggcgcgtggctgcaacgcaaatatcccgacgccaacgaggtgcagaccgacaaggcgctgtaccagttcgtcgcggccatcaagcagcgctacctgaaaaacgccccgctgccggccaaggtgctgtacgacaaccgccagcatccgctgaagggcacgctgggcaccaacaccctggtgtcgcgggtgcagggcggcaaactcaaaagcaagagcgaaatccgcatcgccgcgctgttccgcgagctgccgctgcctttcctgcagatgatagcggtgcacgagctggcccacctgaaggagcgcgaccacgaccgggccttctaccagttgtgctgccacatgctgcccgactaccaccagctggagttcgacctgcggctgtggctgaactggcgcgagcgcgaagcgggatga

SEQ ID NO: 401 - DNA, 537 bp, Chromobacterium substugae
atggccctgaccgccaccatttacaaagcttccctgacgctgtccgacatggaccgcggctattacgccagccaccagctgaccctggcgcagcatccctcggaaaccctggagcggatgatgctgcgcgtcgccgccttcgcgctcaacgccagcgagacgctgagcttcacccgcggcctcagcgccgacgatgagccggaactgtggcagaagaactattccgacgaaatcgaactgtgggtggagctgggcgagccggacgaaaaacgcctgaaaaaagcctgcagccgcgccgacaaggtggtgctgtacacctacggcggccgcgctagcgaagtctggtggagccagatcgaaaacaagctgtcgcggctggacaagctggaagtgttccgcatcgatttcgacgcgctgcagacgctggccggcctcgcccagcgcagcatgcagctgaacgtcaccatccaggacggccagatgtggctggccgacgagcagcacaccgtgctgctggaaccgcagcggctgaaataa

SEQ ID NO: 402 - DNA, 693 bp, Chromobacterium substugae
atgcccatagcctcgcacaggctgataggcttgctgctgctgctccccgcgctggcgctggccggcaagaacgaccggccgcacgcggccggctccggccacgccgccgcggacgcggtcaagccggccgaagaaaacagcgacgcgccgccgccggtcgccaccgacttccactgcgacaagcccgccaatatggtggaaagcatggtgtgccaggacgacggcctgacccggctggacaaccgcctggaaaaggtctacgcccaggcgatgggccaggcggagcaaagccgcaacggcgcgcaggccaagctggtcggcgaacagaaacgctgggtgaagagcctgaaggactgcctgaagaacgaagacccgcacatgtgcctgggcgacacctacatcctgcgcatctcgcagttgcaggcggcctggggcctggcgccgtcgctgacgccgctgcgctacctgtgccgcggccagccttcgtccaccattctggccaccttctaccgcacccatccggccaccgccaagctggagcgcggcaacaccctggtcatcgtgcaccagggcttgagcggcagcggcgcgcgctatgtcggccagggcgtggagttctggatcaagggccgcgatgccagcgtcaattggcgcagcgaatcgctggagtgcaccagccagccgaccccatga

SEQ ID NO: 403 - DNA, 1407 bp, Chromobacterium substugae
atgtccgatcttacctttgccgacctaggcctggcagaccctttgctgcgcgcggtcgccgacaccggttataccacgcccaccccgattcaggctcaggccattccgcaagtgctgcaaggcggcgacctgctggccgcggcgcagaccggcaccggcaagaccgccggcttcacgctgccgctgctgcagctgctgatgcgttcgcccagccaccatgccggccgcccgcgcgcgctggtgttgacgcccacccgcgaactggccgcgcaggtggaggagtcggtgcgtacttatagcaaatacctgccgttgaagtcgctggtgatgttcggcggcgtcaacatcaatccgcagatcaaggcgctgcgctcgccggtggatatcctggtggcgacgccgggccgcctgctggaccacgtcggccaaaagaccgtcgacctgtccggcgtcgagatcctggtgctggacgaagccgaccgcatgctggacatgggcttcatccacgacatcaagaaggtgctggccaagctgccggccaagcggcagaacctgctgttctccgctaccttctccgacgagatcaaggcgctggccgacaagctgctggacaatcccaagctggtggaagtggcgcgccgcaacaccaccaacgaactggtgacccagaaggtacacctggtcgaccgcgacaagaagaccgagctgttgatccatctcatccgcgagcacaattggttccaggtgctggtgttcacccgcaccaagcacggcgccaaccggctggcggagaaactggacaagatcggcatcacggccgccgccatccacggcaacaagagccagaacgcgcgcacccgcgcgctggccgacttcaagagcggcgaattgcaggtgctggtggcaaccgatatcgccgcgcgcggcctggacatcgatcagttgccgcacgtggtcaacttcgagctgcccaacgtgccggaagactacgtgcaccgcatcggccgcaccggccgcgccggcacgccgggcgaagcgctgtcgctggtttgcgtcgacgagttcagcttcctgcgcgatatcgagaagctgatcaagatgtcgatcgagcgcttcaccgtgccgggcttcgaggccgacctcaacgtcaagccggagccgatcccgatgggcggcggcgcgcgcggccgcggccagggtcaaggccagggccgaggcggccagggacgcagccagcagccgcgcaacccggcttccaagccgcgccatcaaaccgaaagcaagccggccggccacggccatcgcggcggcggtcagggccaaagccaggcgcgccaggacggcgcccgctcgcctaagtcgtcggcgccgcgcgccgcgctgttcagcccgccgaagagccgctaa

SEQ ID NO: 404 - DNA, 792 bp, Chromobacterium substugae
atgcgataccacggctatctgctgggtatcctgagctgggccgtgctgctggcggctccggttgaggctgccccacgcctcaagatcaccctgtccaatcaggaatggccgccgtacatgggccaggaattgccgtacgacggcattctgtcgcggctggtgaaagaagctttcgcccgcggcggcgtcgatgtcacctatcgctattatcccaacaaccgcacgctgcagtcggcgcgcaacggccaggtggacggcagttttggctgggcgccgacgccggatcgcaagcgcgacctgctgtacacgcagccggtgctgtcggcgcgcatggtgtttttccagcgcaaggagcgcaggctggagtggaaccgctgggccgatttgcgcggcgtccgggtgggcgtcaccgtcggcaatttctattccgacgatttcgacgcccaggccaagagcggcctgctgacggtggacagcgcgccggacgacctgatcaatctgcgcaagctgctggccgggcgcatcgacctgttccccatcgacctggaggtgggcaaatacctgatcgcccaccattttccgccgcagcagggcgccctgctggaggcgcaggccaaatcgttctggtcggcgccgctgcatgtggtgatctggcgcaagcatgcgcgcggcaaggagctggtggagcgtttcaaccgcggcctgaaggcgctgcaggacagcggcgaattcgagcggctggtgacggaaacgcgcgaagcctgtctattgcccagaaccgtctcgccctga

SEQ ID NO: 405 - DNA, 564 bp, Chromobacterium substugae
atgcgctatcccggcagccacaagctccagacccgccgccgcatcatcgcgatcgcgtcgctgcgctttcgcgccgaagggctggcccatgtcggcatcgccaacctgatggccgacctcggcctgacccatggcggcttctacgcccacttttccggcaaggacgcgctgatcgccgccgcctgctgcgaagcccaggaacagatgaaccgccactggcggcaacaactggcggaggcggccgacggcgcatgcctggcggcgctggcggaacaatacctgagcccggcccatcgcgattttcccgactccggctgcgtggcggcggcgctggccggcgagctggcgcgccaggggccggcggtgaggcggcgcttcaccgacggcttgctgccgatgctggaaaccctggaagaagcccgccgccgcgacggcgccggcccgccgccgctggccagcctggcgctgatggtgggcgcgctgctgctggcgcgcgcggtcagcgacgacgagctgtcgcagcgcatgctggacgaagcgcgcgcggcgctggcaggcggctga

SEQ ID NO: 406 - DNA, 1905 bp, Chromobacterium substugae
atgccgccaagcaatgcctcgatgcgcaatctgggggacgcggcgctgcgccaaggcggcgccgcgctggcctatgccgttttcgcgctggcgctggcgcggctgctgccgcccgggccgccggcggcctggctgcagcctggcctgccgttggcgctggcgctgttgtcgcgtctgggaaaccgggtttggccggcgctggcgttggccggtctgtggctggcgtgggatggagccgggcggatggccgatgtcctgttgcaggctgccagcggcctgggagccgccttgctgggcgccggcctgctgcggcgccggccgccgcatctccagctggccgacgtgccggccgggttgccggccgccgcggcgctggcttgcctgctggcggcgctgggccaggtattcgcgttgctgccggaatatggccggcgcctgccggagctggcgctcacgggcgtgcagatctggctgggcgacatggcgctggtgttgacgctgacccccatcctgctgctgctgggcaggccgggaccggcttgcggcgcggcgcgctggcgcgagagcgcggcggtggcgctggccacgctggccttggcggcgctggtgtgctgcttgctggatggcggcggcggccgctacgctatgttgccttacctgttcatcatgccgctgctgtggctggctttccgcggccggccgctgctggcgcacctgctggcgctgggcgtggcgtcggccgcgctgcttggcgtgcgtctggggcatggcgcgctggcgtcggacggcggcggctacccgctgctgaacgcggccttgctggcgctggcgcagtcggcgaccctgctggtgttcggcgcgttgttggaggagaggcggcaggtggagcggcgcttgctgctggccaaccagtcgctggaggccaaagtgcgggagaggaccagccagctggcggaaagcgaggccaggctcaggctgatggccgacgccgcgccgtttccgctggcgatgaaccgcttgtccggcggccagctgatctacgccaacacccgcgccgaggagttgttcggcgcgcggctgctgcccgagcgctcgctgcgggtgcaggatttctacgccgacccggcggagcgggagcgggtatcgcgcgacctgcgcgccgccggccaggtgctggaccgcgaggtgaagctgaaggatgccgacgggcgcgagttctgggcgctgatttcctgttcggcggtgaagagtgacaagatctggtacgtgatcaatggcgtcaacgacatcagcgagcgcaagcggctggagcagagcctgcacgacgccaacgccgcgctgcgccgccatgtcggtgaaatcgaggtattgcagcagggcctgcgcgagcaggcgctgcgcgatccgttgaccgggctgttcaaccgccgccatctggacgaaatcctgccccgcgtgctggcccacatgctggcgctgcaccgcgatgtggcggtgctgatggtggatgccgatcatttcaagcgcatcaacgacagctacggccatcgctgcggcgatatggtcctgacggcgctggcggcgtatctcagcgatcatttccgctgcggcgacatcgtctgccgctacggtggcgaggaattcttcgtcttgctgccgggcgcgtcgctggaggcggcgcacgccaaggcgcaaggcttgtgcgacgcggtccgcgcgatgccgatccgggcgcaggaacatgtcttgtccatcaccttgtccgtcggcctggcgctcagcccgatgcacggcgaggatgcggaaagcgtggtccacgccgccgacgccgctttgtaccaggccaagcaaatggggcgcgaccgggtgtgcgtcgcggcgacgcttcagcccttgccgtcctga

SEQ ID NO: 407 - DNA, 984 bp, Chromobacterium substugae
atgtcctacccgaaatacgcgctgcacagcctgggatgggtgcgttaccagcggcggcgcatcctgcgcgcggcgctgttcagcgcgctgctgttcgcgccggcggcggggctgacgctggccggccacggcggcggcgtgttcctgttcgcgctggccgccaactacagcgcgctgtgcatgatgatggcgcgccgcttgcagccgctgtcgctgctggcgattcccgggctttacctcgccggccggctatgcgccggccagccggcggccatgctggccctgctggcggcggggctggcgctgcaggcgctgagcgcgcgccgcggcctgcacaagggcgtgcagttctggctgttcgcgctgctgttgggaaacatgacgccgacggcggcgcttccgccatggcaggaagcagcctggatgctggccggcgccggctacggcggcgcgctggcgcggctggggctgcgcgactggttccgcgtgctgccggccgcctcgtccgccgactgtcgccgctatggctggcatctgctgccctggggcattctcgcctggctggccggcggctggatgcgcagcgcccacgcgtggtggctgccgatcgccgccgtcgccatccccgatccgtcgccggaccagatgctgtggctggcgcgcgagcgggcgataggcacgcttgccggcgcgctgctcagcggcctgctgtactggtcgctgcgcgcgctggacgcggcgccgttgtggcacgtgctggcgctggcgctgctgcagatggcgatgctgatcgcgatgcggcacagcttccgcgtcttcgtcgcgctgctgaccgcgctggtgctgtcgctgctgccgccggaacagctggccagcggcgcgctggaacgggtggaggacacgctgctcgccgcgctgctgttcgccgcgctggcctggtttctgcgccagcgccggcgcgacgctcaggacggcaagggctga

SEQ ID NO: 408 - DNA, 687 bp, Chromobacterium substugae
ttgcaacaacaaggcttcggcggccgcaaggaatgccgccagctgatcgactacggcctggtggaagtgaacggcgaggtggtggacaactaccgcgcccagttcgagctggccgacatttccagcttgacggtggacgacgagccgtggccggtggtgcgcgggccgctatacctcttgctgcacaagccggccaattacgaaacctcgcacaagcccaactgccaccccagcatctaccggctgctgccggaccagttctccaatctggacatcagcgcggtgggccggctggacgtggacaccaccggcctgatcctgctgtccaacgacggccagttcatccacgcgctctcctcgccgaaaaagctggtgcccaaggtttaccgcgtcacgctgaagcacgaggcgacgccggagctgatcgcccaactgcagagcggcgtgtacctgaacgacgaggcgcgcgagttcgccgccgacagcgtagcccagatcgacgcgcacaccatcttgctgaccatcaccgaaggcaagtaccaccaggtgaagcggatggtggcggcggccagcaaccgcgtcgaggcgctgcaccgcgaaagcctgggggctattgtcttgggcgatctgccggcgggcgaatggcggcatctgacggccgaagaattggcggccttcggcttctga

SEQ ID NO: 409 - DNA, 807 bp, Chromobacterium substugae
atgcgccgcacgatattgctggtctacgcccagcccgagcctcgctccctgacccgcggcttcgccgccgccgccgtggaaacgctgacggcgcaagggcatcaagcgctgcagtccgatctctacgccatgcgctggaaagcggtgctggacgccgacgattttccggcgcgggccgatcccggccgcctgtctttcatcgacgaatccggccacgcctacgccaatggcgcgcaaacgcccgatgtcgccgaagagcagcgcaaactgctggccgccgacgcggtgatcttcatatttccgctatggtggtacggcgtgccggccattctgaaaggctggttcgagagggtgtacgcctatggcttcggctatggctaccagaaccaggccaaccggctgcgctacggcgacggcgcgctcaagggcaaacgcgcgctgctggcggcgatggtaggcggcggcgaacgggactacggtccgcgcggcatcaacggcccgctgcaggagctgctgttcccggtcacccacggctgcctgttctaccccggcatggacgtgctgcccacccacgcggtctatggcgtcaaccatttgagcgcagcagacctgcgccagcaactagacgcgtggcgcacgcgcttggccggcttgttcgacgaagcgcccatcccgttccgccgccagaacggcggcgactatccggacggacaccagctggccgaccacatcgcgccggacaaggagggcatctgcgcgcacgtggccgcgccggggccggcgatgaccggagccgcggcgcaataa

SEQ ID NO: 410 - DNA, 912 bp, Chromobacterium substugae
atggataccaagcgcctggatttgaatctgttgcatacgctggaagcgctgctggaggagcgcaacgtcacccgcgcggccacgcggctgcatctgagccaaccagccgtcagcgcgcagctggcccgcttgcgcgaactgttcggcgatccgctgttgctgccgacgcagcgcggcatgcgtcccaccgccaaggcggagcagttgctggcgcccttgcaggcctcgctgcaacagctgcgcgaaaacctgctggcgcaccaggcgttcgatccagccgccgccagcatgactttgcagctcgcctgcaccgattacgcccaggcggtggcggcgattccgctgatccagcgcttgcgcctgcgcgcgccgggcatcagggtggcgctgcgccatctggaagcgtcccgcttgcagcgccaggccgagagcggcgaggtggatctggctttgatcagcccggatggcgcgccgccaggcttgcatgccaagcccttgtttgaagaccgctatgtcctgatcggccggccggggcatcccgcttggcggcagggcctcagcttggagagctatctgcagcatcagcatgtggtggtgtcgctgggcagcggcgatttcagcaccgcggtggatgcggcgctggccgagcaagcgctggcgcgacgggtggctttgtcggcggcgtcttttctgctggtgccggaaatcgttttccaaaccgattatctcgccttgctgccggcgcggctggtggcggtcagccgggtgccgctgcagacggaggcgtgtccgtttccgctcagcggcttcggcgtggcgatggtctggcatccgcgcaaccacagccatccgggccagcgctggatacggcagcagtttgccgagttgatggcagagtccgccgcggcatag

SEQ ID NO: 411 - DNA, 1863 bp, Chromobacterium substugae
atgaacgctgtccgcagtttgccgctggacgagatccgccgccgtttcttcaccggccagcccttgcccggccaggcgctgccgccacccatcctgcactcctggcaacgctgccgcagcctgggtctgccggccggcggcggcggcggcgacaagctgagcccgatggagctgaacgaaaggcagcaggcgaaccaggactggctggcgccggccgcgccggcgctggccggcttgtacgaacaagtggccagccagcagctggcgctggtggtggccgacagccacggcctgatcctggaccagagcgggcatatcgattttctgaacaaggccgagcggctggcgctgacgccgggcatggactggagcgaggccgcgcgcggcaccaacgccatcggcaccgcgctggccgcgatggacagcgtgctggtgcgcggcggcgagcattacctggagcgcaaccgggtgctggcctgcgccgccgcgcccttgctcggcccgcagggacagttgctgggcgcgctggacatcagcggcgccagccgcaagctggggccgccgcaaatcctggcgctgcacgccgcgcgcggccagatcgaggcgcgcttgctggaggacgccgcccgccacggctggctgctatgcctgcacgccgatccgcgcctgctggacgcgccctccgcctgcaagctggttttcgacggcgatggccgcctgctggccgccaaccgcccgggtttggcgctgtgcggtctggaagccggcggctggcaggcgcgccatttcgccgcgctgttcggccaaagcctggagcactggctgcaacgccatggccaggccatcggcgcgctgcgaatcggcgcgcaacgattctccgcccggctgaagccgccggctcccgcccaatcggccgcgtctgccagccgttcgcctcggtccgcgccgctggcgaaagcagcgcccgccgccgccatcgcgccgctggacggcgcgccgcccgaattgttcgccgccgcgcgcaagctgctggaggccgacattccggtgctgatcctgggagaaaccggcaccggcaaggaccggttggcgcgcgcgctgcatggcgccggcagccgccgcggccaacccttcgtcgcggtcaactgcgccgccattcccgaaggcctgatcgaggccgagctgttcggctatctgcccggcgcctataccggcgccaaccgccagggcagcaagggcaggttgcgcgaggccgacggcggcgtgctgttcctggacgaaatcggcgacatgccgctggccctgcaggcgcggctgctgcgggtgctgcaggagcgcgaagtgacgccgctgggcggcgggccggcgcaacagctggacatccggctgatctgcgccacccaccgcgacctgcgcgccaaggtggacgagggcgctttccgcgccgacctgtattaccggctctgccactatccgctcagcctgccgccgctgcgcgagcgcggcgacgtggccgccatcgcgcagcgcatgctggacgaaatgggcgcggcgcggcgcggcatcgcgctggcgccggagttggcgcgggctttccgcggctaccgctggcccggcaatctgcgcgaattggccaatttgctggccaccttgctggcgctggccgacgacggcgcgcaactggaaatccgccatctgccggccttgctgcgcgccgatatggcaagccagggccatgcggtgccggacagcgccatcgccgatttgctgcgccgctgcggcggcaacgccagcgcggcggcgcgcgcgctgggcatcagccgcgccacgctgtaccgccgcttgggcaaaaccgccaaataa

SEQ ID NO: 412 - DNA, 1506 bp, Chromobacterium substugae
atggcaagcctgcaacctggatttcaattgaagacgcgttacgccaatttcatcggcggccaatgggtgccgccggtgaacggccgctatttcgaaaacgtcaccccgatcaccggcaagaccttgtgcgagattccgcgctcggacgagcaagacgttgagctggcgttggatgccgcccacgccgcccgtttcaagtggggccatacgccggtgaccgagcgcgccatcgtcctgaacaagatcgccgaccggatggaggccaatctgaacctgctggccgaggtggaaacctgggacaacggcaagccgatccgcgaaacccgcgccgccgacattcctctggccatcgatcatttccgctacttcgccgcctgcgtgcgcgcgcaggaaggcagcctgggcgaaatcgacgccaacaccgtgtcctaccacttccacgagcctctgggcgtggtgggccagatcatcccgtggaacttccccatcctgatggcggcgtggaagctggcgccggcgctggcggccggcaactgcgtggtgctgaagccggccgagcagacgccgctgtccatcctggtgctgatggaactggtgggcgacctgctgccgccgggcgtgctcaatgtggtcaacggcttcggcgtggaagccggcaagccgctggccagctccaagcgcatcgccaagatcgccttcaccggcgaaaccggcaccggccggctgatcatgcagtacgccagccagaacctgattccggtgacgctggagctgggcggcaagtcgcccaacattttcttcgacgacgtggcggcgcaggacgacgccttcttcgacaaggccatcgaaggcttcgtgatgttcgcgctgaaccagggcgaggtgtgcacctgccccagccgcgcgctgatccatgaatccatctacgaccgcttcatggaaaaggcgctgaaacgcgtcgccgccatccagcagggcaacccgctggacccggccaccatgataggcgcccaggcgtcgcaggagcagatggacaagatccagagctacctcgccatcggccgcgacgaaggcgccaaggtgctggccggcggcgcgcgcgcgcaactggccggcgagctggccggcggcttctacatccagccgacggtgttcgccggcaacaacaagatgcgcatcttccaggaggaaatcttcggcccggtggtgtcggtgaccaccttcaaggaccgcgacgaggcgctggccatcgccaacgacaccctgtacggactgggcgccggcgtttggtcgcgcaacatcaataccgccttcttcatgggccgccacatcgaggctggccgcgtctggaccaactgttaccacgcttacccggcgcatgcggccttcggcggctacaagcagtccggcatcggccgcgaaacgcacaagatgatgctggaccactaccagcaaaccaagaatctgctggtcagctacggcgaggacaagctgggctttttctga

SEQ ID NO: 413 - DNA, 654 bp, Chromobacterium substugae
atgcagtcggaccgggaaatgagcatccatggcgcggaagagggcgacgcggcgtacgaacagcccgagcgggcgctggagctggtctggctgcggcgttatctgccgcagcagttcgccggccgccaggtgctggaatgggcgtgcggcagcggttactggacgcaatacctggcgccgcgggcgcggcgctacctggcattggacgaggccgctgccgcgctggcgctggcgcgccaacggccgggcgtggagcgggtggagtttcgcctggcgcaggactgcgcgctgccggccggcgccggcggtttcgacgcggctttcgccgcgcagtgtttttcgcggctgcccaagcagcgccgcgacgattggctggctggcctgcacggcggcttgcaggccggcgccgaggtgctgtggttggacgacagcgaggcgcagtgccgcgaatatccgctggtggagtatgacgcggcgggcaacggctaccagatgcggcccggacccgacggcggcgagctgcggctattgaagaactttcccagcgaaaccgaattgcgcatcctgctgggccggcatggcgtcagcgacatggccttgctgcggcgcgagcatttctggctgctgcaataccgtttgccgaagcgccattga

SEQ ID NO: 414 - DNA, 1422 bp, Chromobacterium substugae
atgagttccccccgcaaagccagccccttcctgcgctcgcatctggcctgggtgctggcgggcttcaacgccctggtggtgctgtccatcgtcgacgactacctgctgccggccggcgcccaggccgcggtcagcgtcctgctgctgatcgccaccatcgcgctgtcctgctggctgtggcaaaagggcagccgcatcttcctcctgctcaacgccctcacccgccagctgggcctggcctgcagcggcgaattgcaccaccgcagcaccggcacccgcgaaatgggcgaagtcggccaggtggcctggcagctgaatgacttcctcgacctggtggaaacctacttcaaggaaatcaacacctgcttccaggagatcagccagggcaacttctcgcgccggccgctcaaccaaggcctgcccggcatcctggccagctcgctggagaacgtgaacaagaccatccagaccatggccgacaacgacggcttcgtgcgccgcaaccggctgtcgtcgcaactggcggcgctgaacaaccccaaccttcgtcacgacctgtccggcagccagcacgacctcaccgccatcagccaggcgatggacgcggtggccggcatcacccgcgacaacgccgccggcgcgcgcgaaagcctggacagcgcggcggaattgtccagccacctggataccatcgccggcagcgtcaacagcatggatcaggccagccagctgctggcccaggaatggcagggcatagaaagctcgctggccgacatctcggccatcgccgaccagaccaatctgctggcgctgaacgccgccatcgaagccgcccgcgccggcgaaaccggccgcggcttcgcggtggtggccgacgaagtgcgcaaactggccgagcgcagcaagagcaccgccaaccaggtgcagaatgtgctggaatcgctgtccacccgcatcgccgacatgcaggcgcaggccagcgacgccggcggcgtggccggcaatgtgcagacatcggtggaatcgttccgccagcgctttgccagcctggccgagcaatccgaccgggtgttgaagcaggtgagcgaggtgcagcagaagtcgcagacctcgctgcagaaagtggcgcacgtgatctacaagcaaagcgcttaccacgcgatcgaggaagccgaggcccaagccccggcggtggagctggagcactggatagacggcggcggcgccagcctgttcggcgcctccgccacccaggcgctgcgccagccgctggcgcagctgcagcagcaagtcggcgcggcgctggccgccgccagccagagcggccagctggacgaggccggcatcgtcgcgcggatgcaggcgatggagcaggccagccagaagctgcagcagggcctggaccagctgtccgcggcctga

SEQ ID NO: 415 - DNA, 582 bp, Chromobacterium substugae
atggtcaaagagaagcagacaatggaaaaaacagccatcggcagaggcgccggccgggaagtgcagctcgcgccgcacgaactgatcgtcaccaagaccgaccccagcggccacatcacctacgccaaccgcgtgttcatgcgggtggccggctacgccgagcaccagctgctgggcaagccgcacaacctgatccgccatcccgacatgccgcgcggcgcgtaccggctgatgtggcagacgctgcaggccggccacgaattcttcgcgctggtgaaaaacgccaccgcggacggcaactactactgggtgctggccaacgtcacgcccgattacgacccgcaaggccgcctgcagggctactactcggtgcggcgcccgcccagccgcgccgccatcgccgccatcgaaccgatctacgccgaaatgcgcaagatagaagccagccagggcaaggccgccgcgccagacgcctcgcgcgactggctgctggcgctgctggcggaaaaaggctgcagctaccaggacttcatcctggggctgaacgccgacgtactgaaagccaaaggagtcaccggatga

SEQ ID NO: 416 - DNA, 1920 bp, Chromobacterium substugae
atggcaagattattgcctcatctatcgacccaccccgcgcgccgcggcgcgccagccaagaatggtttcccgatgcgttttcccgtttccctgttgagcaccacgctggtcctggccggccccgccgcgctggcggcgcgccagccggcggaagaggcgccgctggcgctgaaggccagcatcagctgccgccacaacgccgacaacagcctggactgcaccacccgcaaccaattcaccatcctcaaacccgccggcaaggagtttttgtcgcggatagatttcacctacccggacaccgacaagctggaagtgctgggcggcgaagtgcgccagcaggacggcaaggtggtcaagctggaaaagtcgcaggtggaaacccgcgccgcgcccaacccctacgccggcgtcagccgcgacaagcaaacctggctggccttccccgaattggcggtgggcagcgtggtgtcctaccaggtcaggcaccatatcgccgcgccgccgctcagccgcgagctgctgtaccggctggacttcgatcccgagccggtgcgctacgacagctatcatttcgagctggattcgccgcggccgctgctgtggcgcgccgaagcgatggaaggctttcagaccgcggccagcgccgacggcaagcggatcaccgtcgaccagcgcggcagccgctacctgaacctcaccaatgaatggagcaatagcgcgctgcgccgctggccgcggctgagcatcgccaccagcgactcgccgcagcagcatttcggcgtctacgccgagcgctacaacgccatcctggcggcgccgttgccgccgggcgcggcggcggtggtgtcgcagcagcgcggcaagccggccgcccagcaagtggccgccttcatgcagcacatcaacagccattaccgctacctcaacgaccagcggctggccgaacgcggcctggtgccgttcacgctggccgaaatcgagcagcacggctacggcgattgcaaggacctggccaccttgctgaccgcgatgctgcgccgcgccggcatcgccgccgaaccggcgctggtcttccgcggcaacttcgcccagcagccgctgctgcctggcctcggcaccgtcaaccacatgatcgtgcgcgcgcaagtggacggcaaaaccgagtggctggacgccaccaaccccttcttcgccgccggccgcatcatgcctgacctgcaggagcgcgcgacctacctgatgggcgacgacggcaaggtgcgccaggacttcattccgctgcaggcggccaccctcagcagctcggtcaagcgcgtcgaaaccctgaaacgcgacagcagcgcgcgcatcgtcagccaaagcctgctggccagctggcccttgatcgaaatgacgatgcaggaccgctaccagggcagcagcggcaccgaccagaacatctgccgcggcctcggcaaccagacgcagaactgcaaggtggcgcgcgccgccaccggcttcctgattccggagcgttacccgatccagataagcggcgacgacacccgcgcgctggagaagatctccggcctctacctgtacgacccgcgcctggaaagccgctggaacgacttcgacaactaccgcgccaacggcaaccaggccgacgtctacctgggcgacccggaaatcatggagcgctcgctggaactgaaaggcgccaaggccatccagccgccgttcagctgccaggcgcgctcgccctggttcgacctggacctgaagcaaaccgccgacgccagcggcgtccgctaccaataccggctgagcagcaaggtgcgctggctgagccacgacgacatcgtcagcccggaattcgccgcgctcagccgccaggcccgcgcctgcgccacccaggtgcggcagatcctgaagctgtaa

SEQ ID NO: 417 - DNA, 411 bp, Chromobacterium substugae
atggcgttcggtagtttcaaccagggcccggccgcgccgatggccgagcccaacaccacgccgctggtggacgtgatgctggtgctgctggtggtgttcatcatcaccaccccgctgctgaccaacgcggtcaaggtggacctgccgcgcgcccaggccgcccagcaccaggacaagccggaacagatccgcctggcggtggacgccgccggcaagctgttctggaacgacaaggcggtggcggaagccgacctgccggcccgcttcgccgccgccgccgccgccaatcccgaggtggaactgcacctgtcggccgacaaggccgtgcgctacgaaaccgtggccaagaccctggccgccgcccagagcaacggcgtcggcaagataggcttcgtcaccgccgcgccctga

SEQ ID NO: 418 - DNA, 669 bp, Chromobacterium substugae
atgaccgtattccaccaaggcgacgccgtactgatttcggtgttcctgatcctgatcctgatgtcggcgctcacctggtacctgatcatcgtgcgcggcgtgcagaccctgcaggcgcgccgcgccaaccgcagcgccgagagcgcgctgtggagcgcggccggctggacgcaggcggagcaccagttggcgcacagccgcggacaggtggccaacctgacccgcgccggcctcgccgcgctcaagcagtaccaaagccaggccggacgcgcgctgggccaggcttgcggcgtcgacgaattcctcacccgcgccatccgcaaggcgctggcgcaggaaaacgcccgccaggaagccggcctgaccgtgctggcctccatcggctccaccgcgcctttcatcggcctgttcggcaccgtctggggcatctaccacgcgctggtcaatatcggccaggccggccagatgagcatagccgcggtcgccgggccgataggcgaagcgctgatcgccaccgccgccggcctggccgccgccatcccggcggtgctggcctacaacgccctcacccgcgcccagcgcgtgatgtcgcaggaactggactatttcgcccacgacctgcacgcccagttgttgacccaatccggagagcaagatggcgttcggtag

SEQ ID NO: 419 - DNA, 378 bp, Chromobacterium substugae
atgagcgccgccgcatatcgccaggccggcgccgcgctggcggcggccatgctgatgctgacgaacgccgcggcagaacctagtcccgccggccacgatcaagcccgccgcaagcaaacctcctccttgtccgaggaagcgatggaggcgatagcggcaggccaagccggtctcgcgaaagtgcgggtgctgatcagcgccgaaggcctgccgcaggagatcgccctgattagcagcagcggcgtcccgcaattggacgccgccgcattgaaaaccgtcaaaaactggcacttcaccccagccaaacgcgatggccaggccattcctgtcatcgttatcgtccctatcgaattttctttgaagcctggcaaaccatga

SEQ ID NO: 420 - DNA, 738 bp, Chromobacterium substugae
atgagaattatttgtattatcatcgatttcatgaaacccctgccaaccttgcaactttctgccatcggcgcggtgctgggcctgcatgcgctggcgctgtgcttgctcaatggccagcccggccgggagctgccggtgacgccgccgcggctgctgacatcgatgacgatgctggcgccggcggccgcgcccaaggccgccgcgccgtctcccgccgccccgcagaaaccgcaggtccaggccaaggccgcgcctagcaaggccatcccgcagacgcggccgctgccggcagtgaagccgcagaaaaccgacacgccgccgccggcgcccgccaaggccatccaggtggccgccgccgctcccgcagcctctgctgccccggcggcggagccggccaaagcgcccggcggcggcaagccggacggcgacagccgccagcagcaaatcaccgagccgctgtccaccggcggctacctgaacaatccgcagcccgcctaccccaccgtctccaaagaagaaggcgaggaaggcaccgtgcgcctgcgcgtccatgtcagcgtgcagggcctgccgcaagaagtgtcggtgcaaagcagcagcggcttcccgcgcctggaccgcgccgcgctggcctcggtcaagcgctggcgcttcatcccggccaagcgcggcgccgagcccatcgcctacacctacatcgtgccggtcgagttttccttgaagtccagcaggtcatga

SEQ ID NO: 421 - DNA, 1317 bp, Chromobacterium substugae
atgcagacttccctacgacaacgactgaatggcctgcctcccggtttccatctgctgatgctcagcgacgtcttgagcgggctggcgatgggcgccggctatgtcagcatcagctggtgggtggtatcgatgggcggcgcccgcgacatggcctggttcagcacgctgaccgcgctggtgatgctggtggcgctgccgctgaccgcgccgctgggcgaccgcttcccgaaaaaccgcgtcatcgccggcggcatcctgctggccatgctgtccggcctggcgctggcggcgatggcttggttccacttctatagattggcgtgggtggtggccagcgaatcgatggccatgttcgcctgggccatcgtaattccttccatgttgagcatcgccgccgagctggtgccggcaaaccggctgtccgacgcgctgtcgatgcagaaaagctcgcaatcggtaggcaacctgatcggcccggtcataggcggcagcctgatggcggtggcgccggcctggatggcgctgggcagctatacgctgctgctggccatcgccgccgtcggcgccttgcgcatccggttgccggcgcgcagcttggcggatgtccgggcggaaagcttcatcgaacagatccgcagcggcctgcgcgtgcgctggcgcattccgctggagcgccgctgggcgctgtggggcttgctggtgatgaccgcctacttcccgatggtggtgacgctgctgccgatcaagctgcatcaattgggcctgccggcgttctggctgggcgcctgcgaggcggcggtcagcggcggcctgctggtcggctcgctgtggctgacgcaccgcctgctgctgcactgtagccggccgcgcgcccgcgctttcgcgatgtgggcgctcggcgcggtattcctggtggtggcgttgaccgatcatccgctggtgatgctggcaatgttcggcatcgaaggcgcgctgctgtcgatcaccatgctgatcggccagacccatcgcacgctggcggtgccggagccctatcgcgcgcgggtgtcggcgatcaatgtgctggtggccaagctgggcggcatgctggggccggcgctggccggcatcctgctggcgcgctggtcgctggatgaggtctatctgttcttcgccctgttccacctgctgacggtgccgccgatgctgctgctgcccggcgtcaaccgcttcctgaacctgagccatgacgaggtgaaggactggtacctgaaacagcacccggaggctttcgagccgatggcgccggcgggcggcaagctggaacaatcggcataa

SEQ ID NO: 422 - DNA, 1475 bp, Chromobacterium substugae
gaactgaagagtttgatcctggctcagattgaacgctggcggcatgctttacacatgcaagtcgaacggtaacagggtgcttgcaccgctgacgagtggcgaacgggtgagtaacgcatcggaatgtaccgtgtaatgggggatagctcggcgaaagccggattaataccgcatacgccctgagggggaaagtgggggaccgtaaggcctcacgttatacgagcagccgatgtctgattagctagttggtgaggtaagagctcaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgttcgggaggaaatcccgctggttaatacctggcggggatgacagtaccggaagaataagcaccggctaactacgtgccagcagccgcggtaatacgtagggtgcaagcgttaatcggaattactgggcgtaaagcgtgcgcaggcggttttgcaagtctgatgtgaaagccccgggctcaacctgggaacggcattggagactgcaagactagagtgcgtcagaggggggtagaattccgcgtgtagcagtgaaatgcgtagagatgcggaggaataccgatggcgaaggcagccccctgggatgacactgacgctcatgcacgaaagcgtggggagcaaacaggattagataccctggtagtccacgccctaaacgatgtcaattagctgttgggggtttgaatccttggtagcgtagctaacgcgtgaaattgaccgcctggggagtacggccgcaaggttaaaactcaaaggaattgacggggacccgcacaagcggtggatgatgtggattaattcgatgcaacgcgaaaaaccttacctgctcttgacatgtacggaacttggtagagatatcttggtgcccgaaagggagccgtaacacaggtgctgcatggctgtcgtcagctcgtgtcgtgagatgttgggttaagtcccgcaacgagcgcaacccttgtcattagttgccatcatttagttgggcactctaatgagactgccggtgacaaaccggaggaaggtggggatgacgtcaagtcctcatggcccttatgagcagggcttcacacgtcatacaatggtcggtacagagggtcgctaagccgcgaggtggtgccaatctcataaaaccgatcgtagtccggatcgcactctgcaactcgagtgcgtgaagtcggaatcgctagtaatcgcagatcagcatgctgcggtgaatacgttcccgggtcttgtacacaccgcccgtcacaccatgggagtgagtttcaccagaagtgggtaggctaaccgcaaggaggccgcttaccacggtgggattcat

SEQ ID NO: 423 - DNA, 74 bp, Chromobacterium substugae
gggtttgtagctcagctggttagagcactgtgttgataacgcaggggtcgtaggttcgagtcctaccagaccca

SEQ ID NO: 424 - DNA, 73 bp, Chromobacterium substugae
gggggattagctcagttgggagagcacctgctttgcaagcagggggtcgtcggttcgatcccgtcatcctcca

SEQ ID NO: 425 - DNA, 2892 bp, Chromobacterium substugae
ggtcaagcgactaagtgcatctggtggatgccttggcgatcacaggcgatgaaggacgtgtaagcctgcgaaaagcgcgggggagctggcaatagagctttgatcccgcgatatccgaatggggaaacccggcccttaggggtcatccctgactgaatacataggtcagaggaagcgaactcagcgaactgaaacatctaagtagctgaaggaaaagaaatcaaccgagattccgtaagtagtggcgagcgaacgcggaacagcctgtatgtgatagagattgcgttagtggaaggttcatggaaaggaccgccgtagtgggtgatagccccgtacacgaaaacgcattcttggtactaagcatacgagaagtagggcgggacacgcgaaatcctgtctgaatatggggggaccatcctccaaggctaaatactcgtgatcgaccgatagtgaaccagtaccgtgagggaaaggcgaaaagaaccccgggaggggagtgaaatagaacctgaaaccggatgcatacaaacagtgggagcggacttgttccgtgactgcgtaccttttgtataatgggtcagcgacttacgttcagtagcaagcttaaccgaataggggaggcgtagggaaaccgagtccgaatagggcgctttagttgctgggcgtagacccgaaaccgagtgatctatccatggccaggatgaaggtgcggtaacacgcactggaggtccgaacccactagtgttgcaaaactaggggatgagctgtggataggggtgaaaggctaaacaaactcggagatagctggttctccccgaaaactatttaggtagtgcctcatgtatcacttccgggggtaaagcactgttatggctagggggtcattgcgatttaccaaaccatggcaaactctgaataccggaaagtgcaagcatgggagacagacggtgggtgctaacgtccatcgtcaagagggaaacaacccagaccgccagctaaggtcccaaatgatcagttaagtggtaaacgaagtgggaaggcatagacagccaggatgttggcttagaagcagccatcatttaaagaaagcgtaatagctcactggtcgagtcgtcctgcgcggaagatgtaacggggctcaaactgataaccgaagctgcggatgggcgcgtaagcgtccgtggtaggggagcgttctgtaggtctgtgaaggtgtctcgtaagggatgctggagatatcagaagtgcgaatgctgacatgagtagcgataaagcgggtgaaaagcccgctcgccgaaagcccaaggtttcctacgcaacgttcatcggcgtagggtgagtcggcccctaaggcgaggctgaaaagcgtagtcgatgggaaacgggttaaaattcccgtacttttgtgcagtgcgatgtggggacggagaaggttaggtcagcagactgttggaatagtctgttcaagccggtaggcgtgaagagtaggcaaatccgctcttctttaacgccgagacgtgataacgagggtctacggacctgaagtgactgataccacgcttccaggaaaagccactaagcttcagctgcacaagaaccgtaccgcaaaccgacacaggtgggcaggatgagaattctaaggcgcttgagagaactcaggagaaggaactcggcaaattgataccgtaacttcgggagaaggtatgcctgttgaggtgtaggacttcgcgtccgaagctttgacaggtcgcagagaatcggtggctgcgactgtttaacaaaaacacagcactgtgccaacacgaaagtggacgtatacggtgtgacgcctgcccggtgctggaaggttaagtgatggggtgcaagctcttgatcgaagccccagtaaacggcggccgtaactataacggtcctaaggtagcgaaattccttgtcgggtaagttccgacccgcacgaatggcgtaacgatggccacactgtctcctcctgagactcagcgaagttgaagtgtttgtgaagatgcaatctacccgctgctagacggaaagaccccgtgaacctttactgtagctttgcattggactttgaagtggtttgtgtaggataggtgggaggctttgaagccaggacgctagttctggtggagccgaccttgaaataccaccctgacccctttgaggttctaaccttggtccgtgatccggattggggacagtgcatggtaggcagtttgactggggcggtctcctcccaaagtgtaacggaggagttcgaaggttacctaggtacggtcggaaatcgtgctgatagtgcaatggcaaaaggtagcttaactgcgagaccgacaagtcgagcaggtgcgaaagcaggacatagtgatccggtggttctgaatggaagggccatcgctcaacggataaaaggtactccggggataacaggctgataccgcccaagagttcacatcgacggcggtgtttggcacctcgatgtcggctcatcacatcctggggctgtagccggtcccaagggtatggctgttcgccatttaaagtggtacgtgagctgggttcaaaacgtcgtgagacagtttggtccctatctgcagtgggcgttggaagtttgacgggggctgctcctagtacgagaggaccggagtggacgaacctctggtgtaccggttgtcacgccagtggcatcgccgggtagctaagttcggaagagataaccgctgaaagcatctaagcgggaaacttgcctgaagatgagacttccctggaggcttgacctccctgaagagtcgttcgagaccaggacgttgataggtcgggtgtggaagcgctgtgaggcgtgaagctaaccgatactaattgctcgtgaggcttgatcct

SEQ ID NO: 426 - DNA, 118 bp, Chromobacterium substugae
tgtctggtggccatagcgaggtggtcccacgccttcccatcccgaacaggaccgtgaaacgccttagcgccgatgatagtgtggcattcgccatgtgaaagtaggacaccgccagacg

SEQ ID NO: 427 - DNA, 696 bp, Chromobacterium substugae
  modified_base (558)..(558): a, c, t, g, unknown or other
atgagcgtcagaggacgaccgcgcagcttcgaccgcgagcaggcgctgcgttcggccatgcgcgtcttttgggccaagggctatgacgccacccagctggcggagctgaccaaggtgatgaacatcaagccgcccagcttctacgcggctttccgctccaaagaagccatcttccgcgaagcggtggagctgtatctgcactcggaaggctccgccagcatgcgcgcgctggcgagcgcggcgacaacggccgaagcgatacatggcatgctgctggccagcgtggatacggtgctggcctccccgggggccaacggctgcctgctgatcctgggcctggtcaattgcgaaccggacaacgtcgcgctgcaggactatttgcggcaaatccgccaacacaccatccagctgatacaaagccggctggaagacggggtaggcaagggagagctgcccgcggacgcggactgcaagcaattggcaaacttctatttcaccgtgatacagggcatatcgctgcaggcgcgcgatggcgccgaccgcgccagcctgataganaaagtaggacaccgccagacgccccatacagaaccccagctcgatgagctggggtttctgcgtttcggccgccgcccgtggggcggcgccgtttcggccttgccgtcccctccccgttcccccgcggcttgccattga

SEQ ID NO: 428 - DNA, 1122 bp, Chromobacterium substugae; identical to SEQ ID NO: 371

SEQ ID NO: 429 - DNA, 1431 bp, Chromobacterium substugae; identical to SEQ ID NO: 372

SEQ ID NO: 430 - DNA, 1197 bp, Chromobacterium substugae; identical to SEQ ID NO: 373

SEQ ID NO: 431 - DNA, 519 bp, Chromobacterium substugae; identical to SEQ ID NO: 374

SEQ ID NO: 432 - DNA, 1176 bp, Chromobacterium substugae; identical to SEQ ID NO: 375

SEQ ID NO: 433 - DNA, 759 bp, Chromobacterium substugae; identical to SEQ ID NO: 376

SEQ ID NO: 434 - DNA, 489 bp, Chromobacterium substugae; identical to SEQ ID NO: 377

SEQ ID NO: 435 - DNA, 1137 bp, Chromobacterium substugae; identical to SEQ ID NO: 378

SEQ ID NO: 436 - DNA, 1170 bp, Chromobacterium substugae; identical to SEQ ID NO: 379

SEQ ID NO: 437 - DNA, 3144 bp, Chromobacterium substugae
atgttttcctcctttttgatccgccgaccgatcttcgcctgcgtgctctcgctgatcatcatgctggcgggggtggcggcgatgggcgtgctgccggtcgagcagtacccgcagatcgtgccgccgcaagtacaggtggtggcaagctatcccggtgcctcggccgaggtgatcgccaataccgtggccgcgccgcttgagcaggcgatcaacggcgtcgacgacatgctgtacgtgcagtccatcagcgccagcaacggccagttgacgctgaacgccacgttcaagatcggcaccagtccggaccaggccaccatcaacgtcaacaaccgcgtgcagtcggcgctggcgcagctgccggaagaggtacggcgccagggcgtatcggtgcgcaagcagtctgcggcgttcctgcaggtgatcgcgctgtacgcggagaaggggcgctacgacaccctgtacatgagcaactacgcgctgctcaacgtggtggacgaactcaagcgcattcccggcgtaggcgacgtgatcaacttcgccggccgcgactattcgatgcggatctggctcaagcccgatcgtctggcgcagttgaagctgacgcccagcgacgtggtcgccgccatccgcgagcagaacgcgcagttcgccgccggcaagctgggcgccgagcccagcaaccaggcgctggactttacctacaccgtcaccacccgcgggcggatgagcacgccggaggagttttccaacatcatcgtgcgcgccaatccggacggctcggcggtattgctcaaggaggtggccaaggtggagctgggcgcgttgaactatgacttcaacggcaagatcaacggcgatccgatggcgccgatcgggattttcctggcgccgggcgccaatcagctggaaacggccaaagcggtcaaggacacgatggccaggttgtccggccgcttccccgacggtctgaaataccgcatcccgttcgattccaccaagtttgtcgaggtgtcgatcgaggaagtgtacaaaacgctggccgaagcgatggcgctggtatttctggtggtgttcctgttcctgcagaactggcgcgccacgctgatcccgtgcctggcggtgccggtgtccatcgtcggcactttcgccggcatgtacgccttcggcttctccatcaacctgttgacgctgttcggcatggtgctggccatcggcatcgtggtggacgacgccatcgtggtgctggaaaacgtcgagcgcatcatgagcgaggcgaaggtttccgccaccgaggccaccctccaggcgatgaaagaagtgtccgggccggtggtggccatcgtgctggtgttgtgctcggtattcgtgccggtggctttcctcggcggcatcgccggccagatgtacaagcagttcgccatcaccatcgccatttcggtcagcatttccggcctggtggcgctgacgctgaccccggcgctgtgcgcgctgatcctgcggccggggcaccagagccgcaatcgtttcttcgactggttcaaccgcaacttcgacgccgtgggcggccgctacgtgcgcggcgtggcgttcctgtcgaggcgcagcgcgctgggcctggcgctgttcggcctgctgttgctggtgtcggcatggctgttccgcgccatccccaccagcctggcgccggatgaggatcagggttatgtgatcgcggcggctttcttgcccgacggcgcgtccttgcagcgcaccgccaaggtgatggacaagctggaccatctggtttcgcgcaatcccgcggtgaaggacatgctgtcgatgtccggcttcgacatcgtcaccggcggcaagaagaccaatgccggcgtctccttcatccagctgcagccctgggaggaaaggcgcggcgcggcgcagtcggcgcaggcggtggtcggcgacatcttcgccaagaccggcgccggcatccgcgacggcttcattttcgcggtcaatccgccgccgatctccggcatgtccaataccggcggttttgaaggctatctgcagaaccgcaacggcgcgtcgccggccgagctggaaggcgtgtcgcggcaattcctcgccgccgcggccaagcggccggagctggccggcgtgcagaccacctattcggcgtcggtgccgcaggtgtacatcgagctgaatcgggccaaggccaaggcgctcggcgtgccgatcaacaccgtgttcgataccctgcaaagcacgctgggcgagctgtacgtcaacgacttcaacaagttcggccggactttccgcgtgcagctgcagtcggaagcctcctaccgcagccacagcgacaacctggccaaggtcttcgtgcgctccacctctggcgccatggtgccggtgacggcgctgctggacatccagcgcagcaccggtccggaagtgctggagcgctacaacctgtatccgtcggccaagctgatcggcggcccggcgccgggctacagctcgggcgaggcgctggcggcgatggagcaggtggccaaggaaacgctgcccgacggctacgcgctggcctggaccggcagcgcgctgcaggagaaggcggccggcggctcctccgccaaggtgttcctgttcggcatcgtcgtggtgttcttgatcctggcggcgcagtacgaacgctggaccctgccgctggcggtgttgctggccgtgccgttcgcggtgttcggcgcgctggtggccaactggacgcgcggcctcgccaacgacatctacttccaggtggcgctggtgacgttgatcggcttatcggccaagaacgccatcctgatcgtggaattcgcgatgctcaagctggacgagggcatggagttggtgcaggcgaccatgcaggcggcgcgcatgcgcttccgccccatcgtgatgacgtcgctggcctttgtgctgggttgcgtgccgctggccgtttccagcggcgccggctccgccagccgccactcgatcggcaccggcgtgatcggcggcatgctggccgccactttcatcgccaccttcttcattcccttgttcttcattctgatcatgaaggcattccataaaaaagccccggcggctgcggcggccgaggaggaggtgctcaatgtttaa

SEQ ID NO: 438 - DNA, 1389 bp, Chromobacterium substugae
atgtttaaaccgctatttctcgccgccgcgttgagcgccgccctggcggcttgcgcggcgggccccgactaccagcgccctcagctggcgttgcccgacggccaggcgcaggcggcggccgacgtggccggctggtggcggcaattccaggagccggagctggaccggctgattgccgtcgcgctggcgcgcaaccaggatctgagcgaagcggacgcccgtctggcgcaggccgaggcgctggccggcatcgcccgcagccagctgctgcccaggctggacgccgccgccgacagccagcgccagcgcgtcagcgcgacgctgcccgccacggcgccgggcggcctttacgacagccgcgatttcaatctgcgggcatcgtgggagctggacctgtggggccgcctgcggcgcgagcgcgaggcggcggtttccctcgccgccgccagccaggccagccgcgacggcctgaggctggcggtggcggcgcaggtggcgcaaacctatttccagctgcgcgcctacgatgcgcaactggaagtctcccggcgcacgctggccaaccgccgggccgccgcgacgctgaacgagaagcgcttccgccagggcgacgcgtcggaactggactggcgccaggccgaagcggaggtggcggtggccgaggccagcgccgcgcagttcgagcgcagcgtggcgcagaccgaaaccgcgctgggagtgttgctgggacgcgagcccagacagttgctgggcgagggaatcgcgcgcggccaggcgctggatgcgctgagcctgccgccggccttgccttccggcttgccgtccgacctgctggcgcgccggcccgacatcgccgccagcgaggctggcctggtggcggccaatgcccgcatcggcgtggccaaggcggcctattttcccagcatcagcctgactggcgcgctgggcagcgccagcccggatttgcgccagttgttcagcgggccggcctatgtctggagttttgccggcaacctggcggcgccggtattcaactttgggcagacggcgggagcggtggacgtggccagcgccggccagcagcaggcgttggcgcagtaccgcaaggcggtgcagctggcgttcaaggatgcggcggacgccttgagcgccatggcggcggcacggcgcgtcaacgatgcggaaaccgcgcgcgtcaaggcattgcagcgggcggtgcggctggccactttgcgctatgacagcgggcactccgcttacctggaggtgctggatgccgaacgcggcgcgttccagtccgaattgagcgcggtggatgcccggctggatctgttcaacagcgcggtggcgctctacaaggcgctgggcggaggctggcgcgcgagctag

SEQ ID NO: 439 - DNA, 2919 bp, Chromobacterium substugae
  modified_base (2582)..(2582): a, c, t, g, unknown or other
agctccagacgatgcggatagtgccgcttgactccatgaagtcgtccagcaccagctccagcgtgccgtccgccagcgcgtcgcgcaccgagaaatccggcacgcaggcgatgcctttgtcacgctgggccaggtagatcagcgcttcgctattggtgcagatcacggtgctgggcagcagcggggccggttcgccggggagagggcgcagcggccagcgcgccagtttgccgctgttgggaaacttgtattgcaggcaggcatggcgttgcagatcggccggccgttgcggccggccgcgctcgctcaggtagcccggcgcggcgaccagcaccaggcggaacgagcccagtcggcgcgccagcaggcgggagtccagttgctcgccggagcggatcgcggcgtcgaagccttcttcaatcaggtccaccagccggtcgctgtagtcgagatccagctcgacctccggatagaggctcatgaattcggccagcgcggggttgaacagattgccgtccggcaggctgacgcgcaaccggccgcgcggtcggtcggcgctttgcgccagctcgctttccgcggcatccagctcggcgaagatgcgctggcagcggcgcagaaacagctcgccttcggcggtcagcgccatgtgccgggtgctgcgctgcagaagccgtatgcccagcctttcctccagcctggcgatgcttttgccgactgccgaggcggagatgcccaattggcgtccggcggcgacgaagctggaggtttccgccacttgtacgaatacgtgtatcccgttgagtttttccatggtggcgttcgaattgcggacaaatttatccgcataaaatggaaatctaacatgtttttatgcttttggtcttgccttatgctggtgtgactggcaaaggccatccatgacatcgctaagaaaggaagagttatgctgactgcggaattgtccaacccggtagtgcagccgggagtgcatcaatacggtatcgccgagcggatcgacgacgccatccatcgcgcgctggccgagcagaggctggtcggcgcggtggtgctggtaagcgtcgacggcaagctgatctaccaaggcgccaagggttgggccgaccgcgaggcggaacggccgatgacggcggacgccctgttccgtttgtcttctttgagcaaggtctacgtgtccaccgcggcgctggcgatggtcgaggcgggcatcatcggcctggacgacgctgtcacccgttggctgccccattttgcgccggccttgccggatggccgcattccggaaattaccgtccggcatctgctgacgcacaccgccggtctcggctacggtttcctggagggcgagcaaggcggtccttacaagcagatgggcatttccgacggcatggaccattcggtgctgtcgctgcgggaaaatatcgaacggctgggccaagcgcctttgctggccgagccgggcagcgcctggatctattcgctggcgaccgacgtgcttggcgaagtgctggagcgcgcgacgggcagccatctgcatgaagtggtgcgcaaatgggttaccgagccgctgggcctgcaggacacccgcttcgccgccagcgattaccgccgtctgaccacggtgtacgtcaacgagcagccggcgccgcggcggatgcgcgacctggagctggtgccgattctggaaggcttccgcggcgtcagcctggccccgggccgcgcgctggatcacaacgccttcccctccggcggcgccggcatggtgggaaccgcgggtgatttcatgaccttgctggaatcgctgcgcagcggcggcggacctttattgtcggccgccatggccgcggaaatgggtcgcaaccagactggagacttgccgctggccccctggccgggccggggatatggcctgggtttcaccgtgttgaccgatccgcaggcggccaatacgccggagtcgccgggcagctggcggttggcgggggtgttcggccattcgtggtttgtcgatccggccaagcgcatcagtgtggtggcgctgaccaataccttgctggaaggcatgctggggcagtttaccgtcgatatctgcaacgcggtttacggccaggtttgagaggcgggggtttgtctgccaaaacggcccggcggcgatgccgggccgatttcgtatggccagcgcgcagggccgtgccgaccgcgtctggcttttaagtcgcatggctggacaaattaagatggcagaattgttaacgcgtattgctgagacatataatgcttttttaattcacttaattggaattttgtcgctgtgaaaacaaaattccggcccgcatcgtcatggacctcaccaacctgctgtcctccttcgcctccgccttcacccaggaccgccgccagctcaccctgcaactgggcgacggccatgtcgcggccgagcagctgctgccgcaaagcctggacggcgaggaaggcgtgtcccggccctatcgcttcaccctgacctgcctgtcgcccgacggcgccatcgcactcaagaccctgctcggtcaatccgcccntggtacgtgagctgggttcaaaacgtcgtgagacagtttggtccctatctgcagtgggcgttggaagtttgacgggggctgctcctagtacgagaggaccggagtggacgaacctctggtgtaccggttgtcacgccagtggcatcgccgggtagctaagttcggaagagataaccgctgaaagcatctaagcgggaaacttgcctgaagatgagacttccctggaggcttgacctccctgaagagtcgttcgagaccaggacgttgataggtcgggtgtggaagcgctgtgaggcgtgaagctaaccgatactaattgctcgtgaggcttgatcct

SEQ ID NO: 440 - DNA, 118 bp, Chromobacterium substugae; identical to SEQ ID NO: 426

SEQ ID NO: 441 - DNA, 1155 bp, Chromobacterium substugae
atgcaaacccgacacagcctgctgctgtgcgcgctggtagccggcgtcgccgcctgcaacaagcctgccggccagacttcatccaacgacaaggccgccgaagacaagatcgtcgtcaagatcggcaccgccaatccgctgaccggcccgttcgcccactggggccgcgacgccgacgacggcgtcaagctggcggtacaggaagccaatgccgaaaaactggtgctggacggcaagccggccagcttcgaagtggtgtcggaagacgaccaggccgatcccaaggtagccacccaagtcgcgcagcggatggtggacgccaaggtggccggcatcgtcggccacctgacttccggcgcggccatccccgcgtcccgcatttactccgacgccggcatcccgatgatttccggctcggtcaccagcccgtccttcacccagcaaggctatcgcaacaccttccgcctgatcgccaacgaccagcagcaaggcgaagcgctggccaagtacgcggtgggcaagctgggcgccaagcgcgtggcggtgatcgatgaccgcaccacctacggccagggcctggcggacgacttcgccaaagcggtggaacaggccggcggcaaagtggtgaagcgcgagttcaccaccaatagcgccaccgacttcatggcggtgctcacctcgatcaagggagaaaagcccgatctgctgttctacggcggcatggatgcccaggccggcccgatggtcaagcagatgggcaagctcggcatcaaggcggccttcatgggcgccgacggcgtcaacacgccggaattcgccaaactgggcggcggcagcgccgaaggcgcctatgcctccagcgccggactgcccaaggaaaaactgcccggctacgccgacttcaaccagaagttcaagcagcaattccagaccgaaatccaggcctacgcgccgtacaactacgatgccgccaaggtgctaatcgcggcgatgaagcgcgccggctccgccgatccggccaaatacctgccggaagtcgccaagaccgattaccagggcgtcaccggcccggtgaagttcgacgccaagggcgacatccagcaggcgacggtatcgctgtatcaactgaagcaaggcaagtgggtaggcttgtaa

SEQ ID NO: 442 - DNA, 1404 bp, Chromobacterium substugae
atgcttaagcgcgccctgattcccgtcgccgtcgcgctggccgtatccgcctgcgcggtcggtcccgactacagccggcccaaggtcgagctgcccgcggcccaggccggcgcccaagcgccggcgctggacgccgactggtggcagcgtttcgacgacccggcgctgaaccagctgatcgaggaggccgtgaagagcaacctcgacctgcaggccgccgccgcccgcgtcgaacaggccgccgcccaggccggcatcgcccgcgcggcgctgctgccctcgctcggcgccaatgccggctaccagagcggccgcacctcggccctcaccaccagccccggcaccccgctggtcaacgacgtgcgcgcggccaacctgaccgccgcctgggaactggacctgtggggcaagctgcgccgcagcaacgaagcggcgcgcgccggctacatcgccagccgctacgaccgcgacgccgcccagctggcgctgacggcccaggtagcgcaaacctacttccagctgcgggcgctggacgcccagctggacatcgccaaacgcacgctgcaaagccgcgaggaatcgctgaaactgcagaccaagcgctttcacggaggcctgatttccgagctggaccagcgccaggccgaagcggaagccgccgcggcgcgcgcctcggtgccgcagatcgcccgctcgctggaacagaccgaaaccgcgctgggcgtgctgctgggccacagccccaaacagctggccagcggcgatctcacgcgcggcaaggacatcaacagcctggccagcccgcccgacgtgccggccgacctgccggccagcctgctggagcgccgccccgacgtcgcctccagcgagcagcagctgatcgccgccaacgcccgcatcggcgtggccaaggccgcctacttccccagcatcaacctgaccggggcgttgggctcgcaaagcctgtcgctggacggcctgttcaccggcccggcccgcacctggggcttcgccgccaacctggccgcgccgatcttcaacttcggcgccaccggctatggcgtggatgccgccagcgccgggcagaagcaggcgctggcgcagtaccagaagtcggtgcagtcggcgttcaaggacgcgctggactcgctggccgccaacagcgccgcgcgcgacatcgtgcaggcgcaaaccacccagctcgccgcgctcaaccgcacgctgaaactggccggcctgcgctacgacaacggctactccagctatctggacgtgctggacgcgcagcgcaacagcttccaagccgagctgaacctggtcagcgccaagctggaccgcctcaataccacgataggcgtgtacaaggcgctgggcggcggctggcaagcgcccaaaccgcaataa

SEQ ID NO: 443 - DNA, 3141 bp, Chromobacterium substugae
atgttttccgctttcttcatccggcgacccatcttcgccagcgtgatctcgatcgtgatcatgctggcgggcctggccgccatcaaggcgctgcccatccagcagtaccctgaaatcgtgccgccggtggtgaacgtcaccgccagctatccgggcgcttccgccgaagtgatcgccaacaccgtggccgcgccgctggaacaggcgatcaacggcgtggacgacatgctctacgtgcagtccaacagcgccagcaacggcacgctgtcgctgaccgtgtcgttcaagatcggcaccaaccccgaccaggcgaccatcaacgtcaacaaccgcgtgcagtcggtgctgtcgcagctgccggaggaggtgcgccgccagggcgtcaacgtccgcaagaaatcggccaccatcttgcaggtggtgtcgctgttctcgcccgacaacagccatgacacgctgttcatcagcaactacgcgctgctcaacgtggtggacgagctgaagcgggtgcagggcgtgggcgatgtggtcaacttcgccggccaggactactcgatgcggatttggctgaagccggacaagctggcgcagctgaagctgacccccagcgacgtggccgccgccatccgcgagcagaactcgcagttcgccgccggcaagctgggcgccgaaccgacgccgcagaagctggacttcacctacacggtgaccaccaagggccgcctgtccgagccggaagagttcgaaaacatcatcgtgcgcgccaatccggacggctccgcggtgaagctgaaggatgtggcccgcgtcgagctgggcgcgctgtcctatgacttccacggcaagcacaacggcaaggccaccatcccgatcggcatcttcctggcgccgggcgccaaccagctggccaccgcgcaggcggtggaaaccgaaatgctgcgcctgtccaagagcttcccgaccggcctgtcctacggcatcccgtacgacaccaccaagttcgtcgaagtatcgatcgaagaggtgtacaagacgctggccgaagccatggtgctggtattcctggtggtgttcctgttcctgcagaactggcgcgccacgctgattccctgcctggcggtgccggtgtccatcgtcggcgccttcgccggcatgtacgcgttcggcttcaccatcaacacgctgacgctgttcggcctggtgctggccatcggcatcgtggtggacgacgccatcgtggtgctggaaaacgtcgagcgcctgatgacgcaggaaggcttgtcgccgcgcgaggccagcctgaaagcgatgcaggaagtgtccggcgcgctggtggccatcgtgctggtgctgtgctcggtattcatcccggtggccttcctgggcggcatcgccggccagatgtacaagcagttcgccatgaccatcgcggtatcggtggtgatttccggcatcgtcgcgctgacgctgactccggcgctgtgcgcgctgatcctgaaggccgagcaccagcacccgaaccgcttcttcacctggttcaacaattggttcgaccgcctgaccagccgctacaccaacggcgtggccttcatcaacaagcgcgccatgctggcggtgctgctgttcggcggcctgatcgccgcctccgccggcctgttccgcatcattccgtccagcctggcgccggacgaggaccagggctacatcctggccgcagccttcctgcctgacggcgcgtcgctgacccgcaccgccgccagcatggacaagctggatgccatgatggccaagaacccggcggtgcaggaccggatgactttcgccggcttcgacatcctgtccggcggcaacaagaccaacgccggcgtgtccttcatcgtgctcaagccctgggatcaacgcaaagatccgcagctgtcggcgcaagccgtggtcaaggacgtgttcggcaagggcatgatgggcatcagcgacggcatcgtgctggccttcaacccgccgccgatctccggcatgtccaacaccggcggcttcgaagcctatgtgcaggaccgcgccggcggcaccccgaccgcgctgggcgaagtcaccaagaaaatggtggccgccgccgccaaacggccggaactgaagggcgtgcaaaccaccttctccgccagcgtgccgcaagtcttcgtccaactggaccgcgacaaggccaaggcgctgggcgtgccgatcaacagcgtgttcgacaccatgcagagcaccttcggcgcgctgtacgtgaacgacttcaacaagttcggccgcaccttccgcgtgcagctgcagtcggaggcgccgttccgcaccaaggtggacgacctgcgcaacgtctacgtgcgctcgcagaccggccagatgatcccgctgaccgcgctggtgaacatccagcaaaccaccggcccggaaacgctggaacgcttcaacgtgttcccggcggcgaagctggtgggcggcccggcgccgggctacagctcgggccaggcgctgaccgcgctggaggaagtcgccaaggaaacgctgcccgcgggctatagcctggcctggaccggctcggccttccaggaaaagtccaccagcggctcgtccgccctggtgttcggcttcggcatgatcatggtgttcctgatcctggcggcgcagtacgagcgctggagcctgccgatctcggtgctgatggcggtgccgttcgcggtgttcggcgcgctgatggccaactggctgcgcggcctggccaacgacgtgtacttccaggtggcgctggtgacgctgatcggcctgtcggccaagaacgccatcctgatcgtggagttcgcggtgcagaagatggaagaaggcatggaggcgatggaagcggcgctggaagcggcccggctgcgcttccgtcccatcgtgatgacctcgctcgccttcgtgctgggttgcgtgccgctggccatttccagcggcgccggctccgccagccgccactcgatcggcaccggcgtgatcggcggcatgctggccgccaccttcatcgccaccttcttcatcccgctgttcttcatcctgatcatgaagttcggcaagaaaaaacctcaaccggcggttgaggcaggagagaactcagatgcttaa

SEQ ID NO: 444 - DNA, 1182 bp, Chromobacterium substugae
atgcaaggaactgcaactctcccgcgcgccgcgcgcggcctgctgttgggcgcgctggcagccagcctggccgcctgcggacaaaagcccgacgccaaggccggcgccatgccgccggtgccggtggccgtgatcaaggtcgaaccggccgacgtgccggtatcgtatgaattcgtcggccaggcggccggctcgcgcgaagtcgaggtgcgcgcccgcgtcggcggcatcctgcaaaaacgcgcttacgccgaaggcaaaccggtgaaggccggcgacctgctgttccagatcgatccggagccgttcaaggcggcgctggaccaggccaagggcaatctgcaggtgcagcaggcgcaattgctgcgcaccaagcaggactacgaccgggtaatgccgctgttcaaggaaaacgccgtcagccagaaagaccgcgacgacgcggtggccgccttcaacgccgccaaggcgcaagtggcctccgcccaggcgcaactggagcaggcgcagatcaatctgggctacacccgcgtcaccgcaccgatttccggcatcaccagccaggaagcccgctccgagggcagcctggtggccaccagcgccgacgccagcctcttgaccaagatctcgcagctggacccgatctacgtcaacttcagcatgtccgacggcgacatgctggcgctgcgcaagatgcagcacgccggcaagctgaagctggccaatggcggcggcttcgaagtgcagctgaagctgccggacggcagcgtctacggcaagaccggccacctgaacttcaccgacagcctggtcgacaccaataccggcaccatccgttcgcgcgccagcttcgccaatccgcaaggcggcatcctgcccggccagttcgtccgcgtgcagctgaacggcgcggtgcgcaccgccgccatcaccgtgccgcagcgggcggtgctgaccacccagcaaggcaagatggtgtgggtggtggggccggaaggcaaggcgcagccgcgcccgatcacggtatcgcaggaagtcggcctgagcgtgctggtcgagcagggcctgaaggccggcgaccaggtggtagtcgacaacatcatcaagctgcgcccgggcgccgacgtgaaaccgcatccgttccaggcggacgccagcgcgcccgcggcagcggcccagtaa

SEQ ID NO: 445 - DNA, 642 bp, Chromobacterium substugae
atggcacggaaaacacgtgaagaggccgagcagacccgccagctgctgctggatgccgccgagcggctgttcagcgagcagggcgtgtcgcgcacctcgctggcggaaatcgccaccgcggcgggtctgacccgcggcgcggtgtactggcatttccagaacaagctggacctgtaccgcgcgatgctggaccgggtttcgccgtctttcgacgatatgcgcgagcaactgttgcgaaccgccgacaccgatccggcgcgggcgctgtgggagcacagccaccgcctgctggcgctgatcgagcataatcctcaggtgcggcgcatcctgctgatcctgtttttgcgcagcgagcacgtcggcgagctagagcctatccacgaggagtgcgtggcgcacatgcacgaggcgcgcggcttgctgagccatgtggtgcaggtggccaaggacagggggcaggcgtatgcctgcgtcgagccggaagaggcggcgacggtggtgcaggcgctgcacgacggcctgatgcacaagctggtgatagagcagccggggccggacgccatgctggcggccagccgcttgttgcaatatttgtaccgcggcatcttcacgcctgaaatcatggaacaacttaccacctga

SEQ ID NO: 446 - DNA, 903 bp, Chromobacterium substugae
atgtcccacgcaatcgaaatcgaggccgtcagcaaacgctacggccagctgcaggcgctggataaggtgagcttcaccgtcgagcccggcgaattcttcgcgctgctcggccccaacggcgccggcaagaccacgctgatctcggcgctggccggcttggcgcgccccgacagcggccgcatccgggtgatgggccacgacgtggtgcgcgatttcaagcaagcgcggcgcgccctgggcgtggtgccgcaggagctggtgttcgaccccttcctgtcggtgcgcgaaacgctgcgcttccaatcgggctacttcggcctgtcccgcaacgacgcctggatcgacgagctgctgttcaaactgggcctggccgacaaggccgacagcaatatgcgcgcgctgtccggcggcatgaagcgccgcgtgatggtggcgcaggcgctggtgcaccgtccgccggtgatcgtgctggacgaacccaccgccggcgtcgacgtcgagctgcgccagagcctgtgggtgttcgtgcaggagctgaaccgcgccggccacgccatcgtgctgaccacccattacctggaagaagccgaaacgctgtgctcgcgcatcgccatgctgaagaagggcaagctgctggcgctggaaagcaaggacaagctgctggcccacagcgcgcgccgcgaagtggcggtgaagctgtccggcgcgctgcccgacagcctgctgccgcgcaagctgcgcgacgaggatggccgggtggtgctgcaactggccgagctggccgaactggaaacggtgctggccaccttgcgccaggccggcgtcgacgtgcgcgaattgaacgtggtggaggcggacctggaaagcgtgttcgtcaagatgatgaacgggagcgcggcatga

SEQ ID NO: 447 - DNA, 756 bp, Chromobacterium substugae
atgataggttttctcaccctgttcaagaaggagctggtgcgtttctggaaggtatcgttccagaccgtggccgccccggtgctgaccgcgctgatgtaccagctgatcttcgcccacgtgctgtccaagcacgtcgaggcctatcccggcgtcggctacaccgcttttctgattcccggcctggcgatgatgtcgatggcgcagaacgccttcgccaacagctcctccagcctgatccagtccaagatcaccggcaacatcgtgttcctgatgctgccgccgctgaccgcgccggagttcttccttgcctacctgctggcctcggtggtgcgcggcctggcggtgggcgccggcgtgctgctggtcaccgcctggttcggcctgccgttgccggcccagccgctgtgggcggtgctgttcgcggtgctgggctgcggcgtgctgggcacgctgggcgtgatcgccggcatctgggcggagaaattcgaccagctggccgccttccagaatttcctgatcatgccgctgactttcctgtccggcgtgttctattccatcaacagcctgccgtcgttctggtacgccgtgtcgcacgccaacccggtgttctacatgatagacggcttccgctacggctttttcggccaggccgacgtcagcccctggctgtccgccggcgtggtgggcggcagcttcgccgcgctggtgtctttggccctatggctgatccactccggctacaagctgcgccactga

SEQ ID NO: 448 - DNA, 246 bp, Chromobacterium substugae
atgaccgaacagcaagtcaagcaatacatcgaggccggcctcgaatgcacttacctgaaagtggagggcgacggccaccacttctacgccaccgtggtttcggccgccttcgagggcaagcgcctgatcgaccgccaccgcatggtgaaggaagtgatcgccgcccgcctggccagcaacgaaatccacgcgctctccatcgtcaaggcggccacgccggacgagtgggccaaactgcaagcttga

SEQ ID NO: 449 - DNA, 1254 bp, Chromobacterium substugae
atggataaactgaaaatcatcggcaacggcccgctcaacggcgaaatccgcgtctccggcgccaagaacgccgcgctgcccattctgtgcgccagcctgctgaccggcgacaccatgcgtttcaccaacgtgccgatgctgcgcgacatcgccaccacccagaagctgctgcagggcatgggcgtgcgggtgatgaccgacaatgtccacgagatggagatcaccgccggccagctggacagcctggtggcgccgtacgatctggtgaagaccatgcgcgcgtccatcctggtgctgggcccgacgctggcgcgcttcggcgaagccacggtcagcttgcccggcggctgcgcgatcggcagccgtccggtcgaccagcacatcaagggcctggtggcgatgggcgccgaggtgtcgatcgagcacggttacgtgaaggcgcgcgccaagcgcctgcgcggcgcccgcgtggtgatggacatggtcaccgttggcggcaccgagaacctgctgatggccgccaccctggccgaaggcaccaccgtgctggaaaacgccgcccgcgagccggaagtgaccgacctggcccactgcctggtggcgatgggcgccaagatctccggcatcggcaccgaccgcctggtgatcgagggcgtcgagcgcctgcacggcgccgactactcggtgatgccggaccgcatcgaggccggcaccttcctggtggcaggcgcgatgacccgcggccacgtggtgctgaagaacgccgcgcccaagagcatggaagcggtgctggacaagctgcaggaaaccggcgcgctgatcgagtgcggcgacgactggatctcgctggacatgaagcagcgtccgaaggccgtcaacttccgcacgctgccgtacccggccttcccgaccgacatgcaggcgcagctgatgacgctgaactgcgtggccgaaggcgccggcgtggtgaccgagactatcttcgagaaccgcttcatgcacgtgccggaactgaaccgcatgggcgccaacatcgaagtggaaggcaacaccgccatcgtcaagggcgtggacaagctgtccggcgccaccgtgatggccaccgacctgcgcgcctccgccagcctggtgatcgccggcctggtggcggaaggcgaaaccatcgtcgaccggatctaccacctcgaccgcggctacgagcatatcgagaagaagctgggcgccgtcggcgcgctgatcgaacgcatcagctga

SEQ ID NO: 450 - DNA, 339 bp, Chromobacterium substugae
atgagtcaattgcccgcctgcccgcaatgcggatcggaatacacctaccaggacggcgcgatgttcgtgtgccccgagtgcgcgcacgaatggaacgagcaaagcgccgcgccagccgaggaacagcgcgtggtgcgcgacgcggtcggcaacacgctgcaggacggcgacagcgtcaccgtgatcaaggatctgaaggtcaaaggctcgtcgctggtggtcaaggtcggcaccaaggtcaagaacatccgcctggtggacggcgaccacgacatcgactgcaagatcgacggcatcggcgcgatgggcctgaagtcggaattcgtcaagaaagcctga

SEQ ID NO: 451 - DNA, 810 bp, Chromobacterium substugae
atgcgccgcatcctgcccctagtcgccattctgctgctggccggctgcgccagcgcgccggccacgccgtacgacccgtacgagccttacaaccgcacgatgttcaaggtcaacgacaccgccgaccagtgggtgctgcgcccgctggcccagggctaccagaaagtggtgccctcgccggtgcgcaccggcgtcggcaacttcttcgacaacctgaaggatgtctacagcttcgccttcaacgtgctgcgcgccgagccggaaaaagccgccaacgacttcatgcgcgtggcgatcaactccagcttcggcttgttcggcctgatcgacatcgccgaccaggctggcctgaagaacaacaagaccacgctgggcgacacgctggccacctggggctggaagagcagcaactacttcgtgctgcccttcttcggcccgtccaccgtgcgcgacagcgccggcctgggcgcgtcgctggccggccccggcccggagcggctggtctaccacaacagccgggaggccatcgccttctacggcgtctacggcgtcagcacccgcgccaagtatctgggcgtggacggcttgctggacaccgccgcggtggaccgctacagctacacccgcgacgtctacatgcagctgcgcgccaagcagctgggacagccggatccgacccagccggccgacaacctgaacctggacgaactgatggactcgccgggaccgggcggcaagagcgacagctccgcgccggccgcgcatgcggtggagagttcggcgccggccgcggcctccgccgcccagtaa

SEQ ID NO: 452 - DNA, 288 bp, Chromobacterium substugae
atgctgaagaccaccgcccccggcgaggccagcctcagcgggcgcatcgacatggcggccagcgccggactggcgcgcgcgctggccgagctggcggcgcgcggtccgctgcggctggacctgtccggcatcgaggcggccgactcgtcggcgctggcgctgctgctgcaggcgcgccgcgccgccgccgccgccggccacgcgctgaccttcgccggcatgccggcgggtctggccaccctggccggcctgtacgatctgggccccctgctatccgccggagagtga

SEQ ID NO: 453 - DNA, 636 bp, Chromobacterium substugae
atgaaaaaactgtttaccctgttctgtctgatcgtcggcctgtcgtccacccaggccatcgccgccgccgactccccggttgaaatcatcaaggacggttcgcgccaggtgctggacatcctgaagcaggacaacggcaagaacaccaagcaggtgcgccagcaggccgaagccgccgccgtgccgctgttcgatttcccgcgcatgaccgcgctggcggtcggcctgggctggcgccaggccaccccggagcagcgcacccagctgacccagcagttccagaccctgctggtgcgcacctactccaccaccatgacccgcttcaaggccgcccaggtcgacgtgaaggccaacccggccctgtccgccaacggccgcgacaccaccgtcaagaccagcgtcaccctgccgggcaacgccaacccagtgtcggtggattacgtgatgtacaagggcgacaagggctggaagatctacaacgtcagcgtcgaaggcgccagcctggtcaccgtctaccgcaacagcttcaacgaagaaatccagaaaaccggcgtgaacggcctgatcaagctgctgcaggacaagaacgccaccccggccgccgccgctgccgctgccggcaagggcaaaccctga

SEQ ID NO: 454 - DNA, 468 bp, Chromobacterium substugae
atgaaacgctctaccattgatttatgggtcggcatctttgttgctctgggcatcgccgccgtcgccttcctgtcgctgaaagtggccaacctgacgccgcagagcgcgtcgcaaacctacgtcgtctacgccgacttcgacaacgtcggcggcttgaaggtaaaagcgccggtcaaggaggcgggcgtgctggtgggccgcgtggccgacatccgcctggacccgaaaacctaccgcgcccgcgtcgcgctgaacatcgacaagacctaccagctcagcgacgacgtcagcgcctccatcctgacctccggcctgttgggcgagcaatacatcggcctgcagcagggcggctcggaaaccaccctggccgccggcggcaccatcaccatcacctcgtcggcgatggtgctggagcagttgatcggtaaattcatgaccggattttccggcaaagacgcaagcaaatag

SEQ ID NO: 455 - DNA, 786 bp, Chromobacterium substugae
atgcttgatttcctgacttcgccgctgcgccggctcggccacgccaccatcaacgcggtatggcggctgggcttcgccgcccgcttcctggccgccatcctgctcaacagcggccagagcctgctcaggctgcagctgaccatacgcgagatctacttcgccggcgtgatgtcgctgatcatcatcgtcgtctccggcctgttcgtcggcatggtgctgggcctgcagggctacaccacgctggccaagttcggctccgccgacgcgctgggcgcgatggtggcgctggcgctgctgcgcgagctgggcccggtgctggccgcgctgttgttcgccagccgcgccggcagcgcgatgaccgccgaaatcggcctgatgaagaccaccgagcagctggacgcgatgagcgtgatggcggtcaacccgatggcgcgggtgatcgcgccgcgcttctgggccggcgtgatctccatgcccatcctggccgcgctgttcaacgtcgtcggcgtgttcggcggctatctggtgggcgtggtgatgataggcctggacgccggcaccttctggtcgcagatgcagggcaatgtcgacctgcactacgacgtgatcaacggcctgatcaagagcctgtgcttcggcgtcgccatcacgctgatcgccgtgttcgaaggctacgacgccaccccgaccgccgccggcgtgtcggccgccaccacccgcaccgtggtcacatcggccttggtgatcctggcgctggatttcgtgctgaccgccttcatgttctag

SEQ ID NO: 456 - DNA, 819 bp, Chromobacterium substugae
gtgtcctcagaccatttcatcgaattcaggaacgtcagcttcgcctacggcgaccggcccatcctgaaagatctcaccttgggcgtgccgcgcggcaagctggtggccatcatgggcggcagcggcagcggcaagaccaccctgctcaggctgatttccggccaaatccgcccgcaagcgggcgaagtgctgatagacggccgcgacatcgccaggatgagccaagccgagctgtaccagcaccgccgccgcatgggcatgctgttccagttcggcgcgctgttcaccgacctgtcggtcgccgacaacgtcgccttcccgctgcgcgagcacaccaagctgccggaaaacatgatccgcgacctcgtcaccatgaaactggaggcggtgggcctgcgcggcacccagaagctgatgccggccgaactgtccggcggcatggcgcgccgggtggcgctggcgcgcgccatcgcgctcgacccgcagctgatgctgtacgacgagccgttcaccgggctcgacccgatctcgctcggcgtgatcgcgctgttgatcaagaaactcaacgacgcgctcggcaccaccgcggtgatggtgacgcacgacgtgcaccagtcgctggccatcgtcgaccacgtgctgttcgtcgccaatggccagatcatcgcccagggctcgccggacgaagtccgcaactccgattcgccgtgggtgacgcagttcatcaacggcgaggccgacggccctgtgcattacaactatccggcggccagctcgctggccgccgacctggggctgcaagggggcgcgcatgcttga

SEQ ID NO: 457 - DNA, 861 bp, Chromobacterium substugae
atgacgacatccatccacattgccaaaggactgaaccagatgcatccgatccaaagcctgatcgaacaggcattcgagaaccgcgccgaaatcacccccgccaccgtgtcggcggaactgaaggcggcgatagaccaagtgatcgccgagctggacagcggccgcctgcgcgtcgccgagaagcaaggcgccgactgggtggtcaaccagtgggtgaagaaggccgtgctgctgtcgttccgcatccgcgacaacgcggtgcaagacgacggcgtgtcgcgctacttcgacaaggtggacaccaagttctgcgactggaaccaggcccgcttccaggaagccggcttccgcgtggtgccgggcgcggtggcgcgcaagggcagcttcatcgccaagaacaccgtgctgatgccgtcctacgtcaatatcggcgcctacgtcgacgaaggagcgatggtggacacctgggccaccgtcggttcctgcgcccagatcggcaagaatgtgcacctgtccggcggcgtcggcatcggcggcgtgctggagccgctgcaggccaacccgaccatcatcgaagacaactgcttcatcggcgcgcgctcggaaatcgtcgaaggcgtgatcgtcggcgaaggctcggtaatctcgatgggcgtctacatcggccaatccaccaagatctacgaccgcgaaaccggcgaagtgatgtacggccgcgtgccgccgggctcggtggtggtgtccggcaacctgccgtccaaggatggcagccacagcctgtactgcgcggtgatcgtcaaaaaggtggacgcgcaaacccgcagcaagaccagcatcaacgaactgttgcgcggcgtctga

SEQ ID NO: 458 - DNA, 1206 bp, Chromobacterium substugae
ttgaacccacgcctggcccaactgcatccttatccgttccagcgcctggccgcgctgctggctgattgccgcccgccggccgaactgccccacgtcagcctggcgatgggcgaacccaagcacccggcgccgcagctggtgaaggacgcgctgtgcgccaacctgtccggcctgtccggctacccggccacgcagggctcgccggcgctgcgccaggcctgcgccgactgggcggggcgccgctacggcgtcgcgctggacccggtgcgccaggtgctgccggtcaacggcagccgcgaggcgctgttttcgctgacgcaatgcctgatagacgccgacggcggcgcgaaaccggtagtggtctctcccaatccgttttaccagatttacgaaggcgcggcactgctggcgggggccgagccccattacctgaactgcgaggcgcgaaaccgcttccagcccgactgggacagcgtgccggacgaaatctggcgccgtgcccagctgctcatcgtctgcagcccgggcaatcccaccggcgcggtgatgggtctggccgactggcaaaagctgttcgcgctgtccgaccgttacggcttcgtcatcgccagcgacgaatgctattccgaaatctatttcgacgcgccgccgctgggcggcctgtccgccgcgcggctgtccggccgctctttggagcggctggtgatgctgaccagcctgtccaagcgctccaacgtgcccggcatgcgctccggcttcgtcgccggcgacgcggccatcctggaaaaattcctgctttaccgcacctatcacggcagcgcgatgagcctgacggtgcaggccgccagccaggccgcctggaacgacgaagcgcacgtcgagtccaaccgggccgcctacgccgccaagttcgccgcggtgctgccgctgctctcgccggtgctggaggtggaaatgccggaggccggcttctacctgtgggccaaggtgccgggcggcgacgacgccgccttcgccctcgcgctgttccagcagcaacacgtgacggtgctgcccggcagcttcctggcccgcgacgcccatggcgccaaccccggccgcggctacatccgcatcgccttggtagccggccaagatgaatgcgtggccgccgcgcaaagaattgtagaattctgccgtacgcaatccgccgccctgacggcgtga

SEQ ID NO: 459 - DNA, 924 bp, Chromobacterium substugae
atgacacctgtaaaacaaaaatttctcgccacctccggcatcctcaccaccgcgctggtgtgggcgctgatgtggtatccgtttcgcagcctgaaggccagcggcgtcagcgtgccgatggcttcgctggccacctatctgatcaccatcgcggtcggcgtcacggtgtttttcaaggtctaccgccgcgagttccggctggagccgccgctgctgctgctgatgctggtgttcggctggtgcaatttcagctacaccatggcggtggcggaagggaaggtgatgcgggtgctgctgctgttctacctgtcgccgctgtggaccgcgctgctgtcgcggttgctgctgcatgaaaggctgacgcgcagcggctggatggtggtggcgctgtcgctgctcggctgtttcgtgttcatctaccggccggggctgctggcgggcgagctgccgctgacccactcctacgagtggctggcgctgtccggcggcctagccttcgccttcggcaacgtggtcagccgcaagctgcacaccattccggtggcggtgaagtcggccaccatctggttcggggtggcgctgatcggcgcggtcagcctgctgcgcagcggcgaattgcacaggatgctggaaatcccggccgagagctggctgatcctggccattctgggcgtggtgctgctgtgcaccagcgtgatctcgcaacacgggctgtccatcctgccggcgacgcaggcgatgacgctgatgctgatggagctggtgttcgccgcggtgtcggcctacttgctggctggcgaggcgatgagcatgcaggaatggctgggcggcgcgctgatcgccggcgccagcctgttgtccggcgacatgacgcatccggcgccgcaccctcaccaccatcctccgtcgcagccggcggcgtga

SEQ ID NO: 460 - DNA, 495 bp, Chromobacterium substugae
atgacgccggccgatttctcggcgttctggccgatattccgcgacatcgtcgcggcgcaagagacttacgctttcgacccggcgatgggagaggcggcggcgcgggcgctgtggtgcgaggcgccgctggaaacctggctggccgaagaggacggcgcggttctcggcagctattttctgaaagccaacgccgccgggcccggcggccatgtcggcaactgcggctatatggtgtcgccggcggcgcgcggcaagggcgtggcgcgggcgatgtgcgagcactcgcagcggcgcgcgcgcgaacgcggttttctggcgctgcagttcaacagcgtggtggccagcaacgcggcggcggtggcgctgtggagcaagctgggcttcgagacggtcggccgcttgccgcgcgcctatcgccacgccgttcatggtttggtggactgcctggtgatgtacaagtggctgggcgaggcggaacctagccggccagcttga

SEQ ID NO: 461 - DNA, 693 bp, Chromobacterium substugae
atgctgtggaaaaaattagccgttcccgccgctgttcttttagccgcattgctgacaggatgcgcgactccgaccaagatggccatgtcggaaaaccccgcagccaagccatcccaggataaagcggtatatttgatgacggccaccatcaaaaatgcgtacaagccatccttccaacccgatctgctggtgacccattttgaaaaaaatggcggcgccacctcggcggaccgaatcaatttcgtgatggatgaactggcgaaaaataaaaatgacgcggcaaaagacgggcattcctatttgcttcgcttcgagctggacaaaggcaaatataatcttcgcggcatgactgcgatggccaatgcctttattgtcatcggcaatttctttatcccgctgcatcaagaactcaatgccaacgagccaggcctgtattaccttggccatgtgcaggcggacgtccgcgaacgccagggaaatgaattccgcgccggcccgccgatcccgctgatcgaccaagccgctaccggcgcctccggcggcacattcgacgtggcgatccaggacgcgtgggaaaccgatgaagccaagttccgcaaacgcttcccgggcctcgccgaccaaaccatccacaaagccatcctgccgccgtttgatcgcgccgccgcgcagaaatggtgggaagaccactaa

SEQ ID NO: 462 - DNA, 507 bp, Chromobacterium substugae
atggcacaccccatcgcagtcaatgtcccggccaaacaggaaatcgaagccgtcgacggcgtggtcaagcaattgaaggagtatcagtccaagaattgggccatcggcctgaacggcgacaacctggcgccggacagcttcctggccttcttcaccgagcgccagctgccgttcagctactacgtgcgcgcccagggcgtcagcgtcggcgagccggccgcctaccagatcaataccgacacgctgaaccattatgtcggcctgatccgcagctcggaaggcatcgccgtccacggcgtgatagaacagctgaaccgctacaaggccaataactgggcgatcggcctgaacggcaccacgctgcagccggacgacttcctgccgttcttcgacacccgcggcgtggccttcgcctactacgtgcgcagcggcggcgtcgaactgggcgcgcccagcgcctacgatgccaatatcaaggcgctgcaacagtatctgcaacagctgtaa

SEQ ID NO: 463 - DNA, 195 bp, Chromobacterium substugae
atggccgggctgcgcatccgctcgaccgacggcattcatgatcatccgttccggcaggacgccatccgctggcgcggcggcctgccctggtgtccgctgcgcggctggctggacatgtaccggcaaatggggcgggaagaacgggcgcggcagattgagcgcctgctggcggacccggcggcgcgcctcatctga

SEQ ID NO: 464 - DNA, 213 bp, Chromobacterium substugae
atggataccgatatcgacacccgcctggccgagctggaagtgaagctggcgttccaggacgagctgctggacgcgctgaacgccaccgtggcgcgccagcaaaaggaaatggaattgctgcaacagcagatgcggctgctgtaccagcagctgcgcagcagccagccggacaacggcgccggcggcggccacgagattccgccgcactactga

SEQ ID NO: 465 - DNA, 1314 bp, Chromobacterium substugae
atgaatgccgttgtccttgccgtgggcgccatgctcactctggcgctgctgcgcacccacgtcgtcatcagcctgctgctgggcgccctgatcggcggcctcgccggcggcctgtcgctgtccgccacgctgaccgccttcaacaacggcatcaccggcggcgcctcggtggcgctgtcctacgcgctgctcggcgccttcgccgtcgccatcgccaaatccggcctgccgcacgcgatggccgaactggcggtgaagcggctggagcacagcagcggccacggccggctgaaatggacgctgatcctgctgttgggctgcgtcagcgtcgccagccagaatctggtgccgatacacatcgccttcatcccgatgctgattccgccgctgctgtacgtgatggcgcggctgaagctggaccgccggctggtggcctgcgtgatcaccttcggcctggtgacgccctatatggtgttcccggtgggtttcggcgacatctatctgaagcagatcctgctgggcaacgccgccaaggccggcatggacatccgcggcatcaacgtgatgcacgcgatggcgatcccggcgctgggcatggtggccggcttgctgtcggcggtgctggtcagctaccgcaagccgcgccagtattcgctgggcaaaatagaaaacgccgagcgcacccgcgcccgcgtcagccccaagtcgctggccaccgcgctggcggccatcgtcgcggcgttctcggtgcagctgtacaccggctcgatgatcatgggcgcgctggccggcttcctgctgttcctcgccaccggggtggtcaagtggaaggacgccgacggcgtgttcaacgaaggcatgaagatgatggcgatggtgggcttcaccatgatcacctcgcaaggcttcgccgaagtgctgcgcgccaccggcgagatcgccccgctggtcaaggccggcgccgcgctgttcgaaggccagcgcccgctggcggcgctggcgatgctggccatcggcatgacggtgacgctgggcataggctcgtcgttctccaccgtgcccatcctcaccgccatctacgtgccgctgtgcgcgcacctgggcttttcgccgctggccaccgtgtccatcatcggcaccgccggcgccttgggcgacgccggctcgccggcatccgactccaccatggggccgacttccggcctgaacctggacggccagcacgaccacatccgcgacacggtgatccccaccttcctgcacttcaacctgcccttgatggcggccggctggatcgcggcgatggtgttgtag

SEQ ID NO: 466 - DNA, 297 bp, Chromobacterium substugae
atggaggcgctactggtaggcgcggacagcctgggcaatatcccggaagtcctgcagcattacaatatccgcatcgcccgccacatctgcgggcgcaacgtcgcgcatcagcgcaaggcggcgctgccgggcaagccggacgtgctgatcctgctgaccgacttcctcggccacaacgtgatgcggcattaccgcgacagcgccgccgcgctggggattccggtgttggcctgccgccgctccgccaccgcggtggaacagcggctgcgccgccatggctggagccgcagcgcatga

SEQ ID NO: 467 - DNA, 135 bp, Chromobacterium substugae
atgatcttttccggcaatgaaaactggctggcctggcagctgaagcaaaccgcccagcaggctttgccgcgggtggagtggctgaagataaaccgcccggcgcccgccaagccacccattcctcccgcgcgctga

SEQ ID NO: 468 - DNA, 396 bp, Chromobacterium substugae
atgtcggttttttccgttgaattcaaggtgcgcgactacgaatgcgacatgcagggcatcgtcaacaacggcgtgtatttcaattacctggaacatgcccgccatgagtttctgctggccaagggcatagacttcgcccagctggcgcgcgacaaggtcaatctggtggtggtgcgttcggaaatggattacaaggcttcgctgaccagcggcgaccaattcatcgtcaccgtggcgttcgaggctgtttccaaagtgcgtttcggttttcgccagcaagtgatccgccaggccgacggcaaggtggcgctggatggcttggtgatcggtaccgccatcaacgagcgcggccgcccggccatcccggaaggcttcgccgagcggctgaccgcctga

SEQ ID NO: 469 - DNA, 708 bp, Chromobacterium substugae
atgatcgccgcccatctcccggacatcagccgtctggccagcctgctggccgaccccggccgcgcccgcatgctgctgttgctgctggacggcaggagctatccggccagcgaactggctcagcacgccggcctcagcgcccaggccgccagcaaccacctggccaaactgctgcaaggcggcgcggtgaaagtggagcggcacggccgccatcgctactatctgctggccaatgccgccatcgcccaggcgttggaggcgctcagcgcggcggcgcatggccacgatctggccaagccggcggccagccgggtggcgccgacgctcaggctggcgcgcacctgctacgaccacttggccggcaaactgggcatcgccgtcgccgacggcatgcaggcgagcggctggctggcgctgaacggggagaggcagttcgaagtcaccgcggcggggcgcggctggttcgccgaggcgttgggcgtggccgagccggcgagcggccgccggccgcaggcgcgcgcctgcctggactggagcgagcggcggccgcacctggccggcgcctatggcgcggcgctatgccgggagtttctggcgcgcagctgggtggagcggcggcaggatagccgcgcgctgagaatcacgccggccgggctcgccttcttgcgcgagcaatggggcatccggccggaaacgctggcggaatag

SEQ ID NO: 470 - DNA, 627 bp, Chromobacterium substugae
atgcaggccttgttggattatctgcaaagccattttctgagcgagccgcagttgttgtttcgctgccgcagcgcgcccgagcgcctgcgcgagctgcaacaggcggggcggatgcccttgccttcttatcgactgtccggatcgggcatggcgtcctcgcatttcggcgaacgccggatgcgcggcgagctggcctggtatccgcgagcgatgatggaatggctgatcgaggcggagcatgcggatgccgccgcgctgcgggggcgtttcgatcagcgttaccgcgccgagttgcgccgtttggcgtccgaaggcatcgcggcggagagcgaagcgccgttggatgaggagtgggcgcatttcctggctggggtgtacggggcatgcacccggcaggggcgaatcgaacagatcgcggccaagggcgcggccatcgccgtgatcgacaggctgaccgacggccagcggctggcgcgcgtgccggctgccgacattcctttattgtggcgggcggtggacctgctggacgcggtcagcgccttgttcgcgcctgatgagcaggcggctagctcccgcgcccgctgcgtggatgcggtgaagcgaaaatatctgggagaggcggcatga

SEQ ID NO: 471 - DNA, 1095 bp, Chromobacterium substugae
atgagcgcctggccgcaaaacgttttgatggccgcgcgccatcctgacccctatccctactaccgcagtctggcggagaagggctggcattacgacgaggccttggggatatggctggcggcgtcgcaccgcgccgtcggcgcggtcctggacagtccggtctgccgggtgcgcccgagcgggcagccggtgccgcccgccatcgacggctcggttctgggccaggcctttggcggctggctgcggatgagcgagggcgcggcgcatgccggtttgcgacgcgcggtgagggatagtctggcggccttgtccttaagcgaggtcgaaggggtggcggcagcgctcgcggcgcgcttcttgtccgagggcgagttgagcggccgccgcatagacggcctgatcgacttgctgcctgtcgccgcgctggccgcggcgctgggttggcctgcggcgcgcctgtccgctgtgggggagggcattgccttgctttgccgcgcgctggcggcggacgccgacgatgcggcgcgggagcagggcgctgcagcctgctgggccttgctcgacgaattggcgtctttgcctgtgaatggctggctgcggcgctggcgcgaggcttttgtggatttggacgaggccgcattggcggccaatctgctgggcgcgctattccagagccgcgacgccggcgccgggctgctgtcggcgggcatcgcttggcgttgcgagggaccgtgggattggcgtgatgcgggcgagtggaagcgccgcctgcgcgtcgatccggcgctgcatcacacccgccgcttcgtggcggaggatgtcgagctggccgggcagcggctcaaggccggcgaccaggtgctggtgttgctggcagccgccgcgcatgacccggcgggaccagcagaggcgctggatttcggccgcggccggcatgcctgtccgggcgaagggctggccttggcgatcgcctgcggcgcgctggacgcgttggaggcaagccgtccggattggcgggctttgggcggcggcatcgtttttcaggggccgccgaatatcagaatgcgccgcttcggcgcgggagagagcaaatga

SEQ ID NO: 472 - DNA, 348 bp, Chromobacterium substugae
atgatcgcagtgattttcgaagccacgccgacggcggacggccgagatgcttatctgcagtgggcggcgcggctggcggagacattgcccggcgtagacggttttctctcgatagagcgttttcagagcctggcgcggccggatgctttgttgtccttgtcgttctggcgcgacgaggaggcggtggcggcctggcgcaatctggaatcgcaccgggcggcgcaggcggcggggcggggaaagtttttcgccgattaccggctgcgggtggcggcggtagtgcgcgactacggcatggacgaccgggcgcaggcacccggcgacagccgcgccgcgcactcaggctga

SEQ ID NO: 473 - DNA, 783 bp, Chromobacterium substugae
atgccgatgaccgccaccccgctctactgcgccgaagccgcgcgcatcgatgccgcccgcctgctggccgaccgtttccagcttcccctgatccgccagcgccccgccgacggctattggctggagttgggcgcggaacggctggagctggtcaccaccggcaagcacggcgcggtgtatgccgaattcgtcgagggcgcggcgcgccatcgccgcgagcagggcggcggccgcggccagccggtggccaaggcggtgggcctgaaaggggcaaaagatttgccttacgtggtggacgccaccgccggcctggggcgcgacagcttcgtgctggccacgctgggctgccgggtgacgatggtggaacgctcgccggtggcggcggcgctgctggccgacgcgctggcgcgcgcggcgcgcgacgacagcacccgcgacatcgcggcgcggatgacgctggcgcacgccaactcgcgcgactggctggccggcctcgccgacgatcaacggccggacgtggtgttcgtcgacccgatgttcccggacaccgacaagaaagccgccgccgccaagaaagacatgcaggccttccagcaggtgataggcgacgatatggacagcgccgaattgctggccgccgccatcgccgccgccaaggtgcgggtggtggtgaaaaggccgcgcttgggcgcggccatcgaaggcgtcaagccatcggcggtgctggacggcaagtccacccgcttcgacctgtacgtgatcaaggcgctggcgtcagcctga

SEQ ID NO: 474 - DNA, 7098 bp, Chromobacterium substugae
atggcatggtggaaatcggcaggccggcagcaggcggccaaacaggcggcccgtccggccaatcgcttgctgttgcaggcgctggagccccggatgatgtttgacggcgcagtggctgccaccgccaaccatgtcgcgcagcatgtcggcgtgatgcacgacccgcaggacgccggcgcgcagcagcatcacggcgaggctaggccggccgccgccgcggcgcagtcggccgcagaagcgccgcgcgcggtcggagcgcgcgacggcgcggccaacgtgccgcaagtggtgttcgtcgaaaacgacgtcgccaatctgcaaagcctggtgtcgcagttgccgtccaattaccaggtggtgattctggacagcagcaaggacggcctggcgcagatcgcgcagtgggcgcaaacccacagcggctacggcgccatccacatcatgtcgcacggccaggaaaacgatctgcagctgggcacgacgcagctgacgacggccaatgtcgccagctatcaggcggaattggccacgataggacaggccttgcgccccggcggcgacatcctgctttacggctgcgatgtggccgaaggcagcgacggcgcggcgctggtcaatgcgatcgcgcaggaaagcggccgcgtgacagccggctctaccgaccttaccggcgccgccagcctgggcggcgactggacgctggaatacgccaccggcaagctgcacgtggcgacgctggacctgtcgggctatgacggcctgctgacgcaaccgacttccggcaccaccagtttcgattcgctggacggttccaccaccgtggtgcccaccggcaacgccacgctgacggtaagcaattaccttggctggaatttcaccatgaacatgaactcgaacagcgacggtcagaacgagatgatcatcgtcgagaaggatggttcgagctccacggaaaccgtcgacgcgctgagcaacggcgtcaagcagatcaattatttctcggtcaagcccaacgatggcagcctgttcacgctgaactccatcaccgtagtgatcaatggctacgattccaccttcaacggcggcaccatgcagctggtgggctatctgaacggttccgccgtcgccggcgccaccttgagccagagcgtcagcgacatcgacaacgacggctcgccggtcaccttcaatgtgtccagcaacagcaatttcgtcggcatcgactccttccgcgtgatcgcggccaatggccacaacgtcaccggcctggtcggcatcggcgccatcaacgccaccaccttccatttcccggggccgacgctgaccgccagcggcggcagcagcgcctacagctccggcaacggcaacgcggtgacggtggacagcggcatcacgctcagcgataccgcggcctcgacccaaaccagcgccacggtatcgattaccggcaacttccacagcggcgaggacgtgctggcattcaccaataacggcagcaccatgggtaatatcagcggcagctacaacagcggcaccggggtgctgacgctgacctccagcggttccaccgccaccaatgcccagtggcaggcggcgctggaggcggtgacttaccgggacagctcgctgtcgccgaataccagcacccgcaccctcagcttcgccatcaccgacgccagcagcaacaccagttccacggtgaccaagaccgtcaccgtggcggcggacagcgcgccggtgatcagcaacctgaacggcgacagcaatacctactacgccggcagcggcgcggtgagcctggacaccggcaccgcggccacggtcagcgacagcgatacttcgaatttcaacggcggcaatctgacggtgcacatctccgccaacggccacagcggcgaggacgtgctaggcatcagcaccgccggcacggtcacgctcagcaacggcactaactccggcagtacggtgtcggtaggcggcgtagcggtcggcaccatagacagcagcggggtgggcagcggcgggcaggatctgatcgtcgacttcaacagcaacgccactgcctccagggtgggcacgctggtcaacgcgctgaccttcaacgacaccgccggcacgcccaatacctccacccgcactgtgcaggtgacggtcaacgacggccgcggcggcaccagctcggcgtctagcgtgacgctggcaatcagcgacgcgccgctgctgagcactagcggcggcagttcggccttcaccgccggcgacaacgccacctccacgccggtggcggtggacggcagcgtcagcgtcaccgacaacgccagcagcacgctggccagcggcaccgtgtccatcaccggcaacttccacagcggggaggacgtgctggcgttcaccaatgacggcagcaccatgggcaacatcagcgccagctacaacagcggcaccggtgtgctgacgctgacctccagcggcgccaccgccaccatcgcgcaatggcaggccgcattgcgggcggtgacgtataccgacagcgcggtgacgccgaacagcgccacccgcaccatcagcttccaggtgcaggacggcggtagcaataccagcacggcggtgaccaagacggtgacggtggcggataccgaccagacgcctatcgcctccgccagcggcggcagcacggccttcaccgccggcgacaacgccacctccacgccggtggcggtcgacagcggcatcacggtgtccgacctcgacaacaccacgctggccagcggcacggtatcgatcaccggcaacttccacagtggcgaggactcgctcagcttcaccaataccagcgccgtcacctacggcaacatcgtcggcagctacaacagcggcaccggggtgttgacgctgacttccagcggggcgacggcgacggtggcgcaatggcaggctgccatgcgcgcggtcaaatacaccgacagcgcggtgacgccgaacagcgcgacgcgcaccatcagctttgtcgtcaacgacggcaccaagaacagcgccgccaccaccaaaacggtgacggtggcggataccgaccagacgccgctgctcaccgccagcggcggcagcgccgcgttcaccgccggcaacaacgtcacctccactccggtggcggtggatagcggcgtcacggtgtccgacctggacaacaccacgctggctagcgcgacggtgtcgatcaccggcaacttccagagcgcggaagacacgctggcgttcagcaataccaactccaccacctacggcaatatcagcggcagttacaatagcggcaccggggtgctgacgctgacttccagcggcgcgaccgcgacgctggcgcagtggcaggcggccttgcgcgcggtgacttacaccgatagcgcgatcacgcccaacaacgccacgcgcaccatcagcttcgtggtcaacgacggcaccaagaacagcgccacggcgacacgcagcgtgacggtggccgacaccgaccagacgccgatcgccaccgtgtccggcgccaacggcagttataccctcagcggcacgccgacgccggtggcggtggacagcggcatcacggtgtccgaccgcgacaacaccacgctggcgagcggcacggtgtcgatcaccggcaacttccacagcggcgaggacgtgctggccttcaccaataccagcgcgtccacctacggcaacatcgtcgccagctacaacagcggcaccggggtgctgacgctgacctccagcggcgcgaccgcgacagtggcgcaatggcaggcagccttgcaggcggtaacgtacaacgacacctccggttcgcctaataccgccacccgggtgatcagcttcgtggtcaacgacggcgaagtgaacagtgccgccgtcacccgcaacatcgccatccagctgccgacgccgtcggtgagcggcctgactgcgggcaccgacaccggcagcagcagttccgacggcatcaccagcgacgccacgccgacggtgaccggcacggcggaagcggacagcaccgtcaccatctatgtggatggcgtatcggtgggcaccaccaccgccagcggcaccggcgcctggagctatgccttcagtgacccgatcgccagcggcagccatgcgataaccgccatggcaaccagcggctcggtgaacagcagcgtatcgactgcttacacggtgatgatcgacaccaccgcgccaagcgcgccgacggtgacaggtctgaccgctgccaccgataccggcagcagcagctccgacggcgtcaccagcgacaacacgccaacggtccaaggcacggccgaggcgaacagcacggtgacgttgtatgtggatggcacggcggttggtacgactaccgcggacaataccggtgcgtggttctacaacgtttccagcagcttggcggacggcaatcacagcatccgcgcgacggcgaccgataccgccggcaatgtcagcagccaggcgaccgcctacagcgtgaccatcgataccgcgacgccgacgacgccggcaatcagcggcctgaccacggcgacggacaccggcagcagccatagcgacggcatcaccagcgacaacaccccgacgctgcagggcaccgcgccggccaatagcacggtgacggtgtatatcgatggcttccaggtcgggacgactacggcgaacggcagcggcgcgtggagctacagcctgagcgccaatctgccggacggcaaccatggcgcgcgggtgacggcgaccgacgcggccggcaatgtcagcacgctgtcggcggcctacagcatcacaatcgacaccactgcgcctaatgcgccgaccggtctggcgctggccacgtcgtcggacaccggcagcagccacagcgacggcatcaccgacaacaaccagccgacggtgcaaggcacggccgaggcgggcagcacggtgacggtgtacgtggacggcacggcggtgggcacggcgacggcgaacggcagcggggcgtggagctacaacctggcgagcagcctggccgacggcaaccacagcatccgggcgacggcgaccgacgcggcaggcaacatcagcgcgcagtccagcggctacaccatcaccatcgacactaccgcgcccaatgcgccgactggtctggggctgagcgtggcgtcggatactggcagcagccacagcgacggcatcaccgacaacaaccagccgacggtgcaaggcacggccgaggcgaacagcacggtgacggtgtacgtggacggcacggcggcggggacggcgacggcgaacggcagcggcgcgtggagctacaacctggcgagcagcctggccgacggcaaccacagtatccgggcgacggcgaccgacgcggccggcaacatcagcgcgcaatccagcggttacaacgtcaccatcgacaccactgcgcccaatgcgccgaccggtctggcgctggccacgtcgtcggacaccggcagcagccacagcgacggcatcaccgacaacaaccagccgacggtgcaaggcacggcagaggcgaacagcacggtgacggtgtacgtggacggcacggcggtggggacggcgacggcgaacggcagcggcgcgtggagctacaacctggcgagcagcctggccgacggcaaccacagtatccgggcgacggcgaccgacgcggccggcaacatcagcgcgcaatccagcggttacaacgtcaccatcgacaccactgcgcccaatgcgccgaccggtctggcgctggccacgtcgtcggacaccggcagcagccacagcgacggcatcaccgacaacaaccagccgacggtgcaaggcacggcagaggcgaacagcacggtgacggtgtacgtggacggcacggcggtggggacggcgacggcgaacggcagcggcgcgtggagctacaacctggcgagcagcctggccgacggcaaccacagcattcgggcgacggcgaccgacgcggccggcaacatcagcgggcagtcgaccggctacaccatcacggtggacaccgccgcgccccaggtgcagagctttaccgccaccgacgccttgagcacttcggccagcacgctgggctaccaagtggtgttttccaaaccggtggtcgggttcaacgcagccgacctgagcgtggtgaccagcagcggcgcgcatggcacggtggcgagcgtcacgcagatcaacgcgaccacttacgccattcaactgaccggggtgggcggcgacggcaccctgtcgctggcgatcaagagcggcacggtcagcgatgtcgccggcaaccagctggcgggcacggtcagtgtgcccgcgtatcaggtatcgacgtcggtggtgatgaccagcacggtgacgccggtggcgactgtcgagacgaccagcttcggcaataccatacagctgccgccgatcacgcccaatatcgtgttggccgcggtcagcggcaaccctgcggtgacgaccgccaacggcaacaccgctccagggacgggcacgctgccgaccgatcatgccggcgtcggaaccagcgtcactacgcctactttcggtacgacggacaccgtcaatggcgcggcgccgtcctttgtcagcaatgtggcggccaaccccaccatcgcgctgcaggtgaacccggatcttggcgtcaggccgctggtgtccgggcagtctttctccatcacgctgccgccggccaccatcatcacccgcgagtccacggccagcctgagcattgtcgcccggcagagcgatggccagccgctgccctcgtggctgaagttcgacccggcgacgggcaaattcatcgggcaggcgccggcgggctggaacaagccgatttcaatcgacatccgcgtgcaggacaagagcggccaccatggcaacagccacatccagctcaacttcggccagtcgcgtgcgaacggaacgccggcgggcaaggcggcaggcaaggcggccgccggcaagctggcgttgaaccagcagttcgaccgccacggccacaaggctttcctgcagcggatgcaggcatggctggagggcgatgggcaagcgtag

SEQ ID NO: 475 - DNA, 138 bp, Chromobacterium substugae
atggctggagggcgatgggcaagcgtagccttgcgcggcggcaggcatggcggggttcggaccccggcattttccaagttcaaggggacagcagcatgcaatccaaagatcaagcgggatcatgggtggttcgactga

SEQ ID NO: 476 - DNA, 1518 bp, Chromobacterium substugae
atgcaatccaaagatcaagcgggatcatgggtggttcgactgaccgttctggccgtcgctgcggcgctggccggctgcgcggcgacgccgcagccgatcagcctgtcggagcggcaggccacgctcgccgccgacaggcaggcgatgttcggcagccaggaagcgttgtccgcgccggtcaccttgcaggaggcgatggcgcgggcgctcaaatacaatctggattaccgggtgaagctgatggaagaggcgatggcgcagcgccagctggatctgtccagcctggacatgctgcccaagctggcgctggcggcgggctacacctcgcgcagcaaggacaacgcctcgtcctcgcaaaacatcgccaccggcgagcagtcgctggcgccgtccatctccagcgagaagcgcgaccgcaccgccgacctgaacctgagctggaacgtgctggacttcggcgtcagctatttttcggcgcagcagcaggcggaccgggtgctgatcctggagcagcgcaagcgcaaggtcgcgcagcagctgatgcagcaggtgcgcgaagcgtggtggcaggccgccggcgcgcagcgcctgcaagggcgggtggacgcgttgctgaaagacgccgaatcggcgctggacgacgctcgccacgtcgagcagcagaaactgcgggcgccgctggacgcgctcaattaccgccgccagctgctcgacgtgatccgccagatgagcgcggtgcgcaacgcgctgtcgcaggccaagcccaggttggccgccatcatgaatgtgacgccgggccaggacttccaggtggccgcctccgccgacatgccggtgccggcgctgggcatcgatgtcgacaagatggaggacatggccctgctgaaccggccggaagtggtcgaagccaattacagcaagcgcatcagcgcgctggagacgcgcaaagccatcgccaagctgttgccggggctggagttcagcgtcggccagcattacgacagcaacaaattcctgatcaacaactcctggagcgacgccgggctgcgcatcagctggaacctgctgaacttgttcagcgcggggccgatcacgcgcgcggccgaagcgcaaaagcgggtggacgacgcgcagcggatggccttgaacatggcggtgctgacccaggtccatgtcgcttatctcgacttccagggcaaggcgcggcagttcgaactggagcatgagctcaacagcgtcgaccaggccatctatgagcaaacccgcaatgcggtggacagcggcgccaccgcgcggctgcagggcattctggccgacgccaacgcggtgttttcgtcgctgcggctgttccagacctacggcgatctgcaaaacgcctatggccaaatgggcgccagcctggggctggacccgctgccggccgctacccagggctatgatctggcttcgctcagcgccgcgttccgcggctccgaaaccaaatggcagggcacggtggcgggaggcgcggccaaatga

SEQ ID NO: 477 - DNA, 744 bp, Chromobacterium substugae
atgataacgcgctggctcaccctcgccgccatcggactggccggccacgccggcgcggccacgccgccggcctcgacgctcaacgccgccgacggccgcatccgcgtgcagctgatgtcgcgccacgcggtgaccctgtccagcgaaatcccagccaagatctccgcgctgccggtagtggaaggcggaagcttccgccgcggccagccgctggtggagttcgactgcagcagctaccgcgcgcagctgcgcaaggcgcaggcctcgctggaggctgccagccagctgttgaaggtcaacaatcagctggccaaatacaactcggtcggcacgctggagctgacccaggcgcagggcaaggccaaggaggccgccgccgatgccagctacgcgcagacgctggtgtcgaagtgcagcatcgcggcgccgttcgacggccgggtggccaagcgcagcgcggcggtgcaccagtatgtcagcccgggcaaccccatcctggacatcgtcgattccgactcgctggagttgcggatgctggtgccgtccaagtggctggccacgctgaagccaggcagccgtttcacgatctcggtcgacgagctgggcgccagcttcccggcccggatagagcggctgggcgcgcagatcgacccggtgagccagtccatcctggcgataggcgtgatagacggcaaggccggcaacttgctgcccggcatgagcggctgggccagtttcaaataa

SEQ ID NO: 478 - DNA, 1326 bp, Chromobacterium substugae
atgggacacgccgacaaaagtctggaactggccaccctgctgcagctgcagcgccatgcgcgggaggccgacagcgcggcgcagctgggcttcgtgatggtcaacgaaagcctgcagctgctgccctaccggcaggccgcactttggcgcgagggcctgcatcgccatgtcgcaaccttgtccggcctggttgatcccgaccccaccgcgccctatctgcaatggctgagcgccttgttccgccaattggcgcgcgaggccgccggcgcggccagccggcgctgcgaagccgccgacctggcgccggcgctggccgcggaatggcagcaatggctgccgcagcatgcgttgtggctgccgctgggcgagcatggcgccttgctgttggcgcgcgatcaaccctggagcgactacgagctcaagctggcggaagagctggcgcacgcctacgcccacgcgctgcggcagttcgcgccgcgccgcaactggcgggcgctgctgcgggatggcctgcgcgccggaccgcggcggcggcgcgcgttgttggcggccctactggtggcctgttttcccattcgccagagcgtgctggcgcgcgccgaagtggtgcccagcgacccgatgctgctgcgggcgccggtggcgggggtgatagaccgcgtcgaagtgtcgcccaatcagccggtgaagcgcggcgcgcccttgttcgatctggacgccaccctgttgtccggccagtttgagctggccaaggaagaaaggcgggcggctgaggaaagcttccgcgccagcgcgcagttggcggtcaccgatgacaagggcaagctggcgatggcgcaggacaaggccaggctggaggagaaggacatcagcgccgatttcgccggccgcgagctcaagcgtctgcatgtcaccgctccggccgacggcgtggtggtgttttccgaccgcaacgactggcagggcaaggcagtagcccagggcgaaaaggtgatgacgctggcggaccccgccaaagtggagctgacagcctggctgccggcggccgaggccatcgccatccagcccggcagccaggtcacgctgtatcccaacgcctcgccgttccgctcctacgatgccactttgctgcgggtggcctacaaggccgaagtcagtgagggcaatctgctggcctaccgtctgcaggcgagcttcgccgccggccagcgtctgccgcaattgggccagatgggcaccgcgcgggtgtatggcgactgggtgcctttgtcctattacgcgctgcggcggccgttgacggcggcgcggcaatggctgggctggtga

SEQ ID NO: 479 - DNA, 2112 bp, Chromobacterium substugae
atgggcgccgcggcgctgccgccgctgcggcaggagttgaccctgcacgccggcccggcgcaggcggacggctcgcccagctggatgctgcacgatccgggagccaaccgtttctatcagctgggttgggccggtttcgagatgctgtcgcgctggccgcttggcgacgccgcggcggtattggcggcggtgaatgccgaaaccacgctcgaactgggcgaagacgatctgctgcagctgctgctgtttttacggcagcaccaattgctgcaaccgcttgcccccgccgattgcgagcgggtctggcgccagtaccaggccggcaagcccgggcatgcgatgtggctgttgaagaactacctgttcttccgcattccgctggtgcggccggagccggtgttgaaccggctgctgccctggctggcggcggtgtttcggccggcgttctggtggctgatggcgacggtcgccgcgctggcgctggcgctggcgtcccggcgctgggatgagttcactcataccttctccggttacggcggctggagcgccgcattgggcatcgcggcgtcgcttagcttggccaagatattgcacgagctgggccatgcgttgacggcccggcatttcggctgccgggtgccggcgatgggagtggccttcctggtgatggtgccggtgctgtacaccgataccagcgacgcctggaaactgccgtcgcggcggcagcgcatgctgatcggcgtctccggcatgctggcggagctgacgctggcggcctgggccacgctggcctggtgcttcctgccggacggtccgctgcgggcgggggtgtttctgctggccaccaccacctggctggcgacgctggcgatcaactccagccccttcatgcgcttcgatggctatttcctgctggcagactggtggggcatgcccaatctgcacgcccgcgccttcgcgctggcgcgctggcagatgcggcagtggctgttggggctggacgacccggttcctgagttcttccagcccgcccggcgccgcgcgctgatcctgttcgcctgggccacctggctgtaccggctggtgctgttcctctccatcgccttcctggtttaccacctctttttcaagactttgggcctgctgttgctgggcgttgaactgggctggttcatcgcgcggcccatcgttgccgagctgcgttgctggtgggcgcggcgggcggatttgcgctggcagctggaaaccgcgcgcagcgccgctttgttggcgttgatcgctctgtttctgttgctgccgtggcagcgcgatgtcttctccagcccggcggtgttggccgccgcgcaatcgcaaggcttgtacgcgccggatgcggcggaggtggtcgaggtcaaggcgcgggatggccagcaggtgcgggcgggccaggtgttggccaggctgtactcgccggaattggcccggcaaatggcgcaggcccaggtggtggagcgccacctggcctggcaggcgtcgcagcagccgttcaacagcgagttgcagcagcaggggccggccttgcagaaacaatggcgggccgcgcagcagcaggtggccagcctgtcccggcaagtggccagactggtgctgacggcgccgttcgccggccgggtggcggacagcagcgaggcgttgcggccgggcaccgtggtggccgagggcgagcatctgctggatctggtcgggccggacggggcgcggggggaagcgtttgtcgacgaggacagcctgatcgggctgcggcgcggcggccgcgccagctttgtgccagacagcggcgagggctgggcggtgtcttgccggctgggaccgatagacagcctgaatctggccacgctggaccagccgctgctggcttccactttcggcgggccgatcgccaccgaagcgcgcgaccatggcctggtgccgttgagcgcggtgttccgggtccggctggaggactgcgaccgccaggtcgcgccgctgcgcgaaaccgcgggttgggcgaagttgcgcggcgagcgctacagcctgttgcagctgggttggcggcatcttctggccgttgtcgagcgcgaggccggcttgtag

SEQ ID NO: 480 - DNA, 528 bp, Chromobacterium substugae
atggccgccgaactcaatttcgcctccctggcccagggcctgaccctgaggccggcgcagtccgccgacgcgcctttcatcgacaaggtctaccgcagcgcgcggccggacctgcagtggatacagggggagcgcgaactgatcgatacggtgcagcgccagcagttgcaggcgctgctgcagggcgcggggcagaatcatccgaacgcgatgcatttcgtggtggagcagaccggcgccgccatcggcgtggtgatggtggacttcggccataacgaggtgcgggtcatcttcctggccatgctgccggagacgcgcgggcggggctatggcaagcaagtgctgcagggcttgcagcaggcggcgcgccaggtgcgttgtccgctggcggtggtggtgtggcatggcaacgagcaggcgcggcgtctgtatcagtcgctgggtttcgtgctggaagaggcgggcgcggtggccgacaagctggtgtggtatccggacggccggtccatcatggtcggggcggtttga

SEQ ID NO: 481 - DNA, 336 bp, Chromobacterium substugae
atgctggccgaactccgtagcgaagatttcgctcccttgctggggcagagctgtctgttcagcgtggagcagcagcccgaactggaattgcggatccagactgtccgccagaagccactggcgcaggtgcctggccgggaggacacgcagcgcacgcctttcgtggtggagttggtcgccgcccacgccaccgaactggtggacgccgtcggcaccctgagcctgccggcggcagacggcctgcccgaacggcggctggaaaacgtctggatcagccgcaccggcgccatgggccgcgaccgccagtactgctatttccagttgccgttcaattaa

SEQ ID NO: 482 - DNA, 588 bp, Chromobacterium substugae
gtggacgcatacatcggcaccattctcgcctttggcttcgactttcccccgatagactgggcgcaatgccagggccaaaccctgcaggtctcccagaaccaggcgcttttcgccaccatcggcagccactacggcggcaatggcagcaccgtattccagttgcccaatttgtgtggccggatgcccatcagcatcgggccggcgcaacccacctacaacctgccgtcctacgccatcggcaacttcggcggccaacagaccgtcaacctgctgaccgccaacatgccgctgcacaaccacggcacctcggccgtcaacgtcagcttccaggcctccaccgtcccgaacccgacgacaccggccagcgcgcccagcaccagcaacccctatctgggcgcctccggcggcggcaccggcctcgccaccatctggagccaacaactggagagcccggtcaccgtcaaagggctgggactgagcggcaataccgacaccgccggcggcaccgccccggtcagcgtgctcaacccctacctggcgctgaatttctgcatcgccgtgcaaggcatcttccccaccagacaataa

SEQ ID NO: 483 - DNA, 2304 bp, Chromobacterium substugae
atgccggatggccgcgaacggcgcgccaggcccgcgcctggcatggcggcgctgattgcctgggtcgtcggggtggggggctgcgctttcctgccggctttgccggacctgcgcgagtatgcgctgctgccggcggcgctggccgcttgtgcctggcggtcgggctggccgctccgccgatggctgctggtattgctggcgctgtgcctgggtcttggctatgccgcagcgcgcgcgcagtggcggctgcagcaggaattgccggccgcctggcagcagaagccgattgcgttcgtcgcggtggtgcgcggcctgccagatcccggcgagtacggcgtccggctggtgctggaggtggagcggacgctgacgccgggcgcggcgctgccggagcgggtgcagctgcacgactatctgaagcgggactggccgcctggcagccgctggcaattgagcgcgcgattcaagcccaggcgcggcagcgccaacgcgttcggcttcgacgccgaacagtggctgtggtcggaggggctgctggccagcggctcggccggcaaggagcggcggaggctggccgacgggcacggcctgatggcctgggtggacggctggcgcgcgcgccaagtggcgcgcatcgaacgggcgctaggcaccggcagggagtcggcgttggtggccgcgctgacggtgggcgcgcagcagcgggtggcgcgggaggattggcaattgttcgccgccaccggcctgacccacatcgtgtccatctctggtttgcacatcacgatgctggcgggattggcgggctgggcatgcgccagcctgctgcgccgctggccggtggcgcgcgcgccgcgtttgctggccgccggcgccgccctgtcggcggccaccgtctatgcgctgctggccggcttcacggtgccgacccagcgcaccttgttcatgttggtggccggctggggctgtttgcagctgcgccgccagctgtcgccgttccaggtgtggtggctggcgctgtcgttgaccttgctgctggacccgttcgcggtgttggcgcctggcctgtggctgtcgttcggcttggtggcggcgctgatgttttgttcgttggcgcggcgtcggccgccgccgggctggcgcgccgcgctggatggccaatgggcggcgggggtggccagcttggtgccgctggcggcgctgttcggcggttttccgttgttgtcgccactagcgaacgcgctggccatccccttcgtttccatgctgctgacgcctgcggcgctgctggcggtggctttgccgtgggatggcttgttgccgctggccgcttggctggcgcgagctttctacttcggcgtggagcggctggccgccgggccggcctggcatgtggcgggcgcgccgtggccgctgctggcgctggccggcgcgggttcgctgtggttgatcgcgccgcgcggcgtgccgggcaagcccttggcctgcctgctgttgctgccgggtttgctctaccggccgccggggccggcgcgcggcgaatttcgcgcgacggtgctggacgtggggcagggcttgtcgttgctggtgcagacggcggagcatgcgctgctgttcgacaccggcgccggcgacgccggccgggtggtgctgccgcagttgcgcgggctgggggtggcgcggctggacgcgctgatgctgtcgcatcacgacaatgaccacgacggcgcggcggccggcgtgttggcggccttgccggtgggaaaggtgttggccggccagccgcagacgctgccgcgggccgcagcttgccggcagggccagggttgggactgggacggcatacgcttcgatgtgctggcgcctggggccggggcggcggcgggcgaggacaatgctcgcagctgcatcctgcgggtggcgggcggccgacatgccttgctgatcagcggcgacgcgccgcggcaggtggaggacgcgctggcggcgcagcccggcatccggctggccagcagcgtgctgatcgccggccaccacggcagccgcacctccagcggggaggcctggctggcggcggcgcggccgcggctggcggtggtcagcgcgggctttctcaaccgctaccgccatccgcatccgcaagtgttgcagcgcttcgagcaatacggcgcaacggtgctgcgcaccgatctggacggcgcggtgacgctggacttcggccgcgagctgcgctggggctgcctgcggcagcagcagccgcgctactggcgcgctcgcggcgcctgcggcgggatcagccctgactga

SEQ ID NO: 484 - DNA, 891 bp, Chromobacterium substugae
atgcctcacaaactcttgctcgttgacgacgagccgttcaatctggaactgatgaccgaactgctggaggatgccggctacgaaacccggcaagcggaaaacggcgaagtcgcctggcagatcctcgagcgcgaaggcgaacagttctccaccatcctgctggacaagatgatgccgggcatgagcggcttcgacgtgctcaagaagatcaaggccgagccgcggctggagttcctgcccgtcatcatgcaaaccgcgatgggcgccgcctccagcgtgcaggaaggcttggctgccggcgctttctactacctgaccaagccattttctcgcgacatgctgctggccatcgtcggcgccgccgtcggccactgggaccgctacgcccatttccgcgaattggccaatctgcatgtcgacgcgctgcgccacctgcagggcgcccgcttccgctgccgcacccaccgcgaagcccaatccatcaccgcgctgctggccaagaccagctcgcagccggagcgggtggccaccgggctgttcgaactgctggtcaatgccatcgaacacggcaatctggacatcagctacgagcagaaaagccagctgctggccagcggcgaatgggagcaggagctggagcgccggcagctggcgccggaataccgcgaccgcgaggtgtcgctggaattcagcctgatcgggcagcagctgcagttcatcgtcgaggacatgggctcgggcttcgactgggagtactaccagaacgccgagccggcctcgctgatgaccagccacggccgcggcatcctgatcgcccgcaagctgtccttcgacagcctgcactacgaaggcaagggcaaccgggtgatcgcccgcgtcagtcagggctga

SEQ ID NO: 485 - DNA, 2589 bp, Chromobacterium substugae
ttgaaccgactcacctcgctattgctgggctgcctgctgggggcgggcctgctgttcaccgaatactggctgctgctggagcatgaccgcgccgaacgtctgcaggaacagcagcactggggggcgcttggcaccggtctggtggtggtgcagctggaggacgcgctggagcatacccggatcatggcgcagcagctggccagcaacggccaggcgcgcggcctggcggaaatggcccgccgcgtggtgcgcgaggacagcgtgttcgccggcatcggcaccgtggcgctggtcgagcaaaaccagcgcgacgccttcgaaaaccgcatcgccaccagcatccgcttcctgaagaaccagcacctgcagcccagcccggtccaattgcagtactacccggtggccagctacctgccagacgacgccaacgcgctgccgcagggattggacctcagccatctgggcgactccaaatggctgctggacctggcccgccgcagcgaccagccgatgctgctgcccagccagctctccggcctaggcggcatccggctcgacatcatcacccggctgggcgacgaccacacgctgctgctgctcaatctgcgccaagacaagctgatgcagccgataggcaacgagctgatcaccgacaatccgctgcatcatgtccgcctgctgatctggagcaagaaccagcccgacgtgccgctgctggactcggcgccgggccgccccatccccaccgagccgccgatgttctcgcgccgcagcaaggtcggcggcaacgaattgctgctgggcgcctattcgctgcagccggtgcagcccctgctcagcccgatggcctggacggtgctgatcgcctcgtccgccaccctggcgctgctgctgttgctgcagcaacgccagctgctggccaatcgccagttgcacgaacagctcaaacaacagcaactgctgctggagcagaacaaccgcacgctgcgcgagcagatcagcgaccgggtgatgtcggaacaggcgctggcgcaaagtgaggcccgccagcgcgccatcctggaggccagctccgacgccatcatcctgatagaccgcagcggccatatcctgcagaccaaccccgcggcggccaaactggtggagcaaagcgcccactcgctggaaaacctgcccgccggcgtgttgttccccgatctgtacaatcccgaccccggccacgcgttcgagcagaccgcgagccagcacgaaggccggccgttcgaaacccgcttgctgcgcagcgacgagcaacagctgccagtggagctgtccctcagccgggtggtgatgccggatgactggttctacgtcaccgtctgccgcgatatctcgcgccgcaaggagcaggaagaagcgctgatccagctgaagaacagcctcgccgaacaagtggaagtgcaaagccggcagcttgcggcgctgctggacgccagcccgctggcgatggcctatatcgtcgaccgcaatctgcgccaggtgaaccacgcttttctggagctgttccagcagcagggccaggacgtgatcggccgccccaccatgccttactttgaaaaccccgaacaatgggagcgcaccggcaaggccctgtacagcctgctcaacgatggcaaggtggtgcaaaccgaagtccggctgcgcaccggcaaaggccagctgttctggtgccgcctgcacggccgcgcggtcaacccctcggtgcccaagctcggcaccatctgggtgtacctggacatctccgcgcagcgctcgctggaggaaaccctgcgccacgccaagatcctggccgaggaaaccagccgcgccaagaccgagttcctggccaatatgtcgcacgagctgcgcactccgctgcacgccatcctgggtttcaccgaaatgggacagctgcgcgcgcagagtctgggcgaggccaaactggagcaatacttcacccgcatcaacaccagcggcagccggctgttgaccctgctcaacgacctgctggacatggccaagatggaggtcggccgcatggactacaacatcggccgcggcaatctcagccaatgcctgcgcgaagcctgcgacgaaatgacgccgatggcgtcccgcaaccagatccgcatcgatctggaatgcgcgccggaaaccctagcggccgacatcgaccccttccgcatcggccaggtgatacgcaatctgctgtccaacgccgtcaagttcagccccgccggctcggaaatccgcgtgcgggcgctgttggacgaacaggacggccaggaatgggcgcacgtcagcgtggccgactccgggcccggcatcccggaaaaagagctggaaaccattttcgacaagttcatccagagcagcaccaccaaaaccggcgccggcggcaccggcctgggcctggccatcagccgcgaaatcatccacgcccatcatggtcggatcattgccgacaatctgcctgacagcggcgccattttcaccttttccattcccagtcattttcagcgtaacctagaggagggaacgccggatgcctcacaaactcttgctcgttga

SEQ ID NO: 486 - DNA, 777 bp, Chromobacterium substugae
atgactatccgacgcgtggtattcaatcagaaaggcggggtgggcaaatccaccatcgccgtcaacctggcggcagtggcggccagccgcggccgccgggtgctgctgatcgacctggacccgcaaggcaacgccagccactacctgctgggcgaggcgatgaaggaggccggccccagcgtcgccgacctgttccagcaaatgctcaacatctcgttgttcggcaaggagccgcaggacttcgtccgcgccaccggcatagatggcctgtcgctgctggcttcccagcccgaactggccgaactgatggccaagctggagtcgcgctacaagatgttcaagctgaaggaagcgctggaccagctggcgccgcattacgacgaaatctggatagacacgccgccggcgctgaatttctacacccgctcggcgctgatcgccgccgaccgctgcctgattcccttcgattgcgatgcattctcacggcatgccctctataacctgaaggaaagcgccgacgagatccgctccgaccacaatcccgcgctgtatatagaaggcatcgtggtcaaccagttccagccccgcgccagcctgccggtgcggctggtggacgagctgaaggccgaaggcctgccggtgctggcctcgcccttgtcggcgtcggtcaagatccgcgaatcgcaccaggccgcccgccctatggtgtacctggatccgcgccacaagctgtcccgtgaattcgaggctctgtatcaagaattgagcgagcgctga

SEQ ID NO: 487 - DNA, 480 bp, Chromobacterium substugae
atgcgtactcgtcttgcccccttgttcgccctgctgttgctggccggctgcgccaccgcgccccagcaggccgccgcccccgccccggccaaagcggcagagccggcgccgccgccggccagcgccgactggcagaatctgggcgtctcgcccaacggcaacatcctcaacgagctggactggctgtcgctcaagcgccagggcccgctggtcaccttccgcgaccgcaagaccatcttcaacctgaagcaggaaaacttcctgtccacgccgcggcacaaggtttcgctgaatacctggcagatagactgctcccagcacaccttccgcctgctggacatgacgctgttcgatgaaaacggccggcagatcgccagcttctcctataatgacagtcagataaaagccatgccggtcgtgcagaattccgccagttaccagcagatgctgctggtctgcaagggacagcccggcttctga

SEQ ID NO: 488 - DNA, 156 bp, Chromobacterium substugae
gtgcatgccgggtgcgatctgcgggaaaaaacgccattgtacggcaagcggggggaggaatgcgccgggacaaaaaaagaagccgccaggatatggcggccacaagttggatggagacaatgtgaaacgaagaggaaaaatgctctcgcactgtga

SEQ ID NO: 489 - DNA, 1800 bp, Chromobacterium substugae
atgcacgacgcagtctccatcctcaatcatgttttcggctacccggaattccgcgggcagcagcaggagatcgtcgagcaagtcgcgcatggcggccacgcgctggtgctgatgcccaccggcggcggcaagagcctgtgctaccagattccggcgctgctgcgcgacggcgtggccatcgtggtgtcgccgctgatcgcgctgatgcaggaccaggtggccaccttgcaggagctgggcgtggccgcggcctgcctgaactccgccacctcgccggaagaggcgcgcgacatcgcccgccaggcccgcgccggcacgctggacctgttgtacgtggcgccggagcgcttgctgacgccgcgcttcctggaattcatgtccagtctgaacatcgcgctgttcgccatcgacgaggcgcactgcgtcagccactggggccatgatttccgtcccgaataccagcagctgggcttgctggccgagcgcttcccgcaagtgccgcgcattgcgctgaccgccaccgccgacgagcagacccggctcgacatcatccattatctgaagctggccgaagcgcgggtattcctgtctagcttcgaccgtcccaacctgttttaccaggtggtggaaaagcacaacgccaaaaagcagctgctggacttcatccgccaggagcaccagggggccaccggcatcgtctactgcctgtcgcgcaagcgggtggaggacaccgcgcagtggctgtgcgacaacggcatcgaagcgctgccctaccatgccggcctcagccacgcccagcgcgaggcgcaccagcgcagcttcctgcgcgaggatggcatcgtgatggtggccaccgtcgccttcggcatgggcatcgataaacccgacgtgcgtttcgtcgctcacatcgacatgcccaagagcccggaaaacttctaccaggagtccggccgcgccggccgcgacggcctgccgtcggccagttggttgtgctacggcctcaacgacgtggtgcagctgcggcagatgatagaaggcggcgagatggccgagctgcagaaacaggtggagctgtccaagctggatgcgatgctggccttctgcgaaaccgccggctgccgccgccagcacatcctcgcccacttcggcgaggacagccgcccctgcggccattgcgacaattgcctgcacccgcccatcacttatgacgccaccgaaccggtgcgcaagctgttgtcctgcatttatagagtggggcaacgctttcccaccggccatgtcatcgacgtgctgctggggcggcaaagccccagcatcggccatcatcgccacgaccagctcagcacttacggtatcggcaaggatatgaaccagcgctggtggcgctccatcgtccgccagctggtggcgcgccaactggtgcaggtggacatcgcccgcggccagtcgctggtgctcaccgatgcctgccggccgctgctgaagggcgaggaaagcatctatctgcgcccgctggccgacgagaagaagtcgcgcggcagcgccgccgccgaccgctggttgcgcaccgagcgagaggagaggctgtggcaggcgctgcgccgctggcgccgtcaggtggccgacgagcacaatgtgccggcctacgcggtgttctccgaccgcacgctgcgcgatctggtggaaaagcgcccggacagcccggccggcctgcgccatatccacggcctgggcgagctcaagctggcccgctatggcgaagccttgctgcaatgcctgagcgaggcgcagcaagcctga

SEQ ID NO: 490 - DNA, 1218 bp, Chromobacterium substugae
atggctgtgaatctgaatccgccgcaagccggcctgctgccgccggtcgccggcgtcgaattgctggtggccgaagccggcatcaaaacgccgggccgcaaggatgtgctggtggtacgtctggacaagggcaataccgtggccggcgtgttcacccgcaaccgtttctgcgcggcgccggtgcagctgtgccaggagcacctggccgccggcgtgcagatccgcgcgctggtggtgaataccggcaacgccaacgccggcaccggcgtcgatggccgccagcgcgcgctgagcgtgtgccaggcgctcgccgcgcaaagcggcgtgcagaccgagcaggtgctgccgttttccactggcgtgatcctggagccgctgccggccggcaagatcatcgccgctttgccgacgctgcgcgccgccgactgggccgatgcggcccaggccatcatgaccaccgacaccatagccaaggccgccagccgcacgctgcagctggatggcaagccggtcaccatcaccggcatcgccaagggctcgggcatgattcatcccaatatggccaccatgctgggattcgtcgccaccgacgccgccgtcacccgtccgctgctgaaccaattgctgcgcgaagtggccgatctctcctttaatagcatcacggtggatggcgatacctccaccaacgacagcttcatcctgatttccaccggcaagagcgaggcgggcctgatcgactccgccgagcagccggcgtatcagcaactgaagcaggcgttgctggaagtggcgatcgaactggcgcaggccattgtccgcgacggcgagggcgccaccaagttcatcacggtggacgtcaacggcggccgttctgtggccgagtgcaaggatgtggcctatgcgattgcccgttcgccgctggtgaagaccgccttcttcgcctccgacccgaatctgggccggctgctggcggccatcggctatgccggcgtcgccgatctggatgtggatcgcctctccttatatctggatgatgtgctggtggcctgcgacggcggccgcaatccggcatacagcgaagagcagggtcaggcggtgatgaaccagagcgaaatcaccgtgcgagtggagttggggcgcggcgccgccagcgccagggtgtggacctgcgacttctcctatgaatatgtgcgcatcaacgccgactaccgcagctga

SEQ ID NO: 491 - DNA, 522 bp, Chromobacterium substugae
atgcgttatcgtcgttcaatggcagaaggcggcacatggttcttcaccgtcaacttggcggatcggcgacaagattatctgactcgccatatcgacgttttgcggcaggttgttcgccaagtgcggaaccgccatccatttgagatcgtcgccatggtggtgttgccggatcatttccatgcggtatgggccttgccgcagggcgacgcggattacgcgacaagaatggcgctgatcaaggcggcgttttcgcgcagtctgcccaaagtcgaacgcatccgggagagtcgagagcgcaagcgggagcgcggcatctggcagcggcggtattgggagcatcagattcgggatgaggcggatttgcaggcgcatgtggattacatccattacaacccggtcaagcatggcgatgcggagcgggtggcggattggccgtattccagcttccatcgctatgtcaggttggggtggttgcctgcggattgggcaggggaaggtgttgtggtgcagttgcaggagtag

SEQ ID NO: 492 - DNA, 1800 bp, Chromobacterium substugae
atgagcaatctgatcgaattgaaagtcccggacatcggcggccacaacaacgtggacgtgatcgaagtgttcgtcaaaccgggcgacgtgattgaaaaagaagccagcctgatcacgctggaaaccgacaaagccaccatggaagtgccggccgaagccgccggcaccgtcaaggaagtgcgcgtcgccgtgggcggcaaagtgtccgagggcgacgtggtcgtcatcctggaagccgccggcgcagccgccgcggctccggccgaagtgaaaccggtggaaaccaccggcgtcgcctccgccaccacccaggccggcttcgcgccgcaagccgcgccggtcgccgcctcccatagcggcggcgccgacgtggaatgcgacgtgatggtgttgggcggcggccccggcggttactccgccgccttccgcgcggccgacctgggcctgaaagtggtcatcgtcgagcgttacgccaccctgggcggcgtgtgcctgaacgtgggctgcatcccgtccaaggcgctgctgcacaacgccgcggtgatcgacgaagtgagccacctggccgccaacggcatcaagttcggcaagccggaagtggacatcgacatgctgcgcggctacaaggaaaaggtcatcgccaagctgaccggcggcctgggcggcatggccaaggcgcgcaaggtggaaatcgtgcgcggcaacggccacttcatcgacccgcaccacatcgaagtctcgctgaccaccggccaaggccgcgaagagtcgggcgagaagaagatcgtcaagttcaagaacgccatcatcgccgccggctcccgcgtggtgaagctgccgttcatcccgaacgacccgcgcgtggtggactccaccggcgcgctggagctgaagggcgtcgccaaacgcatgctgatcatcggcggcggcatcatcggcctggaaatgggcactgtctactccacgctgggcgcgcgcctggacgtggtggaaatgctggacggcctgatgcagggcgcagaccgcgacctggtcaaggtatggcagaagtggaacgcgcaccgcttcgacaacatcatgctgaataccaagaccgtggccgtggagccgaaggaagacggcgtatgggtgactttcgagggcgagcaagccccgaaggaagcgcaacgctacgacctggtgctgtacgccaccggccgcgcgccgaacggcaagctgatcggcgcggaaaacgccggcatcgcggtgaccgaccgcggcttcatccaggtggacaagcagcagcgcaccaacgtgccgcacatcttcgccatcggcgacatcgtcggccagccgatgctggcgcacaagggcgtgcatgaaggccacgtggcggcggaaaactgcgccggccagaaggcctacttcgacgcccgcgtgattccgggcgtggcctacaccgatccggaagtggcctgggtgggcgtgaccgaagacgaggccaagaagcaaggcctgaagatcgagaagggcgtgttcccgtgggccgcctccggccgcgccatcgccaacggccgcgacgaaggcttcaccaagctgatcttcgacgccgaaagccaccagatcatcggcggcggcatcgtcggcccgcatgccggcgacatgatcggcgaggtgtgcctggcgatcgagatgggttgcgacgcgaccgacatcggcaagaccatccacccgcacccgaccatgggcgagtccatcggcatggccgcggaagtggcgcacggcacctgcacggacctgccgccgcaacgcaagaagtaa

SEQ ID NO: 493 - DNA, 1662 bp, Chromobacterium substugae
atgagcaatctgatcgaactgaaagtgcccgacatcggcggtcacagcaacgtagacatcatcgaagtattcatcgccccgggccagaccgtgtccgtggacgattccctgatcaccctggaaaccgacaaggccaccatggaagtgccggcggaagccgccggcgtggtcaaggaagtgaaagccgtcgtgggcggcaagatttccgaaggcgacgtgatcgccatcatcgaagtgggcgctaccgcgtccgctccggcgcctgcagccgccgcgccggcgcctgcagccgctccggtcgctgccccggctccggttgccgccgctccggccgacgcgccggcagcgcccaccgcatccggccgcagcgaaatccgcgtgccggacatcggcggccataacggcgtcgacgtgatcgaagtgacggtcaaagtgggcgacgaaatcgccgtcgacgacagcctgatcacgctagaaaccgacaaggccaccatggaagtgccggccaccgccgccggccgtgtggtggaagtgaaaatcaaggtgggcgacaaggtcagcgaaggcgacctgatcgtcgtggtggaaggcgctgtcgccgcgtccgccccggcagccgctgcgccggctccggcagcagccccggccgctccgaccccgcttgcagctgcgcctgccgccgcgccggccgtggcgccggtagccgccgccgtggccgccgccatcgacgaaatcgccttctccaaggctcacgccggtccgtccgtgcgccgtctggcgcgcgaactgggcgtggacctgggcaaagtgaagggcaacggccgcaagggccgcgtcaccgaagacgacgtcaaggccttcgtcaagggcgtgatgcagaacccggctattctggccccggccgccgcgccggcgggctccggcgtgggtctggacctgctgccgtggccgaaggtggacttcgccaagttcggcccgatcgaaaccaagccgctgtcccgcatccagaagatttccggcgccaatctgtcgcgcaactgggtgatgatcccgcacgtcacgttcaacgacgagtgcgacatcaccgagctggaagacttccgcaagaccgtgggcaaggaatgggaaaagtccggcctgaagatcagcccgctggccttcatcatcaaggccgccgccgaagcgctgaaggctttcccgaacttcaacgcctcgctggacggcgacaacctggtgctgaagcagtactaccacatcggcttcgccgccgacacgcctaacggcctggtggtgccggtgatcaaggacgcggacaagaagggcctgcgccagatcgcccaggaactgaccgacctgtccaagctggcccgcgaaggcaagctgaagccgaccgacatgcaaggcgcgaccttcaccatctcgtcgctgggcggcatcggcggcaccagcttcacgcctatcgtgaacgcgccggaagtggccatcctcggcgtctgcaaatcgcagatcaagccggtgtggaacggcaaggaattcgcgccgcgcctgatgtgcccgctgagcctgtccttcgatcaccgcgtgatcgacggcgcggccgccgcgcgcttcaccgtgcacctgggcaagctgctgaccgacgtgcgccgtctgatcctgtaa

SEQ ID NO: 494 - DNA, 2664 bp, Chromobacterium substugae
atggctgcaactttccctgacgatatcgatccgttggaaacccaggaatggactgaagcgcttgagtcggtgctggataacgaaggcccggaacgcgcgcattacctgttggaaaagctggtggagcgcacccgccgccgtggtgcccacctgccgtttgacgcgaccaccgcgtacctgaacaccatcccggtcggcaaggaagccaagtcgccgggcaaccacgagatggaacaccgcatccgctcgatcaatcgctggaacgccgccgccatggtgctgcgcgccggcaagaaggatctggagctgggcggccacatcgcctcctaccaatcctccgccacgttgtacgacgtcggcttcaaccatttctggcgcgcccagaatgaaaaccaggacggcgacctgatctacttccagggccacatcgccccaggcgtgtacgcccgcgccttcatggaaggccgcctctccgccgagcagatggacaacttccgccaggaagtggacggcaagggcctgtcctcctatccgcacccgtggctgatgaaggacttctggcagttcccgaccgtatcgatgggcctgggcccgctgatggccatctaccaagcccgcttcctgaagtacctggaaagccgcggcctggccaagaccatgggccgcaaggtgtggtgcttctgcggcgacggcgagatggacgagccggaatcgctgggcgccatcgccatggccgcgcgcgaaggcctggacaacctggtgttcgtgatcaactgcaacctgcagcgcctggacggcccggtgcgcggcaacggcaagatcatccaggaactggaaggcgacttccgcggttccggctggaacgtgctgaaagtgatctggggctcccgttgggacccgctgctggccatggacaccaagggcctgttgaagaagcgcatggacgagtgcgtggacggcgactaccagaccttcaagtccaaggacggcggctacgtgcgcgagcacttcttcggcaagtacccggagctgcgcgagatggtggccaacatgtccgacgaagaggtgtggaacctcaaccgcggcggccatgatccgcacaaggtgtacgcggcctaccacgaagccacccacaacgccaacggccgtccgaccgtgatcctggccaagaccatcaagggttacggcatgggcgcgtccggcgaagccaagaacatcgcccaccaggccaagaagatggacctggaaagcctgcgcaacttccgcgaccgcttcggcatcccggtgtccgacgaggacctgccgaatgtgccgtattacctgccggccgaagacagcccggaaatgaagtacatgcgcgaacgccgcgcggcgctgggcggctacctgccggcccgcaatccggtcaaccacccgctggcggtgccggaactgtccgccttcgacgcgcagctgcaagcgtcgggcgaccgcgagttctccaccacgatggccttcgtccgcatgctgggcaccatcatgaaggacaagaacatcggcaagcgcgtggtgccgatcgtgccggacgagtcccgcaccttcggcatggaaggcatgttccgccagtacggcatctggtccacccagggtcagaactacgtgccgcaggaccatgaccagctgatgttctacaaggaatccaaggacggccagatcctgcaggaaggcatcaacgagccgggcgcgatggccgactggatcgccgcggcgaccagctacgccaacagcagccagccgatgatcccgttctacatctactactcgatgttcggcttccagcgcatcggcgacctggcctgggctgccggcgacatgcgcgcccgcggcttcctgctgggcggcaccgccggccgcaccacgctgaacggcgaaggcctgcagcacgaagacggccacagccacatccaggccggcctgatcccgaactgcatcagctacgacccgaccttcgcctacgagctggccgtgatcgtgcaggacggcatgcgccgcatgtacgcggaacaagaggacgtcttctactacctgaccctgatgaacgaaaactacgttcacccggcgatgccggcaggcgcggaagagggcatcctgaagggcatgtacctgctgcaggacggcggcgacgccaaggtcaaggtgcagctgatgggctccggcaccatcctgcgcgaagtgatggccgcggccgacctgctgaaggccgacttcggcatcggcgccgacatctggagcgtgacctccttcaaccagctgcgccgcgacggcatggaagccgagcgccacaacctgctgaacccgaccgccgaggcccagtcctcctacgtcgaacagcagctggccggccgcaacggcccggtgatcgccgcgaccgactacatccgcaactacgccgaccagatccgcgcctacgtgccgggccgctacgtcgtgctgggcaccgacggcttcggccgctcggacagccgcgccaacctgcgctccttcttcgaggtggatcgctaccacgtggcgctggcggccctgtccgccctggcccgcgacggcaagatcgacggcgccaaggtggcggaagccatcgccaagtacggcatcaagactgacaagctgccgagctggaaggtgtga

SEQ ID NO: 495 - DNA, 984 bp, Chromobacterium substugae
atgcccatccttcccgccgccccgccccggctgaccgccggcggccgcgccgacttcggcgtctatcagggcaccgtgtccgacctcagctgggacggcctggccatgagccgctggcagcggctgggccgccggctgcgccacaaacgctggcagtacgccgccatcgccggcgagcgcttcttcatcgcgatggcggtagtggacgtgggctggagcggcaccgccttcgcctacctgttcgaccgccgcagcggccgggtggtggccgctgccagcgccgacgcgctgcccggcgccggcccccgcgtcgccgatcgggcctttggtgacgcccgcttccgcgcgcccggcaagcgcttcgaattcacccgcgacggtgacgcgctgcggctgcggctggacagccgggcgctgcagctggacgcgacgatcgcgctggccggcatgccgccggtgctggcggtgatcgcgccagccaactacatggcccacagcacccacaaaagcggcggcctggcggtgagcggcgaggcgcgctgcgcggccggccgctattcgctggacggcgcaaccgcctcgctcgactactccaacggcctcttggcgcgcgaaaccggctggcgctgggccagcgcccactcgcggcgcttcggcttcaacctgcagcaaggctatatgggcgacgcggaaaacgcggtgtggctggacggccggctgttccgcgtcggcgccgccgccttcgactaccagcccggcgatccgctggcgccgtggcgcgtcgccaccgccgacggcctgctcgacctggtcttcacgccggaaggcgcgcggcgcgaggacaagaacctgatcatcgccgccagccgctacgtgcagccgataggccgcttcgacggcgcgctgaccgacccggacagcggcgagcgccacgcggtgcgcgatctcgtcggcgtcaccgaggaccatctgtcgcgctggtag

SEQ ID NO: 496 - DNA, 759 bp, Chromobacterium substugae
atgctgttgttgttgaaactgctgctggtgccggcgctgatcggcttgatcagcctggctgcgaaaagatgggggccgggcgtggccggcgcgctggccggctttccggtgatcaccggctccatcctgttcatcctgagcctggaacaagacgccgccttcgtgcgcgaggcgtcgctggccgccgcgctgggcaccagcgccaacctggtgttcggcatcgcctacagctggaccgcgcgccaggcgcgctggccggcgtgcctggcggcgggcctgctggcctacgcgctggcggtggcgctgggacactgggcacagccgtccggctggcaaagcgccgttttcggcgttcttttcctgccggtggcgggcaagctgtttcccatgccgccgcagacgccggattcgccgccgcgcagcgccggcatggcgccgcggatgctggccggcgccgcgctggtgctggccatcaccagcctgtcggcacggttgggccccagcctcagcggcctgctagcggtattcccggtgctgggctcggtgctggcggtgttcagccacctcagcgccggcccggcgacgacgatacggctgctacgcggcatggtgcgcggcttctacgccttcgtcgccttttgcgtcgcgctggccgctgcgctgagcgcctggcccgcgtccgccgccttcggcgccgcgctgggcttggccatcgcggtgcaaatcctgatgatgtggctgggacgccggcatcattga

SEQ ID NO: 497 - DNA, 561 bp, Chromobacterium substugae
gtgaacgaaaaattggccaacccggccccgctgggcctgatgggcttcggcatgaccactgtacttctcaatatccacaacgccggcttcttcccgatcagctcgatgatcctggcgatgggcctgtgctacggcggcctggcgcagatcgtcgccggcatcatggaattccgccgcggcaacaccttcggcgtcaccgcctttttgtcctacggcctgttctggctgagcctggtgctgctgatcgtcttgcccaagaccggcctggccgacgccacgccggtcggctacatgggctggtatctgctgatgtggggcgtgttcacgctgttcatgctgctgggcactgtcaactatccgcgcgcgaagcagttcgtgttcgcctcgctgaccgtgctgttcttcctgctggcggcgcgcgatttcaccggcagcgccgtcatcggcatgatcgccggtttcgaaggcattatctgcggcgccagcgccatctacctggcgatggccacggtgctgaacgagcagtacggccgaaccgtgctgcccatcggcgcgcgctga

SEQ ID NO: 498 - DNA, 219 bp, Chromobacterium substugae
atgcagtcggtccatgggtgcggtttcctgtgcggatatcgggacggattcacctgtgcgtccagcgggcgcacaggtgaattcgctctggaagttttactctattccgggcggcatgctaccaccagtcggcggaatcggacaaaaattcgcggccgacgaatcgctggagatggaggcgatgccggcgattgcaagcggggtaagtccttattctaa

SEQ ID NO: 499 - DNA, 582 bp, Chromobacterium substugae
atggaccgactgcataccctgctcgaacacaatcgcgccttcgtggaaaaccgcgaatacgagcaatacaaaaccgacaagtttcccggcaagggcctggccatcctggcctgcatggacgcccgcctggtggagctgctgcccaaggcgatgggcctgaagaacggcgacgccaagctgatcaagaacgccggcgcgctgatcacccaccagtggggttcggtgatgcgcagcctgatcgtcgccgtctacgagctgcgcgccgaggaaatctgcgtggtggcccaccacgactgcggcatgcgcgcgatcgacccgcacaagatcctcacccatgcccaggagcgcggcgtcagcgaagacaccatcgccacgctgcgcggcgccggcatcgacctggacaactggctgaaaggcttcgacaacgtcgccgacagcgtgcgccactcggtgaacaccatccgcaaccacccgctgatgccgaaagacatcccggtgcacggcatggtgatccacccgtccaccggccgcctggaagtcgtggtcagcggctacggcgaagagggcgcgccggccgcatga

SEQ ID NO: 500 - DNA, 639 bp, Chromobacterium substugae
atgagcccgcgcatcggggtgttcggcggcaccttcgaccccatccaccaggcccacctccggatggctgccgccttcgccgacgaactggcgctggagcgggtgctgctgattcccgccggccaaccctaccaccgcgcgcgcggcgcgcgcgccagccccgagcaaaggctggaaatggtgcgcctggccatcgccggcgaccccaggctgcaggcggacgaccgcgaaatccgccgcggccgcccggcctataccgtggagacgctgcgcgaattgcgcggcgagctgggccaggacgccgagctgtggttcctgatgggcggcgactcgctggccacgctcgacagctggaaggactggacccagttgttccagctggccaacctggccgtcgccatgcgccccggcttcgactggcagacgctgccggccgaggtgcggcgcgagtggcaggcccgccaagtccatgatttttcaaatcgaacggcttccggtacaatccgctccctggctctgccgccgctcgatctgtccgccacccgcctgagggcccggctggcctccgggcaaacggccgagggcctgatcgacccggccgtgctggcctacatccgccagcagcggctataccaatga

SEQ ID NO: 501 - DNA, 369 bp, Chromobacterium substugae
atggaaattcaagcaatcagcaaactggccgtcgaggccctggaagacatcaagggcaaggacatcatcgagctggacaccagcaagctcacctcgctgttccagcgcatgatcgtcgccaccggcgactccaaccgccaggtgaaggctctggccaacaatgttcaggtcaccctgaaggaagccggcgtggacatcgtcggcagcgaaggccacgagagcggcgagtgggtgctggtggacgccggcgacgtggtgatccacgtgatgctgccggccgtgcgcgactactacgacatcgaggcgctgtggggcggccagaagcccagcttcgccgccggcgccgccaagccgtggtcggcggtctga

SEQ ID NO: 502 - DNA, 471 bp, Chromobacterium substugae
atgaaaatcaccatactcgccgtcggcaccaagatgccgcgctgggtggacgaagcctattccgactacgccaagcgcttcggccgcgacatcacgctggaactgaaagagatcaagccggaaaaacgcggcggcggcgtcaccgccgaaaagggcatcgccgccgagcacgaacggctgatcgccgccatcccgccgcgcgcgcggctggtggtgatggacgagcgcggcaagaactggacctcggtcaagctggccgaaggcctgaaagaatggatggccggcggcgacgacgtggtcttcatcatcggcggcgccgacggcctgtcggctgagctgaagcagcgcgccgacgtgctgctgcagttgtcggcgatgacgctgccgcacggcatggtgcgggtgatgctggccgagcagatctaccgcgcctactcgatactcaacaaccacccctaccaccgcgaatga

SEQ ID NO: 503 - DNA, 399 bp, Chromobacterium substugae
atgatgagcacttggtatgtcaggatttgggcgtttgccgccatcgccagcgcgatcggccacttgctggcgccgcagttcatggcggccggcacggcctggggcctatccagcggctggcagtgcgagatcgctatcttcgatctggtgctggcgacttatctgctgtgcaggctgcatgaggagccgcagtccgcgcaccgcttgatggcgctgctgtgcgggttgtcgctgctgctggggatcaaccatctgcagggcggtttgctcagccattggagctatctgcacgtggccggcgtcgccgccaacggtctggcggtgctggcgggcgtcagcttgctgtggccgtacagcaggcgccgcttgagcgccgggctgcgcaagcatccgcagtag

SEQ ID NO: 504 - DNA, 1278 bp, Chromobacterium substugae
atgacccttctgagcggctggagccgggggcgtttccactatgcctggatcgccgtcgccgtcaccttcctggtgatgctggtcaccgccgccatccgttccgctccgggcgtgatgatggtgccgctggagcatgagttcggctggagccgctccgcgatttccaccgcgctggcgatcaacctggcgctgttcggcctgatggggccgttcgccgcggcggcgatgctgcgcttcggcctgcggcgcacggtgctggcggcgctggccttgctggcggtttgcgtgggcttgtccagcctgatgcgcagcaactggcagctgcagttgctgtgggggctgatggtgggctgcgccaccggcgccaccgcgatgacgctgggcgcgtcggtggtcagccgctggttcgtgcgccaccgcgggctggcgatgggcatcctcaccgccagctccgccaccggccagctggccttcctgccgttgatggcctacctcaccgaatggcatggctggcgcagcacggtctggctgctggccatcgccgccgcctgcgcgatgccgctggtggcgctgctgttgccggagcggccgtccagcataggcttgcgcgcgctgggcgaagcggacgacgcgccgccgccgccggtccttggccacaacccgatccgcatcgccttcgacgcgctggcccgcgccgcccgttcgcgcgatttctggctgttgttcgccactttcttcgtctgcggcgccagcaccaacggctatatcggcacccatttcatcgcgatgtgcggcgattacgggttgacgccggtgcgcggcgccagcctgctggcggcgatgggcatgttcgatctcttgggcaccacgctgtcgggctggctatccgaccgctttgcgccgcaaatcctgctattttgctattacggcctgcgcggtttggcgctgatatacctgccttacgctttcgggctggagtatttcctcggcctgccgctgttcgcgatgttctacggcctggattgggtggccacggtgccgccgacggtgaagctgaccgccggcagtttcggcagccaggaggcgccggtggtgttcggctggatcgtcgccggccaccagctgggcgcggcgttcgcggcgctgggcgccggcatgctgcgcaacagcctgggcagctatacggcggcgacgatgatttcgggggggctatgcctgttggccgcgggactggtcctgttgatcaaccgaccctcgcgcgtctggcgggcggcttga

SEQ ID NO: 505 - DNA, 366 bp, Chromobacterium substugae
gtggcggagttatatgccagccaaggttggggagaggagaaagctttcgatctgcaggcgatggagcgggcgttccgcgcctgtttcggcgtatgcgcgttggacaacgggcgagtgctggggtttgcgcggggtttcagcgatggttggcaagcgggctggctggccgagattgtcgttcatcgtgattgcatcggcttggggctgggcacggcattggcgcgggcattcatgctccgctgcggcgcggaggtggtctattgcgaggcgctggccggccgcgagccgtttttcgagcggctgggattcaaggtgcggccgcggctcagcgcgatggcatggcgcgcgccgacgggctgtgggtaa

SEQ ID NO: 506 - DNA, 882 bp, Chromobacterium substugae
gtgctggcttcattgagcgatctggcggtgttcatcaccgtggcagagcagggcagctttgtcggcgccgggcggctgctgggggtgtcggcgtcggcggtgggcaagcggatcagccggctggaggcggaactgggcgtgcggctgctgcaacgcagcacccggtcattggccttgacggcggagggcgacgcggtgttgggccggggccggcgcatgttggaagaagcctccgcgatggcggcggagctggagcaggcgggcaagctgccaggcggcctgctgcggttgagcctgcccccgataggcggcgtgatgatggcggagctgtcggctttccagcagcgctttcccgaggtgtcgctggagctggattacagcgagcgcaacgtcgacatcatcgaggaaggtttcgacgccgccatccgggtgggcgagggggatgacggcaagctgcgcagcctggccttgccgggattccgccgcctgatcgtcgccgcgccggactacctggcccggcatggcagtccgcggagtccggcgggcttggcggaccaccgcttgatccattaccgctcgcccaatagcggcaagctggaggattggccgctggccgacacatcgctatcggccgcgttggtctgcaatagcatgcatgcgcggctggaattcgcgttgcagggacagggcatcgcctgtctgccggacatttccatccgccgcgagctggacgacggccgcttgcggcctttattgaacagcgacagcggcgagcgggtgccgttgcggctgctgtggccatcgtcgcgggggctgtcggcccggatggcggcgttcgtggatttcatgcgtcagatggcgggggaggcggagtatggctga

SEQ ID NO: 507 - DNA, 1143 bp, Chromobacterium substugae
ttgacgctggcggtggccgccttcgccatcggcaccgctgaattcatcatcatgggcttgctgcccctgatcgccgccgacctgcgcgtcggtttgccgcgcgccgcatatctggtgtcaggctatgcgctgggcgtggtggccggcggcccgctgctggccggcctgatcgcccgcctggacgaaaagcgcgcgctaagcgggctgatgctgattttcatcgcaggcaatctcgcctgcctgctggcgcccggcctatggccgctgctgctggcgcggatgttcaccgccttctgccacgccagcttcattggcgtggcggcggtgatggcggcgcggatggctccgcccggcatggccggccgggcgatggcgctgatgttcagcggcatgacgctggccaatgtgctgggggtgccggccggcacgctgatcggccagtgggcgggctggcgcgccagcttcgccgcggtggcggcgctgggcttccttaccttattgctgatccgctggcagctgccgacgcacatcggaaaccataccagcggcgaaacgcaggcgcgcttgcctggacgcgtctggccggcgctgctcgccagcgtcctggccgcagccagcatgttcgccttcttcacctacctagtgccgacgcttagccaggtcagcggcttggcggcgaagcacgccagcgcggccttgttgctatgcggcgcgggattggtgatcggcggctggctcggcggccgcttggcggacggaaacctggaccaggccctgtcgcgatgcctgatcctgctatgcgccacgctggcgacgttctacttgctggcagcgcgcctgcctttcgcgctggcgctgatggcgctatggggcggcctggctttcgccctatgcatgctgctgcaaacgctggccattcgccaggcgggagaggccgccgcgcaggcatccgccctcaatgtcggcgcctttaacctgggcaatgccttgggagcgtggctggctggaagactgctcgaccatggcggaaccttggcgcaaaccagcctgttggccgcggcgctggcggggctgacctggctgctggcgcggttcatttcacgcgtggaaaccgcccggcgcgtcgcactggcgcgggcatga

SEQ ID NO: 508 - DNA, 981 bp, Chromobacterium substugae
ttgaccgcggcgctggccaaggggctggcgccgttgtacctggtgcacggggaagaggcgctgctggcgctggaggccgccgacgccgtgcgcgcggcggcgcgcgcggccggttacctggagcgcgaagtgctgacggtggaggcgggtttcgattggtcgcagctgttcgacgcgatgagcagcgtgtcgctgttcgcctcgctgaagctgctggaaatccgcattcccggcggcaagccgggcaccgagggcagcgaggcgctgcagcggctggcggccaacccgccggccgacaccctcaccctgatcacgctgcccaagctggacaagacccagcagcagggcaagtggttcgccgcgctggaaaaggccgggctggcggtggaggcgcgcccggtgggccgcgccgaactgccgggctggatttcgcggcggctgaaggcgcagggtcagcaactgggcagcgaggcgctggcgttcttcgtcgagcgggtggagggcaacctgctggccgcgcgccaggaggtcgacaagctggcgctgctgtatcccaagggcgaactcagcctagcggacctgcaggcggcggtggccaatgtcgcccgtttcgacgtgttccagttgtcggaatcctggctggccggcgacgcgccgcggctgatgcggatgctggacgggctgatggccgaaggcgaggcgccggtgctggtgttgtggtcgctgtccgaggacgtgcgcatgctgctcaggctgcgccagggcctgaaggacggccgccagctgcgcgacatggcgcgcgaactgcggctgtggggcgacaagcagcggctggccgagccggcgctgcgccgcatcggcccgcgcaagctgatgcaggcgttgtccgagtgcgcgcgcatcgatcgccagatcaagggcgtggagccgggcgagccctggcagaccatgcgggcgctggcgaccctgctggccgcctga

SEQ ID NO: 509 - DNA, 558 bp, Chromobacterium substugae
atgaaacaaagcctgaactgcctgctgttggccggcttggtcctgctgctgagcgcttgtggcttccacctgcgcggcctggggggcagcgtcaaggagctgccgttctcaaccatgtatctggaggcggccaataccggcatcgaagcggacctgcgcacggtgctggcgcgcaattcgaagctgacgctgctgccggctgccaagcaggcgcaggcggtggttaccgtgctcaacgagaaccagtccaaggacatcctcaccatcaacgccagcggcaagatcagcgagtaccagctgacctacaccgccaccgtgcgggtggtgctgggcggcgtgccgatcgagccggacatggaggtgagcgtgcgccgcagcatgaattactcggatagcgcggtgctgggcaaagagcaggaagagggcctgctgtgggccgatgcccgccgcgacgccgccgagcagatcgtgcgccgtctggcctacctgaaagtgccggctgtctcgccggccggtccgcaaagcttgaagccggccaatgccgtcactcagccctga

SEQ ID NO: 510 - DNA, 2718 bp, Chromobacterium substugae
atgcaagaacactactccccgcgcgagctggaaagcgccgcgcagcagaaatggcagaaaaccgccgccttcaaggcggttgaagacgcttcccgccccaagtactacgcgctgtcgatgttcccgtatccgtccggcaagctgcacatgggccacgtgcgcaactacaccatcaccgacgtgctggcccgcttcaagcgcctgcagggcttcaacgtgctgcaaccgatgggctgggacgccttcggcctgccggccgagaacgcggcgatgaagaacggcggcgcgccggcggcgtggacctactccaacatcgaatacatgaagacccagctggacagcttgggcttcgcgctggattgggagcgcgagctggccacctgcaagccggactactaccgctgggagcagtggctgttcacccgcctgttcgagaagggcgtgatctataagaagaacggcgtggtcaactgggacccggtggaccagaccgtgctggccaacgagcaagtggtcgacggccgcggctggcgctccggcgcgctggtggaaaagcgcgaaatcccgatgtactacttccgcatcaccgactacgccgagcagctgctggcggacctggaccagctggacggctggccggagcaggtcaagaccatgcagcgcaactggataggcaagagctacggctccgacgtggtgttcccgtacgacgaggccagcatcggccataagggcgagctgaaggtctacaccacccgtccggacacgctgatgggcgccacctatgtcgccgtcgccgccgagcatccgctggctacccaggccgcggccggcaacgccgaactgcaggccttcatcgcggaatgcaagtccggctccgtggccgaggccgacgtggccaagatggaaaagaagggcatgccgaccggcctgttcgtgacccacccgctgaccggcgaacgcttgccggtatgggtggccaactatgtgctgtggggctacggcgaaggcgcggtgatggccgtgccggcgcacgacgagcgcgacttcgaatttgctaagaaatacaggttgccgattaagccggtagttctgaatgagaaaaatgttgatgatgtaaacgtcagttatgcagaggttggtggggcgtctaatggtgaaaatggtgtcccgtttagattcccagttattcgcagagcgaataacctagtagtggaacacagaatttcttgggatgaatggcagccttcttttgctgagcatggcaaattaatccaatcagacgaatttaatggactgacttcttctgaagctttcgagaaaatttgctctaagttgcaagataagggtttaggccagaagaagacccaataccggctgcgcgactggggcatcagccgtcagcgctactggggctgcccgatcccgatcatccactgcgccagctgcggcgacgtgccggtgccggaaaaagacctgccggtgacgctgccggaaaatgtcattccggacggcgccggcagcccgctggccaagatgccggaattctacgaaaccgcctgcccgaagtgcggcggcgcggccaagcgcgaaaccgacaccatggatactttcgtcgagtccagctggtactacgcccgctacgcctcgcccaagtgcgacaccgcgatggtggacaagcaggccgccgattactggctgcaggtcgaccaatacgtgggcggcatcgaacacgccattctgcacctgctgtacgcgcgcttcttccacaagctgatgcgcgacgaaggcctggtatcgtcggacgagccgttcaagagcctgctgacccagggcatggtgatctgcgaaaccttctaccgcgacctgcccaatggctccaaggactggatcgcgccgcaggacgtgatcctcgagcgcgacgccaagggcaagattgtggcggccacgcaccgcgtggacggccagccggtggtggtgggcggcatcgagaagatgtccaagtccaagaacaacggcgtggacccgcaggagttcatcgagaaatacggcgccgacaccgcgcgcctgttcatgatgttcgccgcgccgccggagcagagcctggagtggtccgacgccggcgtggaaggcgcgttccgcttcctgaagcgcctgtggaagagcgcgcgcgagcacgtcgaggccggcgtggtcgctccgtatagcgcgggcgagctgaacgccagccagaaggagctgcgcttcaagctgcacggcaccatccagaaagtggccgacgactacggccgccgccagcagttcaacaccgccatcgccgcggtgatggagctgctcaacgcctacgacaaggccgacaccagtggcgacaccggccgcgcggtggcgcaggaagtgctggaagccgccaccctgctgctgtcgccgatcgtgccgcacgtctgcgacggcatctggagccagctgaagccgggcaccgagctgctggcccagtcctggcccaaggtggatgaggccgcgctggtgaagagcgagatcgaactgatggtgcaagtgtgcggcaagctgcgcggcagcgtcaccgtggctgccgacgccgccaaggacgcgatcgaggccgccgcgctggcgcacgagaacgtgatcaagttcatggaaggcaaaccggccaagaagatcatcgtggtgccgggccgcctggtgaacatcgtcgtttga

SEQ ID NO: 511 - DNA, 804 bp, Chromobacterium substugae
atgctggcgccgcccttgctggttgccttgctgggctgcggcgcggtggccggcttcctggccggcctgctgggcgtcggcggcgggctgatcatcgtgccggtggtgctggcggtgttggcggccgcgcatctgggcggcgagcacgcgcagcatctggcggtgggcacttcgctggcggtgatggtgttcaccagcgcttccagcgtgcgcgcccaccacaagaaaggcgcggtggactggcgcatcgtgcgcggcatggcgccggcgatggtgctgggcacgctggccggcagcctgctggcgggctggattcccggccgcgcgctggcctggtttttcgtggtctacgcctacgcggtggcggcgcaaatgctgataggcaagcagcccagggccgggcgcgagatgccgggccgcgccggccagggcgcggcgggcggcgccatcggcatgatttccagctgggtgggaatcggcggcggctcgatgagcgtgccgttgatgagctggtgcaatgtgccggtgcatacggcgatagggaccagcgccgcgctgggctggccgatcgccgtttccggcgcgctgggctatctggccagcggctggcgcgcgcaaggcctgccctggggcagcgtcggctttgtttatttgccggcgatgctggccttgatgctgatgacggtgctgtgcgcgccgctgggcgcgcgggccgcgcaccggctgccggtggccaggctgaaaaaggcgtttgccttgctgatggcggcgatggccagcgagatgctgctccggctgctatga

SEQ ID NO: 512 - DNA, 459 bp, Chromobacterium substugae
atgcgctattggctgatgaagtccgaaccggacgaaacctcgatcgaccacctggccgccgaaccggcgcgcctgttcgagtggaccggcgtgcgcaactaccaggcgcgcaatttcatgcgcgacgacatgcgtcccggcgacctgctgctgttctggcattcgtcttgtcccgagcccggcatcgccggcatcgccgaagtggccgcgccggcgcatcccgactccagccagttcgatcctgacagcccctatcacgatcctaagtccgacccggcccagccgcgctggcagtgcgtggacgtgcgcttcgtcagcaagacccggctggtgtcgccggccgagctgcgcggccatccgccgctggagggcatgacggtgctcaagcgcggcaaccgcttgtcgatcacgccggtgacggcggaagagtgggactatctcacgcgcgaggtgttgtga

SEQ ID NO: 513 - DNA, 156 bp, Chromobacterium substugae
atgaaaacgtggatactcgccgtaatcgcgataggcagcctaagcggctgcgtggtggaaccgccgcgagtgggcatcgcaccggtagtggtgcggccggcggtggtggtggcgccggcttactactacggcccgcgctactacggctggcgttga

SEQ ID NO: 514 - DNA, 330 bp, Chromobacterium substugae
atgattctgctgctgttgctgcccttgctggctgcctgcctgctggggcggctgggctggggctggtggctgccttacgccgcgctggccttgccgacgctgctggcgtattggctggacaagcgcgccgccctgcgcggcgcctggcgcattccggaggccaggctgcagctgctgcacctggccggcggctggccggccgcgtttctcgcgcagcgctggttccgccacaagacccgcaagcagcctttcctgctgatctattggctggcggcgctggccaatctggcgccgccgctggcatggtggtggcttcaacgccagccgtag

SEQ ID NO: 515 - DNA, 609 bp, Chromobacterium substugae
atgaccgatattctccccattacagacaaaccgacgctgcgccgccagctgcgccgcgcccgcatggctttgccgccggcttatcgcgccgccgcggcgcaggccatcgcccgccatgcttcgcgcctgttgaagcgcggcaagcgcgtgggaggctatctggccgccggctccgagctggacctggccatgctgctcaacgccgcgctgtggcgcggcgcgcgcgtctatctgccgcagattccgcgccgcggccgccggctgtggttcacccggctggcggccgccgaccgctggtatctgcacccgcgctaccgcatcctggaatacgccggcgcccggctgcgcgccgagcggctggacgtggtgttcgtgcccttgctgggcgtagaccgcgagggttaccggatggggcagggcggcggtttctacgacagcacgctggccttccgccgccgcgtcgccgccggcgggccgctgctggtcggcgtggctttcgattgccagctggtggacgcggtgccgcgcgaggcctgggatgtgcggctggactgcctgctgaccgagtccggcctgcggcggctgccgctgcgggaggcggaagcatga

SEQ ID NO: 516 - DNA, 312 bp, Chromobacterium substugae
atgagcgacgtggttcaggtcgagatcgaactgttgggccgtcatttcaccatcggcaccccgcagggcgagcaggaaaccctgctggaggcggtgcgcctgctggaaggcaagatttccaccattcagcagcacggcaaggtgatggacgccgacaagatcgccatcatggccgcgctcaacatcgcccacgatctgctgaaaacaaaagtgggcgagggcttggagatggcggcgtttcagcgtaagatacgcgacatgggcgaagcggccgacaacgcgcttcgccagagccagcaaccgctgttctga

SEQ ID NO: 517 - DNA, 210 bp, Chromobacterium substugae
atggacaatgaactggaatatctggaatcccgcgtcgcggcgctgatcgcccgcatccgggagttggaaacccagaacggccgctttgccgaggcgctgtccgaagcgctgaaggagaatgccgagctgaatttccgcgtgaacgaaacccgcagccgggtggcggccctggtggcgcgcctgccgggcgcgccggaggatgagcaatga

SEQ ID NO: 518 - DNA, 855 bp, Chromobacterium substugae
ttggccgccctgttgctggccggcgccgcgcaggccgatatccgtgtgacggacggcgatggccaggaagtggcgctgcggcagccggcgcagcgcatcgtcagcctggtgccgcacgccaccgagctcttgttcgccgccggcgccggcgacaaggtggtggccaccgtcgaatacagcgaccatccgccggcggcgaagaagctgccgcgggtcggcagcttcaccggcttcagcctggaggcggtgctgcgccagcggcccgacctggtggtggcctggaaggatggcggcaccccgcgcgaactggcgcgtctgcgcagcctgggcgtgccggtgttcatcagccatccgctgcagccgggcgacgtggcgctggaaatcggcaagctgggccggctggccggcagcgaggcggcggccaaccgcgccgccgcgcaataccggcggcaaatggcggcgctgcagcagcgctacggcggccgcgcgccggtgcgggtgttctaccagctgagccaggcgccgatcttcaccatcagcggcaaaagctatatcgattcgctgatccgcacttgcggcggggtcaatgtgttcgccgacctgccgctgccggcgccgcaggtatccaccgcctcggtcgtggcggcgcagccacaggcgatagtggcgtccgacgaggcgacgctggcgatgtggcggcgctggcgcggcgtgccggcggtgtcgcatgccgcgctgttcgcgctgccgggtgacgacatcagcattcccggcccgcgcctggtcgagggcgcggcggcgctgtgcgagcggctggacatggcgcgccagcggctgggtttgacgcccaactag

SEQ ID NO: 519 - DNA, 528 bp, Chromobacterium substugae
atgccccatctgatcagcggcggcgcccgcagcggcaagagcgcccatgcagaagacctggcccgccgccatgccggcccggtgtgttatctcgccaccgccgaagtgcgcgacgccgagttcgcgcgccgggtggagcgccaccgcgcgcagcggccggcgcattggcgggtggcggaagccggccgcggcctggccgccgccatcgccgccgctgactgcccgggcgggctggtgctggtggactgcctgggcatgtggctgatgcgctttttcggtgaaccaggctttgacgaagccggctacgccgtcgagcgcgacgccctgctggcggccttggacggcgcgcgtggcgaaatcctgctggtcagcaacgaggtgggctggggcgtggtggctggagatgccgaaacccggcgcttcgtcgacgaactggggcggctcaaccagctggcggcggcgcgctgccagcgggtgacgctggtggcctgcggtttgccgctggttttgaaagggggtccggcatga

SEQ ID NO: 520 - DNA, 1974 bp, Chromobacterium substugae
atgttcaagtttcaatcctgcgcgctgttcgcggcgctgaccgccgccggcgtggttcaggccgccgatcttcccgagttcgccggcgacccggtgatcgtcaccgccagccgggtgccgcagaaagtctcgtcgctgccggcgaacgtcaccgtcatcaccgccgaggacattgccaacagcacggcgacgacggtgcaggatgtgctgtctagctacgccggcgtgcatgtgtcgaacagttccggctccgccagcacggcgatggtggacttgcgaggtttcggcgtgacgggcatgagcaacacgctgatcctggtcgatggcgtacggcaaaacaccaatgatttgagcgcgcctaacctgggggcggtcacgctggcgagcatcgaccacatcgaggtggtgcgcggcatcggcggcgtcgcctacggcggcggcgcgaccggcggggtgatcaacatcattaccaagtccggcgcggccaacggggtgaacggcagcgtcatgctgaccggcggcagttacgatctgcgccagctggatgccaatctgcacgcggggaaccagtatgtggcgctggatggctatgtccagtcgttgaagaccgacaattaccgccagaacaatgccgagcgcgacgacaacgccggcgccaccttgactttcaagcatgacggcggcgacatcaagctgttcgccaaaacggcgagccagggcttgcgcctgccgggatccatcgtcatggatccggccaacggccagaaccccttgctcaacaatccgaccggcacggcgacgccgaacagtcactcctccaccggcaccagcagcggcggcgtttctttgagccaggacttgggggccgggacgctgtatgccgactggtcgcgccgcgtcaaggatgcggactcctgcgtccagtatgccggcatcgccggatgctcgcgggaccagcgcaatctgggcgaaaacgccgccagcgcccgttacgagctgcctatcggcaagcacaccctgtctttcggcagcgactggctcgacagttcgatgagcgtatacaactcgctgggcaataagcagacctcgcaaaagcgcgtcggctatttcgtcgacggccagttcaagctgtggcagggcgcgacgctgtcggccggaggccgccagcaactggtggacgacaaggtcaacgccatgagcggcggggccaatctgtcgaccatccataccagcctgcatgcctggtccttgggcctgaagcaggatttgcgcgcgggttggagcgtgtatgccagatccggccagagcttccgcctgggcaatgccgatgaggtgacttataccaacggcctgccgctgcagccgcagcagtcgcatgatagggaagtgggggcgcaatgggcgaacgatgcggcgcatgccaagctggcgctgttccgcaatgatctgaccaatgaaatcgcttacaaccccttcgtcgggctgtttggcgccaatgccaacttgccggagacgcgccatcagggtgtcgagctggagggcggcgccaagctgtcgcagcgggtgggcgtgaacgccaatctgacctggactcaggcgacctaccgctcaggcgccggcttggccggcaacactattccgatggtgccgaagctgatggcgaataccgcagtgaattggagcatcagcgacgccagcaaggtgtcggtggcggcgcaatatgtttctcagcagtatttcgataatgaccagagcaacgcctttggccgcaagttgccggcttacacggttgtcgacgccaagttcagccaggcattcggcaagcatgtgagcgccactttcagcgtgaacaacttgttcaacaggcattatgcgacctatggcgggacggatgcttacacctcgcctacggcttatgatttgtacccggccaacgcgcggaattaccaagccgccgtgacttacacgttctaa

SEQ ID NO: 521 - DNA, 1035 bp, Chromobacterium substugae
atgaacagcagcaaacccctggatctctccgcccgcaacgccgcccgcgcccgccaggccgtgctcaccaagccgcccggcagcctgggccagctggaggaactggcttgccgcttcgccgcctggcagggacgggcctgccccgaggaattgaaaccggcgatcaccgtgttcgccggcgaccacggcgtcaccgtcgaaggcgtgtcggccttcccggccgaggtcaccaccgaaatggtgcgcaacttcagcgccggcggcgcggccatctgcgtgctggcgcgcgcgctggacgcccggctggaggtcgtcgacgtcggcgtggcgggcgatgtgtcggcgctgcccatcatccacgccaaggtgcgcgccggcagccacaatctggccaaacagtcggcgatgagcgccgaggaaaccgccgccgcgctggaaaccggccgcgccgccgcgcgccgcgcggtggatgccggcgccaatctgctgatcgccggcgacatgggcataggcaacaccaccgcctccgccgcgctgatctgccgcctcaccggcgcggcgccggagctggtggtcgggcgcggcaccggcatcgacgacagcggcctctccaacaagcgccgggtggtgaaaaccgcgctggcgcgggtggcctgggaaaacctcagcggcgaggacacgctggccgaattgggcgggctggaaatcgccgcgatcgccggtttcttcctggaaggcgcgcgcctgggcgtgccttcgctggtggacggcttcatcgccagcgcggccgcgctgtgcgccaaagcgatagacccgacgctgcacgactggctgctggccagccaccgctccgccgaatccggccacgacctggcgttggcggcgctgcagctgcacccgctggtggacctggggctgcgcctcggcgaaggctccggcgcggcgctgtgcgtgccgatgctgcagatggcggtgaagctgcacaacgagatggccactttcgccgaagccggcgtcagcggcaaatcggcatga

SEQ ID NO: 522 - DNA, 603 bp, Chromobacterium substugae
atgaatccctacacgctcaccctgctgcgccacggcgaaatcgaccacgacggccggctgatcggcctgaccgacctgccgctgaccgagcacggccaccatcagctcggtcgcagctggcagcgcatcagcagcctggcgccggtcaccgccatcgccagctcgccgctgcagcgctgccgcgaattcgcggtcaagcaggcgctgtccggctcgctgacgctgaaagtggacccgcgcttcgccgagatggacttcggcggctgggacggccagccggtggccgacctggagcgcgtccaccccggctggggcgaagcgctggccgacggcaggctgagcccgcccggcggcgaaagcttcgaagcgttccgcacccgggtgctggccggcctggccgactggatgaccgaggcgcgcggcagccaccggctgctggtgacgcacggcggcgtgatcactgtgctgatggcggaattgctcggcaccgatttttccgtcgccaagctgatgacggtgcagcgcggcggcttcgtccagctgtcgatgctggaaggccacccggcctacctgctgcgcctggagtctgcatgcgcggactga

SEQ ID NO: 523 - DNA, 741 bp, Chromobacterium substugae
atgcgcggactgatcctggcggtgcagtttctcacccggctgccgacgccgcagttggcggaattcaagccggaatggctggccgccagcgcgcgctggtttcccgccgtcggcgcgctggtcggcgcgctgctgctgggcgcgctgcaagtgggccagccggtcgacccctggctggcggcgctgctggcgctgctggtctggaccggtgtcaccggcggcctgcacctggatggcctggccgacctcgccgacgcgctgggcgcgtcccaccgctcgcgcgaacgcttcttcgaggtattgaaagacccgcatctgggcagcttcggcgtgctctcgctgatcctggcggtggtttgcaagctggtgctgctgatgctgctcgcgcgccagagcgggccggtctggggactgctgctggcgccggcctgggcgcgcggcttcgccatcgcttggtctgcgacgctgccggccatcgcgccgggcagcggcgaacgcttcgcctggcgccgcgactgggccggcatggggctgaacctggccgcgctgctggcgctgtcggcctggctggcgccggcgctgctgctggcccccttggccggcctggcctggtgggccttcctgaagcgccgcctgggcggcatgaccggcgactgcctgggcgcgggggttgagctttgcgagatcgcgctgctcgccgcgctgttgattctgccgacgtattttcctgtgttgaagtga

SEQ ID NO: 524 - DNA, 1077 bp, Chromobacterium substugae
ttggcggcgccggttcacgccgatgtctggcagggcgagttgggcggcgcgccggttgtgatggagtggagcgtcgataacgagggcgaggtcgacggccgttatttctatcgcaaattccataatgacatcgcgctgacgggcaagcgggatgcgcagggcgcgttgcgcttgagcgagagcctgggccatggcgaggcgcgggccgatctcgcgttgcgcccatccggaaccggttgggtgggtgagtggcgcgaaccgaagacgaagcgcgcgttgccggtcacgctgacgccgttggccatgtcgagcgaggagggtacggacgaagcggattggatcgacgactacaaccgggccagattggctgacctgcggttgcggcgggtgggcgaacaggttttcctcggccatcggctgagctggtgggaggagccggtcagccggatccgctggttccggttggaaagcggctattctgcggacgccatggcccgtctgaaccggatttttgagaggcggcaatggcgcgcggtggtggatgccttcgagtgcgtggcggccgcgcagggttcgactttaggcaggtatcagcaggcggtgaccccgcgcttgctgacgccgcgcgtggtgagcatcagcattgaaaccagcgcgttttgcggcggcgcccatccggactccggcgacgcgccgttgaatatggaggtggccagcgggcgcgttttgcatctggaggatgtattgtggctggggaggggcgaaccacaggatgcgcggggcgaggatggcctgctgcgagatgccgggtatgaaagcaaggtgctgcagccttggctcgctagcgtcttcggcaagttgtatccgcgggagatggctggtggcgaaggcgggggttgcgattaccgcggtcccgaggcctggaatgcgttcaattggtatctgacgccgaaaggcatgcagatcggcgccttcttcgcgcgcgcgcggaaggattgcgacaacccggcctggagcctgttgccgtgggcattggtgcgccagcacccaggcgttttgacgccgcgtttgccgtaa

SEQ ID NO: 525 - DNA, 840 bp, Chromobacterium substugae
atgggtcgccgttttgcttgccggattgccatggcccgacacttccacattaccaggctgctggaccgcggccgcttcaacgacaaggtattgcgccagctgggctgggcgatggccttcatcgccggcgccatcaacgccggcggcttcctggcggtgcaccgctatacctcgcacgtctccggcatcgtgtccggcatggccgacgcctggggcaccggtgaggtgcggctggcgctttcgctgctggtgatgctgtgctgcttcatcggcggcgccatgcacagcacctggctgatcctgtgggcgcgccggcaacggctgcgcggcggctacggcgtgtcgatgatggaggaggcgctgctgctgctggtgttcggcttgctgggcgccggcttgtcgttgcacaagggcctgttcacgccgccgacggtgatgttgttgtgcttcatcatgggcatgcacaacaccatcgtcaccaagctgtccggcggcctgctgcgcagcacccacatgaccggcatcgccaccgacatcggcatcgagctggccaagatgagctactacaaccgccagcaggggccacggatccaggcggtgcgatccaaccgcaacaaattccgcgtctacagcctgatcctgttgtccttcttcgccggcggcgtggtcggcgcgctgggcttcaagcacctgggtttcggcttcacgctgccgctggccttgttcctgttcctgctgggtctcaggcccgcctggtacgacgtcaggctgcgctggcgctggtggcggatcggcttgacggcggccagggcgcgcgccggcgctttgcgccggacttga

SEQ ID NO: 526 - DNA, 831 bp, Chromobacterium substugae
gtggcgctggtggtggtgctgaatctggtggtggccatgtatggctccttcaagcagcggccgccgatggatgtgcatgcgcaggaagtgagtcccggccaggtgaaactgttgccgacaggctggacgccggacgcgtcggccgggcaggccagcgcgccgcatgcggcggcgagcgctcccgcgtccgccgccaaggcggcgtcggcgccgctggcggcagccaagacggacaaacatgccaagcccgcggcgagcgcgccgcaggaacaggccaaatcggccaaggcgcaggcgaagccggcggccaagcaagaggcgtccaaaccggccgcggccaagtccgcggaagccgcgccgccggccgccaaggcctgctaccgctgggccggcctcagcgacagcctgctggcccgggtgaagggcggcgtgccgttgctgaagctgaaggctggccaattgcaggaagacagcaaggaagaaagcaagggctcgagccgcttctgggtgtactacccgccgctggccacccaggccgagaccaagacgctgtcggccgagctgaaggacaagggtttcgacaactacctcgtcagcggcgacgagttcaagggcaatctgtcgctgggcctgttcggccgcgaagacgcggccaagacgctggcggcgcgcctgaaggcggccggctacgacaaggcggtggtcaagtccaagaacgaagcggccaaggtgaccacgctgtccttcaaagacctggacgcggcgcaggccgagcatctgaaggcgctgcagaagcggttgacgccgggcatcgcgctgaaaggctgctga

SEQ ID NO: 527 - DNA, 744 bp, Chromobacterium substugae
atgaagttattgatagacgccggcaacagccgggtgaaatgggccgcctaccgcggcgcggaatgcgtggccaaaggcgccgccgaacatggcgagctggccagcctggcgccggtctggagccaactgccgctgcagggcgcctggatgtcgtcggtggcgcggaaggaagtggccgacgcgctggcggcggcgctggcctgccccttgcaccgggtgcatgcccagagccgcttcggcgcggtgtgtaaccattatcgcaacaccgccgagcagggcgccgaccgctggctggcggtgttggccgcgcgcgaactgtgcggcggcgacgtcatcgtcgcctgcgccggcacggcgttgacggtggaaacgctgaccgccgacggcgattatctgggtgggctgatcttgcccggctatggcctgatgctgcaaagcctggcccagggcacggccaatctcgatcgcgccgccggcgcggtggtggatttcccgcaaggtacgcaggatgcgttggccagcggcgtgatggcggcgctggtgggcgccatcgaagggcaacggcgcaagctggccgaacgcaccggccgccagcctgccacggtgatcctgaccgggggcgacgccggccgcatcgcgccttggctcgccgctccgctggagatcgtggataatctggtgttgatgggtttactcaaggtggcgaacgcgtcaagtggcttgtggcgctggtggtggtgctga

SEQ ID NO: 528 - DNA, 966 bp, Chromobacterium substugae
gtgaacgaacacgcgttcgcggtgctgcaccacctgtcggatgggcgcttccattccggcgaggacatcgcccaggcgctgggctgttcgcgcacgctggtgtggcaggcggtgcatgcgatagaggcggatttgggcctcaccgtgttcagcgtgcgcggccagggctacaagctggcgcagccgttcgcctggctggatgtcgccggcgtgcgcgccggcctgtccgaagccgcggccgaggtctataccttggcggtggccgaacgcaccgactccaccaacagccagctgatggcgcgcgccggcaacggcggactgcatggcctggtgctggcctgcgaattgcagaccgccggccgcggccgactgggcaggcgctggcaggcgcgcttgggatcggggctgacgttctcgctgctgtggcgcttcgaacgcggcgtgtccgagttggccggcttgtcgctggcggtgggcgtggcgctggcgcgcgcgctgcgcggcctgggcgcgccggtgcggctgaagtggcccaacgatgtgctgctggacggcagcaagctggccggcatcctgatcgagctgtccggcgacgcgctggggccggcggcggtggtgataggcataggcttgaacgtggccgatccgggcgaagtggaccagccggtggcgaccttgcgccaggccggcgtggcggccgaccgcaacagcctgttggccgcgctgctcaatgaattgcaaacggtgctgtcggcgttcgatcgcgacggcttcgcgccgctgcgcgacgagtggtgcgcgttgtccgcgcatcagcaggcgccggtgcggcttagtttttcccacggcgagccggtggacggcatcgcctgcggcgtcgccgacaacggcgccctgcgggtggagaccgcgcaggggatgcggaccttccatgtcggagaggtcagtctcagggaacgccaatga

SEQ ID NO: 529 - DNA, 501 bp, Chromobacterium substugae
atgacttacccgatgccgtcgtttgaagacaagatctgcccgccggaacagctggcggagcgtctggccgcgctgccgcgcccgttggtgttcaccaacggctgcttcgacatcctgcatcgcggccatgtcacctacctggcgcaagcccgggcgctgggtgccagcctggtgctgggcctgaataccgatgcttcggtgaagcgccagggcaagggcgaggacaggccgatcaacaacgagcataaccgcgccgcggtgctggcggcgctggagagcgtcagcctggtcacctggttcgacgccgacaccccggcccagctgatcgagcaggtgcggccggaggtgctggtgaagggcggcgactggacggtggacaagatcgtcggcagcgccgagacgctggcgcgcggcggccaggtgcattccatccccttcctgttcgatacctccaccacccagaccttgaataagatccgcgccggcgagggcaaggcgtga

SEQ ID NO: 530 - DNA, 552 bp, Chromobacterium substugae
atgtcgggcaacagccgcggcttcaccttgctggagatgatggtcaccctggcggtgatggtgatattgctgacggtggcgatgccggcctggcagacgctgatgcagaaccagcggctgatcagcacccgcgacaatctgctcagcgcgatgagccaggccagggcgtcggcggtgaacgacgacagcgtcgtcaccatctgtccgtacagcgcggcttccagcacggcgtgcggcagcagctggagcgccggctgggtgataagcgagcaacagtccggcagcgcggtgttgctgaaatcgcagccgctggtttccggttcccccaccataggcacgctggcggcgggcaccgccagcggcaccatcgccagcgtcagcttcaatccgcgcccgccctatgtcgcggtggcgcagaccggcgacttccgcatctgcgacagccgcggcgccgccgtcgccctgtcgttcaatctgcagagcaccggttatgcccagtcggccgccagcgccggcgccacgctgagcggcgccagcctgagctgtccctga

SEQ ID NO: 531 - DNA, 408 bp, Chromobacterium substugae
atgcgcggcatcaccttggttgaaatgatggtgacgctggcggtggtcgcgattctggcgtcgatcgcctacccgctgtacaccagccatgtgcagcaatcgcggcgcggcgacgcctggcaggcgctgaccgccgcgcagtcgcagatggagcagtgctacgcccagtatttcgcttacaacaacgccgcctgcacggtgtcggccagctcgcctggcggctattaccaggtgcaggtgtcttccgccaccacggccagcggctatgtgctgaccgccacgccggccgccggcggactgcaggcggccgacaccacctgcagcagcttcaatgtcagcaacagcggcttgcgcagcgcggccaacgcgcagggcagcgataccagcagcacctgctggccgcattga

SEQ ID NO: 532 - DNA, 3654 bp, Chromobacterium substugae
atggctgactggaaaccggcggtgcgcatcgtggtcggcatcctgctgctggcatgcattctgctggcggcccggaaggtggccggcggcggctccaccgccacgctggcgatctcgcaggtgccgctgaccatcaccaccccggcgcggccgcaggtggtgatcgccgtcaccaattccgaatcgatggacggcagcaccatcacttattgcaacggcaccggcaattccggcgccaactgcagcaatggcttttccaccagctataccggccgcggcggcgctttgctgaccggcgccggcgcggtgagcggactgaccggctcgtcctcgccgatcaactacccggtgccggccagcttcacgcctccggtgtcgggcggcgcggccggcagcctggtgccgtacacctcgacgctgtccggcggccaactggccgacaacagcccgtcgcggctcaatgtcgccaaggccggcatcctgtcgatcctcaacacctatctggcgacgacggatttcgccctgttgtcctaccagatgagcaacaccaggatgtacaccacctgggtgtattacatggcgccgaccggcggcttcgccttcaccaatacgcccaccgccaccagcagcaccgacacggtctacaacccctgctacaactacctgacctcgtcgtcgaccaccgtggccagcaattgcgcgtcgatcgcgctgtcgctgggcctcagcgggtcgtcggtcagcggcagccagtacatgacggtggcggccaccagcgacgacgccaacatcaacgacgtgctgtattcctcgtcgctcaacccggtgttcatgacctacggcacggtcagccccagcaatccctacacctattactcgctgagcagctacaagtccggctcggtgtcggtgtcctacagcacgatggcaccgggcgggcgcaccaactgggccaccagtccgaccaatgccggctacgtgccttactcgccgcaggtgatgtatgtgcagcgcggctggggctatggcggctcgcagtcgtactccggcgccaccaccaatgtgacgatgaccaatctgggcagcccgtcggccagccagctcaccagcgcctacaacagcttctcgccgttcctgcagccggaaaccaattccaccagcaccagcgaaatcaagtcggcggccgggcagtcgccgatctacgcgctgctgaagaccgcgcaaacctcgttcaccagcacgtcgtccagcagcggctgctcgccgcaaaaatacgtggtgctgatcaccgacggcctgccaacccaggacaagagcggcaacttctggccgccggcgggcagcgccgccgccagcggctatggcgtgaccgccagcttcaacgccgacggctcgctcaacaccggcgccaccaacgatcaggcgttgctggacaccatcagccagatccagtcgctggccaacagcggcatcaagacatatgtgataggcctgggcgccggggtggcgccggctaccaatcctacggcggcgcagacgctgaccgcgatggcggtggcgggcaataccggctcctattacccggcagtcagcgccaccgcgttcagcaacgcgctcagctccatcctggtgcagatccagaaaggcagttacgaccaggcgtcggtggcgctcaacagcaccacgctgagcaccaattcgcaggctttcctcgccagcttcaatcccagcgacagcccgtacaacgactggaccggcaatctgtcggcctattcgttgtccaccagcagcgggctgaacgtcggcaccagcgccaactggcaggcgcagactcaggtggacaccttctccagcagcaacgcctggcaaaacacgcgcttgatcgccacctgggacgcggtcaacagcaagggcgtgccgttcgaatggccggcttccggcgtcaccggcatcaacagcacccagcagggctggctgcagccatcggacaccaagggcagcctgcggctcaactacctgcgcggcgacaagtcgcaggaggtgcagaacggcggcggcttccgcaaccgcagccacctgctgggcgacatcatagacagcggcccggtgtatgtggccaaaccggatggcccgtacagcgacgccagctacctgagcttcatcaacgccaacgccaaccgcacgccgctgctctatgtcggcggcaacgacggtatgctgcacgcattcaacgccagcaccggcaacgaggctttcgccttcatccccaacggcgtgttttccaacctgtaccagctgaccagcgcctcgtacaacaacaaccacatctatttcgtcgacggctcgccgcaggccggcgacgtgatgttcgccaacggcgtctggcattcgctgctggtcggcggcctgggcggcggaggctccaccatttacgcgctggacgtgaccacgccgtccaatttcaccagcgagacggcgctggccaatgccgcgctgtgggaattcagcgacagcggcctgggctatacctatggtcggccctccatcgcccgggtcaacgccacgccgggattcgcggtgatgttcggcaacggctacgccagcagcggcaaccacgccatcttctatgcggtgaatccgcagaccggcgccacgctggccaagatagatctgtgcagctcggtgccggcggcctgcaacagcagcgcgccgcaaggcttgtccgaggtagtggcgatcaacagcagcggcaatgccggcgcggcggtggacatggtttacgccggcgatctgcagggcaatgtctgggcgatcaacatcggcagcagcaatccggccagttggagcgtgcgcctgctgttcaccgccaccgacagcagcggcaaccaccagccgatcaccgccgcgcctgcggccacgctgaacgccaacttccccaagcagaagggcacgatggtctatttcggcaccggccagctgctggcccaatccgatctgaccaataccaatacccaggccttctacgccgtttacgacaatctgagcatcagcggcctgacgccgtccaacctggtgcagcagaccgagtcgctggtcacctcggcgcagtcgggcttcaccaacaccacggtgacttcgaccacctacaactggcaaagccccaacccgccgctcagctgcgtggtggggcgcacttgcccgaccctgtacggctggtactacacgctgagcttcgccggcagcggcacccgggtgctgaccaatccgcaggtcttcgccggcaatgtggtgtacaccaccttcgcgccgccctccacgccttgcaccagcggcggcctgtcgttcctgatggcgtcgagctacgccaccggcgggccgccgacgcagcccttcctcgacgccaatggcaacggggtggtcaatagccaggatgtctataaccaattgccggtgtccggggtgcagctgggcagcttcttcgcatcgacgccggccttcgtcacctcgaatcagggcggctacagcgccagcatcctggtgggcgggggcaatggcaacagcaacaataattgcgccaacggcaagctgagctgcaccagcagcagcccgttgcagcaatactattcctggagcggctggtggcagatcatgtga

SEQ ID NO: 533 - DNA, 549 bp, Chromobacterium substugae
atgaaaccattgcgcaaagccggctcggagcgcggcgtggtattgatcatcgcccttatcttcatgctggtgatcatgatcctggggctggccggcagcacccaatcgctgagccagctgcacatggccagcaacaacgtgcagtaccagagcaatctggagctggcggagggcacgctgcgccaggcgtactcggccatgctgcagggcgtgttcgccagccagacctacacggtggcgggcaacaacggctactaccagttcaacgccaacaccgtgccggcgtggcagcagaatttatacacaccttcgttctggaccaatagcgcgatgacgattcccggctataccggcacgccgcccaattcggccgtcaccagcagctatgtggtggaaaacatgccggcggcctgccgggcgggaaccagctgcggcaaccgcgggatctatgggcaggcggccggcggcaacaactaccgggtgaccgcccgggtggtcaccagcaacggcgcgagcccggtggtggtccaggcaatcttcacgcagtga

SEQ ID NO: 534 - DNA, 1065 bp, Chromobacterium substugae
gtgaggccgacgcgcgcgcagacaggtttttcgctggtggagctgatggtggcggtcaccatcggcctgctgctgctgaccgcgctggtgggtgtgatggtggcggggcgcaaggattattcgaccgacgccggtcagggccagctgcagaacgccggcgccaccgtttccagcctgatttcgcagacggcgcgcagcgccggtttcttcggctgttccggggcgactacttccaacgcgctggtgagcgccaatggcctgctggggaatttcagcgcgccggtcaccggctatgacgcggtggtggcgtcgtccacgctgaccttgtccagcctgaacggcgccaacgacagcgcgctgaccgactggagcccggcgctggacagcagcctgcagggcaaggtgcagcccggcagcgacgtggtggtcttcagcggccagagcaacggcacggtgccggtgtgggtgagcgtttacgcctcgaccggcgcgacttcgttgcagacgctgtcggcatcgggcgtggcggccaacaatctgctgtcggtctccaattgcgcgcactcgtccatcatgcaggtcagcggggtgggcagcgccagcggcggcagcgtcatcaatctcaaccaggcgctggacagcgattttccggtgggctcggtggcggcgttgctgtcgcagacagcttacttcgtcggccaggcctcgggaacgcaaagcgcgttgtaccaggcggtgtatgacggcaccggcggaggctggcaggtgacccctatcgtgcccggggtggacaccatgcaggtgtggtacggcataggcagcgcgccaggcgtcaccaccgaatatttgccggccaaccagatcagcagctggagccaggtgaacagcctgcgcatcgcggtgctgctggaagggccgcaaggcaccgcgccgctcagcaaggccggcaattgcctcaaccggacgcagtggacggtgctgagcaatacggtcaatgtgccttgcgacacccggctgcgccatgtctacaccatgacggtatcgttgaggaacgcgggcctatga

SEQ ID NO: 535 - DNA, 441 bp, Chromobacterium substugae
atgctggaagtgctgatcgcgctgctggtgctggccatgggggtgttggccgccatcgcggtgatgctcaacgcggagcgcgccagcggctccggctatctgcgccagatggcgaatcagtatgcctacgatatggtggaccggatgcgggcgaattccgcgcaggtggccgccggcgcctatgacgtcgcctccggcgtcagcgcgtccacttttcaaagcaattgcgtggccacggcctgcactgccgccaccatggccactttcgacaaataccagtggctgaccgacttgcagaacaatctgccgaacggcactggcagcatttatcagccggccagcggcgccaccaccgagcgggtggtgcaggtgtggtggacggatggcaacgcggcgagcggcggtgcggtgctcaccgaaatcgtgaggaccatcatgtga

SEQ ID NO: 536 - DNA, 118 bp, Chromobacterium substugae; identical to SEQ ID NO: 426

SEQ ID NO: 537 - DNA, 747 bp, Chromobacterium substugae
atggcgaaccgacaactactacgtgaaatccggctggtgcatgccgaggtcaatggtatttatggccatcggcgtattcatgccgaacttcttgcacagggcttcgcctgcgggcggcatcgcatcgcgggcctgatgcggcgaaacggtatcagggttagaacgcgtaaacattgtcgacccgtcagtggtggtcaacaccttctacccgtggcgcctaatctgctgcagcgacaatttgctgctggtggcgacatcaatcagcgttgggtgtcggatatgacctatatccggaccggtgaagggtggctgtacttggcggtggtgctcgacttgtactcccgggcgatagtgggctgggccatgcatcatcgaatgccgcaagaactggtgcatgctgccctgacgatggcagtggcgcgccgccagccttcaggagaggtgattctgcattcggaccgcgggagtcagtactgtgcctttgactaccaggcattgctgaaacggcacggaatggtaccgagccactcccgcaccgggaactgctgggataatgcagcaatggagagcttcttccgttcattgaagtcggaacgtgtttatctgacccactaccggagctacgaggaggcgcgtacggatgtgtttgattacatccgcttttacaatcaccaacgacgtcattcaaccctggggtatctgaccccggttgaattcgaacgccgccgttcagagcttagtgcttaa

SEQ ID NO: 538 - DNA, 1689 bp, Chromobacterium substugae
atgagccatcatcgtttcgccttgcccggcagtttccgcttgcggctggccgcgttgtttggggggctgtttctcgcctcggcgctggtggcagggctgtgcctggatcaggtgctgtcccagcgcatgctgcgggaccagggcgaagcgatgggcagcctgaccggcagcatcgcccaggcgatagaaagcaatctgcgcgaacgccaccgcgaggtgatgctgctggcgcagacgcccacctacgtcagcgcgccgctggatggcgacgagctgcgccaaagcctggagcgcaccaagcaaacctaccgctactacgcctggatcggcgtcgccgacactcagggcaaggtgctgtcctccaccggcggcatgctgctgggccaaagcgtggccaagcggccgtggttcatccagggccggcacgcgcctttcgtcggcgacatccaccaggcggtgctgctggccaagctgctgccgtcggccaagctccagggcgagccgctgcgcttcgtcgacttcgcttcgccgctgtacgacgcctcgggcaagctgcgcggcgtgctggctacccacgcgctatgggattgggtggaagaaatcatccggacgcggctaccggccaagggcgggctggaggctttcatcgtcgataaacagaacaacatcctgtcgccgttcgaggcgatagggcggacgcgggcgcccgcgccgctgcccgtcggccaaaccttccgcctgggcgcctggccggacggcggcgactacctgtacagcgaagcctgggcgcagcatgccggggtgggctggcgcgtgattgtccgccagccgcggcagcaggcgctggcggccttgaatcagctgcgcggggtattgctgctgctggggctggcggccagcgtgctgctgatggcggcggtgtaccggctggcgacctcgttcagccggccgctggaggaactggcggagatcgccgagcgcgtcggccgcggggaagagggggccgattgggaaatccatggcggcgcgcaagagctgcgccagctgtcggaatccatgcgtgaaatgaccaccgcgctgctggcccgcaagcagcaactggccgacatcaatgccagcctggaaggcgcggtggcagaccgcaccaatgaattgcgcgaggccaaccggctgctggtggccaaggccacacagctggccaaactggcgcgcaacgatgcgctgaccggcctgaacaaccgcatggccgccaacgagcagctgcaggacgagcaccagcgctatggccgcagcggcgaaccctatgccgtgctgctgctggacatcgaccatttcaagcgcgtcaacgatagctgcggccacgacgccggcgaccgcgtgctggcccatctcgcccaagtcatccgccaggcggcccgcgccaccgatttcgtcgcgcgctacggcggcgaggaatttctgctgctgctgccggccaccgatgccgaaggcgcggcggtgttggcggagaagatccgcgccgtggtcgagcaatcgcaagcgccggatgtcggccgcatcaccgtcagcatcggtctggcggtggccggccgtgccgatgaacagccggaagcggtggtgaagcgcgccgaccaggcgctgtaccaggccaaggccggcggccgcaaccgggtggagggtggcgcctag

SEQ ID NO: 539 - DNA, 1425 bp, Chromobacterium substugae
ttgaaatcggataatcgtgaggccggcgcggcgccgtcggccgcctgggcagtggccagcctggcgctgaccatgttgatgccttcgctggataccagcatcgccaacgccggcctgccggcgctggcgcaggcgctggacgccaccttccagcaggcgcaatggatcgtgctggcctatttgttggcggtgaccacgctgattgtcagcgtcggccggctgggcgacctgctgggccgccgccgtctgctgttggcgggcatcgcgctgttcaccgcggcgtcgctgctgtgcgggctggcgccgacgctgccggccttgatcgccgcccgcgcggcgcaggggctgggcgcggcggtgatgatggcgctggccatcgccatggctggggaggcggcggcgcaggggcggacaggcagcgcgatggggctgttgggcagcatgtcggccatcggcaccacgctggggccgtcgctgggcggtttgttgaccgcgggcctgggatggcgcgccattttcctggtcaacgtgccgctgggtttggtcaatttcgcgctggcgcgccgttacctgccggccgaccggcgggcggccaaacccggacgccaggatttcgacccgctgggcacgctgttgttggccttgacgctggcggcttacgcgctggcgatgacgcaggggcaaggccgcttcggcgcgctgggcggcggcttgctgctggccgccgcggccggcgccgcgttgttcatccgggtggaggcgcgcgcggcatcgccgttgctgcagccggccatgctgcgccaaccggagctggccgcgggtctggccatgagcgcgctggtgtccacggtcatcatgtccacgctggtggtcgggcccttttacctgtcccgcgcgctggggctggaagcggcgcgggtggggctggcgttgtcggtcggcccgctgttgtctgcctgctgcggcgtgccggcaggccgcctggtcgatcgtttcggcggcgggcgcgtcagccgcgccggcctgctgggcatgctgggcgggacgcttctgctggcgctgctgccgtccagcctgggcatattcggctatctctgccccatggggatgaccaccgccggctacgcgctgttccaggcggccaacaatacggcgctgatggcgaacgccggcgcggcgcgccgcggcgtggcggccggcatgctcagcctgtcgcgcaatctgggtttgatcaccggcgcggcggcgctgggcgcggtattcgcggcggcatcggcccactccggcgccgggccggcggaagcggcggccgccggcatgcgcgccactttcgcggcggccgcgctgctggtggcggcggcgctggccatttccacggccgggcaggcgcgggcgcgccggctgctggcggaacgcggtggctaa

SEQ ID NO: 540 - DNA, 945 bp, Chromobacterium substugae
atgtccaaacccgatttgaacctgctgatcgccctggacgcgctgctggcggaaaacaatgtggcgcgcgcggccaagcgcttgcggctcagcccgtcggccatgagccgcaccctggcgcgcctgcgcgaaaccaccggcgaccccttgctggtgcgcgccggccgcagcctgacgcccactccgcgcgcgctggcattgcgcgagcaagtcggccggctggtggaagaagcggaagccgcgctgcgcccggcgcagacgttggatctggcgcagctggcccgcaccttcgtgctgcgcgccaacgaaggcttcgtggaaaacttcggcccggcgctgctggcgcgcgtcggcgcgcaggcgcccggcgtgcggctgcgcttcgcgcccaagccggacaaggacagcgggccgctgcgcgacggcagcgtcgacctggaaatcggcgtggtgggcaaagccaccggaccggaagtgcgcgcccgcgcgctgtttcgcgaccgtttcatcggcgtggtgcgcgatggccatccgttggcgcagggcgaaatcacgcccgcccgctatgcggccggccgacatgtgctggcatcccgccggggcctggagcgcgggccgatagacgacgcgctggccgcgctggagctggagcgggacatcgccgccaccgtggccggcttttccagcgcgctggcgctggcgcgcgaatccgacctgatcgccagcgtgccggagcgcggcaccggcaagctgcgcgccggcatgttcaacttcgcgctgccgctggccgcgccggaaatcaccgtttccatgctgtggcacccgcgcctggacgccgatttggcgcaccgctggctgcgcggctgcctgctggcggtgtgcgagccgccggctcaaaccggatgcacgccgccatccgggctagccgcctcgcgctgccgctga

SEQ ID NO: 541 - DNA, 621 bp, Chromobacterium substugae
atgcacgccgccatccgggctagccgcctcgcgctgccgctgatggcgctgctggccgccgtcccggcgcgggcaatggactgcgccgccccccgcctcagcggggcggaaacatggatctgcgccacgccagcgctcttgatggcggacatgagcctcaacgacagctaccgcatcgcggcattgctagccccatcccggccggcgctgcgccgggaacaacaggcctggctgcgcgcgcgcgaacaatgccgcgaccagcgctgcctgcggcaaagttatgtcgaccgagcccggcagctgcgcgcccgcatccgcgactgggcccagccctgcgccgtcgacccgcgccgcatcctcggcgactgggaaagcatccgcagcggaaccttcgaccaattccagcttgcccccggccatcggttccacagctggctgcaccagcggccagaattcaacgacaagccatggaccttcgccgctagcgattgccgtctgagcatcggtgccggccgcgacgggatcgcattcgcgttcctgctggcccagccccggccggaccggctgatcctgatcgactccggcagcctggatgcccagctgtataaaaagctgcgctag

SEQ ID NO: 542 - DNA, 552 bp, Chromobacterium substugae
atgcgcggcctgagcctgtggctgtaccgccgctcttcggcgcccgccgcgctggttttgctgctggcggcggccgcgctggcctggctgttcaacttctccgacaccgcgctgtcggtcagccggctggcgcgcctgtatggccagcccattctggacttgcggccctggtattcggccgacgcggtgcgggcgctgctggcggcttacggcgcggctggccgccagggctatctgcattttctggctttcgacacgctgttcctgctgtgctacggcgccggcttcgccttgttgatcagcctgctgcgccggcggctgccgcggcccggctggttcaacttgctgccgctgatggtggcgggcgccgacgcgctggaaaacctgtgcagctatatcgatctggtttcctatccggatttttacccgccgatagcctgggcgggcggcgcgatgaccagcggcaagcacttgctgagcgcggcgtccttgctgtgcctgggctattccgcctggcgcgcggggcggcgggcggcgcaggcggtttcctag

SEQ ID NO: 543 - DNA, 939 bp, Chromobacterium substugae
ttgggcgccaacggccgtttcggcatggcgatggttcaagcgctgcgcgagcggggctggcaggtaagggcgcaaacgcgcgccggctggcgcggcgagggccgggtggaggaagtccattgcgacggccacgaccgcgccgcgatcctcgccgccgcgcgcggttgccaggtggtggcgcacgcgctcaatccttcgcaatacacccaggcctgctggcggcgcgacgcgctgcctatgctggacaacgccatcgccgcggcgcaggcggccggcgcgctgctgttgttgccgggcacggtctacaacttcggctccagcctgccggcgacgctgacggaaggcacgccggccgcgccgggccatgtgttcggcgccatccgcatcgaaatggagcggcggctggcgacggcgcccggcctggacagcttcgtgctcaccgccggcgatttcttcggccagggcaccggcgtatggttcgacaaggtgattgccgccggcctgcagcgtggcgtgttcacttaccccggcccgctggacagcgtccacgcctggacccatctggcggacctggccgaggcctttgcccgtctggccgaccagcgcgccggcatccgcggcttcaaccggatgatgatgccgggccacgacctgactggccggcagctgcaggaggcgttgcagcgggtgttgggccggccgctgcgcgcgcgcgcgctgccctggggctggctggggctgatgcggccgttctcgccgatgctgcggtcgatgtggggcaaccgctacctgtggcggcgtccgcatgcgctggatggccgggcgctgcgcgcgcggctgggcgattggacgccgacgccgctggacacggcgctggcccaatcgctgcggcagctcggccaggaggtggcggcggagggcggcgcatgcgcggcctga

SEQ ID NO: 544 - DNA, 894 bp, Chromobacterium substugae
atggactggaatctggtgcaagccttcctggcggcggcggaagccggctcgctcagcgcggcggccgacaagacccggcaaagccagcccacgctgagccggcaagtggcggcgctggaagccgccatgggcgtgagcctgttcgaacgcagcccgcgcggcctgcggctgacgcaggcgggcgaagcgctgctggcgccggcccgcgccatgcgcgcggcggcggcggaggtggccaccgccgcggaacaaggccggcaattgctgccgggcacggtgcgcgtcgccgccagcgagatgaccgccgcctacctgctgcccgacatgctgagcgcgctgcggcgcgactacccgcagatcgccatcgacatcgtggtcaacaacggcctcgacaacctattggagcgggaggcggacatcgccatccgccatgccaggccggcgcagggcgcgctgatcgcccgccagctgggagagctgaaaatccaggcctgggcgcacgacagctacctggcgcggcacccgccgctcaaacggctgcaggactacgactggataggcatggaccgttccgatttcctgctgcggcggatgcgggaagccggtttcgacgtggatcgcgacttcttcgcgctgcgctgcgacaaccaggtggtaggctggcagctggcgctggccggcgccggcgtcgctttcgcgccggcggccaccgccagccgcttccccggcatgcggccggtgctgcccgagctggcgcaaggcatgatgccggtgtggctggcctgccaccgcgaactgcggcaaaacgcgcgcatacgctgcgtgttcgatcatctggccgccagctggcaaaacctgctggctagccagccgccagccgcgcttcgccactga

SEQ ID NO: 545 - DNA, 1203 bp, Chromobacterium substugae
atggataccccttccaccggcttgagccgcgccatgacgctgctgttcgcggtttcctgcggcgccgtcatcggcaacatctattattcgcagccgctgctggcggtcatcgcccatggcttcggccagccggccgccagcctgggcttcgtcgtcactctcacccagctgggctatgcctgcggcttgctgctgctggtgccgctgggcgatgtgtgggaccggcgccggctgatcgtgacgctgctgggcagcagcgcgctggccttgctggcggtggcgctgagcccgggcctcgcctggttcgcggcggcctgcgtggcgctgggcctgtgcacttgcgccgcgcagctattggtgccgttcgccgcctcgctggcggcggagcgcgagcgcggccgggtggtgggcacggtgatgagcggtctgctgctgggcattctgctggcgcgcaccttcgccggcctggtggcccagctgggcggctggcggctggtgtactggctggccgccgcggtggtgctgctgttcaccgtgattctggcgcgggcgctgccccgcgacggcggcaagccgccgctgcgctaccgcgaactgctggcctcgctgctgacgctggcgcgcgcccatccggcgctgcggctgcgcgcgctgtacggcgcgctggccttcgcctgcttcagcctgttctggaccggcctgacctttctgctcagccagccgtcgtacgcttacagcgaggcgcagatcggcgccttcggcctggtgggggcggcgggcacgctggcggccagcggcgccggccgcctggccgaccgcggccgcggcgggctggtcacgcgttgctgctgcctgggcattctgttggccttcggcctgttgtggctgggcggccaatggctggcggcgctgctggccggggtgctgttgctggatgtatgcgtgcaggcgctgcacatctccaaccagagcgtgatctacgcgctggcgccggaggcgcgcagccgcatcaccacggtttacctggtcagctatttcctcggcggcgcgctgggttccggcgcggccagcctggcctacgcctatgccggctggctgggggtgtgcctggtcggcgcggggatcgcttgcctgctgctgggactgtgcctggcggcgcgccggaacgcgctcagtggcgaagcgcggctggcggctggctag

SEQ ID NO: 546 - DNA, 471 bp, Chromobacterium substugae
atgcagcaatcgcataccacccaggacgcccgcgtcgaactgaccgcccgcatcatcgccgccaaggctttgcaggatctgagctgggagcagctggccgccggcaccggcctcagcttggcctatgtcaccgccgccctgttggggcagcacgcgctgcccaaggccgccgccgaccgggtgtgcgacaagctgggcctggacgcggcggattccgccaatctgcaggccattccgctgcgcggcagcatcccgggcggcattcccaccgaccccaccatctaccgcttttacgaaatgatccagatctacggcaccacgctgaaggcgctggtccatgagaaactgggcgatggtatcatcagcgccatcaacttccggctggacatccagaaagtggccgatcccgaaggcggcgagcgcgcggtgatcacgctggacggcaaattcctgcccaacaagccctattga

SEQ ID NO: 547 - DNA, 636 bp, Chromobacterium substugae
atgcaagccatcatcgacggcttcctcaagtttcagcaggaagctttccccaaacgttccgagctgttccgccagctggcttccagccagagccccagcgtgctgttcgtcacctgctccgacagccgggtggtgccggaattgctgacgcagcaggagccgggcgacctgttcgtgatccgcaacgccggcaacatcgtgcccggctacggccccgagccgggcggcgtcaccgccacggtggagtacgcggtggccgcgctgggcgtcagcgacatcgtcatctgcggccattccgactgcggcgcgatgaccgcgatttcccgctgcgcctgtctcgaccacatgccggcggtggccggctggctgcgccacgccgacgcggccaaggcggtcaacgccgctcgaactcacgcctcggccgaagccaggctgagcgacatggtcagggaaaacgtcatcgcccaattggccaacctcaaaacccacccggcggtggccgtggcgctggagcaaggccggctgcgcctgcacggctgggtctacgacatcggcaccggcaacatcgaaacgctggacggcgccgccaagcgctttgtcccgctgggcgactttccacatacccgcgccgcctga

SEQ ID NO: 548 - DNA, 888 bp, Chromobacterium substugae
atgatactcagacacatccgctatctggtcgccgtggccgaacacggcaacttcacccgcgccgccgaggcgctgcacgtgtcgcagccgacgctgtcgcaacagatccgccaattggaagatcaggtgggcgcgccgctgctggaccgcagcggccgcgcggtgcggccgaccgatgccggcgcggcctacctggaatacgcgcggcgggcgctgcgcgagctggcggccgcccagcgcgccacccaagaggtggcggacctgtcgcgcggcgcgctccggctggcgatgacgcccacgtttacctgctatctgctgggaccgctggtggaacgctatgcggcgcggcaccccggcgtgaagctggaaatccgcgagatgacgcaggatgcgatggaggcggcgctggcagccgacgagctggatctgggcatcgccttcgataccgcaggcgcgccggaaatccagcgccagccgctattcgcggaaaagctgtgcgtggtggccggcccgcgccaccgctggcgcgagctagcgacgccgttggacgcgcgcgcactggaacaagcgccgctggcgctgctgagcgcggacttcgccacccgaggccatatcgacgcgcacttccgccagctgggcatcgcgccgcgcgtagccatggaggccaataccataggcgccatcctggaaacggtgcgccgcggcgccatggccaccatcctgccggaggccatcgcccggcaagacccggccttgcatgcgctggaaatgcggccggcgctgccagcgcgcaccgccgccctgctctgccggcgggacggctaccgcagcgccgccgcccgcgcctgcctgccgctgctggaagagctggcgggacaactggcctaa

SEQ ID NO: 549 - DNA, 402 bp, Chromobacterium substugae
atgagcagcattcagatcgtgcagactttcctcgaccacgtattcagcggccggatggcggaagcgttggccttggtggcggatgacgcggttttcattcccagccggccgcaggccagcgccaaggtgtccctgtacggcacttaccgggggcaggccggcgcggcccaggtgtttcaatctttcgccgccgaattgaagcctggcgaatttgaagtggagtcggctttcggcgacggcgagcacgcggcgatgcacggccggctgcggcattacagcgtggccaccggcaaacccttcgccagcgattgggcgctgatcggcaaggtgagggacggcaaaatcgttttgtatcacttctatgaggacacggccgcgctggaggaggcgctggccgagtga

SEQ ID NO: 550 - DNA, 1029 bp, Chromobacterium substugae
atgcccgcggtcggcatcctggccgcgccgccggccgaactgcgcgatttgatcctgccggtgcccacgcctgctggctgggatgtgttggtccgggtggacgccgtggcggtgaatccggccgattgccgcgtgcgccggcgcaaggcggatgatggcgccaggcggcggtgctcggctgggacgccgccggtgtggtggcggcctgcggggctgaggcggcggcgtggtttccagcccggcgactcgatatactatgccggcgatgtgaaccggcccggctgcaatagcgcctaccagctggtggacgcgcgcctggcggcgcgccgtcccgccaactggagcgcggtggaggccgccgccctgcctttgaccgggctgactgcctgggaggcgctgttcgagcacctgggttatgcgccggacgcgccggccgatgggcgaaccttgctggtggtgggcggcgccggcggcgtcggctccatcgccatccagctggcgcggctggtgcccggcttgcgggtggtggccaccgcctcgcgcgcggagtccacggcctggtgccgccagatgggcgcgcatgaggtgatcgaccatagtctgcctttgcggccgcaactggaggccatcggcatcccggccgtgcaatccgttttgctgctcaatcgcccggatgagcacttcgccgccttggccgaactgatcgcgccgttcggccatatcgccaatgtcgtgccgttttcccggccggtcgaactcaacgcgctgatgcgcaagagcgccagcttcagctggaactacatgttcacccgctccatgttccagactgccgacatggcgcggcagggggacatcctggcccggttgaccgctttggcggaggccgggcggatacgcagtacccggcgcgagcacctgggccagctttccgcccgcgcgctcggcgacgcccatgcccggctggagcggggcgacgccataggcaaattgaccttgtccggtttttccaactttcaggagccagtatga

SEQ ID NO: 551 - DNA, 846 bp, Chromobacterium substugae
atgcaatgggacgatgtgcgttattttctggcgctggcgcgcgaaggcagcctgtcggccggggcgcgggccttgggggtggagcacagcacgatatcgcgtcgggtgggccagctggaagccgcgctggggctgcggctgtttgatcgcctgccgcgcggctggcagttgacccagaagggagaaagcctgctgccgcaggccttggcgctggaaaccggcatcgccgggatgctgcgctcggcctcggcgaagaacgcgctggccggccaagtgcggctgaccgcgccgccgcagttgctcaaccatgtgctgctgccgctgttgacgacgttccgccagcgttacccggatatcgatctgactttgctaggcgagcggcgccgcgcccggctggaacaaggcgaagccgacctggcgctgcggctggacgtgcccgacacgccggagctgatcgcccggccgctggccctggtgggctacgcgctgtatggcaccgcgcgctggcggcaaaccgaggcaagcgaatggctgttcatcggcttcgacgacagccaggccggcttgtccctgaagcgatggctgggagaacacgccggcgcgcgccgggtggcgctgcgcggcaacgatctggatacccatttccaggcggcgagacagggcctgggcgtagcgctgctgccgcgcttcctggcgcgcgccgcgccggagctcgccgaactggacagcccgccgccgccggacaagcagctttacctgctgatgcatccggacgtgcgccgcgcgccgcgggtgcgcgcgctggcggacttcatcgccgcggcgctgccgggcgcgctggcttga

SEQ ID NO: 552 - DNA, 921 bp, Chromobacterium substugae
atgccttatatcaagattctggtggtggcgatcttcatcctctccaccgtctacgttcatttccgcggccgcgtacggcttggtttttggcgccagttgagcgaccactccaccatcatggccccgatcaactgcttcatgtatctgttttccaaggtgccgcccaaaccgtatctgccggtggagcgcttccccgagctgcaggcgctgaccgccaactgggagaagatccgcgaagaggcggtggcgttgtacgaccgcggcaacatcaaggcctcggacaagtacgacgatctgggcttcaattccttcttcaagaccggctggaagcgcttctacctgaaatggtacggccaggaccacccgtccgcgcaggcgctgtgcccgtacaccaccgagcttttgaagcagtttcccaatatcaaggcggcgatgttcaccgcgctgccgccgggcagccgcctggtgcgccaccgcgatccgttcgccggttcggtgcgctaccacctggggctgatcacgcccaacgacgaccgctgctacatcgacgtggacggccagcaatacagctggcgcgacggcgaggcggtgattttcgacgagacctatctgcactacgcggaaaacaccaccgaccagaaccgcatcattctgttctgcgacgtggagcggccgatgtggttctggccggcgcgagtgatcaaccgcatcgtcagccgcgtgctggtgggcgcggccaatgcgccgaacgaagccggcgaccgcgtcggcgcgctcaaccgcgccttccgctacattcagcaggtgcgcctgttcggcaagaggatcaaggcgcagagccgtttcacctactatctgctgaagtggctgatcctgggcggccccatcgtgctgtggctgttctggggcagctggggctga

SEQ ID NO: 553 - DNA, 528 bp, Chromobacterium substugae
atgccttttcaaaccttgcgccatttcaaaaattggattgtcggcatcttcaatccgccctaccagctctcgctgtgcgaaatcctgccgggccggcaaggcggcggcaccgtctacgttttcaagcaatacggcacccacgacatcgtcaagctgagccataaggacatcatcggcaatgtccagattctggccgccattaatcccaaggatttgatcggcatcgcgctgtacgaaaacaacctgaaggaagccgccggcgaatgccaggtgctggagaccatccgcggcaatcaataccggatcgccagccacggccgcgaagaggtgtattccggagaaagcatctgcggcaacctggacctgttccaacgcctgccgccgcacgaaatttgcaagatcgcctacgaaaccggcttcagcaagggccgcaaggtgtccggccaactgcgcgcgctggccgagcagggccgcgccgaagccggcgcggccgcggccaatgtggtgccgctgcgctcacgccaatga

SEQ ID NO: 554 - DNA, 738 bp, Chromobacterium substugae
atgaatatcctgcaactgaccgatctgcatttgttcgccgcgcgcgacggccggttgctgggccgcgatacctacgcggcgctgcaaaaggtattggccgcggtgcgggcgctggggccggacgcggtcgacgcggtgtttctcaccggcgatgtgtcgcaggatgagtccgcggcgtcgtaccggctggcggccgaggcgctggccgggctcggacggccggtgtattggatcgccggcaatcacgactgccgctcgacgatggccgaggtgttcgccggctatccgctgttgcggccgctggatgaggtgaagctggccggctggaccttcatcggcgtggacagctgcgtggcggggctggacgaagggctgatcggcgccgacgaactggcgcgtttgcgcgagcagctggccgcggtggacgatggccacgccgccgtagtgctgcaccaccatccgctggcggtcgggacgccattgctggacgactgcatgctgcgccagagttcgcagttctggcaggcggcgcgggccgagcggctgaagctggtgatctgcggccatgtgcatggcgctcacagtatcgattaccgcggccgcatgctggaggttggcccggccacttgtttccagtggcaggcgggggccagcgacatcgatatcgacgaccgccagggctaccgcttgttcagcttctccgcggacggctatcgggtggccacttcattggcgtga

SEQ ID NO: 555 - DNA, 717 bp, Chromobacterium substugae
ttgaacgagtttcgcttgtatggattgatagttggtttgactgtcaccatcatgattatctgtgattcgctggtgtacaaaaccgtagatgtcttcagcctgaaaatcaccgccagcggcatcgtgttttcgctgtgctatttgttgtccaccatttccaccgaggtgtacggctacaagctgggcggccgcacggtttggatcatcgtgatttgccagaccctgttcgtgttgattctcaacgctttcgcgctgatccagccggacaacaacgccatctccaagcagtattaccagttattccacgaattctggcgcgtgatggtgggcacctggatttcggtgccggcttcctatttctgcaatggcttcatcgtttcgcggatgaagatattttttgccggccgcttcttcttcgcccgttacctgatcgcctcgatgctggcgcaggctgtgctgctgctcaccgcctatcctatcagcctgtcttccaagtacagcggccatgagctggtcaacatcatcgccaccacctggtcgtacaaggtggtgatgtcggtgttgctgctgccgctgggctactatctggtgtcggtgatcaagaagatagagcgcaccgattatttcgattgggaagtttcctacaatccgctgacggtgttccgcgatagcgacggcgccattgaacgcaaccgttttgagagcgccaaggcatga

SEQ ID NO: 556 - DNA, 666 bp, Chromobacterium substugae
atggtgaagggagtggaaaaggcgctgccggcgaatgatgacccgttggcggtgatctccggcaatttggccagcctgatgcaaaggcatggcgtggatgctgtgcggctgagcgatgagaccggcctgggcattgccaccatcaacaatttgcggcgaggcgtcggcaatcccaccttgtccacgctggtcgagttggcgcgctatttccaggtcagcatcggcgaattggcggcatccggcgccaagcagtcggcgctgccgcggcaggcggttttttccatgcccttggtcggcatcggccatgtcggcgatttcatcgaaaccggtatcgccgaccaaggagattattgcgcggaggttgtcggctatgccgagcggccgctattcgcggtattggtcaataacgacacgctgtacccgcattacgcgcagggcacggttttcgtgatggtgcgggagagccggccgcaggatggcgatatcgtgctggtgacgataggcgccaactctccctgtctgcgccgggtgtatgtcgaagaggattttttgctgttttcgtcgatatcgccacagaacgatgtggcgccgtcgctttataaaaactatcaggtgctggccgtggtgttgaaagccatcaaaaccttgtctggaggcgtgcgttga

SEQ ID NO: 557 - DNA, 258 bp, Chromobacterium substugae
atgcacaacccaaacctgactgaatgcattcatgaagatgaattcgcggtagacgtcatcaatggagaaaaggtcctgatcaccctgcccaccatgctgggtcagcaaggcagcgaatgggagggctcgcccatcttcggcaggagctacctgatgtcgctgatccggcgcggcatagaaaacgacgtgctgcacccggcggatatccagcgcgcgctgagtcgcgaagccagcctgcgcgcctgctcgatggaatga

SEQ ID NO: 558 - DNA, 2355 bp, Chromobacterium substugae
atgctcagacgatttcttgcaataatggcaggcgtgtttctaggtggtgtggtgctgctggcgggagccgccgcaattgccatcatcataacttatccgcgcctgcaaagccttgatgtaatcaccgattaccgtccgaaaatcccgctccgggtgtattcggccgataatcagctgctgggcgagttcggcgaggagcggcgatccttttcccgcatccacgaagtcccgcagctgatgaagcaggccgtgctggccgccgaggacgagcgtttctaccagcacagcggcatcgactacctgggaatcatgcgcgcggcggtcggcaatctggtgtccggccacgcccgctccggcgccagcaccatcaccatgcaggtggcgaagaacttcttcctgtccagcgagaaaaccttcacccgcaagttcaacgaggcgctgctggcgttcaagatcgagcacacgctgagcaaggaccagatcctcgagctgtacttcaaccagatctacctggggcagcgcgcctacggcttcgcggcggcggcgcaggcctattacggcaagccgatcaacgagctcagcgtcgcccagatggcgatgctggcgggcctgccgaaggcgccgtcggcctacaaccccatcgtcaaccccgagcgcgccaagctgcgccagcaatacgtgctgcgccgcatgcgcgagctcaacttcatcacccaggcgcagtacgacgaggcgctgaacgagccgctgaaactggccagccaggctgccgataccagccagccgggccagtatgttgcggaaatggtacgccaggcgatgtacgagcgttacaaggaagcggcttacaccgagggcttcaaggtttacaccacgctggacagccgccaccagaaatgggcctatgacgccttgcgcgccggcctggttgattacgaccgcaagatgggctatcgcggcccggaaagcaccatcgacctgcccagcggcggtggcgaggacctgaccgaggcgctggacgaggcgatgggtgatttgcgcgacagcggcgacatgctgccggccatcgtgctgtcggccagcccgtcggaaatccaggcctatatgcgcggcggcaagaccatctccatcaagggcgctggccttgaattcgcccgccgcgcgctgagcggcaaggcgtcgcagcagctgcagatccgccgcggctcggtgatccgcgtgtcggccaatgccaagggctattgggaagtggtgcagatgccggaagtggaaggcgctttcgtgtcgctggatacccataccggcgcgatcaaatcgctggtgggcggctttgatttcaaccgccgcagcttcaatcacgtgacccaggcttggcgccagcccggctcgtcgttcaagccgttcatctattcgtccggcatcgagcgcggcatcacgccttccaccatgatcaacgacgcgccgctgtcggtgcccggcatcaacggccagaactgggagcccaagaacgatgacggcaagttctccggcctgatcaccctgcgccgcggcctgacccagtcgaaaaacctggtgtcggtgcgggtgctgatggccgtgggcaccgattacgcgcagcaatacatccagcgcttcggcttctccgccaagcagcatccggcctacttgccgatggcgctgggcgcgggctcggtgacgccgctgcagatggtggagggctattcggtgttcgccaacggcggctatcgcaccaaggcttacttcatcgaccgcattgaagaccagtccggccgcgtgctggccaagaccgtgcccacggtggccggccagaacgcccagcaggcgattgatccgcgcaacgccttcatcatgcgttcgatgatgggggacgtggtgcgttacggcaccggctaccgcgcgatgagcctgggccgcaccgacctggccggcaagaccggcaccacctcggactggaaagacgcctggttcgtcggcttcaaccccaacctggtggccgccacctgggtaggcttcgaccagccgcgctcgctgggccgttacggctatggcggctccgcggccttgccgatctggatcaactacatgggcaacgcgctgaagggccagcctgaagtcgagctgccggtgccgcagggcatcgtggtgaagccgggcgccggtcagcgcggcggcgacgagtactactaccaagagttccagaagaccaatccggagctgcacatcgacaaccagggcacggtgccgggcagcggcgacgacgccagcgcgccggccgccgacgacaagccggcggcccaggacgcggtggaaaacgtcaaggaccagctgttctaa

SEQ ID NO: 559 - DNA, 1080 bp, Chromobacterium substugae
ttgctcgaacaactgggactggggcaatcccgcaacgcttccctgcttggcctggacatcagcagcacggcggtcaagctggtggagctgtcgcgcaacggcaagaattaccaggtggagcgctacgtgatcgagccgctgcccaaggaggcggtcaacgacggcaacctggtggaaattgacggcatcgccgaggcgctgcgccgcgcctggaaacgtctgggcagcccgatccgcagcgtcgccatcgccattcccactccgatggccatttacaagaagctgctggtgccggtcagccagaccgaagagctggaccagatgatagagtccgaagccaaccagatcatccccttccccctcgacgaagtgaacctggaccaccaggtgctgggcccctccccgtccagcatcgacgacctcgaggtcctgctgtgcgcggcgcgtaaggaaaaggtcgaggagcgcgtggcggtggtggaaatggccggcctgcgcgccctggtggtggacgtggagtcattcgcgatgatgacggcgttcgagcagatccagcaccagctgcccgaccagggcatgaatcagactttcgccatgttcgacatcggcgccacccgcatccactgcaacatcatccgcaacggccagcagatctactaccgcgagcagatgttcggcggccaccagctgacgcgcgacatccagcgccgctacaacatcagcttcgaggaggcggaaagcggcaagcgcagcatggcgatgcccgacggctacgaatcggagctgatgcacccgttcatcgattcgctggcacaggaaatccagcgcgcgctgcagtttttctacaccaccgtcagcgtgtcgcaatacctgcgcgtcgactacatcctgctggccggcggctgcagcatgctgcccggcctggacgacgcggtggccggccgcacccagatcagcaccatgatcgccaaccccttcaccaccatggtgcaatcgagcgccatccgcctgaaagagctgctgatggatgcgccggcgctgctgatcgcctgcgggctggccctcaggaggttcgactga

SEQ ID NO: 560 - DNA, 573 bp, Chromobacterium substugae
atgatacggatcaacctcctcccccaccgcgagcagcgcaaggccgcgcaccggctgcgcttccagctgctgctggccggcaccgccgtatcggcgctgctgctggtgggcatcgcctacctggtgcttgagcaccagctgtcgcgccaggagcagcgcaaccgctacctgcaggcggaaatcggccggctggacggccagatcaaggacatcggcaagctgaagaagcagcgcgacgacctgctggcgcgaaaacagctggtggagcggctgcaggagggccgcaacgaggcggtgcacctgttcgaccagctggtgcgccagacgcccgacggcgtctacctgcgcagcttccgccagaacggcaaccagatcgtgctgaccggcttcgcgcagtccggcgcgcgggtgtccagctacatgcgcatgctcgggcaatcggaaaccttcgaggcgccggtgctggtcgaggtgtcgtcgtccatcgtcaacaaccagcgcgtcagcgccttcaccctcaacgccagcctgcgccaggcgcccgcgggcggtccgcaaggagccaagccatga

SEQ ID NO: 561 - DNA, 618 bp, Chromobacterium substugae
atgacgctggacgaactgcgcggactcgaccccaaggacatggccaactggccgctgcaggcgcaggcgctgatgctggcgatcctgacgctgctggtggccgggctgggctatttcttcgtgctgggcgatcagctagaccatttgaaccaggcccgcctgcaagaggcccagctcaagcagaccttcgtcgacaagaagcgccaggcggtgaacctggacgcgctgcagcagcagttgcgcgagatcgacgcctccttcggcgcgctgctcaagcaactgcccaccaaatcggacatggacaccctgctgaccgagatcaaccaggccggactgggacgcggcctgcagttcgagctgttcaagcccggcagcgaatcgcgctccgccgaaatggccgaggtgccgatcagcatccgcctgtccggcagctacaacgacctcgccgccttcgtcaacgacgtcgcccagctgtcgcgcatcgtcaccatcagcgacatttccctcaacccgggcggcggcaaggacaaccgcctgacgatggacgccaccgcgcgcacctaccgcgcgctggagcccagcgagcgcagcggcctgcccgccgcccagccaaagtga

SEQ ID NO: 562 - DNA, 519 bp, Chromobacterium substugae
atgaagaaaacctgcgtctgcctgctgcccctgctgctgagcggatgcggcggccccggcaccgaggacctgcagcagtggatggccagcagcagccagggcctgcgcggccagatcgagccgctgccgcaggtgcagacctacaagccgttcaactaccaggcctacgatctgctcgacccgttcaacgcgcaaaaactacaggccggcaaacagcaaaactccgccaacgcgcccgacctcaagcgcccgcgcgaggcgctggaaaattacgatctggacaagctggcgatggtcggcacgctgaagcgcggcgactcgctctacgcgctggtgcgcacgccggagggcgccatctaccgaatccagcccggcaactacgtcggtcccaatttcggcaaggtgaccgccatccacgattcggaaatcgtgctctccgaaaccgtcgaagacctgaatggagaatgggtgcagcgcgacagcagcctgcacctggacgaacaagggcaaaacaaatga

SEQ ID NO: 563 - DNA, 2094 bp, Chromobacterium substugae
atgaaaaagcttgcgatcagatggatggcggggctgctgctgagcctggcgggcggactcgccgccgccggcccggccatcacggcgatagaacccggcaaggtggacggcaacctgcagctcgtgcagatcaccttcgacggccccgcggtgcggccgggcagcttcgccatgtccaacccgccgcgcatcgcgctggacttcgccggcgccagcgtcaagctcgcccgccccgccatcaatatcgacagcgcgctgctcaagtcggcggtcgcggtggaggcgcccggccgctcgcggctggtattgagcctggcgcgcaacgcctccttccgcagcgtggtcaacggcaacaaattgctgctgacgctggacggctcgatggcgccggcgctggatgccaccccgcaagagcaaacctcggcggcagccccccaggccgcgggccaggcgcagatcggccaggccggcctggacttccgccgcggcgccaatggcgaaggccgggtggagctggccctgcccaacgccaacaccccggtggatgtgcgccgcgacggcaaaaacctggcggtcgacatcgccggcgcggtcctgccgcgccagcaggtgcgccggctggacgtgaccgacttcggcaccccggtggccaaggtggatgccgccaaccagggaaacaacatccgcatccagatcatcccccagggcgactgggactattcctcctatcagaccgacggcaagctggtggtggaagtgcgccgcccggcgccggaaacgctggccaacagcgacggcggcaagccggtgtacaagggcgacaagctgtcgctcaacttccagaacatcgaagtccgcaccgtgctgcaagtcatcgcggaattcaccggcctcaacatcgtcaccagcgactcggtcagcggcaacatcaccctcaggctgaaggacgtaccctgggatcaggcgctggacctgatcctgcagaccaagggcctggatcagcgccgcaacggcaacatcatccagatcgcgccgcgcgacgagctgctggcgcgcgacaagcagctgcaggaagcccgccagcagctggcgacgctggagccgctgcgttcggaaaccttcgtgctgcgctaccgttcggccgaagacttcaagaaagtgctggatggcgacaacacctccggcaagaaagaaagcctgctgtccgaacgcggcagcgtgctgatcgatcccaagaccaacaccctgatcgtcaacgacatcaacgcggtgatcgacaagatccgcgacgtcatcgccaagaccgacatcccggtcaagcaagtgctgatcgaggcccgcatcgtcgaagccaccgacaactgggaacgcgacctcggcatccagctcacctacgaccggatggaccccaagggcatcatttcgggcagcccgctgggcaccgcggtcaacaacgtcaccaacctgaacaccggccagccctacgtgatccagaccacgccggccggcgtcaacctgcccatcgccaatccctccggcacgctgaccgcgctgtacaacgtcggccactcggtgatcctggggctggagctgcaggcaatgcaggccgaggacaagggccgcatcatctccagcccgcgggtgatgaccgccgaccgccaggaagcgaccatcgagcagggcaccgagattccctatcaggaagccagctccagcggcgcgacctcggtatcgttcaagaaagcggtgctcagcctcaacgtcaagccgcagatcaccccggacaatcacgtgatgctggacatcaaggtcaacaaggactcggccaacttccagcaaaccgtcaacggcacgccgtcgctgaccaccgagaaaatcgaaacccaagtgctggtggacaacggcggcacggtggtgctgggcggcatctatcagcagcaactggacaatgtcgtcaacaaagtgcctttcctcggcgacataccgcttctgggcgcgctgttccgcagctcgcagaagatagacaagcgcagcgaattgctgattttcatcacgcccaaggtggtcaacgacctgatcgtcgcgggacgctga

SEQ ID NO: 564 - DNA, 543 bp, Chromobacterium substugae
atggagagattggcaggcaacttttttctggtcggcctgatgggcgcgggcaagaccacggtaggcagggcgctggcgcgccgcaccggcaagacgttctacgattccgaccaggaaatcgaggcgcgcaccggcgtgcgggtcgctaccatcttcgacatcgaaggcgagctgcggtttcgcaaccgcgaaacctgcgtgatccgcgacctggcccagcagagcgacattgtgctggccaccggcggcggcgcggtcctgcgccaggaaaaccgccaggtgctgatgcaatacggcaccgtgatctacctgcgcgcgccgatcgacgacctgctggcccgcacccagcacgacaagaaccgtccgctgctgcaaatcgccgacccccgcgccaaactggaaagcctgttcaacgagcgcgaccctctctaccgggaaatcgccgacgtcatcgtcgacaccacccagcaaaacgtcaacctgctggtcagccgcctgatcgaccagttgcagccccccatcaccaaggaagccgattcgtga

SEQ ID NO: 565 - DNA, 1080 bp, Chromobacterium substugae
gtgatcaccctcgacctgatcctccccgacacccgctacccgatacatattggccacggactcctggaacaggtcgaactattgcttccccacctgcccatccccaaggtggccatcgtcagcaacgaaaccgtcgcgccgctgtacttggcgcggctgcggcaagcgcttgaaagccgcggcgtggcctgcgccagcatcgtcctgcccgacggcgaaacgcacaaggactggcagacgctcaacctgatcttcgacgccctgctgtccggcaacgccgaacgcaagaccacgctgatcgcgctgggcggcggcgtgatcggcgacatgacgggcttcgccgccgcctgctaccagcgcggcgcgcccttcatccagattcccaccacgctgctggcgcaggtggactcgtcggtcggcggcaaaaccgcgatcaaccatccgcagggcaagaacatgataggcgcgttctaccagcccaaggcggtgatcgccgacatggacctgctcgccaccctgcccgaccgcgaactgtccgccggcctggcggaagtgatcaaatacggcctgctgggcgacgccgacttccttgcctggctggaagacaatatggccaggctgagggcgcgcgacagcgccgcgctgcaatacgcggtgcgccgcagctgcgagatgaaggccgccatcgtcaccgaagacgaaaaagaaaacggcgcgcgcgcgctgctcaatctgggacacaccttcggccacgcgatagaagccgggctgggattcggcgcctggctgcacggcgaagccgtcgccgccggcatggtgctggccgccgccgcctccgccgagctgggctggcttgccgccgccgacctcgatcgggtgcgccggctgatcgccgccgccggcctgccggtgacatctcccgccatgcccgtccaccgctggctgcagctgatgagccacgacaagaaagtggaagccggcaccatacgcttcgtgctgctgcgcgcattgggccaggccgtgatccaacctggcctggcggacagcctgctggagaagattctgcgcgaaaacagctga

SEQ ID NO: 566 - DNA, 384 bp, Chromobacterium substugae
atggatgtatttacggccttggccagcagcttggccctgatgcttgtctattattcgcttcgccagttctggcgtcgcctgcgctacaccaagccggtccaccgcggcatcgatccggttggcgaggccgaagtctatctcgcctacggccgcaccaaagaggcggtccgggtgctgaaagactccctcaaagacgatccggacaatctccacgccaaagtggcattgctgcgcgcctattccagcgcccgcaacagcgaagcctatgtgttgctggcgcgcgatgtgcaggcgcaggtgcaagaccagccggtctggcacaccatccaggagaacggccgccagctcgcgccacaggatccgttgttcgacgccaagttgtaa

SEQ ID NO: 567 - DNA, 1242 bp, Chromobacterium substugae
atggcaatagagcgtcagcgcgacttacgttatgattggcttgtttggggattgacatttattgtcatcgcattgggttttgtctggaggggtagcgctacgatagtggcttgcttgctttccttgattggcatagccctttctttcaggaaaaactatttcaagatatgctgggatttgtataggccctggattttcgccatgtctattcttggcttggcgattatttgtagagagctgatttccggcgatcctcgatttcgtttcgcggattcagcctccagaaccatgctggctattccgttattcgtagcgatgtgccatagcgccagattcgatctgaaatcggcacggtggatttttgccgctgccgtgttcttgatgctgatattcggctattggaatatgacccatggcggtgatctgcgcattgcgacagcatttacgaatactattccgtattctgcattctgcttgttgtttggcacgattttcttcctctattcatatagtcttggtggctggaatcgggttgcctcgattgtcgtgattgcaactacatacttggttctgtatttttcggagtcgcgcggggtttgggctgcgggtgtcgttgcagcgctattcctgtttacaaccgtgtttggttttaactggaagagttttgccggtattttgttgcttgtgttcgcgcttctcgtgctgtcttacttctgcagtgcaatcgtcaaataccgcatagacttggcggtatcggaataccatgccttttttgttggaaaaaaagatggctcggtaagcatgcgtatggatatggcactggcttcatggcatatattcaagatgcatccgatttttggcgtcggccgggatttaccaccggtgatgcatgcactatatgagcagggctttgttggtcttccggttgcggatgcggctgatactcatggcgagttgttcttcaatgcggccagtctgggctcggtcggtttgctggcgtatgtcattttctatgtagggggcagctatccttattggaaggcggcggtttcaggcgagcccgagcttgtgaagatcggcaagattgggctggtttgcaatgttatctttttcattgtcggttacacccatatcacgctcggcttggttatgtacgcttctgtatatgccacggtacaggcggttttgctgtccaccttatataaattgcagtatggcaaggctagtcaggtatcagcgtaa

SEQ ID NO: 568 - DNA, 621 bp, Chromobacterium substugae
gtggggaaggaaatccagaaatattatggtattgatgaggccaaaataaaagtcttatatcctcccgtagacacccacaagttttcattggatgccagggccaatcgcgaagaggttagacagaagcttggtatcagaccaaaccagttcatgctcttgtttccatcaaataatcatgatttgaagggcgcagacatcatcctggatgcgattggtcgcatggatgaagatgttgtgttggtagcggcgggaaaagcgccgctgaaaagcgataaggttatcaacgcagggttctgcgatgaaatgcccccgttgtatgcggcggcggatgcgacgatcctggcctcaaaatatgaagcatttggcatggtgggcccagaatcaattttgtgcggcacccccgttttatttgccgatacggtaggtgcgacggaaatattgtccgagccaggctgtcatgtcttcaaacgggatgcggcggcattgaggacatgcctggagcgagtggtcaggcaggctaagcacttggaaagagacccggcctccttggcatcccagtctattcattatccttattcattggaagatcatgtgctggatttgctggcattgttggagtaa

SEQ ID NO: 569 - DNA, 843 bp, Chromobacterium substugae
ttgatcagtacctataatcggcctgatgcgcttgatgcagtattgtctggttttcaccaccaatcgggcatgcttgccggtgattgggaaatcattgttgccgacgatggctccggtcctgcaacccaagcggtggtgaaggcccatcagaagattttccatgatcggctccagcatgtttggcatgaggacttgggattccgattggcggagattcggaaccgggcggcgctgcaggcgcggggtgattatctgatattcctggacggggattgcatcccacagtcggacttcctgtttcagcacgccaagcttgccgaacgcggctgggtggtcgccggcaatagggtattgatgtccgaaagatttaccctgagctatgtttccggtgaatgccgtccggtatccaattggacgggattttcctggcttgctcatcggctgaggaaaaatatcaacaattttttgggttggttgcggcttgatttgccaaagtggcgcaagaaaagaaaagatagttggaaattgctgcgtggttgcaatatcggtgtttggcgcgaagattatttgatggtagatggatttgatgccacattttccggctggggctatgaggattcggacttcgctgttcgcttgattcgcaatggagtgggcatcaagaatggccgtttcgccatgccggttctgcatctctggcataaggaaaatgatagaagttttgagggtgaaaactggagaagattcgaggcgtcaatccgcagcgagcatgtcaaggccttgaaaggtatttcctcattggatattgatcctggttggctgtcgaatggaaaatcggaatga

SEQ ID NO: 570 - DNA, 549 bp, Chromobacterium substugae
ttgccgcgttgccggcatgcctgggtactgaatctggatgccgatgaaaggttggagccggatttcatcgcttatgtgaagaataccgatctggacgccctgggcgtggatctggtcgaaacgcgtcgccgcaattatattggcgaccgcttcacgccttatgccggtcaataccccgattatgtgaagaggttgttcaatcgccaccgggccgatttcacgccggttgtcgcgcatacttgtgtcaaggcggcgacttcgacgaaggtagcggttcatattacgcattattcgtaccggaattatccggacatgatcgcaaaatgcaagtatgccgaatggctttcagtgggcctggctaaaagcggcaagaaaatctatccctggcatccggcgctgcatggcggctgggcttttttccgccactatgtgatcaagctgggatttctggccggtttggatggcttgaccttgtcgatgtgcaaaggcatcggttcttatctgaagtatgcccatgctttggagctgagaaggagcggaaaggtctga

SEQ ID NO: 571 - DNA, 1749 bp, Chromobacterium substugae
atgtcattcttagataacaaaaccagtttcgcgctctacaagcgggtgatgctgtacctgcggccctactggaaggtcttcatcctgtcgatgctgaccatgaccatcgcggcggctaccgagccgatgttcgcccggctgatgaagccgctgatcgacggcggcttcgtcaaccgcgatccacacgccatcgtctggacgccgctggccatcgtcggcctgttcatgctgcgcggcctgaccagctacatcaacgaatatacttccagctggctgtccggccatctggtgcagacgctgaggcaggaaatgttcgcccgcatggtgcggctgccggtcaattactacgacaacaaccagtcgggcagcatcgtctcgcgggtggtgttcgacgtgacgcagatcagcgaggccggtttcaatgtgatcaccgtggtgatcaaagacggcatcacggtgattggcctgctggccttgctgctgataaccgactggcgcctcacgctgatctgcctggcggtgatgccgatcgtggcttggtgtgtccgctacgtcagcaagcgcctgcgcggtctgtcgcgcaaaaaccagcaggatatggccgaaatgacccagattctgggcgagagcatagactgccagcgcgtggtcaaggtttacggcggccaggactacgagagcgagcgcttcagccgctcggcggagtctatccgccacaatatggtcaaggagcgggctaccagcgctgccagcaccggcgtcacccagctgatcatcgcctgcgcgctggcggtgatcctgtatttcgctggcacgctggcgcagcatggcagtttttccgccggcgatttcatgtccttcctgaccgcgatgctgatgctgttcgcgccgatcaagcgcatcaccagcattagtcagacggtgcagaaggggttagccgccgcggaaagcgtgttcaaattcctggacgagcgtgcggagccggatgagggccggatccgtttgggttcgaccaaaggaaatttccggttcaagcagctgtcattccagtatccaggcgcggagcgaccggcattgcgtgatatcaacctagacatccgcgctggcgaaaccatcgcgctggttggctccagcggaggtgggaaaaccacgttggccagcctgattccccgcttctacgagccgactgccggccagatactgctggacgatgtgccgctgacgcagatcagcctagtcagcctgcgcgagcagatcgccctggtcagccaggatgtggtgttgttcaacgacaccgtcgccgcgaacatcgcttacgggcgtttgggcgatgtcacgcgcgacgggatccgcgaagcggcgcgcgcagccaacgcgctggacttcatcgaggcgatgccgcaggggcttgataccctgatcggcgaaaacggcactcgcctgtccggcggccagcgacaacggctggcgatcgcgcgggccattctgaaggatgcgccaattctgattctggatgaggcaaccagcgcgttggataccgcgtcggagcggctggtgcagtcggcgctggataatctgatgaaaaaccggacgacgatcgtcattgctcaccgtctgtccacgatagaaagtgccgaccgcatcgtagtgatgcaccagggcgagatcgccgagatcggcaaacaccaggacctgctggacaaacagggaatttattcaaagctatatctgctgcaatttggcagctga

SEQ ID NO: 572 - DNA, 1044 bp, Chromobacterium substugae
atgcaccacggcgacgtgctgctgacctcgccggtgttcaccgtgctgaaaaaccatgcgcctcacatcgagattgacgcgctggtctaccatgaaacccgggaaatgctgaccctgcacccggccatctccaatgtcttcaccatagaccgcggctggaagaagctgggcgcctgggcgcggctgcgccatgagctggcgctgtattcgagcctgaaggcgcggggctaccagttgatcgtggtgctcaacgacaataatcgcgctacctcgttggtgaggctgctgaagccgcgctggtcggtggtgccggacgtccccgatcgcgggcgctttttccggaaaactttcacccaccgccatggtctggtgctgggtaacaagcgccatatcgtcgaatggcatctcgacgcgctgcgacggctgggaatttatcccaaggaagcggaaaccgccctttcggtggtgcccggcgccgaagccgagcaaagcgtgagcgccttgctgcaagccaatggcgtcgcggcgggccgtttcatcctggttcacccggggtcgcgctggttctacaaatgctggccggcggacaaggtggccggcctgatcaacgctttgcatgagcaagagtggcaggtcgtgttgagcggcgcgccgtcggcggaggaaaacgccatgatccgcgaggttcgggcaggggtgcggcggccggtggtggatttgagcggacagctgtcgttgaagcaattggcggcgctgatcgcgcaggcgcgattgttcatcggcgtcgactccctgcccatgcaccttgccgcggcggtgcaaacgccggtggtggtcttgtttggcccatcgcgggacaaagtgtggggcccatggcgggtgccgcatcgccaggtttcgctggacctgccctgtcgaccctgcaatctggccggttgtggcggcggcgagcgcagcgaatgcatcgagcggatcgcggtggcccaggtgctggccgaggtcgagtcgctgttggccgaaacccgcccgagtcacgcttgctaa

SEQ ID NO: 573 - DNA, 1740 bp, Chromobacterium substugae
atgagcatcatcctgcacggggtggccatcggcggcggcatcgccatcggccgggcccatctgatttcgcgcagcatggacgatgttgcgcactatttgctggaagagggcgagattccggcggaaaaggcgcgtttcgacgaagccgtgcgcgccacgcgcaaggagctggagatgctgtggggcagcatcccggaaaacgcgccggcggagctcggcgcttttctgtcgctgcacatcatgctgctgggcgacgtcaccatctcgcgcgagccgcgcgaaatcatcgaaaagcagcactgcaacgccgaatgggcgctgaagctgcagtgcgaccacctgatcgagcaattcgacgccatcgaggaagactacctgcgcgagcgcaagaacgacgtgctgcaggtggtcgagcgcattttcaagaacctggacggcgacgcgccgcaattgccggcgcaggaagacctggtcgacgaccacatcctggtggcgcacgacctgtcgccggccgacatggtgtatttcaaggattccaacttcgccgccttcatcaccgacgtcggcggcgccacctcgcacaccgccatcctgggccgcagcctggatctgccgtcggtgatcgcgctgcaccacggccgcgagctgatccgcgaggacgagatgatcatcgtcgacggcctgcagggcgtggtgatcatcaatccggacacgctggtgctgaacgaataccggcgccggcagcgggcctggcgcggcgcgcggcgcaagctgtcgtcgatccgcaagtccagcgcggtcactcgcgacggctcggtgatcgagctgttggccaatatcgagcggccgcaggacgtcgatgacgtgcgcgaatccggcgcggtgggggtggggttgttccgcagcgagttcctgtttctgggtcgcgacacgctgccgaccgaggacgagcagttcgaggcctaccgccacgtggcggtggcgctgaagggcatgccggtgaccatccgcaccatggacttgggcgctgacaagagcccgaaatggctgggccacgaccaggccgacaacccggcgctcggcctgaccggcatccggctgtgcctggcggagcccttgatgttccgcgcccagctgcgcgcgctgctgcgcgcctcggcctatggccggatacgcgtgctgttcccgatggtgaattcgctgccggaattgcggcaggcgctggcgcagttcgaatacgcgaagtcggagctgcgcgacgagggcataggctacgccgaagacatcgaagtgggcgcgatgatagaaatcccgtcggcggcgctggtggccggcagcttcaccaagctggtcgacttcctgtcggtgggcaccaacgacctgatccagtacacgctggcgatagaccgcaacgacgacaccgtcagccacctgtacgacccgatccacccggcggtgctgaagctgatcctgcacaccatcaagtgcggcatcaaggccaatgtgccggtgtcggtgtgcggcgagatggccggcgacgccaagctcacccgcctgctgctggggatgggcttgcgcaagttctcgatgcatccggccaatctgctgtcggtgaagcaacaggtgctgaccacccacctggacgagatcgcctcgatcacgacgcgcatgctcagatcggaagaccctgataaaatagccgatctactgcaactgctgaatgcagagccgggcgattaa

SEQ ID NO: 574 - DNA, 270 bp, Chromobacterium substugae
atgctgcgatctgaagtcgaaatcatcaacaagctgggcttgcacgcgcgcgcgtccagcaaattcacccagctggccagccgttacaagagcgatatcttcatcgcccgcaacaaccgccgcgtcaacggcaagagcatcatgggcgtgatgatgctggccgcggccaagggcgcgaaggtggaattggagatcagcggcgaggacgagcagcaggcgctggaggcgctgatcgcgctgatcaacaaccgctttgacgaagcggagtga

SEQ ID NO: 575 - DNA, 408 bp, Chromobacterium substugae
atggtaggtgttctgataattgcacatggagacctggggcgtagcctggccgattgcgccaagcacatcctgggccgggaaccggacaatctggcggtgatggtggtggacaagaccgaagacccggaacgcaagctggcagaagcgcagggcctggtggacgggctggatcagggcgacggcgtgatggtgctgaccgatatgtacggcggcacgccatccaatatcgccagcaggctgatccgcccaggccgggtcgaggcggtggccggcgccagtctgccgatgctggtgcgagcgctgtgctacagcagccagccgctggagatcgtcgtcagcaaggcgatcaccggcgggctggaaggcgtgctttacattatcccgggggaaggaaatgctgcgatctga

SEQ ID NO: 576 - DNA, 1413 bp, Chromobacterium substugae
atggatttcttcccgattttcctcaagttgcaacagcagccctgtctggtggtgggcggcggcgaggccgccctgcgcaaggcgcggctgctggcggcggccggcgcgcggctgcaggtggcggcgccggcattggcgccggagctggccgaaatggccggccgcggcgagctgacccacctggccggcgcctacgcggcggagcagctgcgcggccagcgcctggtcgtcgccgccagcgaggacgacgaactgaaccgccgcgtcgcgcgcgatgccgaggcgctgggagtgctggtcaacgtggtggacgacgccgaggcctcgcgctacatcacgccggccatcgtcgaccgctcgccgctgatgatagccatcgccagcggcggcggcgtgccggtgctggtgcggatgatgcgggcgcggctggaaagcctgattcccggcgcttacggccggctggcccgcttcgccgccggttttcgcgagcgcagcaagcagcgctttcccgatgtggaccagcgccgccgtttctgggaggacgcgctggaagggccgctggccgacgcggtgctgaacggacacgaggagcaggcggcggcggaaatggagcggcgcctggccggcgcggggccggaaaccgtcggcgcggtttacctggtgggcgccgggccgggcaatcccgacctgctgaccttccgcgcgctgcggctgatgcagcaggccgacgtggtgctgtacgacaagctggtggcgccggagctgctgcagctggtgcggcgtgacgccgagcgcgtctatgtcggcaaggcgcgcgccaaccacgcgctgccgcaggacgacatcaaccagctgatggtggacctggcccggcagggcaagcgggtgctgcggctgaaaggcggcgacccgttcaccttcggccgcggcggcgaggaaatcgccacgctggcggaaaacggcgtggccttcgaggtggtgcccggcatcacctcggccagcggcgcggcggcctatgcgggcattccgctgacccaccgcgactacgcgcagtcggtcaccttcgtcaccggccacaagcaggacggcagcatcgcgctggactggccggcgttgacgcggccgcagcagacggtggtggtgtacatgggggtgtcgacggcggccgagctatgccaggccttcatcgccaacggccgcgcggcggcgacgccggcggcggcggtggagtgggccaccaccgcgcgccagcgcacggtgtgcggcactttatcgacgctgcctggtctgatggcctcgcacggcatcgcctcgccggcgctgatcatcgtcggcgaagtggtggaattggcggacaagctggcctggtaccgccgcagcgagaattcagctgttacaattcaggaagattga

SEQ ID NO: 577 - DNA, 129 bp, Chromobacterium substugae
atggccggccgcggcccaggccggttgggcgaggagcgggagcagacaggggaggatgggcaaggcggagggtcggcgggtcaaacagcgctccaggcgaaaggcggcaaaccaaagcgggaattttga

SEQ ID NO: 578 - DNA, 1848 bp, Chromobacterium substugae
atgagccaggccggctggctgctggccatgctggtcaccgcgctctggctgcggggccgccagcaacggcgcaaagcccgcgccacgctgcaggacgcctgcctggggctcttggagttcgatctggcgcgccaatacgtgcgcggcagcgtccatacgctgcaacggctgctgggcctgccggcgcacacccgcggcatggactgcgcgcgctggctgactctgctgcaccccgaagaccgcccgcgcttcggcgaactgctgcggcagccgccgcagatgccggaagccggctacgaattgcgcatccgccattacagcggccactgggaatggctggaaatgagcctgcagccgacctggcgcgccggcaaggtcagcgcgctgaccgccatctgccgcgtcatcaccgcgcgcaagcacagcgaggcggcgatgatgcgccgcgagcagcagttccgcaccctggtggaaaactcggaagacatcatcgcccgctacgatctggagctgcactgcctgttcatcaaccgcagcgtgtcgcgcttctccgacctgccgctggaagaacacctgggcaagaccccgcgcgagaaaggctggaccgacgaggccagcacccgcttcgaaatggaatgccgccagctgatcaacaactgggaagcgcgcagcttcgagctggagctgtacaaggaccagcagcgccatatcttcgaaatccggctgttcccggaattcgacagcgccggcatgctgaagaccatcctgtcggtggaccgcgaagtcaccgccagccgccagggcgagcggctgctggcggaggaaaacgcggtgctggaaatgatagccggcaaccatccgctgccgcagacgctcaaccagatctgccagatgatggaatcgcagcagccgcgcggcctgtgcagcatcatgctgctggacgaggacggcgccgcgctgcgcttcgccgccggcctcagcctgccgccggcctaccgcaaggaggtggagcgcgtcgccgtcggccccagcgccggttcctgcggcaccgccgcgcactggaagcgcaccatcgttgtggacgacatccaggaaagcccgctgtgggcgcacgcgcggcacaaagcgcagcccttcggcctgcgcgcctgctgggccacgcccatcttctccagcgaccgccgcctgctgggcaccttcgccacctattaccgcgaaccgcgcagcccgacgccggaagagctggccctggcccaccgcagcacccacatcatcgccatcgcgctgcagcgccacggccacgagaagcagctgttccgcctggccacccaggacagcctgaccgagctgagcaaccgccgccagttcatcgagctggccgaccgcgaagtcgagcgcagccgccgcaaccacggcccgctgacggtgctgatgatggatctggaccatttcaaggacatcaacgacctgcacggccacgcgctgggcgacgacgtgatccgccacttcgcccaactgtgccgcgaagtcctgcgcgccagcgatttgtgcggccggctgggcggcgaggaattcgccgcggtgctgcccgacacccggctggaagacgccttgctggtggcggaacggctgcgcgccgcggtcgccgcgtcccggctgccgaccgacgacggcgagctcggctacaccgtcagcatcggcgcggcgatgcggctgccggccgaatcggacatcgacgaagtgctcagccgcgccgacaagctgctgtaccaggccaagcgagccggccgcaaccgcatttgcgccgacctggacgcgccggcggcgaatgcgccgctttccggctag

SEQ ID NO: 579 - DNA, 840 bp, Chromobacterium substugae
atggcggcctttcccaccgaacgccccgccgtgaaccactggcacgccgcctacctgtcccatccgctgtacgcgccgctgcggccgctgctcgccggcctgacgcctagcgactggcccgagcagcctgactacgaccgcctgctggcggccgcccgcgccgccggccgcccgctgccgccggcgctgcgcttcgtctgcggcctggagccggatggctattacgaaagccatatcgcggccaccggcgaagtgccgacccggcggcaaaactggcacgactggttcaacgcgctggcctggctcgcctggccgcaggccaagtcggcgctgaaccgccgccacgcgcgcgctctctcgcgcggcgaaacccggcgcgggccgctgcgcgacgccgccaccctgctcgacgaatgcggcgtgatcgtggcgacagccgacccggagctgggccgggcgctggacgacatgcgctggcggcggctgttcatcgagcggcgcgccgactggggccgtagcatagccgcccacacgctgggccacgcggtgatggagatggggttgacgccgcacataggctggtgcggcaaggcgctgattctggaggtggcgccggacttcttcgcgcgcgacgacgcggcgcggcagcggctgctcgatgcggcgctggcggcgcggctggacgacgacgccttcctcgccagcccccgcgcgctgtgcccgctgccgctgctgggcattccgggctggtggccggacaaccaagacccggccttctacgacaataccggctacttctgcccgacgcggcgggcgaagtccgccaccgtctcggcctga

SEQ ID NO: 580 - DNA, 1209 bp, Chromobacterium substugae
atgcaagtccaacgattcgaaccctatttcggctttgcccgcttcctcgcgcgccgcatgggcggcctgcgcgtgctgcaggtgtcgggcagcctgaccttcaccacgctgctggcgctggtgccgctgttcaccatcgcgctgacggtgatttcggcgtttccggtgttttccgactacagcacccgcttcaagatcatgctgctgtcgacgctggtgccggagttcgccggcaaggtgatcaccgtctacatgcgccagttcgccgacaacgcggaaaagctcactgccgccggcatcgtgatgctgggcgtcaccgcgctgatgctgatgtccaccatcgagcgcactttcaacgcgatctggggcgtgcgccgcggccggccgtggctgcagcagggcatggtgtattggacggtgctgacgctggggccgctggtgctgggcggcagcctgctgtcgtggcgctggctgttccgcgtcacccgcttcgagaaaaacctgcccttgctggccagcctggtggaggcgggcggcaccatcgtgctgaccgcgctggtgctgtcgctgctgtaccgcatcgtgcccaaccgcttcgtgccgatcaagcacgcgatctggggcgcgctggccacttcggtgctgctggaggccaccaaggccggcttcggcttctacatcggccagatcgccagctaccagctggtgtacggcgccttcgccagcatcccgatcttcctgctgtgggtgtattgcctgtggctggtggtgctggccggcgcggtgttcacctcggcgctgtcctactgggagggcgatgcctggcgccgccgcaatcagccgcagcgccgtttcctggacgcgctggcggtgctgttgctgttggatgccgcccatgcgcgcggcgaggcgatgacgccgccgcagctgcggcaggcggtgaaggtgggttacgacgagctgggcctggtgctggacaagctggcgcggcgcggttacgtgcaaaagggacagggcgacgcctgggtgctgatgaagcgcgcggcggcgatcccgttgtcggagttgttcgaactgttcgtctaccgccgcgaccttgggcgcggcgatgccctgggcacggcgctggccgagctgctggcgccgctgaccggcgggcttcaggccgagacggtggcggacttcgcccgccgcgtcgggcagaagtag

SEQ ID NO: 581 - DNA, 597 bp, Chromobacterium substugae
atgctagacatcctggtgctgtattacagccagcacggcgccacccgcgagctggcccggctgatcgcgcgcggcgtcgacagcgtgcccggctgccaggcgcggctgcgcacggtgcccaaggtttccaccgtgtgcgaggccagcgagccggccatcccggaaaacggcgcgccctacgtggaaaagcaggatctgatcgactgcgccggcctggcgctgggcagccccacccgcttcggcaatatggcggcggcgatgaaatacttcctcgacggcaccagcggcgaatggatgcagggcgcgctgtccggcaagccggcctgcgtgttcaccagttcggcgtcgatgcacggcggccaggaatccaccttgttgaccatgatgatcccgctgctgcatcacggcatggtcatcgccggcctgccctattccgaaacggcgctggcggcgacgcaaaccggcggcacgccgtatggcgtcagccatgtatccggcctggacaaccgccaggcgatcagcgagcacgaaaaggcgctagcgctggcgcaagggaagcggctggcggagttggcggtgaagttggcggcaaattga

SEQ ID NO: 582 - DNA, 783 bp, Chromobacterium substugae
gtgcgcggcaagccgcgcgactatccggcggggctggaaacgccgcgccacaaccatcccaccgcccagctgctgtgcgcggtggaggggctgatgctggtcagcgccgagcgcggccagtgggtggtgccgccgacgcgcgccatctggctgccgatcggcgcctggcatcaggtcaagatggtcagcgatgtgcggatgcgcagcatctacgtgcgcgaggacaagctgcaaggcctgcccgaggcttgctgcgtgctggaagtgacgccgctgctgcgcgagctggtggtagcggcgatggcggtggcggtgccgtgcgccgccggctcgcgcgatgaaaaggtgatggacctgctgctggaggaaatcgcccgcgccaaggtgctgcccttgtcgctgccgcagccgtcatcggccgcgctgcgccagctgtgcgatggctggctggcgcaaccggacgacgcgcgcggcgcggccgagtgggcgcgcgagctggcgctggacccgcgcaccctgcagcgccgcttccgccgcgaaaccggcctcagcttcggccagtggcggcgccaggcgcggctgatgctggcgctgcagcggctggcctgcggcgacagcgtgctgaaggtggcgctggacctgggctacgccagcccaagcgcctttgccaccatgttcaagcgggaattgggcgcgccgcctagcagtttcttggcggtgtcgggtgcgtcaccccgcaggggcgacgcaccggttggtgtccgcttcgcggatgaaatttga

SEQ ID NO: 583 - DNA, 1200 bp, Chromobacterium substugae
atgaccgcaagcacccagctagccgcgccggcgcaggacacgcgctttcgcgtgctcggcgccatcagcttttcccattttctcaacgacatgctgcagtcgctgctggtggcgctgtacccgttgctgaaaggcaactaccacctcagcttcgccgaaatcggcctgctgaccttcacctaccagtgcaccgcctcgctgctgcagccgctggtcggcatctataccgacaagaagccgcagccctactcgctggtgttcggcatgggctcgacgctgatcggcctgctcttgctgtccagcgccggcagcttcccgctgctgctgctggccgccgcgctgatcggcaccggctcgtccatcttccaccccgaatcgtcgcgggtggcgcggatggcttccggcggccgccccggcctcgcccagtccatcttccaggtcggcggcaacgccggcagcgccaccggcccgctcttggcggcgctgatcgtgctgccgctgggccagggcagcgtcgcctggttcagcctggccgcgctgctggcgatgtacgtgctgttccgcgtcggccagtggtacgcccatcagcaccgccaggcgaagaagggcgccgccgccgccaagccggcgctgccgcccggccgcgtcaagctgaccctgctgctgctgttgctgctggtgttctccaaacacttctacctggccagcatcaccagctactacaccttctatctgatccaccatttccatatcggcgtgcaatcggcgcagctgcacctgttcctgtttctgttcgccgtggccgccggcacggtgctgggcggcccgatcggcgacgccatcggccgcaagcgggtgatcggcttctccatcctcggcatcgcgccgctggcgctgctgctgccgcacgccgacctgttctggacctcggtgctgtcgtttccgatcggcttcatcctggcctcggccttcccggccatcctgatctacgcgcaggagctgctgccgggcaaggtgggcatggtgtcgggcatgttcttcggcttcgccttcggcatcggcggcatcggcgccgcggtgctgggcgaactggccgacctgaatggcatcgagttcgtctaccagctgtgcgccttcctgccgctgctgggcctagcgtcgctggcgctgcccgacctgcaccgccaggccaaggcctga

SEQ ID NO: 584 - DNA, 543 bp, Chromobacterium substugae
atgcgtcgcttcgtctgccagctggccatcgccagcgtagccctgtccgcctccttcgccgccatggccaaggaatacccgatcggcaaacccacgctgaaaaacggcatggaaatcggcgcggtctacctgcagcccaccaagatggacccggacggcatgatgctgaagccggaagcttccgacatccatctggaagccgacatccacgccaccaagaacaaccccaacggcttcgaagaaggcgcctggatgccctacctggtggtcaagtacgaactgaccaaggtcggcggcaagacccagaagggcgacctgatgccgatggtggccaacgacggcccgcactacggcgacaacgtcaagctgcaaggtccgggcaagtacaagctgaaatacaccgtgatgccgccgtcggccaacgagcacgcccacttcggccgccacgtcgacaaggaaaccggcgtcgccccgtggttcaagccgtttgaaatcaactacgagttcaccttcgccggcatcggcaagaagggcggctactga

SEQ ID NO: 585 - DNA, 336 bp, Chromobacterium substugae
atgactgttctgcgcctgttggccgccgccctgctggccggcctgttctccgcttcggcattggccgaggaaatgccggtgttcaagctggaaatcaaggatggctatttcaagcccgcccggctggtggtgcccgccggcaagaaattcaaggtggaagtgatgaataccggcaagacgccggccgagttcgaaagcacgccgctgcgcaaggaaaaggtgctgggccccggcgcggaatccttcctggtgttccagccgctgtcgcccggcgaatacaagtttttcgacgagttccacatgaagaccggccagggcgtgatcgtcgccaaataa

SEQ ID NO: 586 - DNA, 825 bp, Chromobacterium substugae
atgggacaggtacttttcattgtctggcgcgaaagcgtcgaggccttgctggtggtcggcattctcaatgcctggatgaaccagaacgaagccggccgcgccggcaagccctatctgtggggcggcgtggcgctgggcgtcgcgctggccatcgcgctggcggtggcgctgttcgcggccagcagcctgatggcgggcgcgcaggattacttccagctcggcatggtgttcatcgccgccgccctgatcgtgcagatggtgctatggatgcgcgagcacggccgcacgctgaagaaagaactggaaagcgggctgagcgaaaacgcccgcagcgacaactggtggggggtcaccgtgctggccgcgctggccatcgcccgcgaaggcagcgaggccgtggtgttcctgtacggcatgctggccgaagcccagggcatggagctggccaagatgggcgtggccggcctggtaggcctgctgctggccttcctcactttctacctgctgcagctgggcggcaaggtgctgtcgtggcggctgttcttccgcgtcaccgaaatcatgctgctgctgctgggcgcctcgctgttcctcaacggcgtggagaaactgatctcgatggacatcctgccgccgctggtggacccgctgtgggacagctcggcgctgcttgacgacatgagcccgttcggcggcgtggtggcttcgctcaccggctaccgctcgcacccggcgctgaccagcctgatcgcctacgcgctgttctggctggcgatctggagcctgttccagtggcgcaaccgccgccaggccgccgccgcatga

SEQ ID NO: 587 - DNA, 1449 bp, Chromobacterium substugae
atgaaagcggatcccaagcggctgcgcccgcagcgggtgattcccatcgtcgccgccccgggcggcggctcctgtagcccgcagcgacagccgcgcggcctgctggcgctggcgggcatctggctgcgcgaccacgccgcgctgctgcgcaagctgcaatgggcggtggtgctggtttacgccttcctgctgattgtccccgcctgcctgccgctgccggaagacaccgcgcggatgtgggacaacctgaccatcttcgcccagttcgtgttctggggcatctggtggccgttcgtgctgctgtcgatggtgctgttcggccggctgtggtgcggcgtgctgtgcccggagggcgcgctgtcggaatgggcggcgcgcaagggcatgggacggccgattccgcgctggatgcgctggggcggctggcctttcgtcgccttcgtcctcaccaccgtctacggccagctggtcagcgtctaccaatacccgaaagccgcgctcttggtgctgggcggctccaccgtggccgccgtcgccgtcggtttcgtctacacccgcggcaagcgcgcctggtgccgccatctgtgcccggtcaacggcgtgttcggcctgttgtccaagctggcgccgctgtactaccgcgtcgacgaggccgcctggaaagcctcgcatgagcggacgccggcggtggactgcgcgccgctgcaaccgctgcgccacatgcagggcggcagcggctgccatatgtgcggccgctgcagcggccatcgcgacgcgatcgagctgagcctgcgcccgtccaacgatgaagtggtgcgggtggcggaaaaagaagccgatggctggcagaccgcgctgatcgtctacggcctgctgggcgtggcgatgggcgccttccactggaccatgagcccctggttcgtatcgctgaagcaagccgcggcggaatggctggtggaccgcgacatcatgtggccgctggacaccggcgcgccgtggtggctgctcactcactacccgcagcacaacgacgtgttctcctggctggacggcgcgtcgctgatcgcctatgtcgccgccaccgcgctggtgctgggcagcggcatcctggcctgcctcgccttgtcggtaaccgtttccggccgctggcacacgcaacgcctgcaccatctggcgcaggcgctgatcccgctggccggctgcggcgtgtttctcggcctgtcggcgctgaccgtcaccctgctgaaggccgaaggcttcgccatgcactgggtcaacgatgcccggctggccttgctggccggcgccaatctgtgggcgctgcggctggcctgcggcattctgtcgcgctggagaggcggcctgagccgcctggcggcgctgctgccgttctgcggcgcgctggcgctggtagactgcgcctggggttatatgttctggtggtggtga

SEQ ID NO: 588 - DNA, 762 bp, Chromobacterium substugae
atgcggcgtctgctgcctctggttttcgcgctgtcgctcggcggtccggccgctgcccagccggccgtcgagctggccaccggcgagtggccgccctacgtctcgcaaagcctgccgcaggacggcgtgttctcgcagatcgtgcgccaggccttccagcgcgccggctacccggtgcatttcacctatcagagctggccgcaggccgaggcggcggccaaggccggccgggctgcggcggcgtttccctaccggccgacgccggagcgcgagcaggatttcgacttctccgcgccgctgatgcgctccaccagctatctgttctatcacaagccccacatgccgcacccgccgccgcagttcaaatcgttagacgagctgcgcggctaccgcgtcgccgtccagctcggctattggtacattccgctgttccagcagcacaagctcaataccctgctgaccagcgacgaagtcaacgccttgcgccagttgcagctgggccgcctggacctggcgccgatgacgctggagcgcggttttttcctgatccacagcgcgctgcccggacatgaaaaggaattcggctacatcccgacgccgctggacaaggaaacgccgctggggctgatgttctcgcgcggctatccgcaggtggcgcgcatccgcgaggacttcgcccgcgcgctggagtcgatggagaaagacggcacgctgaaggcgatctaccagcgcaacttcccggaagtcacgccgccgcgttga

SEQ ID NO: 589 - DNA, 480 bp, Chromobacterium substugae
atgtccagcaaggcccccgtcacccaggccgtccgcgcgctgcgcgagcacaaggtcgactacaccgaacacctgtacaaatacgaggacaagggcggcaccacggtgtcggcgcgcgagctgggcgtcgacgagcacgcggtggtgaagacgctgatcatggaggacgacaacaagcgtccgctgatcgtgctgatgcacggcgaccgggaggtgggcaccggcatgctggccaagcagatcggcgcgaagaaagtccatccctgcgacccgaaaaccgccgacaagcacagcggctaccaggtgggcggcaccagccccttcggcacccgccacccgatgccggtgtatatggaggccagcatcgccgagctgccgctcatctacctcaacggcggcaagcgcggcttcctggtaggggtcagcccgcaggaggtgatccgggtgctgaatcccacgctggtcaacgcggcggcgtga

SEQ ID NO: 590 - DNA, 618 bp, Chromobacterium substugae
atgacgacgctgcgcatgaaaacgcccgccgccccggccgaccgccgcctcgccgtcggcaaggttttgttgttcatcgcctgcctgctgccgctcatgcgcgcggcgtggatcgtgctgatgggcgaagcggtgaacccggtggagttcattactcgctccaccggcacctggacgctggtatggctgctggccacgctggcgatgacgccgctgcgccgcctgaccggccaggcctggccgctgaaatgccggcgcatgctgggcctgttcgcctttttctacgccagcctgcatttcaccacctatatctggctggaccagttcttcgactggcaccacatcctgaaggacatcgccaagcggccgttcatcaccgtcggcttcgccgccatcgcgctgatgtcgccgctggcgctgacctccacccagggctggatgcggcggctgaagcgcaattggggcaagctgcaccggctggtgtacccggtggcgatcctggcggtcacccattactggtggctggtgaagaaggatgtcacccagccgctgatctacgccgctgttctggcctgcttgctgggcctgcggctgtggtggcgcgcgcgcaaggcttga

SEQ ID NO: 591 - DNA, 918 bp, Chromobacterium substugae
atgctgatcagaaaacccgccgaccacttgccgtcggaaatcacgccggaaaaagtgtacttcaaccgccgccagttcatggccggcgccgccggactgttgctgtcggccgaaacgctggccgggctcaacgccaggaaaagcccgctgtcgcagctggcggccaatgacaagcccaacagcctgaaggacatcaccagctataacaactattacgaattcggcaccgacaagagcgatccggcggagaacgccggcagcctgcatacccggccgtggagcgtgctggtggacggcgaggtggccaagccgcgccgcttctccatcgaggagttgctgaagtttccgctggaagagcgcgtctaccggctgcgctgcgtcgagggctggagcatggtcatcccctgggtgggcttcccgctggccagcctgatcaagcagatgaatcccacttcgcgcgccaaatacgtgtcgttcgagacgctgcagcggccgagcgagatgccaggccagcgccaggcggtgctggactggccgtaccgcgagggactgcgcatcgacgaggcgatgcatccgctggccatcctcgctgtcggcctgtacggcaacgcgctgccgaaccagaacggcgcgccgatccggctggtggtgccgtggaaatacggcttcaagagcatcaagtccatcgtccgcatccggctgcaggaaacgatgccggccaccagctggaatatggccaacgcccatgagtacggcttttattccaatgtgaatccggatgtcgaccacccgcgctggagccaggcatccgagcggcgcatcggcgaattcttcaagcgcaagacgctgccgttcaacggctacgccgagcaggtggccggcttgtaccgcggcatggacctgagaaagaactactga

SEQ ID NO: 592 - DNA, 435 bp, Chromobacterium substugae
atgaagaaacaactcgccatcgccctgaccgtgggcagcctgctgctctgccaatccgccctcgcccgccgcgagccgctggaacagccgcaacgcgtcacccttaccgcgcccaacggcgacgtcggcaaaaccaaggccgccatcatccgcgccgccagcggcctgcaatggaatgtcgtggccgaccagcccggcaagctgaccttcaagcatgtcaaaggcaatatcgtgctggtgctcgatgtcagctatgacgccaccggctatcaggtgcgctacgcgtccagcgaaaacctgagctaccaggaaaccgaaaccggcgcccgcgtccaccccaccgtcaaccgctggatggacaatctggtccgccacatcggcggggaccgcaccgatggcgacgacgacgacaagccggccagcgcggccgagtaa

SEQ ID NO: 593 - DNA, 759 bp, Chromobacterium substugae
atgccatccaagctgaaataccagatccaacccgctccggaggtggacaccgccaccttgcgccgcctgcacgcgctgcggctggcgcagtttccgttccgccgcgccgaccccgcgcgcgaagccgccatgtggcgcgaatttcaggatagctatcgacagcgcgccgcctggtcggtgattttccgcgacgccgacggcgcgccgcgcggcttctggctggctgtctgcgagcggccccggccgccggcgccgcgcggcgtgctgctgcgggtggattatttgtataccgaaccgggctggcgcggcagttccgtattgatcgcgtccaccctgaggctgctgtggcggaccaagctgcaagcgcccggcctgcctctatggttcggctgcatctgttttcccaatagtttcatccgggtggcggccaccttcgaacaggtgcgcacgctggccgacgcgccgctggcggccgcggaccgcgccttgctgctgcagctgggcgccgacgccgcgggcgcccgttggcgcgcggccagcggcctcgccgacttcagcgaccatcatccgccggcgctggccgccggcatcgccgacacgccgcgcctggccaggcacttggcccgctacgaagccgccaacccggactggcgccggggcatggccatgccgatgttctgccggatcggcctggccaccgccatccgcggcgtttggcacaccctgcgccgcgcttggcggcgcaaaccggcggcttga

SEQ ID NO: 594 - DNA, 183 bp, Chromobacterium substugae
atgtttggacgcctgttcaagtttttcgtgctgtgcctggtgctgtgggcggtggcgcgctggctgctgcggcccagccagcgccgcacgctgcacgagctgttttccgcgctggccatcgccctgctgatcagcgcggccctgttctgcgcgctgtactggctgggctggcaccagttgtag

SEQ ID NO: 595 - DNA, 1143 bp, Chromobacterium substugae
atgaccgacaccaactgttcggtaggcatcgtcgcgccccaggacgccgtgttcgatgtcccattgccgctggcgagcggcgccgtgctgcccagctaccagctgcgcttcgaaacctacggcgcgctcaacgccggccgcagcaacgccatcctgatctgccacgcgctgtccggccaccatcacgccgccggccgccatcacccggacgacaaggccgccggctggtgggacaatatgataggccccggcaagccgatcgacaccgaccgcttcttcgtggtcgccgtcaacaatctgggcggctgccacggcagcaccggcccctccagcgtcaacccggccaccggccagccctggggctccgcctttccggtggtgacggtggcggactgggtgagctcccaggcgcggctggccgaccggctgggcatagagcgctgggccgcggtgataggcggctcgctgggcggcatgcaggcgctgcactggagcatcgcctacccgcagcgcgtcgcccacgcgctggtgatcgcctccgcccccaagctgtcggcgcaaaacatcgccttcaacgacgtggcgcgccaggccatcctcaccgacccggaattccacggcggcgacttctacgcccaaggcgcggtgccgcgccgcggcctcaggctggcgcggatgctgggccacatcacctatctgtccgacgacggcatgggcgagaaattcggccgcatgctgcgctccggcgaataccgtttcggctacgatgtggaattcgagatcgaaagctatctgcgctaccagggcgacaagttttccgactacttcgacgccaacacctacctcttgatgaccaaggcgctcgactacttcgatccggccaaggagcacggcggcgacctggccgccgcgctgcgccaggccagcgccagcttcctggtggccagcttcaccagcgactggcgcttcgcgccggaacgctcgcgcgaaaccgtgaaggcgctgatcgccgccggcaagcgcgtcagctacgccgaaatcgaatcggcgcacggccacgacgccttcctgatgaccgacccaccctatgtggacctgatgcgcgcctacctgtcccgcgtggccgaggaggcgaacgcatga

SEQ ID NO: 596 - DNA, 594 bp, Chromobacterium substugae
atgaaccatcccgctctccgccccgacctgcggatcatctacgactggatctcgcccagcagccgggtgctggacctgggctgcggccggggcgaactcctggcggcgctgcaggacggcaagcaagtgcaaggctacggcgtcgatttcgacgtcgccaacgtggtcggctgcgtcgccgccggcgtcaacgccattcagggcgacctggaaactggcctcgccgaattcgaggaccagcgcttcgaccacgtggtgctgtcgcaaacgatacaggcgatgcgccataccgaggccatcctcaacgaaatgctgcgcgtcggccgcgaggccatcgtcagcttccccaatttcggctattggcaaaaccgctggcagatcctgcagggccacatgccggtgtcggacaccattccctaccaatggtacgacacgcccaacatccactggtgcatgctcggcgatttcgaggcgctgtgcgcgaagaacggcatacgcatcgtccagagggtggtcatggacaagggcaagcgggtatccttgttgcccaatctgcgcggcagcctggccttctaccgggtggcgcgcggctga

SEQ ID NO: 597 - DNA, 189 bp, Chromobacterium substugae
atgcgcctgctgctggccattttcctgccctggctgcagttcttcaccataggccggccgttcgccggcctgttctgcctggtcctgcaactgactctcatcggctggattccggccgcgctgtggtcggtgtacgcgctgagccagtacaagaccgaccagaaaatcgccaaggcgctgcggcgctga

SEQ ID NO: 598 - DNA, 1278 bp, Chromobacterium substugae
atgaccctggcctccatccactggcggcgcgatgtgttctcccgcgccatgctggtttgcgtattcaccggcttcgcctccggcctgccgctctacaccctgatcaacctgctgccggcctggctgcgcagcgagggcgtcgacctcaaatccataggcctgttcgcgctgatcggcctgccctacacctggaaattcctgtggtcgccgctgatggaccgctacgcgctgccgctgttgggccgccgccgcggctggatgctggccagccagctggcgctgctgttcgccctcgggctattcggcctgttcgacccgcgcgcggacatctggaacatcgccgcgctggcgctggcggtcgcctttttctcggccagccaggacatcgtgctggacgccttccgccgcgaaatcctcagcgatgccgaactggggctgggcaacaccatccacatcaacgcctaccggctggccggcctggtgccgggctcgctgtcgttgattctggccgaccgcatgccctggggcggggtattcgtggtcaccgcgctgttcatgctgcccggcgcgctgatgacgctgctggtgaaagagcccagcctagccgccggcagcccgaagacgctgcgcgaagcggtagtggagccgttccatgagttcgtcacccgccagggctggcagggcgcgctgtggatattgggcttcattttcctgtacaagctgggcgacagcatggccacctcgctggcgacgccgttctatctcgacatgggctacgccaagtcgcagatcggcctggtggccaagcatgccgggctgtggccggcggtggccggcggcctgctgggtgggctgtggatgatcaagatgggcatcaaccgcgcgctgtgggcgttcggcgtggtgcaggtgctgtcgattctgggattcgcctggctggccagccatggccgtttcgacagcgtcggcgccgagcagctcggcatgctggccgcggtgataagcttcgaggcgctgggcgtcggcctcggcaccgccgccttcgtcgccttcatcgcccgcagcacccatccggcctacaccgccacccagttcgcgctgttcaccagtctggccgcggtgccgcgcacgctggccaacgccgccaccggctacatcgtcgactctatcggctggacttcgtttttcttcctgtgcaccgcgctggcgattccgggcatgatgctgctggtgaaagtggcgccctggggcgacgacccggcggccagcaaggcctga

SEQ ID NO: 599 - DNA, 426 bp, Chromobacterium substugae
atgaagacaaatgtcggcggcttcagcctgctggaactggtcggctgcatggcgatcgccgcattgctgctggcggtggcgctgccgggctaccagtcatacttgcagcgcgcccggctggaggaggcgcgctcggccttgctggaggacaaccacttcatgcagcgctggtatcacgagcacggcgtgtttcaccaggaggggccgctggcctggccggcattgccggtgatcgagaccgccgctttcgatatcggcttcagcagcgcgttgccgtcggccgacaatgtcgagcagaccagcttcatcatcgaggccagggcgaaaaccggttccggcctggaggagtggctgctgaagctggaccaggatggcaatatccgccagtgccgccaggacggcggcggcgagcagtgtcggccgtga

SEQ ID NO: 600 - DNA, 648 bp, Chromobacterium substugae
gtgagggccagccgccagcgcggcggcgctttgttgctggtgttgtccttgctggcggcgctgagcatgctggccttgtcctcgtcccagctgacgatcagcgcgcagcggctggcggacaatgtccaggatcggcggcgggcgcagctgttggcgcggcaggcgctgctgggcgccgaggactgggtgtggcggctggaccgccggctggacatggcggccctggccgcccggccggcggagctgtatggcgagggccggctgtttccgcccagctgccatggtccgcagggcaagggcctgtgcgagcccaaggaaccgccggaacgccgcgcgaacggcgcggtgccgctgctgcatccctgcggcaacagccgcgcctttccgctggagccggagccggcgcagtccaggtgtccgcagcaagtgcgcagcggcgggctcagctgggccaatccgcgctacgtggtggagctgatcgatcccggcttcctggcgcgggacggatcgcccgggcgtttgtaccggatcacggtgcgggcctggggccgcacgccttacagctcggtcaccctgcaaagctggtaccgggtgggcgacggcgaggcggcggggcggcgtttgaactgggaggagcgcagggaatga

SEQ ID NO: 601 - DNA, 1218 bp, Chromobacterium substugae
atgtgcgcgacgccgagctgcgcggccgcatcgacgacgcggtggccgacctggccagcgccatccagtcccggccggacagcttgtggccgcattatctggaaagcggctatgacgatcatccggctggcgagtgcgcggggccgtgcacttccgcgcagctggcggccgccgatctcggccatttcaagcaggcgctgcgcgcgggcagcagccgcgccgaacagggggcggtggtgtgccgcggcgacggcggcgtgccgcccaccctcgcccggccgggctgcggcgcgcagggggagttggcgatacgggtggcctggcgcagccgcgccggccggcaatggcaggagcatgccggtgtctggccgctgcagccctgaacgcgcgcggcagcgcggttccttgttgttgggccaattggtggcgctggccttgctgtcttacgtgctggcgcaggcggtgtcgtcttacggggtggccgaccgcgcggtgcgcttggccggacagggcctggagcggcggcaggaggcgcgctgggcgatgcggcagctggcgcaggatttgtccatgcacggccgtctgggatgcgcgcaagaagcctggcggcgcgaggatttcggccagactgcgtggacgctgtcgctgcccgggcgctggctgcggcaccggcaggcggtgctggacgacgcgggcggactgagccgcctgctgctggagccgcaggacagcgactggcgcgcttggcgcgagagccggctggtcagctgcggacaatcgctgcgcttggccggaggcgaggcaagctggagcggcggcgcggcgacgccgtcgctggagctgtctccggcgctggccgcgggcagcttgcacctgccctctttgcagctgtggctgccgcggcagcgccagtaccgcctgctgcgtccggggcgatcggggcagttgctgatgcgcgatgcgctgggcggcatcgccgacggcggcgagcgggtggcgttggatggggtgaagtcgctgtcgctgcgggtgctggcgcaaaccggctgcgggccggatgcgcgctgggcctggcgcggcatcgactcgttgacggctggcgaggccggccgcctggcggcggcgcgggtgacgatggagtggtatccggatagcggggaggacaaggtgatcaagctgagccatgacgcggcgctgacgccgttgcagccatgctaa

SEQ ID NO: 602 - DNA, 543 bp, Chromobacterium substugae
atgggcatagccaagcaggccgggatttcattgctggaatggatgaccgtgctggccatcgtcgccatcggcagcggcagcgcgctgcctttgctcgaccgctcgctggagcggcagcggctgcgcggccatggcctggccttgctgggcagcctgcaatacgcgcgcgcccaggccttgcggcgcaatcagccggtttatctgtgcgcggccaatctgaaacgcaaccgcgagctgcagggctgcctgccgcctcaggcggggccgcaggcggtttggccggagggcgcgctggtctacgccgaccgcggcgccggcaatggctattacgacagcggcgaacgcttgaagctggcgatgttcgacggcgcccgagtggccgtgcgcgcgccggcgcggcaattgacgctgacggcggagggacgcttgcgcgaggccggcgccatggtgttccgtctgtccggcggccgccagtgcctggcgctgacgctggctgaggatgggcgggccaggctgggagaggtgtccgatgattgcggctag

SEQ ID NO: 603 - DNA, 2784 bp, Chromobacterium substugae
ttgatcgacggctcttcttacttgtaccgcgcctttcacgcgatgcccgatttgcgttccccggatggccgcccggtgggggctgtctatggcatggtgaacatgctcaggcggctggagaaggaggttgaattcgattatagcgcctgcgtcttcgacgcgaagggcaagaccttccgcgacgacctgtaccccgaatacaaggccaatcgcccgtcgatgcccgaggagcttgcctcccagattacggcggtccacgacgtggtgcaagcctccggctggccgatgctggtggtgccgggggtggaggcggacgacgtgatcggcacgctggcgcgcctgggcgcggcggccggcatgaaggtgatcgtctccactggcgacaaggacatggcgcagctggtgacgccagatgtcaccctggtcaacaccatgaccaacgagctgctggacgaagccggggtgaaggagaagttcggcgtgccgccgaaccggatcatcgactacctgaccctgatcggcgacaaggtcgacaatgtgcccggcgtcgacaagtgcgggccgaagaccgcggtgaagtggctggaggaatacggcagcctggacgccatcgtcgcccaggccgatagcgtcggcggcaaggtgggcgagaacctgcgcgccgcgctggactggctgccgatgggcaagcggctgatcaccatcgattgcgaggtgaacctggcgacggacttgccgcacggcctgccgggcctgcagcacggccggaaggacaagccgcggctggccgagctgttccaggatctgggcttccgcaccttctaccgcgaggtgaccgagggggcggagatgccggctgtcgcccagcgcggcgaggacgcgcccgccgcgccgcgcggcgatcaggcccagggcgacatgttcgccgaaccggccgcagcgccggcggcccaagccgccccggccgaagccgcgctgacgcgccattacgaaacgatattgaccgaagcccagctggacgcctggctggaaaaactggcggcggccagggtggtgtcgttcgacaccgaaaccaccagcctcgatccgatgcaggcgcgcatcgtcggcgtcagtttctcggtggaggccggccatgccgcctacctgccgctggaccaccactacgccggcgcgccggagcagctggggctggatgccgcgctggccaagctcaagccgtggctggaggacgccagccagaaaaagtgcggacagaacctgaagtacgactgccacgtgctggccaaccacggcatcgccctgcgcggcatcgccgatgattcgatgctggcctcctacgtgctggaaagccaccagcgccacaatatggacgatctggcgcgccgccatctgggcgagaacaccgtcagctacgaggacatctgcggcaagggcgccaagcagatcggtttcggcgaggtggacgtcgacatcgccgccaattattcggcggaggacgccgacatcacgctcaggctcaaccagtatttcgccggcgagctgtccggcgatctggaaaaggtctaccgcgacatcgagctgccggtggccgaagtgctgttcaagatggaacgccacggcgtgctgatcgaccgcgacaagctggcggcgcagagccaccaactgggcagccagatgctggaactggagcagcaagcttacgagctggccggccagccattcaatctgaactcgcccaaacagctgcaggagatcctgttcggcaagctggcgatcccgaccaagggcgtcaagaagacgccgagcggcggctattccaccgacgagtcggtactggagcaactggcgctggaccatccgctgccgaagtgcattctggagtatcgcggcctggccaagctgaagtccacctacaccgacaagctgccgacgctgatttatccacagaccggccgcgtgcatacgacttatgcacaggcggtggcgatcaccggccgcctggccagcaacgatcccaatctgcagaacatcccggtgcgcaccgccgagggccgccgcgtgcgcgaagccttcatcgcgccggccggctggcagatcgtgtcggccgactattcgcagatcgagctgcgcatcatggcccatctgtccgacgacgagggcatgctgaaggccttcgccagcggcgaggacatccaccgcgccaccgcggccgaggtgttcggcgtcgatctcggcgcggtcacgtccgaccagcgccgcgcggccaaggcgatcaacttcggcctgatctacggcatgagcgcgtttggtttggccgcccagttggatatcgagcgcagcgccgcccagcagtacatcgaccgctacttcatgcgctatccgggcgtggccgagtacatgcagaccacccgcgagaaggcgcgcgagcagggctatgtcgaaacggtgttcggccgccgcctgtacctgcccgacatcaagctgtccaatcctggccgccgcgccggcgccgagcgcgcggcgatcaacgcgccgatgcagggcaccgccgccgatctgatcaagctggcgatgatcgcggtgcaggcttggctggagcgcgacggcttgcagagcaagctgatcatgcaggtgcatgacgaactggtgctggaggtgccgcaggccgagctggagttggtcaagcggcgtttgccggaaatcatggccggcgcggcggcgctgaaagtgccgctgctggccgaggtcggcgctggcgacagctgggaggcggcgcactga

SEQ ID NO: 604 - DNA, 729 bp, Chromobacterium substugae
atgagcttgtccgataagttgccgcagaccagtgaccgtcacgccatgatgcagcgcttccgttcccgcgaggcctggcacgtgatgaagatattgtcggagtttgtcgagtcggccgaggaactgcaaggcattaccccggcggtgagcatattcggcagcgcgcgcacgccgcgcgatcacaaatactacaaattgaccgaggacgtggcgcggcgtctgtccgattccggcttctcggtgatatccggcggcggccccggcatcatggaggccgccaacaagggggcattttacggcagaagtccgtcggtggcgctcaacatcgtgctgccacacgaacaaaaacccaacgattaccaggacctgtcggtcaagttcaaccacttcttcagccgcaaggtgatgttcgtcaagcacgcgatcgcctacgtagtgatgcccggcggcttcggcacgctggacgagatgttcgaggcgctgacgctgatccagaccggcaagagccgcaagattcccatcatcctgtgctgcagcgaattctggaccggcctcttggactgggtgaaagaccgcctggtcagcgaaggcatgatcaacccggacgacctcaacctgatccagctgatcgacgacccgcagcagatcgtcgacaccattttcaaacactacgagacccgcggcttcgacgccttgcccgaagagcgcgagcagctgctcaacctgtaa

SEQ ID NO: 605 - DNA, 330 bp, Chromobacterium substugae
atgcgccgcctcaccgccctgcttctactcctgccgctggcccccgccttcgccgccgacgcctccgcgccggccaaggcggtggtgcctccgccccccatcatcagccaggacaactccgcagaacccgagccggaagtgcggctgatccagaaaggcgacgagaagatcgaggaataccggctgaacggccagttgtacatggtgaaggtgacgccagggcacggcgtgccgtattacctgatcgacgacaacggctccggcaccatgaagcaggtcgaccccgccacccgcatcatgatcccgcgctgggtgctggttcgtttctga

SEQ ID NO: 606 - DNA, 942 bp, Chromobacterium substugae
atgtcggtttacaccacggtcagccgcgaaagcctgcagcaatggctgcagggctatgcgctgggccagctgctggagctgcaaggcatcgcggcgggcatcaccaataccaattatttcgtcaccaccacgcacggccgctatgtgctgacgctgttcgaaaccctgcaactggacgaactgccgttctacctgtcgctgatgagccatctggccaggcacggcgtggcctgccccgcccccatcgccgaccacaccgaccgcttcgcttcgacgctggccggcaaaccggcctgcctggtcacctgcctgcagggcgcggacgtcagcgcgcccacggccgcccattgccgcgcagtcggcgaaatgctggcgcagatgcacaaagcctccgccaccttcccgctgaaaatgcagaacccgcgcggaccgcgctggtggagccgcgtcgcgcagcagctatacccgcagctgccggccgaggaagcggacttgctgcgcgccgaaatccagtttcaggacgggcaccgcttcgaccatctgccgtccggcgtgatccacgccgacctgttccgcgacaacgtgctgatgaacggcgagcagatcgccggcttcatcgacttctactacgcctgcaacgacatcctgctgtacgacgtggcgatcgcggtcaacgactgggcgcgccgcgacgacggcagcctggacgacgcgctggcgaaagcgctgctggacggctaccagtcggagcggcagctgaatccggacgagcgcgccagctggccggtgatgctgcgcgccgccgcgctgcgcttctgggtttcgcggctgcaggatctttaccagccggccagcggagaactgacctataccaaggaccccgcggttttccggcaactgttgcgagaccacggccaacgcacggtcttctggctggattga

SEQ ID NO: 607 - DNA, 276 bp, Chromobacterium substugae
atgctgctaaaaaaaatcatcaccgttaccctggccgtcatgctcgctagcccggcgttcgccgccggcgaagaaaccgtcggcggcactgccggaaccgcaggcacggccggcaccgccaccgccggcaccgcaggcatcgccggcaccaccgccggcatcgcgggcctcagcgtcggcaccatcgccgccatcggcgcagccgtcgccgccgccgtcgcagtctccagcaacagcaactcctcgtcctcccactccgccgccacgcaccactaa

SEQ ID NO: 608 - DNA, 2850 bp, Chromobacterium substugae
atgcagaacaaatccagacgctatctggcttcgggggtgttacaagggggcttgccgctgcttttcgcctgcagcgccatcgcccaaccatcgctgaccgggcagatgggctatgtcaacatgccgtcggcccgcgtcggcgaagacggcaccttcagccttggctacggctatgacaagccgtacggcgtgctatggacttccaccacggtgctgccctggctggaagtgtcgggacgctacacgtccatctccggcattcccggtttcgacaatccgcaatatggcggcaattacggcaggtacaaagacaaggccatagacttgaaattcaagctgtgggacgaatccgcgctgatgccggaaatctcgctgggcacgaccgacatcgtcggcaaccggctatggaaaagcacctatctggtcgccagcaagaatctgctgcccggcctggaggcttcgctgggctatggcaaggaccgcatacaaggcgcattcggcggcctgcgctatacgccgcaagcgctgcccaactggtcgctggtcgccgagtacgacgccaacaactaccggcaggatccctacgaatccagcacgctggccgccgaccggaaaaaaggcccggtggtcggcatcgaataccaatggggctggctgggcctgcaagtcgcccggcagaaaaccctcaacagcgtcaatgcccacatcgacatcccgctgaacgtgaaggagttcgtgcccaagatccaggagcctgactacttccgcggcggccccgacctgccttcacgccccacgctggcgcaatggaaggacagcggcgactacgccagccagctggcgaccgcgctcgccaagcaggacttcaagaacatccgcatcgccatgcagcgcgacgcgctggtgctggagctgagcaacagccgcatctccaatgtcggccgcgctgtaggccgcgccgtgcgcaccgcgctctatttcgcgccgctggaaacgcgcgaaatcaaggtggtttacaccgagttcgagcagccggtcgccacatacagcttttacgacatgcccacgctcaacgactacttgctgggcaaggccaaccgcgcccgcttcctggaaaccgtcaacatccgtccgggccgcgacgaggaaacccagccgctggccagccagtcgctggcccaaggcctgaaggaaagcatccagctcaacctgctgaccaaccaggagggcgacctggttcaagtcaccagcaacgacgccgaagacaaccatttccacatggcgccgaaattcggcgtctatttcaacgaccccagcggcgccttccactacgacatcatggccgaggccacctacaagcgccggctcgccaagggcctgtatctggacagcgcgctgagcgccgacctctacaacaccatcaccgccgtgacgcaaccgtccaacagcctgctgccgcacgtgcgctccgatatcgccgactacaagcgcgtcaaggcgcccaagctgaaccgcttcatgctcaaccagtacatgacgctgtcgcccaatacctatgcccgggcttccgtcggcatctacgaggaaatgtaccgcggcgccggcggccagatcctctactaccccggcgtgaagaactgggcggtggacttgaccgtggacgcgctgcagcaacgcgacgtccagggctggttcggcaagcgcgactaccagaccatcaccgcgctcgccgccatgcactaccaactgccgctgggcgtcaccgccaccgtgcgcgccggccgcttcctggccaaggacgacggcgcgcggctggagttgaagcgccgcttccactcgggcatagaggccggcttctggtacaccaagaccaacggcaacgacatcaccagccccggcacgccgtccaagccatacaacgacaaggggatgttcttcaccattccgctcaacagcctgctgaccttcgacagccgcaccgccggcgacttctcgctgtcgccgtggacccgcgacgtcggccagatggtgatgacgcctggcgacttgtacgaaatcctcagcgacccgaagcgcgacatcaacgcctacgacggcctgggcaatttcgccgaacgccccgacgagcagaacctgcccgcggtcaatccgccgcagcccagctaccacccgtggccgatgatccggatgcggctggaagattccggcactcagtggctgcaaatggacgacaaggccgccgcgctgggcaccatcggcttcgccaccctgaccgcgatggcgctggaccggtcggtcaatcgcgctttccaacagcatgagcagaaccgcctggtgaaggactggggcaagctcggcaaggacctgccctacgccgcggcggccctgtccggcgcggcgttcgcattgggcgacgacaggctgagcaacactggcttgatcgcgctggaatccagcgccgcggcagtggcaggcagcgagctgctcaaaggcttggtcaaccgcgcgcggcccgacgccggcgccggtccctggagcacccagccgtcgggagaatcccggctgcaaagcagcttcacctcgaaccacgccgccgtgctgttcgccgccgtcaccccgttcgccaaagaatacgaccagccctggctgtacggcgtcgccgccttcggctcggtcggccggctggccagccgcgaccactggctgtccgacgtcaccgtcggcggcttcctcggctacctggtgggcaactggctgtggcaggcccagcgcgacgacagccgttaccgcagcaatgtgatcgtcagccccaagcaggtaggggtgcagcttcagatacccatccaataa

SEQ ID NO: 609 - DNA, 1911 bp, Chromobacterium substugae
ttggcgctatgcctgctggcgatcagcagctgcccgcaggccgccggcggcggcaacgtcagctaccccagcaccaccatgcccggctatgaaaccgacaacaacaacgggctccccgcgatcaacagcctgcccaccggccagcaggcattcgacaagccattcccgcaactacaacaacagaacggccggagcaaccaggcttatccgcagcgcaaccagccttatctcgacgacaacggctacgaactgaacccgttgaacggcaaacccaagctgccgccgttcgccgactatgtccagaaagccaccgagcagaccctgccgattttcggtagcaagctgttccgcaacccgtacaacaatttcgagtcggcggacggcgtgcaggtcaatcccgactacgtgatcggcaacggcgaccagctgcaaatcaagggctggggcatggtggacatcgatctgaccatgacggtggaccgcaacggcgcgatctacctgccgcgcgtcggcagcgtcgccgtcgccggggtgcgctaccgcgatctgcaaggcgtgctgaagaaaagcgtcagccgggtattcaacaatttcgacctcagcgtcagcctggtgcaaagccgctcggtgcaggtgtatgtggtgggccatgcccgccagcccggcagctataccctcaacgcgatgagcacgctgctgaacgccctgctgaaggccggcgggccggacgacagcggcagcctgcgccgcgtcgcgctgatgcgcggcggcaaggaggtcgccaaggtcgacctgtacgcgatcctggtggatggcgacaagtcagaggatcaaaccctgcgcgatggcgacgtgatccagattcccgccgccggcccgcgcgtggccctgctcggcgacgtcaagattccggccatctacgaattccgcgatggcgacaacgtcggcaacctgctgcactgggccggcggcctggagtccgccgccgaaggcaaggagttgtggatagaaaagagcgtgaacaaccgcttcctcaatctggcgcatgtgcagaacgacgatcggcagctgtccggcatcgcgctgaaggccggcgacatcttccgtctgcacgtgccaggcgcgcagccggtaagcgtgcagaagaacgacgaattcgtcagcgtcggcggcgaagtcggccacaccggcaccttccagatccagaaaggcgaaaccttgcgccagctgatcatgcgcctcggcggcgtcaacgatgacggctatgtgttcgccacccagttcaaacgcgaaagcatacgccagatgcaacagcaaaaactggacgaagtgtccgcccgcttcgagaaggagctggagcaaaacgccgccggccgcctcggcaagctgaccgacaaggacgcgatcgcctcggtgacggccgaggtggagcgccagcgccagatcgccgccaaaatgcgcgaaatcaaggccgaaggacgcgtggtgctggagatgaaagatgccaacgcccaggtcaaggacctgccggatctggagctgcaggatggcgaccaggtggaaatcccgcgccggcccggcacggtcaacgtgctgggcgcggtctaccagagcaacgccttcatctaccggccgcaacgctcggtcagcgactacctgacgctggccggcggcgtggtggacagcggcgacaagtcgtcgatctacgtgctacgcgccgacggcaccgtggccagcagcaacaatggcagctggttctccggagtcggcggcaaacgcatcaatccgggcgataccatcgtcgtgccggaagaactgaacgccggcagctggacccagtcgttgaaggagtggacctccatcctgtatcagttcggcctcggcgccgcaggcctgaaagtgctgaagtga

SEQ ID NO: 610 - DNA, 1185 bp, Chromobacterium substugae
atgcaaaccgcaaccgatgggcgcgccaaggacgaagtcgacctgccgaccctgctggcgcagctggcgcgccacaagcgctggatcgcctccagcaccttgctgttcggcgcggcggcgctggcctattgcctgctggcgaaaccggttttcaccgccaccaccagcatcatgcccccgcagcagcaaaacaacggcatgagcgcgctgctgggccagctgggcgggctggccggcgccgccggcggccttaccggcctgaaaagcccgaacgacctctatatcggcatgctgcaaagccgcagcgtggccgacaagctgatccaacgctaccagttgaaacagcgctaccagcaggacaccatggacgcgacgcgcaaggcgctgcaaagcctgagcagcttcgccaacggcaaggacggactgatcagcatcagcgtcgacgacggcgaccccaaattcgccgcggcgctggcgaatggctacgtcgaggagctgaaggcggtgaaccagtcgctggcggtgaccgacgccgccaaacgccgcctgttcttcgaacagcagctgaagcaaaccaaagacctgctgaccgaagccgaaagcgaactgcgcaaaacccaggaaaaaaccggcatggtattgccggaaggccaactgccggcgatcgtcggctcggtcacccagctgcgcaccaatatcgccgccaaagaagtgcagctggaagcgatgaagagcttcgccaccgcgcagaacccgctctacatccgcgccgagcaggagctggccggcctgcgcgagcagctcgccaaactggaaaccggcgacggcaacggccgggacatgctggtgccaaccggcaaggtagcgcaaagcgggctggaatacctgcgccggctgcgcgaagtcaaatatcaggaaaccattttcgaactgctgtccaagcaatacgagctggcgcggatagacgaggccaaggactcctcgctgatccaggtgttggacgccgccgtgccgccggagctgagaagcaagccgaaacgcagcctggtgctggcgcttggcctgttcgccggcttgctggtcggcaccctggccgctctgctgcgggcccggctggacgagcgcggcgcgcggcgcggcccatcccaggccgaacccgcgttcgcgctgaagaacaacggctga

SEQ ID NO: 611 - DNA, 1206 bp, Chromobacterium substugae
atgtcctcatccgcgcgcagccatttcggcctggttttcctgctggcagctctatccaccatcggtcccttctccatcgataccttcctgcccgcgatgcgggccatcggcgacagcctggcggcctcgccgctgcagatgcagcaggcgctgacggtttatctgttctgttacgcgttgatgatgctgtggcacgggtccatttccgacgcgatagggcgccggccggtagtgctggccaccacgctgctgttcggcctggcttcgcttggctgcgcgctgtctgacagcctgggcatgctgctgctgttccgtggcttgcagggcttgtgcggcggcgccggcctggtggtcggccgggcgattatccgcgacaagctggacggcgccgaggcgcagcggctgatgtcgcatgtgaccatgctgttttccttgtcgccggcgattgcgccggtggtgggcggctggttgttcggcgccttcggctggcactccatcttcgtgttcatggccttggtcggcttcgccttgttcgccttgtgctggttcggcctggaggaaagccaccatcgcgaggcgcggcagccgctgaaggtccgttatctgctggccaattactggcaggtgggcaaaaagcgcgatttccagctgctgacggcggcggtgtcgttcaacttcgccggtttcttcctgtatgtgccgtcggcgccggtattcctgatgcagcacctgcacctggggcccagccagtttctgtggatgttcggcccggtggtgtccggcatcatgttcggcgcctacctgtccggcagaatggcgggccatgcctctcagcgcgaaatcgtgtcgcgcggctattggctgatgttcgccgcggcgctggccaatctggcctacaacctggcggcggatcagctgacgctgccgtgggcggtgctgccgctggcgctgtacaccaccggcatgtcgctggcggcgccgtccatcacgctcaatctgatggaccagtttccttcgttgcgcggcacggtgtcttcgctgcaagggttctgccagaccatgatgtccagcctggtggcgggggcgctggcgccgctggcctggggcagcccgctgcggctggcctgcgcgatgtgcgtgctgttggcgctgggttttgtctgccggatgggctaccgcttgcggatgcgggcgataggacgctga

SEQ ID NO: 612 - DNA, 351 bp, Chromobacterium substugae
atgatccgtctttaccacaatcccaagtgttcgaaatcgcgcgcggcgctggccctgctggaagaagcgggcgccgaagtcgaagtcgtcgaatacctgaagcacccccccagcgccgaagagctggaccgactgctgcagctgttgggcatggagccgcgcgagctgatgcgccagaaagaggaagaatacgccgacctctaccttgacgacatcacgctggaacgcaaacacctgatcgccgcgatggtggacaacccgaatctgatcgagcgcccgatcgcggtgggcgacggccgcgccgtcgtcggccggccgccggagcaggtgctgctcctgctgtcccgctaa

SEQ ID NO: 613 - DNA, 501 bp, Chromobacterium substugae
atgagcccaaacaagtcctttgcccaactggaacaggcgatcaaccatgtcgaggcccgcttccccggcgtgccgcgccaggaagtgatcctcacccggctgattttccatatcgtgccgcggctgagcgcccacatgtgcgagagcctgaagcagcacggcctgaacgaaaccgtctggatggcgctgttggcgctgtacgcctgcccgaaccaggcgctcaatcccagcgacatcagcgagacgctggactcctcccgcaccaatgccacccgcatcgccgacgagctggtgaagaacggctgggccgcgcgctccgccagttccgaagaccgccgcaagatcgtgctggaactcaccgccgccggcgtggcgctggtggaaagcctgctgccctactcgcgcgaagtccacaaaaccctgtgggccgacttcgacagcgaggagaaagcgctgctggaacgactgatgcgcaagctgctgagcaaactcggcggctga

SEQ ID NO: 614 - DNA, 1425 bp, Chromobacterium substugae
atggagaccgacaaggtgaacaagaaatcttggccacagaccgccggggtgctgctgatcagcgccgtgctcggcggctgcgccagcttcggccccgatgtcacccccgatcaggcgctgagcgccgaacagctgaagctggccgcccccggcaaacagaacctgagcggcaactggtggcagcaactgaacgacccggcgctgaaccagctggtggacagcgcgctgaaagacgcgccgtcgctgaagctggccgccgcgcgcctgcgccaggcccgcgccgccgtcggcatcgtggaaagcaaggatggcccgcagctggacgccaccgccaatgtcgcgcaaatccacaccgaccagctcaagccgctgctgcatgaagactacgtcaccgcctacaccgcggcgctggtcggcagctgggaattcgatttctggggcaagaaccacgccgcggtcagcgccgcgctgggccagcagcaggccatcgctttcgaaggcgagcaaacccggctgatgctgacccaggcggtgatcgcccaatacacccagctgcagcgcagccaggcccaggccgatctgctggcccagcggctggccatcgcgcaaagccgcgagaagctgacccaggcccgcatcaacgccggcctcctgcccggcgacaatcagcgcggcaacgaagtgtcgatcgaaaaactgctgcagcagcaaagcgcgttcgccaacgacatcgagcgcagccgccacgcgctggccgcgctgaccggccaggggccgcaagcgcaagccgcgccgcagccgggcaaactcgatccggcgccggcgccgcagctggacagcctggacgccaacctgctgggccgccgtcccgacatcgccgcccagcgcgcgcgcgtcgaggcgatggacagctcggtcaaggaagcccgcgccgagttctaccccaatgtgaagctgacggtgttcgccggccagacctcgctggaaatggaccaactgttcaagagcggctcctcgctgtggggcttcatgccggcgatcaacctgccgctgttccactccggccagttgcaatccaacctgtccaaacagcaggccggctacgacatggcggtgcagcagtacaaccagaccgtgctggacgcgctgcgcgacgccgccgactcggtgtccggctggcagaacagccagcgccagctgaagcaggccgaacgcgcgctggccagcagcctcaaggccaacgacgcgatggcatcgcgcctgcgcgccggcctggtcaacaagctgtcgctgctggacgcgcaagacgcgctgctcggccagcaatccgcctacatcgacgccaaggccgccaaccgtctggcctgggcctccctgaacaccgcgctcggcggcggcttccaagcccagcccgccagccactaa

SEQ ID NO: 615 - DNA, 1155 bp, Chromobacterium substugae
atggatcagaaactagaaaccgcgcaaagccgcaaacgcaatctgctggtcgccaccaccctgttcgccgccatcgccatcggctacggcgcttactggagcctggtgctcagccaccaggaaaacaccgacgacgcctatgtcgccggccatctggtgcaggtcaccccggaagtcggcggcaccgtcgccaaggtgctggtggacgacacccaggcagtcaaggccggccaggtgctggtcagctacgacaacagcgacgccgagctggccttcgagcgcgcccgcaacgaattcgcccagaccgtgcgccagacccgccagctgatggccaatacccagcagctggacgcccaggtggcgctgcgccaggccgagctatcccgcgccgaagccgacctgaagcgccgcaagctgctggccggcagcgaagcgatgtcggctgaagagctgggccacgccggcgacgccgtcgccgccgcccaggccgcgctgaccgccgcccaggaacaggccaaggccggcctggcgctggtgggcaaggacgcgctggcgcagcagccggcggtgaaggccgccgccagccgcctgaaggaagcctggctcaatctgcagcgcaccgagatcaaggcgccgctggccggcaccatcgcgcgccgcaacgtgcaagtgggccagcgcatcgccgccggcacgccgctgatggcggtggtgccgctggaaaacctgtgggtggacgccaacttcaaggaaggccagctggccaagatccgcgtcggccagccggtggagatcaagtcagatctctacggcggcaaggtggtctaccacggcaaggtgcaaggcctgtccgccggcagcggcagcgccttctcgctactgccgccgcaaaacgccaccggcaactggatcaaggtggtgcagcgcgtgccggtgcgcatcgcgctggacccgcaggaactgaaagaccacccgctgcgcgtcggcctgtcgatagacgcggtagtggacaccagcaaccaggacggcaaatcactggccgaagccgcgccggccgccgccgccagcgaaaacaacaacacgttgcccgacctgaagcaggcggacaagctggtggccgagatcctggccgccaacgccgctgccggcaagtaa

SEQ ID NO: 616 - DNA, 1533 bp, Chromobacterium substugae
atgaaccatccgccactgaccggctcgaaactggtctggatcacgctggcgctgtcgatgtcggtgttcatgcaggtgctggacaccaccatcgccaacgtggcgctgcccaccatttcgggcaacctgggcgccgccaccagccagggcacctgggtgatcacctcgttcggcgtggccaacgccatctcggtgccgttgaccggctggctggccaagcgcttcggcgaggtgaagctgttcaccgcctccaccttgctgttcgtgctgacctcctggctgtgcggcatgtccagcagcctggaaatgctgatcctgttccgcgtgctgcaaggcgcggtggccggcccgatgattccgctgtcgcagagcctgctgctgtcgtgctatccaccggcgaagaaaggcatggcactggcgctatgggcgatgacggtgatcgtcgcgccggtgttcggcccgattctgggcggcgtcatcagcgacaactggcactggggctggatcttcttcatcaacgtgccggtgggcctcgccgccgccttcatttcctggcgcatcctgaagccgcgcgaaaccgacaccgtcgacctgccgatcgacaagatcggcctggccttgctggtgatcggcgtcggctcgctgcagatggtgctggaccgcggcaaggagctggactggttcaactccgccgaggtcgtcaccctggcggtggtcgccgcgctggcgctggtctacctggtgatctgggagctgggcgaggaacaccccatcgtcgacctgtcgctgttcagccagcgcaacttcaccgtcggcaccgtcgccatcagcctgggcttcatgctgtacttcggcgccgtggtgctgctgcccttgatgctgcagacccagctgggctacaccgccacctgggccggcctcgccgccgcgccgatcggcctgatcccggtggtgctgtcgcccatcatcggtaagaacgcgcaccgctgggacatgcgctgggtggtgacggtcagcttcagcgtctacgcgatctgcttcttctggcgcagcaacttcaacaccgacatggacttctcctacgtggtgtggccgcaggtggtgcaaggcataggcgtggcctgcttcttcatgccgctgaccaccatcacgctgtccggcctgcatccgtcgcggatcgccagcgcgtccagcctgtcgaatttcctgcgcatcctggcgggcagcatcggcacctcgatcaccaccacgatgtgggaccgccgcgaggcgctgcaccactccaagctgaccgaacacgtgacgcaatacgatccggagtcggtgtcttggttcggcgccatgagcaagctgggcctgaaccccggccaacagcaggcgctgacccagctgcaggtcaccaagcagggctacatcatggccgccaacgagatcttctgggtctccggcatcctgttcgtgctgctgatcgcgctggtgtggctcgccaagccgccgttcaccgccgccggcggcgacagcggcgcgcactga

SEQ ID NO: 617 - DNA, 870 bp, Chromobacterium substugae
atgagcctgcatatcagcctgcgcgagctggaggtattcgtggcggtggcggagctggacacggtgacgcgcgccgccgaccgggtggcgctgacgcaatcggccgccagccaggcgctgtgcaagctggaacaggggctcggcgcgcagctgttcgaccgggtggggcgccggctgctgctcaacgagcatggccggctgctgctgccgcgcgcgcgcgccttgctggacgcggccgccgatgtgcagggcctgttcgacggcgacgcgctggcgctgcgcgtcggcgccagcaccaccatcgccaattacctgctgccgccgctgctggcggccttccgccgcgactggccgcgggcgcggctggagctggaggtggccaatacccgcgacatcgtcgaggcggtggcggctttccgcgtggacttcggcctgatagaaggcccgtgccaccatccggaactgctggccagcccgtggcggcaggacgagctgatcgtgttcgccgccgccggccatccgctggccgggcgcaaggtggcggcggcggaattggcgcaggcggaatggatactgcgcgaggccggctccggcacccgcgaggaggtcgagcgggtgctgctgccgcatttgagccggctggcgatcagcatggagctgggccactccgaggcgatcaagcacgcggtggcggcggggctgggcgtcagctgcctgtcgcgccatgtgatcgccgatctgctggccgccggcgcggtggcggcggtggacgccgacctgccgccgctgacgcgcacgctgtaccgggtgcagcaccgcgacaagtcggccagccgcggcatggcggccttcggcggccatctgcaatga

SEQ ID NO: 618 - DNA, 1026 bp, Chromobacterium substugae
atgaccaaacattcaaacatcctgcccggcctgctgctggcgctgggcctggccgccgccgccatctgggccgccgagctgccggcgatgaaaagcctgggcctgtccgccctcaccctcgccatcgtcggcggcatggtgatcggcaacaccgtttaccgcttcatcgccggccccagccaccacggcatcgccttttccaagcaaaagctgctgcgcgccggcatcatcctgttcggcttcaagctgacctttcaggacatcgccgccgtcggcttctccggcgtgctgatcgacgcgctggtgctgacttccaccttcctgctggcgttttgggtcggccgcaacaagctgggcctggacgagcagagcgtgatcctgatcggcgccggcagctcgatctgcggcgcggcggcggtgctggccaccgagccggtgctgaaggcgcacgccgagaaagtggcggtagcggtggccaccgtggtggtgttcggcaccgcggcgatgttcctgtggccgctgatgtacgaggcggtgcgctatctgggcatttccgaattcagctacggcctgttcgccggctccaccatccatgaagtcgcccaggcggtcgccgccggcaagtcggtcagcgacgcggcgatgaacaccgccgtcatcaccaagatgatacgggtgatgatgctggcgccgttcctgatcggcctgtccgcctggctggcgaagcggcaccgcggcaacagccacgagaagaccggcatcaccatcccctggttcgccgtcgccttcctcgccgtggccggactcaactccttcaacctgctgccgcacgcgctgctgcgacagatcatcgcgctggacaacctgctcttggccgccgcgatgggcgcgctgggcatcaccacccacctgtcggccatccgccaggccggcagcaagccgctgctgctcgccagcatgctgttcggctggctgatcgtcggcggcgggctgatcaatgccggcgtggccatgctgatccgctga

SEQ ID NO: 619 - DNA, 3594 bp, Chromobacterium substugae
atgcgacactggatcatcgccctgctggccctgctgctgggcacggccgccgacggcatcgagctggggctgagcctggcagccatcgccggcatcgtcagcctggccttcggcaaatccgccggcgccggcggcaatagcgaaatcattcccggccaaccgccttcccgcgccctgaccttatggcagatgcagcagcggctggaggcgctggagatagaagtggagttgctgcgcgagcaagcgcgcgcccgctcagacgccgccccggccgctcccgactacagctggcggcccgtggagccggacgaagcgccgccgcctgccccgcaggaacctccgccgctccccgcgccagaacctcctccccaggagccgccgctcgagatcgagtgggaagaggtcgggccgcctcatgcccagaccccgccggcgcctcaacccgtccgcgccgcgccggacatcgcgcccgcaagaccctccgctcccaccctgctggagcgcggctggcagtacgcgcgcgcctggctgctgggcggcaatagcgtggtgcgggtcggcatgctgctgctgttcttcggcttcgccttcctgctcaaatacgcggccgacaacagcctgctgccgatagaactgcgcctggccggcgtggcgctgggcggttgcgcgctgctggccgccggctggcggctacggctgaagcgccgcggctacgcgctgatcctgcaaggcggcggagtcggcacgctgtacatcaccgccttcgtcacgctgaagttcttccagctgttgccgccgggcctgacgttggccttcctggtgctgctcggcgccgccagcgcctggctggcgatacgccaggacgcgccgtcgttggccgggatgggcatcaccggcggcttcctcgccccgatcctcacctcgaccggcggcggcagccacgtgctgctgttcagctactacgcgctgctcaacgccggcatcttcggcatcgcctggcgcaggtcctggcgcagcctgaacctgctgggattctccttcaccttcgtcatcgccaccgcctggggcgtgttgcagtaccagccggagcagctggccagcacgctgcccttcctggcactgttcttcggcttctacctcggcatcgccgtgctgtacgggctgcgccagggcctggccctgcgccattacgtcgacggcacactggtattcggcacgccgctggtcaccgccgggctggcggccggcctgctgcgccataccgatttcggcatggcctggttcgcgctggcgttggccgcggtctatctgctgctgaccttctggctgcgccgccgcgccgccttgccgctgctggcggaatgcttcctggcgttgggcgtgatcttcgccacgctggcggtgccgctggccttcgatggccgcgtcaccaccgcgctgtgggcggtggaaggcgccggcctgctgtgggtcagcctgcgccagaatcgccgcctcggcctctggttcgccctaggcctgcagctgtgcgccggcgccgcctgcctgagccatctgcccgcccaggccgctggctggccggtgctgaacgcttcgttgatcgcctgcctgctgctggcagcctccgggctgttcagcggctggcagttgcaacgccgcggcggaaacgccgccgtgccgccgtcctggctggccgtctgggccggcctgtggtggctgggcggcggcatccgcgaattgaagctgtacctgccggccggttacctggccgatggcgtcatgctgctgctctgcgccagcgcgctggcttgcggcctactgcggcgccggctggactggaagctgctcgcctatccggcgctggcgctgccggcgctgacgctgggctggagcctgctcggcgccttgccttacctgcagcggctgtcggaactgggttggctggcggcgcccgccgcgctggccgcttcgctatggctgctgcgccgccacgaagaggaaaccgccgacgccggctggctgcacgcctgctggcaatgggcgctggtcgcgctgctggcgcgcgaagccggcggctggctgtggcaatggctgccggacggcgtctggcgccacgtggccttcccgttcgcggccagcgcgctgctgttgctgggcggaccgctgagccggctggaatggccggtgcgccgccaccgcgccgcctacctaggctacggcccagcgccgctcttcccggcgctggcgggctggatgctatggtcgctgctgtccgatggcaatccagccccgctgccgtggctgccgctgctcaatccgctggacctcgccgtcggcttcagcctgctggcgctgtgcgcctggctgctgcgcctgaaccggcactggccgacgcagccgcgcgccgcggccgcctggctgctgtgcccggccatcctgctggcggtcagcgccgatgtgctgcgcgccttccatcactgggccggcctgccctattcgctggacatgctgtggagcgcttccgacagccgcatcgttctggcgctgggctggtgcgcgctggcgctgctggcgccgcggctggcggccggccgcgagagcggccgcgtcgtcgcctggtggagcgcggccgccggcgccgtcctgctgctgtggatgctgctggccaatttggaaaccggctcgccgctgctgctgccgtggctgcccttgctcaacccgctggagctggcgcaactggcggtgctggcctgcgtctggctcaactggcgccgcgccggcttcccccgcccccgctccttgccttggctggactacgcgatcgcggcctggctgctcgccttcggctgcgccatcgtgatgcgcgccttccatcactggcagggcgtcgactaccggctggacgccgccttgcgctcgccgctgccgctgactgtgctgatgctgtgctgggcgctgctggccctggccgcgccgcggctggcggccggccgcgagggagcggccgcggtgaccgccagcctgctgcgcctgctcagcccggtgctgctgctgtggagcgtgctggccaacctgcagggcgagcggctgctgcccttgccgcacctgccgctgctgaacttgatggatctgtcccaactggccgtattcgccgcctgctggctgaactggaaacgcggcctgctgcgctgcgcgccgctggagccctggctgcgctggctggccggcggctggctgttcctgttcggcaacgccgtggcgctgcgcagcctgcaccattggctggacatcccttaccgcttcggcgcgctgctgcactccaccctcgcccaggcgacgctgtcgctgggctggacgctggcggcgctgggcctgatggtggccgccacccgccgcggccagcgcctgccctggctgtgcggcggcgccttgctgatgctggtggtggccaagctgttcgcggtggacctggcttcggtgggcagcatcgcccgcatcgtcagcttcatcggcgtcggcctgctgttcctgctgatcggctatctgtcgccgctgccgccgcgcgcccaccagccggaacaggataggccgtga

SEQ ID NO: 620 - DNA, 189 bp, Chromobacterium substugae
atggctgaggtatggcgggcgatggtgcagaccgcccggttgatggtggggcagcgcgactacgatctgtacgtcggccgccgccgccgtttcgacccggacgcccaggtgatgagccgcgaagagttcttccgctactgccaggagcagcgctacggcggcaagagcatgaagaaatgcccgtgctga

SEQ ID NO: 621 - DNA, 2067 bp, Chromobacterium substugae
atgcaacaactcaagcagtgcgtcgtctggctgctggtggcgctggcgggggccacggccttcgcgatggtggcgctgaaccggggcgagacgatcaacgcggtctggctggtggtggcggccttgtcggtttatgccatcgcctatcgcttctacagccgcttcatcgccgacaaggtgctggagctggacgcgcgccggctgacgccggccgagaagttcaacgacgggctcgactacgtgcccaccaacaaatgggtggtgttcggccaccacttcgccgccatcgccggcgccggcccgctggtgggcccggtgctggccgcgcagatgggctatctgcccggcaccttgtggattctggtcggggtgatgctggccggcgcggtgcaggacttcatgatcctgttcctgtcgatgcgccgcgacggcaagtcgctgggcgagatgatacgccaggagctgggcgacattcccggcgtcatcgcctccatcggcgtgctgatgatcatggtgatcctgctggcggtattggcgctggtggtggtcaaggcgctggccgacagcccgtggggcaccttcaccatcgcctgcaccattccgatcgcgctgttcatgggcgtgtacacccgcttcatccggccgggcaagatcggcgaggtgtcggtgcttggcttcatcctgctgatgctggccatcgtctacggcggcgacgtcgccaagagcgccacgctggcgccgctgttcacgctgaagggcaccacgctcgcctggacgctgatcggctacggcttcatcgcttcggtgctgccggtatggctgctgctggcgccgcgcgattacctgtccaccttcctcaagatcggcaccatcgtcggcctggccatcggcatcctgatcgtggcgccgcagctgcacatgccgtcggtcaccaagttcatcgacggcagcggcccggtgttcgccggcaatctgttccccttcttgttcatcaccatcgcctgcggctcggtgtcgggcttccacgcgctggtggcctccggcaccacgcccaagctggtggagagcgaaacccaggcgcggatgataggctacggcgcgatgctggtggaaagcttcgtcgctatcatggcgctgatcgccgcctgcgtgctggacccgggcgtctacttcgcgatgaacagcccggcggcgctgatcggcaagaccgcggccgacgccgcccaggcgatttccggctggggcttcatcgtcacgccggacatgctgacccagctggccgccgacgtcggcgagcacaccatcctgtcgcgggccggcggcgcgccgacgctggcggtgggcatggcccacatcctgtccggggcgataggcggcaaggcgatgatggcgttctggtaccacttcgccatcctgttcgaggcgctgttcatcctcaccaccgtcgacgccggcacccgggtgctgcgcttcatgatccaggacctgttgggcttcttcatcaagccgatggccaacaccgagtcctggggcgccaacctggtggccaccggcctggcggtgggcgcctggggctacttcctgtaccagggcgtggtcgacccgctgggcggcatcaacacgctgtggccgctgttcggcatcgccaaccagatgctggcgggcatcgcgctgatgctggccacggtggtgctggtgaaaatgcagaagacccgctacgtgtgggtgacggccattcccaccgcctggctgctgctggccactctggtggcgggctggcagaagctgttccatgaaagccccaagatcagcttcctgacccatgccgacaaattctccgccgccgcggccaagggccagctgctggcgccggcgaaaagcatggcgcagatgcagcagatcatcttcaatgattatgtggacgccgcgttgaccgcgatgttcatggcggtggtgttgtcgatgctggtgttcggcatccatgtgatccgcaagtcgctggcggtgaagtgggcgacggccaaggaagtgccggcggtttaccggcaaggaggcgtagatggctga

SEQ ID NO: 622 - DNA, 714 bp, Chromobacterium substugae
atggcacaacacattctcatcgtggaagacgatgccaggctggccgagctgatcgccgcctatctgaccaagcacggctaccaggtcagcctgcacggccgcggcgacaccgcgccggcggccatcctggacacgcgtcccgatctggtggtgctggacgtgatgctgccgggcaaggaaggcttcgacgtctgccgcgacgtgcgcccgcactacggcggccgcatcctgatgatgaccgcgcgcgacgaggatgtggacgaaatcctgggcctggagctgggcgccgacgactacctggccaagccggtggagccgcgccggctgctggcgcgcatccgcgcgctgctcaggcgcagcggcgccgcccgccaggacggcggcggcgtggcggtggagaacgattgcatcgccttcggccagttcaacatcagccaggccacccgcgaggcgctattgggcgatgagcagatcgagctgaccaccgccgaattcgacctcttgtggctgctggccacccacgccggccaggtgctgtcgcgcgacgacatcatgagcgaattgcgcggcatcggcttcgacggcctcgaccgctcgatcgacgcccgcatctcgcggctgcgccgcaagctgggcgacaaccccgacgcgccggcgcggatcaagaccgtgcgcggcaaaggctatctgttctcgcgcagcgattgggaatag

SEQ ID NO: 623 - DNA, 1353 bp, Chromobacterium substugae
atgccgtcgaagaacctgcgcagctggctcaagccatcgctggggaccttgttcgcccgctacttcctggccaccatgctggtgcagctgttgatcatcatcggcttcggcttcctggtgaccaagctgtacgagaagagcgaccaggtcagcaagctcgaattcatgaacggcaccatcgcgctgctgcgcgaccgcctgcaggcgcagccgccgcaggattgggacacccagctggcggcgatggccagccgcttcagctacccgctgaagctggtcgaccagctgccggccgaactggagcgcgacgcccgcccgcagctgcggcaaggcaagccttacctcgacggcgacaaccagctgctgtacgccaccctgcccggcagcccgcgcctgctggcgctggggccgctggacgtgcagtccagcgacagcaactggatcagcgaagacatcgaagtgctgctgatctggatgctgctgtccggcgccacgctgggcaccctgctctatttcagcctgcagcccttgtggaaagacctgctggaagtgcgccgcaccgccgaagtgttcgccgagggcgacttcagcgcccgcgcccgcaccgccaagagccggctgttcgcgccgctgccgctggccttcaacagcatggcctcgcggctggagcgccagctggagacgcgccaggcgctgtcgcacgccatcgcccacgaaatccgcaccccgatcgcccggctgcgcttcggtctgaccatgctggaggaagaagaggatgcggccgaatggcagcgctaccgcgacggcatggagcgcgatctgcaggaactggaagagctgatcagcaccagcatggagttcgccaaactcaagcgcagtgaagtgccgctgcacctggagacgatagacctgttcgactggttcgacgacctgatcgacctggtcaccccgctgaagccgcccggcctggaattgacgctggactgcgcgcgcgaagaaggcgccttcgaccgcaagctgatgtacatcgccacccgcaacctgctgctgaacgccttcaagtacgcgcagcaacaggtcaggatgcgggtctaccaccaggggtcgcaattgatcatcgaagtggacgacgacggctgcggcattccggaggccgaccgcgagaaggttttcgaacccttcctgcgcttggaccgcagccgcgaccgcgccaccggcggccacggcctgggcctgtccttcgtgcggctgatcgccgaacaccatctgggccacgccagcgccggcgccagcgagctgggcggcgcccgtttccgcatgatcattgcgcaaccggacgcgcgccagccataa

SEQ ID NO: 624 - DNA, 819 bp, Chromobacterium substugae
atggtttcctcaagaccggcggcattgctggtgcacggcctgggtggcaccgcctacgatctgggcgcgctcggccgcacactggaagacgccgacattgtcacccactctccggtactgcccggacacggtggcagcccggaagatcttctcggcgtcggctgggaagagtgggtggaaagcattcgcagcgaataccgcgcgttgaaggccaagcacaaggtggtgcacctggccggcgtttgtctgggcggcctggtggcgctggaagtggcgcgccgggaaaagcatcaggacaagctggcgctgtacgcgccgccgatgttcctcgatggctggagcctgcccaagctgacctggctgcgccacgcggtgtactgcctgccgcagctggccaagaagatgcgcgtgccggaagtctccccgttcggcatcaagaacgcccgcatccgcaaagccatccagcagcgcttcgagcgcggcgaccgcttccactacgcctacattccgctgatgtgcatccgcgaagtggaccgcctgcgccgccagctgatgccgcgtctggccgaaatcacctgtccgacgctgatcgtccacgccgacgaggacgacatcaccagcccgcgctccgcccactacctgctgcaatacctgggcggcccggtggacttcatgccgctgtccaacagctaccacatggtgatggtggacaacgagcgcgccgaggtgctgcagcgcagcctgaagttcttcaacagccacgcccgccagcaaagcgccgagcaaccctgcggctggacggccttcgccgccgcctga

SEQ ID NO: 625 - DNA, 585 bp, Chromobacterium substugae
atggccctgagcgccctgagcgcccacgccgccgatcttggcgcctacgcattcggcactgccggcgcatcgtattccaccatcgagcgcggcgacaacctgccgagcagcgccagcgtcaactctggcaagcaaaccgacgccgcctgggaaatgggcgccggctatcgctttgaccgcagcctggccgtcgaagtcagctatgccgatttcggcaagagcgacgccaacttcaacttctgcgggttcctgtcctgcgtcaacggcaatctcagcgccgccaccaccgcggtgcgcgcgtcgctgctgaccttcctgccgatcaacgacaaggtggagctgttcggccgcctcagcctgaaccgcgtgcagaccaaggtcagcctcggcagcgacagccaggacttcaaccgcacccgcgccggcttcggtttcggcgcccactacgcgctgagcaagcaactggcgctgcgcggtgagttcgaatatctggcgggcgccatggacctgcaatacaacggctactcgctggtcaagacctccggccaaagcgcgctgaaagccggcctgagctaccagttctaa

SEQ ID NO: 626 - DNA, 909 bp, Chromobacterium substugae
atgagccacccgcatagcgacgccgtcaaatccttcctgctggatctgcaagaccgcatctgcgcggcgctggagcaggccgacggcgccggccagttcgccgaggacgcctggcggcgcgaagccggcggcggcggacgcagccgggtgctgaaagatggcgaggtattcgagcaagccggcgtcaacttctcccacgtccacggcgacgcgttaccggcttccgccaccgcgcaccggccggaactggccggccgccgcttcgaggcgatgggcgtgtcgctggtgatccacccgtccaatccgcacgtgcccaccagccacgccaatgtgcgcttcttcatcgccgaaaaagacggcgaggcgccggtgtggtggttcggcggcggcttcgacctgacgccgttctacccgcgagaagaagacgccgtgcactggcatacggtggcgcgcgacctgtgcgcgccgttcggcgccgaggtctacccgcgctacaagaaatggtgcgacgaatacttctacctgaagcacaggaacgaggcgcgcggcatcggcggcctgttcttcgacgacctcaacgactggggcttcgagcggagcttcgacttcatgcgagcggtcggcgacggcttcctgggcgcctacctgcccatcgtcgcgcggcgcaaggaccaggcctggggcgaccgcgagcgccaattccagttataccgccgcggccgctacgtcgaattcaacctggtgtgggaccgcggcacgctattcggcctgcagtcgggcggccgcaccgaatccatcctgatgtcgatgccgccgctggcgcgttgggaatacggctaccagccggaacccggcagccccgaagcgaagctctatgccgacttcctcccgccgcgcgactggctgtga

SEQ ID NO: 627 - DNA, 1659 bp, Chromobacterium substugae
atgcataccacctccggctccgccaccgccccgcaccgggccctggaacccgccctatggctgctgttcgcgctgatctggttcggcagcctgggttatcgcggcctgatccacgccgatgaaggccgctacgcgacgatctcgctgttcatgctgcacagcggcgactgggtcaccccgcgcctgaacgggctgttgtatttcgaaaaacccatcctgcaatactggatgggcgcgctcagcttcgccattttcggcgtcaacgagttcgccgcccgcttctggcccggcctgaccggcttcctgagcgtggccgcggtgtcgctgaccgcgcgccgtttgtggggcgcggccgccggccgccacgccgcgttggccgccggcggcatggcctggatcgtcgccaacagccacttcctgtcgctggacatgggcgtcagcttcttcctcaccgccgcgctgtgcggtttcctgctggcgcaacaagataacgccagccgcgcgcaaacccgctgggcgatgtggatcacctgggcggcgatggccggcgccacgctgagcaaaggcctgatcggcctgttgatccccggcgccacgctggtgctgtacagcctgatcaactggcaatgggcgttctggaaacggatgcactggctcagcggcctgtcgctgttcttcgctctcaccgcgccgtggttcgtgctggtttcggaacgcaacgccgatttcgcccatttcttcttcatccgcgagcacttcgagcgcttcctcaccaccgagcacaagcgcaccggcgcgccctggtatttcgtgccctacctgattctgggcctgttgccgtggaccaccttgctaccgcgcctcgtcaaggatgcctgggccgatcgcgccgccggcctgcgcatcggccgcctgctgttgatctggtgcgtgttcatcttcgccttcttcagcaagtccagctccaagctgccgtcctacatcctgccgatgttcccggcgctggcgctgatgctggcctatagcttcggccggatgcggccggcagagctgaaaaagcatatcctcctgcccgcgctgctgtggctggcgctgctggccgcctggccgttcgccggccgcttcgccaaccaggattcgccgctggacgtgatccagcccttcgcgcacttcatcgccgccggcgcggcggtgtttttgctcggctcgatttacgcctggcgcgcgctggggcaacagcggatgctggccgccatcgccgcgttgtccttcggcagcctgatcgccgtcaccttggccgccagcggccacgacagctacggccggctcaagggcagcaaggaaatcgtcaagcaaatccagccctacctgacggcggacagcgaagtctactcggtgcgctactacgatcaaaccttcccctattacgtgggcaggccggtcaaactggtggatttcgtcgatgagttcgagttcggcgagggacaggagccgcagcgctggatgccgcggctggagcagttcaccgccgcctggcgcgccgcgcccaaggcagtggcgatgctgaccgacggcaccttccaggaattgcaaaagcaaggcctgccgatgaaagtgatttatcaggacccgcggcggatggtggtggcgaagccttag

SEQ ID NO: 628 - DNA, 372 bp, Chromobacterium substugae
atgaaactgattgaattcggattgatactgttcggcgtgctgctcaacgccgccgcgcagctgtgtttgaaagccggcgtgcgccagatcggccacttcgacttttccgccgccaacgcgctgccgataggctggtcgctggccaccaacctgcccatcatcggcggcctgtcctgctacgcggtcagcgtggtggtatggatcatggcgctgtcgcgggtggaagtcagcgtggcctacccgatgctgtccatcggctacgtggtcaacgcgctgctcgcctactggatgttcggcgaagcgctggccgcgcaaaaactcatcggcatcgccgtgatcatcgtcggcgtggtgctggtcgcccgcagctga

SEQ ID NO: 629 - DNA, 1125 bp, Chromobacterium substugae
atggaatttctgcccttcacccgtcccgcgatagacgaggacaccatcgccgccgtcggcgaggtgctgcgctccggctggatcaccaccggcccgcgctgccagcaactggaagccgagctgtcggccttttgcggcggccgcccggtgcggctggtctcctccgccaccgccgcgctggagatggcgctgcaaatcgccggcgtcggccccggcgacgaagtgatcacctgcccgctgagctgggtggccaccgccaacgtgattttgaaagtcggcgccacgccggtattcgtcgacgccgacccgaccagccgcaacatcgacctggccaaggttgaagccgcgatcaccccgcgcacccgcgccatcatcccggtggacctggccggcctgccggtggaccgcgagcgcctgtacgacatcgcccgccgccatggcttgcgcgtggtggaagacgccgcccaatccatgggcgccagctggcagggcaagcgcatcggcatggaaggcgacctggtgtcgttcagcttccacgccaacaagaacatgaccagcggcgaaggcggctgcctggtgctgaacaacgccgacgaggcgcggctgttcgaaaagctgcggctgcagggcgtcacccggctgccggacggcaccatggacgtggacgtgctgggcggcaaggccaacctcaccgacatcgccgccgccatcggcctcggccaattgaaaaaactggacggcttcaacgcccgccgccgcgagctggccaagctgtattttgcgcatttcgaccgtgaactgggctgcgagctgccgccggccgacttcgagcagagcaactggcacatgttccagccgctgctgccgctggcccgcatgagcatcagccgcggcgagttcatcgcccggatgaaggccgaacagatcggcgtcggcgtgcattacccagccatgcacttgttcaccctgttccgcgccaaaggctacgccgagggcgactacccggcagccgaagacatcggcgcgcgcaccgtcactctgccgctgttcccggcgatgcgcgacgacgacgtggcgcgcgtctgcgccgccttcagccgcgtgctgcgtcctgttttaagctga

SEQ ID NO: 630 - DNA, 948 bp, Chromobacterium substugae
atgaatacaagcatccatctttccgtcgtcatcccggtctacaacgagcaggacgtgctgcaggcgctgttcgaccgcctgtacccggcgctggacgcgctgaacgtgcgctacgagatcgtgttcatcaacgacggcagccgcgacaagagcgtggccatgctgtccgagcaattcaacctgcgccccgatgtcacccgggtggtgctgttcaacggcaacttcggccagcaccgggccatcctggccggcttcgagcacagccgcggcgaacgggtggtgacgctggacgccgacctgcaaaacccgccggaagacatcgccgtgctgctggccgaaatggacaagggccacgactacgtcggctccatccgccgccaacgcaacgacagcctgtggcgccacctggccagccgggcgatgaaccgcctgcgcgagaagctcacccgcatcaagatgaccgaccagggctgcatgatgcgcgcctacagccgccgcatcatcgacaccatcaaccagtgcaacgagctgcacaccttcatcccggcgctggcctaccagttcgcgcagaaccccaccgaggtgacggtcggccacgaggagcgcttcgccggcgaatccaaatactcgctgtacagcctgatccgcctgaacttcgacctgatgaccggcttctcgctggtgccgctgcagtggttctcgctgatgggcatggccatttccgccggctccggcctgctggtggcctacatgctgctgcgccgcctgttcctgggtccggaagaaggcggcctgttcacgctgttcgccatcgccttcttcctgatcggcatcgcgctgttcggcatcggcctgctgggcgaatacatcggccgcatctaccaggaagtccgcgcccgcccgcgctacgtgatccaggcggtgctggagcaaggggacaagcgatga

SEQ ID NO: 631 - DNA, 924 bp, Chromobacterium substugae
atgagccgcgccgtcgtcttcgcctaccacaatgtcggcgtgcgctgcctgaaagcgctgatcggccgcggcgtggaagtagcgctggtggtgacccaccaggacaaccccaacgaaaacatctggttccagagcgtggcgcaaaccgcgcgcgagcatggcatcccggtgatcacgccggacgatccgaacacgccggaagtggcggcgcaggttgaagcctgccgggccgacttcctgttctccttctactaccgccacatgctgaaggcgccgctgctggaggccgtcaagcgcggcgcgtacaatatgcacggctcgctgctgcccaagtaccgcggccgggtgccgatcaactgggccgtcatccacggcgaaaccgaaaccggcgccacgctgcatcaaatgaacgtgaagccggacaatggccccatcgtcgaccagatggcggtgcccatcctgcccgacgacagcgccgacgaagtgttctccaaggtgacggtggcggcggagatggtgctgtggcgcagcctgcccggtttgatggacggcagcgcgccgcatgttcagcaagacctgagcctgggcggctacttcggcggccgcaagccggaagacggccgcatcgacgcgcaggcgccggcccggcggctgcatgatttcgtgcgcgcgctgaccctgcccttccccggtgcctttgccgacacccgcgccggccgcctgctgttgtggaaaaccctgccggccggccaggccgcgccggctggagccgccgagctgtaccgcgaagacggccgcctgtggctgcgctgcgccgacggcggccgcctggcggtgctgcgcgccgaactggccggacaggcgctggacgccggcaatttcgccgcgctggccggcggcgacgcgctgcccctgggcggctaa

SEQ ID NO: 632 - DNA, 1044 bp, Chromobacterium substugae
atgaaaaaagtactgatcctgggcgtgaacggcttcatcggccaccacctgaccaaacgcatcatcgagaccaccgactggcacatctacggcatggacatgcacgatgaccgcgtggccgaatggaaagaccacccgcgcttccacttcttcgaaggcgacatcaccatcaacaaggagtggatcgaataccacgtgaagaagtgcgacgtggtgctgccgctggtggccatcgccaccccgtccacctacgtcaacaacccgctgcgcgtgttcgaactggacttcgaggccaacctgcccatcgtccgccagtgcgtgcagtacaagaagcatctggtattcccgtccacctccgaagtctacggcatgtgccacgacgacgagttcgacccggaaaactccgaactgatctgcggcccgatcagcaagccgcgctggatctactcctgctccaagcagctgatggaccgcgtgatccacgcctacggcatgcaggaaggcctgaactacacgctgttccgcccgttcaactggatcggcggcggcctggacaacatcaacacgccgaaggaaggctccagccgcgtgatcacccagttcctgggccacatcgtgcgcggcgaaaccatcaagctggttgacggcggccaccagaagcgcgcgttcacctatgtcgacgacggcatcgccgcgctgatgaagatcatcgagaacaaggacggcaaggcttccggccagatctacaacatcggcaacccggccaacaactactcgatccgcgaactgtcgcaaatgatgctggacctggcccgcgtctacccggaataccagctcaacgccgatcaggtgaaggtggaggaaaccacctccggcgcctactacggcaagggctaccaggacgtgcagaaccgcgtgcccaagatcagcaacaccatggccgacctggactggaagccgaccgtcaccatggccgacgcgctcaaaggcatctacgactactaccgcgaccaagtcgccgccagccgcgacctgtcggagtaa

SEQ ID NO: 633 - DNA, 489 bp, Chromobacterium substugae
gtggaacggctgcggatactggccgcgctgggcccgctggcctgcgcctgccggatcgaacacatcggcagcaccgcggtgcccggcctcgccgccaaacccgtcatcgacatcatgctggggctgccgaagctaaacgatctcgaaccgtatttcccagcgctggccgccgccggcttccaccgccagccgcaaatggccgccgccatgccggaccggcattatttcacccagcccgtcctgccgccgcgtcaggctcacctgcatgccgtggcgctggattcggacttttggcgcgacaagctagccttccgcgacgcgctgcgcgccgacggccatcttgcggaacactatgccgatttgaaacggcggctggcggtcacccacggcggcgaccgcgccgcctacaccgatgccaagagcggctttatcgcctccgtgttggcgatgacagccggaaaaccgcacggcaagtccgcaacacggtaa

SEQ ID NO: 634 - DNA, 900 bp, Chromobacterium substugae
atgaaaaaactcgccctgaagatagacgtcgatacctggcgcggcacccgcgaaggcgtgccgctgctggtggacatgctcaaacgtcgccaggcgaacgccaccttcctgttcagcctgggcccggaccacaccggccgcgccatcaagcgcgtgttccgccccggcttcctgtccaaggtgtcgcgcacttcggtcgtcgaacactacggcatccgcaccctgctgtacggcaccgtgctgccgggccccgacatcggcaagcgcgaggccgcgctgctcagaagcgtgcgcgacgccggcttcgaagtgggcattcattgctgggaccacatcaagtggcaagaccatgtcgccggcgaagacgcggtgtggacccgcgccgaaatgcataaggcggcgcgccgctttcaggaaatcttcggcgagccgccgcgcacccacggcgccgccggctggcagatcaacgacgccgcgctggcttaccagcaggaactgggcatgctgtacgcgtccgacggccgcggcacccacccgttccagccggtggacgccgccggccgcaacctgggcgtgccgcagctgcccaccacgctgccgacgctggacgagctgatcggcctgaacggcctgaccaacgacaatgtccacgaacacctgctgcggctgaccgaaaccgcgccggacaccggccacgtctacacgctgcatgccgagctggaaggcatgcgtctggccgaaaccttcgagcgcctgctgcaaggctggcaggagcaaggctaccagctggtcagctgcctggacctcttcaacagcctggaccgcgccgcgctgcccaacggccgggtggcgatgggagaaatccccggccgcagcggcacgctggcgctgcaggcataa

SEQ ID NO: 635 - DNA, 354 bp, Chromobacterium substugae
atgcattggtatttctcagttttgtccaagtacgcggtgttccgcggccgcgcgcgacgtcaggagtattggtatttcgtgctgaccaatctgatcatcagcctcatgctgctggttgttcagcatgatgtgttcggcgatcacaatcggtggctgacgaatctttattcgctggcgctagtgttgcctaccataggcgtgtcgatgcgccgtttgcacgatatcggccgcagcggctggtggatgtggatcttgttcattcctgtggtcggcgccatcgttttgctggtgtttcattgccaggatagccaagcgggcgacaatcagtatggcccttcgccaaaagacgcgtga

SEQ ID NO: 636 - DNA, 246 bp, Chromobacterium substugae
gtggagatcgcccaaatcgaacgcctactgctgatcaacctggcctttcattacgccatcctgatcctctggtttggcgtttttcattgcttccacggctggctgtaccggctgcacagccgctggttccgcttgtccgaaccggccttcgacctgctgaactacggcggcatcggcctctataaaatcctggttctggtgttcaacctggcgccgctcttggcgctgtggctgaccgggtcctga

SEQ ID NO: 637 - DNA, 1014 bp, Chromobacterium substugae
atggtgatagcggaatccagggtggaatgcatggtggtgcatcgggtgggcaacccgacgcgcggcgagccgctgcaattgtctgagcgcaccacttcggtcgacgaggcggtgtcgggcatgctgctggacggctatctgaagggcatcgtctccgatcgcaagaaacatcagttcgtccatgagaccgatctcaacctgaacgagatctaccactacacgcggcagttcttccgcggcgagatcgatttcctggcggtgtcgcagcgcatcgccaagcatttgtacggccgctcgcagcaccccaacatcagcgccggcgacctgctgatcatcgaattctccggcctgtccgacggcgaccgcgacatgcgcgcgctgggggtgttcaagtcggaaatccgcgacgatttcctcaccatcatcgacggcgccggcgtgttcgacatcagccacgcctccggcatcaatccgcggctgatagacaagggcgcgctgatcctggagcacggcccgacggtgtacgcagtggaccgcctcagccgcgaggccaagttctggctggacgatttcctgaaggcgctgcgggtgccggacaaggcgtccagcagcaagatgctggctagcgtggtggagcagctgagcggcgagatcgaggacccgatggagcaggcgcgcttcaaggacgagctgttgacgctggtggagagccagcaggaggaggtggcggccaagtcgctgaccgacgccgccgagcgcttcgtgccgcgcgcgcaggtggaagaggcgctgggcagcgccgccgaatcctatggcttcgagctggacgacgaggcgaagctgccggccaagggcatggcaaagcagctggaaaaaacgctgtcgcgctacggcgtcggccacggcatcagcgtgttgttgccctccggcatcacgctgaagaacatccagtcggtcaacgacggcgaaggcggactcagcctgacgctattcctcaacaagcgcgaaggctga

SEQ ID NO: 638 - DNA, 882 bp, Chromobacterium substugae
atggcggcttgggaaggcatccaggaattcgtggcggtggccgacagcggcagcttcacccaggcggcgcggttgctggggatctcggtggcgcaggtcagccgccaggtcagccagttggaggcgcggctgggcgcgcgtctgctgtaccgcaccacccgccagctcagcctgaccgaggccggcgggctgtatctgacgcactgccgccagctactggaatcgttggccgaggccgagcaggcggtgtcgcggctgcaggcggcgccgcagggcaaattgaagctgaccgcgccgctggcttacggccaaagccatatcgcgccgctgctgctggatttcatgcagcgctacccgcagctggaggtcggcctcaatctgtccaaccaactgcaggacctggtgcacgacggctacgacctggcgatacggatagggcatctgaccgattcttccttgatggcgcgccggctgtcgcagcgccgccaccacatttgcgcggcgccggcctatctcgcgcgccgcggcgcgccggcgcggccgcaggatttggccggccacgactgcctgctgctgggccaggatagctggcatctgcaggcgggcggcaagcgccaggcggtgcgggtgcgcgggccgctgcgctgcaacaacgcccaggtgctggccgacgccgcgctgcgcggcatggggctggcgcagttgcctgactattatgtggcggcgcatctggccagcggcgcgctggtggaggtgctggccgattacgccgaaccggaggagggcatctgggcgctgtatccgcacaaccgccagctcagccccaaggtgaggctgctggtggatttcctggcggcggcgctggcgccggcctggccatag

SEQ ID NO: 639 - DNA, 1206 bp, Chromobacterium substugae
atggccgattgcgcggcgcaggccgcccgacatcccgctagaaaaaaggaatcccgcatgagcccgtccgtcatccgttgcaaagccgccgtggcctgggccgccggccagcccttgagcatcgaagaaatcgaagtgcagccgccccaggccggcgaggtgcgcgtgagaatggtggccaccggcgtctgccataccgacgccttcaccctgtccggcgccgatccggaaggcatcttcccctgcgtcctcggccatgagggcggcggcatcgtcgaatcgatcggccccggcgtcagcagcgtggcggtgggcgaccacgtgatcccgctctacacgccggaatgccgcgagtgcaagttctgtctgtccggcaaaaccaatctgtgccagaagatccgcgccacccaaggcaagggcctgatgccggacggcaccacccgcttctccaagaacggccaacccatctaccactacatgggcacctccactttcagcgaatacacggtgctgccggaaatctcgctggccaaggtgaacccggccgcgccgctggaggaagtgtgcctgttgggctgcggcgtcaccaccggcatgggcgcggtggtcaataccgccaaggtcaaggccggcgacagcgtggccatcttcggcctgggtggcatcggcctgtccgccatcatcggcgcgcgcatggccggcgccggccgcatcatcggcatcgacatcaacgagggcaagttcgagctggcgaagaagctgggcgccaccgactgcgtcaaccccggtcatttcgacaagcctatccaggacgtgatcgtggagatgaccgacggcggcgtcgacttctccttcgaatgcataggcaacgtcaaggtgatgcgcgcggcgctggagtgctgccacaagggctggggcgagtcggtaatcatcggcgtggccggcgccggccaggaaatcgccacccgcccgttccagctggtcaccggccgggtgtggcgcggcagcgccttcggcggcgtgcgcggccgcaccgagctgccggaatacgtggaacgctatctgcaaggcgaattccgcctggacgacttcatcacccacaccatgccgctggagcacgtcaacgaagcgttcgagctgatgcacgagggcaagagcatccgttcggtgatccattaccgcccggccggccaggacgcggtctga

SEQ ID NO: 640 - DNA, 837 bp, Chromobacterium substugae
atgctggagaaaatcagcgagaaccaggccttcggcggctggcaacaacagtggcggcatcgttccgccatgctggattgcgacatgcgcttcggcatctacctgccgccggcggcgcggtacggcaaggtgccgctgctgctgtggctgtccggcctcacctgcactgacgaaaacttcagccacaaggccggcgcgcaaagagtggcggcggagctgggcatcgcgctggcgatgcccgacaccagcccgcgcggcgaaggcgtggccgatgacgcggcctatgatctgggccagggcgccggcttctacctcaacgcgacgcaagcgccgtggagccgccactaccggatgtacgactacgtggccgacgagctgccggcgttgctggaagcgcagttcccgctcaacggccgccgcgccgtcgccggccactcgatgggcggccacggcgcgctgatctgcgcgctgaagcggccgcaggactacgtgtcggcgtcggccttcagcccgatctgccgcccgacggcggcgccttggggccgcaaggccttcgccgcctacctgggcgccgatgaaagccggtggaaggaatgggatgccagccatctgctggccgaacgcggctgcagcctgccgctgcgagtggacgtgggcctggccgaccccttcctcgccgaacagctgcagccggaagcgctggaactcgcggcccaggccagcggctgccggctggagctgaaccgccacgccggctacgaccacagctactacttcgtcgccagcttcatcgaggcgcagctgcgcttccacgcccgccatctgttcccgacctga

SEQ ID NO: 641 - DNA, 83 bp, Chromobacterium substugae
ggaggggttaccccagcggtcaacgggtccggactgtaaatccggcggctcagccttcgaaggttcgaatccttctccctcca

SEQ ID NO: 642 - DNA, 732 bp, Chromobacterium substugae
atgcctctctccacccatcgcccggtttgcagtctgatctcctcccgcgcccataccgacctcgccgccctgccgctgctgcgggacgcgcccgaggcgctgatcacccatctggcgcggcacaccactccggttgacggcaaacagcgcaaactgctgttcctgcgcggcgacccggagaatttcatcggcctggtgctgcggggcggcgtctatcactcgctgcaggagccggatggacacgaggtgatcatggaccgcactcagcccggggaaatggtgggcgaaagcgccttgctgcaatccggacgccgcagcagcaacgcgctgctaggcagcaacagccagctgctgctgctgcatcagcagcacttcgcgccgttgcaggactgcgcgcagctgatgaaccgagtgcagcagcaattgtgcgcgcggctgcagcgcatcagcagcttcgttgaaaccgtatgcctgtaccggctggaagcccggctggcccgccacctgctggcggaaatggagcaaagcggccgccccggccccgatggcgtgacactgccgatgccggccaaccagggcacgctggccgccatgctcaatgccagccgcccgcggctgaacgcccaactcaagcaatggcagcgcgacggcctgatccagctctcccgccagacgctgcggatactggatcccgataagctgtcccgcatcgctcgccagcttcagccatga

SEQ ID NO: 643 - DNA, 672 bp, Chromobacterium substugae
atggccatcatgcaaagcttttcccaggcagcatcggaatccactgactccagcttctccatggtatggcgggaaatacacgccaaactgcagcgtcgcgcgcggcatctgtgcaagggcgatatccaccgcgccgacgagttgctgtccgacaccgcgttcaaggtgcatctctacctgcagcactcttccgcccgggtgcaaaacctggccggtttcatgttcctggcgctcaaccacgcctttctggacttgaagcggcgccagcgccgggaaatcaaggtcatcgatcccgactccgatcccgacggcgatcaggcgctgtcctgcaccggccatggccccacccccgagcagcaattatccctgcggcaacagctggccgaactggaatgcgcattcgccgcgctgaacccggaccagcagcagctgttccagctgaaattcgaagaggacctgtcctattgccagatcgccgcgcggctcggcatcaacgaagcgctggcccgcaagcgggtggaactgctgcgcaaggcgctgcgcaagcagctgaacccgggtttcacgctctccgatggcagccgtccatatcagcagaagcgccagcggcagtccgccgccaatggcccgctctgcgccccctgcgccgacgacaaggacaaagcagcatga

SEQ ID NO: 644 - DNA, 504 bp, Chromobacterium substugae
atgaccgccaaactgggcagcctgatcagcggcctgaaacgcgccgtgatcgaggcgcaacgcagcgtctgccaccagcacatcgaggaattgcagcaattcttcgttccggaccaagagcagaacccggcgcaaagcttccccgagggcgcctggaccgcccgcatggtaggcatgaacgtgccgcgcgaagtgagccgcaacggcgtggtcacgatggagcaccacgaggttcaggtgccgctgatcacgctgctgccgctgaaaagcttcgccattgaaaaagtggaggtgctgaccacgctcagcctgtcgctgaccgagccgcccgacggccagccggacgcggatgacgaggccgccgacgtgctggtttccatgcgcaggcaggacgaacagaccgccgaaatcaagatcgtcatccagggtctggagcctccagccggctaccagcgcgtggtggcggcctacgagaaactgttgaacgcgcagctgcccacctaa

SEQ ID NO: 645 - DNA, 675 bp, Chromobacterium substugae
atggccgatacctcggacaacaacctgttgagcatggcccagcagttttccggcctgccgatgaaatcgctgatcggcggaccgctgcaggccgccgcccaggcgcagcagagcctggcgatgacgcagacccaggccatcctggaaaccggcttcatccgcctcggtgaccgcaacggcaagctgaccggctacaagccgctgactgccgtcatcgagatggcgtccagccgccccggccccgccggccaagcctcgtcggcgctgacgctcaatctgccggtgctgaccttgatgcacatcccgtcgctggccatcagctcggtggacatcgccttcgacatggaggtgaagtccagcttcacccgggaaaccgacgagcagtcggcgtccaagctggaagccggcgcagcctgggatgcccgcgccggctggggcgccttcggcgtcgagctcaagggttcggtctcctacgactcctcccactcccgcgacgacaaacagggcgtcagcaagagcaacgacgcgcgctaccacgtggaggtgaaggccgagcagcaaccggtgccggaaggactgaggctgctgctgcaggccttcggcaaaaacatggacatggcgcaggcgccggccgacgcgccggccgtcccgccgccggccggcgccaagagctga

SEQ ID NO: 646 - DNA, 804 bp, Chromobacterium substugae
atgaacgccatgctgctccatttcatctccctgccctcatcggcgcagatcgccgcctgggctgcgtccggctgcctatgcgccacgctcgtccatctgctgctgcgcaagctggcgcccgaccatgtcacccagaagcagagtgacgaggtcggcgtcatcatcgccgtggtcggcatcttctatggcctgatcatcgccgcattgctggttcgggcgatcaaccacttcgacgcctcgaccgacatcgtagagcgcgaagccgagctggccggctcgctctaccggatgagcgcccagggcctgccttcggcgcgtcaaacggtgaaggacaatctgctggcctatctggacgccgtcgtcgcccgggagtggccgcgccaacaaggcggggaagaagtgccatccggctcgcccgaactaggccggttgagccgcgcgctggccggcgtccgcccggccgaccggcgggaggctgaatatctgaatctggcgcagagccagctgaacggcctctacgccagccgccacgcgcggctgtccgaccaggcgatgaccattccctgggacatctggtcggtcagcctgatcggcgaagtgctgctgattttcttcgcctggctgatgcacgtgccgagcaagggcgtgcacttcttcctcacctgcgcgatggccgcctccatctccatcgtgctggccatcatcctgatctacgacaccccgttctacggcgacatcagcgtgtcgccggagccgtaccgcaaggtgctgcatgccatccgcgccgacagcctggacggctga

SEQ ID NO: 647 - DNA, 240 bp, Chromobacterium substugae
atggcagacaacaccgcagtcaacggacagatcaccgacgccgtcacccaaaccaatgtcaaggtggtggcggaagcgccggcccaggcgatggcctcgctgtaccagctggccagccattccgccggcttggcgctgcagaactcggtccacagccagcaagcgctgaaccagatttccagcgcggtgatttccaaagcggtgtcgatgatcctgtcgatcggcgagaaaagcagctga

SEQ ID NO: 648 - DNA, 615 bp, Chromobacterium substugae
atgcccttccccaacttcaagaacctgttcggcgccaagccgcccgccggccaggacagcgcccagcccaaaccggaccagccggccgcatccgccgccaaaaacgagccggcccagccccctggaccgccgcccgccccgccgccgcccagcccgatgcgcggcttcaccaatcagttgaaaaccgcgccggatgccagcccggacaccagcgcgctcaacagccagatcgtgcaggcggtacagctttccaacagcgaaaccgccgcctacgccggcagccagatcgcggtcgcgcccaatatgatgatcagccaggccggcggcctggtggcgcaggccggcgccaactacttcgacagcgcgagcaagctggcgctggccagcaagagcgtgctgctgaagaacatgaccgagaaattcgccaaggaggacctcaagggcgcggccgaggacgcgctgggcattctgatcaccgacctgctggtcggcaccgccgcggcggtggcggcggccgccggcgcgatggagggcgaggccgcgcacttcgccctggacaagatcgatcagagcctgagcaagtatcaacagtttctggataaaaaaactaattag

SEQ ID NO: 649 - DNA, 408 bp, Chromobacterium substugae
atggacacacccgaccaagacgccaacgacgccgcgccgcgcggcgggttgctgcgcggcagcatcccggaattgagcaagagcccggtgcacctgctgtcggccatcgtcacgctggccgcggacaagctgtgggacgtgatgctgctggacatggcgaagacgatgccgctgcaggaaaaaacccgcttcttgctgtgcgccggcctgctgctgctgggcttcaccgccctcagcgcctcgatgacccaactctgggtggacaaggacgatccgggcatggcgctggccaagggactggcgatggggattctggccgggctgccgtactcgttcggctcaaccgagctggggctgctgttcatcggctggtccggcatcaacgagctgcagaagctggagaaataa

SEQ ID NO: 650 - DNA, 1053 bp, Chromobacterium substugae
atgcgcgtcaccctcacctcccgcagccatctggccgccctgcttctcgccgcctgcggccaggcgtcggccgccgccgcgccgctgcccgcgctgggcgccgatcccaagcagaacaccgtctccggcctgtcgtccggcgccttcatggcggctcagttcagcgtcgccaactcggcccgcgtggctggcgccggcatcgtcgccggcggcccgttctactgcgccggcttgggcggcctcaatggccccgaacgcttcctcaccaccgccactacccagtgcatgcgcccgctgggcgcggccccctccggcgcggcggcctggcaggcagcacagaaattcgccggccagggcctgatcgacccggtggacaacatcaagcgccagcggctgtacatcttcaccggcgcgtcggacagcatcgtgctgcccaaggtggtggcgcaaacccgcgccttctaccagagcgccggggtgccggacgcccaggtccgatacgtggacaacgtcaacgccggccacgcgctgatcaccgccaacgccaccgacctgaaatgcccggccaacgccgcgcccaatctcaacaactgcggcttcgtccagtcgcaggacatcctgcgccagctgtacggccagttgaagccgcccgccgccaaactgtccggccaactgaaggatttcgaccagaccgagttctccaagaaagggtatacagggctgtccgacatcggccacgtttacatcccggccgcctgcgccaaggacagctgccgcgtgcatgtggccttccatggctgcacccaggaagacagccgcatcggcaaccgcttctacgccaccaccggttacaacgagatcgccgacagcaaccgcatcgtggtgctgtacccgcagatccgcaccgatcccaagcgcaacccgcagggctgctgggatttctggggctacagcagcaaagacccaagcaaccccgactactacgccaagagcgcgccgcagatgtctgccgtccgcgcgatggtggaccgcctgaacagcccccgcaaatga

SEQ ID NO: 651 - DNA, 510 bp, Chromobacterium substugae
atggatccccaattcctgtccgcctggctccagaacgtgaatgacagctggcagcggctggctcaaaccggcctgcccgatgagcgggagtggaaaggcgcgctcaaggcttggctggacagcggccagcggctgtcggaatggcagcaggaagcgcagcggcaatggaccgaagactggcgcgcgcgcgcgggcgcggactcgttgctggccttctaccgccaatgcgacgaagtctgcaccgaattcgtccggcaaaacctgctctggcagctggagtggagcgccgggctgcggcgccaggccggcgagttggcgggctctctgctgcagacgcggggcgaaggcgacgcgctgctggcgctcaacgccgccgtccagggcggacgaaaagactgggacgaaaaactggagatgttgcagcagacgctgagcgaactgtcgccggcgctggcgcaaaacctgcagcaatggctggcgccgccgcccgcggacgcgcccgccgcctga

SEQ ID NO: 652 - DNA, 441 bp, Chromobacterium substugae
atgaaaaccaacgcagccggcatcagcctgatcaaacaattcgagggcgtccgcctcgccgcctaccaggacatggtgggggtctggaccataggctacggccataccggtccggatgtgaaaaaaggcatggccatcacccagcaacaggcagaccagttgctggccgaggatctgcagacattcgaaaccggcgtcggcaaagccgtgaccgtgccgctgaacgaaaaccagttttccgcgctggtcagcttcagctacaacctgggtctgggaaacctgcgcagttccacgctgctgcgcctgctgaacaagggcgactacgccggcgccgccgcgcagtttccgcgctgggatcgggccggcggccaagtcgtgccgggcctgctgcgccgccgccaagccgaacaggcgctgttcctgacgcccgccccctgctga

SEQ ID NO: 653 - DNA, 204 bp, Chromobacterium substugae
atgcaagacgaactgagcactctgcacgcccatgtttcccaactgctgagccagcacctgattgactgggccggcgaactgatgaacggcgcggcgggagaggacgacagccgccgccttaccaagctgcgagcgctgctggccacccgcgatgcgctggcgccgctgctgggcggcgaacagcaggatgccagtcatggctga

SEQ ID NO: 654 - DNA, 582 bp, Chromobacterium substugae
atggctgaggcgccgctgaatcccgccctgcgccaggtggcggaacaatacctgggccggccgttgcaactgcaggaagcgcaaaccctgatggcgttccaacaaaacacgcaaagcccctctcctcagctcgcgcccatccagcaagcccggcagcagacacagcaagccatcgcccagagccagagccgcgccggcgccggcgtgcgcgacatcctggcctccatccaggccagctccagccaggcgctgcagattcaggaggccgaggagcaggcgattctcaagttgttggaaggcacgcaggacctcgccgagcttcgcccctccgcgctgcagccggcgatggcaagcctgcagccgggcagccagctggcgctcggccagatcgccgagcatctgtccaacctggctcgccaggaagtggagaagtgcttcaaccagtacttcggtccgctatccgcgcagttgcaggaagtggtgcggaagctgcaggcgcaggaggccgcgcaagcctccaccgaggcggccgcggcggaaaacgacattcacagcgacgatgccccaccgtccaagcagtag

SEQ ID NO: 655 - DNA, 321 bp, Chromobacterium substugae
atgtccttcccgaccaccgtaaacgatcagatcaccgatgctgtcacccaggccaacgtcaaggtgctggccgagtcgccggccatggcgatgggctcgatctaccagagcatggcccactccaccggcatcctgttccagaacgccgtctcggctcagcagcagcagaatacgctggcccaggctgccgccaatatgggcgtgatgcagatttacagcatggacaccatgtccggcgccgccgccaccgagaaagtcagccaaggcggcatcgccgacaacctgaccagcctgctcaccgtgctgcagtcgttccgctga

SEQ ID NO: 656 - DNA, 324 bp, Chromobacterium substugae
atggctaacaacaccgccgtaaacgatcagatcaccgacgccgtcacccagaccaacgtcaaggtgctggccgaagcccccgccatggcgatgggctcgttgttccagaccgcctcccactccaccggcatcctgttcgaaaacgccacctcggcccagcagcagcagaacacgctgtcccaggccgccgccaacatgggcgtgatgcagatctacagcgtcgacaccatggccgatgccgccggcaccgagaaagtgtcccaggcaggcatcgccgacaacctcagcagcctgatgacggtgctgcaatccttccgccgctaa

SEQ ID NO: 657 - DNA, 324 bp, Chromobacterium substugae
atggcgaacaacaccgccgtaaacgatcagatcaccgacgccgtcacccaggccaacgtcaaggtgctggctgaagcccccgccatggcgatgggctcgctgttccagaccatggcacattcgactggcattctgctcgagaacgccacctcggcccagcagcagcagaacacgctgtcccaggccgccgccaacaccggcgtgatgcaggtctacagcgtggacaccatggccgacgccgccgccaccgaaaaggtgtcgcaaggcggcgtggcggacaacctgtccagcctgatgaccgtgttgcaatcgttccagcgctga

SEQ ID NO: 658 - DNA, 327 bp, Chromobacterium substugae
atggcattcccgaccgcagtcaacaaccagatcaccgacgccgtcacccaggccaatgtcaaggtgctggcagaatcgcccgcgatggcgatgggctcgatctaccagagcatggcgcactccaccagcatcctgttccagaacgccgtgtctgcgcagcagcagcagaacacgctggcccaggctgccgccaacatgggcgtaatgcagatctacagcatgaacaccatggccggcgcggccgccacggaaaaagtggcgcagggcggcatcgccgacaacctgaccagcttgctgacggtgctgcaaagcttccggaaccgctga

SEQ ID NO: 659 - DNA, 867 bp, Chromobacterium substugae
atgaattgggacaacgcgcgttacttcctggcgctggcgcgcgccggcaccttgcgttccgccgccttgcgcctggacgtcgaccaagccaccgtggggcggcgcttgcaggctttcgaagaggaaatcggcagccggctgttcctgcgcatgccgcagggctaccaattgagcgaatccggcgcgatgctgctggccgacgccgaacggatggaggccgccgccgacgccttcagccgcaaggccgcgcacagcgaccgccaactggccgggccggtgcgcatcgccgccaccgacaccgtggccggagcctttgtcattccggcgctggcggagctgtcgcggcggcacccggagctggagttcacgctgctgaccggcttgtcgctcagcgatgtggcggccggcgaggtggatttcgccatccgcagcctgcggccggacaagggcgaggtgctggtgcgcaagctggccgccatcgacatgagcctgtatgcgtcgccggattacctggcgcggcgcgggcggccgctgcccggcgacggcttcgccggccacgagctgctgatgttcccgcgcgacaccgtgccgcgccactggcagcggctgtgcggcgaaagcgtggaccaggcgcgcatcgcgctgcaagccaattcgcagctggccctgcggcaggcggcgctggccggcatgggcatcgccatgctgtcctgcttcctcgccgatcaggacgccgggctggagcgggtgtggccggagcggaccgatccggtggacatgtggctggtgctgcatcccgatttgcagcgggtggcgcgggtgcgggcggcggtggaagcgatcgcggcggtgtttgccaggcggtga

SEQ ID NO: 660 - DNA, 1398 bp, Chromobacterium substugae
atgccccaccgttcccacccgcaagccggcttgccggccctgctgacgctcagcgccggcatgttcatggcgatactggacaccaatatcgtcaacctggcgctgcccgagctgcagcgcggcctgcacgccagcctcagccagctcacctgggtagtagacgcttacgtgctgaccttcgccggcctgatgctcagcgccggctggctggccgaccgcctgggcgcgcgcaaggtgttcgcctggggactggggctgttcgtgctgacctcgctgctgtgcggcctggccgccaatgtggagctgctgatcggcgcccgcctgctgcagggcatggcggcggcgctattcatgcccagttcgctgggcctgctgcgccatgccttcccgcaaccggccgaacgcgcgcgcgcggtgggcgtcttcggcgggctggtggccaccgcggccgccgccgggccggtgctgggcgggctgatcctggggccattgggctggcgcggcgcgtttctggtcaatgtgccggtgggcctggccgcgctcttggccaccgcgcgcgcggtgccggcccagccgcccgcgcccggacgccgacctgatgttcccggccagctgtccggcatgctgacgctgctcttggccagctgcgcgctgatagaaggcccgcgcctggccggcggctggcagctgccggcgctgctggccgccagcgccgcctcggcctgcttgttctgcctgcttgaacgcggcaatccgcaggcgatggtgccgccgcaactgttccgccatccggctttcgccgccgccaactgggtgggcttcgccatcggtgccgcttacttcggcagcctgctgctgctcagcctgtatctgcagcaaggcttgcggatggacgcgctgcgggcgggactggcgctgctgccgctggcgctgtgcctgaccgccggcaatatcgccgccgggcggttgctgcccaggatgggcgcgcgccgccagatccgcgacggcctgctgctggccgccgccggctacctgctgctggcgctggccagccgcctcggcctgccctggctgctggcggcgatgctgccgctggcgctgggcaccgcgctggccatcgcgccgatgacggcgacagtgctggagagcgcgccgccgcaaatgggcagcaccgcgtccgccgtgctcaacgccatccgccaggccggggctctggtaggcaccgccggcgcggcgctggtcgccggccgctgcgcggacctgggccaggcgctgctgtacggcatggcgctggcggcgctgctctcgctgagcggcgcgctggcggccggacggattccccgtcccgacggcctgcgcggcctggaggcggccgcgcccagccccgtcacaagatga

SEQ ID NO: 661 - DNA, 114 bp, Chromobacterium substugae
atgcgctatctataccgtttgtacccgtggttgtttcaacgcgaacgcgccgtcggctgccgccttggcctgcgccggcaatgggaggcggcggcgaggcgcgtcatcttgtga

SEQ ID NO: 662 - DNA, 999 bp, Chromobacterium substugae
atgttccaaataaacgcgcaatccagaaccaattgtccagatatgaaaacaatgccctcccccgacaacctgctggccttcgacgcgctggcgcgcgccggcagtttcaccgccgccgccgacctgcagggctgccacaagagcctgatcagcgcccgcgtcaaggaactggaacgcgagctgggcgcggtgctggtgctgcgcagcacgcgcaaaatggcgctgaccgaggccggcgagcggctgcggccccacgcggcgcggcttagggaaacgatggcgcaggcgcggatggcggtggaccagacccaaagcggcctggccgggccgctggcaatcagcaccacctcgtcgctggcgcaatacgtgctggggccggtattgagcgaactggccacccgctatcccgatttgaccctgtcgctgcgggtgaacaaccggctgcaagacccggtggccgatgtgctggacttctgcctgcgctcggcgcgctcgcacaaggtgcacgatgaaaacctggtggccaggctggcgggctacgccagcgaaaacctgtacgcgtcccccggctatctggcgcgccacccgccgctgcggcagccggccgacctgtcccggcaccgtttgttggtgatggagtcggaacagcgcgatgggctgctgttgaaaaagggggagcagctgttgcgccaacccatcgcggcgcagctgtatctggatcattacccgctgcgggcggagctggcgctggccagccagggcatcaccctgctcgccgactacaccgtagagcggcatctggcgcgcggcgagctggttcgagtgctgccggaatggcattgcgactactggcccatctacctggtgcatccgttccgcaccccgctcacctgcaaataccagaccttcatcgacttcgtcttgccgcgggtggcggcggcattgccggacaaccgcgctcaggcgggcagcgacggccgcgccagcagcacccggtaa

SEQ ID NO: 663 - DNA, 948 bp, Chromobacterium substugae
ttgattgttatcgaaaaattgacagttgatatggcgcgaggcgtagagaacaatctggaaggactgcagatcttcgtggcggtggccgaagccggcggcttcaccgccgccgccgagcggctggggatgaccaaggccaacgtcagcctgcaggtggggcggctggagacgcagctgggagccacgctgttcaaccgcaccacgcggcgggtaaagctgaccgaggccgggcaggcgctgtacctggacgcgcagccggcgctggcaaccttgcgcgacgcgctgctgcaggccggccacggcgcggcggcgctgtccggcacgctgcggctgaccgcgccggtcagccacatggcggaatcggtggcgccggcggccacccagttcatccgccagcaccctggcctgcagctggagctgcacgccagcgaccatatggtggatctggtggcgtccggcatggacctggccatccgcctgggcatgctgcgagactcttcgctcagggcgctgaagctgggggaattcgctcagttgccggtggcgtcgccggcgtatctgcaagcgcgcggccatcccgagcggccgcaggatctggccgagcacgactgggtggcgctgacgctgctgaaaacgccgctgagctggccgtttgccgggccgggcggcgaggagcaggcggtgcggatgaaggcgcggatcaaggtggattcggccgcttcgctgcgcgccttgctgctggccggcgccggcgtgtcggtgctggattcgttcagcgtgcaggaggacatccgccagggcaggctggtccacctattgccgcagtggaccttgccaaaaggcggcgtttacgcggtgtttccgcctggccgccacgcgccggcggcggcgcgcgccttcgtcgagttttaccgggtgctgctggcgcggccgtcgctgcccgcctga

SEQ ID NO: 664 - DNA, 639 bp, Chromobacterium substugae
atgaaaatcgcactgatcggcgccagcggctatgtcggttccgccctgttgcaagaagccctgtcccgcggccaccacgtcaccgcgctggtttcccgtccggaacgcatcgaagcgcaagccaacctggccgccgccaaagtcgacgtgcaggacagcgcccagctggcggaacaactgaagggcttcgacgccgtgctcagcgccttcagcggccacgcccaggcagagcagttcgactacttcgtcaagggcatccgctccatcatcgccgcggccaaggccgcccaggctccgcgcctgctggtggtcggcggcgccggcagcctggaagtggcccccggcgtgcagctggtggacaccccggaattccctgagcaatggaaggcctcggcgctgggcgcccgcgaagcgctgaacctgctgcgcgccgaaaccgagctgaactggacgctgctgagcccgtcggcgatgctgcagccgggccaacgcaccggccagttccgcctgggcaaggaccagctgctggtcgacgccgcaggcaacagccacatctcggtggaggactacgccgtcgccatgatcgacgagctggaaaaaggcgagcatcagcgcagccgcttcaccgtcggctactga

SEQ ID NO: 665 - DNA, 414 bp, Chromobacterium substugae
atgaagaatgaagaattggcggtatgggcgcaggttcgcgacactttggcgcagatcgcgcgctggctgggcgacgggccgcatggcgaggaggcgctggccgcgctgatgatggatttcgacgccggcttcgccatggtggcgccaaacggcgcgcggctggactggcaggggctgcgggccttcttccagggcgcggcaggtagccggccggggctggaaatcacgctggagcggatgacgctgctgatgggagatggcgacgccgcaacggtggcctactacgaaacgcaggccttgggcgacggcagcggcaacggccgccacgcgaccgccgtgctgttccgggatggcgccaactggcgctggcgccatctgcaggaaaccggggaggctgtctggcctccccgttga

SEQ ID NO: 666 - DNA, 1422 bp, Chromobacterium substugae
atggagtatcgcaaacgcgtggccgcagtgtacctgttggggtttttcatcgatctggccaatcttttcgtcggcaatgtcgcctttcccgacatcgcccgcacctttcatcgcgatgtggcggagctggcctgggtgggcaccgcctacattctggggctgaccgcggtgattccgctgggcaactggctggcggcgcgctggggcggcaagcgggtgttcgtcgcctcgctgctgctgttcatggcgggctcggccggcgcggcgcaggccggctcgctcggcgcgctgatcgcctggcgcgcgctgcagggcttgggcggcggcttgctgattccgctgggccagaccatgacctatcgcttgtaccggccggcggagcggccgggcctgaccgcgatgattttgctggtgggccagctggcgccggccttgtcgccgacgctgggcgggctggcgctggacgcgttgggctggcgctggattttctggctcaacctgccgctggccatcgtgccgctggtgctggcgctgcgctggctgcgggacgagcgcgagccggagccggccgccggcctggattggctcggcctgctgctgggcagcctggcattgttgctggccttgcaagggctgggcgatctggcgcagccgtccacctgggcgcgcggcggcgcgctgctggctgcgggcctggcgttgggcgcggcttacgcgcggcatagccgccggcatccgcggcccatcctgcggctggaattgctgcgcgatccgctgctgcggatgtcgatgctgatgtatctgctggtgccgggcgccttcatgggcgtcagcctggtggcgatgctgtatctgcagcaggtgctgggcgtgtcggcttccgcggccgggctgttgatgctgccgtggtcgttgggcgcgttcgccgcgatcgcgctgaccgggcgcggttaccgccgcctggggccgagaccgctgctgatggccggcgcgctggcgcagggcatcggtttcctgagcttgctggcgatagaccgctccgggcaactgccttggctggccggcagctacgcgttgatgggcctgggcggcaccttgtgcagcagcgccagccagagcacggccttcctgggagtggcgccggcgcggatgggcgaggccagcgccttgtggaacatcaaccgccaggtgagcttctgcgtcggcatggcgttggcttgcgtgttgctgaatctgctgcttgccgggcaaggcatcgccgatccggcggcgcccgcggcgcgggagttggcggcgcgggccttccatctgtgttttctggccgccgccttggccatgttgccgcccttgtggctgggcagccggataggcaatgcggaggtattgcgtttattgaatcgtcctcaaatgggagaagcgtga

SEQ ID NO: 667 - DNA, 906 bp, Chromobacterium substugae
atgagcctgcaacgcttccgcatcttcgccgccatcgtggaaagcggctcgctgaccgccgccgccgaggcgctgggccacagcaaggcggtggtcagcttcaacctgaaacagctggaggccgagctgggcgtggcgctgctgacccgcagcacgcgccggctgcagttgaccgaaaccggccggcgcttctaccaggactgcctgcatgtgctgcgcatggcgcagacggcgatggacgatgcgcgccgcggccacggcggcctgcagggcacgctgagcgtgagcaccacaccggaatacggccgccgccgggtgataccggcgctggcggccttctccctgctgcatccgcggctggcggtgcggctggagtcgtcgtcgcggcatgccgacctgatttcgcagcaagtggacgtggcgatccggctgggctcgctgagcgactccagctaccgcgcgcggctgctggaggaattcgacatctggccggtggcctcgcccggctatctggcgcagccggacaagcaagtggaaagcgtggacgggctcgcccgcgccgactggctggcgcacagccggctggcggcgccgctgcgctggaaactgacgggaaaagacggggaagcgatgctggacgcgggcgacgcgccgcgcatcgtcgccgacacctcgggcgcattgctggacttcgcgcgccagggctgcggcgtggcgctgctgccggactggcaggtaacagacgatgtggccgccggtgcgctggcgcgcctgctgccggattgggcatttccacgccaaggcgtgtacgcggtctacccggacacccgccacctgccggaaaaagtgcgcgccttcatcgactttttcgccgactacctcgcgccgcggcaaggggaaggctga

SEQ ID NO: 668 - DNA, 1935 bp, Chromobacterium substugae
atgttcaagaactggtcggtcaaacagaaaatcctggtcagcgtcgcgctgatcctgctcatcgcgctggccatcgccggcgcggtctccacccgcatgttccaggcggcgctgaccgagcgcctggagcagcatgagctgaaggcgacggtggagggcatacgcaacgagctggacgcctccatcgcgctgcccttgagccagacccgccagttggcggccaacacctatctgctggactggaccgcggccggcgagcccgaatccggcgtcggcccctggcagcgctacgccaaggcgctgatgcagacctcgggcgcgtccatcatctcctggacttccgaagccacgctcaacatctacatcgaccacgccacggtcaaggccgaccccaagggcaacgacaagtggctggccgacttcctggcctccggccgcgacagccagttcacgctgggctcggaaaccggcaagcagcaggtgatgatgttcgtcaacgtgctggccaacaagggccaggccggccaccgcgcggtggcggcattaggcttcgacgtcacccagatggccgagcgcgtgcgcaagatggcggtgggcgagcgcggccaggtctacgtggtggacgccgccggccaggtgcggctgcaccgcgatccggcggcgatgcagaagaaaaccatgctggcagagctgcctggcctgtcggcgatcgcgccgcagctgctgaacaagtccggcttcaacctggcgcatttcgacggccccaatggcccgaccatcgccgcctccagctatatgcccaacgccgactggttcgtggtggtggaaatggacgccggcgaagtctacggcgcggtgacgcgcaccatctggtgggtggcggcgattgacgcggtggtgctgctgctgtcgctgctggtgatctggcaggtgtccggcttcatcagccggccgctggtgcaactgcgcgacgcgatgcgcgcgctcagctccggccacggcgacctgaccatgcgcctgccggccgacagccgcgatgaaaccggccaggttgcggcggcgttcaaccagttcatggagcagctgcgcgcgatgttcctgcaggtgcgcgaacaaagcggccagctgcaccgcagcgccggcgagctggcgcggatgaccgagcgcctgtccgccggctcgcgccacaacgccgacctcagcgaaaccaccgccgccaccatcgagcagctgtcggtcagcgtcagccacatcgccggcaattgccacggcaccgccgaggcggtgcagcaggccggcgcgctgtcggaacagagcgcgcaggcggtgggcaaggtcagcgtcgagatcggctctgtcgcttcgtcgatggacgaggtgaagacggtgatggaagagctggagcgccgctccgcccaggtgggcagcatcgccggcgtgatcaaggacatcgccgaccagaccaatctgctggcgttgaacgcggcgatcgaggcggcgcgagccggcgagcagggccgcggcttcgcggtggtggcggacgaggtgaggaagctcgccgagcgcaccagccaggccacggtggagatcgacgacatggtcggcggcatgcagcagggctcgggccaggcgcgcgagcgggtggcgaagacttatggcgcggtgcagggcggcgtggagctggccgaagaagcgcagcgccagatcgccgagatccgttccagcatgcagctggtggtgcgccaggcggcggaaatccgcgacgccgccagcgagcagtccaaggccaccgaagacatggcgcgcaccgccgagcagatgtcgtcgcaggcgctgcaatctgacgccgaaatcggccgcgccggccaggtggtggccgatctggagcgcttgtcgcagtcgctggagggcgtggtgtcgcgcttcaagctgtaa

SEQ ID NO: 669 - DNA, 504 bp, Chromobacterium substugae
atgagtttccccgagctgtttccctccttgttccgttacaaggcctgggccgatgaagagctgcatgcggaggcggcgcggctggatggcgcggcccatccggacaagcgccatctcgccatccgcatcctcaaccacatccacgttgtggaccggatcttccgcggcaacctgacgcggcagccgcacggctacgccgccaccaacaccccggacacgcccgaattggcggcgctgctggccgcggtgcgcgaaaccgatgcctggtatgtggaatactcatcctcgctgagcgcggccgagctggccgaggccatcgatttcaccttcaccgatggcggccatggccggatgagccgggcggagatgctgctgcaggtgatcacccacggcggctaccatcgcggcgcggcgggccgcgtgctggccgaatgcggcctgcagccgccacgcgacatctacacccgcttcctgcacgacagcgagccggcgcgccgcgcttga

SEQ ID NO: 670 - DNA, 603 bp, Chromobacterium substugae
atgcgcacaaaaagcgaaagcaagcgtcaggcgatcatcgccgcggcgaccgaggtgtttctggagcgcggctacgaggcggcgtcgatgtcggaaatctccacccgggccggcggctccaaggccacgctgtacaactatttttcgtccaaggaagagctgttcctggaggtgatggcttgcctggccggggaaatgtccaaggtctacgtcaagctggtgcccggcggcgatctggcggcggtgctgcaggatttcggcgaggcctacctggacaatctgttcagtcctgaattgcgcgcgctgcgcgccatcgtgatgggcagcggcagccgctccgaggtggggctgttgttttatgaaaacgggccgaaggtcggctggggcaatctggccgagttcatggccgccgagatgcaggccggccgcctgcgcgaagcctcgccgtggaccgcggcgatgcatttccacggcctggtgcatgccgaatgccaggtggcgctgatcaccggcctggtggatcaactggcgcccaaggagagccggccggcctgggtggcgtcggcggtggaggtgttcctgatcgcctacggcgcgcgatga

SEQ ID NO: 671 - DNA, 1446 bp, Chromobacterium substugae
atgagaaccgctaaatttttcccgccgcggccgctgtccatcggcctattggccgcgctggcgctgctgggcggctgcgccgccgtgccggacatgggtccggcgccgcagatcaaaccgctgcaaccataccagaatacgcaaagcctgccttctgaacagggtcaatgggccgctggccaatggtggcgcaaatacggcgatgcgcagctgaacaagctgatggacgaagcgctgagccaggcgcccgacctcgccgccgcccgcgcccgcgtcgagcgcgccgagggcctggcgcagcaggccggcgccgcgcggctgcccagcgcggacctgaacgcggcgatcaaccgcgacaagcaaagctacaacaacggcatgccggcgccgataggcttcaacagcagcggccgcgccacgctggacttcagctacgagctggacttctggggcaagaaccgcgcgtcggtcgccgccgccacttccgagctgaccgcggcccgcgccgactccgcccaggcgcggctgatgctgaccacctcgctggccgccggctacgccgagctggcgcggctgttcgccgagcgcgacgccgccgcccaggcgttggacgtgcgcagccacaccgcgcagctgatgagcgaacgccagcgccagggcatggaaacgctgggcagcgcgcgccaggcagagtcgcgcgaggcggccgcccgcgccgacctggccgccgccgacgaaaacatcgtcctgcagcgccatagcctggcggcgctgatcggcgccgggccggaccgcggcctggccatcgcccgccccgccgccggcttgtttcgcgaacagcggctccccgacacgctggcggcggaactgctgggccgccgaccggatctggcggccgcccgtctccgcgccgaagccgcggccaagcgcatcgatgccgccgaggcccagttctaccccaacgtcaatctcaccgccttcgtcggcgcccagtctttgggactgggactgttcgacaaggccggttccggcatagccggcgtcggcccggcgatcaatctgcctatcttccgcggcggccagttgcagggccaataccgcgccgcgcgcggcgactacgacgccgccgtcgccagctacgacgccgcgctgagccaggccttgcgcgaaaccgccgacgccgtggccagccaggccgcgctcacgccgcagctggagcagcgccggctggcgctgcaaaccgccgacgaagcctaccgcgtcagccagaaccgctatcagggcgggctggccaactacctggacgtgctgaacgccgaagacggcgtcatcgccagccgccgcagcctggccgcgctggacgcgcgccgcttcgcgctggacgtcgccctgatcaaagccctgggcggcggctaccaacaaaccgaaccacaggccgcccgctga

SEQ ID NO: 672 - DNA, 1155 bp, Chromobacterium substugae
atgagcgaaaacgtacaagccctgccggcctccgaagcgcccgctgccgcaggccgtcccctgcaacgcaagaagctgttcacgctgctgttcggcgcggtggccgccgccgccgtcggctacggcggctactggacgctggtcggctcccgccatgtcagcaccgacaacgcctatgtcgccgccgagatcgcccaagtgacgcccgaagtggccggcaccatccagcaggtgaaggtggtcgacacccagccggtgaaagccggcgacgtgctggtggtgctgaacgacagcgacgccaagctggcgctggcccaggccgaagccgacctcgcccgcgccgagcgccgggtgaagggctacttcgccaatgacgagggcctgagcgcccaggcccaggcgcgcagcgccgacgaggcccgctccgccgcgcagctggcctcggcccgcgccgacctggagcgcgcgaaactcgacctgcagcgccgccaggcgctggcgaaaagcggctcggtgtccggcgaggaactgagcaacgcgcaaaacgcctacgccaccgccgcggccagcctgaaagccgccgaagccgccagccagcaaagcgcggccaactaccgcgccgccgtcggcagcctgaaagccaaccagacgctgaccgccgacaccacggtggcagacaacccggaagtgacgctggcgcgcgccaagcgcgaccaggcacggctggacctggcgcgcacggtgatccgcgcccaggtggacggcgtggtggccaagcgccaggcccaggtggggcagcgggtgcagtccggcacgccgctgatgtcgttggtgccgctgcagaacgcccacgtcgacgccaatttcaaggaagtgcagctgaacaaggtgcgtgtcggccaaccggtggagctgaccgccgacctctacggcggcaaggtggtctaccacggcaaggtggccggcctgtccggcggctccggcgccgccttcgcgatgattccggcgcagaacgccaccggcaactggatcaaggtggtgcagcggctgccggtgcgcgtcgcgctggacccggccgagctgaaggcccatccgctgcaggtgggcttgtcgatggaagccaccatagacgtcagcgagggcccccatgtctag

SEQ ID NO: 673 - DNA, 1536 bp, Chromobacterium substugae
atgtctagcgcgaatcccgccgtccagcagccgctgaccggcaatatgctgtggctggcggcgctggtgctggccgccgccaacttcatggtggtgctggacaccaccatcgccaacgtgtcggtgccgaatatcgccggcggcctggcggtgtcgtccagccagggcacctatgtgatcacctcctacgcggtggccgaggccatcatcgtgccgctgaccggctggctggcggcgcgcctcggcaccgtgcggctgttcgtcggctcgatgctgctgttcggcctgttctccatgctgtgcggcctggccggctcgctggagacgctggtgctgttccgcgtgctgcaaggcctggccggcggcccgctgatgccgatgtcgcagacgctgctgctgcagatcttccccaagcacaaggccggcgcggcgataggcctgtggagcatgaccacgctggtggcgcccatcatgggccccatcctcggcggcacgctgtgcgaccaggccagctggccgtggatcttctacatcaacgtgccgatcgcgctgggttgcggctttctgggctggagcctgctcaagcgctaccagagccaggtgctcaagctgcggatagacgtggtgggcctggcgctgctgatggtgtgggtggcttcgctgcagctgatgctggacaagggcaaggagctggattggttcggctcccccatcatcgtcggcctggccatcgccgcgctggtcggcttcgccgccttcctgatctgggagctgaccgaggcgcagcccatcgtggacctcagggtgttccgccaccgcggcttctgggccagcgtgctgaccatctccctggccttcggctccttcttcggcgccacggtgctgacgccgcagtggctgcaggcctatatgggctacaccgccacccaggccggctacgccaccgcgatgagcggcatccttgcggtgatggtggcgccggtcgccgccaagctgtccaccaagctcgacccgcgcaagctggtgttctgcggcgtgatgtggctgggctgcgtcacgctgtaccgcagtttctccaccaccgacatgggtttctggcaggtggcgctgccgctgctgttccagggcctgggcatgccgttcttcttcgtgccgctgaccggcctggcgctggccagcgtcgagccggcggaagtggcctcggcggccggcctgatgagcttcatgcgcacgctgtccggcgccttcgccacctcgctggtgaccaccgcctgggacgacaaggccaattacaaccatgccgagctggtcggcatggtggacggcggcggcgacgcgctgcgcgcgctgaccggcagcggcctgtccgacagcacggcctggggcaccatcgagcaagcgctgcaggcgcaaagcatcatgctgtccaccaaccagatcttctggctggccggcctgtccttcatcgtcgccgcctgcgcgatctggctggcgccccggcccagccgcgtcgccgacaccagccaggcccactga

SEQ ID NO: 674 - DNA, 126 bp, Chromobacterium substugae
ttgccccgcgcccttgtggccggggctttttttcgtcctgtatcgaaggccagtctttacatacggccaccatcttgtaacagacttttacatatacagcgtgctatcaatatgccgacacaataa

SEQ ID NO: 675 - DNA, 1635 bp, Chromobacterium substugae
atgaaacattcgatccagcggctggcgctcgccgccgccgccgcgctcgcctgccaggccgccgccgccgcgccgctgcagcccatccgccacgacgccttcgcccaggcctgccaggcgctatggggcagcgcaaacgcccgcagccattgggtgaaggacgacggccagggcggcctcgcctacgcgccgctgaacggcgacggcgaccgcatcatggacttctccagcgccggctacatgggcggcggcgtggcgctgccggccgcgccggtgaaggcgacggtgaagcccagcggcaacgcggccggcgacctcgccaacatccaggccgccatcgccaaggtggccgccttgccggcggtgaacggcgtgcgcggcgcggtgctgctggcgtccggcaccttcctgctgaatgggccgattcaactgaatcaggatggggtggtgctgcgcggcagcggctccggcgccggcggcaccgtgctgaaggcgcaaggcagcggccacgcgatgctgagcctgggcggcgccagcgcccgcctgacgccggtcggttccaccgccatcatcagcgacagctatgtgccgtccggcagccgcgtcatccacgtggccagcgcctccggcttccagcccggcgacgcggtgatggtgcgccgccgcgccagcgccgaatggatccacttcatggacatggaccagctggtccgcgatggccaggcccagacctggatcaacgccggcaacaacaacgaaatctggctgcgcaccgtcgccgccgtcagcggcaaccagctgacgctggacatcccgctgtccgactccttcgacagcggctacctgggaacgaacggcggcagcgtgcagaaataccaggccagcggcatcgccgcccagatcggcgccgagcacctggcgctggaaggcctgcccaacggcagcggcaccgactacggcgtcgccaacctggacaatctggccgacggctggctcaacgacatccaggcgcacaacttcaccaacggcgtggtggtcggcaagcaggcgcgccgcctcaccctggaaagcatcgcgctgaatcacgaccacaacaacgtcgattgcaagggcgccaaggccttcgaattcagcatcgccggcagccaagtgctggtggaccgcagcgcgtccaccggcagcaagaagtcgttctactacgccactcaggcccaggccggcggccccaacgtgctgctgcacttcagcggccgcgccgaagcctgcggcaatatcgaaccgcaccagcgctgggccaccggcctgttggtggacaacgccgacatcagcggcgcgatcgcgctgggcaaccgcggcgccgatggcagcggccacggctggagcatgggctggggcgtggcgtggaatgccaaggccgaccagctggccatcgccgcgccgcccggcgccaccaactgggcgatcggcagcagcggcgcgctgacgcccaatgtgccggacgcccagggcgtgccggtgccgcccaagctggggacagtcgactcggtcaacgtccgcgtcggtccggacagcctgtacctgatgcagctgtgccagcggctggggccgcaggcggtgaagaacatcggctattga

SEQ ID NO: 676 - DNA, 633 bp, Chromobacterium substugae
atgaataagccggagttttttgtcgatacctcgatgggcgagctgctggcgcaaacccggcgcaatttcgccaagcgtcccagatggtggcacggcgtgtgcgggcgcctgctgcacacccatccgccaaccttcatcgcggcagaggacggcctgcaggaaatctatcgccagcagaggctgctgttcaaccacggcagcgtgcgctgggccgcgctggtgcaggccaaccgcttgctgttcgaggttggcggctatgatcacccgctgttgctgctgcattccggcgacccgtatttcgatcgccagccgcaagcgctggcggtgttggccagcgatttgtaccagttgaagaacactgagcaggcggacgaggagcgggcgcggctggcccagctggtgacggacgaaatgggccgctgcctgagcatgaccttgccgcaggcctggtccgagcgtcccgtcgaggcgtccaccgcgatgttcttccgccgttacgcgccgaatgcgcgcatcaccgggcgctggtatccgattctgacccatccgtcgacgccggcggtgctgcagttgcccaagctgttctggccggagcggctggcgcagatgtgggaaaacggagacttgcactga

SEQ ID NO: 677 - DNA, 342 bp, Chromobacterium substugae
atgagcgaagaattgaagatggaagacctggtggtgggcgagggcaaggaagccgtgcgcggcgctctgatcaccacccattacaccggctggctggaggatgggacccagttcgactcctccatcgacaagggccggccgttccagtgcgtgatcggcaccggccgcgtgatcaagggctgggaccaggggatgatgggcatgagagtgggcggcaagcgcaagctgtgggtgccggcgcacctggcctatggcgagcgccagatcggcgaccgcattccggcccattccaatctggtgttcgagatcgagttgctggaagtgctgacgcgcgatgaataa

SEQ ID NO: 678 - DNA, 804 bp, Chromobacterium substugae
atgaaaatgccgaaactgggcgtgggcaccttccgcctgaaggatcaacaagccgaagaatcggtggcgatgggcctggagctgggctaccgccacatcgacaccgcgcagatctaccgcaacgaggccgacgtcggccgcgccatcgccaagggcggcgtgccgcgcggcgaactctacgtcaccaccaagatctggaccgacaagttcggccccggcctgctgatccccagcctgcgcgagagcctggacaagctgggcctggacagcgtggacatggcgctgatccattggccgtcgcccaaggacgaagtgccggtggcggtgtacatggaacagctggcggaggcgaagcaactgggcctgacccgcgacatcggcgtgtccaacttcaccatcgcccacctgaagcaggcgatggacgccgtcggcgccgacgccatcggcacccaccagctggaagtgcatccctacctgcaaaacctgaaggtgcgcgatttttgccgcgagcacggcatcgcgctgaccggctacatgccgctggcctacggtcgcgttgtcagcgatccggttctgcaagccatcggccagaagcatggcgcgacggcggcgcaggtggccttggcctggcagctgcggcaggacatcgcggtgattccgtcgtcgaccaaacgcgccaatctggcggccaatctggacgcgctgacgctgcgcctggacgaggacgacatggcgcgcatcgccaagctggaagacggcggccgcatcgccgatccggatttcgccccggcctgggacgcctga

SEQ ID NO: 679 - DNA, 1194 bp, Chromobacterium substugae
atgcctctcgcactttgggcgctgacgctcagcgccttcgccatcggcacgacggaattcgtcatcgtcggcctgattcccaccatctccgccagcctcggcgtgtcgctgccgtcggccggcctgttggtcagcctgtacgcgctgggcgtggccgtcggcgcgccgctgctgaccgcgctgaccggccgcctgccgcgcaaatggctgttgatcgggctgatggccttgttcaccatcggcaatctggtggcctggcaggcgccgggctaccaggcgctgattgccgcccggctgctgaccggcctggcgcacggcgtgttcttctcgataggttcgacgctggccaccggcctggtgcccaaggacaagggcgccagcgccatcgcgctgatgttctccggcctgaccgtggcgctggtgaccggcgtgccgctgggcaccttcatcggccagcatttcggctggcaggccacctttctggcggtgtcgctgctgggtgttgtggcgctgctgggcagcctggcgctggtgccgtccaatctgcccaagccggcgccggcttcgctgtccagccagctggcggtgctggcgcagccgcggctgctgctggtgtacgcgatgacggcgctgggctacggcggctccttcaccgctttcactttccttgcgccgatgctggagactgtgagcggcttcgcgccgggcgcggtggcgctgatcatgctgctgtacggcgtgtcggtagccatcggcaatatctggggcggccgcctggccgaccgcaaggggccggtggccgcgctgaagatcattttcgcgggcttggcgctggtgctgctggccctgaccttcaccgccggctccaagtggctggtggcgctgacggtgctggcctggggcgcggtggccttcggcaacgtggccggactgcagctgtacgtggtgtcgcaggccagggcgcgggtgccgcaggcggtggacgtggcctccggcctcaatatcgcggctttcaatgtcggcatagccggcggcgcctggctgggcggccacgtggtggccagcctggggctgatggccacgccttggataggcgcattgatcgtgctgggggcctggctgttgaccgcctggtcgggtaggctggatgccggccatgcttcgggcatgacggttgccgccggccgcatctga

SEQ ID NO: 680 - DNA, 948 bp, Chromobacterium substugae
atgctgagcacggaaagcctgattacctttatcgccatcatggattgcggctcgttcaccgccgccgccgagcaactgggcgtcaccgcgtccaatgtcagccgcagcctggcgcagctggaaaagcagctgggcgtgcgcctgctcacccgcaccacgcggcggctggagctgaccgaggaaggcgcctggctgctggagcgcgcccgcgccatcgcgcaaagcctggacgacgccgaacagcagctgcaggccgcggcggcgcgcccgtccggcctggtgcgcgtcaacgccgccatcccggtgctgaatcatctgctggcgccgctgctggccggtttccaggcgcgctatcccgacatccggctggagctgaccggcgccgaagccgtggtggatttgatagaggaacgcgcggacctggcgatacgcgtcggcccgctggccgactcgacgctgaacgcgcggctgctgtgcgaaagcccgctgcgcatcgtcgccgcgcccggctatctgcggcaacgcggccatccccgaagcgcggcggacttgccgggccaccgcctgctcggcttcaccagcccggccacgctgaacctgtggccgctgggcgcgcgcggcctgaaagtgtcgccgtcgccggccgcctccagcggcgccacgctgcgcgcgctggcgctgcaaggctgcggcatcgcctgcctggcggactttctggtggggccggacatcgccgccggccgcttggcggacatccgcttgccggaacagcaggactggaaacagccgatctgggcggtgttctacaaacagggccggccgcaaccgcgcgtcgcctgcctggtggactacctggcggcggcgctggcggagccggccggcggctccccgcccgcaagccagcacgccgccgcggccgccaacccttcccccgcccatccaacatga

SEQ ID NO: 681 - DNA, 711 bp, Chromobacterium substugae
gtggtggtgggcgtcggcgaccaggcgtttccgccatacaagctgggcaaccagacgctggacccgcgccgcccgggcctgtcggtggagctggttcgcctcgccagccaaagctgcggactgcaggccgatttccggctactgcccggcgcccggctgttgaaggaattggaaaacggcaatgtcgacgcggtgatgatgctttcctacacgcctgaacgcgcccgcttcgccgtctatccgctgcgcagcgggctgccggacgaagcccgccggctagcgacgctcagctacgtgctgtacgcgctcaagggcagccggctggcctgggatggccatcatctgtccaatcaaaaacgcgccatcggcaccaacgccggctggtccatcaacctggatctgcagcgcatggggattccggccgaggccgccaacagcgtcgaacagaatttcgacaagctgctcagccgccatatcgacggctacgcggtgcacgaatcgctgggcgacgcgtacctggcgcgccatccggcgctgccggcgcgcaagctgtcgccgcctatcagcaccaagccctacttcctgccgttttcgcgccgctacgccgccacgcagcccaggcagatgcagtgcgtctggcaagccatcgccgccaatcgcgacgaattgctgcggcagcgcatcgccgcttatctggacgacaagcgctga

SEQ ID NO: 682 - DNA, 156 bp, Chromobacterium substugae
atgaagattttcatcttgttgagcttgttgattgcgctggtggcgtatctttccggcaacagtgtttggtgggggctggcgcctattggcgtggcagccatcctgctgctgttgctgatcgtgatggcgttggtgcagcttaagcagcgcaggtaa

SEQ ID NO: 683 - DNA, 120 bp, Chromobacterium substugae
ttgcatggcgtttctccagtggattccgggatggatgcggtatggcgatacggtgctgctgatggcgcgcttattgctaggaagtgcgttctccggcgaagttcccgcggacaaagatag

SEQ ID NO: 684 - DNA, 783 bp, Chromobacterium substugae
atgcaattgaacggaaaagtcgccctgatcaccggagccgccagcggcataggcaaggaaatcgccattgtgtacgccaaggccggcgcggcggtggccatcgccgacatcaatctggacgccgcccgcaagaccgccgacgaaatcgcctccgccggcggcaaggcaatcggcgtggcgatggacgtcaccaacgaggacgcggtcaaccagggcacccagcaggtggtggacgccttcggccggctggacatcctggtgtccaacgccggcatccagatcgtcaatcccatcgtcaactacagcttcgccgactggaaaaagatgcaggccatccacgtggacggcgccttcctcaccaccaaggccgcgctgcagcacatgtacaaggacaagcaaggcggcgtggtgatctacatgggatcggtgcactcgcacgaggcctcgccgctgaaatcggcctacgtcgccgccaagcacgcgctcttgggcctggcccgggtgctggccaaggaaggcgcgccctacaatgtgcgctcgcacgtgatctgccccggcttcgtgcgcacgccgctggtggacaagcagattccggaacaggcgaaggagctgggcatcagcgaggacgaagtcgtcaagcgcgtgatgctgggcaataccgtcgacggcgtgttcaccacggtggacgatgtggcgcagaccgcgctgttcctggccgccttccccagcgccgcgctgaccggacaatctttcgtggtcagccacggctggttcatgcaataa

SEQ ID NO: 685 - DNA, 1209 bp, Chromobacterium substugae
atggcgcaaaccaagctcaacccggcctgccacgtcgacgccggcatccaccacagccccgccctgcccgccggccaccgctaccaggtggtggcgctggtgctgcaaggcggcggcgcgctgggcgcttatcaggccggcgtctaccaggggctggccgaggcgaacctgcaccccaactgggtggccggcatctccatcggcgccctcaacgccgccatcatcgccggcaacccgcccgaaacgcgcgccgacaagctggagcagttctggaacaccatcagccgccagccgctgctgccgcccagcccgcacaatctgctggacctggggcagacgctgccgccgtcgctgcagggcctgttcaacggctgggaagcctggcgcgcgctgaccgaaggccagaacggcttcttcgtgccgcgcaagctggtcggcgccggcagcctgctgcgccccggcaacgccagtttctacgacacctcgccgctgaagagcacgctggaaaagctggtggatttcgaccgcctcaacgacagcggcgaaatgcgggtgtcggtgggcgcggtgaacgtgagaagcggcaacttcgtctacttcgacaacacccgcgaaaggctgcgcgccgagcacttcatggcctccggcgcgctgccgccgggctttccagcggtggagatagacggcgagcactactgggacggcggcatggtgtccaacaccccgctgcagcaggtgctgacggcccagccgcgcaagcattcgctggtgttccaggtggacctgtggaacgcgcgcggcgcgctgccggaagacttgtccaaggtggcgctgcggcagaaggacatccagttctccagccgcacccggatgatcaccggctatatgcaggaagcccagcagtttcgccagatgctgcgcgaagtgctggaactggtgccggaggagaagcggcaggcgccggcctaccgacgcgccgcccagcaagcctgcgaccggctgttcaacgtcatccacctgatctatcaggacaaaccctgcgaaggccactacaaggactaccagttcagcgccagcaccatgcgcgaacactggcagagcgggctgtccgatatccgccgcagcctcagccaccccgactggctgcagatgccgccgccggagcggcccttcaccacccacgacgtgcaccggctccaccaggcctaa

SEQ ID NO: 686 - DNA, 738 bp, Chromobacterium substugae
atggcggcaatccaagacaaggtggtggccattaccggcgcgagcagcggaatcggcgcggcgaccgcgctgctgttggcggagcgcggagcgaaggtggtgctggcggcccgcggcgagcggcgcttgcgcggcctggccgagcggatagcgcaagcaggcggacattgcgcctggacttgcgcggatgtccggcggcgggaggacgcgtcgcggctggtgcggctggcgtgcgaacgctacggcaggctggatgcgttgatcaacaatgccggcgtcggcccgatctcccctctcgacgaattgcgcgtcgacgattgggagcagatggtggacgtcaacatcaaaggcgtgctgtatggaatttacgctgctttgccggtgtttcgcgcgcagggtttcggccatttcatcaataccgcgtccaccgccgcgcagcgcatcctgccgaacatggcggtgtatgcggccagcaaggccgcggtgcgcgcgatttcggaaggcctgcggcaggaggccggcgacaagctgcgggtcactgtgatctcccctggcttcacgcgcaccaacttcgccgaatcgatgaccaatcgggcggtgaaagcgcacatcgccgccagcatgcaggcattcgcgctgccgccggaagcggtggcccgcgcgatagccttcgccatcgaacagccggctgatgtcgatgtgggcgaaatcatcatccggccgacggcgcaggcttag

SEQ ID NO: 687 - DNA, 948 bp, Chromobacterium substugae
ttgatcgtacaaatctccatggacccgctttccgatatcttccacctgctcaaagtcgaaagcgtgctgtcggcgcggatcgaggcgcatggcgcttggtcgctgcggttttccgcctaccagcacatcaaattcggcggcgtgctggcaggctccttctggctgtggtttgaagatggcgcgccgccgctccggctgaagccaggcgacttctacctgctgacccaaggacagccgtattgcgccggcagcgatccggcgctcgctcctgtcgacggccgcgaggtgcttgccgcaaacctgtgcgcggatggcattgtacgttatggccagggcggggagacggtcagcgcggcaggcggccgcttcgtcttcgagccccactccagcgccttgctgctgcaagcgctgccgccgctgatccatattccggcggcgtcggcaagcgcgcaggccttgcgcgccacactggagctgctgcgcttggaaacggaggcatcccgccccggcgcgtcgatggccgccgccagcctggccaatatggtgctggtgcaggtgctgcgcgcccacctggcttccggcgcgcatacaccgggctggctgggcgcgctggccgaccccagaatcggcaaggccttgggcctgatgcatgccgacgtggcccggcattggaaagtggaggagctggcgtcggcagtggcgatgtcgcgcaccagctttgccgagcgcttccgggcgcgggtcggcatggcgcccatcgactacctgacccgctggcgcatcgccaaagccggcgccgcgctgagagccgggcaaagcctcgccgccgtcgcccaaagcataggctatggctccgaagccgccttccacaccgccttcaagcgcatcgtcgggcatagcccgggccgctatcgacggcggcaggccgcggaacccgcccaacgctag

SEQ ID NO: 688 - DNA, 303 bp, Chromobacterium substugae
gtggcgctggctgccgaagacgccttcggcgaacgcgacgaagcgctggtcaccaccatgtccaaggctgatttcccgcccggcatcaaggtaggcggccaattgcagcgtcccggcccggatggccagccgctctactatttcgtcaccaagatcaaaggcccgacggtattgctggacggcaaccacccgctgtgcggccaagacctgcgtttcgccctcaaagtcatcgatgtgcgtgaggcgaccgccgaggaaatcgctcaccagcatgtgcatggcgagcatgggcatcaacactga

SEQ ID NO: 689 - DNA, 942 bp, Chromobacterium substugae
atgtttgccaaagcggtagagcttggcagcatccgcaaggcggcgcaggcccaaggcgtatcaccgcaagcggcgactcagaccattgctttgctggaaaaacatctgggggtgcgtctgctgcaccggactacgcgcagcttggcactgactgaagaaggcctgcagtttttggaggatgcgcagccggcactggctacattggagcgcgcagtaagtaccgcccgtgcgggtagggaggggattagcggtccgctgcgcattgtcgggcccaagtcatcctttgccagcatcctgatgcccttgctggacactttttgccgcgagcaccctggcgttcgtcctgatgtccagctggacgacggcattggcaactgggtgctggaacgggtggatgtgggctttcggatcggggcgtcggcacaagatggggtgatcagccgccgcctattccccatccagctaatcgtttgcgctgcctctgattatctggcaaggcatggcatgccagatacgctggaagagctggcagcgcaccgttgcagtattttccgccaccccagtagcggcaaggtttcaccctggtatctaactatcgacggcagcgtggtgcagcgccacttttcacctgctttttacagcaacgataccgagttggagctgcaggccatgctggccggtcaggtgatcggacaagttgctaatctgtcggcagcgccgcatatccgtgcaggccgtctgattccggtactgttgccttttatgagcgcacccattgccctccatgtctactatggcagccgggcggcacaacccagccgagtgcggtcatttctcgatctggccatatcgaagttatctgacagcccagactatgtgctgtcttcaatcgagctggctgccgctcacgccgcatttgccgcgcgacggtatccgctatga

SEQ ID NO: 690 - DNA, 855 bp, Chromobacterium substugae
gtgaatcatatgaaagaaacccttgtcgtcgtcggagccgggcagatcggccaggccatcgcgcgccgaattggcgttggcaaacagatcatgctggcttcgctacgaatagaagaggccgaacaggcggtggaactgtttcgccatgccggtttcagcgccaccgcagccagtgtggacgtgagctcgcgcgcttctgtcagcgcattggtggaacaggcctgccagttggggccgatcaccgggctgatccacgccgccggcgtatcgccctctcaagcgccggttgccgccattttgcgggtggatctgtatggtacggcgctggtgttggagctgtttggcaatgtcatggcctccgggggctctgccgtggtcatcgcctcgcagtctggccaccgcctgccggcactgagtcagcagcaggatcggttactggcgctgacaccaacggaagaactgctgcaactggattttctgcaacctgggcaagtgcttgacaccctgcatgcctaccagttgtccaaacgtgccaactcactgcgggtgatggccgaggcggtacgctggggcccgcgtggagcgcgggtgaataccatcagccccggcatcatcatcaccccgttggccaacgacgagttgaacggcccgcgtggcgccggctatcgcagcatgattagcgccagcccggtgggacgtgccggaacccccgacgaagtaggccatgtcgcggccctgctgatggggccggatggcacttttatcacaggcagcgacattctgatggatggcggcgtgacctcagccttccgttttggggacattgcacagccggtcgcgcagggaggagcctga

SEQ ID NO: 691 - DNA, 1059 bp, Chromobacterium substugae
atgagctaccgcgttaaaagttatgcggcacaatcctccagcagtccgctggccccgtttcagtttgaacgccgcattccccgtgcagacgatgtggtgatcgagattctgtattgcggcgtctgccattccgatgtccacaatgtacgtaacgattggggcaatgccaattatcccatggttcccggtcatgaaatcatcggcagggtcattgccaccggagctggcgttactcgtttcaaggagggcgatcacgtcggtgttggctgcctggtggcctcctgccagcgctgcgacgcctgtgaccatggccacgagcagtactgccagaatggcgctacctacacctataaccacaccgacccgatagacggcacgcgcacttttggcggttatagcgaaaagatcgtggtggcggaagactttgtcctgaaagtaccgaatacgctggacctggccggtgcggcacccttgctgtgcgcaggcatcaccacttattccccactgcgccactggaaagtggacaagagcagcaaggtggcgattgtcggcctgggggggctcggacacatgggattgaagttggccaaggccatgggggcggaggtgacattgttcagccgttcgccgggcaaggagcgtgacgcgcgcaggctgggggctgaccatatcgtcatttccaccgatgtacagcagatggccgccattgcgggccgcttcgacctcatcatcaacacggtgccctacaagcatgatgtcaacccctacattccgacgctggcctccggcggcaccatggtgatggtgggctatctggggccgctggataacttcaataccggaccgctggtattccgccgcaaggcattggccggttcgctgatcggcggcattgccgaaactcaggaaatgttggatttctgcggcctgcacggcattcactccgatatcgagctgatcgccatccaggacatcaaccaggccttcgaacgcatgcttaaggctgatgtgaaataccgctttgtgattgacatgaacaccttgaaagagtccatatga

SEQ ID NO: 692 - DNA, 126 bp, Chromobacterium substugae
atgaaccacatcgccattcaggaggcgctagatggcaagtctgccacctggcaggaggcggtcagcgatgcggattatctcggtggtaagctagatgtcaatctgagcgatcagagcccgccgtaa

SEQ ID NO: 693 - DNA, 1830 bp, Chromobacterium substugae
atgtgtggcatcgttggcgccatcgccaagcgtaatatcgttcccatcctggtggatggcctgaagcgtctggaataccgcggctacgattcggccggcgtggccgtgctggccggcgacgaaatccgccgggtgcgccgcgtcggccgcgtcgccgaaatggaaagcgccgccgccgaggaaagcctgcaaggccagctcggcatcggccacacccgctgggccacccacggcggcgtgaccgaatacaacgcccacccgcacatctccttcggcaagatcgccgtggtgcacaacggcatcatcgaaaaccacgaagagcagcgccagcgcctgaaggatctgggctacgccttcgaatcgcaaaccgacaccgaagtgatcgcccacctggtgcatcactattaccagtccggcgacagcctgttcgacgcggtgaaaaaggccacccgcgagctgaccggcgcttacgccatcggcgtgatcgcgctggaccgcccggacgaactggtgtgcgcccgcatgggctgcccgctgctggtgggcctgggcgaaggcgaaaacttcatcgcctccgatgtctccgccatcctgtccgccacccgccgcgtgatcttcctggaagagggcgacatcggccacctcacccgcgacggcgtcaaactgatggacaagcacgaccaggccatcgagcgcccggtgcatctgtccgacgtctcgctggcatcccttgaactgggcccgtacagccacttcatgcagaaagaaatccacgagcagccgaaggcgctgtccgacaccatcgaagcggtgcaggactacggcttcaaccccgagctgttcggcgacgccgccgccggcatcctgccgcaactggaaggcgtgaagatcctggcctgcggcaccagctactacgccggcctcaccgccaaatactggatcgaaagcatcgccggcctgccgtgcgatgtggaaatcgccagcgaataccgctaccgcgacgccttcgccaaccccaagcacctgatcgtcaccatctcccagtccggcgaaacgctggacaccatggaggcgctgaagtacgccaaggagctgggccaccagtacgcgctgtccatctgcaatgtgcgcgaatccgccatcccgcgcgccagcgatctggtgttctacacccgcgccggcgccgaaatcggcgtggcctccaccaaggccttcaccacccaactggtgggcctgttcgcgctggccgccaccctgggcaaggcgcgcggccgcgtatcggctgaaatggaagcgcaatacctggacgaattgcgccacctgccgggcagcgtgcagcacgcgctgaatctggagccgcagatcaaggcctggtccgagcgcttcgccgccaaggacgacgcgctattcctcggccgcggcctgcattacccgatcgcgctggaaggcgcgctgaaactgaaggaaatctcctacatccacgccgaggcctacccggccggcgagctgaagcacggcccgctggcgctggtggacgagaacatgccggtggtggtgatcgcccccaacgacgcgttgctggaaaaggtgaagtcgaacatgcaggaagtgcgcgcccgcggcggcgagctgttcgtgttcgccgacgccgacagccatttcagcgagtccgacggcgtgcacgtgatccgcaccccgcgccacgtcggcatcctcagccccatcgtccacaccatcccggtgcagatgctggcctaccatgtcgcgctgtcgcgtggcacggatgtcgacaagccgcggaatttggccaaatcggtgacggtggagtaa

SEQ ID NO: 694 - DNA, 795 bp, Chromobacterium substugae
atgacgaaacgaaacacccaacaacgccgccatgccatcgccaccctggtgcaggagcgcggcgaggtcagcgtggaagagctgacccagcgtttcgccacctccgaggtcaccatccgcaaggacctggcgctgctggaaaccggcggcctgctgctgcgccgctatggcggcgctgtgtcgctgcccagcgaaatggcggccgagccggatgtcggccaggtttcgaaacgaaagcaggcgatcgcccgcgcggcggcggaacgcatccgcgaccacaaccgcgtgatcgtcgacagcggcaccaccaccagcgcgatgattccgctgctgggcagcaagcgcggcctggtggtgatgaccaactcgctgaatgtggccggccaactgcgcgagctggagaacgaacccatcctgctgatgaccggcggcacctgggacccgcattcggaatcgttccagggccagatcgccgagcaggcgctgcggtcctacgatttcgaccagctgttcatcggcgccgacggcatagatctggagcgcggcaccaccaccttcaacgaactggtgggcctgtcgcgggtgatggccgaagtggcgcgcgaagtgatcgtgatggtggagtcggaaaagataggccgccgcattcccaatctggagttgccgtgggacaagatccacaccctggtgaccgacgacggcctggcgcaggacgccagagacaagattcaagcgaagggcgtgacgctgatttgcgcgcccgcagttcaagacagcagtgcaaggagaaaataa

SEQ ID NO: 695 - DNA, 1365 bp, Chromobacterium substugae
atggatagtctcagcatcgttattcttgccgccggcaaaggcaagcgcatgtattccactatgccgaaagtgctgcacccgatagcgggcgagccgatgctggcgcgggtgatccgcaccgcgcgcggcctcaatccttcccgcctggtggtggtgtacggccacggcggcgaccaggtgcgcgcccggattccggacgccgatatcgtctgggccgaacaaaccgaacaactcggcaccggccatgcgttgaaaatggccttgccccacctgccgcaagacggcaaaaccctggtgttgtacggcgacgtgccgctgacccgcgcctccacgctgcaacggctgatcgacgccgccggcagcggcatggcggtgctgaccgacgtgctggccgacgccagcggctacggccgcatgctgcgcggcgccgacggcaagctcaaagccatcgtcgagcacaaggactgcacggcggagcaactggccatccgcgagatcaacaccggcatgatggcgctgccgaacgcgcaattggccggctggctgaacgcgctgaacaacggcaacgcccagggcgaatactatctgaccgacgtgctggagctggcggtgaaagacggcgtggcggtggaaagcgccagcgtcgatgccagctgggaagccgccggcgtcaacaacaagctgcagctggccgagctggagcgcatcctgcagaccaatcaggcgcgcgccttgctggaagccggcgtcacgctggccgatccggcgcgcatcgacatccgcggcgagctgaaacacggcatggacgtcagcatcgacgtgggctgcgtgttcgaaggcgtggtggagctgggcgacaaggtgcttatcggcgccaactgcgtgttgaaaaacgtcaagatcgccgccggcagccagatcgcgccgttctcgcatctggaagacgccatggtaggcgaggaatgccggatcgggccgtacgcccgcctgcgtccaggcgccgacctggccggccatgtgcacatcggcaacttcgtcgaagtgaagaagagcaagatcggcgatggctccaaggttaaccatctgacctatatcggcgacgcggaaatcggccgcaaggtgaacgtcggcgccggttccgtcacctgcaactacgatggcgtcaacaagttcaagaccgtgatcggcgacgatgtattcgtcggctccggcaccttgatggtggcccctgtgacgctggaagacggcgcgaccatcgccgccggctcggtgatcaacaagaccgccccggccggcgagctgaccgtggcgcgcgcgcgccaggtgacgattccgggctggaagcggccgcagaaaaagtcctga

SEQ ID NO: 696 - DNA, 423 bp, Chromobacterium substugae
atgtccaagatgcgtgtggaagtggttagcaccgagcaactcatcttctccggcgaggcggaattcgtcgtcgcgccggctaccgaaggcgagatcggcgtctacccgcaacacgtgccgctcctgacccgtatcaagcctggtgtcctgcgccttcgcgtgccggacagcaaggaagaagtactggtggcggtgtccggcggcatgatggaagtgcagccgagcctgatcaccgtgctcgccgatacggcgatccgcggcgaggatctcgatgaggcccgcgccaatgaggcgaaacgcgctgccgaggacgccctcaagcacgcgaccgacgacatgagcacggccaaagcccacgccgcactggcggtggcgattgccgagctcaagacgctggactacctcaagaagcgcgctcactga

SEQ ID NO: 697 - DNA, 1398 bp, Chromobacterium substugae
atgagccaaggcaaaatcgtacaaatcattggcgcggtgatcgacgtggaatttccgcgcgacgccatgccgaaggtttatgatgccctgaagctggtagacgccgacctgacgctcgaagttcagcaacagctgggcgacggcgtggtccgtaccattgcgatgggcagctccgacggtctgaagcgtggcatggccgtagccagcaccggcgcaccgatttcggtgccggttggcgccgccaccctcggccgcatcatggacgtactgggcaacccggtggacgaagccggtccggtagcgaccgaagcgcgtcgcgccattcaccaagctgcgccgaagttcgacgaactgtcggccgcctccgacatcctggaaaccggcatcaaggtaatcgacctgctgtgcccgttcgccaagggtggcaaggtaggcctgttcggcggcgccggtgtgggcaagaccgtcaacatgatggaattgatcaacaacatcgccaaggcccactcgggtctgtccgtgttcgctggcgtgggtgagcgtacccgtgaaggtaacgacttctaccacgaaatgaaggactccaacgttctggacaaggtagcgatggtgtacggtcagatgaacgagccgccgggcaaccgtctgcgcgtggccctgaccggcctgaccatggccgagcatttccgcgatgagaaggacgaaaacggcaagggccgcgacgttctgttgttcgtggacaacatctaccgctacaccctggccggtaccgaagtgtccgctctgctgggccgtatgccgtccgcggtgggttaccagccgacgctggccgaggaaatgggccgtctgcaagaacgtattacctcgaccaaggatggttccattacctccatccaggccgtatacgtacctgcggatgacttgaccgacccgtctccggcgaccaccttcgcccacttggacgcaaccgtggttctgtcgcgcgacatcgcctcgctgggtatctacccggccgtggacccgctcgactccacctcgcgccagctggacccgctggtcgtaggcgacgagcactacaccatcgcccgcggcgtgcagtccaccctgcagcgctacaaggaactgcgcgacatcatcgcgattctgggtatggacgaactgtccgaggaagacaaactggtcgtggctcgcgcccgtaagatccagcgcttcctgtcccagccgttccacgtagccgaagtgtttaccggttccccgggcaaatacgtgccgctgcgcgaaaccatcaagggcttcaaggccattctcgctggcgaatacgaccacctgccggaacaagcgttctacatggtgggttcgatcgaagaagctgccgagaaagccaagacccttaactaa

SEQ ID NO: 698 - DNA, 867 bp, Chromobacterium substugae
atggcagtcggtaaagagattctcaccaagatccgcagcgtgcaaaacacgcagaagatcacccgcgctatgcagatggtgtcgacctcgaagatgcgcaaaacgcaagagcgtatgcgcgctgcccgtccttacgccgagaaggtgcgcacggttatggcgcacctcgctcaggcgaacgcggaacttggtcaccccttgcttgcccgtcgcgagacgatcaagcgcgccggcatcatcctggtttcctccgacaagggcctatgcggcggcttgaacgtgaactcgttcaagcgcttcttcgccaaggtcaaggaactgcaggatcagaacgtcgaaatcgacgtttgctgcctgggccaaaaaggcctgggagctgcccagcgcgctcgtctgaacgtggtggcaagcgcggttcatctcggcgatacgccgaagatggaaaaactgattggcccgcttacggttctgttcaagcagtacgccgaaggcgaactggacgcggtctacatcgtctactccagcttcgtgaataccatgaagcaggagccggcactcgaacagctgcttccgctgaccccgcaccacatggtggtggagcattcgcactcgtgggattacctgtacgagccggatgcgccgacgctgatggagttcctggtgcgccgttatctggaatcggtggtgtaccaggctctggccgagaacatggcttccgagcaggccgcgcggatggtggcgatgaaagccgccaccgacaacgcgggcaacaccatcaagcagctgcgcctggtgtacaacaaggcgcgtcaagcggcgattacgaccgagctgtcggaaatcgtggccggtgccgcggcggtgtaa

SEQ ID NO: 699 - DNA, 1545 bp, Chromobacterium substugae
atgcagttgaacccctctgaaatcagcgatctgatcaaggccaagatccagaatctggctgaaggcgctgaagttcgcaccaagggcacggttatctccgtgaccgacggtatcgtccgcatccacggcctggccgacgtgatgcagggcgaaatgctcgaatttccgggcaacacctttggcctcgcgatgaacctggagcgcgactctgtcggcgccgtggttctgggcgagtacgagcacatctccgaaggcgacgaagtcaagtgcaccggccgcattctggaagtgccggtgggtccggagctgattggccgcgtggtcaacgctctgggtcagcctatcgacggcaaaggcccggtcaacgccacgaaatcgtccccgatcgaaaagatcgctccgggcgtgatcgcgcgtcaatcggtatcgcagccgatgcagaccggcctgaagtcgatcgactccatggttccggttggccgcggccagcgtgagctgatcattggcgaccgtcagaccggcaagaccgccgtggcgctggacgccatcatcaaccagaagggcaatggcgtcatctgcatctacgtagccgtaggtcagaaggcttcctccatcgccaacgtggttcgcaagctggaagagcacggcgcgatgggtcacaccatcatcgtggccgccaccgcttccgaagccgccgccctgcagttcatcgctccgtactccggctgcgcgatgggcgaatacttccgcgacatcggcgaagacgcgctgatcgtgtacgacgacctgtccaagcaagccgtcgcctaccgtcagatctcgctgctgctgcgccgtccgccgggccgcgaagcctatccgggcgacgtgttctacctccactcccgtctgctggagcgcgccgcgcgcatcaacgaagacgaagtggaaaagctgactggcggcgccgttaagggcaaaaccggttcgctgaccgctctgcctatcatcgaaacccaggccggcgacgtttccgcgttcgttccgaccaacgtgatttcgattaccgacggccagatcttcctggaaaccgacctgttcaacgcgggcatccgtccggccatcaacgccggtatctcggtatcgcgcgtgggcggcgccgctcagaccaaggtgatcaagaagctcggcggcggtatccgtctggctctggcccagtaccgcgagctggctgcgttcgcgcagttcgcttccgatctggacgaagccacccgcaagcagctgtcgcacggcgaagtggtgaccgaactgatgaagcagaagcagttctccaccctgtcgaccgcggaaatggcgctgaccctgtgggcggtgaacaagggctcgtacgaagacgttccggtgaagaaggccctggccttcgaagccgagttcctggccaacgtgcgtgccaaccacgccgaagtgctgcaggccgtgaacgcttccggtgatctgtctgccgacaacgagaaggtactggccaaggcgatggaatcgttcaaggctggctacagcttcaactga

SEQ ID NO: 700 - DNA, 537 bp, Chromobacterium substugae
atggcagaactcattaccgtcgcaaggccctacgccgaagcggtatacagcctggccaccgaacagcgtagcctcgatcagtggtcggatgcgctgtcgtggctggctgccatggtgaacaacccggatctggcgcaggtagtcaccaatccgaaacataccgcacaagaggttgaggcgctgatgctggatgtgctcggcggccgcggcaacgaagacgtgaaacgcttcatcgccgcgctgatcgagaacgcccgtttgacgctgctgccggaaatcgccgcgcagtttgaactgctgaaggcgcaatcggaagacatagtggacgcccaggtggagtccgcttttgccatgtccgatgcacaacaagccgaactgaccaccacgctttccaagaagtacggcaagaccgtgcgtcttgacgtgcgtgaaaaccccgacctgattggcggggtgcgtgtgctggttggcgacgatgtcatcgacgcttccgtgcgcggcaaactgcaagcaatggcagcaagcctcaagaattag

SEQ ID NO: 701 - DNA, 471 bp, Chromobacterium substugae
gtggaattcaacgtaacactactgggccaggcgatcacgttcgccatcctggtatggttcaccatgaagtttgtttggcctccgcttaccaacatgatggatgagcgggccaagcgtatcgctgatggcttggccgctgcggaacgcggcaagcaggatctggaagcggctgaaaagcgcgttgcggacgaaatccgcaaggccaagcagcaagctaccgagatcgtggttgcagccgagaagcgcgccaaccagatcgtggacgaagccaaggacgcggcccgcaccgaaggtgcccgcatcgtggccgacgccaagtcggaaatcgatcaggaagtgctgcgcgccaaggaatccctgcgcgcgcaggtggccgaactggccgtcgccggcgcagagaagatcctgcgcaaggaaatcgacgccgccaagcacgccgacctgcttgcctccatcaaagcggagttttaa

SEQ ID NO: 702 - DNA, 288 bp, Chromobacterium substugae
atggaagcactcgtttctcagatccagtcgatgaccgctatcgctgcagccctgatcattggtctgggcgctctgggcaccgctatcggtttcgccattctgggcggcaagttcctcgagtcctccgctcgtcagccggaaatgatcccggttctgcaaaccaagctgttcatcatcgccggtctgcttgacgcgatctccatgattggtgtcggtgttgccatgctgttcaccttcaacaacccgttcctggctgccgctctggccgttgtcaaggctgcccactaa

SEQ ID NO: 703 - DNA, 813 bp, Chromobacterium substugae
atggcaagcaacgcaactgattacatcaagcaccacctcacgttctggaactcggacccgtcggccggcttctggagcctgcacgtcgacaccttctccatctccctgctgctcggcttcctgttcgtaggcgtgttcgccatggtggcgcgccgcgccagcatcgaagcgccgggccgtctgcaattgttcgtcgagatgatcatcgagctggtgcagacccaggtgcgcgaagtgttccacggcaagagcaagatgatcgccccgctggcgctgaccatcttctgctgggtgttcctgatgaacttcatggacctgttcccggtggatctgttcccgatggccgcgcaatggatcggctacaccttcttcggcctggagccgcatcacgtgtacttccgcgtggtgccgtccgccgacgtgaactccactttcgccatgtcgctgtcggtgctgatcctgatcgtcggcttctcgatcaaggccaagggcctgggcggctggggcaaggaactgttgaccgcgccgttccacagctcccacccggtgggcgccgtgatcctggccccgctgaacttcgcgttccagctggtagagctggccgccaagccgatttcgctgtctcttcgtctgttcggtaacctgtacgccggcgaattgatcttcatcctgatcgcgctgctgccctggggcctgcagtgggtgctgggcgcgccgtgggcgatcttccacatcctgatcatcaccctgcaggccttcgtgttcatgatgctgaccatcgtgtacctgagcctggcagtggaagcgcactga

SEQ ID NO: 704 - DNA, 339 bp, Chromobacterium substugae
gtgctgcgcctgcaggccagcctggtcgggctggcagtgctgatttcgctgcttgtcggcgccggcagcctggtggtggcagtgtccaccttgctgggcgggatcgtggtgctggtgccggccctggtgtacgccaggatcgcctatgccaagcggcatgttcctcccgcggcgttgatcaaggcgcattttctggccgaagcggtaaagttttgcctgaccgtactactaagtggcgcggttttggctggtttcaaggatttgtccgtagtcggctttctcggtgggttctttgccgccatctccggctacggtttcgggcttctaatcaaaaattga

SEQ ID NO: 705 - DNA, 858 bp, Chromobacterium substugae
atggccaaactcaaaggattggggcgcggactcgacgcgctcctgtccaccgtcgacacggtggacgacagactgacttcccttcccatcgacagcatccgccccggcaaataccagccgcgcagtttcatggacgaaaccgcgctggaggagctggcggcttccatccgcgtgcagggcatcatccagccgctgatcgtccgcgatctgggcctgggcgactacgaactgatcgccggcgagcgccgctggcgcgcgtcgcgcaaggccggtctcgtcgaagtgccggtggtgatcaagagcgtgcccgacgaagcggcgctggcgatggcgctgatcgagaacatccagcgccaggagctggatccgatcgaagaggcgcagggcatcaagcgcctgatcgacgaattcggcctcacccacgagtccgccgccgacgcggtcggccgttcgcgcagcgcggtgtccaacctgctgcgcctgttggtgctgccgcaaccgctgcagcagatgatgcacgaaggccaactggagatgggccacgcccgcgctttgctgtctctgcccaccgtcgcgcagctggagctggcgcaggaggtggtgcgcaaggggatgtcggtgcgcgaggtggagcgccgagtgcaacagcatgatgcgcaaaaaaccacagttgccgcgcaacaaaatcgcgtcgatcccgatgtcgagcggctggaaaaccaggtgtcggaagcgataggcgccaaggtcagcattcgtcatgcaaacggcggaaacggcaggctggtcatagaatatgccagcctggacgagctggacgcgctgctggagaaactgcagaaaaaacctcaaaaatga

SEQ ID NO: 706 - DNA, 792 bp, Chromobacterium substugae
atgaatccacgcgtgatcgcggtggccaatcagaagggcggggtgggcaagaccaccaccgtcgtcaatctggcggccggactggccgagctgggcaagcgggtgctgatcgtcgatctggacccgcagggcaacgccaccatgggcagcggcatcgccaagcagtcgctggagaaatccggctatgacgtgctgttgggcgaggccagcgtggaggaggcgcgccaggacgccaaggcgggcggctaccatgtgctgccggccaatcgcgatctgggcggcgccgagctggagctggtcaacgagctggcgcgcgaggcgcggctgaagagcgcgctggctgaggtggaagaccagtacgactacgtgctgatcgactgcccgccgtcgctgaacctgctgaccctgaacggcctggtggccgcgcacagcgtgctgattccgatggtgtgcgaatactacgcgctggaaggcttgtccgacctggtgtccacgctgcgcaaggtgcggctggcggtcaaccccaagatcgagatcatgggcttgctgcgcaccatgttcgacgcccgcaacaatctgtcgcaacaagtgtcggcgcagctggcgcgccacttcggcgacaaggtgttccagaccgtcatcccgcgcaatgtgcgcctggccgaggcgcccagccacggcttgccggggctggtctacgatcgcaactcgcgcggcgcgcaggcttacctgacgctggcgcaagagctgatcgaacgactagaacccgcaaccgcaactcccaccgtctga

SEQ ID NO: 707 - DNA, 630 bp, Chromobacterium substugae
atgacacaacatatcgcagaattgcagcaagggctggccgcgctggccctggacttcactgaatcgcagcaggttttgctgcagcgctacctagcgctgctagtgaaatggaaccagacttacaatctcaccgccatccgccaggaagagcggatggtcagctatcatctgctggacagcctgagcctggtgccgcacctggccggcggcgcgcgcatgctggacgtcggctccggcggcggcatgccgggcattcccaccgccatcgcgcggccggatatgcaggtggtgctgttggactctaaccacaagaaaaccaccttcctgcgccaggtggtggtggaattgggcctggccaacgtccaggtggtgaccgaccgcgtcgaggcctatcagccggagcagaagttcgatcgcatcaccagccgcgcgttctcggaactggccgagttcgtcaagctgacccgccacctgatggctgaagacggccagtacgtggcgatgaagggcgtgtatccgtatgaggaaatcgccttgctgccgcaaggcgtggcggtttcggaggtgctgccggtaacggtgccggggctggacgccgaacgccatctggtgaggatggtgctgcaatga

SEQ ID NO: 708 - DNA, 1902 bp, Chromobacterium substugae
atgatttatccgacaagcttcgacgtgatagtggtgggcggcggtcacgccggcaccgaggccgcgctggccgcggcgcgcatggggtgcgccaccctccttctgacgcacaatatcgagaccctgggtcagatgtcgtgcaacccgtcgatcggcggcatcggcaagggccatctggtgaaagaggtggacgcgctgggcggcgcgatggcgctggccaccgacatcggcggcatccagttccgcacgctcaacgcctccaaaggcccggcggtgcgcgccacccgcgcgcaggccgaccgcatcctgtacaaggccgccatccgcgagatgctggaaaaccagcccaacctgacgctgttccagcagccggtggacgacctgttgatggacggcgaccgcgtcgccggcgccatcaccgccatcggcatcaccttccgcgccaagaccgtggtgctgaccgccggcaccttcctgtccggcaagatccacgtcggcctggaaaactacaccggcggccgcgccggcgaccaggcggccagcacgctgggcgcgcgcctgcgcgaattgaacctgccggtgggccggctcaaaaccggcacgccgccgcgcatcgacggccgcagcgtcgatttttccgtgatggaagagcagccgggcgacacgccggagccggtgttctcctaccgcggcaagcgcgacatgcaccccaagcagttgccgtgctggatcacccacaccaacgagcgcacccacgacatcatccgcagcggcttcgaccgcagcccgatgttcaccggcgtgatcgaaggcgtcggcccgcgctattgcccgtcgatcgaagacaagatcaaccgtttcgccgacaaggacagccaccaggtgttcctggaaccggaaggcctgaccacccacgaattctatccgaacggcatctccaccagtctgccgttcgacatccagctggccgccgtgcgctcgatccgcggcatggaaaacgcccacatcctgcgccccggctacgccatcgagtacgactacttcgacccgcgcggcctgaaggcctcgctggagaccaaggccattcagggcctgttcttcgctggccagatcaacggcaccaccggctatgaagaagccgccgcccagggcctgctggctggcctcaatgccggcttgtacgtgcgtgagcaagccgcctggtgcccgcgccgcgacgagggctacctcggcgtgctggtcgacgacctgatcaccaagggcgtgtccgagccgtaccgcatgttcaccagccgcgccgaattccgcctgcagctgcgcgaagacaacgccgacctgcgcctgaccgaaatgggccgcaagctgggcctggtcggcgatgcgcaatgggacgccttctgccgcaagcgcgatgccgtggaggcggaaaaggcgcggctggcggccacctggctgcatccgtccaaactgcaggccccggacgcgctggcgaacgtgttgggcaagcccatcgaacgcgaatacacgctgtccgacctgctcaagcgccccaatgtcgcctaccgcgacctgatgtcggtgccggacgccgcggccggcgcgccggagcttgacgaggtggttgccgagcaggtggaaattcaggtcaaataccagggatacatcaaccgccagaacgaagagctggcgcgccgcgacaatctggaagacatccgtctgccgggcgacatcgactacagtctggtgaagggcctgtccaaggaagtgcagcagaagctgaaccagcagcgcccggaaaccatgggccaggcttcgcgcattcagggcatcaccccggccgccgtcgccctgttgatggtgcacttgaagcgcggcttcaccgacgccacgaaaaccgcatga

SEQ ID NO: 709 - DNA, 750 bp, Chromobacterium substugae
atgctgctaaatgaacagcttgcaggcagaagcaaaccgcggctggccgtgcgcctggccgccggcgccgaagacatccgccgcgcgcagaagctgcgctacgacattttcgccggcgaaatgggcgcggaactggcgtcgcgggatttgggcatagattgcgacgaatacgacgagctgtgcgaccacctgatcgtcgaggaccacaacagcggcatggtggtcggcacctaccgaatgctgtcccccgccaacgcgcgccgcgcgccgcgcctgtactccgagcatgaattcgacctgtcccgcctttcccatctgcgcgatggcttgattgaaatgggacgttcctgcgtgcaccgcgacttccgctccggcgcggtgatcgcgctgctgtggtcgggcctggccgactacgtgagccagcgaggcggcgaatacctggccggctgcgccagcgtgtcgctgaccgacggtggccaccaggcggtcagcctgtatcgccagctggagggccaatacctggcgccggcggaatggcgggtgtttccgcacttgccgctgccgctggaccgagtggtggacgacaccgcgccggtgccgctgccgccgctgatcaagggctatctgcgcgccggcgcccacgtctgcggcgagccggcctgggacccggacttcaactgcgccgacttcttcatgctgctgccgatgagccggctgaacgcgcgctacaacaagcacttcatcggttga

SEQ ID NO: 710 - DNA, 687 bp, Chromobacterium substugae
atgacttacgctttcgaagcggtgggcgtgatccgctcgccctaccgcgaaaaattcggcatcccgcgccagccgtcgctggtcaacgccgcccgcgtcaccctggaattgctgccgccctacaaccaccccgactgcgtgcgcggcttgtccgagttttcccatgtctggatcagcttcatcttccaccagaccatggcgcgcggctggcaaccgctggtgcgcccgccccgcctgggcggcaacgccaaggtgggggtgttcgccagccgcgccacccatcggcccaatccgttgggcttgtcgctggtggagctggccggcgtggagtgcgacaacggcgtgcggctgcatctggccggcgccgacctactggacggcacgccggtggtggacatcaagccttatattccgttcgtggaatcgcggccacaagcccgcggcggcttcgtcgacggcccgccgccgcagctgacggtgcgatggagcgaacaggccttgcggcagctggccacgctggccgcgccgcccgatctggcgctgctggtggagcaggtgctggcgcaggacccgcgcccggcttaccaggacgaccccggtcgcgtctacggcgtgtcgctgtattgctacaatatccgcttcggcatccgcgaagacatcgccacggtgcttgaaattcttgaataa

SEQ ID NO: 711 - DNA, 1002 bp, Chromobacterium substugae
atgaccactcgcgcgaagacgatcgtactcgccttcaccatggtttccgtgttggccactccctttgccgaagccgcgcgcctcggcaagggcaagagcgcaggcatgcagcgctccgcccccacccgcacctatcaacccagcaccccggcgccgcaaccgatggccgcgccggctccgcgtccgggcgcgccggcccaggccgcgccgcagaaatccggcccgggcatcggcaccgcgctggcagccggcgccgtcggcgccgcggccggctacatgatcggctcttccggcaatgagaaacaggcggctccggcgcagcaaaacgccgcgccggtcgaacaacccgcccagcaggccgcgcaatcggccccggcccaacaggaaaaaggcggcatgccctggggcatgctggcgctgctgggcctggccctggtcggcggcatgatgttcttccgccgcaaagcgggcaatccggccgccaacgcgccgcaaccggccggcatgccgcagggcatgaacagccaggccggcggtttcgacgccgtgcccaagatcggctccggccttgacaacggcaacagcggcttcggcggcggcttcaacagcgcggcgccggccggcggcgcgcctgcgcgcctgcccgacggcaccgaaacccccaacttcctgcgccaggccaaggctaccttcctgcacctgcaaagcctgaacacgccggaaagcctggaggaagtgcgcaagtacttgacgccggaactgttcgaagcgctgcgcggcgacatcgccgacaacggcgccgtggccgacttcccgcagctggactgccagctgtccgacgccagcgtcgagaacggccgctacatcgccagcgtgcgcttctccggccaggtcagcgaagaagtgaacgccccgctggcgccgtttggcgaaacctggcactacatcaaggatggcaacaccggcggcaagtggctggtggcaggcatccagcaagactga

SEQ ID NO: 712 - DNA, 1203 bp, Chromobacterium substugae
atgacagcattcgagcacgccggcctgaaaatcggcagccactttcagcccatctacagcctggcgcatcggcgcagcataggcgtggaggcgctgttgcgtgccgagcagggcgatgtcgcgctcagccccgccgaggccttctacaccgccgtctcgccggaaaagcgccaccagctggacctggccgtctgccaggcgcacatccagcgctttctgcagctgccgtccgatcagccgcgctggctgtttctcaacctcgacgccgcctcgctgtcgcgccccgaccgcgcgatggcgctggtcaacaacatccgccaggccggcctggagccgcacaaggtggtgctggaagtgctggagcacgtgctggaagtggacgaggcgctgatcgaaggcgtcaacatcctgaagaacaacggcttcatgatcgccatcgacgacttcggcgtcggccactccaacctggagcgggtatgccagctggagcccagcctggtgaaattcgaccgccagctgctgcgcaacgccatccagcagccgcgcagccgcagcctgctgaccaggctggtgcggctgatgcacgagattggtgcgatggtggtggtggaaggcatagaaaccgaacgcgacgtgctggtggcgatggattccggctgcgacctgatccagggctacttcatcgcccacccggccgagcagcctaccagcgacgagatcatcacccccaagctggacgaacgctgggacgaattgatggcgcacgcgctgctcaagcgcaagctcacccgccgccagatcgagctggcgcggcaatgcttcgtgcaaagcgccatctcgctgatgcagggcaccccgttcgacctggccgccaaaccgatgctcagcctgccggacgtgatccgctgcttcctgctggacagcgagggccggcagataggccgcaacctcaacagccgccagtccaccgccgccaccgacccgcgctacgcgccgctggccgacaccaccggcgcggtgtggtcgcgccgcagctatttccagcacgcggtggaccagcccggcgtgctgtacatgagcgagccctacctgtcgatgaccgacccgcgctcctgcgtgacgatgtcgatggcgatagagatcgacgaatacatgcacgtgctgtgcgccgacctgctggtgccgcaggccagcaccgtatga

SEQ ID NO: 713 - DNA, 438 bp, Chromobacterium substugae
atgaaaaacaagctgttgttgccgctggccttgctgccggttttggcgtgggcggactgcggagccggggcgaagacggtgttcgcctgcacgaccaaggctggcaagaaggtggagctgtgcgatgcgggcaaaaccatccgctatgccttcggcaagccaggcgcgccggaaatcgcgctgagcgtggagcgcaagcgcgcgagcacggggcagtggactggcgtgggttcgccgtcctataccgtgaatgtgccgaacggcgatacggtttacaccgttttctggggtgttgacaggaatgtcgaaagcctgccggtcgaggccggcgtgcatgtgtatgtgaaagagaagtgggcggctacggtgtattgttccggcaaaaagccgattttgcaggaaatggaagacatcaagctgccggctgaggtgatctag

SEQ ID NO: 714 - DNA, 588 bp, Chromobacterium substugae
atgaagcgtagtgtattcgcattgttgctggccgccggttgcgccagcgtgttgagcggctgcgtcggcctggtggccgcgggcgcagccggcggggcgctggtggcgtccgaccgccgcaccagcggcgcgtatgtcgacgatcaggcgatcgagctgaaatccggcgagcagattgccaaccgcctgccgtcctcccacgtcaaccgcaccagcttcaaccgcgcggtgctgctcaccggcgaagtgcccagcgacgaggcgcgccagcaggccgagctgatcgcgcgcggcattcccaatgtgcgccgcgtctacaactacacggtggtggcgccggtgtccggtttttccgagcgcagcaacgatacctggctcaccagcaaggtgcgcgcgcggctgctggatggcaagggcgtcaatcccaacaacgtcaaggtggtgagcgaggcgggcgtggtttacctgctgggcctggtgacccagggtgaaggcgccgaggcggcgcgggtggccagcgaaaccgccggcgtgcagaaggtggtgacgctgttcgaatacatccaggatgtgaccccggcgcagtaa

SEQ ID NO: 715 - DNA, 591 bp, Chromobacterium substugae
atggatctgattgaccgggtcaacggccatttcctggaaagcatcgccgccaagcaggaggcgatggagctgctgtcgcctggcgtggcggccgccgcggagcggatggtggcctgcctgatgaacgaaggcaagattctggcctgcggcaacggcggttccgccgccgacgcccaacatttcgccgccgagatggtgggccgtttcgagaaggagcgtccgggcctggcggccatttcgctggccaccgacacctcggcgctcaccgccatcggcaacgattacgatttcgacatggtgttctccaagcaggtgcgggcgctgggccataccaacgacctgctgctggcgatctccacttccggcaactccgccaacgtgatcgaggcgatttacgccgcccacgagcgcggcatgagcgtgatcgcgctcaccggcaaggacggcggcaagatcacggaaatcctgtcgccggaagatattcatttgaacgtgccgtcgctgcgcacctgccggatccaggaagtgcacatcctgctgatccacgcgctgtgcgacgccatcgactgcatgctgttgggaggggaatga

SEQ ID NO: 716 - DNA, 339 bp, Chromobacterium substugae
atgaaccaggcgggccgcgaagccgaagaccgcgcgctggcgctgctgcaggcccagggcctgaagctggtggcgcgcaactggcattgccgcggcggcgagatcgacctgatcatgcgcgagggcgcgtgcctggtgttcatcgaagtccgccatcgcggcggcagccgcttcggcagcgccgccgacagcattacccaggccaagcagcggaaactgctgctggccgccgaggtctatctagccagccacaagatcgacgcgtcctgccgctttgacgcggtggtgagcgtgggcggcgccaagccgcagtggctgaagaacattttcacgcagtaa

SEQ ID NO: 717 - DNA, 1140 bp, Chromobacterium substugae
atgcaaagactgactccgctgttggttggcgtcttgttgacttggttggcgccggcgatggcgcaaacccccgactatatcattcaaagcaatagcgcgccgatccgcgcgctgagcgcgccgccgggccagacgccgcggctggcgccggcccaacccgtggcggccgcgccattggcggcgctagccagcgcgccggcggccaggagcgcggcccgcgcccgggtgcgcataggcgtgatcttgccggtggaatcgtcggcgctgggcgaggccgcggcggtggtgcgcagcggcgtggaggcagcggcgcaggtggagcagaacgccgagctggtgagcgtggacgccaccaccgacaacgtggtgcagcgctaccgcgccgcggtggccgacggcgtcaacgtggtgatcggcccgctgtcgcgcgaggccatcgcccaattggcgccggcggtgacggtgcccaccatcgcgctcaattcgatcgaccgccaggcggcggccaatcccaagctgttttcgctgtcgctggtggtggagggcgaagcccgccagctggcgcggctgatgcgcgacgacggccgcgtcaatccgctcctggtggagggcggcgacgcgttgtcgcagcggctggccaaggcgtttgccgacgaatggcgcgcgctgaccggcaaggacgcgcagcgccggccgtttgacggcggcaacctgccggcgctgctggaggccagcggccaggccgatgcgctggcgctggcgctggacgccgcccaggcggcgaagctgaaggcggcgctgacgccggacatgccggtgtacggcacctcgcaattgaatatcggcggcaatcagccggagctggccggcgtgcgcttcatcgacatgccgtggttcctgatgccggaccatccggcggtgaagcgctacccgcgcccggccgccgcgctgacgccgcaaaccgagcggctgtacgcgctgggtatcgacgcttaccggctggcggtgcagatggcggccagccgccccggcgcggcggtgcggctggacggcgtgaccggggacttgaagctgggccgcgaccgggtgttcgagcgccagctgccggccggcgtgatgggcggcaacgcgctgcgatga

SEQ ID NO: 718 - DNA, 831 bp, Chromobacterium substugae
gtggtggccacgcccattggaaatctggccgacatcagcgcccgcgccctggcggtcttcgaagcggccgacgtcgtctgcgccgaggatacgcgggttaccggccagttgctatccgcatatggcatccgcgccaagcgcctggtcagcctgcgcgaacacaacgagcgcggcatggccgaacaagtggtgcgctggttgggcgaaggccagattgtggcccaggtgtccgacgccggcaccccggcggtgtccgaccccggcgcgcggctggtggaagccgtgcgcgccgccggccacccggtgcgcccgctgcccggcgccagcgccgtgatcgccgcgctgtccgccagcggcttcaccgcccccaccttcctgtttcacggctttttgccgcccaaaagcggcgagcgccgcaagacgctgcagcaatggctggacgcgccccacctcaccatctgctacgaagcgccgcaccgcatcgtcgacgcgctgcaggacatcgtggcggaactgggcggcgaacgccgggtgatgatagcccgcgagctgaccaaaacctttgaaaccttccacgcgctgccggcggcggaactgctggaatgggtgaaggccgacagcaaccagcagcgcggcgaaatcgcgctgatcctggacgccgcgccggccgcagcccccggcgcagacgacatgccggccgaagcgctgcgcgtgctgcagctgctggcggcggagctgcccaccaagcaggccgccaccctggccgcccagatcaccggcgccaaccgcaagcagctgtacgaccacgcgctaaaactgaaaaaagactga

SEQ ID NO: 719 - DNA, 82 bp, Chromobacterium substugae
gcccggatggcgaaattggtagacgcaggggattcaaaatcccccgccgcaaggcgtgtcggttcgagtccgactctgggca

SEQ ID NO: 720 - DNA, 1179 bp, Chromobacterium substugae
atggccctgaccgaccttgccatccggcaagccaaaccccaagacaagccctaccaactcgccgacggcgaaagcctctatctcgaagtgtccccatccgggggcaagctctggcgcttccgtttccgctttcaaggcaaggccggcatcctggccctaggcaagtaccccgctgtcggcttgagcgatgcgcgccagaaagcccacgaggcgcgagtacagctcgcccaaggcatcaatcccagccaggccaagaaagaagccaaggttgtcgcccagatcgcggcaaccaacgctttcgaattggtggccagagagtggcatgaaaagcagctcgaccgctggacgccagatcatgcgaggcgagtgatggactcgctggagatagacgccttccccgacctaggcaagctgcccgtacccgacctgaccgcccctctcatcctgaacaccattctcaaaatcgaaaaacgcggcgcagttgaaaccgcgcaacgggttttgcagcgcatcagcgccattatccgctttgcgatccaaaccggcagggccaccgataacccagcagtcaacctagtaggggcgatacgcgcaaagaaggtggaacaccgcccagcactgccacgcggcgagctgcgcgagttctaccgccgcctggcgaccgaacctctctacattccgacacgcattgccatgcatctgctgatgctgaccttcgtccgtcctggcgaactgcgcgccgcgcgctgggaagagtttgatgaagaacgcgccgaatggcgtattccagccgaacgcatgaaaatgcgcgagccccaccttgtacctctatcgcgccaggcgctggagctgctgaaagaactacgcccgctgaccggcaaaagcgcgctgctcttccccgccgtgactgacctcaagaaaccgatgtccgagaacacgctgggctatgccatgggacgcatgggctacaaaggcacggcaacccctcacggcttccgtgcccttgcttccacagttcttaacgaagaaggctttgatccagatatcatagagaagcagctcgctcacgccgagcgcaataaaatacgcgccgcctaccatcgagctgagtatttagaagagcgcaggaaaatgatgcagtggtacgcagaattcttagacagccatcaatcaaggtga

SEQ ID NO: 721 - DNA, 219 bp, Chromobacterium substugae
atgaccgccattgccccttcgctcaccgcccagccgctgcgctttctgcgcttgccggaagtcatctctacgtgcggcctgtcccgctcgtcggtatacgacgccatcaagcgcggcagctttccggccccggtgccgttgggcggtaaaagcgtggcctggctgtcgtctgaaatcgatgtctggatggctggacgcatcgctgcccgccacgcctaa

SEQ ID NO: 722 - DNA, 726 bp, Chromobacterium substugae
atgcatatccagaaccccaacacccaagaaaccgtcgctttcgccgtcgccggcctgaccgaacgcctggccaccttcgagcaagacctcaacgcctggcagaccctggccgacagcgccgcccgccgcatccaaaccgccgaagctctgcgcaatgaagccgagcagacgcgcaaggactgccgccaggcgatgcgcgcaaccctgggcattcccaccaaggctgtgcgcgagctgaagagcaaggagatggccaatctggaattggccgaggagacgctgaagatcgccgcagaagaaaagattcaggcggaagtgcagcaggaagcgctgttcgagcagcgccaagccctggccaaggagcgcgaggcgctgcgccaccagtattggaacgcggtgctggacgaccaaatcgcccaatgggggcaacagctgccggtgctggcgctgctgctggaccaagcgcccagggcttgcatcgagcggctgttcggccgcgccgagctgcgcagaaatcaagatgagttctatgccgcgcagctgcccggcgagctgcaacaggcgctacaagccgcgccgcaggcggagccggatgaattgctgactctgctcaaccatccgctgccgccgctggctgaacccgcctcgatgcagcacaacccgctggcccgcatgcgctatcaagccgaacgcgacgcgcaataccaagccctgatcaaccgctaa

SEQ ID NO: 723 - DNA, 990 bp, Chromobacterium substugae
atgcaaaacacgacccgccaagccctggaccacttcatcggccgctatttcagccatatggacgcgcatcaaactcaggacagttgccacgccgccccggagccgcaagctgcgcaggcccgcatcaatgcgctgaagacccatagccggctgctgtccgccatcaacatcctcggcgtggcgaacatcaaaggccgttcgcaaaacttcgacctcgccggcacgctggccgccacggtggacaccaaccgccatgcgtgccagccggcgcaaaagacctggcagccggcgcaatacttctgccggcagaccaacttcgacgcggcgtttgattacgagatgctggacgcctggatgagcgagacgcaagaccaagccctgttcgaggcccgcgcgcggcacacgctggagcgccgcatcttgctggaccgggtgatgatcggcttccgtggcctgatgcgcgccgcagactccgaccgggccaaacatccgcagctgcaagacgtcaatgtcggctggctgcagcaaattcgcgagcaagcgccgaaagcctgcctggagcgcgtgcgcgtcggcgaaggccagcgtttccacaacctgcatcgcctggtgcgccatgcggtcaaccacctgcttgcgccggcctggcgcgacgatccgctgctggtggcgctggtgggcgcggacctgctgccggatgcggtgtgcgagtcaaacggccaagccgcgcccgtcgacgatctggtattccacaagcagcgcctgggcggcctgcaagccgcgacagccgccttcttccccggcgacagcatcctgattacccgcctggacaacctgtcgctgtacttcaaccaaaacgccgtgcgctaccgctatcaggaagaccccgccatcaacagcgtgctgttctaccactccagcgaagatgcctatgtagtcgagaacctggccgcctgcgcgctgattgaagacgtcgagatcgtggactga

SEQ ID NO: 724 - DNA, 282 bp, Chromobacterium substugae
atggcctttccctgcccgctgtgcggcgcggtgtcgagagtgcggaccagccgcatgctgaccgccaccgccaaggagatttactacaactgcagcaatgacgactgctgccaccagtacaagacgatggaaagcgagccgcgtaccgtcgcccagccgatcaagggcggcgcgctgataccgcccgagcggctgcgcgcgctgtctagcttggccaaacccgcgccgccgccagcgctgaccgttacgcccggccggattcagcacaaagtcttgaagtaa

SEQ ID NO: 725 - DNA, 243 bp, Chromobacterium substugae
atgctgatggatttgattattcgatccagtatttcttcgtgcaaacaggaaatgaagcgattaaaaagggagcttgagtctgttcatgaaaaatatgaagcggttttagatattgcttatgataatgacttgactgatgatgaaatcaatcggcaattggaaatggcatcggaaatatctcatgccggtgtaagaggatggcttgccaagcatcgtgaaaaattaaaggttgtatccaaatga

SEQ ID NO: 726 - DNA, 177 bp, Chromobacterium substugae
atgcccaatatcgccctgcgcactttccgcgccctattccctcaaagtacccgtcccgtttccacgctgcccaacgaggcccaagcccgcgcgctcgccgctttgctggtcgcccaggggcaacgcgccttgattcatcgcaccgccgccggcttcgctgtggaggtgatcgcatga

SEQ ID NO: 727 - DNA, 327 bp, Chromobacterium substugae
atgaacgccctgccgctgattgccccgctggcgttgtccgccgtccatcaccaattggcccagctgcaattgctggccaactcgcccgaacacgccgccttgcgcgaccccttgagccagttggccagcttgtgccagggcatcgaacacaccgtcagcgccggcgtgtcgcgcctggcgcgcaccggcgacggtctgcaaggcttggtcgagctgctggattgcgccgaggaccaaccgttgccggcgcagcgcctggccgggctgctggctccgctgcagcagcaagtcatcgacgccagcgccgacatcggccaactgctctaa

SEQ ID NO: 728 - DNA, 1023 bp, Chromobacterium substugae
atgaggctcgatctcgcgcaattgcgtctgcaggcccgcgaccgctggccggacatcctgatggcgctgggcattcctgccgaggtctttacccagcgccgcaaccagccttgcccggcttgcggcggcagcgaccgcttcgaatggatcgacaagggcagcggccgtttcgtctgccgcgccctggatagccagggcggcgacggcttcgtattggcgcaacattggctaggcggcgacttcttccacgcggcgcaagccgtcgcccaggtcttgaacggggcgaagggggagccggcgcgcgtgtcggccgcacccgcgaccacacatccgcaacgagaccaacgcgagcgcctggcgcagctgtggcgcgcggcgcggccagtgaaggctgatgacccggtgggccgctatctgctgcgccgaggcttgagcctgaccgcttacccccgcgcgctgcgctatcacccagccttggcctactggatcaccttgcacggccggccgcagctgctgggccacttccccgccatgctggcgctggtgacgtcgccgcaaggcatcaacgtgggtttgcatcgcacctggctgaccctcgacggccacaaggccgcgctgcgtcaccccgtcagcggcgaagcgctgccggcgaagaaactggccttgggccgttccggcgacctgtccggcgcagccgttcggctctatccgcccacagacggccggctagcgctggccgagggcatcgaaaccgcgctggcggtgcgcgagggcagcgggctgccgtgctgggcggcgctgtcggcctgggggctgtcgcatgcggtattgccggatgaagtgagcgcgctgtttgtgatggccgacaacgacgccaaccaggccggccagaacgccgcccggcgcttggcgcggcggatgcaggaggacggccggcccgtccatctgctgattcccgagcggccggatagcgattggctggatgtgttgaacgaacaaggagaaccgaatgggcagcgctga

SEQ ID NO: 729 - DNA, 1815 bp, Chromobacterium substugae
atgggcagcgctgacaagcaggctttgaagatggccgcgaaggccccggcgctggccatcggcccgcgttatgaagtgaaccgcgatggcgtgcattacatcgccgtcaaacgcgaccgcgataccggcgagctgttggagcagccgccggaatggctcagcgacaagatggagctgctgggctgcgggacggatgcggacgggaaccatcaccgcatcgtcaaatggcagcgccagggcaatggggaagtcatgaccaccgccttgcccagcgccgacatcggcgagcgcgccggctgggcgctgctgcgcaaaggcggcctgacgctgaccaccgaccgcggcggccaggcgcggctggctcactggctgcagcgcgaaggctccaccgagtggcacgacatcgtcaatatgtcgggctggcagcatggcgcgtttgtgctgccgaacggcgacatcatcggccgccccaaccgcaagatgcatttcaacggccggcccaaggatgccagcgcctaccatccggccggcagcctggccgactggcaaagcacggtcggcgcgctggcgctgggcaacccgctggcgatgaccaccatcgcttgcgcgctggccggcccgctcttggccttgtgcggggcgcgggatggcatcggcctgcatctgtacaccaattcctcctcgggcaagagcacctgcgccgataccgccgccagcgtgtggggcgacccgcagcgcaccttgcacacctggtccggcaccgcactagggctgaccaacgaggccgaagccagcaacgacatgatgatctatctggatgaagtcggctccggcgacgcccgcaagatcggcccggccatctacagcatgctgaacggcgtgtccaaactgcaaggcgcgaaggaaggcggcaaccgcgccgcccgttcgtggaagctgaccatgctttccaccggcgaagtggccatgagccagtatctgaccgaaggcggccagacgccgcgcggcgggcaggaaatccgcttgctcgacatcccggccgacaccggcccctatcgcgccttcgaccacatccacggccgcagcaatggcgaagtgttcgccgacgagctgacccgccatgcgcgcagccattacggcacggtcggccgcgccttcgtcgcctggctgcaggacaaccgggcggcggcggtgcagtgggtggagcaatcgcaacagcgcatgctggcggccgtgcccgaaggcgccgcacccacagtccgccgcgcgacgcgcaaattcgccattctgtcggcggcggccgagatggccagtcatgccggcctgaccggatggacggtggaacaggcgattcagggcgtagaaaccacctggcagcgctggatgcaagctttcggcatcgaagaccgcgacgacgcgcgcttgatcgaccaggccgccgccgtgctgcaagccagccagtacgcccgcttcgtattgctgccgatgaatgacagcgacccgctggtccccaacctgatgggctacaagcgctacacgctggaaggcgaagcggtgtttctggtgacgccgggcgcgttcaagggcgaagtcatcgccggctatgaagtgcggcatgcctgcgaagtgctgtaccgggcggggatgctgcaacggccaaaggggggcgcgccggttggaccgtgcatggcggcaaaggcgtgggccaggtctaccgcatgcagttgcatccgcacgacggcgaagcggaagagtaagcgaaaaatttctcacgtgaggccaaacccactgccaacactgccaacacctatctaa

SEQ ID NO: 730 - DNA, 417 bp, Chromobacterium substugae
atgccttgcatcacccgcagtccgtcgcacctcgcgctttccctgaagaaccgtcatcccgcccgcagccgctggctgctgcacaaccaagcccccacgcatccgcccagcctgctggcgatgacccggctgcacgaagcctttgccgccttgcaggcgcaattggccagccaggatcaatccatggttagagagccggccgcgcgcgtcgcgcatttgtgccacgacatcgagcaggcggtagtggagtccatctgccacctgtcccatggccagttgggcttgcaatccgtgatcgatttgctggcttgcctgggagatgacgtgcgcctgccatctagccgcatcacggagttgctgtcgccgctggacaagcgcatgaatgagtcgctgacgctgcttacccgcgtgctctaa

SEQ ID NO: 731 - DNA, 171 bp, Chromobacterium substugae
atgcttcgcgatatcaacgagcagttgggatattcgcagcctgcccgtttcgatctgttttctggtgtgcaaagcttgatagagaacagcaagatgattggccgatatgatcaagtccgcgcccaagcccatgggcttcagattttaaaagcgtatcagaccaaccagtaa

SEQ ID NO: 732 - DNA, 1491 bp, Chromobacterium substugae
atgggagcgaatgtgaaatcgatactggctttggcctgcctgcaactgtcgctggcgctgctgccgctgggcgcgcgggcggaagcgccgctgggcgcggcgcagcaaaagacgaattaccaggcggcgcgcgcttattaccagcagctgctggccgacaagggacgggtggccgaactgggcatgctgatgaacatgctgcccaagggcggcgatctgcatcaccactacaccggcgcgctgtacgccgaaacctatctggactgggtggacaggcagaagtactgcgtctatcaggccacgctgagaatagaaaccaagccggagcaggcgcagccgggcgcggcgtgcctgagcggcagccagatcaaggacgacaacgcgctgtaccgcaagctgctgacgctgtggtcggacaaggatttcgacaaccacagccatgaccagccgccgccggacaagcagtttttcgataccttcggctatttcggcggcgtttccggctattcgccgcgcgaaggcctgcagctgctgaaaacccgggccaaggcggaaaacctgcaatacctggaaaccatgctgcgcggcgcgccgtccggcaacagcgcgctggccgccaatctggacagcctggccccggacgccgctccggccgccatcgagcaggcgctgggccaggccgcatcggcgctggcggcggacgcctccaccgccgagcaagtccagcgttaccggcaggatctggccggcttcgcccagggcatggacgacgacgacttcacgctgcgcttccagacctatgtctcgcgcaataacaagccatccatcaccttcgccgggctgtacgccggcttcgccgccgcgcacgacaacccgctggtggtggggctgaacatcgtcggcccggaaaacggcattgtggcgatgcgcgattacgcgctgcacatgcgcatgatccatttcctcaagcagcgctttcccgatgtgaagttggcgctgcacgccggcgagctggtgctgggcatggtgccgccggagggcctgcgcgaccatatccggctggcggtggagctggccggcgcgcagcggataggccacggcatagacgtcggccatgaaagccggccggacagcctgctgaacgaaatgcgccgccgcgacgtggcggtggaaatcaacctcaccagcaaccagttcatcctgggcgtgcagggcgccgcgcatcccatcctgctgtaccgcaagtacggcgtgccgttcgtgatctccaccgacgatgaaggcgtgtcgcgcagcgacatcagcaatgaatacctgctgtacgtcagccgctaccagccctcgtacgacgaactgaagcgcaccgtctacaacagcatccgctattctttcctcagcccggcggacaaggcgcggcaacggcagcggctggaccagcgcttcgctcagttcgaggcgcgggcggcggcgctgcgcaagatggggcgttaa

SEQ ID NO: 733 - DNA, 204 bp, Chromobacterium substugae
ttgcaggcaggccaaagccagtatcgatttcacattcgctcccattcgcattttgacgacggcataaccgtaacagcagcgcagggaaaccggaaggatggcggcgtggcagcatggccagctggacaaaggccaagcggccagacaagaagcgtaccagccgtaacaaaaaataacgaaaacagctatttaggccagctataa

SEQ ID NO: 734 - DNA, 360 bp, Chromobacterium substugae
atgctgcaaaactacttccccatcctgttgttcattctgatcggcctgctggtcggcgtcgtgccgctgctgctgggcaagctgctgggccccaaccggccggatgcggaaaaattgtcgccgtacgaatgcggctttgccgcgtttgaggacgcgcggatgcgcttcgacgtccgctactacctggtggccatcctgttcatcctgttcgatctggaagtggccttcatgattccgtgggcggtgacgctgaaagacgggctgggcctgttcggcctgggcgcgatggcggtgttcctcgccatcctcaccgtgggctttgtctacgaatggaaaaagggcgcgctcaattgggattga

SEQ ID NO: 735 - DNA, 1368 bp, Chromobacterium substugae
atgaaccaggaacaactgcaagtatcgatccgcgcccagctgcgcgcttttgacgaccaggctttcgaccggctgacccgcgcgctgccgctggccgacgtggtggaggcgctggcggcccatccgccggaggcggtgtcgcgcttgctgcaggcgatgcggcccaagctggccgccgacgtgctggcgctgttgccggccgagcagcaggacgagctgctgcagcggctgccgcagccggcggtggtggcggtgttcgagcgcctgccgtctgacctgcgcgccgacctctacaagcggctgagccagaacgagcaaagccggctgctgccggcgctggggcggatggtgcgcgacgacatcctcaagctggccagctatggcgaggatacggtgggttcggtcaccagttccgactacgccgccatctcgccgcagctgaccgcggcggaggcgatggccgcgctgcgcgccggcgaccggcagcagatcgaggtgatctacatcgtcggccacgagcaccagctgctgggcacgctgccgctgcgcgagctggtgctggcgccgctggaaaccagcgtggccgagctgatgcagcacaatccggcctacgccgaggccggctgggcgcgccaccgcgccgccgacctgatccgccattacgagctgctggcgctgccggtgctggacgaggcgcagcggatgataggcatcgtcaccatcgacgacgcgatggacatcgagcgcgaggacgacaccggccggctggccagcttcggcggcgccgcgccgctggacaagggcaatctggacgtggtgcattccagcgtccgtcgcatgttctcggtgcgggtgttctggctgctgatcctgacggtgttcggcgccatcaccagcaccttcgtcgcccagcaggaagagctgctgagcaatgtggtgattctggccgccttcatcgcgcccatcgtcgacatgggcggcaacgccggcagccagtcggccacgctggtgatccgctcgatggcgctgggccagctcaagctgaactggcgcgacgtcgccttcgtcatccggcgcgaactgccggtggcggcggcgctgggcgtggcggtggcgctgctggacatggtgctgtcgcacttcagcaagggcgtcggcgccgacatcctgctggtggtgggcctgagcatgatgctgtgcacgctggccggcggcgtgatcggcgcgatgctgcccttcctggccaagcgcctgggcaccgacccggccacgctcagctcgccgctgatcacctccatcatggacatgctgggcgtgttcatctacttcggcctggcctacgccttcctgggccacctgctggcctga

SEQ ID NO: 736 - DNA, 831 bp, Chromobacterium substugae
gtgaaacccatcgctcgcgccaaccttatcctgatggcggccgccctgctgtcgttcgcctgcgcgccgcttcgcgccgccgacgctagcgacgccgcccatgccgccaaccgccccgccgcggtgttcaaccacggcgtggcggtgttcgagcagcagcgcgagctggcgccgcgcgccagcctgcgctttcgcgtgctgcacggcggcggcggcgcgttgacgctgtggctgaaaagcccggccggccagatgcccttgccgctgacgccggactccaccttcaaccccaccgcgctgtccgacggccaaagcatcgtggcggcgccggacaaccatgccgggccgctggcctggcggccggacatccgcagccccggcctgccgccgcacagccgccggctgggcgatttgaggctggaatgcctggtggaccagcaaagcggcctcaatccgcaggagccgcgcgccaattgcctgccgccggcgcgccaggccgactgcctggaacagatgggcgattgcctgcgcggcgcctcgctggccctgctggcgcaatggcacgcgatgcaccggctgcaatgggcccgcgccaccggccagccgcagccggcgcgctacctgttcatcgccaagcatccgctggccgccatccagctggcgcacggcgagcataggctgacgctgccagccggctggctgcacggcggcggcgcgcaaaacggcgctccctggccatacccgcgcgaatacctgtattcgctgccgctggacgcggtcgagtggccggacgacacgctggtgaccttcggcgacgccgccaaatcctga

SEQ ID NO: 737 - DNA, 918 bp, Chromobacterium substugae
atgatcgtccgcaacacctcttcctggttccgtctgctgttcgtctggcacggttcggtgctgccgcgcatcctgccgcggttgctgctggttttcgcgctggccatcctcgcctcctccatccgccactggtggctgaccagcctggccgattcggcgctgagcatccccaccttcacactgctgggggtgtcgctggccatcttcctgggctttcgcaattcggtgagttacgaccgcttctgggaagcgcgcaagctgtggggcagcctggtgatcgccagccgctcgctggcgcggcagatgatttcgctgaccggcgccgggccggacagccggcgcgtggccgacggctgctgcgccttcgcctacgccttgaaggaacaggtgcgcggccagcaggacgacgcgccgctggaaaggctgctgccggccgacgtgttccagcgggtgcgcgccggccgctatcgcccggctttgattctgctgtggctgggcgaggaagccgcccgcctgcagcgcgaaggcgcgctcagcgagcggcaatggcaggcgctggaccgcagcctgaatacgctgtcggaagtgctgggcggctgcgagcgcatcgccaccacgcccattcccttcacctaccgagtgctgctcaaccgcaccgtcaccctgtactgcctgctgctgccggcggggctggtcagcagcataggctggctgacgccgccgatcgcggtgttcatctcctacacctatttcgcgctggagcagatcgcggaagagctggaagacccgttcggcttcgaaggcaacgacctgccgctggccgcgctgtgccacggcatcgagtcgtcgctgcgcgagatgcaaggcctgccgctgctggacgagcctgccccgcgccagggcatttacctgcagtaa

SEQ ID NO: 738 - DNA, 1707 bp, Chromobacterium substugae
atgagcgcggcgcggcgcgattattcggtggaccggcggctgctgttgctgtccggactggccttgctggccggcgcggtcagcacgctggcggcggcggcgctgctggacctgatccggctgtgcaccaatctgttctattaccagacgctgtcgctggccgatcgcgggccggccggccacgcgctgggtgcctgggccatcgccgcgccggtggcgggcgggctgctggtgggcttgatcgcgcgctacggcagcgacaagatccgcggccacggcattccggaggcgatggaggccatcctgttcggccagagccggatgtcgcccaaggtggcgctgctcaagcccttgtcgtccggcatcgtcatcggcagcggcgggccgttcggcgccgaaggccccatcatcatgaccggcggctccttgggctcgctgctggcgcagcgcctgcacctgaccgcggcggagcgcaagacgctgctggtggccggcgcctgcgccggcatgaccgccgtgttcggcacgccggtggcggcggtgctgctgctgttcgaactgcggccgcgcagcctgctgccggtggcgctggcttgcgcctgcgccggctttctgcgcgggctgtgcttcgccgccgggccgctgtttccgctgagcacgccgccggccacgctggcggcgctgggctcctgcctgttggccggcctggcctgcggcgccctggcggccttgctgacctgggggctgtaccgggtggaggacggcttcggcaagctgcgcctgcactggatgtggtggccggcgctgggcgggctggcggtcggcatcggcggcaggctgcagccgcgcgcgctgggggtgggctacgacgtgatcggcgacctgctgcacaaccggctgctgctgggcgcgctgctggcgctgttggcggtgaaagccgtgatctggctgctggcgctgggctcgggcacctcgggcggcgtgctggcgcccttgctgatgctgggggccggcctgggcgcggcgctggcgccggccttgccgggcggttcgccggaattatgggcgctggcctgcatggcgggggtattgggcagcgtgctgggcgcgccgctcgccgccatcgtgttcgccttcggcctgaccggcgacgccacggcgctgttgccgctgacgctgaccaccgccgtcgcctgcgcggtgacggcgctggcgctgaaacggtcgatcatgaccgagaagatcgcccgccgcggtctgcacatccaccgcgagtacagcgtcgaccccttggagcggctgaacgtggccgacgtgatgacgcgcgcggcggtggcgatagacggcgcgctgccggcggcggacgcctggcgccaattcttcggcccgcgcggccataacggctatccggtgctgcgcgacggcaaggtggtgggggtgctgctgcgccggcggctgcaggaggcggcggccagccgccagccctgcgtggtgtgggcggagccgctatccggcgatcaggcgctgctggccggcatgagcgcgcgccacgcggccgggcggatggcgcaattgggcgtcggccggctgccggtggtggacggcccggacagcatgcggctggtcggcatcgtgtcgctggccgatctgctggccaatagccacttgctgctgcgcgaggaaacggtgcgcgaacgcctgcgctga

SEQ ID NO: 739 - DNA, 447 bp, Chromobacterium substugae
atggaacacaccgccgcgccggctgtcggcatgggcaagcagcaatacgaggccttgtcggaattccgctatcagctgcgccgcttcctgcatttcagcgaagaggcggccaaaagcgagggactgacgccgcagcaatacctgctattgctgcatgtgcgcggggtgccggggcgcgattgggcgacggtgggcgaactggccgagcggctgcagatcctgcatcacggcgcggtggcgctgctgacccgctgcgaggaactgggcctggtggcgcggcgcaagagcgagcacgaccgccgccaggtggaggtgcatctgaccgcggccggcgaaggccatctcgcgcggctggcggcgcggcacgaggcggagctgcgctcgctgcgcgacgtgttccgggtgtcgcgcatcaccgccttcaacgacggggacggcggcaaatga

SEQ ID NO: 740 - DNA, 1080 bp, Chromobacterium substugae
atgcgacatctgaaacgacactgcggcgactggctgcgcggcttctggccgcaagccatcgcagccagcccgcgtgaccggctggccggcagcctgggcgcggctttcggcctgatcgccgccgcctggctcagccgccacgcgctgggcgaagccaatccctggttcatcgcgccgatgggcgcgtcggcggtgctgctgttcgcggtgccggccagcccgctagcccagccctggtccatcatcggcggcaatctgtgcgcgtcgctggtgggggtgagctgcgcgcggctgatcggcgacccggcgctggccgccggcgcagccgccgccctcgccatcgcgctgatgttcccgctgcgctgcctgcatccgcccagcggcgcggtggcgctgaccgcggtgctgggcggcccggcggtggccaggctgggctacggcttcgtctggcatcctgtgctgctcaattcgctgctgctggccgcggcggcgctgctgttcaaccgcctggccggccgccgttacccgcataaccagtccgcggcgcccacccccagcgagcgcgtcggcgtcagccgcgccgacctgcacgccgcgctggcggagcgcggcgaagtggtggacgtcagcgaggacgatctggaggacatcctgcagcgcgcggaggaaaggctgcaccagcgccgcttcggcgcgctgcgctgcgccgacttcatggcgcgcgaggtgctgagcgtaggcgccgacgcccgctgcgccgacgcgctggctttgctgcgagcccaccgtttcgaagcgctgccggtcaccgcgtccgacggcaggctgctgggcgaaatcaccctgcgcgggctgctggccgaagccgtccgtcccgacgcccgcgtcgggcaatggatggacccgcgtccgcacacctcaagcccggacgacccgatcgagcggctgatccacccgttcgccgaccgcggcgtggcgcgcagcatggtggtggacgccgatggccggctgctgggcctggtgggccagggcgacctgatcgccgcgctgttccgcgagcaactggagcggccggtctga

SEQ ID NO: 741 - DNA, 1743 bp, Chromobacterium substugae
atgagcctgccccgcctgctgttttccttcgtcctgcgccatctgcgcccctactgtctggccgcgctgatgctggcggcggtggcggcgctgaccgtgatgatcccgcgcgaagtcggccgcatcgtcgacgcgctggtggcgcaccggctggccggcggcgatctgctgcgggagctggccaagctgctggccatgggcctggccatctattttctgcgcgtgggctggcggctgcagctgttttccacctcctaccagttgggcgtggagctgcgcacccggctgtaccgccagctgtcgcgccaggggccggcgtttttccagcgccagcgcaccggcgacctgatggcgcgcgccaccaatgacatcgattcggtggaaatggccgccggcgaggcgatactggccggcttcgacggcctgctgaccctggtgctggtgctggcgatgatgacgctgagcgtggattggcggctggcgctggcggccttgctgcccttccccttcatggcctgggctttctcccgcatttccaaccacatccaccgcgaatggggcgaggcgctgtcgcgcttcggtcggctgaacgaccacgtgcaggaaacattgagcggcgtgcgcacgctgcgctcgctggggctggaggcgcgcaacgacgccgaattgtcgcggctggccgccgccgccgccgacagcagtttcgaagcgcagcgctgggaggcggcgttcgagccggctgtcggcgtgtcgctggtcagcgcctcggtcatcgcgctgtcggtcggcggctacctggtatggcatggccagctgaccataggcgcgctgaccagcttcaatatgtatctggtacagctgatctggccgatgttcgccgccggctgggtgctgtcgctgctgcagcgcggctcggccgcctggcagcggctgcagccggcgctggaggccgagccggacgtggccgacgccggcggccgcgccgagctcgtccccggcgcgctgcatttcgacagtctgaccttccattacgcgcccgaggccgccgccgcgctgagccaggtttcgatcgacctgccgccggggcgcacgctgggggtggtcggccccaccggcagcggcaagtccacgctgctgaagctgttgctgcggcaatacccgctgcagcagggcgccatccgctgggacggcgccgacatcgccgactaccggctggccgccttgcgcgccgccatcagctgggtgccgcaagaggcctttctgttttccgccagcgtggcggaaaacatcgcgctggcgcggcccgacgccagccaggccgacatcgagcgcgtggcgcgcctggcggcggtgcacgacgacatcctgcgcctgccccagggctacgccaccccggtgggcgaaaagggcgtggcgctgtccggcggccagcgccagcgcgtcgccatcgcccgcgcgctgctggccgacgcgccgctattgctactggacgacgccttgtcggcggtggacacccaaaccgagacgcaaatcctgcagcacctgcgcgaagcgcggcgcggccgcagcgtgatcatcgtcagccaccggctgtcggcggtggccgacgccgaccacatcgtggcgctgcaccacggccgcatcgccgaacaaggcagccacgagcaactgctgcaacgcgacggctggtacgccagccaatggcgctatcaacaactggaggccagcctggatgaaatctga

SEQ ID NO: 742 - DNA, 1761 bp, Chromobacterium substugae
atgaaatctgacgccacccgcacccaaagccgcgaggccgtcgccctgctgaccgacgccgcccgccccgacctgcgccatctgtggctgggcggcggctggctgctgatcgccgccctgctggaagcggccgcgccgctgctgggcaagatcttcatcgacagctacctgctgccgcaccggctggaatggtcgcccgtcgtcggcctgctggccggcagcctggcgctgggcgtcatcgccgccgtgctgcgctaccggcagctggtgcggctggccggcgtggccatgcgcgcggtgctgcgcctgcgcgagcgggtgtacggccatgtgatccggctgccgatggccttcttcgaccaggccatcaccggccagctggtcagccgcgtcaccaacgacaccgagtcggtcaaagcgctgtacgtgcaggcgctgttcgtcatcctcaacagcagcatcgtggtgctgggcgcgctggcggcgatggcctggctggactggcggctgatgctggtgacgctgctgctgttcccggccactttcttcatcgtctggctgtaccagcggctgagcgcgccgtcggtggcgcgcgcccgcgcgctgcgcagcgacatcaacgcgcagatggcggaatcgatagccggcatcgccgtgctgcaggccagcaacgccgagagccgcttcgtctcccgcttcgacgacaccaaccagcgttattaccaggcgcggctgcgcgaattgaacgccaacgcctggctgctgcgcccggcgctggacctgttgaacgtgctgctgttgatcgcggtgatctacagctacggccagcgcgagctgggcggggtggaaatcggcgtgctgtacgccttcgtcggctacatcggccgggtggtggagccgctgatccagatcaccttgcagttcggccagctgcaacaggcggtggtggcggccagccgcgtcagccacctgctgcgggaaaccgccgcgccgcagtcggccgccgacggcgccatcgccgccggcgcggtcagcttccgcggcctgcgcttcggctaccagccggaacacccggtgctgcacgagctgagcctggagattccggccggcggcttcgtcggcatcgtcggccacaccggcagcggcaaatcgacgctgctgtcgctgctgctgcgcttctaccggccgcagcaggggcaaatcctgatcgacggccagccgctggacgatatcggcgacgccgccttccgcgccggcgtcggcctggtgccgcaagacccgttcctgctggccgccagcgcccgcgaaaacatcgacatgggccgcaacctgccgcagagcgaaatcgaggaagccgcccgcgccgccggcgtgcacgagctgatcctgtcgctggagaacggctacgacagcgatatgggcgagagcggggcgcggctgtccagcggccagaagcagctgatcgccatcgcccgcgcgctggccggcaagccgcgcatcctgctgctggacgaggccacctcgcacatcgacagcgagaccgagcgactggtgcagcaggcgctggccaagctggccggcaagatcacgctgatctccatcgcccaccgcctgtccaccatccgcgacgccgacgccatcatcgtgctgaaccacggccgcatcgccgaaaccggcgaccacgagcagctgatgcagctgggcggcatctaccagcggctgtacctgctgcagcagatgcagaccgaggacgaggcgtga

SEQ ID NO: 743 - DNA, 537 bp, Chromobacterium substugae
gtgagcctggatgcgtgcgcggccatccgcgccgaggtggccgccattacgccgctggacgcgctggaggcccaacaccgccaggccgcgctggattggatagactccggcgcggaattgtggcggcgagcgaagccggccacgccgctggtgcatttgtcgacctatttcgcgctgaaggacgatgccggcctgctgctggtggaccatcgcatcgccggcttgtggctgcccgccggcggccacgccgagcccggcgagcacccgcgcgatacggtggtccgcgagctgttcgaagaactgggcgtgaaaggcttgccggtgccagccgcctcgtttctcacttgcaccaaagtcgccggcggccataccgatgtgacgctatggtatgcgctgccgatttcgcgctccctgccgctgcgccatggccaggaagaattccgcgaagcgcgctggtttgatttcgaccagatgcctcccgccagcgagccgcatctcgcgcgctttgccgccaaactggctaagatagacgcctga

SEQ ID NO: 744 - DNA, 684 bp, Chromobacterium substugae
atgtcccgcctgcacttcctcgccagcctgctcttgctgtcgctggcctccctctcctgccgcgccgacgacggcaaggacctcgacctgtcgatcagcaccgagctgatgacccggcagaccgcttacggcaattcctcgcggctgcagcccagcgtggacatgcagtaccgcacccgcttcggcgccttgtacatccaggatggcgaaggcggctgggcgctgccggcgccggccggctgggtgtcgctgggcgtggccagcgagccggcctggagcctgggcggcggcgtgtcgcagagcctggccatcgcccgctacggcttcgacctgccgcgcgacggcagcctgtccttcggctacgccagccgcatcggcgacagtcaccccggccaactgctggtggccagcctggacgcgccgctgggcgattggcgcgggcaaaaattctcggtgctgggctgggccagcctggccaaccaggagcgccggctgggtttgaatcaccatgacgacggcgccggctggcagctggagcaaagcaatctgatgctggtgatgtcgcacccgctctcccgccactggacgctggacctgggcgccggcagccgctgggcggcggaaaacaccggcagccataccgccggctggcagacgctgctgggtttcacctggaaactgtga

SEQ ID NO: 745 - DNA, 789 bp, Chromobacterium substugae
atgcgcttcgatccgctgccgccggaggactgcctgatagacagccactgccacctggacgcgccggagctggcggcggacgtggacggcgtggtggcgcgcgcgcgcgcggccggcgtcggccaactgctggtgccggcggtgacggccggcactttcgccgacgtgctggcgatgcgcgaacgctacggctgctggatcgccttcggcctgcaccccatctatctggaccagcatctggacgagcacttggcgctgctggacgccgcgctggcagagcacgcgccggtcgccgtcggcgagatcggactggatttctacttgcccgagctggagccggcgcggcaggaaaaactcttggtcgagcaattgaagctggcgcgcaagcacggcctgccggtggtgctgcacgtgcggcgctcggtggaccgggtgctgaaacacctgcgcgaacagaaggtggaatgcggcatcgcccacgccttcaacggcagcgaacaacaggcgcaggccttcatccgccagggcttcaagctgggcttcggcggcgcgatgacctacagcggctcgcgccgcatccgcgcgctggccgccaccctgccgctctccagcctggcattggaaaccgacgcgcccgacatccggccggaatacgcgcaggacacgccgaacgagccgttccagctggcccgcttcgtcgaggtgctggccgaattgcgcggcatggcggccgcgccgctgcggcgggcgctgcgcgaaaacaccctggcggcgctggccttgcgctga

SEQ ID NO: 746 - DNA, 1632 bp, Chromobacterium substugae
atgcggaatttgtctatcgcggccaggatcaccctgggcttcgggctattgttggcggccctgatcttgaccggttgtctgacccagctgggtctgaacaagatctccaagcgggtggaggaggtcagctcgcatgacctgctgttctacacggacatcgtcgaattgcagcgcaatatgggcaatctgcgccgcttcgaaaaagactacttcatcaatatcgccgacgacgccaagcgcgccgaatacctgggcaagtggaagagcgcgcaggcgggcgcgcagaaggccatccagcaggccggcggccatccgctcaacgacgacgccgctcagcagctgaacaagctgtcgacgctgctggccggctacgccgacggcgtcggcaaggtgtccggcatggtggaaggcaagcaggtcaccgccaccgccgacgccaacaagcagctggatcagtacaaggacaacatccatcagatggaaagcgtcagcgaggcgctgggcaaggtggcggccgatgcggtgggccagctggacgaccagatcgacgccaccgccgccagcgtgcgcaaccagctgctggtggaaatcgccgtggcgctggcggccggcgcgctggtggcctggatcatcatcgcctccatccgccagccgctgctgcagatgcgcgatagcagccatgagctggccgaccagcgcaacctcaggctgcaactgcccgatttcggccagaacgagctgggcaacgtcgccggctcgctgaccaaactggtggacacggtgcgggcggtggtggtggagtcgcagggccactcgaccagcctggcccaggccgccggccagctcagccaggtcagcgagcacgtgtcgtcggcgtcggcgcggcaatccgaggccgccgccagcggcgccgcggcgatcgagcagatgtcggtcagcatcaatctggtggcagacagcacccaggacgtggagcgccaggcgcgcctgacgatggagcaggcgtcggcgggcaacgagctggcgcagaaggcggccggcgaaatccgccagatcgccagcagcatcaccgaaaccgccgcggtgatggaaggcctgaaccagcgctcggccgatatcggcgacatcgtgcgggtgatccacgacatcgccgaccagaccaatctgttggcgctgaacgcggcgatcgaggcggcgcgcgccggcgagatggggcgcggcttcgccgtcgtcgccgacgaagtgcgcaagctggccgaacgcaccagccaggccaccaccgagatctccagccatatcgacggcgtgctggccgatacccagcgcgcctaccagagcatgcagcaggccaacagccgcatcgaaaccggcgtggtcagcgcctccagcgtcgcagacgcgctgggccagatccgcgagctggccgagcattcggtggagcgcatcaccgacatcgccagcgccatcaccgagcaaagccacgccagccaggaagtggcgcgcaacgtcgagcagatcgcgcagatgaacggccagaccaaccaggccgccggcgaagccagcacgctggcgtcgcggctgcagacgctgtcgcacgaactggacggctgcctgcagcgtttccgcacctga

SEQ ID NO: 747 - DNA, 345 bp, Chromobacterium substugae
atgagccgcgacttcttccgccgcggcgcgtcggcggcgctgatcgcgctgatcctgctgacgctggcctgggagctgtcgctggcgccgctgcgtccgggcggctccttcctggcgttcaaggccttgctgctgttgctgccgctgcgcggcatcctggccggccggctctatacctatcaatggtccagcatgttcatcctggcttttttcagcgaaggggtgatgcgcggctgggcggaccccggcctcgccggacgctttgccttgggtgaagttctgcttagtacactattctttatctgtgtattgggatttgccaggagcttcaagcgcagagcttga

SEQ ID NO: 748 - DNA, 744 bp, Chromobacterium substugae
atgaacgaacaaccgctgctcgcgcacctgatcgagctgcgcacccggctggtgcgcgccctgttgggcatcgccctggtcttcctcggcctgttccattggtcgtccgacatctaccatctgctggccaagcctttgctggacgcgctgccgcagggcggcagcatgatcgccaccgaagtcacgtccaccttcttcgtgccgatgaaggtgaccatgctggtggccttcctggtgtcgctgcccaacacgctgtaccaggtgtgggcctttgtcgcgcccgggctttacagccatgagaaaaagctggtcctgcccttggtgctggccagcctgctgctgttcctcctggggatgagcttcgcttatttcctggtgtttccggtggtgttccacttcatgtcggcggtgacgccggcgggggtgagcatgatgaccgacatcgacaaatacctgtccttcgtgctcggcatgttcctcgccttcggcaccaccttcgaggtgccggtgatcgtgatcctgctgacgcggatgggcgtggtgacggtggccaagctgcgcgaggcgcggccttacgtgatcgtcggcgccttcgtggtggccgccatcgtcacgccgccggacgtgctgtcgcagaccatgctggcggtgccgctgtggctgctgttcgaagtgggggtcctggcggcggcgctgatggagcgcaaggcgcgcgcgcgcgaacaggccgaatcggcgccatga

SEQ ID NO: 749 - DNA, 495 bp, Chromobacterium substugae
gtgcttgacatcagtttcggcgaattcgtcctgatcggcgtggtggcgctggtggtgctggggccggagcgcctgcccaccgtggcccgcaccgtgggggcgctggtggcgcgcgcgcagcgtttcgtcgccacggtgaaggccgacatccaccagcaggccaacctgagcgggctggacagcctgcgccaggacttgcaggatgccgcccataccttccgcggccagctggaagcggaagtgaatgaagtgcggcaggcggtggatggccatgccgccgaagcgcgcgcgctggctgacgaggccgccggcccgctgttcgaggccgagcgcacgatacaccagagcctgcatcccgaagcggaagcggccgaggcgccggccgcggccgaagccgccgcgccgcgcgacgaaaaccagctcgacctgttcgacgatctgccgccgcaccatccgcccgcttcccaaccctccgcctcccaagcccgcgaatga

SEQ ID NO: 750 - DNA, 207 bp, Chromobacterium substugae
atgggttctctcagcatctggcactggctgatcgtgctgctgatcgtggtactggtgttcggcaccaagaagctgcccaatatcggcaaggatctgggcaatgcggtcaagggtttcaaggaaggcatgaacgaaggcaagggcggcgcgcagcagcctcccgagcagaccggccgcatcatcgacggcgaagccgacaagaaataa

SEQ ID NO: 751 - DNA, 324 bp, Chromobacterium substugae
atgagcgactgccttttctgcaagatcgtggcgggacagattcccgccaacaaggtttacgaagacgacgacgtgctggcctttcacgacattcgtccgatcgcgccggtgcatttcatgatcattcccaagctgcacgtcgattcgctggcccattgcggtcccgagcatgaggcggtgctgggccggattctgacgctggcgccgaagctggccaaggagcagggcctggagtccggcttcaagaccggcatcaacaccggccgcggcggcggccaggaagtgttccacctgcatgtgcacgtgttcggccacaaaggctga

SEQ ID NO: 752 - DNA, 327 bp, Chromobacterium substugae
atgaccccggatgtgttgaaaaacatcgccgatacgctggaggcgcggcgcgaggccgctccgcaatcgtcctacgtggcttcgctgttccacaagggcgaggacgccatcctgaagaaggtggcggaagaggccgcggaaacgctgatggcctccaaggacaaggataaactgcacctggtgcgcgaagtcgccgatctgtggttccataccatggtgctgttgacatatcatggcctgcgtccggaagacgtggtgatggagctgcatcgccgcgaaggcatttccgggctggacgagaaagcctcgcgcaaaccctccgcctga

SEQ ID NO: 753 - DNA, 384 bp, Chromobacterium substugae
atgagctggctggatgaagtgaagtgggacgacaagggcctggtgaccgccatcgcccaggacgcggccagcggccgggtgctgatggtggcgtggatgaaccgcgaaagcctgcagctgaccgccgacaccggcatcgcgcattatttcagccgctcgcggcagaaactatggaaaaaaggcgaggagtccggccaccggcagacggtgaaggagttgcggttggactgcgacggcgacgtcatcgtgatgcagatagaacaaatcggcggcatcgcctgtcataccggacgggaaagctgtttttaccgccgtttcgagaatggcggctggaccatcgtcgacgccgtgctgaaggatccgcacagcatctatcacggctga

SEQ ID NO: 754 - DNA, 765 bp, Chromobacterium substugae
atgcttgccaaacgcatcattccctgtcttgacgtgaccgccggccgggtggtcaaaggcgtcaacttcgtcggcctgcgcgacgcgggcgacccggtggaaatcgcccgccgctacaacgagcagggcgccgatgaactcaccttcctcgacatcaccgcaagctcagaccagcgcgacatcatcctgcacgtgatcgaggcggtggccgaccaggtcttcatcccgctgacggtgggcggcggcgtgcgcacgctggcagatatccgccgcctgctcaacgctggcgccgacaaggtcagcatcaacaccgccgcggtcacccatcccgaattcgtgcaggaggcggccgaccatttcggcaaccaatgcatcgtggtggcgctggacgccaaggcggtgacgccggagaacgaccgctgggaagtgttcacccacggcggccgcaaccgcaccgggctggacgccgtcgagtgggcgcgcaagatgcaagagctgggcgccggcgaaatcctgctcaccagcatggaccgcgacggcaccaagtccggcttcaacctgccgctgacgcgcgcggtgtccgacgcggtgggcattccggtgatcgcctccggcggcgtcggcaatctgcagcacctggtggacggggtgaaggaaggccacgccgacgcggtgctggccgccagcatcttccacttcggcgaatacacggtggcccaggccaaagaggcgatgcgcgccgccggcatcgaggtgcggctatga

SEQ ID NO: 755 - DNA, 741 bp, Chromobacterium substugae
atgctgctgatacccgcgatagacctgaaagacggtcaatgcgtgcgcctgagacagggcgcgatggacgatgccaccattttctccgacgatccggtcaaggttgccgcccactggcgcgaccagggcgcgcgccggttgcatctggtggacctcaacggcgccttcgccggcaaacccaaaaacctggcggtgatccgcgacatcctcggcgaggtcggcgaggacatgccggtgcagctggggggcggcatccgcgatctggacaccatcgaggcctacctcgacatgggcctgtcctatgtgatcatcggcaccgccgccgtcaagacgccgggcttcctgcatgacgcctgcgacgccttccccggccaagtcatcgtcggcctggacgccaaggacggcatggtggcgatcgatggctgggccaagatcaccaatcacaatgtgatcgatctggccaagcgcttccaggattacggcgtcaactcggtgatctacaccgacatcggccgcgacggcatgatgaacggcgtcaacatcgaagccaccgtcaagctggcgcaggcgctgaccatcccggtgatcgcctccggcggcctgaccaacctcgacgacatccgcgcgctgtgcgcggtggaggaagagggcatcgaaggcgccatcaccggccgcgcgatctacgagggcagcattgatttcgccgccgcgcagacgctggcggacgaactggccgaataa

SEQ ID NO: 756 - DNA, 639 bp, Chromobacterium substugae
atgaaagtcgcagtcatcgactacggcatgggcaatctgcactcggtgctgaagtccctgcaggccgtcaacgaaaccggcgccgatattttcctcacccgcgacccggaagcggtggtgaaggccgataaggtagtcttccccggccagggcgcgatgcccgactgcatgcgcgaattgaaccgccacggcctggccgacgcggtccgtgaaaccacgcagagcaagccgttttttggaatctgcgtcggcgcgcagctattgttcgatcatagcgaggaaggcgacaccgccggcctgggcctgtttgcgggcaaggtggtgcgcttcgccgacggcctggtcgccggcggcgagcgcctgaaggtgccgcacatgggctggaaccaggtttaccagcgccgcgcccacccgatgttcgccggcatcgccgatggcgagcgcttctattttgtgcatagttaccactttgcgcccggcgacgcgtcgctgagcctggcggaaagtgattatcccgagcgtttttcctgtatcgtcgggcgtggcaatatattcgccacacagtttcacaccgagaagagccaccgggccggacttcagatgatgaagaacttcctggcctgggacggcaatgtttaa

SEQ ID NO: 757 - DNA, 594 bp, Chromobacterium substugae
atgagaaccgcaaccgtcacccgcaacacgctggaaacccagatcaccgtcatgctgaatctggacggcacaggccagggccgctttgaaaccggcgtgcccttcctcgaccacatgatggaccagatcgcccgccacggcctgatcgacctcgacgtcaaggcggtgggcgacctgcacatcgacgcccaccacacggtggaagacatcggcatcacgctgggccaggccttcgcccgcgccatcggcgacaagaagggcatccgccgctatggccacgcctacgtgccgctggacgaggcgctgagccgggtggtgatcgacctgtccggccgcccgggcctggtctaccacgtcgactacacccgcgccagcatcggccagttcgatgtcgacctgttctccgagtttttccacggcttcgtcaaccacagcatggtcacgctgcacatcgacaatctgcgcggccacaacagccaccaccaggccgaaaccatcttcaaggcattcggccgcgcgctgcggatggcctgcgagcacgacgagcggatggccggcatcacgccgtccaccaagggcacgctgagcatatga

SEQ ID NO: 758 - DNA, 1077 bp, Chromobacterium substugae
atgacgaccaaactgaccgccaagcaactcgtccgcgacgagatcgccgccatcggcgcctaccatgtggcgccggccgccggcttgatcaagctggacgcgatggaaaacccgtggccgctgccgatcgaattgcagcacgcgctggccgccgaactggcccaggtggcgctgaaccgctatccggacgccaacggcggcggcctgaaggacgatctgcgcgccgccttcgctattccggccggcgccgacatcgtgctcggcaacggctcggatgagctgatcacgctggtcacccaggcgttggcgcgtcccggtgccaaattgctggcgctggagccgtcgttcgtgatgtacaagatgaacgcgctgttttccggcctgcagtatgtcggcgtgccgctgaacggcgatttcacgctgaacctgccggccacgctggccgccatcgagcgcgaacagccggcggtggtgttcgtgtcctatcccaacaacccgaccggtccgcgctacgcccgcgacgaggtgctggcgatctgccgcgccgcgccggggctggtggtggtggacgaggcttaccagagcttcgcctccgacagcttcatggatctggcctgcgagctggacaacctgttggtgatgcgcaccctgtccaagctgggcctggccggcatccgcctcggctacgccgcggccagcccggcctggatcgagcagctgaacaaggtgcggccgccgtacaacgtcaacgtgctgaccctcgccgccgcgaagttcgcgctgaagcacctggacgtgttcaaccgccaggccgccgaattgcgcgccgaacgcgcccgcctgagcgatgcgctgtcggcgttgccgcagttggcggtgttcgcgtccgaggccaacttcctcaccgtccgcgcgccggacgcgccggcgctgttccagcacctgaaggcgtccggcatcctgatcaagcagctgcacggcagccacccgttgctggaccactgcctgcgcctgaccgtgggcagtccggatgagaacgccgcgctgctgtccgccatccaacgttttttcgcctga

SEQ ID NO: 759 - DNA, 1293 bp, Chromobacterium substugae
atgttgaaactgtcctcctcccagcccgacttcgccgcgcgcctccaagcgctgctggccttcgaaaccgcgcaggaccccgcagtggacgccgccgtggcggccatctgcgccgatgtccatcatcgcggcgacgcggcgctggtggagtacaccaaccgtttcgaccgcatgcaggcggcctccatggccgacctgacattgtcgcgcgagcagctggaggcggcgttcgcgcggctgccggccgacgtgcgcgacgcgctgaccgccgccgccgaacgcgtgcgccgctaccatgaaaagcagcttgctcactcctggagttatgaagacgaagacggcaccctgctgggccagcaggtgacgccgctggaccgcgtcggcatctacgtgccgggcggcaaggcggcttatcccagctcggtgctgatgaacgcgctgccggccaaggtggccggcgtaggcgaaatcatcatggtagtgccgacgccgggcggcgagcgcaatgatctggtgctggccgcggcctatatcgccggcgtcgacaaggtctttacctgtggcggcgcccaggcggtggcggccctggcctatggtaccgaaaccatccctcaggtggacaagatcaccggccccggcaacgcctatgtcgccgccgccaagcgccgcgtgttcggcgtggtgggcatcgatatggtggccggcccgtcggaaatcctggtgatctgcgatggcgacaccgatccggactgggtggcgatggacctgttcagccaggccgagcacgacgagatcgcccaagccatcctgctgtgcccgtcggccgattacatcgcgcgggtggaagccagcatccagaagctcatgccggccatgccgcgccgcgccatcatcgaggccagcctcggcaaccgcggcgcgctgatccaggtggccgacctggccgaagcctgcgagatcagcaactacatcgcgccggagcacctggagctgtcggtggccgatccggacgcgctgctgccgcagctgcgccacgccggcgccatcttcatgggccgcttcacctcggaaagcctgggcgactactgcgccggccccaaccacgtgctgccgaccagccgcaccgcgcggttcgccagcccgctgggcgtgtacgatttccagaaacgcagcagcctgatccgcgtgtcgcaggccggcgcgcagaagctcggccgcatcgccagcctgctggcgcatggcgagggcctgaccgcccacgcccgcgccgccgaactgcggctggacaagtaa

SEQ ID NO: 760 - DNA, 642 bp, Chromobacterium substugae
atgaagctgaccatcgccctgtccaagggccgcatttttgaagaaacgctgccgctgctggcggctgccggcatcgtgccggcggagaatcccgaatcctcgcgcaagctgatcatcggcaccaatcatccggacgtgcagctggtgatcgtgcgcgcctccgacgtgcccacctatgtgcagtacggcgcggccgacctcggcatcgccggccgcgacgtgctgatcgagcacggcggcgccggcctgtaccagccgcttgacctgaacatcgccaagtgcaagatgatggtggcggtgcaggaaggcttcgattacgacgccgccgtgcgccagggcgcgcggctgaagatcgccaccaaatacccgcagatcgcccgcgagcacttcgccaagaagggcgtgcacgtcgacatcatcaagctgtacggctcgatggagctggcgccgctggtcggcctggccgacgccatcgtcgacctggtgtccaccggcggcacgctgcgcgccaacaagctggcggcggtcgaacacatcatcgacattagctcgcgcctggtggtgaaccaggccgcgctcaagctgaaatacgacgcgatccagccggtgctggacgctttcgccggcgctgtgccggcctga

SEQ ID NO: 761 - DNA, 765 bp, Chromobacterium substugae
gtgagcaacgacacctctcccggcagcccgacaggctcgcatcagccgctggatctggccaagttcaccctggccacgccggcggagatcgcgcagcacctggcgagcatcgccaagcacggccacatggtgacggttttcgccaacaaggggaaaagcttcatcctgacgcgcctgctcgatgtcgacttccagacaggtctgttcacgtttgactggggcgcggaagaggataccaatgcccaggtgctgaacagcgagcgcaatgtcttcgtctgctcgccggaaggagtgaaaacccagttcgtcacgggccaggtgagcaaggtgatgctggagggccggccggccttcctcagcaagctgcccgaacaggtgatcaagctgcagcggcgcgagtttttccgcatccagaccccgctgggcaccccggtgttctgccatatcgccgacttcggccagcgcgccatcgacctggcgctgttcgacatcagcctgggcggcatgagtctgtggctgcccggcgtgtccaccaccggtttcgaaatcggccagcagtaccgccaatgcacgatagacctgaagccgttcggcacgctcaacctcggcatcgaggtgcgccaccggttgaccgcgcgcatgcgcaacggcaacgaggcgatgcggataggctgctcctatctcaacctcacgccgcagatggaaaccctgatccagcgctatgtcggcttcctggagcgcgaacgccgcgcgctggtcggctga

SEQ ID NO: 762 - DNA, 579 bp, Chromobacterium substugae
atgtccaaattcctgcagttgttgcttggcctgctgacggcgttcgcgctgtcggcctgtgcgcccgccgtcaatttcaaaggcacggcgatcgatgacgattccatgggcggcaatttcacgctgaccgatttccacggcaagccgcttggcctggaggctttccatggcaaggtggtggcgctgttcttcggctacaccaattgtccggatgtgtgcccgaccaccatgctggaatacgcgtcggtgatgaagcagctgggcgccgacgccgacaaggtgcaggtgctgttcgtcagcgtcgacccggagcgcgacacgcccaaggtgctggccggctacgtgccgcacttcgacaagcgcttcatcggcttgaccggcacgccggagcagatcgaaaaagtgaagaagcaatacaaggtggtggcgcagaaagtgccgacgccgggtggcggctacagcgtggaccacagcgcgggttcctatctgctggaccagaaaggcaagctgagggtgtttcaggcctatggcacgccggcagccaaccttgcttatgatatccagcagttgttacgctaa

SEQ ID NO: 763 - DNA, 900 bp, Chromobacterium substugae
atgagcgaattgagtttgccgctgtggcggcagcacgcgcaggccttgtggcagctgtccaagcccagggtggtggcgctgatcgtgttctgcgcggtgatcggcatgtttctcgccagcccggggctgcccgaccccgcggtgctggcggcggcgactctgggcatcgcgctggtggcggcggcggcggcgatgatcaactgcctggtggagcgcggcgtcgacgcccgcatgcgccgcaccgcctggcgcgccaccgtcaccggcgagatcggcggcctggaaaccctgctggcggcgctggcgctgggcggcatgggcctgctgctgctgtttgccggctgcaacgcgctgacggcctggctgacgctggccacctttgtcggctacgccatcgtctacaccctgctgctcaagccgaacacgccgcagaacatcgtgatcggcggcgccagcggcgccatgccgccagtgctgggctgggcggcggtcagcggcgagatcagcgccttcgcgctggtgctgttcctgatcatctacgcctggacgccgccgcatttctgggcgctggcgctgtaccgccgcgacgactacgcccgcgccaatctgccgatgctgccggtcacccacggccagcgctacaccaccttgtccatcgtgctgtacacgctgctgctgtcggcgatcaccttgctgccagtggctttgggtgagtcgggccggatttacatggcagcggtattgctgctggacgccaggctgctgtttcttgctgtcagcctgcatcgccagtatgctgacgctctggcgcgccgcacgttccgctggtcgatctggtatctgacctggctgttcgcggctttactgatcgaccactactgtctgataccgcttacctga

SEQ ID NO: 764 - DNA, 1026 bp, Chromobacterium substugae
atgcgaaaactggtttggctggccttgctgctggccgcggtcgtggtgccgttcggcgcctatgtcagattgtcccatgccggcctcggctgtcccgactggcccggatgctacggccagttgtcgccgtcgcacgcggcgcttgccatccagcaggcccaggcgctggcgccggatgggccggtcagcctggacaaggcctggaaggagatgctgcaccgctacctggccggcagcctgggcgcgctgatcgtattgatcgcctggcaggcctggcgcaccggccggcagcggctgccggctgcgttgttgctgggtgtggtgctgacgcagggcctgctgggcatgctgacggtcaccctgttgttgaagccggccatcgtcacctcgcatctgctgggcggcatgggcgtgctgcagatcctggcgtggatggcagcatcgccgcggctggccgcggtgacagcgccgccgctgctgggccgtctgtccggcctgctggcgtcggcgctggcgctgcagctggcgctaggcggctgggtgtccagcaattacgcggcgctggcttgccaggggtttcccggctgcaacggcgacgcctggccggccctgcggttcgatcatgccttccatctgctgcgcgagctgggcgaggcgccggacggcagcctgctggatttcgccagtctggtgaccatccattggctgcaccggctgggcgcgctgctggtgtcgctgctgttgctgtcggtgctggcgctgggctggcggctgccgccgctgcggcgccatctggcctggctggccgcggcttggctgctgcaggtgggcctgggcatcgccaacgtgttgctgcagctgcctttgccgctggcggtggcgcataacgccggcgcggcgctgctgctgatggccgctttattgctgctgtcgcggctgcggccgcgcgcggctgaactcaggccggcggcgcgggtgacgccggccgtcatgaccggcgtcaccagaccgggagagggcagatga

SEQ ID NO: 765 - DNA, 513 bp, Chromobacterium substugae
atgaagtccattaagcgcggacaaagagcgctgatcgcgatggccctgctatgcctggcgccggtggtggcggcgtggctggcctatgcgctgctgccgccgggaggcggacgcagctacggccagttgttgcccacccatcccttcgccgcgtccggccagccggagtggccgcgcggcaagtgggtgctggcctcggtgctgggcgcggactgccataaccgctgccggcagcgctggtatgcgatgcggcagattgaacgggcgcaaggagaggcggcatcccggctgacccgggtggcgctgctggtgtcgccgcgggcggcggcgatggacgatgttccgcacaggctgcctcatatttccgctcaggcgctgccggcgggcaaccagggcttttacctggtggacccgctgggcaatcaggtgatgttctaccaggacggcgccgacccgcggcggatcatcgatgaagtggcgaaggtgctgaaggtgaacaacggcttgggctga

SEQ ID NO: 766 - DNA, 723 bp, Chromobacterium substugae
atgaccgtatcctccacacattccgattcggaaaagaagcagcgccggccagggtggcagcggacgctatggctgctgctcctgctgatcaccttattgccttatgcattggcagtatggcagtggcagcggggtcaagacaaggaagtgctgatgcgctcgctgaccagcgcgatgagcaccgcgccggttggcttggtgtaccgggaggcggagccgccgccggccttcacccgggtgcggctggcgcagggcgagccggccggaccggtcatcgagctgcgcaacagctatctgggcggccagagcggccgccgcatcctgcagccctggcggcaggggccggaccgttcactggtgttgctggatttgggatggctggtggacggcgccaaaatgcctgactttccgccggaacagattcagccgcagggctaccggatgccgacgccccatcatttcgtcctgtccggcgcggccaagggtacggcgggaccggtggacgaggtggacgaggcggcgctgcgccgccgttatcccgggcattggttccagggcgtggtggtgctggagaactctcccgacccgctgctgcactggccggtggtgccggagttcatgccggatcgacattacgcctacgccatccagtggctgttgttgggattttgcctgaccggcttgagctggctgatgtggagacgccgacatgaagtccattaa

SEQ ID NO: 767 - DNA, 198 bp, Chromobacterium substugae
atgaaactcgtcatcctgttcttgcttgtctgcatcgtcctggcgttgttctgggggctgaccggactgctcaaagccgagcatggctcccaacgtctggtcagatcgctgaccctgcgggtcgggctctccatcggcctgttcctgttattgctgctgggcgcgctgttcggctggtggcgcccgcaccaggtttga

SEQ ID NO: 768 - DNA, 873 bp, Chromobacterium substugae
atgtcaactgagcaaatggcgtccgtcgccgagcaggaccgatatttcgtgccgccgccatcgcgctggcccatggtgggggcggtggcgctgttcttcatcgggctgggcgcggctttcgcggtcaacggcctgctgttgggcaagctgtcgctggggctgggcttcctgatcctagtgttcatgctggtgggctggttcggcgatgtgatccgcgaaagccgccatggcgtttacctagggcgcgaggacatgtccttccgctgggggatgggctggttcatcttttccgaggtgatgttcttcggcgccttcttcggcgcgctgttctgggtgcgtacggtgtcggtgccgctgctgggctcgctggactacaagatgctgtacccggacttccaggcgtcgtggccgctggccaccgggccgggcatcaccgaggcttaccaggcgatggaggcctgggggctgccggcgttcaatacgctgatcctgctcagctccggcgccaccgtcacctgggcgcactgggggctgctgcaaggcaagcgcgagcaattcaagctgggattgctgctgacggtgctgctgggcttctcttttctgacgctgcagctgcacgagtacggccatgcgttttccacgctgcatctgacgctggcttccggcgcctacggcatgaccttcttcatgctgaccggcttccacggcctgcacgtgctgctgggttccatcatcttgctggtggtgtggttgcgcgcgttgaacgggcatttcgacgccagccagcatttcgccttcgaggcggccagctggtactggcacttcgtcgatgtggtatggctgctgctgttcatcttcgtttactggctatga

SEQ ID NO: 769 - DNA, 177 bp, Chromobacterium substugae
atgagctgggtgcaaggagtgcgggcggtgctgggcgctttcatcggcgtgcgcaagggttccgcggccagggtggatcagatcttgaagccgtggcagttgatcgcgacggccctgctgctgatggcggggctgatcgcgctgttgctgttggtggtgtcctgggtgaccagctag

SEQ ID NO: 770 - DNA, 549 bp, Chromobacterium substugae
atggacacggccgccaggacgcagcgccgcaacttccgcctgatggggcggttgatggtgatcgccgcgctgatgttcggcttcgcctggggcatgattccgctgtaccggatcgtctgcgagcagaccggcctgaacgatgtggtgaaggcggacgagctgtccagcggcgacctggcggccggcggcgccgaagtcgacatgaccttcgacgccacggtgcaggcgggcttgccatggcaggtcagaccgctgaccaggcatctgaaggtcaaacccggcaccttcgtccaggtgcagtaccagatcaccaatgccagcccgcacgaggtggtcggccaggcgctgccgcgctacctgcccggcgaggccgcgcagtatgtgaagaaactggagtgcttctgcttcacccagcagcgtttcctgccgggacagacccgcacctttccggtggtgttcgtgatcgaccgcaagctgccggcctcgatcgccagcatcacgctggcttacaccgtgttcgatgtgccggggcagggaggcaagtcatga

SEQ ID NO: 771 - DNA, 1635 bp, Chromobacterium substugae
atggcaatcgcagaaaccacccacgccggcggcgcccaccacggcaagccgcacggcatcgcacgctggctgatggccaccaaccacaaggacatcggcacgatgtacctgtggttctccttcaccatgttcctgtccggcggcgtgctggcgctgtgcatacgcgccgagttgttcagccccggcctgcgcttcttccagccggagctgttcaaccagctgaccacgctgcacggcctgatcatggtgttcggcgccatcatgccggccttcaccggcatggccaactggatgctgccgctgatgataggcgcgccggacatggctttcgcgcggatgaacaactggagcttctggctgctgccgccggcggcgctgctgctgttgctgtcgttcgcggtgccgggcggcgcggcggcggccggctggacgctgtacgcgcccctgtccacccagatgggcgtggggatggacatgaccatcttcgccatccacattctgggtatcagctccatcatgggctcgatcaacatcatcgtcaccatcctcaacctgcgggcgccgggcatgacgatgatgaagatgccgatgttcgcctgggccagcctgatcaccgcctatctgatcatcgcggtgatgccggtgctggccggggtggtgaccatggtgctggccgaccgccacttcggcagccacttcttcaacgccgccggcggcggcgaccccattctctaccagcatgtgttctggttcttcggccaccccgaggtctacatcatggcgctgccggccttcggcatcgtcagccaggtgattccgaccttcgcgcgcaagcccctgttcggctacacctcgatggtttacgccaccagctccatcggcgtgctgtcgttcatggtgtgggcgcaccacatgttcgccaccggcatgccggccaccgcccagctgttcttcatgtacgcgacgatgctgatcgcggtgcccaccggggtaaaggtgttcaactggatcgccaccatgtgggaaggcagcatgacgttcgagacgccgatgctgttctccatcggcttcatcctgctgttcaccatcggcgggctgtccggcatcaccctcagcgtggcggcggtggacatccagctgcacgccagctactacgtggtggcgcatttccactatgtgctggtggccggcgcgctgttcagcctgttctccgccatctattactggtttcccaagatgagcggccggatgtacagcgagaggctgggcaagctgcatttctggtggtcgatgatctggttcaacgtcaccttcttcccgatgcacttcctcgggctggcgggcatgccgcggcggattcccgactacgcgctgcagttcaccgaattcaaccagatcgccagcgtcggcgccttcatgttcggcctgggccagctgatcttcctgtacaacatcctgcattcgctgcggcacggcgcggtcgcgccgcaaaggccgtgggagggcgccaacacgctggagtgggagctgccgaccccggcgccctaccacagcttcgagcaggcgcccaagctcgaggtcggggagaacggcgtgatcctgtcccacctgccaggcgagccgcgcgcgcattga

SEQ ID NO: 772 - DNA, 1107 bp, Chromobacterium substugae
ttgcgcattctgtgctgtttgctgctggccgcgcaaagcgcggcggcggcggaattcaacctgcaggcgccggtcaccccgctggcgcgcaccgaataccatctgcacaccctgctgctgatcatcaccggcgtcatcttcgccgtggtgttcctggtgatgctgtactccatcatccgccaccgcaagtcggccgggcaccaggccaagcagttccacgaaaacaccacggtggaaatcatctggaccgtggtgccgctgctgatcctggtactgatcgccctgcccgccacccgggcggtgctggcccagaaaggcactcgcaacgaggacatgaccatcaaggtcaccggctaccagtggaagtggcgctacgactatctggatgacaacttcggcttcgtcagccacttgtccacgccgcgcgaggcgatagagggcaagatcccgcggccggccaattacctgctggaggtggacgagccgctggtggtgccgaccaaccgcaagatccgcctgctgctgaccgccaacgacgtcatccactcctggtgggtgccgcagctgggcgtcaagcaggacgcggtgcccggcttcctgcgcgacagctggatgctgatagaacagccgggcacctaccgcggccagtgttcggaactgtgcggcaaggaccacggcttcatgcccatcgtggtggtggccaagtcgccggacgactacgccaagtggcgcgaggccaagatcaagcagatggcggccagcgccgacgatcccaacaaggtgtggaagctggaggacctgaaggcccgcggcgagaagatctacacccagaactgcattccttgccatcaggccaacggcaagggcattcccggcactttccccgcgctggacggctcgcccatcgccaccggcgacaaggccgcccatatcgagatcgtgctgttcggcggcaagaagaacccggcgatggcggcctggggcaagcagctgtccgataccgacatcgcggcggtgatcacctacgagcgcaacagctggggcaaccataccggccaggcggtgcagcccaaagaagtgaaggccgcgcgcggcaaagcggcataa

SEQ ID NO: 773 - DNA, 828 bp, Chromobacterium substugae
atgaagcacccgatcgcgctggcggcaggctggctggcagccgtctgcgccctcgcgccagcccaggccaagacgatttgcacggcggtggccgatggccacagcggcgccatcctgctgcagcagggcgattgccgcgatcgcgtctcgccggcgtccacattcaagatcccgctggcggtgatgggatacgatgccggctttctcaagagcgagcatgcgccggcgctgccctaccgccagggttatgtcgactggggcggcgaggcgtggcggcaggacaccgatccgacgcgctggctgaaatattcggtagtgtggtattcgcagcagattacccaccgcctgggcgccgaggcgctgggccgctacgtgcgggcattcggctacggcaatgccgatttctccggcgatcccggcaagaacaatggcctggagcgggcttggatcggctcttcgctgaaagtgtcgccgttggagcaagtggctttcctcgacaatctgctgcacgaccggctgccggcctcgccagaggcgcaacggttggcgcgcagcatcgtcgaacaaaccgcgctgcccggcggctggaacgtgcgcggcaaaaccggcatggcttacccctggctgcggaacggcaagcaggatctggcgcacccgtatggctggttcgtcggctgggccgagcagggagagcgccggctgatattcgcccgcctgatccaggacgatggcaaactgccgggcaccccaggcgtgcgctcgcgcgaggcctttctcaaggaactgcccgcgctggcggatgggctggccgacggcaagcgccgctga

SEQ ID NO: 774 - DNA, 627 bp, Chromobacterium substugae
atgagccagggctatttcatcaccggcaccgataccgagatcggcaaaacccattccgcagtcgagctgatccgccattaccgggggcaaggcagatcggtgctggcgatgaagccggtggcgtccggttgcgagattttgccggatggccgctggcataacgacgatgtggcgcgtttgaccgccgccactgggcaaaccgatctggagctgatgaatccctaccgctttttgccgccggtgtcgccgcacatcgccgcgcgccaggcgggagtggagatcgacttggcgcgcatccgccagcattatgagcaactggcggcgcaggccgacatcgtgctggtcgaaggcgcgggcggttggctggcgccattgaccgatgcgctgttcatggaggatttggcgcgggatttggccctgccggtgatcctggtggtgggcatgcggctgggatgcatcaaccacgcgttgctgacggcgcgcgccatccagggcagcggcctggcgctggccggctgggtggccaattgtccgcagccgcggcaggccgcgtatgacgagaatctggaaaccctcaagcgccatatcccggcgccgatgctgctggaaatcccgtaccagccatga

SEQ ID NO: 775 - DNA, 999 bp, Chromobacterium substugae
atgcgtcatttgcagccgggcgatatgctcgcctgtttcagtccttcttttcccatcacggcgaggcagccggcgcgttaccggcgcgcggtggagtttgtcggcaggcagggattgcgtttcctgcccggcgcgttgaccggcgccgacgacggctaccgttccggcagcgcccgcgagcgggcggcggagttcaatgccttgctgcgcaaccccgaggtgcgttgcatcatgtccaccattggcggcagcaacagcaatgcgatgctgccttatctggactatgacgccttccgccgcgatcccaagatcgtggtcggctattccgacgccaccgcgatcctgctggccctgtatgcgaaaaccggagtcccgactttttatggccctgcgctggtcgcgtcgctgggcgagtttccgccgctggtggaggagacctggcgggcttttgcagcattggcgatgggggagccgtcctatccatacgcattgcggatgcccgcgcattggagcgatgaacgtctgccgtgggagagccaggatcggcccaagacgctgcaagccaaccagtggcgctgcattcaacctggccgcgctgagggccgcctgataggcggcaatctcaatacgctgtacggctttctcgccagcgaatattttccgcctatccgccaaggggacatcctgttgttggaggatggcctgaaagatgcggccacggtggagaagaacctcgccatgctgaagctggccgggatattcgacaaagccggcgcggttttgctgggcaagcatgagggtttcgatgattgcggcactggccgcagaccgtcctacattctgctggaggtgctggatggcctgccgctgcccatactcgccgacttcgactgctgccatacccacccgatgctcaccctgccgctgggggtgaatgtcagggtggatgcgggcgaatcgatggtggaaatactggaagactggcgcgcgctggtgtag

SEQ ID NO: 776 - DNA, 444 bp, Chromobacterium substugae
atgaacgaaaacgaagccttcgcgacgctggccggcatgggcatcatgatgctggtggtcgcgggcgcgctggcgctggcggtcagcatcttctactacctgacgctgcaccagacgatgaacgcgatcagcgaggtcaaccggccgctggccggcggcctggtctggctggcgctgatccccttcgtcggcgtgatctggtacatggtctacatcatcctgctgtccaacgcgctgaaacgggaggcggcgcaacgcggcctgcccggcgacggcgccgccggcgtcagcctggctctggccatcctgctggcgctgtgcttcgtgccctacgccaacctgatcgcggtgattcccgccatcgcgctgtgggtgatccactgggcgaggatggccggctaccgcaagctgctgcaggcggcgcagccggcattggcgacctga

SEQ ID NO: 777 - DNA, 1788 bp, Chromobacterium substugae
atgcaagtggatatagaacgactggtggcggacttcggcgggccggggcggctggcggatgaattgaaccggttgttcccagacgagcaggtgagccgggcggcgatatacaaatggagggaacgcggcagcctgccgctggcgcagctgagccgactggcgcagctggccgccggccagggcaggcgctttgatttcaacgactatctggtcggcgagccggcacagggagcagggagagctatcaatatgggcgatcgtctttacatcttcgacaccaccttgcgcgacggcgagcagtcgccgggcgcatcgatgaccaaggaagagaaaatccgcatcgcgcgccagctggagcggctgggcgtggacatcatcgaggccggcttcgccgccgccagcccgggcgacttcgacgccatccatgcgatcgccgaggtgatcaaggaatccaccgtctgtagcctggcccgcgccaacgagcgcgacgtgcgcgccgccggcgaagccatcaagccggccgcgcgcggccgcatccatactttcatcgccactagccccatccacatggaaaagaagctgcggatgagtccggacgaggtggtggacgcggcggtgaaggcggtgaagatcgcccgcgaatacaccgacgacgtcgagttctccgccgaggacgcgctgcgctccgacatcgacttcctggcccgcatcttcggcgaagtgatcaaggccggcgccaccacgctgaatgtgccggacaccgtcggctacgctgtgccgcgcctgaccgaggctttcttccgcgagctgatcgcccgcacgccgggcggcgaccgggtggtgtggtcggcgcattgccacaacgatctgggcatggcggtggccaacagcctggccgcggtgctgggcggcgcgcgccaggtggagtgcaccatcaacggcctgggcgagcgcgccggcaacgccagcctggaagaaatcgtgatggcggtgaagacccgccgcgacgtgttcggcgtcgacagcgcggtcgatgccacccagatcgtgccggcatccaagctggtgtcgactgtcaccggctacccggtgcagccgaataaggccatcgtcggcgccaacgccttcgcccacgagtccggcatccaccaggacggcgtgctcaagcaccgcgaaacctatgaaatcatgtcggccgagtcggtgggctggagcgccaaccgcctgacgctgggcaagttgtccggccgcaacgccttcaagaccaagctggccgagctgggcatcgtgctggacagcgaagaggcgctgaacgccgccttcgcccgcttcaaggagctggccgacaagaagcgcgagatcttcgacgaagacctgcacgcgctggtgtcggacgaaatggtggcgatcgagcaggagcattacaagttcgtgtcgctgcgcatcgccaccgaaaccggcgaggcgccgcaggccagcatcgtgttcgccgagagcggccaggagcgccatgccgaatccagcggctccggcccggtggacgccgcgttcaaggcgatagaaagcatcgcccacagcggcgccgagctgcagctgtattcggtcaacgccatcaccaagggcaccgagtcgcaaggcgaggtcaccgtgcgcctgcagcaggacggccgcatcgtcaacggccagggcgccgacaccgacatcatcgtcgccagcgccaaggcctatctgtcggcgctgaacaagctctccagcgaagtgaaggtgcacgcccaggccatagtctga

SEQ ID NO: 778 - DNA, 966 bp, Chromobacterium substugae
atgccgctgatggcctgcgcggaaggaaacgacggccagaccggcggcggtttttccggatcgctgggcttgggcgtcggctattaccgggtggaaaccaatttcttcaaaacccccagcgatgaccagcgttcgatttccagcctgaattcatccccggcgacgcagcattacgtcaccggcgtgccgtccgccaacctgcgctacgcgctgcccggcagcggcacccagctgttcctgagcgtggagccgctggctacgctgggcgagggcggcggcctgcaagccggcgtgcgccagacgctgccgggcgccggcaccctatctgccgcgctgaaatacgaccaggccagcgtctggcgcgacccctacgcgctgaataccgagcgcagcgacgacaagctgaaaacctacggcttcgcgttcggctggcacggcatcatggaaacgccgttcagcgccagcttcagctacggcaaggtcaagatgaaccaggagcaaagcgggcagaacctggggctgtcggcggcgaaccaggccctgctcgaccgcaacggcaagcaatacggcgcgcagctcgcttacacgctgaaactggatccggccggacagcaaagcctgagtccggcgttgatttatgtccgcaacgatctggacggcaaggcgatgagcaccacccgcagcggcctgcaactggcctatgcctacaagggcgacctcaatgagctgagcgccgcgctggccatcgcccgcaccggctaccaggccggcaatccgattttcgccggacgcaaggccgacagcgacgactacctgctgaccgccacctacacccgcaagcagctgttcggcgccaaggcctggtcggccttcgtcagcggcgtgtatggccagtccaattccgacatcagcttcttcgacgcccaggcccgcgcgctcaacgtcggcatcggctaccgcttctga

SEQ ID NO: 779 - DNA, 900 bp, Chromobacterium substugae
atgcgcaacgccatgcgttataatccgccgtttacattaaatattttgagaacgcccgtgtccgagcgcctgtttgtattgtcccagcacgtgatgcccaagctggccctcacccgtttcgcgggatgcgtcgccggctggaagggcggcagcctgaccaccgcgctgatccgccgcttcatcgcccgttacaacgtggacatgagcgaagcgcaaaacagcgacccggcgtcctacgccagcttcaacgatttcttcacccgcgcgctcaagcccggcgtccgcccgctcgccgacgcgcgacaggtctgcccggtggacggcgcggtcagccagttgggggcgatagacaacggccgcatcttccaggccaagggccgcgactacagcgccaccgcgctcttggccggcgacgccgagctggccgcccgcttcgccgacggccacttcgccaccatctacctcagcccgcgcgactaccaccgcatccacatgccctgcgccggccggctgctggaaatgacttacgtgccgggcgagctgtactcggtgaacccggccaccgcccgcggcgtggataggctgttcgcgcgcaacgagcgcgtggtgtgcctgttcgaggacgagcaggggcagccgttcgtgatggtgctggtgggcgccaccatcgtcggcagcatggccaccgtctggcacggcgtggtcaatccgccgcgccggccggcgctggagaaatgggattaccgcagccaggacatccgcctggccaagggcgaggaaatgggccgcttcctgctcggctccaccgtggtgctgctgtacccggccggcccgctgcgcttcaacccgcaatggcagcccgccagcccggtgcggctgggcgagaaaatggccgactga

SEQ ID NO: 780 - DNA, 1062 bp, Chromobacterium substugae
atgcacatcaccgatgttttgcgcaaaaccatccacaaccccgccacctggagtcagcaggagctgtacgacaatctgcaggccgcggtggacgtggagctgtggaccatcccgctgtacctgaccaccctgtattcgatgcagggcttgaacgccgacgatcagcaggcctatccgggcgtggccaagctgatcgaaagcgtggtgatccaggaaatgctgcacctggagctgatttccaatctgtgcaacgcgctgggctacgcgccgcgatatccattccccagcaatgaagaaaccgagggcattcccttcctcaaacccgacgtgccgccgcaatacgccggctatcaagtcaagctggggccgctggacatcaaccagctcaagctgttctgtgtgatcgagttgcccgagccgcccggcaagccggactggaacaagcaaacccgctacaactcgataggcgagctgtaccaggcgctggaaatcgccgtcaaggtgcagtggaaagacctgtacgtcggcgcggccgccaacaccaagcaacaggccaacttcaccgactacgcgcagaaaaaccagcacggcgccggtttcagccagaccatcaacagcctggagcaggcgctggcggcgatgcaggccatcgtcaaacaaggcgaaggcaaccgcgccaccgcggaaatcccgctgcgcgaccagccgccggcggaaaatccggccaattacgaccccagcgatttcgatccggcgcagagccatttcctgaaattcaatgaaatcctcgacatcctgcgcctggggctcaccccctggattcccgccgtctacccgctgattccccgccccgacaagcaacaactggcggagcaggaaatggcccagcgccaattgcaggccggcttccgcgccttcatggcgcaactgcaaaccggcttcaacaccgcgcagcccaatcagcaaatgccgggcagcttctacaacagcatgttcaatctgcagaacctgatcaccgcggtctggcaaaccggcgcggtgccggcctttcccagcgagtga

SEQ ID NO: 781 - DNA, 1017 bp, Chromobacterium substugae
atgaaagtttattacgacaaagacgccgacctctccatcatcaagggcaagaaagtggccatcatcggctacggctcgcagggccatgcccacgcgcagaacctgaaggaatcgggcgtcgacgtcatcgtaggcctgcgcaaggacggcgcgtcgtggaagaaggccgaagcggccggccacaaggtcaaggaagtggccgaggcggtgaagaaggccgacgtggtgatgatcctgctgccggacgaatcgcagccggacgtctaccacaaggacatcgcccccaacctgaagaagggcgcggcgctggccttcgcccacggcttcaacatccactacaaccagatcgtgccgccggccgatgtcgacgtgatcatggtggcgccgaaaggcccgggccacaccgtgcgttccgaatacctgaagggcggcggcgtgccgaccttgatcgccgtctaccaggataaatccggcaaggcgcgcgacgtggcgctgtcctacgccgcggccaacggcggcaccaagggcggcgtgatcgaaaccaacttccgcgaggaaaccgagaccgacctgttcggcgagcaggccgtgctctgcggcggcgccgtcgagctggtgaaggccggcttcgagacgctggtggaagccggctacgcgccggaaatggcctacttcgagtgcctgcatgaactgaagctgatcgtcgacctgatgtacgaaggcggcatcgccaacatgaactactcgatctccaacaacgcggagtatggcgagtacgtgaccggtccggaagtggtgacctccgccaccaaggaagcgatgaagaaggcgctgtaccgcatccagagcggcgaatacgcgaagatgttcatcctggaaggcaagaccaactacccgtccatgaccgcccgccgccgtctgaccgccgcccacccgatcgagaaggtcggcgccgagctgcgcgcgatgatgccgtggatcgccaataacaagctggtggaccagtccaagaactga

SEQ ID NO: 782 - DNA, 492 bp, Chromobacterium substugae
atgcgacacatcttatccatacttctggaaaacgaagcgggcgccttgtcccgcgtggtggggctgttttcggcccgcgcctacaacatcgattcgctgacagtgtccaccaccgaggacccgacgctgtcgcggatgaccatcgtcacccacggttccgacgaagtcatcgagcagatcaccaagcagctcaacaagctgatcgaggtggtcaaggtgatagacctcaacgaatccgaacacatcgaacgcgagatgatgctgatcaaggtccgcgccgtaggcaaggaccgcgaggagatgaagcggatggccgacatcttccgcggccgcatcatcgacgtgacggaaaagacctacaccatcgagctgactggtacgagcgacaagctcggcgcctttatcgaggcggtggaccgcacagtgatcctggaaacggtccgtaccggcgcatccggcatcggtcgaggcgaacgggttctgaaaatttaa

SEQ ID NO: 783 - DNA, 1389 bp, Chromobacterium substugae
gtgagcacaacttcctcaaggacgacgagatcgccgccaccatcaagaaggcgttctacatcgccaagagcggccggcctggcccggtggtggtggacatcccgaaggacatcacccagcagcgcgcggaattccattacccgggaaagcgtgcacatccgctcctacgtgccggccacccgcgggcacagcggacaaatcaagaaggcagtcaacctgctgcttgaggccaagcgtcccttcatttatgtcggcggcggcgcggtgcagggccgcgccgaggccgaggtgaccgagctggtgcgctccttgaacctgccgtgcaccaacacgctgatgggcctgggcgcctatccgggctcggaccgccagttcctcggcatgctgggcatgcatggcacctacgaagccaatatggcgatgcagcattgcgacgtgctggtagccatcggcgcgcgtttcgacgaccgcgtgatcagcgtgccgtcgcatttcctcggccgtcccaagaagatcatccacatcgacgtcgacccgtcgtcgatctccaagcgcgtgcgcgccgacatacccatcgtcggcgacgtcaagctggtgctgaaggaaatgctggagcagctgaagcagtccggccagaagccggatggctcggcgctgaaccagtggtggaagcagattgaggaatggcgcggccacgactgtctgctgtatacgccgtccagcgagctgatcaagccgcagatggtggtgcagcagctgtacgagatcaccggcggccaggccatcatcacctccgacgtcggccagcaccagatgtgggcggcgcagtactacaagttcgaccgccccaagcaatggctgaactccggcggcctcggcaccatgggcttcggcctgccggcggcgatcggcgcgcaactggccaaccccaacgcccaggtggcctgcatcaccggcgagggctcgatccagatgaacatccaggagctgtccaccgccaagcagtaccacaccccggtgaaggtggtggcgctgaacaaccgctacctgggcatggtgcggcagtggcaggagttcttctacggcacccgctactccgagtcctacatggacgcgttgccggacttcgtcaagatcgccgaggcctacggccacgtcggcttcaaggtggagaacccggccgacgtcgagccggtgctgcgcgaggcgttcagcgacaagctgaaggagcgtctggtgttcctggatttccgcaccgaccagtcggaaaacgtgttcccgatgatccagaacggcaaggggctggatgagatggacctgccgccgcacatgcgcgacatccagcaggtgcctttcgagaacaaccgtgactacggcaatatgtgctaa

SEQ ID NO: 784 - DNA, 567 bp, Chromobacterium substugae
atggcaagccgcaaggaaatggccgactttctgcagtcggtggaaaaacgcgccttcaagcaggcgctgtacgcggtgcgccaggaagacaatgcgctggacatcgtgcaggactcgatgatgaagctggccgaccgctacgcgcacgcgcctgccgacgaactgccgctgatcttccagcgcatcctgcagaacaccatccgcgaccactaccgacgcagcaaggtgcgcagcttcgtcagcaccctattgtcctcgctgatccccacccatgccgaggacgacagcccggatccgctggaaaccctggacgtggccgccgacgaggcgcacaccaatcctgagcagtggtaccagcgcaaggaagtggcgcagatgatagacgcctccctgcagctcctgcccgcccgtcaacgcgaggccttcctgctgcgttactgggaaggactggatgttgccgaaaccgcccaggtgatggggtgctcggagggcagcgtgaagacgcattgctcgcgcgccaaccacaccctggccgccattcttgcgcaaaagggagtactgctatga

SEQ ID NO: 785 - DNA, 381 bp, Chromobacterium substugae
atgaatcacgccaacgatagccaaggcgaccatttgccgtcccacatcacccgcattctggacacccccaccgccgaacccacccacgcccagatggagcgcctgaaagtcgcccgcgcccgcgcgctgcagcgcttcgaccagcgcgccgccgaacacatcagcctgcaggaaagactggcgatctgggcacagcgccatacgctgctgctcaagcgcggcggcgccgcgctgggcttcgccgtggtcaccggggccggcctgatgctgctggacggcctgctggtggagagcgaagcggtcgacgccgcggtgctgtcgcaggacctgccgctcaactccctgctggagcccaatttcagccgggggctgcatgagtaa

SEQ ID NO: 786 - DNA, 393 bp, Chromobacterium substugae
atgagtaagaccagacgcctggcctgctcgctgggcctggccagcctcttcgccgccgccttggcgcaagcttctcccctggcggatccccgctgggatcaattgaacagcgaacagcagcaggtgctgtcgccgctggcggcggaatggaaccgttacgcgcccaacaagaagcagaacctgctcgccatcgtcccccgcttcatcgacctgccgcccaagcagcagcaaagagtgcggcagcggctcaaggcctggtcggagctcagccagccgcaacgcgacgagatccgcgccaactggaaaaaattgcagcagctgccgcccgagcagcgcgagcgcgtgatgcggcgcctgcgcgagggcggcgccaaaccggaaaccccgcaataa

SEQ ID NO: 787 - DNA, 516 bp, Chromobacterium substugae
atgaacgactttcccgtccccagcctgctccgctgcctggccagcctgtgctacgaaacgctggtgctggtcgccatcatgctgctggtcggcgccgcgctcacgccgctgcagttggtgctgggccaggattcggcgctgctgcacgcgctgatccagctgggcgtggccgccgcgctgttcgcctatttcggctactgctggacccgcagcggccagaccgtggcgatgaaaacctggcatatccgcctggtggcggccgatggccggctgcttggctggcagcaggcgctgatgcgcttcgccatcgccgccatgctgttcgtcggcctgccggtggtgtcctacctgggctggcaacgcagctacggcgaccatcccgccgtcaaatggctggcgctgatctggtggctgctgcctttcctcgcgcgctactacgacaaggacaagcgccatctgcacgaccgcctggccggcacccgcctgctggtgctgcccaagccgccgcgccgctag

SEQ ID NO: 788 - DNA, 948 bp, Chromobacterium substugae
atggattatgaaaatagaatcaaaaaatcaatctcaaattccgtttttgcaatcatgctggatgatctggaactattcgtggcgatcgtggatgccggcagcctgaacgcggcggccaagcggctggggatgccggcgccgaccctgacccgccgcctgcaggccttggaggcgggcctggactgcaagctgctgaaccgcagcgcgcgccggctggcgccgaccaacgagggctggcaatactacgagcgctgcaagccgctattggcggcgctgcggcgggaaacggccgcgctggatggaatgctgaaccgggtggagggcgtggtgaggctgctggcgccgctgagcatggccaacgacatgctgctgccggtgtggacgcgcctgctgcgcgagcatccgcggctcaagctggaattgaagctgaacaacagcctggatgatttatacagcggcatggccgatctggccctgcgggtgggggagcaatcggacgccgcgctgcggcagcgcaaggtcggcatggtgcgcaccatgctggtggcggcgccggactatcaggctgcgcacggcaagttggagcggccggccgatctggcggcgcaccgcttgctgctggccgagccgtttgagcgttggcggctgcggcatgcggaaaccggcgaggaggccgcctggccggcggagcccgatttgcaggccaacgacatgctgctgacgcgccgcctggcggaggcgggggccggcatcgcggtcagcccgctcagcatctgccaccggcaattggcggaagggcggctggtgcgcgtgctggagcagtgggagatcgccgcccggccggtttacgcggtgtggccgcagcggcgcgcgctgccggcgcgggtgcgggcggtgctggacgcgctgctggacttcgcggccgacgcgccgcaattgcggggatga

SEQ ID NO: 789 - DNA, 429 bp, Chromobacterium substugae
atgagagtcgattacacccaactgtcgcccaaggcttaccaaggcctgctggcctgcaagaacgcgctggcggaaagcccgctgggcctgcccttgatcgaattggcgtatttgcggatcgcccagctcaacggctgcgtgttctgcctgaaactgcacagccatgcgctgcgccgcaggggagaaagccaggagaagctcgacgcgctggccggatgggatgtggcggaagaaaagctgttcacgccgcgcgaaagagccgccatcacctggaccgaggcagtcacccgcataggcgaaagccgcgcgccggacagcgtctacctgccgctgcgcgaacacttcagcgacgcggagatttccgacctgacgctggccatcgcgctgatgaacgccttcacccgcgtcgcggtggcggtgcggcagtaa

SEQ ID NO: 790 - DNA, 291 bp, Chromobacterium substugae
atgccttttccctggttctggattttcgcgccgcagatcaatctgcccttcagcggcaatgtgctgcaggacatcgacccggccacttactggctgaacctgttcgcgccgtggcagggcggccgctggcaatggcatgatctgggcgattgccgcaaggcgctggacttgctggcgttgtctccggcggctgccgaagacgcggcccggcaacaggccttgctgacgctgcgggcatggctgccggcggcgaaccgggtgctggtgtggcacccggcccattcaggctga

SEQ ID NO: 791 - DNA, 1308 bp, Chromobacterium substugae
ttgaaaacagcggtacgcggcgatgtgctgactttccggggcaacccgttccgggaggccgagcaggacagcctggcattccagcgcgacgcgctggtggtgatggaaaacggccgcatcgcggcatgcggcccggcggccaagctgttgccgacgctgacgccggatgtccggctgacgcattaccccgagcacctgatcctgccgggcttcatcgactgccacgtccattatccgcagaccgagatgatggcggccttcggcgagcagctgctggactggctgcatcactacaccttcgtcaccgagcagggcttcgccgatgaagtgcacgcgcgcgaagtggcgcaggtgttcttgtccgagcagctgcgcaacggcgtcaccaccggctgcgtgttcggcaccgtgcactccgcctcggtggagatcctgttgcaggaagcggcgcggatagacctgcgcatcctggccggcaaggtgtgcatggaccgccacgcgccggacgccctgctggacacgccgctgaccgcgtatgaggattcgcgcgcgctgatccagcgctggcacggccggggccgcgccgaatacgtgatcaccccgcgcttcgcgccgacgtccagccatggccaattggaaatgctgggcgcgctggcggcggagtttcccgacgtgccgatccagtcgcacatctcggaaaacctcgacgagatcgcctgggtcaaagcgctgttccccggctgccgcgattacgccagcgtctatcagcgctacggcttgctgcggccgcgcgcggtctatggccatggcattcatttgtccgacgccgagctggagatgttccacgccagcggcgcctcgctggcgcattgcccgacctccaatttcttcctcggctccggcagcctggacctgcgccgctgcgtgctgggcgaccggccggtggcggtggggctgggcaccgacctgggcgccggcaccagcttctcgatgctgcagacgatgaacgccgcttatatggcggcgcaaagccacggcaagccactgtcggccgcgcaggctttctatctggccacccgcggcggcgccgaggcgctgggcatcgccgacaaggtgggcagcgtggcggtcggcatggaggccgacctggcggtgctgaacctgcgctccaccccgctgctggatttccgcatgcgctacgcgcgcgacttgtcggaggctctgttcgtgcagatgatgctgggcgacgaccgcgcggtggcggccacctatgtcgccggccgcgaggtgtaccgccgcgcggcgtaa

SEQ ID NO: 792 - DNA, 498 bp, Chromobacterium substugae
atgcagcaagtaccagaccagattgaccgtatcgtcgccctgtggaacgaggtccgccccgacctggacacctcgtccacccaagtcatcggccgcatcgtgcggatggaatacttcatcacccgccgggtgctgcaggacttgtcccggcacaatttaaatgtaggcgaattcgacgtgctggcggcgctgcgccgcggcggcgagccctaccagctgtcgcccaaccagctgcaaggcatggtgctgatttcatccggcgcgctgaccaaccgcatcaaccggctggaagaagccgcgctggtcagccgctcgcccgatccggacgaccgccgcggcgtgatcgtcaccctcaccgccaaaggcctgcaggtgatagaagacgccgccggccaccacctggcggcggaggcggagctgatggaaatgctggacgccgacgagcgcgacacgctggcgcggctgctgaagaagatgctgcaggcgcaggaagactga

SEQ ID NO: 793 - DNA, 1305 bp, Chromobacterium substugae
atgttctccctccccaccaccgccaccgcgccgttctgcccggccgaggtcaacggcagcatacgcatagacgcgcgcgcctcgttcagccagcgcctgcgccgcttcgccggccccggcctgctggtggcggtcggctatatggacccgggcaactgggcgaccgacatcgaggccggctcgcgcttcggctaccagctgctgtgggtggtgatgctgtccggcatcgccgcgatgctgttgcagatgctggcggccgggctggggctggtgaccggcatggacctggcgcaggccagcgccgcgcgctacggccgcgccggccgcctgcttcactggctgagcgccgaagtctccatcgtcgcctgcgacgtcgccgaagtgctgggctgcgcgctggcgttcaaactgctgttcggcgtgccgctgctgtggggcgtggcgctgaccgcgttcgacacgctgatcgtgctggggctgaagggacggggctttcgccagctggaggccatcgtgctggggctgatcgccaccatcaccctgtgctttctggcgcaactggcgctgctggatacccattggccggcggtggcggccggcctggcgcccagcttgccggcgcacgacatggacaaggccgtggtgctggcgctgggcatcgtcggcgccaccatcatgccgcacaatctgtacctgcattcgtcggtggtgcagacccggcgggtggaggggggagacggcgcgttgcggcagacgctgctgctgtgccggatcgacaccatcgcctcgctgctgctggcgatgctggtcaacggcgccatcctggtgcttgcgggcagcgcctttcatgccgccggccataccgcggtggccgacatcgccgacgcccacgaactgatccgcccgctggccggctcgctggcggcgttgctgttcggcgtcgccttgctggccgccggccaaagcgccaccttgaccggcaccgtcgccggccaggtgatcatggacggcttcctcaagatccgcattccgtgctaccagcggcggctgatcacccgcgcgctggccttgctgccggcggcgggaggcatcggctggtggggggagagtgccgtcggcccgctgctggtgtggagccaggtggtgctgagcctgcagctgccgctggcgatgtggccgctgctgcggatgaccggggaccgggcgctgatgggcgcgcacgccgccctgcgttgggtagtcgtctgcggctggggtctgttctggctgatattggccgccaactgcgcgctgctcttggggtga

SEQ ID NO: 794 - DNA, 642 bp, Chromobacterium substugae
atgaagacgagcctcctcctcccgctgttctgctgcctggcgcttctgcacgcgccggcgcgggccggcgcgcagaaggaggaggccctgtcggccaatgtcgcctcggcgatgagccgttcgatttccgacgtcaacgcgcccaggctggtgttcgacgatccccgcgtcggccaggcctggctcgccgagatgtcggcgcggctgcaaaagcgcattcccgacgcctggatgcgcgagcgcctgctcaccgcggtccagtacgaggcgacccgcgccggcctggatccgcagatggtgctgggactgatccaggtggagagcggcttcaacaaatacgcgctctccagccccggcgcgcgcggcctgatgcaggtgatgccgttctgggtgcgccacatcggcgatccgcgccacaatctgttcgacctgaccaccaacctgcgttacggctgcaccatcctgcgccactatctcgacatcgagcacggcaatctttaccgcgcgcttggccgctacaacggcagcctgggcaagccggaatatccggggcaggtgatgggcgcctggaagcgccagtggtcctggagcgcgccgccggcgttgcaggcggtcggcgacaatctgccgcgcgcccgctga

SEQ ID NO: 795 - DNA, 1707 bp, Chromobacterium substugae
atgcgcgcatcgcagtttttcatctccacgctgaaagaagcccccgccgacgccgacatcaccagccagaagctgatgatgcgcgccggcttcatccgcaagcaggcagccggcatctactcgtggatgccgatgggcctgcgcgtggtgcgcaaggtggaagccatcatccgcgaggaaatgaaccgcgccggcggcatcgaagtgagcctgccggtggtgcagccggccgagctgtggcaggagaccggccgctgggatgcgatgggcgccgagctgctgcgcttccaggaccgccacgagcgcgatttcgcgctgcagccgaccgccgaggaagtgatcaccgacatcgcccgccgcgagctgcgcagttaccgcgcgctgccgaagaacttctaccagatccagaccaagttccgcgacgagcgccgtccgcgtttcggcgtgatgcgcggccgcgaattcaccatgaaggacgcgtactcgttcgaccgcagcgccgaagacgccggcaagagctacgacaatatgtacgccgcctaccgccgcatctttgaccgcttcggcctgacctaccgcgcggtggcggccgataccggcgccatcggcggcgaccgctcgcatgagtttcaggtgatcgccgataccggcgaagacgccatcgtctactgccccgcttccgaatacgcggccaacatcgagctggccgaggcggtggccccggccggcgagcgcgccgcggccgcggccgcgctggccaaggtgcatacgcccaaggtcaagaccatcgccgagttggtcgatttcctcaagatcgacatcgaacagaccgtcaaggcggtggtggtggaaggcgaagaggacgaggccgtgctgatgctggtgcgcggcgaccacgaactgaacgaggtgaaggcgcagaagatcgccggcatcaagaacccgctggcgttcgccagcccggccgccatccgcgacgccttcggcgccaaccccggctcgctgggcccggtgggcttcaagggccgagtgatcgccgaccgcaccgtcgccaagatggccgatttcgtcatcggcgccaacgaggacgaccagcactacaccggcgccaacttcggccgcgactgcgccgagccggaagtgttcgacatccgcaacgtggtggaaggcgacccgtcgccggacggccagggcgtgctggcgatccagcgcggcatcgaagtcggccacgtgttctacctgggcaccaagtactcggtggcgatgaacgccaccttcctggacgaagacggcaagccgaaaccgttcgagatgggttgctacggcatcggcgtcacccgcatcctgggcgccgccatcgagcagaactacgacgacaagggcatgatctggccggatgccatcgccccgttcgcggtggtgatctgcccggtcggctatgaccgctccgaagcagtgaaggaagctgccgacaagctgctggccgacctgctggcccgcggcgtcgacgcgatcctggacgaccgcggcgagcgcccgggcgcgatgttcgccgactgggagctgatcggcgcgccgcaccgcgtcaccatcggcgaccgcggcctatcggcaggcaaggtcgagtaccagcaccgccgcgacagcgaagccaccgccgtcgccgccgatgctattctggagcatgtcctctccaagctggcctga

SEQ ID NO: 796 - DNA, 1866 bp, Chromobacterium substugae
atgcaggatcacaataaacaggcgatggctggcctgaccctggccgcgctcggcgtcgtctacggcgacatcggcaccagcccgctctataccttgcgcgagtgtttcgtcagccagagcatccccaccaccccggacaacatcttcggcatcctgtcgctgatcttctggtcgctgatcttcgtcgtgtcgatcaagtacgtggccttcgtgctgcgcgccgacaatcgcggcgaaggcggcatcatggcgctgatggcgctggcccgccattacaccacccatgccgcgcgctggaagatcgtcatgctggggctgttcggcgcggcgctgttctacggcgacgccatcatcaccccggcggtgtcggtgctgtccgccgccgagggcatggaagtcatctcctccggcatggaggcctacgtgctgccggtggcggtcggcgtgctggtggggctgttcctgctgcaaaagcacggcaccgccagcgtcggcctgctgttcggtccggtgatgatggtgtggttcgccatcctcggcatcctcggcctcaaccagatcctgcagcagccggcggtgctgcaggcgctgaacccctggcacgcgttcgccttcctgcaccagcacggcttccacgccttcctgacgctgggctcggtggtgctggcgctgaccggcgccgaggcgctgtacgccgacatgggccacttcggcaaaacgccgatccgccgcgcctggttcgcgctggtgctgcccggcctcgcgctcaactacttcggccagggcgcgctgttgatgcgcgatccggccgccatcaagaacccgttcttcctgctggcgccggactgggcgctgctgccgatgatcgtgctggccacgctggccacggtgatcgcgtcgcaggcggtgatttccggcgcatactcgctgacgcgccaagccatcctgctgggctactgcccgcggctggaggtgaaccacacctcggagaaggaaatcggccagatctacatgcccttcatcaactgggcgctgctgatcgcggtgctggtggtggtgctgaccttcaagagctcgtccagcctggccgccgcctacggcatcgccgtcaccggcaccatgctgatcaccaccatgctgttcttcgtggtggcgcgggtcaactggcgctggccgctgccgctggcgctgggcatcacgctgctgttcggcgtgatcgacaccgccttcttcgccgccaacatccacaaagtggccgacggcggctggctgccgctggtgatgggcatggccatcttcacgctgatgagcacctggaagctgggccgcgagctgctgttcaagcgcctgcgcgaacaggcgctgccgctggacggtttcatccagaacctggaagcctacccgccggcgcgggtggaaggcaccgcggtgttcctgaccagcacgctgcacggcgtgccccacgcgctgctgcacaacctgaagcacaacaaggtgctgcatgagcgggtagtgctgatgacggtgcgcaccgaggacgtgccctatgtggccgaagacgagcggctggaagtggtgcagatgtcggcgtcgttctggcgggtggtggcgcgctacggcttcaaggaagatccgaacgtgctgcaggtgatggaaatgtgcgcgaaggaaggcttcgagctggagctgatggacacctcgttcttcctgtcgcgcgaaaccatcgtccccaccgagcggccgggcatggcccgctggcgcgaaaagttgttcgtctggatgagcaagaacgcgatgcgcgccaccgacttcttccaggtgcccaccaaccgggtggtggagttgggcgcccaggtcgaactgtaa

SEQ ID NO: 797 - DNA, 567 bp, Chromobacterium substugae
atgagaaatgcatttattcagacggtgtccggccgctatctcaatgtgctggacccgcggcccgacgatatcgacatcgccgacatcgcccatcatctggcgcatctgtgccgcttcggaggcgcttgccgccagttctacagcgaggccgagcatgcgatccggatggcggagatcctgccgccgcggctgcaactggccggcttgctgtacggcgcggccaaggcctacgccggcgaggtggtgagggcggacacctacgaacgctcgccgctgcagggccgggtgggcgcggcggtggaagcccgtttcggcctcagcctgtcgggagaggaccgggcgatgctggcgatggccgacgccaggctgctggcgaccgaacgccgcgacctgatgccgccggacaatgtggaatggccgatattgatgggggtgcagccgttgccggagaggatctggccgatgaccatcgcgcaggtgctggccgccttctgcacggcgtacgagcaatatctgtgctggggcgcgcggcgggagagcccgctgcgccgggtggccaggcgctag

SEQ ID NO: 798 - DNA, 183 bp, Chromobacterium substugae
ttgactcggcccgccggcaggcaggcctgcttcacgcccattcccgcgcccggccgcgccgccgatgcccgcatgagcgccattccgcctcggccggccacgcggcgcggcgacgaaatttattttgatttaataattgaaataattaattccaatagaatagaatcggttcgccccaaataa

SEQ ID NO: 799 - DNA, 534 bp, Chromobacterium substugae
atgcacgcaaaagacctccctaaaaacaatacttcgctgaatgaattcaagctgaaggccatcaagaaaattcacgatcaaaaactcaccatcagcgcgctggcccgaatgaccggcatcaagcagtccactttgcacaagggcttgttcgaagaaagggaattgtcgttcagcaatgcccacgccatcggcaacgcgctggacatcagcctgtccggccatggcgccgcgccgggccggatggcgccggtattgacccatttgagccagctgccgtccttgcgcggcccgggcctgccgatatgggatgaatacgtgctgctgcagcatgcgccgggcgaagccgttctggcgatagaccgctcgctgttccgccccgcgctgtttccggcccgcgccgtcgtgctggtgcaaaccggagagcgcgacggggcaaacctggtgtacccgcaccacgacgcgctttgccttggcgacaacggcaagccgccgctgggcagaatcatcggcatcaccttcaggaaaaaccaatga

SEQ ID NO: 800 - DNA, 744 bp, Chromobacterium substugae
atgagaaccatcagagaactggccggcaaatcgctggccgcggtcgaccccatcgtcatcctgtcctttttgatcctgatttccgcgattgtgtccaatctgacctcatacaaggtcatccagattttcggcacggaagccagcctgggcaccttcaccatgcccatcatcctgatgctgctcaaccccatcgccgaggtctacggcaagaaccgctccaaccagatcctgttcgccacctgcctcgccgagatcgtcttcgcggtctcctttaccgcgctcagccagtcgcagcgcgactgcggactgctgccgctggccgaacgcgaccactgcgcggcgctgaaccaaagttatgtgctgatcagcgaacatatcgtcaggggctcgatctcgttcgcgctgggctgcctgataggcagccagttcaacacccgtttcctgctttacctgaaacggctgtggtccagccgcttctacttcgtccgcgacgtcttctcctcggtgataggcgaggtggtctacaccgccatctgcttcatgatcgccttttacggcgtgttccccttcgccaccatcgtcaagatcttcgccttcagcctgatgttcaaattctcgtccaccgtgctgctgtcctggatttctcaatacatcgtccagttgctgtaccgctaccaggcctggctggagccggcgccgtccagcaagaaaatcaaattctcctcgcgctacctgcaagtatga

SEQ ID NO: 801 - DNA, 1329 bp, Chromobacterium substugae
atgaaacccatcgtccttcatcaccggccccgcgccggccaaaccgccgccgcgccattgttcgcgctggaaagcaattacgactacacccgcaaataccgccgccaatcgcggcgggtggagcgggcgtcgctgacgctgctgtttttcgccgaccgcgtcatgctgctgccgcgcagcgccaacggcctggccatgctgcgggcgctggcggagcggttgccgctgcggcgcgacggcgacggcgacgccttcagcctggcgctggacgccagcgcgccgttgcggcggcggctggcgcagctgctggggctgctgcagccgttccaggccgatgcctgcttcggcctatacggtttcttcacctacgagctgctccatgccgaactgggcctgccctgcgatttgctcggcctgttccacctgccggagcagttaagcgtagacggccagccgcatggatactttgtcgaccccgaggccgacgacggcccggcgccgccgcccgacctggcgcgcttcatcgatctggaccgcttcgccgccggccgcaacgccgagcatgggccgatgtaccgcgccgccagccagcaaatcgccgacggccaagtacgctcggtcaaccccagcttcgccatccgccgccccaccgcccgcaacgcctaccagatttaccaggcgctgcaggcgaaaaacctggcgccgtacaatctgtttttcgacgccggccccttccagctggccggcgcgtcgccggcgatgttcctgcgcatccgcggtggccgggtggagaccagcccgatctgcggcaccgtcgcccggggccgcgacgaaacggaagaccgcgcgcagatcgccaaactgctggcttcggagaaagacgatttcgaactggcggaatgcgtgcgcgccgacctggcggccaaacaggccagctgccgcgacgcgacgctgctggcggccaaggaaatagagaaattcgccaacgtgttccacacttcggcgcacgtggcggccacgctgcgggaaggatgcacggcggccgacgccatagccgatcacctgtggccggccaccatcctgggcacgccgaccgccgccgccgcgcggctgctggccgagcatgaaagccgccactggtacggcggcgccttcggctatctgaccgccgccggcgaagtcgacctgggcaccatcatccgcagcgcgctgctccgcgacggcgtcgccaccacccgagtcggcagcaccctgacccgccactccagcgcgccggccgaacaaagggaactggaagccaaggcggcgctgatcctgggcgtgctatga

SEQ ID NO: 802 - DNA, 456 bp, Chromobacterium substugae
atgaaagcgctgacgatagaggacatcagcggcgaggccatcaccatccggctggtgaacaccgccaaaacctaccgggtcggactggaccggccggtgcggctgcaggatatccgcgggctggccaaggacgagattctgctggccggcgtggtggccggcaaagtggcgcgcggcaatgccgcgctgctggcgcagtacgacttcagccaggtcgccatagccggcgacttccggctgcaaagcgtcattttcgaccagaatgtggccttcgtcgccgacgaaaacgccaggatcgccattccctaccgcgacctgcccagcaatctggacgtgatcggcaagctgtccgacgagctggccttctacatcggcttcctgtacgccgccttcacgctgccggacgaggagctgaccttccaggatcacccccgtccctacctgacgctgaaatag

SEQ ID NO: 803 - DNA, 1020 bp, Chromobacterium substugae
atggatttgccgtttgaagtgaaggagttggaccgcggcgacgcggagctggcgcagcgggcgctgcggctgcagctggccgcccaccgcgtcgaggtggaatggctggactatccggcgctgccgctgctgtggccggacctggcggcgttgctttcttgccgcgaccgcatcctggcggcgttcgagggcggcgagctgcgcgggctggtggtggcgtcgcgccggctggacggcggcctgcacatcgaacgcacggtggtggaccctgcgcatttcggctgcggctggggctaccggctgctcaaccgggcgttgcacggcgagacgcgcgccagcgtcgacaccgccgaagtcaaccaggcggcgatcgcgctctaccacaaggcgggcttcgtgctggagcggcgctggagcgtgccggacgggctggcgctgtggcggatggactaccggccggccgcgccgccggtcctgtcgctggccccggacggctggatgcgcggcgcgctgcagcaggcctcgcccaattgcgacgagcgcagcccgggctgcgcgccggagctgctggtgatacacaatatcagcctgccgccttaccgctatggcggccccggcgtgcagcagctgttcggcaacagcctggacccggacgaagacccgtattaccgcggcatccaccagctgcgggtgtcgtcgcacttcttcatccgccgcgacggccaattgctgcagttcgtgccggtggggcagcgcgcctggcatgccggggtgtcctgctggcgcggccgcgagaagtgcaatgacttttccataggcgtggagctggagggctgcgatttcgagccgttcagcgaggcgcaataccgcacgctggcggcgctgggcgcggaattgcgccgccacctgccgctatcggcgttggccggccacgagcacatcgcgcccggccgcaagaccgaccccggcccctggttcgattgggcgcgcgcgcaggcggactgcggcctggcgctgtag

SEQ ID NO: 804 - DNA, 531 bp, Chromobacterium substugae
atgcttacgctcgacacccttggcggcgccgcggcgcccagcttcgaacagccgctggaaatgctgcaggcctgtcacgacaagatccgccgcttctgcgacaccctggacaagctgccgccctacatcgaagagcacggcgtcgacgaagcggcccgcaacgcgatcaacgacgtggtgcgctacttcgacgtcgccggccccgcccaccataccgacgaggaagaagagctgttcccgctgatcgaggcgcgcgtgcccgccgccgcatccaggctggagcagctggcggccgagcacggctaccttcactcgtgctggaacgccatccgcgacgacctgctgtcgctgcgcgacggccgcatccgccagatcagcaagaacgagctgcaggaattcgcccgccagtaccgcgagcacgccgccgccgaggaggcctggctcttccccgccgccgccagcgcgctgagcgcggaagagctgcgcgccgccggcgcccgcatggcccagcgccgccaaaccggcggctga

SEQ ID NO: 805 - DNA, 1062 bp, Chromobacterium substugae
atgaaccgtttgcaagccatccgtccgttcggccagcgtatctggctggacaatctgtcccgtgaactgatcgcctccggcgaactggcccgcctgctggccgacgacggcatcgccggcgtcacctccaatccggccatcttctacaaggcgatcagctccgacgcgagctatcagggcgagctggccgtgctgaaacaagacgcggcgctgtccgccgaagcgcgctacgaaacgctggtggtggccgacatccaggccgcctgcgatctgctgctggcgcaatacgaagccagccagggcaacgacggctacgtcagcctggaagtgtcgccggaactgtcgcgcgacgaagccggcaccttggcggccgcgcgccggctgtgggccgagatcggccgcgccaatgcgatgatcaagattccggccaccgccgagggcatccgcgccttccagacgctgacccgcgaaggcgtcaacgtcaacatcacgctgctgttctcgctgccgcaagtggaagcggtatgggacgcctacatcgccggcctgtccgcgcgcctggccgacggccagccggtggccggcgtcaaggcggtggccagcttcttcctgtcgcgcgtcgacagcctgctggacccgcaagtggccgagcagcacaagggcaaggtggcgatcgcgctgtccaaggcagcctacgcccgctaccagcaacgcttccacggcgaggagttcgccaagctgcgcgccgccggcgcccgtccgcaattcctgctgtgggcgtccaccggcaccaagaacccggcttaccgcgacgtgctgtacgtggagagcctgatcggcgacgaaaccgtcaacaccgtgccggacgcgacgatggccgccttccgcgaccacggcgacgccgcgctgacgctgccgcagggcatggacgcggcccaggcgctgcttgccgaagtggaagccgccggcgtcgatctggccgctgtcggcgaaaaactgcagcaggacggcctgaaactgttcgaggacgctttcgcccagttgctgaaactgacggcctaa

SEQ ID NO: 806 - DNA, 1308 bp, Chromobacterium substugae
atgcgcgaatttctgcaacggaccctgctgtggctgacgggcatcgtcgtcgtcagcggcggcttctgggcgctgtcctcggccactgacgcgctgctggcgctggcgatcacgctgggcgcctggctggccttcaacctctaccacatcgcgctgctgctgcgctggctgcgccatccggtgccggagcgggtgccggacggcttcggcgtctggcattcggtgttcatgacgctgtaccgcaccatgcgcaaccagagccagagcaagaagaagctgactcacgtgctggagcgcttcatcaacgccggcgaggcgatgccggatggcgtggtggtgttggacgagcatgaccgcatcgaatgggtgaatccgatggcggtggagcacctggggttggaccgcaagcgcgacgtcggcaaccagatcctcaacctgatccgccagccatcgttccacagctatatgaagaacgccagcttcagccagccgctggtgctgaacttcgtccagccgcgcgaactggtgatttcgctgcagctggtgccgttcgactccacccgcaagctgctgctgacccgcgacatcacccagctggagcgggtgcaaacggtgcaccgcgatttcgtcgccaacgtctcgcacgagctgcgcacgccgctgacggtggtgggcggcttcctggagacgctaggcgacatgcctgaggtggacgaccgcaccttccgccagttcctgccgatgatgctggagcagtcgcggcggatgcaaagcctggtggaagatctgctggcgctgtcgcggctggagaacagccccaaggcggcgagttcggaaaaagtggacatgcgcgacatgctggacacgctgatggtggaggccgagggcctgtcccaggggcggcatcaggtcaagctgtccggctgttgcgacgccggcctgtggggcagcggccaggagctgcattcggccttcggcaacctggtgtccaacgcggtgcgctacacgccggaaggcggcagcatcacgctggcctggcaggaggagggcgagcagctgcgcttctcggtcagcgacactgggatcggcatcccgcgcgagcatatcccgcggctgaccgagcgcttctaccgggtggaccgcggccgttcgcgcggcagcggcggcaccggcctcggcctcgccatcgtcaagcacgtgctggcgcgccatcacgcccggctggaaatcaagagcgagcccgacaagggcagcaccttcagcgtggtgttcccgcgcgaacgccgcaacgacagccaggccgcctga

SEQ ID NO: 807 - DNA, 690 bp, Chromobacterium substugae
atggccgccaatatcttgcttgtcgaagacgaaccggcgattcaggagctgatcgccttcaacctggcccaggctggccaccacgtgctgcgcgccggcaccgccgaagccgcgctgaccctggtcagaaacgcgctgcccgacctggtgctgctggactggatgctgccgggcgccagcggcgtcgacgtggccaagcgcctgcgcgccgacgagcgcacccgccacattcccatcatcatgctgaccgcccgctccgatgagcaggacaagatcgtcggcctggaaaccggcgccgacgactacatcaccaagccgttctcgccgcgcgagctgttggcacgcatcaaggcggtgctgcgccgccgcgcgccgcagatgaccgacgacgcggtggacgtgcagggcctgcggctggacccggtgacccaccgcgtcaccggcaacggcagcgtgatcgacctcgggccgacagaattccgcctgctgcatttcttcatgacccacccggagcgcgtgcactcgcgcgcccagctgctggaccaagtgtggggcgatcatgtctttgtcgaggagcgcaccgtggacgtgcacatccgccggctacgcagcgcgctggagggcactcagcacgacggcctgatccagaccgtgcgcggcaccggctaccgcttctccgtgcaacagtga

SEQ ID NO: 808 - DNA, 444 bp, Chromobacterium substugae
atggacagatttgatcgcaaaatcctcgctgcactgcacgaaaatgccagaatcagcttcgccgaactggcgcgccgggtaaacctttccgcccccgcggtggccgaccgggtggccaaactggagcaagccggcgtgatcaccggctaccgcgcccagatcgatcccggccgggtcggcctgccgatttcctgcctgatcgaactgacagtcaagcatctggagtactacctggtgatcgagcagatccgcaacactcccgaggtgatcgagtgcgcgtccatcaccggcaccagcggcctgatgatcaaggtggcggtggacaccatggcctcgctgcaggcattgatcgcccggctgatgcagttcggcgacaccaagacctccatcatcatcgacatgccggtggcgccgcggatgccggcgctgcagcaggacgactag

SEQ ID NO: 809 - DNA, 999 bp, Chromobacterium substugae
atgactatcaaagtcggtatcaacggtttcggtcgtatcggtcgcatggcgttccgcgcaatcgccaaggattttcctgaaatcgaagtagtcggcatcaacgatctgctcgacccggaatacctggcctacatgctgaagtacgattcggtgcacggccgcttcaacggcgaggtcaaggtggaaggcaatagcctgatcgtcaacggcaagaccatccgcctgaccgccgaaaaagacccggccaacctgaaatggaacgagatcggcgccgacatcgtcatcgaatgcaccggcttcttcctgacccaggaaagctgccagaagcacatcgaagccggcgccaggaaagtggtgcagtcggcgccgtccaaggacgacaccccgatgttcgtctacggcgtcaaccacgaaaaatacgccggcgaggcaatcgtctccgccgcgtcctgcaccaccaactgtctggctccggtggccaaggtgctgcacgacaactggggcatcaagcgcggcctgatgagcaccgtgcacgccgccaccgccacccagaagaccgttgacggcccgtccagcaaggactggcgcggcggccgcggcatcctggaaaacatcatcccctcgtccaccggcgccgccaaggcggtgggcaaggtgatcccggagctgaacaagaagctgaccggcatggccttccgcgtgccgacctccgacgtgtcggtggtggacctgacggtggagctggagaaggaagccgactacgccgacatctgcaaggcgatgaaagaggcgtcccagggcgcgctgaagggcgtgctgggctacaccgacgaaaaagtggtgtccaccgacttcgtcggcaacaccgcgccgtccaccttcgacgccgacgccggcatcgcgctggacaagaccttcatcaaggtggtggcctggtacgacaacgaatacggctacacctgcaatatgctgcgcttcgtgcggcacgtggcgggttga

SEQ ID NO: 810 - DNA, 1677 bp, Chromobacterium substugae
gtgagtactctgaacaagtttgccggcatccagcaattggggcgcgccctgatgctgccgatcgccgtgttgccggtggccggcctgctgctgcggctgggtcagcccgacctcttggacatcaagatgatggcccaggccggcgacgccattttcggcaatctggcgctgatcttcgccatcggcgtggcggtcggcttcgccaaggacaataacggcacctccggcctggccggcgccatcggctatctggtgatcaccgcggtgctgaagacgatagacgccaagatcaatatgggcgtgctgtccggcattctgtccggcctggtggccggcgcgctgtacaaccgctacaaggacatcgcgctgcccagctacctggccttcttcggcggcaagcgcttcgtgcccatcgccaccggcttcgccgcgctgatcctgggcgcggcgctcggctacatctggatgccggtgcagaacgccatcgacaacaccggccactggatgataggcctgggcgaagtcggcgccttcgtgttcggcgtgctcaaccgcctgctgatcgtcaccggcctgcaccatatcctcaacaacatcttctggttccagctgggcgacttcaccgacgccaccggcaaggtggtgcacggcgacctgacccgcttcttcgccggcgacaagacggccggcatgttcatggccggcttcttcccggtgatgatgttcggcctgccggcggcctgcctggcgatgtaccgcaccgccaagccggaaaacaaggcggcggtcggcggcctgctgttttcgctggcgctgaccgcgatgctgaccggcgtcaccgagccggtcgaattcgccttcatgttcctggcgccggcgctgtacgcgatccacgcgctgctgaccggcctgtcgatggccatcatgcacgcgctcgacgtcaagcttggcttcggcttctccgccggcctgttcgactacgtgctgggcttcggcatttccacccatccgtggtatctgctgccggtgggcgcggtctacttcgtggtgtactacggcctgttcgtgttcttcatcaagaagttcgacctgaagaccccgggccgcgaggacggcgcggtggccgtcgccgccggcgtcaagggcaccgagcgcgcgcgcggcttcatcaccgcgctgggcggcgccgccaacctgaagaacgtcgacgcctgcaccacccggctgcgcctgctggtggtcagcaatgacaaggtggacgaggccgcgctgaaggcgctgggctcgcgcgggctgatccgcccggccgccggcagcgtgcaggtggtgctggggccggaggccgacctgatcgccgacgagatccgcaacgcgctgggcgcggccgccgccgcgccgcaagccgccgccgagacgctggtgtccaccgcagccgccaacggggccagcatagacaaggtgcgctggctggccgcgctgggcggcgccgacaatgtgcgcaaggtggaggcggtggccggcagccggctgcgggtggaggtggccgacagcggccgcgtcgaccaggacgcgctgcgccagctgggcgccagcggcgtcaccgcagtttcggccacgctgctgcatatcattctgcagggcgacgcaagcccctacgccgctgttttgcaaggatga

SEQ ID NO: 811 - DNA, 2511 bp, Chromobacterium substugae
atggaacaaggaatcgcgatgaccaccacgctagatctgctggcgccgttcaccggcccggccgtgccgctgtcccaagtgcccgatccggtgttcgccggcctgatggcgggcgacggcctggcgctggagccgctgtcgtccacgctgctcgcgccctgtagcgggacggtcagccagttggcccgtaccggccacgcgttgacgctgaccgccgacaacggcgccgaggtgctgatccacatcggcatcgacaccgtcaagctggagggccagggtttccagccactggtgcgggccggcgagcgcgtggttcaaggccagccgctgatcgaggtggacctggacgcggtggcgcgccgcgcgccgtcgctgcagaccatggtggtgatcgccaattccgagcagtttgattttcccctccgcgccgaaggcttggtcgaagccggccggacgcgcttcctgaccctggcggcccgcggggatgtctccccccgcggcgccgccggcggcccggaacgccgcggcgaggcggtggtgcgccatgagggcggcctgcacgcgcggccgtcggcgcgggtgcagcaggcagccaaggcattcgccgccgacatcgtcatcgaattcaacggcaagcaggccaacgcgcgcagcgtggtggcgctgatgagcctgggggtggccgaaaacgacgtggtggcggtagccgccagcggcgccgacgccgacgccgcgctggcggcggtggtgggcgtgttgcaaacccatagcggcgccggccacgcgccggccgctagcgccgctgtcgtccaggtggcgggccgcatcgccggcgtcgccgccgcgccgggcctggccatcggccaggcggtgcggctggatgctttcgacatgccgctgccggagcgcggcgccggcgcgcaggcggaacgcgccgcgctgctggacgcgcaggcggcggtgcgcgccgacattcagcgcggcatagacgaggcgctgcgccgcggcgccaccgccgagagcgacatcttcgccgcccatctggctctgctggacgatccggagctgctggcggcggccgggcgcggcatcgacgccggcctgagcgccggcttggccgcgcgccaatccatccgcgcgcaatgcgaggtgctggccggcctgggcaaccagctgttggccgagcgggtggccgatctgaaagacatcgagcggcagctgctgcgcgcgctgtacggcgacgccggctccgcgcccgagctgttcgacgcgtccatcctggtggccgacgatctggcgccgtccgaattgacccgcctgccgcgcggcaaggtggccggcatcgtcaccgccgccggcggcgccagcggccacgtcgccatcctggcgcgggcgatgggcattccggcgctggtggcctgcggccccgccgcgctgacgctgcgccacggccagcaactgatcctggacgcgcgcgccggcctcgccaatccgcagccggacgcggccgagctggccgccgcgcgcgcgcaaatcgagcagctggcggcgcgcctgcgctcgatgcaggcgtcggccagcgcgccggccatcacccaggacggcgtggcgatcgaagtggcggtcaacatcgccaacgccgacgacgcccgcgaaggcgtggcgcacggcgccgacgcggtgggcctgctgcgcaccgaattcctgttcatcgaccgccgcgacgcgccgaccgaggccgagcagaccgccgcctatcaggcggtgctggacgcgctggacggccgcaacgccatcatccgcacgctggatgtcggcggcgacaaggacgtgccttacctgcaattgccgccggagccgaatccggcgctgggcctaagaggcatccgcgccggcttcgcctatccggagatgctggacacccaattgcgcgcgctgttggcggtgaagccgctggcgcggctgcgcatcctggtaccgatgatcgccgacgtcggcgaactgatccggctgcgcgagcgcatcgagcagctggcggtggaaatgcagttggccgaacggccgcagctgggggtgatggtggaggtgccgtcggcggcgctgctggccgaccagttggccaagcacgccgatttcctgtcgataggcagcaacgacctgacccagtacacgctggcgatggaccgttgcaacgccacgctggccgcccgcatcgattcgctgcatccgggcctgctgcgcctgatcgccatcgcggtggaaggcgccaaacggcacggcaaatgggtgggggtgtgcggcgcgatggcgtccgatccgcaggcggtgccggtattgctggggctgggcgtggccgagctgtcggtcagcccgcggctggtgccggaggtgaagagcctggtgcgcggcttgtcgcaacggcaatgccagagcgaggccgagcgcctgctgggattgagctccgcgcaggaagtgcgcggcaggatagtggagttgtggcccgccgcctga

SEQ ID NO: 812 - DNA, 1023 bp, Chromobacterium substugae
ttggcctcgttgatgcttgaagaagcgctgtacgccgccgaggcggtgtccgcgcaacatatgtacgccgatgaaggcctggccgcgctggggcgcgagctggcccgcatcgcgcctaagctcgcgctgacggtggcgcgcggcagttccgaccacgcggccaactacttcgcctacctggtgatgcagcgcctcggcattccggtggtgtcgctgccgatgtcgctggtgacgctgcaccgcgcgccgctggcggtggaagggcaattggcggtcgccgtgtcgcagtcgggccaaagcccggacctggtggacaccgtcaaggcgctgtccgcggccggcgcgcacaccgtggcgctggtcaacaagcagcagtcgccgctggccgaggccagcgactgggcggtgccgctgtgtgccggcgaggaaaaaagcgtcgccgccaccaagagctacatcaccgcgctgtccgccgtcgcccgcctggtggcgcactggcatgccgacgaggcgctgctggccgcgctggaaaatctgccgcagcgtctgaccgaagccgccgtccaggactggtccgccgccatcgaagtgctgcagccggccgaacgcatcatggtggtcggccgcggcctgggcttcgcggtggcgctggaggcggcgctgaaattcaaggaaacctgcgcgatccaggccgaggctttctccggcgccgagatcaagcacggcccgatggcgctgatcgacgacggctacccgctgctgatcttcgcgccgcgcggcccggaacagcagggcctgatcgatctggcggccgagatgcgcggccgcggcgccaaggtgttgctggcggcgccggccgaagtcgccagccgcgacctgacgctggcgctggccgacgacgaggcgctggatccgctgctggcgatccagagcttctacttgatggcggcgcgcttgtccgaggcgcgcggcctgaatccggacctgccgcgccatctgtccaaagtcacctgcacccgctga

SEQ ID NO: 813 - DNA, 1122 bp, Chromobacterium substugae
atgacccagaacctgaccttgcagggccgcatcctcaccgcctccgggtggatggacggcgtcgtgcgcctggcggccgatggccgcatcgcagagatagacgccaagctggcgtctggccggcagccggaacgctatatcctgcccggcttcatcgacctgcacgtgcacggcggcggcggggtggacatcatggagggcggcaacgccatctcccatgtcgcccggctgcatgcccgcttcggcaccacctccttgcttgccaccaccatgacggcgccgccggaggaaatcagccgcgtgctggccgatctgggccgcaactgcaaggaaagggcgccggcgggcagccgggtgctgggcgtgcacctggaaggcccgtacatcaacccgggcaagctgggcgcgcagcccgacgacgcctgtcaggcggcgatggcgcaaatcgacgcctaccgcgcgctggccccgatctcgctgatcacgctggcgccggaaatccccggccatctcgacatcatccgcacgttgtccgcgcaaggcgtgcgggtgcagatgggccacaccctgggcagctacgagcaggcggtggaggcgctggagcagggcgcgtccggcttcacccacctgttcaacgcgatgaccggcctgcatcaccgcgagcccggcgtggtgggcgccgcgctggcgcacgccgaatacgccgagctgatccccgacttgctccacgtgcatccgggcgcgatccgcaccgcgctgcgcgccattccgcgcctctactgcgtgaccgattccaccgccgccgccggcatgccggacggcgagtacaagctgggctcccactccgtgaccaaatgcatgggcggggtgaggctggccgacggcaccttggccggcagcacgctgaccatggaccaggcgctgcgcaacctggtgaagatcggcctgccgctggccgacgccagccaccgcctgtcgctgtacccggccgactacctgggcttgtccgagcgcggccgcctggcccccggcgcctgggccgacatcgtggcgctggatgccgacctgaatttgcagcaagtctacgtagagggagaagagattggcctcgttgatgcttga

SEQ ID NO: 814 - DNA, 735 bp, Chromobacterium substugae
atggaaaaccgctggctggcattgaaacccgatgaaaacctgagcaccccgctgtacctgcagctgtcgcgcaaactggccgatgcgatcaacgccggctggtggcaggcggacgaggcgctgccgtcggaacggacgttttcggaagagctgggcatttcgcgcgtcacggcgcgcaaggcgatggatgtgctgctggagcagggcatgatccgccggcgccagggctcgggcaccttcatcacgcccaggctggagcagccgctgtcgcgcttgaccggctttaccgagcagctgcggctgcgcggcttcgtgccgtcgtcggtgtggctggagcgcggcgtgttcccgcccagcaacgaggaagtgatccgcctggggctgtcgccgacctcgatggtggcgcggctgaagcggcagcggctggcagacggcgtggtgatggcgattgaaatgagcacgatgccggtggcgtatctgccggatccgcaggcggtgggcacgtctttatacgcccacctggacgcggcgggacattcggtggtgcgcgcgctgcagcacatccgggcggtgaacgcctcgggcgacgtcgccacgctggccggcatccggcccggcgaggcgatgctgctgatcacccggatcggcttcaatgccgacaatgtggcgatcgagctcaccgacacttactgccgcaacgattattacgattttgtagccgaactgaaacgatga

SEQ ID NO: 815 - DNA, 1140 bp, Chromobacterium substugae
atgaaactgcattggcaactccccgccgtgatgacgctaagctgcctgagcgcgccgctatgggcgcatggcaccatggaagttccgatcaaccgcacttacagctgcttcctggaaggcccggaagcgccgaagaccgccgcctgccaggcggccaggcaagtcggcggcacccaggcgatgtacgactggaacggcatcaaccagaatccgcagggcgacaaccaccaggcggcggtgccggacggcacgctgtgcggcggcggcaaggccgaattcaaaggcttcaacctggcccgccgcgactggcgcgccaccagcatcgtgccggacgccaacggcaattacgaattcatctacaaggccaccgcgccgcacgccaccaagtacttcaagttctacatcaccaagaacggctggaatccggacctgccgctgaaatggtcggacctggaactgttcggcaccgtcaacggcaatccgcagcaggacgccgccaagcgctaccacatgacgctgaagctgccgcagggcaagaccggccagcacatcatcttcaacgtctggaagcgttccgacagcgaggaggccttctactcgtgctccgacgtcagcttcggcgacgccgcgccgccggccgccaatccgtggaaggaaatcggcaacgtcgccgcgcgcgaaaacctgccggccggcagcagcgccacgctgcgggtgttcgacagccagggccgcgacgccgagaagcacacggtggcgctgaacgccgccagcggccaggccgccaactggccgtacgcgctggcgctcaaggtcaacgccgcctcgccggccatccgcatcggcgtgctgaaatcgcagcagcgcgccgtatccatcgtgccggtgaaggatgccaccgccaaccgcgtctacctgaacgacagctacaagggctacagcttcgcggtcgatctgaagaagggcgacggcggcgcgacgccgcccgccgccaacgcctggcaggaaggcggcaaatacgcgaccggccaggtcgtcagctaccagggccgccagtaccgctgcctgcaggcccacaccgcctgggccggcgccggctggacgccgtccacccaggccacgctgtggcaggcgctctga

SEQ ID NO: 816 - DNA, 864 bp, Chromobacterium substugae
atgcctttttcacgtctcgcgccgctgacgctggccgctttcctcgccctttacctggtctggggctccacctatctggtcatccgcatcggcgtcgaatcctggccgccgctgttgatggccggcatccgctttttgctggccggcagcctggtgctggggtatctggcgtggaagcggacgccgtggccggacgcgcgccagctgggcggcgcggcgctgctgggggtgctgatgccggcgataggcaacggcctggtgacggtggccgaacgcgaggtgtcgtcgggcgtggcggcgctggtgatcgccacggtgccgctgttcacgctgctgttcgcccgcttgttcggccaccgctcgcggccgctggagtgggccggcatgggcttgggcgtatgcggcatcgtgctgttgaacctgggctccagcctcagcgccagcccgcgcggcgcggcgctgctgatcctggcctcggccggctgggcgctgggctcggcctggagcaagaagctgccgcagccggccggcgcgatgggcagcgcctggaccatgattttcggcggcctggcgttgctggcgtcgagctgcgccgtcggcgagcgcctcgccgcctggcccggcgtggaaggctggggggcgctgctgtacctgacggtgttcggttcgatgatcgcctacagcgcctacctctacctgctgaagacggtatcggcggcggcggccaccagctacgcctatgtcaatccggtgatcgcggtgctgctgggcgcgctgttcctcggcgagcgggtcggcgtccacgagatgctggcgatggtggtgatcgtcaccgcggtggtgctgatcagctggcgcaaatga

SEQ ID NO: 817 - DNA, 669 bp, Chromobacterium substugae
gtgcaacagatttcatttattagcctgatcctgaacgccagcctgatggtgcagctggtgatggcgggactggcgctgacttccctgctgtcgtgggcgctgattttcagcaagatcgcggcgttgagcgccgccaagcgccacagcgaggagttcgagcgcaacttctggagcggggcggatctgaaccgcctgtacgaagacgtgtgccgccgcagcgacaccgccggcatggagcgcatcttccagtccggcttcgccgaatttctcaagcagcgcggccgcggcggcgccgagctgtccgacatcatggacggttcgcgccgggcgatgcgggcggcggcgcagcgcgagctggacacgctggacagccacacctccttcctggcgacggtcggctcggtcagcccctatgtcggcctgttcggcacggtgtggggcatcatgcatgccttcatcggcctgggcaacgccggccaggccacgctgagcaccgtggcgcccggcatcgccgaggcgctggtggccaccgccatcggcctgttcgcggccattccggcggtggtggcctacaaccgcttcgctaccgacgtcgaccgcctggccacccgcttcgacacctatatggaagagttctccaacatcctgcagcggctggcgacgcgttaa

SEQ ID NO: 818 - DNA, 582 bp, Chromobacterium substugae
atgaagtccggttccagccccttgccgcgtctgccaggcagacgcctgcagcaaagggcgcgcgcgcaattgcgccatggcggcgtgatcgcctattccaccgaatcctgctacggcctcggctgccatccgctcgacgtccgcgcgatacgccgggtgctggcgatcaaggcgcggcccaatcacaagggcctgatcgtcatcgccgccgatttcgagcagatccgccatctggtcaagccgctgaatgccgcgcagcgcgcggaactggaacgccattggccgggtccatatacctttttgctgccggcgtcgcggcgggtgccgccggcgctgcgcggccggcacgacaagatagcggtgcgggtgaccgcccacggcgaggcggcggcgctgtgccgcagcctggggacggcgctggtgtcgacttcggccaaccgcgccgggcagaaatcgctgaagcgggcgcgcgcctgtcgcatggccttcaaggacagggtgctgaccttgccgggccgcatcggcaagcgtcgcaaaccgtccaccatcatcgatctggaaagcggccgcgtgttacgctag

SEQ ID NO: 819 - DNA, 159 bp, Chromobacterium substugae
ttgatgcatttcctgacgcacgagcgccgttgctggcgccgcctggcctactggctgaagcagttcaacaccgaagccggcccgccgccgcgctgttatgcctggcgcgccgcgccggaagatgtccccgaagaccacgaggatttgctgttgcattga

SEQ ID NO: 820 - DNA, 1266 bp, Chromobacterium substugae
gtgatcggctccggcggccgcgaacacgcgctggcctggcgcatcgccaaatccaggcgcgtgtccaaggtgtttgtcgcgccgggcaatgccggaaccgcgcttgaccccaatctgaccaatgtcgatctcaacagcgtcgacgcctggctggctttcgccaaacaggaaaaggtggacctcaccgtggtggggccggaagcgccgctggcggccggcgtggtggacgccttccgcagcgaggggctgaagattttcggccccagccagtactgcgcgcagctggaaagctccaaggatttcgccaaggccttcatgcagcgccacggcatccccaccgccgcttaccgcaccttcgccagcgccaccgaggcgcacgcctatgtcaacgacaagggcgcgcccatcgtgatcaaggccgacggcctggccgccggcaagggcgtggtggtggcgatgacgctggacgaggcgcacgccgccatcgacgacatgctgctgggcaacaagatgggctcggccggcagccgcgtggtgatagaggacttcctgcagggcgaggaggccagcttcatcgtgatggtggacggcgagcatgtgctgccgatggccaccagccaggaccacaagcgcttgctggaccacgacatgggcccgaacaccggcggcatgggcgcctacagcccggcgccggtggtgacgccggcggtgcataaccgcgtgatgcgcgaaatcatcaaccccaccgtgctgggcatgaagaaggacggccatccgtataccggcttcctgtacgccggcctgatgatagacgccgacggcaagccgcacaccatcgagttcaactgccgtttcggggatccggaaacccagcccatcatggcgcggctgaaaaccgacttcaccatgctgctggaagccggcgtcaacggccggctggacaaggtggaggccgaatgggaccgccgcgtggcgctgggggtggtgctggccgccgccggctatccggacgcgccgcgcaagggcgacgccatccacggcattccgcatgagaccgacgacggcgtggtgttccatgccggcaccgcgctggatggcgagcagcagctgcgcagccacggcggccgggtgctgtgcgcggtggggctgggcgacagcgtcaagatggcgcagggcaaggcctatctgttggccgacgccatcgatttcgccggcaagcagtatcgccgcgacatcggcgcgcgggcgataggccgcaaggtctga

SEQ ID NO: 821 - DNA, 1578 bp, Chromobacterium substugae
atgaccaagatcgaacgagcgctgatcagcgtgtccgacaagagcggtgttctggaatttgcccgcgagctggcaagcctgggcgtgcacatcctgtccaccggcggcaccgccaagctgctgctggacgccggcctgccggtgaccgaggtgtccgactacaccggctttccggaaatgctggacggccgggtgaagaccctgcatcccaaggtgcatggcggcatcctgggccgccgcgacctgcccgagcacgtgtccaccatggctgagcacggcatcggcaacatcgacctggtgtgcgtgaatctctacccgttcgaagccaccatcgccaatccggactgttcgctggaggacgcgatcgaaaacatcgacatcggcggcccgaccatggtgcgctccgctgccaagaactgggcgcacgtcgccatcgtcaccgacagcgccgactacccggcgctggcggccgagatgaaggccaacgacggccggctggccaaggccacccgcttcgagctggcgaagaaggcgttcacccacaccgccgcctacgacggggccatctccaactacctgaccagcctggccgacggcgtggtggcgggcaagccggagcgcgtcgccttcccgaaccgcctgaacgcccagttcatcaaggtgcaggacatgcgctacggcgaaaacccgcaccaggccgccgccttctaccgcgacctggacccggccgccggcagcatcgcccactaccggcagctgcagggcaaggagctgtcgtacaacaatatcgccgatgccgacgccgcctgggaggcggtgaagactttcgacgacaccgcctgcgtcatcgtcaagcacgccaacccgtgcggcgtggcggtcgccccggatacgctggcagcctacaagctggccttcgccaccgacaccaccagcgccttcggcggcatcatcgccttcaaccgcccggtggacgcagccacggtggaagccgtgaccggccagttcctggaggtgctgatcgcgccgtccttcaccgcagaagccaaggccatcatcgccgccaagaaaaacgtgcgggtgctggaaatcccgctggagaccggcgccaaccgcttcgaactgaagcgggtcggcggcggcgtgctggtgcagacgccggacatccgcaacgtgacgccggaagagctgcgcgtggtcagcaagcgccagccgacgccgcaggagatgtcggacctgctgttcgcttggcgcgtggccaagtacgtcaagtccaacgccatcgtgttttgcaagaacggccagaccgccggcatcggcgccggccagatgagccgcgtcgactccacccgcatcgccgcccgcaaggcgcaggacgccggtttgagcctggccggcgcggtggcggcgtctgacgccttcttcccgttccgcgacggcatagacgtgatcgccgaacagggcatcaaggccatcatccagccgggcggctcgatgcgcgacgacgaagtgttcgccgccgccgacgagcacggcatcgcgctggtgttgaccggcgtgcgccatttccgccactga

SEQ ID NO: 822 - DNA, 237 bp, Chromobacterium substugae
atgcaaaacaacgaacatatcgcgcagtcggtacggattgcgatggagcagtatttccgcgatctcgacggcgaggcgccgtccgccatctacgacatggtgctcgcctgtgtcgagaagccgctgctggaggtggtgctgatacacacccagggcaatcagacgcgagcggcggagttgctgggcttgaaccgcaacacgctgcgcaagaagatgaagtcgtatgatttgatttga

SEQ ID NO: 823 - DNA, 1065 bp, Chromobacterium substugae
atgcagataggtccctaccaactgaaaaaccggctgatcgtggcaccgatggccggggtgacggacaggcctttccgcatgttgtgcaaacggctgggcgccggcatggcggtgtctgagatgatcaccgccaacaaggccctgtggaccaccgcgaaaacgctgcgccgcgccgatcacgaaggcgaggtcgagcccatcgtggtgcagatcgccggcggcgatccgcagatgctggccgaggcggcgcgcctgaatgtcgagcacggcgcgcagatcatcgacatcaatatgggatgcccggcgaagaaagtgtgcaatgtggcggccggctcggcgttgctgcgcgatctggacaatgtcggccgcatcctggaggcggtggtgaaggcggtggacgtgccggtgacgctgaaaacccgcaccggctggagccgcgaggcgaagaccgcgctgcaggtggcgcggatggcggagaacgccggcatcgcggcgctggcgctgcatggccgcacccgcgaggacatgtaccgcggcgacgccgagtacgacacgatacgcgcggtcaagcaggcggtgtcgatcccggtggtggccaacggcgacatcgattcgccggagaaggcgcgccgggtgctggactacactggcgccgacgccatcatgataggccgcgccgcgcaggggcggccgtggatcttccgcgagatccagcattacctggacaccggcgcgacgctgccggcgccggaggtggaggaaatccgccacttgctgctgggccatctggacgagctataccggttttacggcgaatattcgggctgccgcatcgcccgcaagcacatcgcctggtacaccaagggcctggccggcagcaacgagttccgccagcagatgtaccggctggagagcacggacgagcagcgtctggcggtggcggactattttgcacggctgggcgagcaatccgatcgcctggtttacctggccgaggatgcagacaggatggaccacgaccgggaagccggcgtggagggagaggcctgcggctatgctgactga

SEQ ID NO: 824 - DNA, 3159 bp, Chromobacterium substugae
atggagttgaaccaagccaggctgtcgcgcttgcagctgttcggcaccctggccatcgtgtttgcgctggccctcaccctgaccagctatttcctgatgatgagctggcacgatttccaatccggacggcaaaacatagagcaagaggcctccgcgcgcgcgcgcgacaacctgcgggcctataccgaccacgccgcgctgctgctgtcggcgctgcgcgaacgcaccaacgacaccgtccgccaccagctgcaggagcaggtggaccaggcctggagcctggccgacgccatctggcgccgagaacacggccgccgcggcgaacaggacgcgcagcggctgatcgtcgaggcgctgcgcccgctgcgctacttcaacggccgcggctacttcttcatcgacaccctggacggccgctgcgtgctgctgcccaccgcgccggcgcgcgaaggcacctcgctgctggccaaccgcgacgaccgcggccgctacatcatgcgcggcctgatcgactcggtggccaacccagacggccgcggcttctccgcctaccgctggtatctgcccggcggcaaccgcatggacgacaagatcacctatgcccgccgcttcccgccttacaactggctgataggcagcggcgaatacatcagcaatgtggaagccgcgctgcagcagcagggcctggacacgctggcgcggatgcgcttcggccaggacggcggcgaattgatgatcatcgaccgccagggcgtgatccgcctctatccgacccggccgtcgctggtcggcaaatcctaccagacgctgccggcggccgagcgcgaccgcgcgctgcaactgatccagcgcggcaagcacggcggcttcctcgaatacagccgccaggacgaggccggcgccgccgccgaatcctatctcgcctacacccgccagctgccgggctgggactggaccctggtcaccagcctgcgggtgcagacgatacaggacgacggcctgcgcgccgcgcagcggctgaaaagcaggctggccgagcgcatcatcgccacgctgggcatgacgctggtggcgatgctgtgcgccggcctgctgtgctggtatttcgtgcgctgggtcagcgcgctggtgcggcgctaccagcacgatctggcgcaaagccacctgtcgctgaaggagcaggcgcgcgaactgaagctcagccacttcatgatcgacaacgccaccgacctggtggcgctgcaaagcagccagggcgaggtggtgtactgcaacctggcgctgcgccgcctgccgcagctggtggacgacctgttccgccatccgcccggcgccttcccgctgactttcgaaacccgccacgacggcgacgacggcgagctgttcctggaaatcaccgtcaaccagctgcgctatcagggcgacagctatctgtgcgccaccgcgcgcgacatcagcggccgccgccagaccgagcgccagctgaggctggccgcccaggtgttcgaatccagcaacgaagccatcctgatctccgacccggacaaccgcatcctcaccgtcaaccgcgccttctgccacatcaccggctacagcgaggacgaagtgctgggccgcaaaccatcgctgctgttctccggccgccacgagcccgccttcttccagcagctgtggcagaccctgcgccagcgcggccaatgggccggggaaatctggaaccagcgcaagaacggcgaacacttcccctgctgggtcaacatcagcgtgctgcaggacgcgcagggcgcgatcagccacttcgtcgcgctgttcaccgacatttccgaacgcaaggagcaggaggcccgggtgcagcacatggcggaatacgacgcgctgaccgacctgcccaaccgcgtgctggtcaacgaccgcctgcaccaggcgatacgccaggccgagctgcagcacaaccagctggcggtgctgttcgtcgacctcgaccacttcaagaacatcaacgacacgctgggccacagcgccggcgacgaactgctgaaggaagtggcgcggcggctggccggcgcggtgcgcggcctcgacaccgtcggccgcaccggcggcgacgaattcgtgctgatcctgccggcgatcaatcagccgagcgaggcggcgcagatcgccgaacgcatcctgcgcacgctacagcagccgttccagatcggcgagcactcgctggtggtcagttgcagcataggcatcagcctgatgccggacgacggcagcgacatccagaacctgctgatgaacgccgacctggcgatgtaccacgccaaggcgcacggccggaacaccttccgcttctacacccgcgagatgaacacccaggtggcggagcggctgttgatggaaaaccggctgcggcgggcgatggagcagcagcagctgtacctggtgtaccagccgcaatacgacatggccggcaaccgcctgctgggctgcgaagcgctgctgcgctggcgcgatccggacgagggcctgatcatgcccggccgcttcatcccggtggcggaagacaccggcctgatcgtgccgctggggcgctgggtgctgaacgaagcctgccgccaggccagccagtggctgcgcgacggcctggggccgatccgggtggcggtcaacgtgtccgcccaccagctgatgcgccacgacttcatcgacgacgtgcgcgacgcgctgcagaagaacagcctgcccggccactgcctggagctggaggtgacggaaagcacgctgatggccgacgccgacctggcctcgcgccagctggcggtgatcaaggcgatgggggtgcggctgtcggtggacgacttcggcaccggctattccagcctggcctacctgaagcgcttcgcgccggacacggtgaagatagaccgctccttcatcaccgacctgcccggcgacgaggaaaacgccgccatcgtcagcgccatcatccacctggccggcgcgctgggcatggaaacgctggcggaaggcgtggaaaacgaaacccagcagcacttcctggaaacgctgggctgcgaggcgatgcagggctacctgctgggcaccccgctggccgaagaattgatgacgcggcggctggaggcccagcaaccgctgcagccggcctag

SEQ ID NO: 825 - DNA, 573 bp, Chromobacterium substugae
atgaaaaccgcgctgctgacgctggactacatcatcgacatcatgcacccgacgggcaagacggcgcgctgcgccggccatgccgccgagcgcggcgtgatcgcggcggccaactgcgccatcgcgctggcgcgccggcagggctggccgatcatccatgtcaaggtggggttttcgccgaattacgccgaaatgccggagggatcggccatcttcagccgcgcccaggcgctgcaggcgctgaacctggccgggccgggcaccgatttccatccggagctggatgtggcgctggaagacgcggtggtggtgaagcaccgcatcagcccgttttacgccaccggcctggaggcggtgctgcgggcgcagcgcgtcgagcggctggtgatcgccggcgtcagcagcacctgggcggtgcaggcggcggcgcgcgacgcgcacgaccgcgactaccgggtgctggtgctggagccggcctgcgcggcggccaatgaggacgaacaccagatgtcgatgaagcagctggcggccatcgccggcatcattgaccaggcgcagctggaagcgctgtga

SEQ ID NO: 826 - DNA, 441 bp, Chromobacterium substugae
atgatgaaagacaatagcgcccacatcgccgcggcgacccggctgcggatgcagctgatgacgatgacgcgccggctgcgccagcaggcgagccaggatgtgctgcctttcggcttgctggcggtgctgggcgcgatagaccgcgccggcggagaggcgacgcccaccgagctggcgcgcggcgaaagcctgcgctcgtccaatctggccgggctgctgcgcgagttggagggcggcgggctgattcgccgcctgcctgatccggaggatggccggcgggtgcgcgtgcagttgtcggcggcaggcgccgcggccttgcagcgcaatcgccagctgcgcgatggctggctgcaggcgcggctggatggactgggcgacgccgaccgcgcgctgctgttgcgcgccggcgccttgctggagcggctggcgcgcgaggattga

SEQ ID NO: 827 - DNA, 210 bp, Chromobacterium substugae
ttggacacgatacagggcaagcgcgtcctggtgacttgtccatccatcttgggcgagaaggggtcggactgggagggcgcggccattttcggacgcgattatctggttgagttgctggcgctgggcctggcttacagggtattgaatttcgccgatgtgaagatcgcgatgctgaaggccggcgagcacgtggcgacgcagagggcatga

SEQ ID NO: 828 - DNA, 903 bp, Chromobacterium substugae
atgatcgacgacttcaagtcatatttcctgggccgcctggcccagctgctagagtcgcgcggcattgcggagcgcgaacgcacgctgtggctgaagaccctgctgggcatcgacctatccagtgcgaatcgcaaattgaagggcggaatcgccttcaatatcgaagaactggccaaggtatcccgggcggtgagttgctccagcgattacttgcttggcctgaaagacgaagcctccgctacccgtccgcccggccatgccttcgatggccttggcgtgcgcgccacgctggactgcgaccggttgcccgcgcaggacaccatgactgtcgcggctcgccaccttggcgaccctgatgaaaaagcgttgattgcctggatatcgcgcaatgagagtgcgctaaacgcacaagttgtcgcctggaagcctgtcggcggcagcggctggaaaatggcggaacgcgcggacgcgccttccgatgcgaccttgcaccgggtatacgcgcgcctcgcgctggatcccgccatcagcgcctaccggatcgcggtgctggatgatagggccgaaacggcggaagtgatgcaaggctttctggaacaggccgggtacatcgccgacacctacacccggacagacgagctggccaaagcgctgcggcagacccgctacgacgctttcgtgctggactggtcgatgggccgcggcgaaaccaccgaatcgctgatggaagacatccgccagaaccatgccgccgacacgccaatcatcctgatcaccggcgaagccagcgaactggagatagaacgcgccatcgaccgccacggcgtgcgctactttcagaaaaccgggctgttcaagcccatcatcgcccagttgaaaaaggatttgcgcgaattggcttga

SEQ ID NO: 829 - DNA, 1359 bp, Chromobacterium substugae
gtgcagcaggggcggcagtggctgatgtttttctgcctggcggtcttgttgccgatgttgtgcttcttttacgtgcaaagcacgctgttttccaagcaggcgctggagcaggccgcgggcccaggggagggctattactgggcggcatcgcaatatcggtacgcggtgcagcgcctgtatggcgagatcaacgcttatgcgctgcatatcgaaacctttgaagatttgcaggtcgcctacgatgtgctggaatcaaaatacctggtgctgaaccgctcggtttctccgcaattgcgcaagaacgccgattacgcggccttgctggagcagatcgccggcttcatgcggcgcggcaagatcctgtttccggcgacgcggagcgatgccgccgccctggccgcgctgcagcaggagttgaacgacatgtcgccggtgatcgccgatttggtgatagccgctcatcacgaagaggtccggctgcgcgatgcatcgatcgaacagacgctgaggctgcgcaatttcgccttggtcagcctgatcatctgggcggtgctggtggtgtttctggcgcgggagctatggaaggcgatacggcgccaggagatcattgagctgcagcgcgagatgatcgccgcagccaagcaggcccaggaagaggcggtgcagacggcgctggcgcgctccaccatgttgtctaccgtcagccacgaaatcctgacgccgctgcacacgatacagggcggggtcgagttgttgtccgacatggagcgggagcccagggtgttgcggacgatcgccaatgtcaggactgccgccgactacctgtccaagctgatgcaggatttgctggatatgggacggctggacgcgggaaggatgattttgcggccgacgcggttcgagcccggccagctgctgggcagcgtggtgggggagtttcgccaggtcgccgcggccaagggggtggcgctgtcttttgccgcggcgggcgtggccggggtcgaggcgcatgccgacatgaccagaatccgccaagtggccagcaatttgatctccaacgccttgcgctataccgacgccggcgaggtgcgggtggcgttggaattggagggcgtcgcgccgcgagcctgtctgacgctaacggtcagtgataccggcatcgggatccccgagagcgagcaggcttgtctgttcgaggcttttacccaagccaagggcgccaatcgcggcggcgcgggcatgggtttggcgattgtccgcaagatcgccgtactgatgcagggcgaggtgtttctcgccggcagcgaagtgggcaaggggtctaccttcatcgccagactgccggttgagctggtctga

SEQ ID NO: 830 - DNA, 495 bp, Chromobacterium substugae
atgagggatggaatgaaacgattgctggcggggatgctgctggcctggtccggcgcggcgatggcctcgcccgccgatgtcatgctgacggtcaggggcggagcaggcatgttcaacgacgccggccgcagcgaataccgcttcaccgaaagcgagctgttgcgcttgccgcagcgcaccatcaccacgcgaaccacctggacgccgaggtcggtgttttccggcccagggctcagcgacattctgcgcgcggtcggcgcgcgcggttcgaagatagaactggtcacttacgatgaatacaaagtgatcctgccgctgagcgatctggacaaataccatcccatcatggccaggttcatcaatggcaagccgttggagaggcgggatttcggcccgctgtggatgatgtatccggtcagcgatttcgccgaattgcagaaagtcaaagccgacgccaagcttgcctggcaaatcaagaccatcgtggtgcgttga

SEQ ID NO: 831 - DNA, 864 bp, Chromobacterium substugae
atgatcgccaaatcgattacccgctacctgatcaccctgctgttgctggccgccgccgtctgggccggaaaaacgctgtgggaccactacatgctgtcgccgtggacccgcgacggcagggtgaaggccgacgtggtcaccatcgccgccgacgtgtccggcatcgtcacccaggtggcggtgaaggacaaccagccggtgcgccgcggtgacgtgctgttcgtcatcgaccccagccgctaccgcgcggcgctggcgcaggccgaggcgacgctggccggccaccaggccgacaagagccgccgcggcaaggaggcggcgcgccgcgccagcctggacagcgccatcgtctccaccgaaagccgcgaaagcgccgatttcgccgccgccgccgcggtgtcgcagtaccaggcggcggtggccgcgcgcgagctggccgcgctgaacctgcagcgcacggtggtgcgcgcgccgaccgacggctatgtcaccaacctcaacgtccatgtcggcgacttcgcagccaccggcgcgccccggctggcgctgatcgacggcggctctttctatgtcgacggctatttcgaggaaaccaagctgccgatgctgaaggtgggcgccaaggccgaggtgacgctgatgagcagcggccagcgcctgcgcggccatatcgccagcatcgcccgcggcatcaccgatcgcgacgccggcaccggccgcgagctgctggccgacgtcaaccccacgttcaactgggtgcggctggcgcagcgggtgccggtgcgcatccagctggacgagcagccgcagggccagccgctgatcgccgggcagacttgcacggtggtgatagtcggcaaataa

SEQ ID NO: 832 - DNA, 201 bp, Chromobacterium substugae
atgccgcatgaaatcgccgtattcggcatcctgatgccgaccttgctgcccttgttcgtgttgggcatgctgctgcagatcggcctggactgggcgctgggccggctgggggtatatgagaaggtgtggcatccggcgctgttccgctggtgcctgctgatcgtgattttcagcgcgctggcgctgccgctttaccgttga

SEQ ID NO: 833 - DNA, 2139 bp, Chromobacterium substugae
atgagcgccggcctgctggcggccggcaggcgcgtcggccgcgactggctggccagcgagggcgaaaactggagcttcgtcgccaagacgctgctggcggctttcgcctcgctgtggatcgccttccgcctcggcttcgattcgccgagctcggcgatgaccacggtgttcatcgtcaccttcccgcgcagcggcgcggtgctggagaaaagcgcctaccggattctgggcacgctggtgggcagcgccgcggcgctgggcttcgtcggcctgttcgacggccaggcggcgctgttgctgatcagcctggcgctgtgggtaggcgtctgcaccggcggggccacgctgtaccgcgactcgcgctcctacgctttcgtgctgtcgggctacaccgcctgcatgatcgcgctgccggcgctgaaccatccgctggcggtgttcaacctggcggtgacgcgggtgtcggaaatctcgctgggcatcttctgctgcgcggtgatcaacgatttcatcttcccgcgccatcaggccgacctggtggtgcgcaccgtgcgcggccgctaccacggcttcgtgctgctgtgccaggaggcgctgacgcaaaggctggacgcggcgacgctggaggccacccagctgcgcttcgcttccgacatcgccgcgctggaggcgggccgcgccgccgcgttcttcgaggccggcaacgtgcgcgcgcgcagcaaccagctgcacgccttcaacgccaccttcatggcggcgctgaccacctttcatacattgcaccggcagatggagcggctgcgccgcgatccggcgtcgccgctgcccagtctgttctacccgctgttccagcgggcggcggcggcgctgagcaatgacgacggcccggcgcgcaccgcgctggaggccgggccgacgctggcgcggctggatgccgtccgcccggggctgcgccaggatctggccgcggcgcgcgagcagctgctggcgcagccgcacgacgaaagcctgcgcatcgagttcgacaccgccagcgagctgctgctgcgcttcgtcgaagaaatgcacaccttcaccgcggtgtaccacggctttcgccagcgcaacccgctgcaagtggaggcgctggcctattcggcgcgcaccccggccgccatcgcgctggccagcggcgcgcgggcggcgctgacgctgttgacgctgtccgtcgcctggtactggctggcctggcccagcgcgctgggcgcggtgctgctggccaccatcttctgcggcctggcctcgtcgtcgccgcggcccttgctgatggtgaagcagatcctggtcggcttcgcgctggccacgccgctggcctacgtctgcaccttcaagctcttgaaccaggccgacagctttgcgctgttggcgctggcgatgtcgcccttcctggttttgggctgctacctgaaatgctggccgaaaaccgccggcgtcggcaccggcatcaccctgttgatggcgcaggcggtgaacccggaaaacatgatgagctacgacgtggtggcctttctcaacgacggcatcgcccgcctgctgggcctggcgctggcggggatgttcttcgtgctggtgctgccggagcacaccatgggctcgcgccgccacatcgccgcggcgctgtggcgcgaggcgctgaacgcctgccgcgccggcctgccgcacctgaagcagcgctacggcaaccgcgtgcgcgacctgctgaaccaattgaacgccgcgccgggcgaggccggcgatccggcgcgccaggccaccatcagccaggcgatcaccttgctcgaattggggctggccatcatcgatctgcgccagctggcccgcgacgccgggcaggagccggtgcggcgcgcgctcgatgccagcgtggcggcgctggccgactatttcgccgcgccgcagccgccgcaattgcggcgggcgatggcggcgctgctggcggcggggccgccgatacgcgcgcagctggcggtggcgctgccggaggccgcggccagcctgaaccgggcgctggccacgctgcatctgatccatacttcgctgctggacgccatgccgcagccggaagccggcgcgccggcgggagacggccatgccgcatga

SEQ ID NO: 834 - DNA, 1449 bp, Chromobacterium substugae
atgcagcggttctacacggtatggattgcgggtttggccttgctggcggcgggttgcgccgatccgggcgccggcgggccgcagtcgcggctgctggacgccgatagcctcagcgccggcaagcggatacaggaggcggcggccaaggcgggctggccgcaggccgactggtggcatcagctgcacgacgcgcagctggaccagctggtgacggccgccctggccggcaatcccggcctgcgcgccgccgcggcgcggctgcgccaggcccaggcgctggccggcgtggccgaatccgccacccggccgcaagcggccggcgaggcctcgttcacccgccagcgctattccgagcaggacttcatcccgccgcccgaagccggcaactattcctggtacaaccacgccgccctcaacgccagctacgacctcgacttatggggccggcagcgcgccgcgttgtccgcggcgctggacgaggcgcaggtgctggcggccgaagcgcagctggcgcgcctgaacctcagcgccgcggtggtgcgcgcctatgtgcagctggcgctgcagtacgccgagaaagacctgctgcaggacaatctggcgcagcgcgaacgcagctggcagctggcgaagaagcgcaaggccgccggcctggccgccgaagccgaagtggtgttgctggagtcgcggctgccggccgcgcgcaaccagatcgagcaagtggacgaagccatcgagctgctgcgcaaccagttggccgcgctgtgcggccaggggccggccgccggcgaggcgctgcggcggccgacgctgaagctggacgacgccgcgccgcggctgcccagcgcgctgccggccgaactggtgggccgccggcccgacgtgtccgcccagcgctggaaagtggaggcggaggcccgcaagatagacgcggccaaggcggctttctacccgaacatcaatctgatggccttcgccggcttccaggcgataggcttcgacaatttcccgtcggcctccaccgcggtgcgcggcatcggcccggcgatcagcctgcccatcttcgagggcggccggctgcgcagcgcgttgtcggctcaaaccgccgcctacgatgcggcggtggacagctataacgccagcgtggtgcgcgcgctgaacgaggtggccggcgccatcgccaaggtggagtcgcaagccgggcagcagaaacagaccgaactggcgctggcctcggcgcagaaggcgttccggctggcgcagcaaggctaccgcgccggcctgtccgaccaggacaatgtgatcgccgcgcgcctggcgctgctggcggcgaagcagcagctggcgcggatacgcagcgagcggctggacagcttcgccgcgctgatgagcgcgctgggcggcggcgtggcggtgagccagccgccggccgagggcaagccgcaatga

SEQ ID NO: 835 - DNA, 3816 bp, Chromobacterium substugae
atgagcgaacatcacgatcttccccccgaaacgccgcaggcgccgcccgccgcgccgccgcgcccgcgccgctggcggctggcgttttcctgcctggccttgacgctggcgctgttgctggccggcctgggctggatcagcgccagcccggccggcttcgcctgggcgctgggcaaactggactggctcagcggccagcggctgagcgtgggcgcgacccagggcacgctgtggcgcggcttcgcgctgcgcgacatccgcctgcgcggcggcgccgacgatgtcgacatcgaatcgctgcggctggactggcagccggcggcgctgtcgcgcggcgagctgcgcatcagccggctggacgtcggccatgtgcgggtgttgagccggcccgcgcccgaacagaaaagcgcgccgctggccgcgccgcgcacgctggccttgccgctgcggctgaaggtggaccagctgaacctggccagcctgacgctggagccggcgcatttcagcctgtaccggctgcaggccgcctacgattacgacggcgcgcgccaccgcctgcaattgcagcggctggattcgccctggggcgaggcccgcgccggcctgacgctgtcggcggcctcgccgtttgcgctgtccggccagttgtccgccaagggcgagctggagcaggtgccggtgaaggccaggctcgacctgtccggcgacctgctcaagccggccttctccggcgaaatggacggcaagggcgtcagcgtcgacatcgccggcgcgctgcggccgttcgacgccaatccgttcaaccggctggtccggctggatgcccgcgtcggcaacatcaatccgcaagccatcctgcccgattggccgaaggcgcggctcagcttcgcggtgttcgccgagcccgacgccggccagcgggtgaaaggcggcctgacgctggtcaacaccgagccgggcgcgctgtcggcgcaacggctgccgctgtcgctgctggccggcgaattccgcgccgacgagcaggcgctggagctgttcaacagccacgccgagctgggcggcggcaagctgggcctggtgggcgaggtcaagcccgaccggatgaagctggcgctggacctgagccagctgtcgctgcgtcagctgcacgcgtcggcgccggacgacgtgatcagcggccggctgaccgccgagggcgcgttcgccgcgccgcgcttcgccgcgcagctgaaaggcaaatggctgcaggcgagcgcgctggccgagctgtcgggcggccagcagccggccttgctgctgaaaaaactggaattgggcgcgggcagcggcgcggccagcgtcaacggcaagctgggcctgtccggcaagcggctattcgaattgaacggcaagctggtgcacgccgacccagcgcggctgcgcgacggcctgcccagcggcgatctcaacgccacgctgaagatggccggccagctggccgagccgatggaagtgggcgccaagctgcaactggcgcccagccggctgtcgggcgcgccgctgtccggcaacgccagcgtattgctgggcgaggcgcggctgaaacagctgttgctggatctgaagctggcggacaaccgcctgcaggccagcggcagctacggcgtgctgggcgacaagctcaagctggcggtcaacgcgcccaatctgtccttgctgggccccggcttcgccggcgtcgtgcaaggccagggcgagctggccggcgtgccgaagataccggtgctgagcgccaagctgcaggcgcagcggctgcgcctgccgggcggcgtggcgctgcagtcgatgcagttcgccggcaacatcaaggccgaccaggccagccccttccagctgagcctggacgtggcggcgctgcaggccggcggcgtcagcgccgagcagctgcgcgcgcgcgcgtcgggcacccgcgcccgccacagcctgcaattggatggccgtttccagctggagcaacagaattacgcgctgcagctggcggcggcgggcggcttgagcctggacaaccgctggcagggcagcctgcaaaaattggagctggccggcaagcccggcctcagcctgcaggcgccggcagatctgacactgggcgcagacggccaggcgcgactgggcgcggcgcggctggccttgctgggcggcagcctgaatctggcggaattgacgcgccaggcgaacggcgcgctcagcggcggcggcagcgcgcgcggcctgcgcctgagcgaattggggccatggctgaagctgccgctggagcagaacctgcaattcgacgccgattggagcctcagccctgccggcatcggcaagctggcgctgtggcgcagcggcggcgacgtgcagctgccgctggacaagggccggcatgtcgcgctgggcctgaagacggcgcgggcggaactggacctggacggcaggcagctggccttcaatgtcagcgtggacagccgcttcgcccaggcgcagggccagggcagcctgccgtggaacggcggccgcatcgacggccacacgccgctgtccggcaatctacgcgccagcctgccgtcgctggcggcgctggccgagctgtccggcccggggctggagctgggcggacagctggcggccaatctcgatctgggcggcccgctgcagatgccgcaggcgcaggggcagatccgcggcgacaagctgaagctggccgaccgccgcaccggggtgtcgttatccgacggcagcctgctggcgcgggtggacggccgccagctgacgctgcagcagctgcgcttcgtcagcggcaagggcgaagtcaacgccagcggctcgcttgatttcagcgacgcccagccggatgcgcgggtcaaggtgtcgctgcagaagttcagcgtgttcgaccgccccaaccgccggctggtggtatccggccagagcgagctggccttcgtcggcggccggctgtcgttgagcggccgcatccgcgccgaccagggccgggtgggcctgcccaagctgggcgcgcccgacctgggcgccgacgtggtggtggtggggcggccggcggccgagccttcggccttcgccaccatgccgctgacggtggcgctggatctggatctgggcgagcgcttccgcttctccggccaggggctggacgtggagctgtcgggcctggtgcacgtcagcgccaatccgggcgaggcaccggcggccaggggccaggtcaaggtggacaagggccgctacaaggcttacggccaggacctggacatcaccttcggcgccatcaccttcaatggcccgctggacaatccgctgctcaatgtgcaggccaagcgccggctgtcgccggtgggggctggggtggaggtgaccggttcggtggcggcacccaaggtgcggctgatcaccgacgacccgatggcggacaaggacaagctggcctggctggtgttgggccgcgccgccagcggcgaccgcgataacaacgacctggcggcctcggccggcatgatgctggccggttcgatcaacgaccacatcggcctgttcgacgatctgggcgtttccagccgcaaggaaaagacgctgtccaacggcacggtgagcccggccgagcaggtggtgacggtaggccgccagctgacgcgcgagctgtacctgggctatgaatacggcatcagcagcgccgaccaggcggtgaagctcgcttaccagctgtccaagggctggtcggtggtgctgcgcgccggcaccgcgatgtcggccgagtcgcgctatacgctgcgtttcgattag

SEQ ID NO: 836 - DNA, 1710 bp, Chromobacterium substugae
ttggcggccattttgctggccggccaggcccaggccgcgctcgactacatggtggagatagacgcgccgtccaatctggcgcaattgctgcgcgacaacctggagctggtggaaaaccagcgcgatccggacatcgaccagagctggctggaggcgctggtgaagagcacgccggacgacgccaaaaaactgctggaaaccgagggctatttcggcgccaaggtggaggcggcgctggaaggcggcaatcgggtgaaggtgaaggtttccccaggcgagccggtgctgatcgacgacgtggtgatccggctggacggcgcggtccgccaggaaagcgactaccagcagcgtttcgcccaggtgctggaagcctggacgctgccgatgggcgcgccctaccgccaggccgactgggacgccggcaagcgcgcggtgctgcgccgggtgcaggccgaccgctttcccaaggcgcgcatcgtcaagagcgaagccaggatagacccggccacccgccgcgccacgctcgacgtggcggtggacagcggcccgctgatccgcttcggcgcgatcaaggtcaacggcctaaagcgctacccggaaaaactggccaccggcatggccgatttcaaccccggctcgccctaccaccaggacaaggtgctggccttccagtcggcgctggagcagtcgccgcagttctcctcggtgatcgtcagcgccgatttcgaccacatcgtcgacaaccaggtgccggtgacggtggacgtggtggagctgccgaagaaaaagctggagctgggccttacttacgattccgacgtcggccccggcgtgcgggtgggttacgaccactacaatctgttccagcagggctggaccggctcggcgctggtggactggaagcgcgagcagcagtcgctgagcttcggcctgggcttcccgcgcgagtccgacggctattcgcactcgctgaccagcgccttcaagtcggaaaacgtgcagggggtgaagaccaataccatggacgccggtgcctggcgcctgcgcagccgcggcaatatcgaggcgcggctgggggtggaattcctcaaggaaagcgccgaggccggcggcgtcacgtcgagcgacacccacgtcacccagctggtgtacggctggacccagcgcgcggtggacgacctgatgcggccgcgcagcggctatctgctggacggtcagctgtccggctcgctgggcgcgctggcgtcgtccacatccatggtgcgcgcctatggccgcgcggtcggttactggtcgcccttccccaagtacggcaccttcgtcgcccggctggagctgggccaggtctgggccaaggagggcgcgcaagtgccttcggcgctgctgttccgcgccggcggcgccaacagcgtgcgcggctacgactaccagagcctgggcctgcccggccccaacggctcggtgctgggcggcagggtggtggccaccggcagcgtcgaataccagattccggtgaagccggactggtatctggcgctgttcagcgacgccggcaacgccgccgacagctggaaaggcttccagaccatgcgcgccaacggcgtcggcgtgcgctggatgagcccggtggcgccgctgtcttttgatatcgccaaggcggagggggacggcaagatacgctggaacctcagcctgggcctggctttctaa

SEQ ID NO: 837 - DNA, 228 bp, Chromobacterium substugae
gtggcggcgtccagcgtccgcgccaatgcgctgccggcgggcgtgcaagtctcctgcctggtccgcgccgagcgggacggagagcccgcgcaggcgcgcaacgtccatctgctgttccggcgcgatggcaaggctggcgattttcatgcccccgcgttccagccggacgccgatgatgtccaggccttgttcgcgctggttggatcggtcagcgtcaccgaccgctaa

SEQ ID NO: 838 - DNA, 171 bp, Chromobacterium substugae
atgaaatcgttgatttggcttgcttgtcttttatcgccgtttgcggccacggcccagccgatcgccatcgcggcgcccgatgccggctggcaggtgcgtttcgacgcgccggaatggaagccgttgcgcagccagaccgctttgtttacgcggccgcagcgggcaagttga

SEQ ID NO: 839 - DNA, 630 bp, Chromobacterium substugae
atgtccattcgcatttccgggccgcggctggcgatgcgcaaagccccgcgccaggcccgttcccgggccacggtggacgtcattgtcgaggccggggctcgcgttctgggcgcgcgcggctggggcgggttcaccaccagcgaggtcgctggcgtggccggggtcagcatcggttcgctgtatcagtatttcccgaacaagatcgtgctggtcgacgccatccgccgccgccatttcgacgaggtgctggccgctttgcagcgggtctgcgatggcctggggcggccggagtgtccgctggagcgcctggtggacggcatgatcgccgtccacggcggctgcccggccctgcaccgggcgttgctggacgtgccggtgccggacgagatgcgcgccgccggcgacgctttccaggcggaatacctgcggcgctaccgcgcgatcgtcgccggttgccgcggcgtggcgcgggacgaggatgacgagctggcggcgcagacgatatcctccgccatcgaaggcgtggtccacaatgcggccaggcgcggcaggctggcggaggccggcgtgcggcgggagctggtccgcctgctgcgggcttatctgggagactgccgcgaaggccggtga

SEQ ID NO: 840 - DNA, 609 bp, Chromobacterium substugae
atgccggcctcctccgcgaacaatatcaatgatgcggcatcctattactcacatggaaaggttagcatcatgagcgcaagcagactattggcgcggctgttccgctaccaggcgtgggcgaacgatgacatgctgcgggcgctggcggcactggaccccggccggcacgccgaggaacgccagctcggcctgcggctgatgaaccactgcctggtggtgaaccagatcttcgccgcccatctcgccggccgcagccacggcttcgccgccgacaacacgcccgataccccggccccagaagcgctgcggcgcgagctggcagccgtcgaccgctggtatctggactacgccgaagccgccaccccggatctgctggcccagccgctgccgttcaccttcaccgacggcgatccgggcttcatgagccacgaggacatcctcgcccacgtggtcacccacaacggttatcaccgcggcgaggccggacggctgctgcgccaggcgaacgaccgcgccccgctgcgcggcgagctgccgtgggacacctacgccgttcacctgcaccgcgccgagccggaacgccggcggcaaggccgcgccgcgccgtaa

SEQ ID NO: 841 - DNA, 1194 bp, Chromobacterium substugae
atgttcgacaaaagcgacaaaagcatcattctgaaaaccatcatggtggccgcccccatcctgatctgcatgggcctgctgccggtgctgtcgttttacatcgaaaaactggaggaaaacggccgcgccgaaatcgtcgactacatcgccatcgcccaggcggcgatggaggtgaaattcgacgccgccgacctcaacggctggcaaaccggctacgccttcgacatcatccgccatgtcgacggcgccagccgcaacgatgccgtgtcccgcgccgaattcctgcgctcggccggcaatttccgccgcgacatccaggcgctgcgcgcgatgccgctggccgccgaccagcgcaacctgctggacgaggtgcagcaggatttcgacagcttcatggcgctggatgcccgcatcatcgccatgtaccgcggcggcgcgcccgccacccgcgacaaggcgtccaacctggtgatgggcgaggaaatccagatcttcaaccacatctcgcagaacaccaacgcgctggcggtatccatcacgctggacctgatgaagaaagtggcgcaatccaactcctacggcatcgtcgcccgctggatgatgctggtgatgtggatcatcgccagcgcgatgggcattctgctggtgcggctgctgcacaagtggctgggccaaatgcgcagcctgatgcaaaagctggaatcgctggccggcaccgacgaactgacccagctgcccaaccgccgcacctgggacatccagatcgaaatgatgctggccgccgccaagcgctaccgccagcccatcgcggtggcgctgttcgatctggaccacttcaagcagttcaacgacagccacggccacccggaaggcgaccgcctgctgcgggaagtgtccatcctgatcaagtcgcggatgcggcaatcggacctgttcgcccgcttcggcggcgaggagttcgtgctggcgctgatggactgcgacctgccgcaggcggtgacccgcatcgactcgctgcgccgcaacctgccggacaaccagaccttctcggtgggcgtcacgctgtgggcggagggcgagcgcatccacaataccctggcgcgggcggacaaggcgctgtaccaggccaaggacggcggccgcgaccgggtggtgggggtggagccgcccgggggcagaatcgaagggcgctag

SEQ ID NO: 842 - DNA, 696 bp, Chromobacterium substugae
atgacgctgccccaagccgttttcttcgatctggacaacaccctggtgcaccggaacgacagcatcgatctttacgcccttcagttctggcgcgatttcggccacgccatcggttccggcggggcagagcgggtggcagaggtgatcaagcgttgcgacaacggcggctatttgcccgccggctcgccgcatggttcgatcaagcaggcggtttcccatggcttgaaaacgcagatcgtctggcggcaagcggtggagcaggaggcgctgctggatcattgggagcgctacaacgcggtttgcaccgcggcgatgccgggcgcggcggaggcggttgccgctcttctggcgcggggcgtccgcatcggggtgatttccaatggcagccatcgcacccggctggagaaagtggcgcggctgccgttcgcatcggccatcgagctgacggtcagctccgaatcggcaggggtaggcaagccggacgcggcgattttccggctggcggccgaggcgctgggggtggcgccggcggagtgctggtatgtcggcgaccatccgctcaatgacgtgatcggcgccgcaggggcggggatggcgccggtgtggctgagcggctttcacgcttggccggcggagaggccgcggccggcgcgcggcatctttgcgctggggcaattggccgaagggctggtttag

SEQ ID NO: 843 - DNA, 123 bp, Chromobacterium substugae
atggatgagttgtgggggcaattcgaggcgtacttcgccgattttgtgtccggcgcgcgggatggccgctatgtgtattcggcggagtacggcggcctggcgagcgcggaggatgtggcatga

SEQ ID NO: 844 - DNA, 669 bp, Chromobacterium substugae
atgaaccaccacctcgacctctccgtaaacctccccctccgcctcgactacgccaaaaatttcccgctgcgcgtcctccgccgcgaggagggtttctggttcgtcgccgccgaaatcgccgcctcgatgaaacaggaggtggaagacctgctacacacgctggaacaacccgccggccgcttgctgttgctggcaggcgaggacgagccggtgctgtgcttgtccgaaggcgagctggacgaggtggtcaggaggatcaagaaaccgggcgcgcggcggttgcgacgctggtggcaggaggaaacccggccggccttgctgcatgagggcgggccggccaccacggcggagagtctgcatctggcgctggccttggccgccgaggcggcgcagcaagtggggcgggcggtgatggaggcggtgctgcgcggccccaggccgtggcagcattcgcgctgggtggtggccctggattacgagcgccacaacaagcagcgctggccgcatggcaagctgatcggcttgaccagctccgtcgccacgctggaaggcttggcggagttgatcgccgaaccgggcaggatgccggtgaacaataccgacttggtcaaactggcttccgcctgccatttgcggctggcggagcggatggggcggattgccggctga

SEQ ID NO: 845 - DNA, 1794 bp, Chromobacterium substugae
atgaaatctataaacaaagtaaagcaagaccttacggtcaaaggtgaaacaattgaaagactatatattaattatgtagaagacaaatacacagtcaatcgtagatatcaaagaaaattagtatggggaatagaagaaaaaaaagctttcattgattcaatttctaaaaaatttccagttccaatcatacttctagccgagaatataaaatcccaatcgatagaaataatcgatggaatgcagcgactaaatgctattttttcatttattgaaggtgaaattacacttgataatagatatttcgaccttgaatcaatagcatcaacaaagcaattgttagacgctggggttttgaaacaaaaccttcctaaattagacagggcagaatgcgtcaaaataactgcttatgaagttccgatgtcaatttttgaatacagttcagatactgatgtagatgaagtatttaggagaattaactctggtggtaggaagctctcaagacaagaattaagagccgccggctcacttgatgatttctcaacagcaaccagaaagatatctgcaagtattagaggagattcttctcactccgacatcttacctttaaataagatgaagttaattagtgtcgcaagtagagacttagggtatggcattgatgtggattctgttttttgggtatcacaaggagttctttccaaagaggaagttcgacaaagccttgatgagcaaattattgctgatatattagcatacgtcattagccacgaaaaaccgggatcaagaagtgagtatcttgacgactactttggtttacgtgacacagaagcatctataaaaagattcaatgaagttaaccttttaaccagaaagatagggatcgaaaatttaaatgataattttttaaaaataattgacacaataattgaggcatcaaaaaaatctggacttgcattgacaactatacttttcggacaagatgcacaacctaaagcacccagagtttttcaaatcgtatttcttgcactatacgaaataataataaataacaacatgcgagttaaatcaatagatgggctcatagagaaattaaaaaaacatggccctaaaatacagccacaagaaggtgggagatggggggcagaacacagaaaagatcaagtagaaagattaaaaaagttaatcataaaagaatttattcacaatgaagaaagcgatcctatagaatcacactgggaaagtaagctaaataacttacttacacaaagcaaaacagaacaagcatcttacgatttcaaacaaggattcctagaactagaatctccttacaaatttgatgtcaaatctttagaaaaaatattaaaaacttgtgctgggattgctaaccttgatatcaatgcaaaaggatatgtaatagtaggaatatctgattctgaagaaacaactaaaagaataagatcaattcatggaattgaatcatatgagcaaaatggattttatataagtggtattgatcatgaagctacaaagaccaataaaacaattgatcaatattaccaaaatatagttgaaaaaatcagacagtcacctcttgataagacattaaaagatcatatttgcagaaatataaaatgtataaattacaaagaaaagtccctcattatctttgaagtaactgctcaagaagacccttctctatataatgatgaactgtatattagagaaggtgctagtgttcggaagttagcccaaaatgagcttccgaatatatacaaaagatttgctcggcaataa

SEQ ID NO: 846 - DNA, 369 bp, Chromobacterium substugae
atggtggtgttgccggatcatttccatgcggtatgggccttgccgcagggcgacgcggattacgcgacaagaatggcgctgatcaaggcggcgttttcgcgcagtctgcccaaagtcgaacgcatccgggagagtcgagagcgcaagcgggagcgcggcatctggcagcggcggtattgggagcatcagatccgggatgaggcggatttgcaggcgcatgtggattacatccattacaacccggtcaagcatggcgatgcggagcgggtggcggattggccgtattccagcttccatcgctatgtcaggttggggtggttgcctgcggattgggcaggggaaggtgttgtggtgcagttgcaggagtag

SEQ ID NO: 847 - DNA, 447 bp, Chromobacterium substugae
atggccgccaacgagcagctgcaggacgagcaccagcgctatggccgcagcggcgaaccctatgccgtgctgctgctggacatcgaccatttcaagcgcgtcaacgatagctgcggccacgacgccggcgaccgcgtgctggcccatctcgcccaagtcatccgccaggcggcccgcgccaccgatttcgtcgcgcgctacggcggcgaggaatttctgctgctgctgccggccaccgatgccgaaggcgcggcggtgttggcggagaagatccgcgccgtggtcgagcaatcgcaagcgccggatgtcggccgcatcaccgtcagcatcggtctggcggtggccggccgtgccgatgaacagccggaagcggtggtgaagcgcgccgaccaggcgctgtaccaggccaaggccggcggccgcaaccgggtggagggtggcgcctag

SEQ ID NO: 848 - DNA, 747 bp, Chromobacterium substugae; identical to SEQ ID NO: 537

SEQ ID NO: 849 - DNA, 72 bp, Chromobacterium substugae
gtctccgtagttaaatggatataacggccccctcctaaggggcagttacaggttcgattcctgtcgggggca

SEQ ID NO: 850 - DNA, 930 bp, Chromobacterium substugae
atgcagacggtagaccgcgtcatacgcgcccgcctgcactccgacgtggtcctgatccgccaggtggcggaatacatcatctccgccggcggcaaacgcttgcgcccggcgctgaccctgctgtccggccgcgcgctgggctaccagggggaacacctgttcgagctggcggcgatgatagagttcatccacaccgccaccctgctgcacgacgacgtggtggacgaatccgacctgcgccgcggccgcaagaccgccaatgcgctgttcggcaacgccgccagcgtgctggtgggcgacttcctctatacccgcgcgttccagatgatggtcaccacccgcaacatgaccattctggaagtgatggccgaagccaccaacatcatcgccgaaggcgaggtgctgcagctgttgaacatcggcaacaccgacgtcagcgaagacgaatacctgaaggtcatccagtacaagaccgccaagctgttcgaagccgccgcccgcgtcggcgcgctgatcgccgacgccgcgccggaacaggtgcaggcgatggccgactacggcatgtacctgggcaccgccttccagatcatcgacgacgtgctggactacagcggcgacgccgaaaccataggcaagagcctgggcgacgacctggccgaaggcaaacccacgctgccgctgatctacaccatgcgccacggcagcccggaagcctcctccaccgtgcgcgcggcgctggaaaatgccagccgcgacggtttccaggatgtgctcgctgcggtacaatcctgcggcgcgctggactacgccaagaacgaagccaccaaaatggccgaaaaggccatcgccgccttgcaagccatccccgatacggaaacccgccaagctctgaccgagctggcccgcctgtcggtggaccgcagcgcctga

SEQ ID NO: 851 - DNA, 312 bp, Chromobacterium substugae
atgtatgcggtcataaaaaccggcggcaagcagtacaaggttgtcgttggtgaaaaactcaaagtagaacagatacctgcagacgtcgacagccagatcgtacttgaagaagtgctgatgattgctgacggtgaacaggttgttgtaggcgccccgatgattgccggcgccactgttaaggccaccgttgtttcccacggtcgtggcgacaagatccgcatcttcaagatgcgtcgtcgtaagcactaccagaaacaccagggtcatcgtcaaaacttcaccgaaatccgcatcgacgcgatttcgaagtaa

SEQ ID NO: 852 - DNA, 276 bp, Chromobacterium substugae
atggcacacaaaaaagcaggcggtagctcccgcaacggtcgtgactccgaagccaaacgcctgggcgttaaggtttacggcagcgaactgattccggctggttccatcatcgtgcgtcagcgcggcacccgcttccacgctggtgaaaacgttggccagggcaaggatcacaccctgttcgccaaggttgatggctacgttgaattcaccgttaagggcgcgcaacagcgcaagaccgttaacgtgattccgtacaccggtgttgacggcgaataa

SEQ ID NO: 853 - DNA, 1164 bp, Chromobacterium substugae
atgaagttcatcgatgaagcccggattgaagtgatggccggccgcggcggcaatggcgtggccagtttccgccgcgagaaatacattccgttcggcggcccggatggcggcgacggcggcaagggcggcagcgtgttcgcggtggccgacgagaacgtcaacaccctggtggagttccgcttcgtcaagaaatacctggccgagcacggcgagcgtggccgcggcgccgactgctacggcaagggcggcgacgacatcgagctgaaaatgccggtgggcacggtgattaccgaccacgacaccggcgaactggtggccgacctcacccaccacggccagcgcatcatgatcgccaagggcggcaagggcggcctcggcaacatccatttcaagtcgtcgaccaaccgttcgccgcgccaatgcacgccgggcgagcagggcgagcagcgcacgttgaagctggagctgaaggtgctggccgatgtcggcctgttgggcatgcccaacgccggcaaatccaccttcatccgctcggtttccgccgcgcgccccaaggtggccgattacccgttcaccacgctgcacccgaatctgggcgtggtgcggatggacgacagccgcagcttcgtgatcgccgacattccgggcctgatcgaaggcgcggccgaaggcgccggcctcggccaccgcttcctgaagcacctgcagcgcaccggtttgctgctgcacgtggtggacatcgccccgttcgatccggatgtcgacccggtgcgcgaggcgcgcgccatcgtcgaagagctgaagaagtacgacgaagagctgcatgagaagccgcgctggctggtgctgaacaaggtggacatgttgccgccggacgagcgcgaactgacggtgtcggccttcctcaacgcctacggctggccggcggacaagccggacgacagcgatggcttcgacatcaaggcgccgcgcgtgttctccatctccgcgctgaaccacgaaggcacccgcgagctgaccttcgccatcatggcttacctcgacgtggtgcgcgccgccgcccgcaagcaggcggagaaggagcgcgaagccgccgccgccgcgcgccagaccgtgatcgcgccggaagcgccgtcatcggcaacagaaggcgaccaagcgtaa

SEQ ID NO: 854 - DNA, 780 bp, Chromobacterium substugae
atgaagaaggcacttgctgcgctggccgtaggtttggtggccgcatcgatgggggcttacgccaaggactggaaggaagtgcgtttcggcgtggacgccagctacgcgccgttcgaatccaaggccgccaacggccagatcgtcggtttcgacatcgacctgggcaccgaaatctgtaagcgcatgaaagccaagtgcgtatgggtggagaacgacttcgacggcatgatcccggcgctgaaggccaagaagttcgacggcgtgctgtcgtcgatgtcgatgaccgaagcccggatgaaggaaatcgccttctccgccaaactgttcaacaccccgacccgcatgatcgccaagaccggcgccggcctgatgccgaccccggcatcgctgaagggcaagcgcgtgggcgtggagcagggcaccatccaggaagcctacgccaagaaacactgggcgccggccggcgtggaagtggttccctaccagaaccagaccctggtgctggccgacctgaccgcgggccgtctggacgcgtccttgcaggatgcggtgcaagccgacatgggcttcctgaaaaagcctgaaggcaagggcttcgccttcgccggcaaggatctggtcgatccgcaaaccctgggcgaaggcgccggcatcggcctgcgcaaggaagacaccgacctgaaggccgccatcgacaaggccatcgccggcatgctgaaagacggcacctacaagaagatcgagaagaaatacttctccttcgacgtatacggcaactaa

SEQ ID NO: 855 - DNA, 690 bp, Chromobacterium substugae
atgtttctggacggattcggtcccattatctggcaggggaccctggtgacgctggagctgtcggtgctgtcgctgctgctggccttcgtcatcggcctggcgggcgcaggcgcaaaattgtccagcaatcccgtactgggcgggctatccaccatctacaccactttggtgcgcggcgtgcccgacctggtgctgatgctgctgatcttctacagcctgcagatcggcatgaacaagctgaccgatgcgctgcatatcgatcaaatcgacctggacccgttcgtgtccggcattgtcacgctgggcttcatctacggcgcctatttcaccgagacgctgcgcggggccttcctgtcggtgcccaagggccagatcgaggccggcatcgcctacggcatgagccactggcaggttttcagccgcgtgcagttcccgcagatgatgcgattcgcgctgcccggcatttccaataactggcaggtgatgctgaaagccaccgcgctggtgtccatcatcggcctggccgacgtggtgaaggcgtctgtcgacgccggcaagagcacctacaaggtgttcttcttcaccctggtggccggcgccatctacctgctgttgaccacgctgtccaatttcgtgctgatgaagctggagcgccgctattcgatgggcgtgagggaggccgagctatga

SEQ ID NO: 856 - DNA, 714 bp, Chromobacterium substugae
atgatagacatcatccagcaatattggcgcgcgtttctgtggagcgacggctaccacctgtccggcctggctgttaccatgtggctgttggtgctgtcgatagccttcggcttcgtggtttcggtgccgctggcggtggcgcgggtgtccaaggtgaaatggctggcccgcagcgtgtggctgtacacctatgtgttccgcggcacgccgctttacgtgcagctgctgttcttctacagcggcatgtacagcctggacgtggtgcgcgaggtaggcttcctcaaccacttcttccgcgaaggctacaactgcaccatcctggcgtttgcgctcaatacctgcgcctacaccaccgagatcttcgccggcgcgatcaaggcgacgccctacggcgagatcgaggccgggcgcgcctacggcatgagcaccttcaccttgtaccgccgggtcatcatcccgtcggcgctgcgccgcgctttgccggcctacagcaatgaagtgatcctgatgctgcacgccaccaccgtggcctttaccgccaccgtgccggacatcctgaaggtcgcgcgcgacgccaacgccgccacctacgattccttcaacgcctttggcctggccgcgctgctgtatctgagcatcacctttatcctggtcggattgttccgcaaggcggagtcgcgctggctcgcctacctgcgtccgatcaagagctga

SEQ ID NO: 857 - DNA, 786 bp, Chromobacterium substugae
atgactggggaattcaagatggacaagctgaacatcagcaacattcacaagagctacggcgaccacgaagtactgaaaggcatctcgctgaaggccaaggccggcgacgtcatcagcatcatcggctcgtccggttccggcaagagcaccttcctgcgctgcatcaacttcctggaaaagccgaaccagggcagcatcgccctcaacggcgaggaaatccgcctggcgaaggacaagcgcggcgaattgatcccggccgaccagaagcagctgcagaccatgcgtaccaagctggcgatggtgttccagcacttcaatctgtggggccacatgacggtgctggaaaacgtcatcgaggcgccggtgcacgtgctgggcctgccgcgcgacgaggccgtcgcccgcgccaagaagtacctggaaaaagtgggcctggacgaacgcgcccaggccaagtatccggcccacctgtccggcggccagcagcagcgcgtggccatcgcccgcgcgctggcgatggagccggaagtgatgctgttcgacgagccgacctcggcgctggacccggagctggtgggcgaagtgctgaaggtgatgcaggcgctggccgaggaaggccgcaccatgatcgtggtgacgcacgagatgggcttcgcccgcaacgtgtccaaccacgtgatgttcctgcacaagggcctggtggaagaagaaggccatccggacgaagtgttcggcaataccaagagcgaacggctgaaagctttcctgtccggtagtctaaagtaa

SEQ ID NO: 858 - DNA, 240 bp, Chromobacterium substugae
atgaagattctcgcgatcgccgccatcctggcgctgggcctggccgcctgcgcgcaaaccccgtccgcgccgccgcgcgccgtcggcatggccaatccggcctcggtgttctgcgtgcagcaaggcggcacgctgctgccgcaaaaagacgccaacggcggcgaatacgcgctgtgccggctggccgatggccgcgaagtggaagaatggacgtatttccgcgaaatgcatccgcattga

SEQ ID NO: 859 - DNA, 465 bp, Chromobacterium substugae
atgaaaccctcgctccccgccctgctgccgctgttgctgctgcccttgctgtctcccgcgccggcccgcgccggcgacgccgccaccgcggtgttcgccgaactgccggcccagcccgcctaccacgccgcctggcaaaccatgctggccggcgaaaaaaaggtgccgcgctgggtcagccgcgcgcgcgccaccagttcgccctaccaggccgccagcatagacggccaaaactatctggccggcgagatgtgcaagccgcatgattgcagcgccaaccgcttctacggcgtcttccgcgccgacaagcgccaggcctgggggctgctggtgaccgtggccgacgtgccggacgcggtggagcatccggcccgccatgcccgctaccgctggttcggcaaacccggcgccaagatcaaggcctatctcaacgatcagctcaaagccgatcccaactggaaatga

SEQ ID NO: 860 - DNA, 1128 bp, Chromobacterium substugae
atgctaacccgccaccatccgctgctgtcgcccagtctgggcagccagcgcgcgctgaccagcttccacttcggccaggccggccgcggcgagaaagtgcacatccaggccagcctgcacgccgacgagctgcccggcatgctagtggcctggcacctgaagcagcggctgctgcagctggaaagcgaaggggccatcctgggcgaaatcgccgtgctgccggccgccaatccgatcggcctcaaccagaaccagcacaaccgcctgctgggccgcttcgagatgatgagcggccagaacttcaaccgccactaccacgcgatggcgcagccggtgttcgccgccgtgcgcggccagctggggccggatcccagggccaacacccgcctgatccgcgcggcgatgaaggaagaactggcgcgccagcagccgcagagcgagctgcaatcgctgcgccacgcactacatagcctggctttcgacgccgacatcatgctggacctgcattgcgacagccgcgccgagctgcacgtctacaccggcacgccgctgtgggaccagtgcgagccgctgtcgcgctatctgggcgcctgcgccagcctgctggcggaagactccggcgatcagcccttcgacgaagcctgcagccagccctggtggcagctgcgcgagctggcggtccaggcaggcatcgacgcgccgatcgagatggcttgcctggcggtgacgatagagctgcgcggcgaaaacgacgtcaaccatgaatacgccgccaaggacgccgaagccatcatccatttcctgcagcatcgcggcgcgatcgccggcgacgcgccgccgttgccgccgctgcgccacccggccacgccgctggccggctcggaagacttgctggcgccgcatgccggcgtggtggtgtaccgcgccgcgcccggcagcctgctcagccccggcgacctggtggccgacgtgatagacccgctgaacgacactgtcagccaggtctgcacccagcgcggcggcgtgctgtacgccaccagcgaccggccctatgccaccgccggcctgggcctggccagggtggccggcagcaccgcgttcaagagcggcaagctgctgaccgcctga

SEQ ID NO: 861 - DNA, 1269 bp, Chromobacterium substugae
ttggattcactgtccgatttcttccagcccggcatcgagcccggctcgttgcaggcggtatcgcggctgcagggcgcctggtcctacctgtcggtgttcgtcacgctgttccgcggcggcgacgaagaggtgctgatgcgcctcctggtgctgcgcgaactgggcggccgcgccgaggcgccgttgtggacgccgcaggaaatcgcccggcgcttctcttatcttaacgataccaaactggccaccattctggggcgtttgcgcgagggcgagttgctggtctacgacagcgacggcggcgtctaccagctgtccgagggcgcgcgcgtggcgctggcggcgctggctaccctgatcgatttttccggcgacgacgtcgagctgggctatctggctagccaggtggcggccggccaggcggtgggccaggtgtccgacgaggcgctgcggcatctgctggcgcggctgaacgagctgtacgcggaattcgaggaggcgctggagtcgcagtccgaattccgcatccgcgccgcccagcaccggctggaagcggtgtggcgctgggtggccaagtccaccgaggtggtgaaggggctgacgcaggacgacacgctgagcctgaccgtgctgaaccaggcgcaggccatcgcgctggcgcaaagccggatgctggccttggccggcaccttcgagcgccggctggcgcaactggccgcgcagcgcgtgcacctcggcaattccggcctcacctccaccgacatcgccgattggctgcgccgccagggggcggccacgctggccggcaagctggccggcgcctggtccatctgtccggagccggccttcctgtccacgccggagctggccgacgtggccgagttcgagctcttggcccgcgagcgcgccaaggccggcgcgcaggtgctgcccggcagcgaagccgcgccggtggccgacgcgccggaaatggagcggctgctggaggcagaggagatgtacgacctgctgctgcagctgggcatgagcggcgcggccgacgcccacatcagccaggcggtgctggccgacagctacaacgaaacagcgtaccgcctgtccttgctgtcgctgatcggcgacccggaaaccagcaacgatcaaagcatcgtcgccgcgctggccaagctgccgttcagcctgcagggcggcgacgcggtgatagagatggatcaccccgaggtggcgactttgtcggatgccaggctggtggcggcgcaacccaagagttga

SEQ ID NO: 862 - DNA, 759 bp, Chromobacterium substugae
atggaacacgaaatcaaaaccctcaccgcccgtttgctggcgcagcgtgtggtgccgcgagccgacgcgttggcgcgcaaggccttgctggacgacatcttccgcgccgagctggacaaaagcctggccgccgtcggcctgcgcctggtggagaacccgtacgccgagcacatcgccgcggcgctgctgccggagatgaccgagccggtgttcggctccggtgacgcctggctcaacaataatctgggcctgccgcgcgacggcgtggcgctgctggtgatcctgtgggcgctgatcatcctgcccaagcgcgagcggcagatcgcccgcgtcgaggccggcaaggagaaccagagcgacatgttcggcgcgcaaaagccgctggaaaccggcgagacggtgtccaccggcatttccgaggacgcgttgtacgccgacttcggcaaggcgctgggcggccgcacccgtttcagcgccaatctgggccggttggtcaacctgggcttcatcgtgcgccgcaaccgctggctggacgaggggccgatgctggacttgatgatcgactacgcgcagctggcgccgcgcatcatcgagggcgcgctggccgacgtgctgctgcggcgcgagggccgcgacatgttggtggataagcgagtcgacgacgaaatcgaagaagaaggcgcggacgacgacatggcgtcggccggcccgctgtttgagctgccgccggacgacgcggccgacggggaggcgcgctga

SEQ ID NO: 863 - DNA, 2811 bp, Chromobacterium substugae
atgttccagatgaaatcggtggaaatggtgcattgggacttctggcagcggctgagcgtgccgctggacgcccagattgtcaccatcatcgggcctaatggctccggcaagaccaccttgctcgacgcgatgcgcacgctgctggcgatcaaatgctccggcaagcgcgactacaagcgctatgtgcgcaacaacaaggaagccttcgcctatctgcgcggtgtggtcgacaatccgcgccgccccagcggcggcctgtatccgacgccgttcttccccatcgtgtccgagtcggtgacgctgctgtgccggatcaagaagcagggcggcgactgggtgcgccactacgcgatcctggacggcgacatcgcgctggagcacgccgagggccaggcgcaatggctgggcgtgcaggaatatcgccgccggctggaagccgccggcctgaccccggcggtggccgaggtgctggcgctggagcagggcgacaccgacaagctgaccgaatacagcccgcgccaattgctggacctggtgttccaggtgttcggcgacaaggacgtgctggacaactaccagcgcgcgcgcgacgagcagcgcgccaccgagctggagctggaggcgctgagccgccaggaagaggcgctgcaggtgcgggtggaggcgatgaagaaccgcgccaaccgctatctggaatggaagcagctgcagaccggcatcgcccggctgcgcgacgaagccttgccggtgctggcctatttggacgccaagtcatcgtttggcaagcagtggcatgactaccgcggcggctaccatgtgctgaaccaggcccgcgccgagcatgccgataccctggcgctggtggccaagctgaaggcggccgaggtcagcgccagcgaggcgcgcggcgcggcggaaacggtgcggctggcggcgcaggaagccttcatgaaggccaagggcgagcacgccggcgtggcgggccagctgaaggagcgcgaccggctgcaagcgctggccggcaaggagtacggcgccgacgccgcgcagctggccgacaagctctctgccctgcgcgccgaggcggagcaactgaaggacggcctgcgcgggctgaaaaagcagcgccaggacagttccgagcatctgcaggcgctggaggtgggccgcggccgctcgccggaggatgtgcgccagttcaaggcggcgctggacgaggccggcattgcccacgcgatgctgtccgacatcgtcgaggtgatggattccaattggcagggcgcggtggaggccttgctgcgcggctaccgccacgtggtgctgctggacaaggagtccgatcgccgcgaggcgtggaaaatcggcgaaaagctgcgctatcggcacttcgtggtgccggaacgcgccgcgccgccgcgcgccgccaagggcagcctgctggaagtggtgcgcttctctgccgacgcgccggaatggctgtaccggcagatgaacagcgtgacgcgggtggagaacgcactagaaggcgctagcgctgaaggagactggatcacccgcgacggctatttccgcgagcgtcgcggcgcgcgccacatcggcgtgccggcgcacgagtacgcgttcggcgaggcggcgcggcagtcgcggctgctggcggtgcgcgacgaattgaaagcgctgaatgtgcgcatcctgggggacgaggagcggctggtggccgccacccgcgaggcggccggcttggccgagtacctgggcggcatggacgccatccgtcaactcgacagccgcgccgacgagttttcagcgctggaatcgcgcaaggccgagctggaagccgagatcgcccgccagggcgcggcgctggccgacgccggcgcggagaaggacgccgccgaccagcgccacggcgacgcgcggctggcgcacgaccgcgtctgccagcgcgagatggaaagcctgtccaagtacaagcagaagctgcaggacgtggaacaggcgcgccgccagttgcgccggctgatcggcgagctgcgcgagtgggccgagcgcctgccggacgcggcgctggcggcggacaacgtcgccgcgctcgaaaacgagttcgacaccgccgccgacgctcgccatcagctgagctatctggaagagcgcttgcagaacggcgactgggagcaggacgaagcggtgctgatgctgaaggacaagctggtggacgacctgacccagctcgaccgcgagcgccagcgccgccagggcgaggtggatcgttcgcgcgagctgaccgaggaggcgcgcgccgcctatatgggcaagctgcgcgccaccgtgcgcgcttacggccagaacgtgaagcggctgggcgagctggccggcatccaggtggaagtggagctgccgcagctgtccaacgacgacgcggtgctggcgcaggccgggctggtgttgaagttcaacttcgaccagaagggcatgatgggcatgaacgacggcgaggcgtcgggcggccagcaggtgatgaagtcgctgatcctgttgatcggcctgatgatggacgagtccaatccgtccggcttcgtcttcatcgacgagccgttcgcccacctcgacatcttcaacatcgaccgcgtggccggcttcctcaaggcgacggaagcgcagtacctgatcaccacgccgaatacccacaacatcaatatcttcgcgccgtcggagctgaccctggccacccgcaagaagcggcccggcgaaacctgggcgccgccgattctgcagacgcggcgccgggtggatggcggcgagcaggcgtaa

SEQ ID NO: 864 - DNA, 1254 bp, Chromobacterium substugae
atgtcacgttcagaagcgcaaagctggtcgctggacatcgcgctggcccaaggcggtttcgacgccctgcacccggaaggcaagaacaccctgctgcagctgggccacgacccggcggatttcgacgcggtgttcgcgcaggtgaaaagcggcgcgatgctgcccaaggcctgggcggaagtggccgcccgcgccgaacggcgcgccgcccactacgagcgcgacggctaccgccgcaccgccgccgacctctatctgcgcgccgcggtgatgtggggccgcgcccagtactcgatcttcgatgccgccgatccgcgcaagcttgccttgcgcgcgcgctgcaatcattgcgtggagcgcatcggcgagctgcgcgggggccgagtgcggcgggtggaaattccattcgagggcggcgtcatccacgccttgctgcacctgcccgacggcgaagtccgccaggcggcggcggtgatcctcggccccggcatggacatgatcaaggaagactatctgtacgccgccgagcgctattacacctcgcgcggcatggtggcgctgtcgatagaaggccccggccagggcgaaagccgcgccggcggcctgaccgtcaccctggataactatgagcgggcgctggaagcctacgccggctacctggctggcctgcccgaagtggacgccggccgcatcggcatgttcggcatcagcatgagcggctattggggactgcgcgcggccgccggccgcacccggctggccgcgctggccgcctacgagccggtgtgcggcgacttcctcaccatcttcgaacgcgcccaacccagcttcaagaaaaactacatgtatatgagcggctatcaggaggaagcccgcttcgaccgcgacctgcgcgatcaaatgccgctgggcgcgctggcggccgacatccgcatcccggtgctgctcggcatcggcgaattcgacgagctgacgccgctggaacaggcactggcctgctaccagcgcatccgcgcgcccaaggagatgcgcgtctacgaaaacgaattccacccgctgggcggcgtggcggccgaagtcttccgctacggcgcggaatggctggagcgggcgttgaacggcgacccggcgctgcgcgaagccggccgcgacattcgccactatctgcgccgcgacggccatatcggcgacggcagcgccgcgccggactggtggcaaggcgccgacccgacccgcctgagcggaaacggctga

SEQ ID NO: 865 - DNA, 483 bp, Chromobacterium substugae
atgtcaaccaagccccaaggggacgctgcgtccagcgcggccgaagacgcccgccgccaggcgctggcgcgtctcagccgcgccgcctacagcctgagcgccgccgacgcgcggctgcgcggccgcgccacgcgccaggccggcgcgttgtcgctgtcgcatgccagagtgctgcggatattggccgaggagggggcgctgccggtggcgcggctggccgaactgaccgagaccaccggcgccggggtcacccagttggtgaacggcctgagcgagcagggctatgtggagaaggcgaagtccttgctggacaagcgttcggtgctggtgcaactgaccgaactgggcctggcgcgccatcgcgagcgcgagcgtttgctggccgaggtgctggagcgcgcgctgcgcgatatggacgagcggtcgctggacgccgccgccgcggtgctgcgcgcgctgggcggcgtctacgaccagttgtga

SEQ ID NO: 866 - DNA, 720 bp, Chromobacterium substugae
atgcaagactcgcccatcgtccgcgcgcagccggaactggatcgccgcggctttctgctggccgcggccggcagcctggccgccatcgcgctgcccgcgtggtcgccgcgcgcccgcgcctcctccgcgcacgcgctgccgccgctgccctacgccgacaacgcgctggagccggtgatctcggcgcgcaccataggcttccactacggcaagcatcacaaggcctatctcgacaacctggccaaactgacagccggccgcgactacgccgatctgtcgctggaagacatcatcgcccgctcggccaagcaagccggcgacgccgccatcttcaacaatgcctcccagctatggaaccacactttctactggaacagcatgcggcccaaggccggtggagcgccgccgcaggcgctgcgcgagcggatcgaggcgtcgttcggcagcgtggatgcctgtaaacaacagctggccggcgccgccatctcgcagttcggcagcggctgggcctggctggttcaggacggcgacaagctgcgcgtggtgaagaccgccaacgccgacaccccggccaccgccggcctgacgccgctgctgaacgtcgacgtctgggaacacgcctactacctggactaccagaaccgccgcgccgattacgtcaacgcggtgctggacaagctggtcaactgggaattcgcgcaacagaacctgaaagcctga

SEQ ID NO: 867 - DNA, 471 bp, Chromobacterium substugae
atggctaaccaactggatcgcgatcaaaaggccggcttgttcatcgtcagctacaacgttttcaaaccgggcgtagacggcggctacaagctgcagttgaagctgtcggtttatccgccgtctcgccgcgtcagcggcgaggccgtcatcacccacgccaccgcccaaccgctggtattcaagagcccggtgcaaggccattacgaggaaaacggcagcaatatcgagctgttcctcttcggccaccagctgccgcaggcccaaggccagcatccgcagcagcaagcgcacgcgccgctgggcgaagacttccacttcgacggccagctgaagggcggctggcaggccgacgccggctccaaggcccgctacgccttcctgcaaaacggccactggaccgaagtgagcggccaggacatccatttgtccgatgagctgcgccacgccgcgaagtcgctgaacctgcgctaa

SEQ ID NO: 868 - DNA, 498 bp, Chromobacterium substugae
atggcaactgttaccctgcgcggcaatccggtggaagtggcgggcgcgctgccggccaaaggcgccgcggcgccggcgctgcaactgaccggcggcgacctggcggaagtgacgctggatacctacgccggcaagcgcaagatcctcaacatcttcccgagcgtggatacccccacctgcgcgatgtcggtgcgcaagttcaacgagaaggccgccggcctggccgacgccgtggtgctgtgcatctcggccgacctgccgttcgcgcaaaaacgcttctgcggcgccgaaggcatcgagggcgtggtgaacctgtccaccttccgcaatccggccttcgccgaagcctacggcgtcaagctggcctccggcccgctggccggcctgaccgcgcgcgcggtggtggtgctggatgccgacaacaaggtgctgcatagccagctggtgggcgagatcgccgacgagccggactacgccgccgcgttggccgcgctgtaa

SEQ ID NO: 869 - DNA, 1635 bp, Chromobacterium substugae
ttgcaacaacaacactcccgccacatcggcccggttgcgctgatgctgaccggcctgggttccatcatcggttccggctggctgttcggcgccgcccacgccgcgcagatcgccggcccggccgccatcgtcgcctggatcgtcggcatggtgatcattctttcgatcgcgctgagctacgccgaactgggcgccatgttccccgaatccggcggcatggtgcgctacgcccgctactcgcatggctcgctgctgggcttcatcgccgcctgggccaactggatcgccatcgtgtcggtgattccgatcgaagccgaagcctcggtgcagtacatgagcacctggccctacgaatgggcgcacaacctgtaccgcaacggcgagctgagcaccatcggcctgtccttcgccgcggtgctggtgatcgcctacttcctgctcaactactggggcgtcaagctgttcgccaaggccaacagcgccatcaccatcttcaaggtgatcgtgccggcggtgacggtgggcgcgctggtttacagcggcttccactcggaaaacctgaacaacccggcgctcggcggcttcgcgccgttcggctgggccagcgtgatgaccgcggtggccaccagcggcatcgtgttcagcttcaacggcttccagagcccgatcaacctggccggcgaagcccgcaatccgggcaagagcgtgcccttcggcgtggtcggctccatccttctggccgcggtgatctacgtcgcgctgcaagtggccttcctcggcgcgctgtcgccggcggaactggttcacggctggaagggcctggacttcagctcgccgttcgcccagctggcgatggcgctgggcctgaactggctgatgatgaccctgtatttcgacgccttcgtcagccccagcggcaccggcgccacctatatggcgtccacctcgcggatgatctacggcatgcagcgcaacggcaccatgccggccatcttcggccgcatccacccgctgtaccgcatcccgcgtccggcgatgtggttcaacctggcggtgtccttcgtattcctgttcttcttccgcggctggggcacgctggcggcggtgatctcggtggcgaccgtgatctcctacctgaccggcccgatcagcgccgccgcgctgcgccgctgcgcgccggacctaccgcgcccgctgcgcctggccggcctgaacatcgtcgcgccgttcgccttcgtctgcgcctcgctggtgctgtactgggcgcgctggccgctgaccggccagatcctgttcctgatcgtggccgcgctgccggtctacatctggtaccaggccaaggccggctggccggaattctcccgcgagctgaagggcgcgatgtggatggtgctctacctgccgacgatggcgctgctgtcctggatcggcagcaccgacttcggcggcctcggcatcctgccgtacggcgtggacatggctgtggtggccgccgcttcgctgggcttctacttctggggcgtcaacagcggctggtacacccgctaccttcgcgacgagcacgatcccaagctggtggaggcgatgcaggcggaaaaccagccgtccggcaagcccgccgtccagcgcggctga

SEQ ID NO: 870 - DNA, 312 bp, Chromobacterium substugae
gtgttgttgttgcaagggcgaatctcctgtcatttgaacgatgacgggcaacgactctgccggggcggcgcgcacgcgccagacgtgtccggaggaggttgcccacatagccgggtgggcccggtcttatgtaaatcgcgcctgcctgctgggcaggcggaccgcgtcggcggaagcgccgcagcggcctggggggtccgaaacggccggcagcggccgacgacggaaatcatgatgttgcccccgactgcgggcgtttctctgaattttgtccgacatatcgacccgaattttcgggtgcgcggattgtaa

SEQ ID NO: 871 - DNA, 1641 bp, Chromobacterium substugae
atgtctctgatcaaacgcttgtggctgaccatcgcctttaccctcgccagcttggcgctggtgatatcggtcaccgggcagcagctatatgctttcacccgccatgtcgacaactacaaccgcctgcagcaactggccagcgatttgcagcagctcaaggccatcgcgctgtcgttcgcgcgcgccgatcccctgctgccggaaaccggtttgcgcttgcaggcggcgcagcggcaagtcgctgatttgcaacgggatatccagtccaacttgccggcggccgacggccaggccttaggcgcggcgttgcgcggccactggcaggcttacgtccgcaacctggccagcgccatccatatcgccgaaaccgcgccgcaggacgcgctgtcgataccggagcaggcatatcagcaggacctggcgccgctggcggcgcagatcgacagccaggtggccaggcgcgacggcgagctgcggcgcgagaaagccgagctggcggccgcgctatcttggctcgcgccgctgatcctgggaccgctggccttggccagcgcgctggtggtgctgatccagctgacgctggcgcgccggctcaagcgccatctgggcgcgatggccagggccgccgacgcgctgagcgagggcaatctgggcgtgcggctgccggatagcggcggcgacgagctggcccatgccgctgcgcgcatcaaccgtttcctggaccgactggccgggctgctggacgaggtgcggcggcatgccggcgacaatctgcgcgacagccagcgcctgcagctgctgacgcggcagagcgccgacgccagccggcagcagacgcagaaaagccggctgagcaacgaggcggcgggcgagatcgccggccacgccgaaagggtggcgcagcatgtcgaagcggcgcaggacagttcgcgcagcgccgcggcggtcaccggcggcgcgcgcgagctgggcggacgcaatgtcgccaccatgcagcgcttggccgaacgcatcgataccgccacccgcgagatgcgcgagctggggcgggcggtgggcgccatcggccagatcagcgcgctgatccgcgaggtggccgaccagaccaatctcttggcgctgaacgcggcgatagaagcggcgcgggccggcgaggccggccgcggcttcgcggtggtggcggacgaggtgcgcaagctgtcggagcggacggcggcggccaccagcggcattttcgacagcctgcggcagatggagcgcgcgcagggcgcgctgggcgaggcgatcgccgccgccggcagcgccagccgcgacagccaggatgcgcagctggccttggagcaggcgctggatacggtggacggcgcgctgtccggcctggccggcttgatggaggacattagcgacgcgcgcgagcggcaaagccgcgccggcggcagcatccgccagcatggccacgagcttgccagcctggcgcacgacatcgaaagccagatggggcaggcggagccgctgatgctgcagctggcggcgtcggccagcgggctcaaccaggctttggcctggttccgcctgccggcggcggcgcgcggcgcggatacgcaggttcgcttcgctgcgcccgccccggcgccgcgctga

SEQ ID NO: 872 - DNA, 513 bp, Chromobacterium substugae
atgcatccgacaccccaggcgcatgacgccgaagagctggaatacgtgggtttctggctgcgcgcgctggcgtcgctggtcgacaccgcgctgctcttgatcgcctcgctgccgctatggtggctgctggagccgaaggcagcgccggaaccggccgccgggacgctggatttctccacgctgctcggcatcggcggcctgggcgacatcctgaccaactacctgctgccggcgctggcggtgatcctgttctggctctacaaaagcgccacgccgggcaagatgatgctgggcgcgcgggtggtggacgccgacagcggccaggcgctgaagcccggccaggcggtgctgcgctacctcggctatttcgccgccgccattccgttctgcgtcgggctgatctgggtggggctggacccgcgcaagcaaggctggcacgacaagctggcgcgcacggtggtggtgcggcccaagcgccgggtggaagccgtctccttccagccgccgcgctga

SEQ ID NO: 873 - DNA, 546 bp, Chromobacterium substugae
atgaaaagcaatatccgcccgtacgacggccaccatcccgacatcgccgccggctgttacatcgaccctgccgcggtggtcatcggcgaagtggcgctggagaagggtgcctccgtctggccgtgcgcggtgctgcgcggcgacgtcaaccatatccgcgtcggcgaaaacagcaatgtgcaggaccacgccatgctgcatgtcagccacaagacggcgtccgacccggccggcgcgccgctgatcatcggcaagcatgtcaccatcggccaccatgtgacgctgcacggctgcaccataggcgacgaagtgctgatcggcatcggcagcatcgtgctggaccgcgcggtgatcgaggaccgggtgctgatcggcgccggcagcctggtgccgccgggcaagcggctggcgtccggctacctgtacctgggcaatccggtgaagcaggcgcggccgcttaccgacaaggaactggcctacttcaagtactccgccgagcactatctgcgcgtggccgacaagcacaaagccaatctggaggactga

SEQ ID NO: 874 - DNA, 2118 bp, Chromobacterium substugae
atgaccgaattgtgccggcgccgcccggcggcgcgcaaattcccctatcatatcagcctcaccaaacaggacgttgaagccatgagccagaaccccctactcgatttttccggtctgccgcgttttgccgaaatccgccccgagcacatcggaccggcgatcgagacgctgcttgaggaagcgcgcgccgcggtggccaggctgacggcggagccgggcgagccgggctgggacagcttcgtgtcgccgctgaccgacgccaccgagcgcctgtcgcgcgcctggggcgtggtggggcacctgaacgcggtggtgaatacgccggagctgcgcgaggcctacaacgccaacatcccgcgcatttccgaattctggaccgagatggggcagaacctggacctgttcgcccgcttcaaggcgctggccggcggcggcgagtacgcgtcgtacggcgcggcgcgcaagaagatagtggaaaacgatctgcgcgacttccgcctgtccggcgcagaactggacgacgcggccaaagagcgcttcgccgcgatccagacccgcctggccgagctgtccgccaaattcgagcagaacgtgctggacgccaccgacgccttcaccctttatctcgacgacaaggccgagctggccggcgtgccggaagacgcgctggagctgttcgccgccgcggccgagggcgacggcaagccgggctacaagatcacgctgcagttcccgttctacttcccggtgctgcagtacgccgacaaccgcgcgctgcgcgagaagctgtaccaggcctacgtgcagcgcgcgtccgaattcggccccgccgagcgcgacaacggccccatcatccgcgaaaagctgcagctggcgcgcgaagaggcgcagctgctgggcttcgccaatttcgccgagctgtcgctgttcaccaagatggcggaaagcccggaacaggtgatcgccttcctgcgcgacctggccgccaaggccaagccgttcgcggtgaaggatcgccaggagctggaagccttcgccaagtccgaactgggcctggacacgctgcaggcctgggacctggcctacgcggcggaaaagctgcgcgtggcgcgctacgccttctccgagcaggaagtgaagcagtacttccccgaggccaaggtggtgcagggcctgttcggcgtggtgaacaagctgttcggcgtggaagtgcgcgacagcggcgcgccggtctggcacccggacgtgcgcttctacgacatcctgaaggacggcgagctgctgggcagcttctatttcgacctctacgcccgcgacggcaagcgttccggcgcctggatggacgacgcccgcggccgccgcctgaagggcgacgcgctgcagacgccggtagcctacctgacctgcaacttcacccgcccggtcggcgacaagccggcgctgttcacccacgacgaagtcatcacgctgttccatgagttcggccacggcctgcaccacatgctgacccgcgtcgacgagctgggcgtgtccggcatcaacggcgtggaatgggacgcggtggagctgcccagccagttcctggaaaacttcgcctgggaatgggacgtgctgcagggcatgaccgcgcatgccgaaaccggcgcgacgctgccgcgcgcgctgttcgacaagatgctggcagccaagaacttccagagcggcatggccaccgtgcgccagctggaattcgcgctgttcgacctgacgctgtacagcaacttcgacgccgagcgcggcgactggctgcagctgctggccgaagtgcgcgccgaggtggcggtgaacatcccgccggcctacaaccgcttccccaacagcttcagccacatcttcgccggcggctacgcggcgggctattacagctataagtgggccgaggtgctgtcggccgacgcctacgccgcgttcgaggaagtgggcggcgccgacgccgagaccggcaagcgcttctggaacgagattctggcggtcggcggcagccgtccggcgctggagtcgttccgcgccttccgcggccgcgaccccgaaatcgacgcgctgctgcgccattccggcatggtggcggacgccgcgtaa

SEQ ID NO: 875 - DNA, 774 bp, Chromobacterium substugae
atgcgctttgccacctggaacgtcaattccctgaaagtccgcctgccgcaggtgatccaatggctggccgataccggcgtggaagtgctgtgcctgcaggagctgaagatggaccaggacgtcttcccgctggccgagatcgaagccgctggctaccgcgcggtctggttcggccagaaaacctacaacggcgtggccatcctggccaaggcgccgctggagatcgaggacgtggtgtccggcattcccggctacggcgacgagcagcgccgcgtcatcaccgccaccatcgccggcgtgcgcacgatctgcgcctatttcgtcaacggcgaggcggtggactcgcccaagtacccgtacaagctggaatggctgtccaagctggaaggccatgtcgccgccgagctggccgcgcatccgcagctgctcttgctgggcgattacaatatcgcgccggaagaccgcgacgtctacgaccccgaaggctggcacgagcaggtgctgtgcagcacgccggaacgcgaggccttccgccgcctgatcggtctgggcctgtccgacagcttccgcctgttcaaccaggaggagaagcagtacagctggtgggactaccgccagatgatgttccgtcgcaacaagggcgtgcgcatcgaccacatcctggtcagcgacgcgctcaagccgcgcgcagcgtcctgcgagatagacaaggcgccgcgcaagtgggagcgcccgtccgaccacaccccggtggtgctgacgctggccgactga

SEQ ID NO: 876 - DNA, 708 bp, Chromobacterium substugae
atgaccacattgcatacccgcgccagcgcgggcgacccctactatcaggacgtgcccgcctacatgaccgaggtctacgactgggcctacgtcaatccgcgcaaggccaggctgctggaccataagctggtggtgcgcacgctgctgttcggcaacgatcagcggctgatgcgcgcctatctcgatgaaatccggcccggggagcgggtgtggcaggtggcgcacgtctacggcgacctggtgcagcgcgccgccgcgcgcgtcggcgaggccggccgcttcacgctgaccgacgtcacgcccatccaggtggaactggccgcgggcaagctggccggcctgccgcaggccgaagtggtgcgcgccgacgcggcccgctatcacaccgacggcaagcaggacctagtgtgcagcttcttcctgctgcacgaggtgccggaggagatgaaggccgccatcgtcgacaatatgctggcccaggtggcgcctggcggccgcgcgctgttcgtcgattaccaccggcctcagccgtggcagccgataggctggctgctcaaatgggtgaaccgcgcgctggagccgttcgccgaggcgctgtggaaccaggagatccgcgcctacgcgcgcgaggcggagcgtttcgactggagcaagcgcacggtgttcggtggcgtgtaccagatcgcgctggcgcggcgcaaagactga

SEQ ID NO: 877 - DNA, 927 bp, Chromobacterium substugae
atgaaaaagctgacccttcttgccttgtccgccgtatttggcctgagttccgccgctggtttcgccgctcaagccgttccggcctccgccccggccgccaaggtagccccggccgccaagaaagttgaaaagaaaaccccggccaagatccaccacgccaagaaggccgagaaagtcaccgcttccgcccagaaggcccaggcagccaaggctgacgcctccgttccggccaagaaggtcgtgaagaagaaagtcggcgtgaagaagcacgcttccgctccggccgcgcaaaaagcccaagccgccaaggccgacgcttccgctccgaaagccaagaaggctcacaagcacgccgccaaaaagcatgccgccaagaaagaagcttccgccgcgcaaaaagcccaagccgccaaggccgacgcttccgccccggtagccaagaaggcgcacaagcatcacgctaaaaagcacgccgccaagaaagaagcttccgccgcgcaaaaagcccaagccgccaaggccgacgcttccgccccggtagccaagaaggcgcacaagcacgccgctaaaaagcacgctgtgaagaaagaagcttccgctcagaaagcccaagccgccaaggccgacgcttccgctccggtagccaagaaggcgcacaagcatcacgctaaaaagcacgccgccaagaaagaagcttccgccgcgcaaaaagcccaagccgccaaggccgacgcttccgctccggtagccaagaaggcgcacaagcaccacgctaagaagcacgccgccaagaaagaagcttccgccgcgcaaaaagcccaagccgccaaggccgacgcttccgccccggtagccaagaaggctcacaagcaccacgccaagaagcatcacgtggccaagaaggctgccgcttcggccgccaagtaa

SEQ ID NO: 878 - DNA, 783 bp, Chromobacterium substugae
atgtcctctcccaatttgtccgctgaaaaagtcctgtcggtccatcactggaacgacaccctgttcagcttcacctgcacccgcgacgccggcctgcgcttcatcaacggccagttcgtgatgataggcctggaagtcaacggcaagccgctgatgcgcgcctactccatcgtcagctccaactacgaagagcacatggagttctacagcatcaaggtgcaagatggtccgctgacctcccgcctgcagcacctgaaggtgggcgacaccgtgatgatcagcaagaagcccaccggcaccctggtgcaggacaacctgctgccgggcaaaaacctgtacctgctgtccaccggcaccggcctcgcgccgttcatgtccatcatcaaggatccggaagtctacgaacgctacgacaaggtgatcctcacccacggcgtgcgttgggtcagcgagctgggctaccacgactacatcacccaggagttgccggaaaacgaattcttcggcgacatggtgaaggaaaagctgatctactacccgacggtcacccgcgagccgttccgcaatgaaggccgcctgaccgacctgatcaccagcggcaagctgtgcgccgacatcggcctgccgcaattgaatccggaacacgaccgcgtgctgatctgcggcagcccgagcatgctgcacgacctgtgcgaaatcctgaacggcatgggcttcaaggaatcgccgcgcatgggcgagccggccgactacgcgatcgaacgcgccttcgtcgagaaataa

SEQ ID NO: 879 - DNA, 1038 bp, Chromobacterium substugae
atgcgcatcatgatcgtcaccgacgcctggaagccccaggtcaacggcgtggtccgctcgctgaccgaaaccgtgcgcgagctggacggcttcggccaccaggtcaacatgatcacgccgctggaattccgcaccgtgccctgccccacctatccggacatccggctgtcgctgctgccttaccgccaggtggcgcagcgcctggccggcttcgcgccggacgccgtccacatcgccaccgaggggccgctgggcctggccgcccgccgctactgcctacgccatggcctggccttcaccaccgcctaccacacccgcttcccggaatacatccaggcgcgctgccggctgccgctcgccatcagctatgcctggatgcgccgcttccacaacgcctcgcaggcggtgatggtgcccacccgctccatcgccgacgacctggagcagcgcggcttccgcaatgtcaggctgtggagccgcggcgtcgacaccgcgctgttcacccccggcgagcgccagcggctggacgacaccgaaccgccgcgcttcgtctacatcggccgggtggcggtggagaaaaacatcgaggccttcctcaagctggacctgcccggttgcaaatgggtggtcggcgacggcccgctcttgccgcggctgaaacagcaatacccggaagtgcatttcgccggcgtgtttccgcaacacgagctggcgcgcttctaccgcgccgccgacgtgttcgtgttccccagcctcaccgacaccttcggcctggtgctgctggaggcgatggcctgcggcacaccggtggcggcgtttccggtggccggcccgctggacgtggtgggcgactccggcgccggcgcgctggattgggacctgcgcgccgcctgcctgcaagcgctggaaatcgaccgcggccatgtgcgccaggtggcggagcgctattcttggcaagccgccagccggcaattcgaatcccatctcaagcccaacccgccggaagcggcgcccgcgccgcaggccgcggcggattaa

SEQ ID NO: 880 - DNA, 828 bp, Chromobacterium substugae
atgcagccagactccgcctccgccgtttcgcgccgcctgcgcagcatctggatttccgacgtgcacctcggcaccgccggctgccgcgccgaccatctgctcgacttcctgcgcgaacatgaatccgactacctgtacctggtcggcgacatcgtcgacggctggcagctgaggaaatcctggtactggaagcagagccacaacgacgtggtgcagaaattgctgcgcaaggcgcgcaagggctgccaggtgatctacatccccggcaaccacgacgaggcggcgcgccagtactgcgggctggatttcggcggcatctccatccgccacgaggccgagcacctcaccgccgacggcaagcgcctgctggtgctgcacggcgacgaattcgacggcgtgatccagtacgccaagtggctggcctatgtcggcgacaatctgtacacgctgatcctgcagctgaaccgcggcttcaactgggtgcgcacccacctgggcctaccctactggtctttgtcgcaatacctgaaacacaaagtgaaaaacgcggtcaacttcatcagccagttcgaagccatcctggccggcgaggcgcggcggcgcggctttgacggcgtggtgtgcggccacatccacaagccggaagtgcggatgatagacggcattctctacggcaacagcggcgactgggtggaaagcctgtcggcgctggtcgagcatctcgacggccggctggaagtgctgcactggacggcgctgaccataggctcgtccatcgaggaatcgccagagcccatcccttcggaggaatccacatgcgcatcatga

SEQ ID NO: 881 - DNA, 342 bp, Chromobacterium substugae
gtgatcgaatgcccggccgaactggcgcaggcgccgcagataatgccgctgatgcaagccgtgcatcaggccgccgtcgccagcggcctgttcgaaacgcccgacatcaaggtgcgggtgctgccctcggcgcactacctggtgggcggccagcccgacgcctttgtgcacgtgaccacccacatcctggccggccgcagcgagcagcagaaaaaacagctggccgacgccgtcgcccgcgcggcctgcgcccaattgccgcaagtggcgatgatcaccagcgaagtgcgcgacatccagcgcgaagcctacagcaaccgccgccaggcgatggcgggctga

SEQ ID NO: 882 - DNA, 414 bp, Chromobacterium substugae
atgaagactccctacctgaaaatcctggcctgcggcctgaccctgttcatcctgctgggcccgctggtggcgctcttggccagcggcgtggtgccgatgatggcctacctgatgggcgcggtgccggccttgatcttcggcctgatgctgtgcctgctgcgcatcatcctggccgcccccatcgcccgctggcaaagcctgtggccggcctggctgctggcgctggcggccttcgcgcccggcgccttcagcggcagcctgatcacgctgctgtacgcccgcgtggccgaaccgctgctgtacaacgactggatgacgatgtacctgggagcgatggccggcggcgtctgcaacgcgctgttctggcgcatgcgcttcggggccggcaagccgctacccccccacgagaactag

SEQ ID NO: 883 - DNA, 1128 bp, Chromobacterium substugae
atgagaccgttcgccgcgctgctcctggccgcgctgctggcggcctgcggccgcgaagcgccgccgccggccccggtcggggactggcattggcggctgccgcccagcgtgtctccgcccccggtgccggccgacaacccgatgagccaggctaagttcgagctgggccgccgcctgttctacgacaagcggctgtccggcaacggcagcatcagctgcgccagctgccatccgcaggccaaggccttcagcgacggcgtcgcgctgtcgctgggtgccaccggcgagcgcaccctgcgcaacgcccagccgctggccaacgccgcctggcgcaaaagctacacctgggccaactattcgctgaccacgctggagcggcagatggacggcccgctgttccgcaccgagccggttgagatgggcatcaacgacggcaacctgccaacggtgctggcccggctgggctcggacccgcgatatgcgagcgaattcgcccgtgtgtttcccggtgaggaaaaacccctgagcctggccaatatcgtcaaggccatcgccacgttcgagcgcggcatcgtatctttcgactcgcgctacgaccgctaccaggccggcaaggccgaactgtccgccgccgagctgcgcgggctgaacctgttccgcgccgacaagagccagtgcctgcgctgccacggcagtccggacttcgacgaccagatggccggccatggcgacggcctgcccttccacaacatcggcctctacaacgccgacggcaaaggtagctacccgtttcccaaccgcggcgcgctggagttgagcggcaagccggccgacatgggccgcttccgcagccccagcctgcgcaacgtcgcgctcaccgcgccctatatgcacgacggcagcgtggcgacgctggaggacgcggtgcgcatccacgccgacggcggccgcgacaacggcaagctgggcgacggccgccgcaatccgtggaaagacccggccatcggccgcattaggctgacgcccgccgagcaggccgacatcgtcgccttcctgaaaacgctgagcgacgaaaccctgacccgggatccgcggctgtccgacccgttcgccgccgcgcggcgatga

SEQ ID NO: 884 - DNA, 1074 bp, Chromobacterium substugae
atggggcatccgccctacggcttgcataacaataaatggagaaccgtgatgaacaagcgctggatcctcgtgcccgggctgtgcctgggcctgtccgcctgcctgggcggcggcgtcagcagcagcgacagcccgccccagaaccagaatcagaccccgccccccggctacggcggcggcaacaccaccgtccgcttcgcgctgaaatccggcagccagccggtgagctgcaacagccagcttagcggcatgggcgtcggccaggccaacgccacgctggccgagggcatggtctacgtccacgacgtggccctggtcaacagccgcggccaggaagtgccgctgcagctggaccagggcaataaatggcagtatctgaacctggccctgctggacttcgccggcggcagctgcaaggacccggcgcgcgacgacggcgacacgccggtgggcaagccgctgccgggcagcaacagcgaggtgacgggcagcgtgccggccgatacctacaccggcctcagcttcaaggtgggcgtgccgatctccgccaagaacgccaagggcgaggaggtggcgctgaaccaccagccggcgcacagcccgccgcacccgatcctcggcgtgtactggctgatgtgggaatggcagtccggccaccgcttcatgcgcatcgacctggccccgagcggcggcgtcaagcgcgccgacggctccagcgccgaccgctgggccttccaccttggctccaccgactgccaggccgacagcgccatcgtcggcggctaccgctgcggcaaacccaaccgcttcaaggtgaggttcgaccgcttcgatccgcaagccgaccgcgtggtgctggacgtgcaatcgctgttcgccggcaacgacatcagccgcgacgacagcgccgacttcggctgcaaatccaacgccaccgacgccgaatgccagcccatcttcgatcgcctgggcctgcggctgaacgaaagccgacccggcgccggcgacggcggccagccgctgggcgacggccgcaacccgcgcgtgttccgcctggaaaaggccgcctcatga

SEQ ID NO: 885 - DNA, 2064 bp, Chromobacterium substugae
atgccgccactttaccaccaagccccggcggagccgctgcgacaatatgccgcattcctggccaggatggtttgcactagcatcgccgcgaacttaaaacaaattcacactttcccgatgacgctgaaaacctccctgctgcccttgccgctggcgctggcggtatgccatgcctttgccgccgacctgcccaccttccaaggcgaccgcatcgtcgtcaccgccgtccagaccgaccagccgctgcgggtggagaccgatccgcgcgcgccccgtcagccggtgccggccggcgacggcgccgacctgctgaaaaccattcccggcttcgacgtggtgcgcaagggcggcagctccggcgatccgctgctgcgcggcctgggcggctcgcgcctcaacatcctggccaacggcggcttcgtctacggcggctgcccgggccggatggacccgcccaccgcctacctgtttcccgacgcctacgacaagctggtggtgatcaaggggccgcagtcggtcaaatacggcggcgcgctgatcagcggcgcggtcagcttcgaacgcaagaccaagccgttcgacgagccgggcctgcgcttcggcggcagcctgctcgccggcagcgccggccgccaggacgcctacgccgacctgaccgcgggcggcaagctcggctatctgcggctgatcgactcgcacaaccaggccggcgactaccgcgacggcgacggccggaaagtgcattcggcctaccgccgcgacagccagagcgtgatcgccggcttcacgccgacgcgcgacaccacgctggaaatctccggcgacttcagcaacggccgcgccgcctacgccgaccgcatgatggacggcagccaattcgaccgccgcgcctggggcttcaaggccgagcagcgcaatctggcgccgtggctggatgcggtgcggctgaccgccaaccgcagctacgccgaccacgtgatggacaactacacgctgcggccgctggccgccggcaagccgccgcgcgccagcaacccggaccgcaagaccgacgccgccaagctggaggccgacctggcgttcgccggcatcgagctgaccgccggcgtggactggcagaacgaccgccacaccagccgcgtgggcgggctcgactacgccagtctgccgcgcgtgccggatcaacacattgaacgcgccggtttctacctggaaggcgacacccccctgggcggcggcaagctggtggccggctggcgccacgaccgcgcgcgcgcctactacgacgccgccgccggccgcggcgagcaactgcaggattaccggctgttcagcggcttcgcccgctacgaataccgactgggcagctggacgccctacgccggcgtcggcgtcgccgagcgcgcgccggactactgggagcgcagctatgtcgccgccagccggccggtgctgcagccggagcgcaatacccagctcgacatcggcgcgctgtacaagagcgaacgaatccagggctcgctttccggctacctgagccgcatcgacgacttcctgctggtcgacgacagcgccgcccagaccacccgcaacatccaggcctaccgctacggcgtcgaggccgacgcgtcctggcaattcgcgccgcaatggcaactgtccggcagcgccgcttacagctggggcgccaacaccaccgatggcaaaccgctggcgcagacgccgcccctgagcgccagcgtcagcctggcctgggacaaccagacctgggccgccgccgccgtctggcgcgtggccgccgggcaagaccgctacgccatcggccagggcaatatcgccagccaagacatcggcccgacgccgggcttcgccacgctgtcgctgaacggcggctggcgcgtcaataaggcgctgaagctcaccgccggtgtcgacaacctgttcaaccgcgcctacgccgagcacatcagcagcggcggcgccgacgtggccggctatgcccgcaccacccgcgtcaacgaaccgggccgcacgctgtggctgaagctgcaggcgcactggtaa

SEQ ID NO: 886 - DNA, 1257 bp, Chromobacterium substugae
atgatgcggaatccgatattcaggccgggacaggccgacgacgccgggcaggccggtttgcgcgtgcgccggctgcgctggctgatgctgctgctgggcttggcggtgctggccggctgcgcgctgcagcaggtggagctgccctggctgctggcgggccaggcgctggccacgctggccgcggtcaacctgctgctgccgcggctgccggcctgggggctggcggccgagcacgcgctgcggctggggctgctggccgacgtgctggtgctgaccgagctgctggccttcagcggcggcgccgccaacccgctggcctcgctctacttgccgccggtgctgctggcggcgctgctgtcgcccggctggttcgcctggctgctggcctggctcagcgtggccgcctacggcctgctgttcgagtggcatctggattggccgctgaacggcggcaacgccgcctatgccttcaatttgcacctgtccgggatgtggctgactttcgcattgtcggcgctgctgatctgcggcttcgtctcccggctggcgcgccagctgcgcaagcgcgacagcgcgctggccgaggcgcgggaaacccagctgcgcgacgagcagctgctggcggtgggcatgcaggcggccggcgccgcccattcgctgtccaccccgctcaacaccctgaccttgctggtggacgagctgatcagcgagcgggcgcaggacgaggcgctgagccaggacctgcgcctgatgcgcgcgcagctgaccagctgcagcgccacgctggcgcgcctcaagcatggctccgagccgcagtcggggccgcggccgctgttcgcggcgctggcggagcggctggaaggctggcgcagcctgcggccggacgtcaggctggaatggcaggcgccgcagggcgaggacccggaggtgtggttggacccggcgttctggccggccttgttcaacttgatcaacaacgcggcggaagcgggcggcggcgaggtggcggtggcggcgcggctgcgcggcggccgtttgtcgctggacatcgtcaaccgccagggctgcctgagcgaggcgcagctggcgcgcgccgggctgacgccgctggattccgccaagccggccggcctgggcctgggcatgatgctcagccacgccacgctggccaggctgggcggcacgctgagcctggacaaccgcgccgagggcggcgtccatgcccgcatcgagctgccgctgaaggagcgggcatga

SEQ ID NO: 887 - DNA, 525 bp, Chromobacterium substugae
atgagcgacttcctgctgatagacgacgacgaggccttctgcatggtgctggcgcgctcgctggcgcggcgcggccacgcggtgcagtgcgcccgcgacgccgacgaggcgctgcggctggcggcgcaggggccggcgcgcatcctgctggacctgaacctggccggcgacagcggcctcaggctgctgccggcgctgcgcgcggccagccccggcagcgccatcgtggtgctgaccggctacgccagcatcgccaccgcggtggaggccaccaagctgggcgcggtgcaatacctggccaaaccggccggcgcggcggagatcctggcggcgttcgagcagcaggcggccaatccggaactgtcggtggcgccgcagccgatgtcgctgcgccgggtcacctgggagcacttgcagcgggtgctggcggaaaacgacggcaacatctccgccaccgcgcgcgcgctcaatatgcaccgccgcacgctgcagcggatgctggccaaaaagccggtgaaaagctga

SEQ ID NO: 888 - DNA, 129 bp, Chromobacterium substugae
atgcagcatcttgcctccccctgttgtcggtatggaatccgcaagttacgccgcattggagcgccggctccaatcatattttctgatggccggccattgcccgatttatatattcgtcatggcaattga

SEQ ID NO: 889 - DNA, 1632 bp, Chromobacterium substugae
atgctgcatggacagatgatggaccagccgttgttgatttccgacctgctcgcgcacgccgagcgcttccatgccgataccgagatcgtatcgcgcacggtggaaggccccattcaccgctacacctaccgcgacgccgcccgccgcgcccgccagctggccaacgcgctgcaggcgctgggcgtgcggggcggcgaccgggtcggcacgctggcctggaacggctaccgccatttcgagatctactacgcggtgtccggcagcggcgccgtctgccataccgtcaacccgcggctgttcgccgagcagatcgcctggatcatcaaccatgccgaagacaaggcgctgctgttcgacctgagcttcctgccgctggtggagcagctggccggccaattgcgcagcgtcgagcatttcgtgctgctggccgaccacgcccacctgccggcggatagcgcgattcccaatctgcaaagctacgaagacctggtgaacagccacagcgacgtctacagctggccgcgtttcgacgaaaacactgcttccagcctgtgctacacctcgggcaccaccggcaaccccaagggcgtgctgtattcgcaccgctccaccgtgttgcacgccttcggcagctcgctgccggacagcttcgacatctcggcgcgcgcggtggtgatgccggtggtgccgatgttccacgccaatgcctggggcctgccctacagctgcgcgatgaacggcagcaagctggtgctgccggggccgaagctggacggcgccagcctgcagcaactgatcgcgacggagggggtgaccaccaccataggcgtgccgacggtgtggatgcagctgttgcagcattgccagcgcgaaaagctgccgctctcgccgctcaagcgcgtgatcgccggcggctcggcggtgccggagagcatggtggagcaactggcggagcacggcgtggaaatgcgccagctgtggggaatgaccgaactgtcgccctgcggcaccacctgcacgcccaagctcaagcacgccgctctggccccggccgaggcgcgcagcctgctgaccaagcagggccggccgatctacggcgtggacatccgcatcgtcgacgacgccggcctgccgctgccgcacgacggcgtctccttcggcaatctgcaggtgcgcggcccctgggtgctgtcgcagtattacaaacgcgaactggacgccaaccacagcgccgacggctggttccacaccggcgacgtggtgacgatagacgccgatggtttcatgcgcatcaccgatcgcaccaaggacgtgatcaagtccggcggcgagtggatcagctccatcgatctggaaaacatcctggtcggccatccggcggtggccgaggcggcggcgatcgcggtgccgcatccgaagtgggacgagcgcccgctgatggtggtgacgctgaagccgggcgcccgggccagccgcgacgagctgctggccttcttcgacggcaagatcgccaagtggtggacgcccaacgacgtggccttcgtcgacgagctgccgcacaccgccaccggcaagctgctgaagatgaaattgcgcgagcaattccgcgaccacgcctggccggaaaaatga

SEQ ID NO: 890 - DNA, 1941 bp, Chromobacterium substugae
atgaatccgtccggggatggcgatgcccgcctgggccgcgccggcagaaccaaagggaacgacatgaaatcactgcgcagccgtctgatagcgctcaacgccttgctgatggcgttgttcggcctggtcctggtgaccatagttttcacgcagatgcgatcagaaatcctggaggggctggataacgaattcgccgccagcctgaaggggcagagctcggtggtgaccacctggctgggagagaagaaacagcagatcgtcgcccagaccgcggtggccggcgaggccgacgcgctgcgcttcctcaaggtgggcaccaaggccggcggcttcaacgtcaactacgccggctacgccgacggccgcacgctgttctccgacgactgggtggccccggccgactacaaggtggccgaccgcgactggtacaagcaggcccaggccgccggccagcccatcgtcaccgacccctatgtcgacgaggccaccaagaagctgaccgtcaccatcgccgcgccgttcaatcacaacggcgccttcgccggcgtggtcggcggcgacgtgatggtggacgcgctggtgaagtcggtgctgtcgctgaaggtgcgcggcaacggctatgccttcatcgtcgacaagaagggcaccgtcatcgcccacccgcaggccgacctgacgctgaagccgatcaccagcgtagtgccggcgctgagcgccgacaagctggcgcagctggtgcagaacgacaaggcctccgatgtcgacatcggaggcaagagcatgctgatttccgcccaggcgatccccggcaccagctgggtgctggcgctggtggccgaccgcgacgagatcctggcgccgctgcacaccctgctgtacacgataggcgggctgacgctgctggtgttcgcgctgatgatcccgttcgccagcctggtgataggcaagatgctggccggcctcacgcggctgaaggcggcgatggaggacatcgcccgcggccagggcgacctgaccctcaggctgaaggacgacggccaggacgaaatcgccgccaccgcgcgcgcgttcaataccttcgtcgcccagctgggccacctgttccgcggcctgaagggcgacgccgccggcgtggtcggcggcgtgcaggacgccagccagctggtggccgacgtcgcgcaaagctcgcgccacatttccgacgtgtcctcgtccaacgccgccacgctggagcagatcaccgtttccatctcccacatcgccgacagcgcgcgccaggccgatgagctggccagcgccaccggccacaacctggcctccagcgccgacaatatgcagcgcctgtcgtccggcatggaaaacaccgtgcagtcggtgcgcggcctggaagagatgctgtcttcgctggacaagcgctcgcaggaaatctccggcatcaccaacgtgatccgcgatatcgccgaccagaccaatctgctggccttgaacgcggcgatcgaggcggcgcgcgccggagaacagggccgcggcttcgcggtagtggccgacgaagtgcgcaagctggccgagcgcaccgcccaggcgacgctggaaatctccaatatggtgggcgcgatccgcgaggaaaccggccgcgccgtgggcgacgtcaactccacggtgcaggcggtggacgaaggcgtcggcctgacccgcgaggcggtggacaatatcgccgccatccgcgcgtccatgctggaggtggtggccaagatgagcgaaatctccaattccacccaggagcagcacaaggccaccacgctgatcgcgcaaagctcggaagcgatcaacggccacgtgctggaaaacgacgatgtgctgcagaacgtcagcagcaccttgcagggcctggccggcaacgccggcaagatggacgccgagttcaataagttccgcctgtag

SEQ ID NO: 891 - DNA, 1827 bp, Chromobacterium substugae
atgccgcccctgtccgccgataccctgcgcgccgcccgcctgttggccgaaggcgagctcgccgccgccttgcaggccgcgcagcaaggcctgcaggccgaacccgccaacgcgccgctgtggaatttgctgggcgtctgcgccgtccggctggatcagccgcaactggccgagcaatgctggcgccaggcgctgcagcatgacgcggccacgccggacgcgcattacaacctgggctgcctgcaggcggagcgcggccacgcggccgaagccgacgcgcactaccgcgcggagctggcccgcgacgccggccatgcctccagcctgggcaatctgggcacgctgctgctggagcaggggcgggcggcggaagcagaagcctgtttccgccaggcgctggcgctgcggccgcagtcggcgctggcgcactacaacctgggccggctgctgcgccagctggagcgccgcgaggaggccgccgactatctgcggcgcggcctggcgctggagccggacgacgccgaggcgcagcagctgctgggccagctgctggtggagctgggccgcgccgacgaggccgaggcgctgctgcgcgccgcgctgcggcgacagccgaaccatgtggcggcgctgaacaatcttggcctgctgctgatggagcggcggcgctgggccgaggcggaggactgcctgcgccgggcgcatgcgctgcagccggacgcggtgctgggcaatctggcggcgctgctgtcggccaccagccggccggccgaggccgaagccctgctgcgcgccgcgttgctggcagcgcccggtaatgtcgactggctatgcctgttgggagtggcgcagctggagcaagggcgcggcgcggaggcggagcgcgcctggcgcagcggcctcgcgctgtcgccgcggcaccgccggctgcggcaaaacctgggctacttgcaattggcgcgcggcgagtatcaggccggctggcgaaaccacgaggccaggctgcagtccggccactatccgcagccgggttcgccgcgttggcagggcgaggcgctggcgggcaggcatctgctgctggtgttcgagcaaggctacggcgacgccatccagtttttccgctacctgccgctgctgcgccagctcgggccggcccgcctgacgctgatgtgccgcgaggcgctgctgccgctgttcgccgcccagggcctggccgacgcttgcctgcctatccgccgggtgaaccccgactttccgccgcacgactgccatgtgttttcgatgagcctgcccggcctgctgcaggccgagccgctgtcgctgcccagctatctgcgggccgatcccgcgctggccgaggactggggccggcgcctgccgcgcggcgggcgcaggataggcttgctgtggcgcggccatgccgcccatccgttcgaccattgccgttcgctgccggggcctgagcgattggaggcgctgtgccggcgcgacgccgtctggatcagcgtgcagccggaccctaccccggaagagaaggaatgggccggccggcacggcgcgctggagctggggtcggggttgagcgatttcgccgccagcgccgcgctgctgacgcagctggacctgctgatcgcggtggacaccgcgatggcccatctggctggcgcgctgggggtgccgtgccggctgctgctgtcctgcgagcacaccgactggcgctggggcgagcagggagacgccacgccgtggtacccgtcgctgcggctggttcgccagcgccgcggcgaggactgggcggcggccatcgcccggctggacgtcggctag

SEQ ID NO: 892 - DNA, 1383 bp, Chromobacterium substugae
atgaacgacttcctgcagcaactggccgccatcatcggcccgcaatacatcctgaccgccgccgccgacaccgcgccgttcacgctggactggcgccgccgctaccagggcgcgccgctggcggtggcgctgccgggctccaccgccgaagtcgccgagctggtcaagctgtgccgcgcgcgcaaagtcgccatcgtgccgcaaggcggcaacacctccacctgcggcgcggccacgccggacggcagcggccgccagctgatcgtgggcatgcgccggctgcgcgccatccgcgccctggacggcgacaacaacacgctgaccgtggacgccggcgtcacgctgcaagaagcccagcaggcggccgaagccgccggccggctgtttccgctggcgctggcctcgcagggcagctgccagatcggcggcaacctgtccaccaacgccggcggcgtggcggtgctgcgctacggcaccatgcgcgagctggcgctggggctggaagtggtgctgccggacggccgcgtgctggaccagttgcaaggcctgcgcaaggacaccaccggcctcgacctgaagcagctgttcatcggcgccgaaggccagctgggcctgatcaccgccgccacgctgaagctgtttccgctgcccagcgcccatgcgaccgcgatggtcggcgtagaagacatcgagacggcgatagcctggctgaaccggctgcgccaccgcttcggcgaccgcctcaccgccttcgaagtgatggacgccaattgccagcaggtgctgcaacgccaccatcccagtctgatgccgttttccgcgccgtggctggcgctgatcgagctgtccgacggcggcgatccggccgagctgaacgacgcgctggtggcatggctgtcggcgcagcacatgctggacggcgtagtggcgcaaaacgaaaccgaacggcgcaagctgtggacgctgcgcgaggagatatctgaaagccagcgcaaggacggtcccagcatcaagcacgacatcgcggtgccgacctcggcgctgccgcggctggtgcgcgactgcgcggcggatctggagcgggccttccccggcgtgcgcatcgtcgccttcggccacgccggcgacggcaatctgcattacaacgtcagctacacccgccccggcaatgccgagctgttcgacgacgagccggcggtcaacgccatcgtctacgaccacgtctaccggctggacggcacgctggcggccgaacacggcgtcggccaattgaagaaggactggctggtccgctacaaagacccgctggcgctggaattgatgcgcggcatcaagcgggcgctggacccggacggcttgatgaatccgggcaaatggctatga

SEQ ID NO: 893 - DNA, 678 bp, Chromobacterium substugae
atggacaaaatgctgacgctagccgatccgtccttgctggacattcccgtggccggccatgccgagcccttcgtcgacctggccgcttatccggactgggcggtggaccggagccgcagccagatctccagccgcagcccccatttcctgaaagccaggcaggcggtggcggaacggctgcgcgacgccgccggacgcttgccggacggcctgcgcctgtacgtcaaggaagcctaccggccgctagcgcgccagcgccgctcctacgacgagcatctggtccgcttgcgtggtctgcagccggaactggacgaggcggccttgctgcgcgaggccagcctttacgtcgcgccgccggcggtggcgccccacccgaccggcgccgcgctggatgtgaccttgatcgacgcggccggcgcggagctggacatgggctgcccgttcaacgccgacgccgaggaatcccgcggcgcctgctacaccgacagcccgggcctctgcgcgcaagcccgcgccaaccggcgcatactgatcctggcgatgcgcgacgccggcttcgtcaattatccgtccgagtggtggcactggtcgtacggcgaccgctactgggcggccgtcagcggcgcgccggccgcgctgtacgccgccgtcgacgaaagctttctggaatccgcatga

SEQ ID NO: 894 - DNA, 477 bp, Chromobacterium substugae
ttggaaaaaaccgaacccagccgttatccggacagccaggaggacctggcccgcggcgcgccgctgggccgccatttcggctttgcccggctgggcatccaccacgagcggctggaacccggccagcgcaccagctggccccatgccgaaagcaccgaggacgaattcatccacgtgctggaaggcgagcccgacctatggctggacggcgcgctgcaccggctgcagccgggcgattcggtcggcttcaaggcaggagacggccaggcccacaccgtgatcaacaacaccgagcaagccgtccgcctactggtggtcggcgacgccacccgcgccgacaaccaggtccactatccgcgccacccggcgcgcaacgccgccatcggcaagctgcactgggccgccgcgccagcgcggccggacggcggccacgacggtctgccggacaagctgcgcgacagcgacggaccgttctga

SEQ ID NO: 895 - DNA, 624 bp, Chromobacterium substugae
atgagcaatctgatcctgtacggcaaccgctactccggccacagctacaaggtgcggctggcgctgatgctggccgacatctcgcacgactatgtccatgtcgacatctcgcagccgcgcgccgaacgcctggaagatttccgcgccgccagccgcttcggcgaagtgccggtgctggtggccgacggcgtgccgctgtgccagtccaacgcgatactgcaatggctggccgacagctacggcgcgctgggcggcgccctgggcgagcgccagcgcgtgcgagaatggctgaactgggaaaccaaccggctgggcctgtcgctgcccaatctgcgctactcgcgcctgatcgcccactacgaaccggcggtggaagcctggctggaaacgcggctgcgcgccgatctggcggtgctggaaaccgagctggccgagcgccgctacctggccggcgaccagatcagcatcgccgacgtgtcgctctgcggctacctgtggtggctggccgacaccggcctggccatcgccgactggccccatgtccaggcctggctggcccgcatcgccgcccagccgggctggcagcatccggacgagctgatgtctccggacattccggaataa

SEQ ID NO: 896 - DNA, 1479 bp, Chromobacterium substugae
atgagccacgcccagctgctgttcaccgccctgatcctgctgacgctggccatcaccgccgccgcgcggcgccgcaccgcgtcccttaatgatttctataccgccggcggccacctgccggcctggcagaacggcctggcgctggccggcgactacctgtccgcagcggccttcctcggcgccgccggcatgtatctgggccagggctacgactcgctggcctacgcggtgggcacgctggcgggctggccgctgctgttgctgctgctggccgagccgctgcgccggcgcggccgctataccgtggccggcgtgctcagccagcgcttcgaccacgccggcgtgcgcctggtcagcatcgccggctcgctgaccgtgacgctgtgctacctggtggtgcagctggtcggcgccggcaagctgatcgagctgctgttcggcctgccctacctcgctgccgtcggcctggtgggcgcgctgatgatggtctacgtggcgctgggcggcatgctggccaccacctgggtgcagatcagcaaggccagcctgctgttcatctgcgcgctgctgctggccggcggcgtgctggcgcgcttcggcggcagcccggcggcgctgttcgacgccgcggagaaactgcgcggcgcggccgcctttctgcccagccaggcgctggccgacccggtggagatgctgtcgctgggcctggggctgagcctgggcctgctcggcctgccgcatgtgctgatgcgcttcttcaccgtggccgacgcgcgcgccgcgcgccgctcggtcggcatcgccacctggctggtggccgccttcttcgctctcaacatcgtcatcggctacggcgcgatgatgctggtgggacccgacgcgcgcttccacggcgccgacggcaaactgctgggcggcggcaatatggccgcgctgcacctggcgcgcctgctgggcggagaaaccgccagcgcgctggtggccgcagtcgccttcgccaccatcctggctgtggtgtccggcctggcgctggccggcgccagcgccgtcagccacgatctgtacgcggtatggctgaagcgcggccaggccgagccgcgccgggagctgcgcgtttcgcgactggccacgctggcgctcggcctgttcggcatcgttctgtccacgctgttccagcaattgaacatcgcggtgatgatgggcctggccttcgccatcgccgcctccgccaatttcccgctgctgctgctggccttgcgctggcaagacctcaccgcgcgcggcgtggtttggggcggcgcggcgggcatcgcttcgtcgctggcgctgatcgtctgcggcccggcggtgtgggtggcggcgctgggccacgccaaaccgctgttcccctacgccaatcccgcgctgttctccgtgccgctggccttcgccgcggcatggctgggctcccgcaacggcgcggcttccaccaacacctga

SEQ ID NO: 897 - DNA, 210 bp, Chromobacterium substugae
atgaagcccgcaccctgccagcgactgctggtcctcctcaccatcgccgcctgtctcggctactacctgatcctggccgcgcgccccggctggctggcctgccggctggccggcctgccggtttccattctgctggcgctggcgctgctgttgctgttctgcctgatcgccgcgctgcacggcggctcgcgcgatgaggacgcatcatga

SEQ ID NO: 898 - DNA, 450 bp, Chromobacterium substugae
atgcgactccgccaggcccgccgcgccgatctcgacgccatcttcgccatcgaacaagccgtgttcggcagccacgtctacccggactttttcttccgccaggcgctggacctgtggccggactggttctggctggccgaagacgaacgcggcgcgcccatcggctacgcgctgggcgcgccgtcccaggagccggaccagctgtggctgctgtcgctggcgctgctgcccgcctgccgcggcaacggaaccggcaaggccttgatgcaggcggcgctggcggccatgcggccgcgcgcgcgcagcatccgcctgacggtggacccggccaatccggccgcggcgctgtaccagcggctgggcttcgccgccgtcggccacgagccggactatttcggccccggcgaggcgcgctggctgatgcaatggcaagcggccgcatccgcctga

SEQ ID NO: 899 - DNA, 786 bp, Chromobacterium substugae
atgaatgtgtctggttttgggggaaagtgccgggttggcagaaagtggccggcgtacgccgcgctggcgctgggcatggcgggccatgccgccgcggcgctggcggcggacgaaccggcgacgccgctgtccgcggagctgaaggataggtacgagcaaatgcaggatgatgtgcccaatcgcgttcccatgcttagcctgacgccggccgcatcgggccgcgccgggcaaatggaggcgttggtgcgccagtgcatgaacgagcagttgcagaaacgcaatgattacagcctggagctgcagcgcgccggggccgcggtcttgctggatatgaaaagaatccgcgaggacaacgccgtcgaagaaagcaggacgatagtggagaacctgcgcgcggccgcgcagcgccatcgttatgacatggacgcggttcccggatgcctggaggacaacctcggcaagctgaaactgagcaaggccgcgaagaaagacttcatgcgcggggtgagcgccggcatggccaaaagccgttatcaggcggaaagaatctggacgctggagttcgccttgatcgaccagatggcggcggccacgcaatatctgaccgcgaacaagaactattggtcgatcgacgacagcggccggatggcgtacgcctctccccaggtgaaggcgcaggcggagtcgatgttggcggtgctgggcaagctgcgcgatcagcaacgcgaactggggcggcaaggcgtggccaacggactggccaatatgagaaaagccggcatgtga

SEQ ID NO: 900 - DNA, 1971 bp, Chromobacterium substugae
atgagcgagttgtcacgtcgcgagtttctcaagttgtcggccgccggcgtcgccgccggcgccattccgcccgggctggccgcggcgatggcgatccgccccgccgggcgcagcctgtccgcggtcaagcacgtggtggtgttcatgcaggaaaaccgctcgttcgaccactatttcggcatgctgcgcggggtgcgcggcttcggcgaccgcagcgcgctgcagctgcgaaacggcagcagcgtgttccgccagccgcatctgctgtccagcgagtttcccttccacctggacagcagccgcaccaacgcgcaatacctgaccgacctcgaccactcctggaccggcacccacgccgcctggaaccagggcaaatacgatggctgggtggcggccaagaccggcctgaccatgggctacttcaaccgcgccgacattccctaccactacgcgctggccgacgccttcaccatctgcgacggctatttctgttcgcagcaggggccgaccaatcccaaccgcctgtacctgtggagcggcacggtggacgccgccggcaagaacggcggcccggtcaccgacaacagcgagaagggctacagctggaccacctatccggagcggctgcaggcggccggcgtcagctggaaggtgtaccaggtggtcggcgacaatttcgacgacaacgcgctggcctggttcacccagtaccgcaacgccaagcccggcaatccgctgcacgaccgcggcatgagctcggtgcccaaggtcagcggcaattcggtgaaggacctagtggcggccatccgcagcgacgcggtgaacggcacgctgccgcaggtgtcgtggatcgtcgcgccgcaggattattccgaacaccccagcgcgcctccggccgccggcgcctacttggtggaccaggtgctgcaggcgctgaccgccaatccggatgtctgggcctccacggtgatgctgctcaattacgacgagaacgacggcctgttcgaccacgtgccgccgccggtgccgccgtccggcaccgcgggcgaattcgtgtccggcgcgccgatcggcctggggccgcgggtgccgctgctggtgctgtcgccgtggagccgcggcggctacgtctgctcgcaggtgttcgaccacacctcggtgctgcgctttctggaaacctggagcggggtgcaggaacccaatatctcggcctggcgccgccaggtgtgcggcgatctgaccgcggcgctggatttcggcagcagcaataccagcctgccggctttccccgacaccgcggcgctgttgacccaggcgcagcaaagcaagggctggccggcgccgaccgcgccggtgccggggcagatgccgcagccggaggcgggccgccgtccggcgcgcgccttgccctaccagtgcaatgcctacgccagcaccgatgtggccggcggcatggtgtggatacacatgcagaacagcggcagccagggtgcccattacgccatctacgccaaccagtaccggctggacggcccgtggcaatatgacgtggccgccggcggcaacatccaggactacttccatgtgcagacttacggcggcggctggtacgacctgaccctgtacggccccaacggcttcctgcgccgcttcgccggcaatatccacagcgcggccggcgtgctggaggcggtgagcggcgtgtcggtggtgcagggcgtgccgcagctgaccctgcagctgaacaatggcggcaaggtcgcggcgactttccaggtgagcgccaacggctatggcggcggggcgccgcagcaggtcagcgtcaacggcggcggcagccagctgctgagctggaacctatccggcgtgtacggctggtacgacttcaccgtcacctgcagcaacgacaccagtttcattcgccgcctggtcggccatgtggaaaacggcgccgccagcgtcagcggttga

SEQ ID NO: 901 - DNA, 213 bp, Chromobacterium substugae
atgtctaatcgccaatccggcaccgtaaagtggttcaacgatgaaaaaggcttcggcttcatcacccctcaaggtggcggtgacgacctgttcgtgcatttcaaagctatcgaaagcgatggtttcaaaagcctgaaggaaggccagaccgtttccttcgtggttgaaaaaggccagaaaggcctgcaagccgtacaggttcgcgtcgagtaa

SEQ ID NO: 902 - DNA, 3441 bp, Chromobacterium substugae
atgaacgcaccccgctttgtccatcttcgcctccattcggagttttccatcaccgacggcgtcgtccgcctcgacgacgcggtgaagcgcgccgtcaaggacggcatgcccgccttgggcatgtccgacctgatgaacctgttcggcatggtcaagttctacaagagctgccgcaacaagggcatcaagcccatcgtctcggccgacatctggctggaaaacgaggaagaccgcgacaagccgtaccggctgctgctcaccgccaagaaccgcgagggctaccgccggctgtgcgaactgctgaccgaggccttcagccacaaccagtaccgtggccgcgccgagatcaagcgcgcctggctggagtccggcgacaacagcaacctcttgtgcctgtccggcgcccatctcggcgatgtcggcatggcgctggcgatggcgcagcgcgaagaagcgcaacgccgcgccgcctactgggaaaaactgttcccgggctcgttctatctggaagtgcagcgcgtggacagcgcccaggtggaaaacgtggtgcaggccacgctgtggctggccggcgaaatgggcctgccggtggtggccacccacccgatccagttcatggatccggacgatttcaaggcgcacgaagcgcgggtctgcatcgccgaaggctacacgctgggcgacaagcgccggccgcgcgccttcagcgagtgccaatactttctcagcgccgatgaaatgctggcgcgtttcgccgacattccggaagcgctggccaacaccgtggaaatcgccaagcgctgcaatatcagcgtggtgctgggcaagaactacctgccgctgttcccgacgccggacggcatgtcgctggacgacttcctggtgcacgaggccaagcgcgggctggaggcgcggctggcgcagctgtacccggacgaggcagtacgccgggaaaggcgccccgagtacgacgagcggctgaaattcgagtgcgacaccatcatccagatgggcttccccggctacttcctgatcgtggcggacttcatccagtggggcaaggccaacggctgcccggtaggcccgggccggggttccggcgccggctccttggtggcctacagcctgtcgatcaccgacctggatccgctgaaatacgcgctgctgttcgagcgcttcctcaatccggagcgggtgtcgatgcccgacttcgacgtcgacttctgccaggaaaaccgctggcgggtgatcgaatatacccggcagaaatacggcgaggaggcggtcagccagatcgccaccttcggcaccatgtcgtccaaatcggtgatccgcgacgtcggccgggtgctggacctgcccttcggcctgtgcgaccgcctgtccaagctgattccgctggaggccaacaagccgctgtcgctgaccaaggcgatggagatggaagcgcaaatcggcgagatcatcgaaaacgaaggcgccggcgagctgatcgaactggcgatgaagctggaagacctgacgcgcggcatcggcatgcacgccggcggcgtgctgatcgcgccgggcaggctgaccgacttctgcccgctctacatcgccagcggcgaaggcgcctctccggtttcccagttcgacaaggacgacgtcgagcagatcggcctggtgaagttcgacttcctgggcctgcgcaacctcaccatcatcgagctggcgcagaagtacatcaaacaggtcagcggcgaggacgtcgatgtcgcccacctgccgctggacgaccgcgacgcctacaaggtgttcgccagcgccaacaccaccggcgtgttccagttcgagtccagcggcatgaaaaagatgctggtggaggccaaaccgagcaagttcgaggaaattatcgccttcgtggccttgtaccgccccggcccgatggacctgatccccgacttcatccagcggatgcacggcgccaagttcgaatacctgcacccgctcttggaaccggtgctggcgcccacctacggcatcatggtgtaccaggaacaggtgatgcagtcggcgcaggtgatcggcggctacagcctgggcggcgccgacttgctgcgccgcgcgatgggcaagaagaaggtcgaggagatggtggcgcagcgcgccatgttcgtcgaaggcgccggcaagcaggacatcccggaagccaaggccaacgaaatcttcgactacatggagaaattcgccggctacggcttcaacaagtcgcacgccgccgcctacgcgctggtggcctaccacaccgcctggctgaaggcgcaccactgcgccgcctacatggcggcgaccatgtcaaccgaactggacaacaccgaccagctgaagattttctacgacgacgccaccgaccacaagaacggcctggtgttcctgccgccggacgtcaaccacagccactaccgcttcgtgccggtcagccgcaaggaaatccgctacgcgctgggcgcggtgaagggcagcggcgaatcggcggtggaccacatcgtcgcgatgcgcgaggccggcggcccgttcgccaacctgttcgacttctgcaagcgcaccgacaagaagctggtcaacaagcgggtgatcgaggcgctgatccgcgccggcgccttcgactccatcgaacccaaccgcgcgctgttgttcgccaacgtcggcctggcgatggaggcggcggagcaggagcacgccaacgccaaccagggcggcctgttcgacatgttcggcgacgacgtcgcgccggcggtggaaatggtggccacccggccgtggagcgacgcggtgaagctggccgaggaaaagctggccatcggcttctacctgtccggccacccgttctccgcctacgaaaaagaagtgcgcgccttcatcaagacgccgctgtcgcggctgatacccaacaagtcgccgcagctgctggccggcttcgtcaccggcatccgcgtcaaggtgggcaaccgcggcaaaatggccttcgtcgagctggacgacggcagcaccaagctggaggtcagcctgttcgccgaaagcttcgagaccaaccgcgacaagctgaaggaagacgtggtgctggtggtggaaggcaaggtcagcgaggacagcttcgccggcgccggccgcctgcgcatcatcgtcgacaagctgtacagcctgggcgaagcgcgcagccgctacgcccgcagcctggcgctgcagctgtccgggcaggtggacgtcgcccgcctcaagtccgagctgcacccgttcaagagccaggacgccggctgcccggtgcggctgcattacaataacggcgaggccaaaggcgacctgatgctgccgccggaatggggggtgcggctggacgacgggctgctgctggcgctgtccgactggctgggtgagaaccgggtcaaggtgatgtggtaa

SEQ ID NO: 903 - DNA, 144 bp, Chromobacterium substugae
atggaggcgaagatggacaaagcggggtgcgttcatcccggcattttaccggctggcgctgtggcaaaccagttgaatcgccgacgccgtgcggctggtgttcggcacgccatgcacattagaatgatggcatcatggtattaa

SEQ ID NO: 904 - DNA, 603 bp, Chromobacterium substugae
atggagttcaatgtgcagcaattggagcggacgaatctgtatcaactgctggtggggtgcgtgctgccccgtcctatcgcctgggtcagcacccaggacctgaagggcgtttgcaacctggcgccgttttcatttttcaatgtgatgagcatcaacccgccgttgctggggatcagcatactcaagcaggcttcggagcgcgacaaggatacgctggccaatatccgcctgaccggcgagctggtggtcaacatcgtcagccaggcgctggccgaggcgatgaatgtcagctgcggcggctatccggccgatgtcgacgagttcgagctggccagcgtggccaaggtggacagcgtcacggtgaagccgccgggcgtggccgaggcgccggtgcggctggagtgcacgctgcaccagtgcctgaccttcggccacggcaccggcgccggcaatctggtgctggcggaagtgcgccacatccatgtggcggacagggtatggaatgagggcgcgatagacgatgtcgcgctgcaggcggtgggcaagctgggtggcgatcgctacagcctgggtcagccggccttcagcctgacccggccctga

SEQ ID NO: 905 - DNA, 903 bp, Chromobacterium substugae
atgactgtaatcaattcggtggatctgttctggtcgctggctagcggggaattctcccaaagagatggctttgacgagggcaagaaccgcttcaagttcgtcctccgcggcatgctgacgctgccctggaccctgcgctggctggaaaccttccgctcgcaggccctgctgacctatctgcggcgcaacccgcgcctggcctgcaagctgcaccgcccctatctgtaccgctcgctgaacgcgcgcggcaagctgcaggcgctgcaagcgcattaccagttgttggagcagcgcttctgcgagccggcgcgcggcctgctgctgtccaatcagccggtagcgctggccgccctgaccggcaagaacgacggcgcgctgcacgtgctgctgacgcagcagcacactttcgacaaggaaggcgaaatgtcgctgcaggtgtgcaatgccgagcgcgtggcgctggccaccctcaccttcaccctgacccgacgcggcgaagacttggtggtgatggtgggcgggctgcaaggcccgaccaagccgcacggcgccgaaagcgtgcagctcgccaccaagctcgcccatggcctgtttcccaagcggctggcgatggaagcgctgacggcgctggcgcgcaagatcggcgccgacgaaatcctggctgtcggcaaggccgagcatatctacagttcctggcgctaccgccgcaacttcttcgccgactacgacagcttctgggaaacgctggacgcggagccgatggaaggcgggcgcttcttccgcatcccgctgacgctggcgcgcaaggccatggcggatatcgccagcaagaaacgcgccgaataccagcgccgctacgcgctgctggacgcgctgtccgcgcagacccaggcggtgctgtaa

SEQ ID NO: 906 - DNA, 246 bp, Chromobacterium substugae
atgagccaagacaacgatccgttcgccctgttccgccaattttggcagcaagccaccccgcccggcatgcaggctttcctgccgccgatgtcggaagaggagatcgaccgcaagctggccgaactcaaggtggtggaaggctggatgacgatgaatctgggcgtgctgtcgatgcagatcaagacgctggaaatgcagaaaagcgcgctgcactcgatgcggccgaaagagcccccggcaggctga

SEQ ID NO: 907 - DNA, 2271 bp, Chromobacterium substugae
atggacgagcaactgcgccaaagcgcgctggaatttcaccagttcccaaccccgggtaagatccaggtcgcgccgaccaagccgctgaccacccagcgcgatctggcgctggcctactcccccggcgtggccgctccctgcgacgccatcgtcgaagacccgctcaacgcctacaagtacaccgcccgcggcaacctggtggcggtgatctccaacggcaccgcggtgctgggcctgggcaacatcggcgcgctggccagcaagccggtgatggaaggcaagggcgtgctgttcaagaaattcgccggcatcgatgtgttcgacatcgaagtcaacgagctggaccctgacaagctggtggacatcatctgctcgctggagccgaccttcggcggcatcaacctggaagacatcaaggcgccggagtgcttctacatcgagaagaagtgccgcgagcgcatgggcattccggtgttccacgacgaccagcacggcaccgccatcgtcgccgccgccgccgtcctgaacggcctgcgcctggtgaagaaggaaatcggcgaagtgcgcgtggtggcctccggcgccggcgccgccgccatcgcctgcctggacctgctggtggccctgggcgtgaagcgcgaaaacatcaccatctgcgactccaagggcgtggtcttcgtcggccgcgacgagaagctggacgagtccaagctgcgctacgccatcaaggacaacggctggcgcaagctggccgacgcgatggtcggctccgacatcttcatgggcctgtccggcccgcgcctggtgtcgcaagacatggtcaagtccatggcccgcgacccgttgatcctggcgatggccaatccggaaccggaaatcctgccgccgctggtgaaggaagtgcgtccggacgccatcatcggcaccggccgttcggacttcccgaaccaggtcaacaacgtgttgtgcttccccttcatcttccgcggcgcgctggacgtgggcgccaccaccatcaatgaagagatgaagctggccaccgtgcgcgcgatcgccgacctggcgatggccgaacagaacgacgtggtcgccaccgcctacggcgaccaggagctgtccttcggcccggaatacgtgattccgaagccgttcgacccgcgcctgatcgtcaagatcgccccggccgtggccaaggccgcgatggagtccggcgtcgccacccgcccgatccaggacttcgacgcctacgccgaccagctggcgcagttcgtctacaagaccaacctgttcatgaagccggtgttctcccaggccaagaaagacccgaagcgcgtggtcctgaccgagggcgaagacgagcgcgtgctgcacgccacccaggagatcgtcacccaaggcctggccaagccgatcctggtgggccgccccagcgtgatcgagaagcgcatcgagaaactgggcctgaagatgcgcccgggcgtcgacttcgagctggtcaacaacgaatccgacccgcgcttcaccgagtactggaaagactactaccagctgacgaagcgcaagggcgtgtcgcaggagcaggcgcgccgccgcgtgatcggcaacaccacgctgatcggcgcgatgatggtgcgccgcggcgacgccgacgcgctgatctgcggcacctacggcccgtaccgccagcacttcgacattctggagaacgtgctcggctacgccaacgaagacaaggtggccggcgcgatgaacgcgctgatcctgccgaccggcaacatcttcatcaccgacacctacgtcaacgccgagccgagcgcggaacagctggcctccatcaccaagatggcgtccgagtcgatcaagcgcttcggcatccagccgaaggccgcgctgctgtccaactccagcttcggcgcgctgaacacgccgtcggcgcagaagatgcgcgccgccttcgacctgatccgcgaagcgcagccggaactggaaatcgacggcgagatgcagggcgacgccgcgctggtggaaagcatccgccagcaggcgctgccggactccacgctgaagggctcggccaacctgttgatcatgccgaacgtggaagccgccaacatcagctacaacctgctgcgcgtgtcggcgtccgacggcgtgaccatcggcccgatcctgatgggcatggccaagccggtgcacatcctcacgcctatcgcctcggtgcgccgcatcgtcaacatggtggcgctggcgtcggtggacgcccagtgctga

SEQ ID NO: 908 - DNA, 1329 bp, Chromobacterium substugae
atgagcgcgctgatcatcttcggcctgttgatggcgctgatgctgaccggcatgccgatctccatctcgctgggcctgaccgtactcacctttttgttcacgatgaccgaggtgccgatcacctccgtcgcgctgaagctgttcaccggcatcgagaagttcgagatcatggcgatcccgttcttcatcctggccggcaatttcctgatgcacgggggcgtggcgcggcggatgatacgcttcgccaccaccctggtcggccactggtacggcggcctcggcctcgccggcgtggtgtcttgcgcgctgttcgccgccatcaccggctcttcggtagccaccgtggtggcggtcggctcgatcatcctgccggcgatgctgaaacagggctacccggcccgcttcggcgccggcgtcatcaccacctccggcgcgctgggcatcctgttcccgccgtcgatcaacctggtgatgttcagcatcgccaccgccggcatggacgtcaccggccccaacggcatgagcgtgtccaccgcctcggtcggccagctgttcatggccggcgtgctgcccggcctgtgcctgtcggcgctcttgggcctcaccacctggtatcgggcgaagaagttcgactacccgcgcctgccgcgcgccagctggaaggagcgctgggaagccttccgcgactgcgtgtggggcctgctgctgatggtgctggtgataggcggcatctacaccggcatcttcacccccaccgaagcggcggcgatggcggcggtgtacgccttcgtgatcgcggtgttcgtctacaaggacatggggctgaaggacgtgcccaaggtgctggtcaacgccgcgtcgatgagttcgatgctgctctacatcatcaccaacgcggtgctgttctcctttctgatggcttccgagcagattccgcaaagcatggcggcgtggatggccagccagggcttcggcgtcgtcgccttcctgctgctgaccaacatcctgctgctggcggcgggcaacttcatggacccgtcggccatcgtgctgatcatggcgcccatcctgtacccggtggcggtgaagctgggggtcaacccggtgcacttcggcatcctgatcgcggtgaacatggaagtgggcatgtgccacccgccggtgggattgaacctttacgtggcgtcggggatcaccaagatggggatcaccgaattgacggtggcggtgtggccgtggctgctgaccatgctgggcttcctgctggcggtcacattcatcccggaaatctcgctgtggctgccgcgggcgctgggcatgatgaattga

SEQ ID NO: 909 - DNA, 588 bp, Chromobacterium substugae
atgctcaagttcctcgaccacctcgaggagtggatgatcgcctgtctgatgggggccgccaccctgatcacgttcgtagcggtgctgcaccgctacggctcgggcattcccaccctgcaaccctacctcgcccacatcaacctgtcgtgggcgcaggaactcaccgtctacctgttcgtctggatggccaagttcggcgccgcctacggcgtgcgcaccggcatccacgtcggcgtcgacgtgctgatcaaccgcctgccggacaagacccgcggccgcttcatcgtgttcggcctgttggccggcgcgctgttcaccggcaccgtggccgtgatgggcggcaatttcgtctgggagatcggccacaccgaccagacctcgcccgacctggaagcgccgatgtggctggtctatctggccattcccgccggctccagcctgatgtgcttccgcttcctgcaagtggcctggaacttcgtcaagaccggcgcgctgcccaaacacgaccacggccacgtcgacggcatcgaaggcgacccggcgctggacaatcttcacccgcatgacaagcaaggaggccggccatga

SEQ ID NO: 910 - DNA, 1005 bp, Chromobacterium substugae
atgaaacgcaaatacaccgcgctggccatctgcgccagcctcaccctgtccggtttcgcccaggccgccggcgaaatcgtcatcaaattcagccacgtggtatcgccggacacccccaagggcaaggccgccgaatacttcaagaaactggccgagcaacgcacccacggccgcgtgaaggtgcaggtctaccccaacagccagttgtacaaggacaaggaagagctggaagcgctgcagctgggcgcggtgcagatgctggctcccagcctggccaagttcggcccgctgggcgtgaaggaattcgaagtgttcgacctgccctacctgttcgacagctacgacgaagtcaacaaggtgatgcacggcccgatcggcaagcagctcttgggcaagttggagagcaaaggcatcaagggcctagcctactgggacaacggcttcaagaatttctccgccaacaagccgatcaaatccccggccgacctgaaaggcatgaagatccgcatccagtcgtccaaggttcttgaggaagaaatgcgcacgctgggcgcgctgccgcaggtgatggctttctccgaggtataccaggcgctgcagaccggcgtggtggacggcaccgagctggaagcctccaacctctacaccagcaaggcctacgaggtgcagaagaacctgacgctgacccagcacggcttcctcggctacgcgctgatcgtcaacaagaagttctgggacggcctgccggccgacgtgcgcggccagctggacagtgcggtgcaggacgctaccgtctacgccaatcagatcgccaaacaggaaaacgaaaaagccgtcgccgcgatcaaggcgtccggcaagaccaaggtttacgtccccaccccgcaagagcgcgaagcgttcaagaaggcgctggcgccggtgcaccagaagatggcggcccgcatcggcccggacctgctcaagcagatctataaagaaaccggcttcaaccccaacaagtaa

SEQ ID NO: 911 - DNA, 2295 bp, Chromobacterium substugae
atgtccgcacccgactcccgcatccgccgcgcgccgcgcctgctgtggctgagcgtcagcctggcgctgatcgcgctgctgctggcgctgtgcagcctcagctacctggtgtaccgcgactggcgcgacgagcagcaggacaatctgatccaggaggtgctgtggctggagcaatcgctgcgcatgcatctggaaggccaccaggaatgggctgacggcctggcgcgggacatcgccgccggcaaggtggacagccagcgcttcgcccatctggccgcgttctacatgcgggaaaatcccgaactgctgacgatagagcgggtgggcgcgagcaaccaggtgcaatgggaccagcacggcatccgccgcgaccgccgcagcctggggccggccgagttcgacggcctgtggcgtgcgtcgcggctgctgcgctccagctacggcgcaccttaccagggcgccgacggcaaataccggttcgacctggcggtgccggtggtgcgcgacggccagctgctgggcgggctgcgtttctcctatcagttggacgggctgctttaccaccaggtgccgtggtggatcgcctccaagaactacatcagtattctcgatctgggcggcaagacgctggcgcagaaattcgacgccgccgagcggccgggcaatatctcgcaccagaccagcttcgacccgcccggctacggcctctacctgcgcgcggtggcctaccgcagcggcttgggcctgaccctgccggtgctcacctgcgtgatcgtgctgctgttgctgacgctgtggtacgcggtgtggcgcatccgccgccacatgcgcgagcgcgccacggcggagcagaagctggcgcaggaagtgtcgctcaggcaggcgatagaggattcgatgaagagcggcctggtggcgatagggctggaaggcgagatcgtccgcgtcaaccgcgccttctgcgacatgctgggcttcgcgccggaagagctggtgggcagctacccgccgcacccgttctggccggccgatcagcacggcgtgctggccgacgcgatggacgcggtgcgcgacaaccgccaaccggagcagggcttcgagctggcgctgatgcgcaagcgcggcgacacgctggtggtgcggctgttcgccacgccgctggtgcgggaggacggcagccagcacggctggatcgcctcgatgttcgacatcaccgaacgccagcgccagcgcaaggaaatggacgctgcccaccgccgcttcctcaccgtgctgaacggcctggccgccggcgtctgcgtggtggcggaaagcagcggccagctgctgtacgccaaccccggcttcgccgaactatggctggtgggcgacgccgacgcgccgtgctgcgtgctgctgcccggcctgagggccggcccggaaaacgaggagtacggccaggaattcatcgtcgccggcgaatgctgcctgctgatccgccgtcgccgcatcgaatgggtgaacggcgaagcggcctggctggcgatactcagcgacgtgtccgaagaccgccgccgcgaggcgcgcgaacaggcgcagcaagaccgtttccagaacaccgcccggctgatcgcgatgggcgaaatggcctcgacgctggcgcacgagctgaaccagccgctcaccgccatccacacttacgccgccggcgtcagccgccgcctgccggaacagctggagctgccggccggcgtgcgcgacgccatccatgccatcgccgaacaatcgcggcgggcggcgcaaatcgtcagcagcattcgcgccttcgtcaaaaagcacgagccgcaactggagcgggtggacccggcgcgggcggtggcgcgggcgctgagcctggccgaaccgctggcggccaagcacggcgtcagcctgcagctggagccggaccgccgcgcctgcctgctggacatggacccggtgctgatcgagcaggtgttgctcaacctgatgaaaaacgcggtggaagcgctggtggaagccgacaccccgcagccgtcggtgcagctgcatacctgcgtgggcgaaggcaaatggcgggtggaggtggtggacaacggccccggtctcgccgccggcatgcaggacaacctgttcacgccgttctactccaccaagccggaagggatgggcataggcctcaacatctgccgttccatcgtggaattccaccgcggcgaattcggcgcggtcagcagcccggccggcggctgcgtgttctggttcacgctgccgctggcgggcagggtggttgaatga

SEQ ID NO: 912 - DNA, 73 bp, Chromobacterium substugae
gggccgatagctcagctgggagagcgctgcgttcgcaatgcagaggtcgggagttcgatcctccttcggtcca

SEQ ID NO: 913 - DNA, 1617 bp, Chromobacterium substugae
atggctgcgaaagaagtccgcttccacgacaacgcccgtgaacgcatcgtcaacggcgtcaacgtgctggccaatgcggtgaaagtcaccctggggccgaaaggccgcaacgtgctgctggcgcgcagtttcggcgcgccgcacatcaccaaggacggcgtgtccgtcgccaaggaaatcgagctcaaagacccgttcgaaaacatgggcgcacagatggtgaaggaagtggcgtccaagaccgccgacgtggcgggcgacggcaccaccaccgccaccgtgctggcccaggccatcgtgcaggaaggcatgaagtacgtcgcctccggcatgaatccgatggacctgaagcgcggcatcgacaaagccgtccatgccgtggtgaaggagctgcaaaccctgtccaagccggtgaccaacagcaaggaaaccgcccaggtggccgcgctgtcggccaactccgacgaagccatcggcaagatcatcgccgacgccatggacaaagtgggcaaggaaggcgtgatcaccgtcgaggacggcaagtcgctggacaacgagctggccgtggttgagggcatgcagttcgaccgcggctacctgtcgccctacttcatcaccgatccggaaaaacagaccgctgtgctggaagacccgctggtgctgctctacgacaagaagatcagcaatatccgcgacctcttgccggtgctggagcaagtggccaaggccggcaagccgctgctgatcgtcgccgaagacgtggaaggcgaagcgctggccaccctggtggtgaacagcatgcgcggcatcctcaaggtggccgcggtcaaagccccaggcttcggcgaccgccgcaaggccatgctggaagacatcgccatcctgactggcggcactgtcatttccgaggaaaccggcctgacgctggaaaaagccggcctggccgagctgggcagcgccaagcgcgtggaaatcggcaaggaaaacaccaccgtcatcgacggcgccggcgacaaggcgaagatcgacgcccgcgtgcaaaccatccgggcgcagatcgatgccgccaccagcgactatgaccgcgagaagctgcaggaacgggtggccaagctgtccggcggcgtggcggtgatccgcatcggcgcggccaccgaagtggaaatgaaagagaagaaagaccgcgtcgacgacgcgctgcacgccacccgcgccgcggtggaggaaggcatcgtcgccggcggcggcgtggccctgctgcgcgcccgcgcccacatcggcgagctgaaaggcgacaacgccgaccaggacgccggcatccagatcgtgctgcgcgcgctggaagcgccgctgcgcgccatcgccgccaacgccggcgacgagccgtccgtcatcgtcaacaaggtgctggaaggcaagggcagccacggctacaacgccgccagcggccagttcggcgacctggtggaaatgggcgtgatcgacccgaccaaggtgacccgcaccgcgctgcaaaacgccgcgtccatcgccagcctgatcctgaccaccgacgccaccgtggccgaagcggcacaggacagcaaggccaaggctccggcggagctggattactga

SEQ ID NO: 914 - DNA, 318 bp, Chromobacterium substugae
atgcaaatccgtcctctgcacgaccggattatcgtcaagcgggtcgaaaaggtccgccagactgcttccggcatcgtcattcccgatagcgccgcggaaaaacccgaacaaggcgaagtcctcgcggccggtcccggcaaacgcttgcctgacggcaccttgctgccgatgcaagtgcaggtaggcgacttggtcttgttcggcaaatatggcggccagaccgtcaagctggacgaccaggaatacctggtgctgcgcgaagaggatgtcttcggcgtgatcgaaggcgcatccgaatccggccgcaaggctgcttga

SEQ ID NO: 915 - DNA, 627 bp, Chromobacterium substugae
atggaattgttcgataccttgtccgcccagatccgccatatgcgcctgccgctgttcgcggtcagcctcagcgccgtcccctgccccgataccccgctgctgctgatgctgcattggcatggcttcggcaaagccgccgccgaccgcgcgccggctggccaagcctcgctgcggcaagtgccggcgtcggccttgcagctgacgcgcagatggagcgcgctgtcgcgggtggaggaggagattctggacgcggcctggcagctgggcgcctggagcctgctgcgcgatgagcggcgcggctgcaacaccatgggcgccgccgccggcgaggagcttgcctgccgccaggcttttggcgacttgcctgccatcgacggccaggaaagcgtcgtagccgaggcgcccgacggcccggagctgatgcggctggcggcgcgccgcggctatgtttgctggcagttccggccggtgcatggcgggctgtggcgcgaattggccgaggacgacacgctgggcgaagatggcttacgccagcccccttgcccgctggcgccgcgcgtctgccgcggcggcaaggcggcccgaaccgaataccgtttcggccgcatcgagcgcgtcattttttag

SEQ ID NO: 916 - DNA, 228 bp, Chromobacterium substugae
gtggcggcaactagacggctcaatccggaaaaattgctgctcagcaagtggaccgccgccgcgccgcgcgacaaggaaaagcactttctggtggtggcgctgggccggccggcgccggatgccgcggtggagacggtgacgctggaggcggtctacacccggcgccggcaaaccatggcgtggcaggcgctgcgcgacgcggaccaatggctgcaggggtggaaatga

SEQ ID NO: 917 - DNA, 537 bp, Chromobacterium substugae
atgctgaaaaaaccgctcgcgctcatcgccctgatcctgctgccgctgaccggctgtgacaccgcgcccccgcccggcatcgccccggcgcggggcttccaactggaacgctaccagggccgctggtatgaaatcgcccgcctcgatcaccgcttcgaacgcggcctgcaggcggtgagcgccgactacagccgcaacgccgacggcagcatccgcgtggtcaaccgcggttttgacgaggcgaccgccagctggcgcgaagcggtgggcaaagcctggttcaacgggcccgccgatgtcgcctcactgaaagtgtcgttcttcggaccgttctacggcggctaccatgtggcggcgctggaccccggctaccgctgggcggtggtggtggggccggacaaggattatctgtggctgctgtcgcgcgataaacaagccgcccccgccgccaagccggcgctgctggcggtggcagccaagctaggcgtgccggccgacaagctgatctgggtgaggcaggaccgtggcggcaactag

SEQ ID NO: 918 - DNA, 1527 bp, Chromobacterium substugae
atgaccaccttgcggctgctcctgggcgatcagctcaatccctgccacagctggttcgccgagcccgacgccaatgtggtgcacgtgatgatggaaatccgccaggaaaccgactacgtgcgccaccacgcgcaaaaaatcctggccatcttcgcggcgatgcgcgacttcgccgcccaattgaaagcgcaaggccaccgcgtgcgctacgtcgcgatcaacgacgccagcaaccgccagtcgctgaccggcaatctggacgcgctgatcgcccattaccgcgcggcggcggtggagtaccaggccccggacgagtggcggctggaccgccagctggcggagtgggcggccggcctgcccatgccctgccgcatggcggacagcgagcacttctacaccgcgcgcggcgaggtggcggcgttgttcggcgggcggcaatggcggcaggagaccctatatcgccacctgcggcgccagcacggcattttgatggacgaaaacgccgagcccgccggcggacgctggaatttcgacgccgacaaccgccagcgctggcccggcgatccgcccgaaccaggcgatgcgcgtcccgagcatgaccacagccggctgtggcaaaccattgtcggcgccggggtggccagcttcggccagccgcaggctgacgcgctgcgctggccgctcaaccgcgccgaggcgctggcgcagctgcgcgccttcgtcgaacatgggctgccgcacttcggcgcctatcaggacgcgatgagcccgcgcgcgcggcggctgttccattcgctgctgtccttcgccctgaatgtgaaaatgctgaacccgcgcgaggtagtggacgccgccgtgtccgcctggcaggagggccgcgcgccgctggccgcggtggaaggcttcacgcggcagatactgggctggcgcgaatacgtgcgcggcgtctattgggccaaaatgcccggctaccgcgacagcaacgcgctggcgcaccagctgccgctgccgcgctggttctgggacggcgacaccggcatgcgctgcctcgcccacgccatcggccaatcgctggaagacgcctacgcccaccacatccagcggctgatggtgataggcaatttcggcctgatcgccggcctgtcgccgcaagcgctgcaccaatggtatctgggcgtctacatcgacgccttcgaatgggtggagctgcccaacacgctgggcatgagccagttcgccgacggcgggctgctgggcagcaagccttacgccggcagcgccgcctatatcggccgcatgggcgattactgcgccggctgccgctaccggcccaagcagcgcgtcggcgccgacgcctgcccgttcaatgccttgtactgggactttttccagcgccaccgcgcggagttggccggcaatccgcggctggccctggtctaccgccagctggacaagctgccggaaaccgagcgcgccgccataaccgcgcgcgccggctggctgcaaaccaatctcgactcactatga

SEQ ID NO: 919 - DNA, 165 bp, Chromobacterium substugae
gtgatggcggcgcggaccttcaagggcaacaaggcggcgctgccgtccaagccctgcgccggctgcggccgggccatgagctggcgcaagaaatggcgcgccagctgggatgccgtgcagtattgctcggagcgctgccgccgccagaaaggcaaagccgcatga

SEQ ID NO: 920 - DNA, 435 bp, Chromobacterium substugae
atgaaacgcatcccctcccaagccgactggcaggctttgcttgactggtaccagacgttgacgccggacaccttgcccgatatcggccacttctacgctgaagacgcccgcttcaaggacccgttcaacgacgcgcgcggcatcaccgacatccaggcggtgttccgccacatgttcaagacgctggagcaaccgcgcttcaccgtcatccacgcgctgcgcgacggcgaccaggctttcatcacctgggatttcgactttgtctacgctggacgcaaggtcaatatccacggcggcagccatctgcagttcgacgccggcggcaagatcgcgctgcaccgcgactactgggacgcggcggaagaactgttcgagaaaataccggtgctgggcctgccggtggcctggctgcgcaagaaactcaaggtggtgtga

SEQ ID NO: 921 - DNA, 1314 bp, Chromobacterium substugae
atgcgtgatgccgcgcgccgctctcgcctccttgctggccttgctgacgggttgcgccggaccgtcggcggccgattacgccgccaaccgtcccgcgctggaccccggccggtttttcctcggcaaaaccgaggcctggggcatgttccaggaacagggccgactgctgaagcgttttaccgtggacatggacggcgagcgccagggagacgagttggtgttgaccgagcgcttccgctacagcgacggcagccgccagcagcgcgtgtggcggctcaagccgctgggcgcaggacgctggcgcggcctggccgacgatgtggtgggcgaggccgcgggcgagactgccggcaacgcgctgcgctggcgctacacgctgaagctgccggtggacggcaaggaataccaggtgcagttcgacgactggatgttcctgcaggacgagcgcagcctgctcaaccgcgccgagatgagcaagttcggtttccgcctgggcgaagtcacgctgtttttccgcaagccggagccgcggccgtgagcctgcgcctcaatcccgccatcgccgactggcatgcgcgccgcgtctgggtgatcggcgcgtccagcggcatcggcgccgcgctggctaccgaactgctggacgccggcgccgaggtcatcctgtcggcgcgccgcgccgagccgatgcaggcgctggccgccggccgcgccggcgcgcgcgtggaaacgctggatgtgaccgatccggcggcctggtcgcgcgtctgggagcggctggagcgaaacggcgcgcggcccgacctggtagtgttctgcgcggccgattaccgtccgcagacctgtctggacctgcatgcagacgaaacccgccgcctgctcgacaccaatctgctgggggtctaccacgggctggaagtggtactgccggcgctggcgcgggaagggcgcggcggcgtggcgctgattgccagcgtggccggctacgccggcttgccgggcgcggcggtgtacggccccggcaaggcggcgctgatcaatctggcggaaatcctctataccgagctcaagccgcgcggggtggcggtttatctgatcaatcccggcttcgtcgccaccccgctcaccgccaagaacgatttttccatgccggcgctgctcaccccgcgccaagcggcgcaaagcatcatgcgcggtctttcgcgcggcgcgtttgaaatccacttcccgctgcgcttcaccgcatggctcaaactgttgcggctgctgccttaccggctgcggctgcccttgctcgcgaggctggctcgaccatga

SEQ ID NO: 922 - DNA, 1206 bp, Chromobacterium substugae
atgagcgcaagccaacccatcgccctgtcccgccctgacattcccgccgccgggcgggcgctgctggccttgttgtcgaaactgcgacacggcagcctcaaaatcgtcacgccagatggcgaagagctgtggtacggcgcgctcaagccgcaggccgacgccgagctgacgctagccgactggcgcgcctgccgccgcatgctgtccggcaacgacataggctttgccgaggcataccgcgacggctggctggacagccccgacctgaccgcgctgttgcggctggcgctgcgcaacgaagacgcgatgcagctgggcgaattgggccgctgggccgcgcgcgcgtggcacaggctgcgccacctcttgcgcgtcaacagccgccgcggcagccggcgcaacatccatgcccattacgatatcggcaacgatttttaccagctgtggctggaccccggctggacctactccagcgcctggttcgacggcgactaccgcttgtccctggccgatgcccaggcgcgcaagtaccagcgcatctgcgatcaattgcaactgcgccccggcatgcgggtgttggaaatcggctgcggctggggcggcttcgccgagcatgccgcccgcttgggcgtggccgtgcacggcatcaccatctccgacgcgcagctggacttcgcgcgccgccgcctggccaacgagccgctggccatactggagcaccgcgactaccgcgacctctccggccagtacgacgccatcgtgtcgatcgaaatgttcgaggcggtgggcgagcgctactggcgcggctatttcgacaccctgcgccgctgcctgaagccgggcggccaggcgctggctcagagcatcaccatagaagagtcgcgcttcgaaacataccgcgccaacgccgatttcatccagaccttcatctttcccggcggcatgctgcccagccgcgaacgcttcttgcgcgcggcgcggcaaggcggcctggcctgccgcggccggctggatttcggccccgactacgcggaaaccctgcgccgctggcgcgatgctttcgaggccaatctcgccgccatccgcagccagggcttcgatgaggccttcatccggctgtggcggctgtatctgtgctactgcgaagccggtttcgacgaaggccgcatcggcgtttcgcaatttctgctgcaaaggcatgcgtga

SEQ ID NO: 923 - DNA, 777 bp, Chromobacterium substugae
atgagcggcgcctatctgttgaccgggcaggtgatgcaccgccgcttgcggccggcgcccaatcgcttcgtctatccggttttctgcttgcggctgaatctggccaagctcgaaagcctgcgcggcttctggtttggcgtggaccgctggcggccgctgtcgctgcgcacgcgcgactacggcccgcgcgacggctcgccgctcttgccgtggatacgcgcgcggctggaggaagccggcctgcccgccaacggcgaggtctggctgcaaacctttccgcgcgtgttcggctatgtgttcaacccggtcagcttctggcattgccacaacgcctccggtcaactgatcgcggtgctggccgaggtgaacaatacctttggcgaaaggcatggctatctgttgagccagaccggcggcggccccatctccgccgccagccagctctcatgccgcaaactgctgcatgtctcgccgttttgccgcatcgaaggccattaccgcttccgcttccatcaaagcggagaccatgcgctggtccgcatcgactaccacaacgacgccgggccgctgctgcacaccgccatctccggccgcctgtcgccgctgacgccgggaaccgccgcgcgcgccctgctgcgccagccgctgctgactctgggcgtcatcgcccgcatccactggcaggcgctgcggctgtggctcaaacgcgtgccctttttccgcaaacctcatccccccgccgccgcgctcagccgcggccaggagttgaaaccatga

SEQ ID NO: 924 - DNA, 1287 bp, Chromobacterium substugae
atggtgaacgcctcatcgccacaacgcatcgccgtgataggcggcggcatcgccggccttgccacggcttactttctttcccgacggcacgcggtgacgctgttcgaagccgccgattatctgggcggccatacccacaccgtcgatgtcacggtcgacggccgcgacttcgccgtcgataccggcttcctggtattcaacgatcgcacctatcccaacctcatcgccttgtttcaggagctaggcatccccagccatcccagcgacatgtcgttcagcgtctcgctgggccagggccggctggagtgggcggggcgcgatctggacagcgtgttcgtccagcgccgcaatctgctgtcgcccggcttctggggcatgctgtccgacatcctgcgcttcaaccgcgaggcggagcgcaatctgcgccgcgcgatcgaggccccgcaaagcctggggcgcttgctggacgcggacggatacggcgcgcgctttcgccaccactacctgctgccgatggcggcggcgatctggtccagcccctgccgcgacatcctgtccttcccggccgagactttcctgcgcttctgcctgaaccatggcctgctgcagctgcgcgaccggccgcaatggcgcacggtgccgggcggcgcccggcagtatgtcgagaaaatcgccgccagcctggccgatgtccggctgtcgacgccggtgctgcgcgtcagccgggtagatggccgcgtgcgcttgcttgccgccagcagcgaagagactttcgacagcgtcgtcttcgctacccatgcgccgcaaaccctggccatgctggcggatgccgatgatttggagcgcaagatgctgtccgccgtccgctatcaagccaatgaggcggtgctgcataccgatgcctctttgctgccccgccgcgaagcggcctggtcagcctggaatttcctgtcggacgacgatgacgacagccgcgcggtgggcgtcagctatctgctcaaccaactgcagcccctgcctgtcgccacgccggtggcagtcacgttgaacccgccgcgcgcccccgatccggccaaggtgctgggccgctaccattaccagcatccgctgtttgacgccgccgccatcgccgcgcaaaaggctttgtccggccttcagggccgccacggctgctggttcgccggagcctggaccggctacggcttccacgaggatgggctgaactccgcgctgcgcgtggcgcgggattttgggctggctccggcctgggcgaggttggagaaatga

SEQ ID NO: 925 - DNA, 645 bp, Chromobacterium substugae
gtgttaccgatgggtatactaggcaggctcagcttcaaggatcaggctttcaagctgcgcgagcaggcggtgctcgacgccaccacgcggatgctggcgagcaagggtttcgacctgatgaccatggacgatgtggccggcgaggcggggatttccaagcccagcctgtacaagcatttcaaatccaaggatgagctggcgaccgaggtgatgatccgcttgctggacgacgcccaggattttctggcgcggcaggcgccggagttgagcccgcttgcccgcctgcgcgatctgctggcttgggcgctgggcatgcgcctcgccggcgggctgccgttcctgccctcgaccagtccgcaggtgcgcgccatgctgacgcgcagcctgcgttacgtcagccgggcgatcaagctgcacaaaatgctgcagggcatcgtcgagcaggccaagcggcagggagagctaagggcggatatgccgactgacgtgatcctgtacagctactactcccggacctgcgatccggcggtggagtacttgcgcgtctatgggaaataccaggacgaagacatcgtcaggcatatgctgcgagtctgtttcgacggcatggcggacgatcatcgccgcgatgacggagagtcgtga

SEQ ID NO: 926 - DNA, 114 bp, Chromobacterium substugae
atgccgcaaagcaataaaaacggcacggcgcagatggtaacacgcccctgcgcgccccaaaggggaagaaagctgacgttcgatgccggcgacagcgaaatggccggcatgtga

SEQ ID NO: 927 - DNA, 1668 bp, Chromobacterium substugae
atgatcattctgaaaaacgtggccttgcgccgcggcaccaaagtcctgctcgacaacgcgtcggtgacgctcaatcccggtgagaaagtcggcctggtcggccgcaacggcgccggcaaatcctcgctgttcgcggtgctgaacggctcgctgcacgaagacggcggcgatgtgtcgatcccatcgcagtggcgcatgtcgcaggtggcgcaggacatgccggaaacggcgcagatggcgaccgagtttgtggtcgaaggcgataccaccctgctcgccgcgcagcaggaggtggccgaggccgaggccggcgaagactacatgcgcatggcgcacgcctataccgcgctcaacgatgccggcgcccacgacgcgccggcacgggcgcaggcgctgattctcgggttgggtttcagcgtcgccgagctgcagcagccggtgaacagcttttccggcggctggcgcatgcggctgcaactggcgcgcgcgctgatgtgtccgtccgacctgctgctgctggacgagccgaccaaccacctggatctggacgcgctggtatggctggaagcgtggttgaagcagtacgccggcaccatggtggtgatcagccatgaccgcgaattcctcgatgccgtcaccaacgtgacgctacacgtcgacaatgccaagctggtgcgctacggcggcaattacagcaagttcgaggacatgcgcgccgaacagctggtcctgcagcaggcggcgcaggccaagcagcaggaaaagatggcgcacctgcagaagttcatcgatcgcttcaaggccaaggccagcaaggccaagcaggcgcagagccgtgtcaaggcgctggagcggatggagaagatcgcgccggtgctggccgatgccgagttccagttcgaattcaaagagccgcagagcctgccgaactcgatgctgtcgatgaccggcgcggcgttcggctatccggcgccggagggcgcgccggaaggcacgccgccgacggtgatcgtgcgcaacgtgaaccgcaccgtgctggccgggcagcgcatcggcattctcggcgccaacggccagggcaagtcgacgctggtgaaaaccgtggccgaggcgctgcaggcggtcggcggcgagatcattcgcggcaaggggctcaatatcggctacttctcgcagcaggagctggacgtgctgcggccggaggacgatccgctgcagcacatgttccgtctggcgcgcgacaccccggcggcgatgcggccgccggccaacgattgccgcgagcaggggctgcgcaatttcctgggcactttcaacttcagcggcgacatggtgaagcagccggtcggcagcatgagcggcggcgagaaggcgcggctggtgctgtgcatgatcgtgtggcagcggcccaacctgctgctgctggatgaaccgaccaaccatctggacctcgccacccgcgaggcgctgagcgtggcgctgaacgagttcgaaggctcggtgatgctggtcagccacgaccgggcgttgctgcgcgcggtgtgcgatgaattctggatggtgtcgcgcggcggggtcagcgatttttcgggcgatctggacgattaccaggtctacctgctggaagaggccaagcgccggcgagaagaggcggccggcaagcgttga

SEQ ID NO: 928 - DNA, 1707 bp, Chromobacterium substugae
atgatcgaggttaccgaactatccattgccgaactgcgcgcggcgctcgaatccgggcgtacaacagcggtggaactggtcaaggcctatctggcgcggatagcggcctacgatggccccgcgacggagaccaggctcaatgcggtggtggtgcgcaatccggatgcgatccaggaagccgaggcatccgatgcccgtcgcgcccgtggcgaaacgctgagcccgctggacggcatcccctacaccgccaaggacagctatctggtgaaggggctgaccgccgcttccggcagcccggcgttcaaggatctggtggcccaacacgatgccttcaccatcgcgcgcctgcgcgcagccggcgccatctgcctgggcaagaccaatatgccgcccatggccaacggcggcatgcagcgcggctgctacggccgcgccgaaagcccctacaacgccgactacctgacggcgccgttcgcctccggctcttccaatggcgccggcaccgctacggccgccagcttcgccgccttcggcatggcggaggaaacctggtcgagcggccgcggcccggcctcgaacaatggcctgtgcgcctatacgccgtctcgcggggtcatctcggtgcgcggcaactggccgctgacgccgaccatggacgtggtcgtgccctacgcccgcaccatggcggacttgctcgaagtgctcgacgtcatcgtcgcggacgacccgatcagccgcggcgacctatggcgcctgcagccctgggtaaagattcccaaagcctccgaggtccggccggattcctattccggcctgctggcccagcccgacatgcttaaaggcaagcgctttggcataccgcgcatgtacatcaacaaggacgagctcgccggcaccagcgagaagcccggcatcggcggcccgaccggccagcgcatccatacccgcgcgtcggtgatcgacctctgggaagccgcgcgccaggcgctggaagccgccggagcggaagtcatcgaagtggattttccgctggtttccaactgcgaaggcgatcgtcccggcgcgcccaccgtattcaaccgcggcatcgtctcgcctgagttcctcaatgacgagctgtgggagctgtccggctgggctttcgacgagttcctgcgcgccaacggcgaccccaagctcaacaaactggccgacgtggatggtccgaagatcttcccgcacgatcctggcaccttgcccaaccgggaaggggatctggccgcaggcatggacgaatacgtcaacatggccaagcggggcctcaagccctatgaccagattgcaagcgtgccggatggtctgcgcggtctggaaaagacccgcaagctggatctggaagactggatggatgcgctgaagctggacgcggtgctgttccccaccgtggccgacgtcggcccggctgatgcggacgtcaatccgcgctccgccgacatcgcctggagcaatggcatctgggtagccaatggcaacctcgccatccgccatcttggcgtccccacggttaccgtgccgatgggggtgatggcggatatcggcatgcctgtggggctgactttcgccgggcgcgcctatgatgacaacgcgctgctgcgcttcgccggcgcctttgaagccaccggcaacaagcgcatgatcccgccgcgcacgccgccgctggctcaatga

SEQ ID NO: 929 - DNA, 975 bp, Chromobacterium substugae
atgaacaatacgaatactttcataaatacggtgaatggtgtgaagctgcatcaactggatctgaacctgctgctggcgctggatgccctgatcagcctgcgcagcgtcacgcgggcggcagagaaactgtttgtcagccagccggcgatgagccactcgctcaaccgcttgcggaccttcttcgacgacccgctgctggtgcgctcgccgcatggcatgctgccgacgcaaaaagcgctctacctgcaacagggcgtccatcaggcgctcagcctgctgcaaagccatttcagccagccggaggccttcgacccggccacatcggcgcgccgcttcaccctgtgcaccaccgattatgtagagtgcgtgctgattccgccactggtgaaaaaactggcggaggtcgcgcccaatgttcatatcgacatcaccatcctgcgggaagacattccggaactggcgcttgccgacggtgaaatcgacttcctgctgggttttgacgaatacatgtccatccccagctatctgtgccgggaaacctggctgaacgagccgctgatcggcatcttgcgccatggccacccgctccagagcgataggctgacactgtcggatctgatcgccttgccgcatgtcttccacgcgccgctaggcaatcgggggtcgccaatggatgattttcttgccgcgcgcggcttgcagcgcaagatttcggtgcacagccaaagctatatggccgcagccgccatcgtcagcaacaccgatcatttgtttatcctgcccaagaaagtcgcggcgatgatggcgggctactggccgttgaagatggtggcgttgccggaagagttgccaggctatcacctcaactgcatctggcacccagtacaggatagtcatccggcgctgcactggctgcgcgatttgatgcgcaagctcatcgaatccgatgatgcggccccggtattcgccgtatga

SEQ ID NO: 930 - DNA, 141 bp, Chromobacterium substugae
atgaatcgtgcatttgcggatgacagactcggcgcgtctcccgatctgcgcgatgcggcggctcgaccaatgcacattcgccgggcggaaccgcctgctggaacggcagatttcctctgcgatgaacgacgaagtgattga

SEQ ID NO: 931 - DNA, 1137 bp, Chromobacterium substugae
atggcatttatcaagccgatggtgatcaacatgaacaataaaacgcacaatagtcttccggccgccgatggtttccacatgccggccgagtgggccgagcatcaggcggtatggatgatctggccgcagcgcccggataactggcgccatgccggacgcgaggcgcaacaggtctttgccgccatcgccaaagccatttccgcggccacgcctgtgttcatggccgtgccggaaccgttcatgtcgcaggcgcgcgcagtgatgccggccgaagtcacgctggtggaaatgaatagcgatgactgctggatgcgcgacagcggaccgaccatggtgatcgatcaggcgggccatctgcgcggcgtggactggaagttcaatgcctggggcggcttcaacggcgggctgtaccatccttgggatcaggatagtgaagtggccagccaggtgttggtccatcatggctttgatcgctacgcggctccgctggtgctggagggcggctcgattcatgtcgatggcgaaggcacgctgctcaccaccgcggaatgcctgctcaatcccaatcgcaatccggatttgtcccaagcccagatcgaggctttgctttccgagtatctggacgtgacgcacttcatctggctgccggaaggcgtgttcatggatgaaaccgacggccacatcgacaatatgtgctgctttgcccgtcctggcgaggttgtgctgcactgggtcgacgatgagcaggatccgcagtatccgcgttcgcaggccgcctacgaagtgctgtcccaagcgcgcgacgccaagggccgccagctcaagatccacaagatgctggccccgggccccttgttctacgagcaggatgaaacggctggcgtggtggctagcgggcaggcggtgccgcgtgaggttggcgagcgcatggccgcttcttatgtcaacttcctgatcagcaacggacagatcattttcccgctgctggatgagcgcaccgatgccgcggcggccagccgcttgcaggagatcttcccggagtaccgaattgtcggcgttcctgcgcgcgaggtactgcttggcggcggcaatatccactgcatcacccagcagattccagctggcaaggctggctaa

SEQ ID NO: 932 - DNA, 963 bp, Chromobacterium substugae
atgaccgcgactcaacgcatcgatgtccatcagcatgtcgtccccccattctgggctgacgccctgcccgcccacggcggcgacccgtccggctggaaaagcccggaatggagcccccaaagcgccatcgccttcatggacagccagggcatcgccaccggcatgctgtcgctgaccgctcctggcgtgcagggctggtccggccaagccaagctggacatggcccgccgcgtcaatgaatacaccgccggcctggtggcgcgccacccggaccgcttcggcaacttcgccaccgtgccgctgccggacatcgaaggctcgctgcgggagattgaatacgcgttcgacacgctgcaagcggacggcgtggtgctgctcagcaactacggcggccaatacctgggcgatccggcattcgagccggtgtgggccgaactgaaccggcgccgcgccaccgtgttcatccatcctggcaaaccggccatcgacgccatcgccggcatgcccggcccgctggtggactatcccttcgataccacccgcaccgcagtgcagatggtgctgaacggcacgctggcccgccatccggacgtgaacgtcatcctgtcccatgccggcggctttctgccgtacgcgtcccatcgcttcgccgaactggctcagggcgtgcgcgatgatgttccggcgacagcggaattgctgcgcctgttccagcgcttccatttcgacaccgcgctctcttccggccccgcggccctgcccagcctgaccgccttcgccggcgtcggccgcatcctgtacggcagcgactacccctacgcgccggcggaggttggggcatcattcaccgccaagctggacgcatgcgctgaactgtccgcggcggaacatgccgccatcaaccaccgcaacgcgctggagctgttcccgcggctggccaaagtccgtggtttagccgcatga

SEQ ID NO: 933 - DNA, 879 bp, Chromobacterium substugae
atggaactacgccatttacgctatttcctggcggttgccgacgagggccatttcggccgggccgccgaaaagctgcatatcgtccagccggccttgagcgcccagatccgggcgctggaggacgagctgggcgtcaccctgtttgaccgcagcacgcgcaaggtggagctgtccgacgccgggagaattttgctgatcgaggcgaggcgcacggtggagcaggccgagcgcgccaagaacgtgatgcgccgcgccgcgcgcggcgaaaccggcgtggtgaggataggttttgtcggcaatgccgtggcggcggggcgtttgccagatgatttgctggcattccatgcggcctggccggatgtggcggtggacttgcatgaaatggcgccggcggcgcagttggaagcgcttctggcggggaggctggacgtcggctattgcccgcagctgggccatccgctgcctgccgggctgcaggccaggccagcaggcagctggcattgggaggtggcgatgggcggccagcatcccttggccgcgcgccggacattgcgcgtggacgatttgcgggagcagtcgttcatcgtttacgccgcagacggcgacgacgagggccagttgccgatgttgcgccagctgttgggcgcagaaccccgcatcgcttacaaggtgggcagcaccatgtcggtgctggccttggcggcggcgggcctgggtctggccctggtgcccgcgccggtgcgcaaaatggcggcgccgaatctcgtttatcgccggttggcggagcgctcgccgctggtgtcggaattgtcggcgatcagccgcgcgggcgaggaatggggcgctgcgcggcgctatctggacatgttgaagggctga

SEQ ID NO: 934 - DNA, 1281 bp, Chromobacterium substugae
atggcttgcgccgcctggctgtggtccgcggcggcgtcggccttgccgagttatgcgcggcagaccggcgaggcctgcatcgcctgccacgtcagctttccggaactgacgccgtatggcaggctgtttaagctgtccggctacactttgggcgccgccaagttgtttccgctggcggccatggcccaggcctcgatttcccatgtcggcaacacccagggcaatgacggcgcctatcccaggcagaacgacggggtgatagaaggcggcagcctgtttgtggcgggcaagatcggcgatcatgtcggcatgttctcgcaatggactttcaacgcgttgaaccagaatcccggcgcgcaggacttttccggccacacggtggcggacaacaacgattggcggctaagcgaccacatcgccaacagcgatctggacctgatctacgggctgtcgctcaacaacaatcccacggtgcaggatgcctggaatacgatgccggccttcggctatccctatcaaagcagccacttgaccggagcctggggcattgcgccgccggccacgctgatcgagggcgggctggcgcaacagacggccggcctcagcgcttacgcattcctgaataaagcctggtacttcgagctgggcggataccgcgtggccaagggcggcgcctcgctgttcaaaagcggggtcgccttgagcaaccggctggatggcaccaatccatacgggcgtttcgcctacagccatgattggagggaacactcgatcgaggctggcgttttcggtctggacgcgcgagtccataccgacccttccgatcccggctcgccgaccaaccactaccgcgataccggcctggacgcgcagtatcagtatttgtccgagccgcatgtgttcaccgcgcaagccgcttacatccacgagcggaccgtttgggacgcgtcgcaagtgggaagcgcggtgcaaaatcccggcagccagctgaacgctttccgcatcaagggcagttactggtatcagcgcaggtatggcctgaccttggcgtatttttctgaaaccggttcggccgacaatatcgtctatcccattaccggcagccccaataccaatggctgcatcgccgagctcaactacatgattcagcccaattggcgggtgggcctgcagtacaccggctttctgaagtatcagggcgccagcgccaattacgacggcaatggacgcaacgcccgcaacaacaacgtcacctacctctacacctggatagccttctga

SEQ ID NO: 935 - DNA, 603 bp, Chromobacterium substugae
atgaaaacgctatggatgataggctggtgcggcgcgttgctgtcggcaggcgtggccctggcggacaaagatccggagtcgctggcgcgcggctggtgcgccaattgccacggcgcggacggcaatagcgtttcgccgctgtttccccgcctggcggggcagcaggccatgtatttgcagcagcagctgcagctgttccgcgagcaaagccgcagcgaccaggcggcgcacgactatatgtggggcgtggccggcggcttgaaaggcgcggaaatcgccggcgtggccggctatttcgccgcgcagacgcccaagcccaatccggcgccgccggcggcggccgctgaactggcggcggggaaggagattttcctgcgcggcaagggcgacagcgtgccggcctgcttcgcctgccatggcgcgcggggcgaaggcagcgaacaggcgccccggctggcgggccagcacgcggcttatctgatcaagcaactgcgggtcttctccacgcgccagcggcccgcggcggcggcgatgcaggccatcgtccatgacctcagcgaagacgatctgcacaatctggccatctacttgcaaagcctgtag

SEQ ID NO: 936 - DNA, 1239 bp, Chromobacterium substugae
atgaaccccttcgcttcgctgacactgccgaatggcagcttgttgcccaaccgcctggccaaggccgccatggaggagaacatggccgaccgcgaccacgcgccgtccgaagcattgatccgcctgtaccgcgcctgggcggaaggcggcaccgggctgatcctcaccggcaacgtgatggtggaccggcgcgcgatgaccggccccggcggcgtggtgctggagtcggagcgattcggcgtccgctttgagcaatggtccgccgccgcccgcgcccgcggcgcgcagatctggatgcagatcaaccacccggggcgccagatgccggccgcgctgggccagcccaccctggcgccgtcggcggtggcgatggagctgggcaatttttccaagcagttcgccgcgccgcgcgcgatgagcgaggccgacatcgccgacgtgaaagcccgcttcgtcaacacggcgcggctggcggagcggttcggcttcaacggcgtacagatccacgccgcgcacggctacctgatcagccagtttttgtcgccgatcaccaaccagcgcgccgaccgctggggcggcagcctggaaaaccgcgcccgcctgctgaccgacatcgtgcgcgaagtgcgcgcggcggtgcgtcccggcttcgccgtgtcggtgaagctcaattcggccgacttccagcgcggcggcttcagcgccgacgacgccaaacaggtgacggccatgctgaacccattgggcgtggacctgatcgagctgtccggcggcagctacgaagcgccggccatgcacggccagacgcgcgacggccgcacgctggcgcgcgaagcctatttcctggaattcgcccaggacatcgccgccgtcgcgcggatgcccgtcatggtgaccggcggcatccgccgctacccggtggtggagcaagtgctgggcagcggcgtcgccgtggccggcatggccaccgcgctggcgataaaccccaatctgcccaatgcctggcgcagcgacgcgacggccgcgccgagactgcgcgccattccctggaaaaacaaggtgctggcctcggtcggctatatggcgatggtgaaataccagctgcgccgcctcagccagggcaagcgcgcccggccggacgttgcgccagtcctggcgctgttgcagcagcaatgggacgccaagatccgcaccggccgctatcgccgctggatccagcgccaaagcgcagccgcgtga

SEQ ID NO: 937 - DNA, 147 bp, Chromobacterium substugae
atggcatcagccatcctcccttggcggaggcgtggcgcaatgtcctgtcatccggaggcgccgcccatgtccactgtccagcaagccgtcccggcggccgtcgccgtctcgcaatccttagcctgggcagggcgggggcgcgcatga

SEQ ID NO: 938 - DNA, 414 bp, Chromobacterium substugae
atgaaaatcggcgaactggccaaacgcagcggcatggcggcgtcggcgatccgcttctatgagtccaagggtttgctgaagatggccagccggcaggtgaatggctaccgcgactacccgccggaagcgctggcggtgctgtcgatcatccgcgacgcgcagcaggccggcttcacgctggacgaaatcaggcagctgctgcctggcgatttccagtcctggcggcatgaggaactgctgtccgcgctgcgccgcaaggtggcggatatcgaagcgctgcaggcgcggctggcccagagcaaggcgcatctgcaggcgttgatccagatgatcgccgccaagccggacgacatggattgcaaggagaacgccgcccgggtgctggcaaaccttggcgtggcgggagattcctaa

SEQ ID NO: 939 - DNA, 2319 bp, Chromobacterium substugae
gtgtcaaaaccgctcatcgccggctgcacggccttgtccatcttgtcttgcctgccggcgtcggcgcgcgccgatgccggctatcaggcgctggtgcagcgcacttcgttcggcattccgcacatcaccgccagcaatgaaggcaacctcggttacggcgccggctacgcttatgcgcaggacaatttctgccaactggcggaagagatggcgaccgcccgcggccagcgttcccgctacttcggcacggcgggcagttacgccagtccggatggcggacagatacccaatgccgccagcgatttctactacgccttcctgaacagcgacgcgaatatccgcgccagtttcgcgcgccagccggaggcggtgcggagtctgctcgatggctatgtggccggggtgaaccgctatctgcgcgaaaccggcgtcggcggcttgccggcggcctgccgcaaccagccgtgggcgcggccgctggagcggctggacatgatccgcatgatgcggcgctacgcggtgacttcgtccggcgcgcaatacatcggcgccttgcaggcggcggttccgccgactgccggcgcggcgcgcaagcagcggctgccggtcggccaggaaccgctgcgcggtttgtatggcaagcgccggccggtgggttccaacgccatcgcgctggggcgcgaagccacccattccggcgcgggcatgctgtacgccaatccgcatttcccctggaacggcgcttaccgcttttacgagcagcatctgaccattccgggcaaggtggatgcgatgggcgtttcgctgggcgggctgccggtggtgaacatcggcttcaaccgcgccgtcgcctggacccataccgtcaacacctcgctgcactccacgctgttcgccttgcgcctggcgccgggcgatccgacgcgctacatcgtcgatggcgtggccaagccgttgcggccggtcacggtcagcattgtcggccgcgacgccaatggcgcgccggagcgcttgcaacacaccttctatctgagcgagtgggggccggtggtggcgtttccggggcaactggattgggacgccgcaagcgcctacgcgctggccgacgccaatcaggacaacgacaggatgctggatgcctggtggcggatgaaccgggccggctcgctggcggagctgcgttccgcggtggaatcgacgctgggcctgccctgggtgcataccctggcggcggaccgcgccggcaatgtttacttcggcgacgtcaccgtggtgcccaatgtcggcgcggcaaaacagcaggcttgcatgccggcggcgacgcggcccttgctggcccagggcgtgatggtgctggatggcgcgcgcgccgcctgccgctgggacaatgcggcaggcacgccgcagccgggcatcttcgcagccagggatttgccgacgctggcgcggcgcgacttcgtgcagaacagcaacgacagcgcctggctgaccaatccggcgcggccgctgaccggctacccggacatcgtcagcgcggccggcggcgtgcagggcgcgcgcacccgctacggcttgcagcaaatactgggccggcttggcgagcagcgcttcactctggacgcgctgcaggaaatgggcttgtccaaccgctcctactacgcgtcgctgttgctggacgatctcaagcgcttatgccggacgtcgggaagcggccaggtgccggcggatgcctgccggatcttggcccgctgggatggcaaggccgaactggatagcgtgggatggccgctgttccaggcctggcgcggacgcttgaacggcagcggcgtggcctactgggggcagcctttcgatccggcgcgcccgctgcagacgccgcgcgggttgcgcatcggcgatgcggcggtggccagcgccgcgcgcgcggccttgttcgacgcggtcaaggatttgcaggccgccggcatcgcctattccaggccatggggcgagatccagcgcgcggcgcgcggcggcaaacgcattccgatccacggcggcggcggcgaagatgtctacaacgtcatcgaaagcgggccgggcggcaatggcgaactcaatccggaatccggcacctcgttcctgatggcggtgtcgttcgagtccggcctgccgcaggcagaagctttcctcacctattcgcagtccagcgatccggactcgccgcacagcggcgaccagaccgagcgcttcagccgcaagcagtggatccgcctgccatacacgcaaactgacatccgccgcgacccggcttatgcctggcgctggctgagggaatag

SEQ ID NO: 940 - DNA, 1110 bp, Chromobacterium substugae
ttgaaaaacgcaagcgcaagacagctgtccaccatcctgaaaacctgcctgcccctgctggccgcgctggctctggcgaatcaggccgcggcccagggctcccatgccggcgcgccggcccggcaagccgcccatctccaggcctgcggcgcggcctgggatgccgccgcgccctatcccgccggcagcctggccagccgcggcggcgtcaactacaccgccgcctactggacccagggcaatgctccgtcggcggacagcgcgggagccggccagccctggatagccggcgccagttgccggccggcggccaagaccgccgccaaggcggccgaccatgacgccaacttctcgccggccacgctgcagtttctcaaggccaacaccgggctggacggcgagcagtgggacaacatcatgaagctgatcaacaagccggagcaggactcgctggattggaccaagttctacggctactgcgaggacatcggcgacaagcgcggcttcaccatcggcattttcggcgccaccaccggcggccccaacgacggcggcccggacgcccctgcgctgttcaaggcattcgacgccgccagcggcgcggccaacccgtcgataatcggcggcttgaaccgcgccggcgcccacggcgcgatgcagggcgccattctcaagatcagcgacgacaagaaaaccttctgcaacaagataggcgcgctgcagaacaacgccgcctggcgcgaagcgatgtggcgcaccttctacgccgtctacatccagttcagcgtccagcaggcgcgccagcgcggcttcaacagcgcgctgacgataggctccttcgtcgacaccgcgctgaaccagggtgccagcggcgattccggcacgctggccggcgtgctgtcccgctccggcaacagcgccgacgagaaaacgttcctgacccgcttctacgccgagcgcagcaagatcgtggacagcaacgactacaaccagccgcccaacggcaagaaccgcgtcaagcagtggagcaccctgctgggcatgggcgagaccgacctgaagaacgccgacgcggcggtgctcaaggtgaccggctggcagatgaagtaa

SEQ ID NO: 941 - DNA, 867 bp, Chromobacterium substugae
gtggcggaaaggatgcgggcgccggctttgcatccggcgatgtcgccccggcaagctggccgggtggtgacggcggcatgcctgcgccatttccaggccaatctggcgggcgccaaggccggcgtcgaccatgagtgcctgcaccaggccagggtggcgctgcgccggttgcgctgcgcgcgcaagatattctccgcccgcgacgcggatggggatgcggcggccgccgatctgaaatggctggccggccagctcgggcaggcgcgcgatctggacgtgctgctagtggaggcgctgccggcggcagaggccgcggcgggcggcggcgcaggcttaggcaagctgcggcaggccttggcgcagcgctcggagcgctgccggcgcgaggcgcaagcagcgctggagtcggcttgctgtgagaggctgttgtcgtcttgccgccatccgcagcttgaggacgcggacgccaagctgcggcgcttcgcccggcggattctgcggcggcggcggcgcgggctgcgccgcttggcggagcgctggcggacgctggatccggaacagttgcatcagttgcgcaagcaagccaaggcgctgcgctatgcggcggaattcttcgcgccattgttcgacgccggcgcggcggcgcgctatctgttccgcctgcagcgggtgcaggacctgttgggcgcgattcacgacgcggcggcgggccgggcgctgctggcgcagtgcggcccggcggaagatggcgagctggcgcgggcggcgggctttgtcgatggctggctggcccaggcggcggcgcaggccgggcagcggctgggccgggcgctggcgcgcctggagcgagccaagcgcttttggtga

SEQ ID NO: 942 - DNA, 765 bp, Chromobacterium substugae
atgggcttgctagaccgtaaaactgccatcatcaccggagccagctccggcatcggccgcgaggccgccctgctgttcgcccgcgagggcgccaaggtcgtcgtcgtggcgcgccggggccacttgctggatagcctggtggacgaaatcgccgccgccggcggccaggccgccgcgctggccgcggacgccagcgacgagcgcgccgcccaagcgatggtggaactggcgctgggccgtttcggcgccctggacatcgccttcaacaacgccggcgcgctgggcgcgcccggcagcctgcccgatctggcgctggacgactggcgccgcacgctggacgccaacctcaccagcgccttcctctgcgccaaataccagattcccgccatgctgaaacaaggcaaggcctcgctgatcttcacctcgtccttcgtcggccacgcggtgggcctgccgggcatggcggcctacgccgccgccaaatccgcgctggttggcctcaccagatcgctggcggcggagtatggcgcgcaagggctgcgggtgaacgccctgctgccgggcggcaccgataccgagatggggcaggcggcgacgccgaccgcggagcagcgcgcctgggtggaaaacctgcacgcgctcaaacggctggccagcccggccgaaatcgccggcgccgcgctgtacctggcatcggacctgtccggcttcaccagcggcgcggcgctgttcgcggatggcggcgccagcagcgcccgcggctaa

SEQ ID NO: 943 - DNA, 1299 bp, Chromobacterium substugae
atgccttacacccaactcatccgccggctcgccccgctgccccacctcggcaaatggctgttgctgtccggcatagtggccgcgctcgccggctgcgcatccgctttcttcctgctggcgctggactgggccagccgctggcgcctggcccatccggcggccatctggctgctgcccgtcgccggcttcgccgtcggctggctttacctgcgcttcggccgggaagtggaggccggcaataatctgctgctggatgaaatccacgatccccgccgcatcatcccgttgcggatggcgccgctggtgctggcgggaaccatcgccacccatttgtgcggcggctcggccggacgggaaggcaccgcggtgcagatgggcggcgcgctggccgaccagctcaaccgctggctgccgctgcggccggcggaccgcggcatcctgctgagcgccggcatcagcgccggtttcgcctcggtgttcggcacgccactggccggcgccgtcttcggactggaagtgctggccatcggacagctgcgctacgacgccatcctgccctgcctgctggccgcggtggccgccgacaggctgggcttggcgctgggcatccagcacagccattacgccattccctttgtcccgcccctgaacgcctggaacatgctggccgcggtgctggcgggcgtcgccttcggcctggtcgccaggctgttctccagcgcgacccacgccgtcggcggagcgttcaaacgcttcatccgctacgcgccgctgcggccattggccggcggcgccatggtggccgccgccgccagcctgctcccggccgacgcgtatctcggcctgggcctgcccactctcgccgccgctttccagcagccgctgcccagctacgacttcgccggcaagctggccttcaccgcgctgaccctgggcgccggcttcaagggcggcgaggtgacgccgctgttctatatcggcgcgacgctgggcaacgcgctggcgccgctgctgcagctgcccttccccctgctggccggcatgggcctcgccgcggtgttcgccggcgcggccaacacgccgctggcctccaccgtgatggcgatggagctgttcggccccgaagccggcgtctacgccgcgctagcctgcgtggtcagctatctgtgctccggccacgccggcatctaccgcgcgcagcgggtggcccaggccaagcacggcgcgttgccggcgcaaatccggctggccgatctgccagcctggcgcgcggcgcgatcctccgcccggccggattga

SEQ ID NO: 944 - DNA, 192 bp, Chromobacterium substugae
gtggggcagcggggcgagccggcggatgagttgggtgtaaggcatggaagtccatcgtctgatcgcattgaacaaacctggacaggagaaaaccggggcgcgcccacagcttccctggccagggaacgctgtaggcatcatcagcccttgtgggcggttggcggaggaatgccatctccatctgaagcgtag

SEQ ID NO: 945 - DNA, 1998 bp, Chromobacterium substugae
atgcatccgatgcaagtggtgcagcccttcctctttaaggcagttccatgcgtacaaggagccgatatgagttatctgcagtttccccggctggcgttcgccggcagtttccaggccgatgtctccaccgtcaacaacgacccccgccactacgacatcgacaatttcgagcccgcgttccaggatttccagaccaagcagtcgtacaacggctggtggcatcccaccggcaccgccatcatgcgtttcgccgactgccaggtcaccagcctgcgcgggccggacggcgtgctgatcactgaatccgggctcgacccgctgctgtcctgtacggtgggcaacgccatcggcaagccttcaggcaagatggtggatctggatccggactggcagctggcgtccaatctctatggcctggcggtatcgctgctcaggccggacggcacgcccatcatgaccgccgactacgaaagcaacccgtttcgcgacctgtggttcacccgcggcagcggtggcggtgacagcggcgcttcggcgatgtttcagtcggtgctgacgaatgtcgagtggcatctggacgatttcgacagtcccctgctggatcagttgatccgggtcagcgagcaggggcggctatctgtccgcctgagcacctatggctacaatatggacgcgtccaacccgcgcttcggctacggcacggtgctgggcgccatcggtcctgtccatgcgggacagccgcgctccttcatcctggggcgccgtttcatgcccactacccagcagggcgccgatctggtcagcagcaacggcatcggctgtttttcctcttatatagacagcgccagcggcagcttgcaggtggacctgagcaacgccttgccgctggggccggataaccaggtcaagtacctgggcgttttgcagtacgcgatcctgaaaaacgcgttgaccgcgcaggacgccgaaatcgggccgggcgattacatttacctgggaacggtggacacttcgcaggcgctgcagaatgtgcaggctggcatccagtcgctgccgctgagcggcgatgccttgcgccagaccgagggccagccgctggccatcatccagatcaacgacagcaacggcaacgcgcaggtctgcgtgcgcgaggcgctgctgggtaatgaggtgagggtcgaggacttcgccactcggctggaccccaacgatccggcgaaaaaccgcctcgtcaccaccctgtacgcggctacctacggccagccggcggcgggggcgagaatggagttctgggcggcgggcccggcgctggattacgacaacacgcccaccagcccggatgccgccaccacgccgcgggcgctgctgcccgtcaacaatgtgcccggcggcgcgatccgcatcgagccgcgcgaagtggtgaccggcgccgatggcaccgcgcagttcacggtgcacggccccgagttcatggcgacgccgcgcgaatacatggacggccagttgttcaccatcaattacaacttcgccggcgacaatccggcggtgcagcaaccttacgacaatctggcgctcatggtgttcagcacctatccgcagcctgggcagcaggtgaacctggaacacccgcgctgggacgatgtgcaacccatcctgcagcagtatgccaatctctatccggtgatgagccagggcttgttcgacttttccaagcagggcgtggccgatgcctgcgccgccatcatgcgcttcgtgttcgacaagccgatcgaggatccggaccagatgccggtcacccgcgacctgtcgtccagcaagcggcggatgctgatcaattactttcaggatgtgatggaccgcaccggcaacaccatggaccggcaactgatgttcggcaaacgttgtccgttgcggcccagcgcgatgcccggcgaggcggacatcgccgccgcgcgcgccgcgcccaccgccagcaagagccgcaaggccggccgctga

SEQ ID NO: 946 - DNA, 1104 bp, Chromobacterium substugae
atgctgaaaattcgtccagaattgatggccaagctgcgcgcggccgcttccgttgaggatgtgcgggaaatgctggccggcgcggtgcggctggaactggccaccatcccgccttacctgaccgcgcagttctcggtgatgccgggccagaaccaggcgtcgcgcgcgctggtgcagtcggtggtggtggaggaaatgctgcacatgacgctggcggcaaatgcgctgatcgcgatcggcggcaacccggacatcgtggcggacggccgcagcctgcagtatccggggccgctgccgatgtgcgtcgacgaggggctgacggtaacgctgaagtcattgacccggctgcaggcgttcgaggtcttcatggcggtggagcggccggataccgaggccatcctgccgggcgagacggcgccggaactggccgacaactccggctacgagtctatcggcgacttctatatggccattctgcacaagctggaagaactggtggcagccggggtgccctgtttcgcccgcccgaggctggagcaacaagtggatatcagcaagtggttccctcccgaggtgccaggccatccggaaggcaaggtttacgatatcggctccgcccgggcggcgatcatgaccatcgtccgccagggcgaaggcctgcagatccaggacgacaagatcaacccaaaggaagacccgagaggcggctacgcccattacttcaagtttggcgagatctattacggcaagcgcctggtgcgcgacccggccagcgtgtccggctggtcgtacagcggagaaccggtgccgctggatgaaaccggcgtttatccgctgctgcccaacgccgccttgtccgactacgccaagggcagcggcgcggcggtcagcggcacgcagttctaccaagcgtatcaaaacctgctggtggcgctgaaccgcaccttcaacggcgagccgaatcagctggatgccgcgctgggcatcatgtacgagttgaagctggtggcgcagaaagtgatgcagaacctggccaaccctgacgtgcccggcgtgctggcggctccgccgttcatgcgtacccatcatcctgacgaagagtga

SEQ ID NO: 947 - DNA, 1475 bp, Chromobacterium substugae
gaactgaagagtttgatcctggctcagattgaacgctggcggcatgctttacacatgcaagtcgaacggtaacagggtgcttgtgttaccgttcgacttgcatgtgtaaagcatgccgccagcgttcaatctgagccaggatcaaactcttcagttcaatctcatagcaaattttctggcacgcaagttcaaagaaataaacaagtatctcttgtctcttgcagtgcaagtttttggctttcgccaaacacttacacctatcggttattctgtctgttaaagagcggtgccgatcgctgcgtcgccatcaccggaaccgtttcgtttccgccgtttcgttcgctgcgtcagctgaggaggcgaactatacccccgggacccacacccgtcaacacctttcgccacaaaaaatgaactttcttcgaccggcccgcgcaaggtattgatttgcaagaaaagccgtgagaaagaatttcaggcccgcagccattgcggcaagaaaaccgccacagtcggacctggctggccaccggaaatgcggcgtcggctacgcgccaacaggcgattctgctacgcttccatgcgtttggcacgcaacgtgcctgccgtggacactctatatatgctcaaattcgatgtgctgattatcggcagcggcctggccggcatgacgctggcgctgcatctggcggaaaaacgcaaggtgggcctgatcaccaaacgcgacctgctggaaggcagctccacttatgcccaaggcggcatcgccgccgtgctggataccgacgactcggtggaagaccacatccgcgatacgctgatcgccggcgccggcctgtgcaatgaagacaccacccgcttcatcgtcgagcactccaaggaggcgatagactggctgatcgagctgggcgtgcccttcacccgcgacgacgagcatcagaccggttatcacctgacgcgcgaagggggccacagccatcgccgcatcatccatgccgccgatgccaccggcgccgcggtgaccagcacgctgggccagaagatcaaggcgcatccgaacatcaccgagctggaacactatatagcgatagacctgatcacgtcgcagaagctgggccaggacggcaagcgcgcttacggcgtctacgccttggacaagaacagcgacgaggtcgtcaccatcgccgcccagcacaccatcctggcgtccggcggcgccggcaaggtttacctctataccaccaatccggataccgccaccggcgacggcatcgcgatgggttggcgcgccggctgccgcgtcggcaatatggagttcatgcagttccatccgacctgcctgtaccatccgcattccaaatccttcctgatcaccgaagccgtccgcggcgaaggcggcattctgaaactgccggatggcacccgcttcatgccgcagcacgatccgcgcggcgagctggcgcctcgcgatgtgg

SEQ ID NO: 948 - DNA, 1475 bp, Chromobacterium substugae
  modified_base (504)..(504): a, c, t, g, unknown or other
gaactgaagagtttgatcctggctcagattgaacgctggcggcatgctttacacatgcaagtcgaacggtaacagggtgcttgcaccgctgacgagtggcgaacgggtgagtaacgcatcggaatgtaccgtgtaatgggggatagctcggcgaaagccggattaataccgcatacgccctgagggggaaagtgggggaccgtaaggcctcacgttatacgagcagccgatgtctgattagctagttggtgaggtaagagctcaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgttcgggaggaaatcccgctggttaatacctggcggggatgacagtaccggaagaataagcaccggctangcggaaacgaaacggttccggtgatgacgacgcagcgatcggcaccgctctttaacagacagaataaccgataggtgtaagtgtttggcgaaagccaaaaacttgcactgcaagagacaagagatacttgtttatttctttgaacttgcgtgccagaaaatttgctatgagattgaactgaagagtttgatcctggctcagattgaacgctggcggcatgctttacacatgcaagtcgaacggtaacagggtgcttgtgttaccgttcgacttgcatgtgtaaagcatgccgccagcgttcaatctgagccaggatcaaactcttcagttcaatctcatagcaaattttctggcacgcaagttcaaagaaataaacaagtatctcttgtctcttgcagtgcaagtttttggctttcgccaaacacttacacctatcggttattctgtctgttaaagagcggtgccgatcgctgcgtcgccatcaccggaaccgtttcgtttccgccgtttcgttcgctgcgtcagctgaggaggcgaactatacccccgggacccacacccgtcaacacctttcgccacaaaaaatgaactttcttcgaccggcccgcgcaaggtattgatttgcaagaaaagccgtgagaaagaatttcaggcccgcagccattgcggcaagaaaaccgccacagtcggacctggctggccaccggaaatgcggcgtcggctacgcgccaacaggcgattctgctacgcttccatgcgtttggcacgcaacgtgcctgccgtggacactctatatatgctcaaattcgatgtgctgattatcggcagcggcctggccggcatgacgctggcgctgcatctggcggaaaaacgcaaggtgggcctgatcaccaaacgcgacctgctggaaggcagctccacttatgcccaaggcggcatcgccgccgtgctggataccgacgactcggtgg

SEQ ID NO: 949 - DNA, 1475 bp, Chromobacterium substugae
  modified_base (332)..(332): a, c, t, g, unknown or other
gaactgaagagtttgatcctggctcagattgaacgctggcggcatgctttacacatgcaagtcgaacggtaacacaagcaccctgttaccgttcgacttgcatgtgtaaagcatgccgccagcgttcaatctgagccaggatcaaactcttcagttcaatctcatagcaaattttctggcacgcaagttcaaagaaataaacaagtatctcttgtctcttgcagtgcaagtttttggctttcgccaaacacttacacctatcggttattctgtctgttaaagagcggtgccgatcgctgcgtcgtcatcaccggaaccgtttcgtttccgcntagccggtgcttattcttccggtactgtcatccccgccaggtattaaccagcgggatttcctcccgaacaaaagtcctttacaacccgaaggccttcttcagacacgcggcatggctggatcaggcttgcgcccattgtccaaaattccccactgctgcctcccgtaggagtctgggccgtgtctcagtcccagtgtggcggatcatcctctcagacccgctactgatcgtcgccttggtgagctcttacctcaccaactagctaatcagacatcggctgctcgtataacgtgaggccttacggtcccccactttccccctcagggcgtatgcggtattaatccggctttcgccgagctatcccccattacacggtacattccgatgcgttactcacccgttcgccactcgtcagcggtgcaagcaccctgttaccgttcgacttgcatgtgtaaagcatgccgccagcgttcaatctgagccaggatcaaactcttcagttcaatctcatagcaaattttctggcacgcaagttcaaagaaataaacaagtatctcttgtctcttgcagtgcaagtttttggctttcgccaaacacttacacctatcggttattctgcctgttaaagagcggtgccgatcgctgcgtcgtcatcaccggaactgttttgtttccgctgtttcgttcgctgcgtcagctgaggaggcgaactatacgcccgggacccacacccgtcaacacctttcgccacaaaaaatgcaaaaagatggcggaagaacacgcaaaccattgataaaccatcaatatgacacaaaaagaatttcagctcttcatgaaaaacgccgcgatccgcggcgttttcgctgcactccgtgccctgctacgcggcctcaaggctgcgcgggagcggccggcggcttcagatagggcagaaaagcgtccaccacttccggcgcgtccggtttcgtgcgggtggagatgctcaccaccttgctcgcgcccggcaggatcaggtacttgtggaagttccacaccggcgcgtcgtcggtggcggcgatcaacgccttgaagaaaggctgcgcgtcgccgccgcgcacgtggcccttgccggccatcggaaaggtcacgccgtaattggcctgg

SEQ ID NO: 950 - DNA, 363 bp, Chromobacterium substugae
atgtcttatatcaacctcaccgccgacaatttcaacgccaatatgagggaagaagggttggtcatcctggacttctgggcgccgtggtgcggcccgtgcaagatgttcggcccggtgttcgaggcggcggcggaaaagcacgccgacatcgtgttcggcaagatcaataccgaagacgagcgcgacctggccgcccacttcaatatccgctccattccgacgctgatcgccatcaaggatggcatcatggtcttcaaccaggccggcgcgatgatgggcgcgcagttcgagcagttgctgcagagcctgcgggacttggacatggacaaggtgcgcgcggaaatcgccagccagccggaatga

SEQ ID NO: 951 - DNA, 1203 bp, Chromobacterium substugae
atgatccaactcgacttctacggcacgctggtggccgcctcgctggtcctgctgctggggcgcaaactggtcgcccatagcggcgcgctgcgcacctacaatatccccgagccggtggccggcggcctgctggtcgcggccgccttgctggcctcgcggcagttttccggtgtggaggtgcgcttcgacgcctcgctgcaaacgccgctgatgctggccttcttcgccgccatcggcctgaccgccaacctggccagcctgaagcagggcggcaagtcggtaggcatcttcctcggcgtggtggtgggcctgctgttggtgcagaacaccttgggcgtggcggtggccagcgcgctggggctggacccgctgatgggcttgctggccggatcgatcaccttgtccggcggccatggcactggcgccgcctggagcggcaccttcgccgacaagtacggcttggcctccgccgccgaactggcgatggcttgcgccaccttcggcctggtgctgggcggcctgatcggcgggccggtggcgcgctttctggtcaagcgggtgaatacgccgggcgccgagcacaacgccgatcagccgccgcaaggcttcgagcagccggacgcgcagcggctgatcacgccgcattccttcatcgaaacgctggcattgatcgcggtctgcctgctgggcggcacttttctcggcggcctgctgaaaggcacggctttcgagctgccgactttcgtctgcgtgctgttcgtcggcgtgctgatcagcaatggcttggcggcgctgggttggtacaaggttttcgagcgcgaggtatcggtggtgggcaacgtcagcctgtcgctgttcctggcgctggcgctgatgtcgctgcggctgtgggacctcgcggcgctggccttgcctatcttcgccctgttgctgctgcagacgctggcgatggctttgtacgccgtgttcgtcaccttccgcgtgatggggcgcaactacgatgccgcggtgctggcggccggccattgcggcttcggcctgggcgcgacgcccaccgccatcgccaatatgcaggcggtgaccgagcgcttcggcccctcgcatctggcctttctggtggtgccgatggtgggcgctttcttcatcgacatcgtcaacgccatcgtgatcaagctgtacctggctttgcccttcgtcggctga

SEQ ID NO: 952 - DNA, 114 bp, Chromobacterium substugae
atgaatcaggaaggcatggaggcgctccacatcccgccgctggcgcggcgaggcggcgcgaaggccgccggctggctggtcggcgactccatgcggaaacgcgctttcttatag

SEQ ID NO: 953 - DNA, 945 bp, Chromobacterium substugae
atgcaggatgtcagcgccttcgccaaccgtctggccaagaattacaagcattacgccaaatgggcgcgccgccaggggctggacgcctggcgcgcctacgacaaggacgtgccgcagttcccgttcgcggtcgacatctacggcggcaaggtgcatctgcaggagtacgacaccggctgggaaatggccgacgacgactaccgcgcctggatagacgcggtggtggcggctatcgagcaagtgaccggcattgccgctgccgccgtcacgctgaagaaccgccgccgccagaagggcgtcagccaatacgaaaaggtgggccgcgagggtgacgatttcatcgttgaggaattcggccagcgcttcatcgtcaatctggaccgctatctggacacaggcctgtttctcgaccaccgcaacacccgcaaacgggtgcgcgaagaggcggcaggcaagcgcttcctcaatctgttcgcttataccggcagcttcaccgtctacgccggcgccggcggcgcggcgtcgtccgagacggtggacatgtccaatacctaccaggactggtcgcgccgcaatttcgagctgaacggcctggactcgtcccggcacaagctggtgcgcgccgatgtgttccagtatctggaagaggcggtggacgccggcaagcagttcgatctgatcgtgatggacccgcccaccttttccaactccaagaagatgcgcgacatcctggacgtgcagcgcgaccacgtctggctgatcgactacgcgatggcgctgctggcgccgggcggcaagctgtacttctccaacaacctgcgcagcttcgcgctggacgagcgtctgcgcggcgattatcagatccgcgatatcagcgagcagtcggtgccggaagacttccgcaaccgcaagatccaccagtgctggcagatcagccgcggctga

SEQ ID NO: 954 - DNA, 483 bp, Chromobacterium substugae
gtgtatgccggaagcttcgatccggtgaccaatggccacctgtggatgattcgcgaagccgtggaactgttcgacgaactcatcgtggcggtcggggtgaacccggacaagcactgcaccttcgatgtcgaacagcgggtggggctgctgcgcgaagtcaccgccggcttcagcaagctgcgggtggacgtgtttgaaaaccagtttctggtcaactacgcgcaaagcgtgggagccaattacatcgtgcgcggcatccgcaccgccagcgactatgaatatgaacgcacgatgcgctacatcaactccgacctgcacccggacatcaccacgctgttcctgctgccgccgcgcgaatacgccgaggtgtcgtccaccatggtcaagggcctggtggggccgcgcggctgggaagggatgatccgccaatacctgccggagccggtctatcgcaagatgctggcgatgtattcgcagcaatag

SEQ ID NO: 955 - DNA, 408 bp, Chromobacterium substugae
atgcatgtgtatccgtatctcaatttcaacggacgcgccgaagaggcgctgcagttctaccgcgaggccttgaacggcgacatcgcgatgctgatgcgttattcggacgcgccgaaggacacgccgccgatgggcgatatcgacccgaactgggtgatgcacgcccggctggcgttcggcgccaatgtgctgatgatttccgacaccgaccggccggcgccgcccagccagcagattgtgctgtcgatcaacctggacggcgacaccgcggcggcggagaaggctttcgcggcgctcagcgccggggggcaggtgacggtgccgctgggcaagactttttggaatgcgctttttggctgttttagtgataaattcggcgtcaactggatgatcaactgccagttgtga

SEQ ID NO: 956 - DNA, 972 bp, Chromobacterium substugae
atgactagcgttttgcaagcgcgggacctgacccgttactacgatgtggcgcagggctggctcaagcccaaggcgcaggtgaaggcgctgggcggcgtatcgttcgaattgtcggccggccgcacgctggcggtggtcggcgagtcaggctgtggcaagagcacgctggcgcgccaattgacgctgatcgagcagccgacttccggttcgctgatcctcgacggccaggatgcggccaaggccggcggcgccgagctgaaggcgatgcggcgcaaggtgcagatggtgttccagaacccgtacggctccctgaatccgcggcagaaaatcggcgaccagctgtccgagccgctgctgatcaataccgagctgtcggcgaaggagcgggaagagaaggtcaggggcatgatggcccgcgtcggcctgcgtccggagcactacttccgctatccgcacatgttctccggcggccagcgccagcgcatcgccatcgcccgcgcgatgatgctgaaccccaagatcgtggtggcggacgagccgacctcggccctcgacgtatcgatccaggcgcaggtgttgaacctgttcatggacctgcaggaagagttcaacaccgcctatgtgttcatttcgcacaacctggcggtggtggagcacgtggccgacgacctgatggtgatgtatctgggccgcgcggtggaggtgggcgccaaggaccgcgtctacgaccggccgctgcacccgtacacccaggcgttgctgtcggcgacgccgtccatccatccggaggaccgccgcgtcaagatcaagatcgagggcgagctgcccagcccgctcaatccgccgtccggctgcgccttccacaagcgctgcccgcatgccaacgagcgctgcaagagcgaggtgccgcagctgcgcgagctggatgcgcggatggtggcctgccaccgcgccgaggagatcaacggctag

SEQ ID NO: 957 - DNA, 981 bp, Chromobacterium substugae
atgagtctgttgcgaatcaagaatctgtcggtggagttcggcgccgagaaaaatcccttccgcgcggtggaggggctggacctgactgtggcgcaaggggaaatcgtcggcatcgtcggcgagtccggctccggcaaatcggtcaccatgatggcgatgatgggcctgttggaaggccagggccgcatcgtcgccgacgagctgagcttcgacggcaaagacttgctgaccatctccgcgcgcggccgccgcaagatcgtcggcaaggatatctcgatgatcttccaggatccgatgacggcgctgaatcccagctataccgtcggctaccagatcatggaagtgctgaaagtgcaccagggcctgcgcggcgccgccttgaaagcgcgcgcgctggaactgatgcagcaggtggagattccggccgcggcttcgcggctggacgcctatccgcaccagctgtccggcggcatgagccagcgcgtggccatcgcgatggccatcgcctgcaaccccaagctcctgatcgccgacgagccgaccaccgcgctcgacgtcaccatccaggcccagatcatggagctgctggtgagtctgcagaagagccagaacatggcgctgatcctgatcacccatgatctggccgtggtggccgaagtcgcgcagcgcttggtggtgatgtacgccggccagtcggcggaggtgggcggcgtgcccggcattttccgccagccggcccatccgtataccgaggcgctgttgtcgtcgattccggagcacagcaagggcgcgcgccggctggcgacgttgcccggcatcgtgcccggacaatacgaccgtccgagcggctgcctgttgtcgccgcgttgtccgtatgtgcaggagaactgccgcagccagcggccgggactcacgccgcagccgaatggcgcggtgcgttgccactacccgttgctggccaaggagaagcagcatgactag

SEQ ID NO: 958 - DNA, 915 bp, Chromobacterium substugae
atgagccaaaccaagcaaaacgcggccccggccgacctggcgctgtcttatccgtctccgctgaaggagttctggcagggcttttcccacaacaagggcgcggtcgccggcctgatcttcgtgctgttcatcgtcgcctgtgcgctgttggcgcctgtcatcgcgccgtacagcccgatcgagcagtaccgcgaccacatgctgaccccgccggcctgggaggccggcggcagcgtgcagttcctgttcggcaccgacgagttgggccgcgacatcctgtcacgcttgatccacggcgccagactgtcgctgttcatcggcctgatgtcggtgctgatggcgctgatccccggcgtggtgctggggctgttggccgcctttttcccgaaggcgctgggcgcttccatcatgcgcttgatggacatcatgatggcgttgccgtccctgctgctggcggtggccatcatggccatcctcggccccggcctgaccaacgcgatgatcgccatcgccaccgtgtcgttgccggcttacgtgcggctgacccgcgcctcggcgatgaccgagctgaaccgcgactacgtggtggcttcgcgggtggcgggcgccggcctgttccggctgatgttcgtcaccgtgctgcccaactgcatggccccgctgatcgtgcacgccaccatgagcttttcctcggccattctcgaaatcgccgcgctgggcttcctgggcctgggcgtgcagccgccgaccgccgagtggggcaccatgctggcctcggcccgcgattacatcgagagcgcctggtgggtggtgacgctgccgggcctgaccattctgctgtcggtgctggcgatcaacctgatgggcgacggcctgcgcgacgcgctggatccgaagctgaagcgcgccgcctga

SEQ ID NO: 959 - DNA, 1029 bp, Chromobacterium substugae
atgtttgcattcattctgcggaggctgggcctgctggtgcccaccttcttcggcatcacgctgctcacgttcggcctgatccgcatgattcccggcgacccggtggaagtgatggtgggcgagcgcacgctcgatcccaaactgcacgccgaggcgctgcatcgtctggggctggacaagcctttgtacgcgcaatatttcgactatgtcaccaaccttctgcacggcaatctgggtgaatcgctggtgaccaaggtgggcgtctggaccgagttcaagaccctgttcccggccacgctggagctggcgctgtcggcgctgttgttcgccgtcgtctggggcttgctggccggcgtgctggccgcgatcaagcgcggctcgctattcgatcacggcgtgatgggcatttcgctgaccggtttctcgatgcccatcttctggtggggcctgatcctgatcatgttcttctcggtcaagctgggctggacgccggtgtcgggccgcatggacctgatgttcgacatccatccgcgcaccggcttcatgctgatcgacagctatctggccgagatggccgatccggaaggcaacgccggcgcgttcaagagcgcgctgagccacctgatcctgccgtccatcgtgctgggcaccattccgctggcggtgattgcgcggatgacccgctcgtcgatgctggaagtgctgcgcgaggattacgtgcgcaccgcgcgcgccaagggcctgtcgcccgcccgcgttatcttcatccatacgctgcgcaacgcgctgatcccggtgctgaccgtaatcggcctgcaagtgggcacgctgatgggcggcgcggtgctgaccgagaccatcttctcctggcccggcatcggcaaatggctgatcgacgccatcgcccgccgcgactacccggtggtgcagaacggcattttgatggtggccacgctggtgatcgtcaccaacttcatcgtcgacatcctgtacggcatcgccaacccgcgcatccgtcacgccaagtaa

SEQ ID NO: 960 - DNA, 1596 bp, Chromobacterium substugae
atgcaagctttcaagaagctgctggttgctggcgtggtcgcgggctcttcattggcggcgcatgccgcgggtactctggtgttctgctcggaaggcagtccggcgggtttcgaccccggccagtacacgaccggcaccgacttcgacgcctcggccgaaaccgtattcaaccggctggtgcaattccagcgcggcggcaccaaggtagtgccgggcctggccgaaaaatgggatgtttccgctgacggactgtcctacaccttccatctgcgcaagggcgtgaagttccagaccaccgactacttcaagccgacccgcgatttcaacgccgacgacgtgctgttcactttcaaccgcatgatcgacaagaaccatccgttccgcaaagcctacccgaccgagttcccgtacttctccgacatgagcatggacgtgaacatcgtcaagatcgagaagctcgatccgtataccgtcaagttcggcctgaaaaaggtggatgccgccttcgtgcagaacatggcgatgagcttcgcctccatccagtcggccgagtatgccgacaagctgctgaaggatggcaagccgcagctgatcaaccagcagccggtcggcaccggcccgttcatcttcaagcgctaccagaaggacgcgcagatccgtttcgtcgccaacaagcagtactgggacaaagtggatggccccaaggttgacaacctggtgttcgccatcaccaccgacgcctcggtgcgctaccagaagctgaaggccggcgagtgccagatcaccaccttcccgcgcccgaccgacatcccggcgatgaaggcggatccgaaaatgcacgtgatctcgcaagcaggcttcaatctgggctatctggcttacaacgtccggcataagccgatggacaagctggaagtgcgccaggcgctggacatgtccatcaacaagaaggccatcctgcaagcggtgtaccagggcgccggccaagccgcgaccaacccgatgccgccgacccagtggtcgtacaacaagagcctgaaggacgcgccgtacgatgtggccaaggccaaggcgctgctggccaaggccggctaccccaatggtttcgagatcaccttgtgggcgatgccggtgcagcgcccgtacaatcccaacgccaagctgatggccgagatgatccagtccgattgggccaagatcggcgtcaaggccaagatcacttcctatgaatggggcgaatacatcaagcgctccaaggcgggcgagcatgatgcgatgctgatcggctggaccggtgacaacggcgatccggacaattggctgagcacccagctgggctgcgaggcgctgaacggcaacaacttcaccaagtggtgctacaagccgttcgaagacctgatccagaagggcaagaccaccgccaacgtcgccgaacgcaccaagctgtacatgaaggcgcaggagatcgtgaagcagcaactgccttacaccaccatcgcgcactccaccgtcaaccagccgatgctgaagtcggtgcagggcttcaaggtcagtccgttcggcatgaactccttctacggcgtcagcatcaagtaa

SEQ ID NO: 961 - DNA, 1122 bp, Chromobacterium substugae
atgcataaggttgttatcagcgggactggcctgttcaccccgccccatgccgtcggcaatgccgagctggtggaggcgttcaacgcctacgtccgcgacttcaatgccgccaaccgggcggccatcgacgcgggagaggtggcggaactggccgaatccagcgccgaattcatcgaaaaggcctccggcatcaagcagcgcttcctgatggacaagggcggcgtgctggatccggcgcggatggcgccgcatctgccggagcgcggcaatgacgaattgtcgctgcaggccgagatggctgtggccgccgcgcgccaggcgctggaagccgccggccgcgccgccgccgacatcgacatggtgatcgtcgcctgctccaatatgcagcgcccgtatccggcgatggcgatcgaggtgcagcaggcgctgggcatcgccggcttcgccttcgacatgaacgtcgcctgctcgtccgccaccttcggcatccagaccgcggtcggcgccatcgccaccggccaggcgcgcgcggtgctgatggtgaacccggagatctgctcggcccacctgaacttccgcgaccgcgacagccacttcatcttcggcgacgcctgcaccgcggtggtgctggagcgcgccgacgcggccacttcggcgcagcgtttcgaagtgctgggctgcaagctggccacggtgttctccaacaatatccgcaataacttcggcttcctgaaccgctgcgacgaggccggcgtcggccagccggacaagctgttcattcagcaggggcgcaaggtattcaaagaggtgtgtccgatggtgggcgagcacatcgtcgcgcatctgggcagcctggacatcgcgccggagggcgtgcgccgtttctggctgcaccaggccaacctggcgatgaaccagctgatcgccaagcgagtgctgggccgcgaggccgacaatgtggaggcgccggtgattctggatcgttatgccaacaccagttcggccggctccatcatcgccttccatctccattcgcatgatcttgcggctggggatgtcggcgtcatttcttctttcggcgcgggctattccgtcgggtcggtggtgctgaagaagcgatag

SEQ ID NO: 962 - DNA, 162 bp, Chromobacterium substugae
atggggcggggtgaacaggccagtcccgctgataacaaccttatgcatgttgatttgtcctttttcacccgcgggcgcgggagcaaacatggcggccagcctatgcggccgaatattgccgcgattttacacaagcccccgcaaaaagtaagaaatccatag

SEQ ID NO: 963 - DNA, 483 bp, Chromobacterium substugae
atgcgcctcaccaccaaaggacgttttgccgtcacagccatgctggacctcgccatgcgcgaggaaggcggcccggtcacgctggccggcatcagcgaacgccaaagcatctcgctgtcctatctggagcagctgttcggcaagctgcgtcgcgccgagctggtcgacagcgtgcgcggtcccggcggtggctacacgctggccaaggagacgcacgaaatcacggtggccgacatcatcgtcgccgtggacgaaccggtggatgccacccagtgcggcggacgcgaaaactgccgcggcagccagcgctgcatgacccatgacttgtggaccaacctcaacgtcaccatattcgactacctctccaaggtgagcctggccagcctggtcgccgagcagcacgccaaggagaccagcgtggtgcaggacaagcgcgatagctgtagcacccctcaccttgccgctgccagccgagccctgtaa

SEQ ID NO: 964 - DNA, 1218 bp, Chromobacterium substugae
atgagccagcccaagctgccgatctatctggattactctgccaccacgccggtggacccgcgcgtcgccgaaaaaatgattccctacctgaccgggaagttcggcaaccccgcctcgcgcagccacagcttcggctgggaagcggaggaagcggtggaaaacgcgcgcgcggaagtggccaagctgattggcgccgatcccaaggaaatcgtctggacctccggcgcgaccgagtccgacaacctggcgatcaagggcgccgcccagttctacaagagcaagggcaagcacctcatcaccgtcaagaccgaacacaaggcggtgctggacacctgtcgcgaactggagcgccagggcttcgaagtcacctatatggacgtgcaggaaaacggcctgctcgacctggaggccttcaaggccgccatccgcccggacaccatcctggtgtcggtgatgtatgtgaacaatgaaatcggcgtgatccaggatattccgcaaatcggcgaaatctgccgcggaaaaggcatcatcttccacgtcgacgccacccaggcgccgggcaaggtcaagatcgacctgaacacgctgaaagtggacctgatgagtctgtccgcgcacaaggcttacggccccaagggcatcggcgcgctgtacgtgcgccgcaagccgcgcgtgcgcctggaagcgcagatgcacggcggcggccacgagcgcggcttccgctccggcaccctggccagccaccagatcgtcggcatgggcgaagctttccgcatcgcccgcgaggaaatggacggcgaatgcgaacgcatccgcatgctgcgcgaccgcctgtggaacggcatcaaggacatggaagaggtctacatcaacggcgacatcgaccagcgcgtgccgcacaacctcaacgtcagcttcaacttcgtcgaaggcgagagcctgatcatggccatcaaggatctggccgtgtccagcggctcggcctgcacctccgcctcgctggagccgtcctacgtgctgcgcgcgctgggacgcaacgacgagatggcgcacagctcgatccgcttcacgctgggccgcttcaccaccgaggaagagatcgacttcaccatcgccctgctgaagtccaagatcggcaagctgcgcgagctgtcgccgctgtgggagatgttcaaggacggcgtggacctgaatagcgttcaatgggcggcccactga

SEQ ID NO: 965 - DNA, 384 bp, Chromobacterium substugae
atggcatatagcgaaaaggtaatggaccactacgagaacccgcgcaacgtgggttccttcgacaaaggcgacgacagcatcggcaccggcatggtcggcgcgccggcctgcggcgacgtgatgaagctgcagatcaaggtgggcgcggacggcgtgatcgaagacgccaagttcaagacctacggctgtggctccgccatcgcctcctcgtcgctggtgactgagtgggtgaagggcaagtcgctggacgaggcgctgaccatcaagaacaccgccatcgccgaagaactggcgctgccgccggtgaagatccactgctccatcctggccgaagacgcgatcaaggccgcggtggaagactataaacagaaacacggcaagtaa

SEQ ID NO: 966 - DNA, 324 bp, Chromobacterium substugae
atggcacttactctctccgaacgcgccgccgcccacatcagcgcctttatcgccaagcgcggcaaaggcctgggcgtgcgcctgggcgtgaaaacctccggctgctccggcatggcctacaagcttgaattcgtcgatgtcgccagcgacgacgacgtgcgcttcgacagccacggcgtctcgatcttcaccgacgccaagagcctggcctacctggacggcaccgagctggactacgccaaggaaggcctgaacgagggcttcaagttccacaaccccaacgtcaagaacgagtgcggttgcggcgagagcttcaacgtctga

SEQ ID NO: 967 - DNA, 528 bp, Chromobacterium substugae
atgaacaccgatttcagccaagacttcttcagcctgttcggcctgccgcgccgcttcgccatcgacagcgccctgctcgacaacgcctggcgcgctgccgcggcccaagtgcatcccgaccgctacgccgccagccccgatgccgagaagcgcagcgcgctgatgctgtccacccgcgtcaacgaggcttaccgcacgctgaaatcgccgctgtcgcgcgcccgctacctgctgcaactgtccggcgtggacacccaggaagagagcaataccgcaatgccgggcgacttcctgatggcccagatggagtggcgcgaagacatagacgatgcccgccgcgacctcgcccggctggaagcgctgtccagccggctgcgcgccgaagccaatgcactgcaggcggcgctggcacaggcgctggacagccgcgccgacttggacggcgccacggttctggtgcgaaaattgcgattcatggaaaagctggaccaggaaatcggcgacgccatcgaaagcctgctggactga

SEQ ID NO: 968 - DNA, 1797 bp, Chromobacterium substugae
gtgggcatagacctgggcaccaccaactcgctggtcgccaccgtaaaaagcggctccgccgtcgtgctgccggacgagcacggctgcagcctgctgccgtcggtggtgcgctacgtcgacgaaggcgaaccggaagtgggctacgaggcgcagcgcgaacaaaaccgcgatccgcacaacaccatcgtctcggtcaaacgcttcatgggccgcggcctgtccgacctgaaagacgccggcagcctgccctaccgcttcgtcgacgcccccggcatggtgcaactgcacacccgcgccggcgtgaagagcccggtggaagtgtcggccgacatcctgcgcgcgctgaaggtccgcgccgaagcgagcctcgccggcgagctgaccggcgcggtgatcaccgtgcccgcctatttcgacgacgcccagcgccaggccaccaaggacgcggcccgcctggccggcctcaacgtgttgcgcctgttgaacgaacccaccgccgccgccatcgcctacggcctggacaacggcagcgaagggacttatgtggtgtacgacttgggcggcggcacgctggacgtgtccattctcaagctcagccgcggcgtgttcgaagtgctggccaccagcggcgactccgcgctgggcggcgacgacttcgaccaccgcgtgttctgctgggtgctggaaagcgccggcctgtccggcctgtccgctcacgacatgcgcctgctgcacacccgcgcccgcgaagccaaggaagcgctgaccgaccacgccggcacccgcatcaccgcgatactgtccgacggccagacgctggatctggaactggaccaagccaccttgcacgccatcaccaaaacgctggtggacaagacgctgctgccggtgcgcaaggcgctgcgcgacgccaagatcacgcccgaagacattcaaggcgtggtgatggtgggcggcgccacccgcatgccgcacgtgcaaaaagccgtcgccgacttcttcggccgcgcgccgctgaccaatctggacccggacaaggttgtcgcgctgggcgccgccatccaggccaatgtgctggccggcaacaagcaggacgacgagtggctgctgctcgacgtgctgccgctgtcgctgggcatcgagaccatgggcggcctcaccgaaaagatcatcccgcgcaacagcaccatcccggtggcgcgcgcgcaggacttcaccaccttcaaggacggccagaccgcgatgtcgatccacgtgctgcagggcgagcgcgaactggtgtccgactgccgcagcctggccaaattcgtgctcagcggcattccgccgatggtggcgggcgctgcgcgcatccgcatcactttccaggtggacgccgacggcctcttggccgtcaccgcgcgcgagcaaacctccggcgtggaggccagcatcgaggtcaagccgtcctacggcctgtccgacgacgagatcagccgcatgctgaccgaatcgatgagccatgtgcaggaagacatcgaagcgcgcaagctgcgcgaagccatcgtcgacgccgacagcctggcggaagccacccgcaacgcgctggccgccgacggcgacctgctctccgacgccgagcgcgccgaggtggaaaccgcggtcgccgccatcgcccaggcgatcgccggcaatgtgacccgccgcatcaacgaggccaccgccgcgctcaaccacgccaccgaaaccttcgccgcccgccgcatggaccgcaatatccagcgcgcgctgaagggccacaagattaccgatttgtaa

SEQ ID NO: 969 - DNA, 342 bp, Chromobacterium substugae
atgccgcgcatcatcgtactgccccacgccgacctatgcccggaaggcgccgtgatagacaacgccgaaaccggccagagcatctgcgacgtgctgctggcccacgacatcgagatcgagcacgcctgtgagatgtcctgcgcctgcaccacctgccactgcatcgtgcgcgaaggcggcaactcgctgaacgaggccgacgaactggaagaagacttgctggacaaggcctggggcctggaagcccagtcgcgcctgtcctgccaggccatcgtcgccgacgaggacctggtgatcgagattccgcgctacaccatcaaccacgcccgcgaacatcactga

SEQ ID NO: 970 - DNA, 195 bp, Chromobacterium substugae
atgaaatggaccgacgtcaacgacatcgcaatcgagctggccgatgcccatccggaagtggacccgaaaaccgtccgcttcgtcgacctgcacaactgggtggtggagctgcccggtttcgatgacgaccacagccgcggcggagaacgcgtgctggaagccatccagcaagcctggatagacgaggcggaataa

SEQ ID NO: 971 - DNA, 1284 bp, Chromobacterium substugae
gtggaaacagttgaagcattgaaattcttgtcgccggaagaaatccctcatctggcagaacgctatggcacgcctctttttgtgtacgatctggacaccatcaagagaaactacgactacttcagccaaataccggcgccgtacggccttaccgtgcgctattccgtaaaggccaatccgactcgcgccatcctggcctatttcaaccagctgggcgcctcgttcgatgtcagctcggtgtgggaagcccgccgctgcgtcaatgccggcattgatgcgagcaaaatcctgatcacggcgcaggaggtgtccgcaggctgggaagaactgtgcgaagcggggatggaattcgatgccggctcgctgcagcagctgcgcgcttacggcgagaaattcccgggcggccaggtttccctgcgcatcaatccgggctttggctccggcctggtcaagaagctcaccagcggaggcgaccactccagcttcggcctgtggtacgcccagtttgacgaagccctcgcgctggccgagcgttattccctttccatcaagcgcatccacctgcacatcggctccggccatgattccggcatcctggaaaaaacggtcaatcgcgcgctggaactatgcgcccgcgcgcctggcgtcacccatctgaacctgggcggcggctacaaggtcaccgcgctgaacagcgacccccaatacgatcaccacgcggtaggcgctcgcatcagcgcttcgctggagcagttccaccgcgaaaccggacgccaactgcatctggaaatggagcccggcaccttcgccatggcattggccggctcactgatcacccgggtcatcgacgtggtcaacaccggcggcgatggctatcgcttcatcaagattgacggcggcctcaccgaactgatgcgcccgtcttactacggcgcgctgcacccattggtcgtggtcaagaaggatggctcgctgggaacccatgacgtcactccgcagatggtctgcggccactgctgcatcgccggagacagcctgacgccggtagcgggcaatacggaagatttcacgccggtgccgctggcccgcgcggaaatcaacgactatctggtggtggaacgcaccggcggctacgccgccagcatgagcgtgaaaaatttcaactcctatccggaggccgccgaggtctgccgcgccggcaaaggcagttatcacaagattcgggaacgccagaccctggagcagatgacgcagaacgagcgcgacctgcctctggagcgttga

SEQ ID NO: 972 - DNA, 969 bp, Chromobacterium substugae
gtgcagctcgcgccggtcaagggccaggatttgcgccgcaacctgccgcgcgaatacttcgttaagcgccccgccctgttcaccgccaaaatcctgttcgccttcgccctgatcgccttgggctggtacggcatctggtacgcgctgaccacacccgtcaccaccgtttcgatactggcggcggttggcggctttttcctgaacggcctgatttacgcccacctgatcgagctgcagcacgaatgcctgcactgccacgccttcaagtcggtgaagctcaaccgtctgttcggcgctctcgccggcgtattcatgttcagctcccattcgcactaccgctacgaccatctgcgccaccatgcctaccttggcacggaacgcaatctggagcacttcgactaccgcttcaatgatctcaactcgctgaccggcttcgccatcgccttcttcgacttgaaccgttacaagcgcgtattcaacatcctggccgccgccctgaccggcaagccgatagccggggtcgccaaagaggaagcccaacgccacatcaagcaggagtatctgatctacgcgctggccttcattgccagcgtgatcgcctcgctgcatttccacacctggctattcgccctggcctggtggctgccgacgctgatcatcgccgaaggcgcccacttcatgatcgagatgcccgaacactacgggctgaatacccaaaccgcgcccgatgtgctggaaaacacccgcaccatccgcaccaaccccatcatcgcctggtacgtgaacggcaaccacacccacaccgcccatcactttcaccaaggcgtgcccatgtgcaacgtcaaaaagctgaacgcgctgatcaagccgcaattgcaagtcgtggaaacctcgtacttcgcgttttattgcgatgtgatccgcggacgaatcagccaccgctacgacgcgacttgcatggccagatga

SEQ ID NO: 973 - DNA, 1119 bp, Chromobacterium substugae
atgaagaaagttggtttggtcggttggcgaggcatggtcggctcggtcctgctgcaacgcatgcaggaagagaacgatttccatggcattgatcctcactttttcagcacatccaacgccggcgccgcgggtcccgccatccatggcgccacccacctgctgaaggacgccaacgatatccgatcgctggcggaaatggacatcatcatcacctgccagggcggcgactacaccaaggcaatctacccggagctcaaggccagcggctggcaaggctactggatcgacgccgcctcggcgctgcgcatggacaaagactcctgcatcatcctcgacccggtcaaccgtccgcagattgaccaagccattcaagatggcctcaaactgtttgtcggcggcaactgttcgatcacgctgagcctgatgggccttgccggcctgatcaaggccgacttgatcgaatggatgagcctgatgacctatcaatccgcctccggcgccggcgccaaacaggtccgcgagttgatcgcccagagcggctacatcagctctcgcctggagcaggaaggcctgacgaagcaggattcgattctgccgctggtcaaacgcgtctgcgaactgatctccagcccggagctcccgaccgaagcgctgggagcgccgctgatgggcagcatcatcccctggatcgacagcgatcttggcgacggcaatagccgcgaggaatggaagggcgaggtggagaccaacaagattctcggcctggcgcccggcacgattccggtcaacggcctatgcgtgcgcgtcggcgtgatccgctgccacagcgcggccatcaccatgaagttgaagcgcgaggtcaatgaacaggaattcgccgcactggtgaaggacgcgcatccgttcgtcagctacgtgcccaataacaagcagcagagcgtcacgcagctgacccctgccgcgatcagcggttcgctcaaggtgggcatcggccgctacaagaaaatgtcgcttggacaagagcctatctattcggtgctcaccgtcggcgaccagctgctgtggggcgcagcggagccgctgcgccgcatgctgaacatcctcctcggccgcgcatga

SEQ ID NO: 974 - DNA, 846 bp, Chromobacterium substugae
atgctgttgaccggcgaagtcagccagcggctgagtcctttcatcgtctgctttttcactttcgcgctggcgacagccattttcctgtcctacaacgcgcgccatctcggatccctctggcgccgcatccgcgaaaaacgcgtgcagggcccggtgctggccatcaatctgagcagcttcgccagctggggcttgatgatctacccgctcacctatctgcagcccaccttggtcgccaccatgattctcggcatcaatccgttggctaccgccctgattacccgcctgtttctcaaacagcgctcgccggacaagctggtggtcaccagcctggccctgttcgcggtgatcgttttcctttcctaccgcagttggcaaggcgaaaacagcatccctggcacgcctcaccagcaaatcgcgctctcgctgctatgctgcgtgctctccggcatcgccacttcggtcaacaacatcctgaccaaaagaatcatgtcgaatgctttcggcatcatcgatgtgatgtgcatgcgtttttacttcaccatcctgatttccggcgtcatcggtttctccagccatcaggtggcgctcaatcaggatctggcggtttccatcctgcaaaccacgctggtattcgtggtggtgccgttgatcctgctgcagatcgctttgaagaagctggatccgctgcgcgtcgccatcatctcgccgctgatgccggtgctggtggtattgatgcaactgtatggcaatatcgccgccctttccgccgccgccatcggcgccgcgctggccacctggctgctcgtatcattgggcacctattgggccatgcagaaaaactga

SEQ ID NO: 975 - DNA, 1578 bp, Chromobacterium substugae
atgtcgaaattgtatttgaagcccaataccatcctcgaacccttgctgtggaactggcacgcatggtcgcatctgatgagcccgctgaccgcatccatgcacatcaaaaaccgccatctgcgcatcatgcagcgctttgtcgaaaccggcagcaagcctcaggtcaagaaccagaaattcgaaggcggcccagtcgtgcagctggacggctcctttgcccgcgatgtggagcgcttgctgaacaagaccctggacgaatgccaggacctgatcgcgctggcggaaggcatcgaagacgcgtcgcaaaaagtgctggagcccgccgggaaaaccctggagccgctgtacgactcgctgcagccggcagtcaagggcctgctggagctggtatacaacctcgacttccagcctggcctgaagttttacgaatcactggtgtggcaagactattactccacccagccgcaggccatcgccttctcccagatccactccgaccggcgtcctttcatcctcggcacgccggtgctgtcaaccgcggacaatctcgttctgccgctgccgttcgcctcgtccatcatcgacgacatccagcgctccacccagcacggcattgagcggcagacgctgctggaccagctgcagctcgatccctcccagctggactccttgctgcgctttttcagcaccgagccgatcgccacccgccacaagcgctacgacggcgaaggcgtgcgagtgcgctattacggccacgcctgcttgctgatcgagagcaaggacaccgccatcctgatcgacccgctgatcagttatgactacccggccgagatcgagcgcttcacttacagcgacctgccggatcagatcgactacgtgctgatcacgcatgcccaccaggaccatttctccatcgagaccttgctcaagatccgccaccgcgtgaagaacatcgtggtgccgcgcaacaaccgcggcgacctggtcgatccgtcgctgaagcgcatcctgcagcacatgggcttcgccaatgtgatcgaactggaggaaatggaccaggtgccgctgccgcatggcgaaatcaccgccataccgttcatcggcgagcacgccgaactggatatccagaccaagctggtttacaacgtccgcctgcatggccgctcctacttcgccggcgcggacttgaacaatttcgacggcgatgtctaccgccgctcgttccgcaagctgggcgagatagaagtcgtcttcatcggcatggagtgcgacggcggcccgatccactggctgtacgggccgctgatcacccgcagctatgacaaggaagccacccgcagccgcacgctgtccggctccgactgcgccaaagccagcgcgctcatcgaaagcataggcgccaagcatgcctacgtttactccatgggagaggagccctggctgaactacatcatgaacatcaattactccccggaagcgctgcaaatcatcgagtcggaccgtttcatccggcaaaaccagcagaacgggctgcactcacgccgcctgttcggcaaggacgagtggctgttctcctga

SEQ ID NO: 976 - DNA, 1263 bp, Chromobacterium substugae
atgcctcaacgcaacaaactcgtcattatcgtggatgcctatggccccgcccgccacttccgccactacttgcagcagcagggctatctgtgcgcgcacctgctcggcaccccccaaccgctgccgcggctgaagctcaccgagctggatcgttacgatgcggccttgatccatcacggcgacctcgccgccaccgcgcggcgcatcgaggagctggcgcaggaactggatgcggaactgcaggagattctgccgggcgtggagcccggagtgctgctggcggaccagctcagccatcgcttccagttgcgcagcaacggcatcgcgaaaagcctggcgcggcgcgacaaatcggtcatggcggatgtcctgtccgccgccggcgtcaaggtgccatcgtattgccgcaccgccagcctagacgaggcgctggcgttttcccgcggccagcaatggccgctggtgctcaaaccgctggacagcgcaggcaccaacggggtgttcttctgccattccgaacaggaactggcccacgccttcgatcaagtgatgggcgccgagaacaatatgggcctgatcaaccaggcggtcttggtgcaaagcttcctgcaaggcaaggagtacatggtcaacaccgtcagccgcgacggccggcacctgataacggatatctggtttgccgaaaagacccggatctccggctatgcctacatctacgacaaaaaccacttgatcgacagcggctcggcagaatacgcgctgctgcgcgactacgtcttcacggtgctggacgcgctggatatccgctatggccccgcccacgccgaggtcatcatcacgccggacgggccggtgctggtggaagtggcttcccgcatcagcggcggcgtcgatccggaattcaaccagctttgcctgagccatgaccagatcacgctgaccctggaaagctatctgcggccggacgccttcctgcagcgcatcggccagcgctaccagatccgcaagcatgggctgcagctgttcctgtcgtccagccaggccggcgtcgtgacggcattcgacttcccggaacatttgtcgcggatcgccagcgtggtgaactacaacctgaaacccaaggtaggcgatacgctggcgaaaacgatagatctgagcagctcgctgggcatcgtccacctcgccgcggacgaccaggccacgctgcaggccgactaccagcacattcagcatctgctcgcgcggcatctgcagtttgcctag

SEQ ID NO: 977 - DNA, 642 bp, Chromobacterium substugae
gtggacatgttcacgctggtcataggcaacaagaacttctcgccctggtcgctgcgcccctggctggtgctgaaaatgctggacgaaccgttcaaggaacagcagatcgatctttacctatccgacagcaaggcccgcattctcgccgccaaccccgccggcaaggtgccggtgctggtcgacgacaagctgcgggtctgggactcgctggcgatctgcgaatacctggcagagtgtttccccgccgccggcttatggccggacgatagcaagctgcgcgccgtcgcccggtccatcatggcggaaatccactccggattcgccgctttgcggcattccttgtcgatggacatctcgctcaggcaaatagactacgaaacttcgcccgcggtggaatcggacatcgcgcgcgtcgtgtcgctctgggaagagcatagacagcggcatgtggctgacggcgaattcctgttcggccgcttttccatcgccgacgcgtttttcgcgccgatctgcacctgcttcgaaacctacaacgtcaagctgccgccggtatcgcaggcctacgtccgccatatcctgtcgctgcccgccatgcaggaatggtatcgggctgcccgccaggaaaggcagcggcaagcttag

SEQ ID NO: 978 - DNA, 657 bp, Chromobacterium substugae
atggcgcgttttttattttttcattacaccgaggaatccgacatgagcacccccttcatcattggcgtggccggaggcagcggcagcggcaaaaccacggttaccaacaaggtgctggaaaccattggttccgagatggcggcggtgatcatccaggattactactatcgcgaccagagccacctgaccttcgaacaacggctcggcaccaactacgaccatccgcaagccttcgactggccgctcttgatctcgcacatcgacgatctgcgcaacggccgcgccatcgagatgccggtgtacgacttcgccaaccacacccgctccgaccagaccatcaccgtgcagccggcgccggtgatcgtgatcgaaggcttgttcccgctgtacgacgccgcgctgcgcgaaatgatgtcgctgaagatcttcgtcgacaccgattccgacgtgcgcttcatccgccgcctgaaacgcgacatcgccgagcgcggccgcaccatggaaaacgtgatcgagcaatacctgtctaccgtgcgcccgatgcacaaccagttcatcgagccgaccaagcgcttcgccgacgtgatcctgccgcacggcgccaatgatccggcggtggacatcatcaccaccaaggtcgccagcctgatggtgtga

SEQ ID NO: 979 - DNA, 276 bp, Chromobacterium substugae
atgcacaccatcaaaccgcgcaatccgctggcttgcgccgccatcctgaaaaagggcggcgcccacggccgcagccgctccggccagcgccaatcgcaaaaacaggcgctatgggccgaactggatcaagactggaatctggaagccgatcttccgccatcgccgctcgcggctcgcgccggccaagacgccgacgaggctttttcgccgcgccaagccccaaaagaaacaggccatcgcaagatggcctgtttcttttgggcgcatgccgcctga

SEQ ID NO: 980 - DNA, 453 bp, Chromobacterium substugae
atgaaatggatcgccaccaccctgctgatgttgctgctggccggctgcggctcgctgggcctgaagaagccgcaagtcggcctcagcaatatcgaacccggcaacagcacgctattcgaacagaacttcaccgtaaccctgcgcatccgcaaccccaatccgataccgctcagcgccagcgggctgaatttcgaacttatgctgggcggcgaaaaactgggcggcggcgccagcaaccaggccttcagcgtgccggcccagggcgagagcctggtgccgctgcaggttcacacctcgctggccgcctggatccgtcagctcgccaactggcaaaagctgcccgacggcaagctggattaccaaatccgcggcgagctgcaaggcctgaacggcctggccaccctgcccttcgacaacaagggcgaatggaagctgccagcccggggccgctaa

SEQ ID NO: 981 - DNA, 441 bp, Chromobacterium substugae
atgaagaagctgtgcttaccgctgctggctttgctggcggccggctgctcgatgattcccacccagcagggctatgcgcaaaaggtgtaccgctggcaaggccgcgacgtcaacgaactgctggccgagtggggcgcgcccagcaacagcctgaagatgcccaacggcaacacgctgtatgcctatgtcaaggaaagcacccagcagcagccgctgacccagaacacccgctacgagcccggcaccaagctgagcgtgaccgacagcaacggccagaccaaggtggtggaaaccccgggccgttgggtcagcgacggcgtcagcggcggcggcaccattcactacaagtgcaccaccaatttcgtggtggacaagaaaacccaggaagtgctgagcgtcagcttcgacggcaacgactgcgtggcgttgccgcgccagtga

SEQ ID NO: 982 - DNA, 1884 bp, Chromobacterium substugae
atgaaatccatccgtagcaagatcgccctgctgctggcgctggccatcctggtggctacctgcagcaccgccgtcagcgcctattacaaattccgcgacagcctgtccgacagcgtggatacccaactggacctggccatcaccggccagcagcgcttcgtgtcggcctggctggaacagcgccggcagatcatctccagcgccttgcgccacggcaacgaagccgatcccactctctatctgcagcagctggccgaggccggcggctacacccagctcttcgtcggcgacggcgacaccaagggcatggtctactccattcccggcaagcaaaagccgacgccggagtacgatcccgcttcacgcggctggttcaagatggccaaggccagcggccagaccatcgtcaccgcgccttaccagccggccagcgcgtcgatcaaggatctggtgatcaccatcgcccaggcgctgccgggcggcaacaaggtggtcggcggcgacatcgccatcggccagttggtgaagtcggtgctgtcggtatcgctgccgggcaacggcttcgtgttcctgatgggcaaggatggcaagctgatcgcctacccgaaggccgacaccgcgctcaagccgctgtccgacctgatgcccggcatggacgccgaccgcatcggcagcctgctggacaagcagcaactggcgacggtcgagctggaggggagcagccggttgctgcgcctcagctcggtggccggcagcgactgggtgctgggcgtggtggtggaccgcgaattgctggacgcgccgctgcgccagatgatggtggacatgctgctggcgctgctggcggtgctggcgctgacccagctgctggcaggcgcctatctgcgccgcctgctcaagggcctgctgcaggtgcgcgacgccttgcgcgagatcgcccagggcgaaggcgacctgacccgccgcatcgaagcggccggcgacgacgaagtggcgcaaatggccgaagccttcaaccagttcgtcggccgcctgaaccgcctgttccgcgaattgcgcagcgaggcggtgcagctggccgacggcgtgatcgcggtcggcggcgacgtggagcggctggctgaggattcccacacgctggccgacatttccagctccaacgcggcggcgatcgagcaggtgacggtgagcatctcgcacatcgccgacgccacccgcgaaaccgacgaactggcgcgcgacaccggcgccaactcccaggccagcgccgaggagctgcagcgcatcagcggcgcgatggcgcgcaccagccagtcggtgggcgaactatccggcttgctcgcgtcgctggagcaacgctcgcaggagatctccaagatcaccggcgtgatcagcgacatcgccgaccagaccaatctgctagccttgaacgcggcgatcgaagcggcgcgcgccggcgagcagggccgcggcttcgcggtggtggccgacgaagtgcgcaagctggccgagcgcaccggttcggcgacggtggagatcggcaagatggtggaaaacatcctgtccgaaaccggcaaggcggtgggcaatatgaacagcaccatcggcgcggtggacagcagcgccgcgcagaccgaggcggcgcgagagcggctggtggacatcacccgcgcgatgcggcaggtggtggagaagatcggcgacgtggcgctgtccaccggcgagcagcataacgccaccaccgcgatggcgcagagcaccgaatccatcaacaacaagattctggattccgacgccgcgctgcaaagcgcgcagcagacgctgaaaaccctggacggcgtggcgcgcagcatgcaggaggccttcagccgcttcaagctgtaa

SEQ ID NO: 983 - DNA, 1887 bp, Chromobacterium substugae
atgcgctccatccgacacaagctcatcttgctgacggcggtttccatcctggtcgccaccctaagcgtcgccatcatcgcctgcctgaatatccgcaaccacgcttacgacgaagccaagcgcgaagtcacccaggtgctgcaactgcagggcggactggtatcggaatggctgggcgtgcgcaaaagcctgatcagcgccagcctgtcgaaggccggcgatccgcaggccagctactatctgcaacagatcgccaagggcggcggcttcaacatcatctacgccggccatggcgacagcggcgagatgttctactctgtgccgggccgggtgaagccgagcgccgactatcagccggcgcagcgcccctggtatcagcaggccaaggcgcagggcgggctgatcgtcaccgatccgtataaggattccgagccggaaaccaaggacaagctggtgatcaccatcgccgacaaggcgcagggccaggagatcgtggtcggcggcgacatcctgatcgacaagctggtgaagtcggtgctggacatcaagctggccggcgacggccatgccttcctgctgacccgccagggcaaggtgatcgcctatccgaagccgggccaggagttgaagccggtgagcgagctgatcccggcgctggacgacaaccgcttccagcaattggtggccagcggcgatgtgacgccgatggagatcgatggcaagaccttcctggtggacctgcgccaggtggaaggcaccgattgggtgctgggcgtggccgccgacgaagacgcggtgctggcgccggtgacccaactgatctggctgatcgccggcggcgtggcggtggtgctgctggtgctggtggcgctgagctccggctacctgacccgcctgctgcgcggcctgatccaggtgcgcgacgcgatgcgtgaaatctcgcagggcgaaggcgacctgacccgccgcatcgaggtgcatggcgaagacgaagtggcgcagaccgccgaggccttcaaccagttcgtcggccgcctcaacggcatgttccgcgaactgcgcggcgaggccgagcaactggcgcacggcgtgatcgaagtgggcggcgcggtgaagcaggtggccaacgattcgcaccggctggccgacatctccagctccaatgccgcggcgatcgaggaagtgaccgtcagcatctcgcacatcgccgaagcgacgcgcgaaaccgacacgctggcgcgcaacaccggcgagcattcgcgcgagagcgccggcgacatgcagcgcatcagcagcgaaatggagcagaccagccaggcggtgggcgagctgtccggcctgctggcgtcgctggagcagcgttcgcaggagatatccaaaatcaccaatgtgatcagcgacatcgccgaccagaccaatctgctggccttgaacgcggcgatcgaagcggcgcgcgccggcgagcagggccgcggcttcgcggtggtggccgacgaggtgcgcaagttggccgagcgcaccggcaaggcgacggtggaaatcagccaaatggtggagaacattctgtccgaaaccggcaaggcggtgggcaatatgcagcgcaccgtgtcggcagtggataccagcgtggacctgaccagccaggcgcgcggccgcctgatcgccatcagcgacgcgatgcagcaggtgatagacaagatcggcgacgtcgccttgtccaccagcgagcagcacaacgccaccaccgcgatggcgcaaagcaccgaatccatcaataaccagatactggattccgactcggcgctgcaaggcgcgatgcagacgctggaagcgttgaatcagctggcgcgcagcatgcagggcgcgtttggccgcttcaagctataa

SEQ ID NO: 984 - DNA, 960 bp, Chromobacterium substugae
gtgaataatattgatgcggtccagctgcgcaagctggacctgaacagcctggtggcgctgcatgcgctgctcagtacccgcagcgtcagccaaagcgccgagcggctatgcctgggccagccggcggtcagccacatcctcaagcgtctgcgcgcgctgaccggcgacgaactgttgtgccgacatggccggcgcatggagctgacgccgctggcggaggccttgctgccgccgctggaggcttggctggagcaggggcagcggctgttgcggccgcaggttttcgatccggccgcgctgcgggccgaataccggctggcgatgcccgatttgctggaggcggccttgctgccggcgctgatcgtcgccctgcaggcgcaggcgccgggattgagcctgcaagtggtggcgatgccggccggcgaggtggaagacgcgctggagcggaggcggatagacggcgcgataggctattttccgcatgcctccgcgcggctgggccggcaggcgctgttcgtcagccgcttcgtctgtttctaccacgccgcgcaaatccggatgccgcagacgctgcgggccgaagacttggcgcggccgccgcacatccatacttcctacgccggcgacagcgccagcttggtggatgattatctgagcgggcaggggctgaagcggcgggtgatcgcctccaccgccagcctgttggcgattccggccgtcctggcgcagctgccggcggtggcggtgctgccggacctgatcgccggggtgttgcgcaggggagacaacggcctggccgcgcagcggctggccgacgccgaattgcagatcggcatcgagcacttgtggcatccgcgccgcaatgccgatccgctgcaaaacttcttcaacgcgctggtgcgggatcaatccgcgcggctggccgagcgctggcagcaatcattcggcgatattttctga

SEQ ID NO: 985 - DNA, 1506 bp, Chromobacterium substugae
atgtcccaagccccctccgcccgcccgctgccgcggctgctcgccatcatgctgatcgcctggctggaattcctgcagaacggcatgctcaatttcgcctcctcccacgtgatgggcggcgtcggcgccgggccggaggagttcagcctggcggccatggcttacgcgctgtgcgcggtggtggcgctgttcaaccaccaatggtgcgtcgagcgcttgggctcgcgccgccatctgcaaatctccctgctgctgttcggcctgggcgcgctcctggccgccaatgcccagactccggccgccttcatcgccgggcgggcagtgcagggcctgggcggcgcggccttcttcaccgccgccaggctggaggctgcccagctgcccccggcctggcgcgcggccgggctggtggccttcggccaggcgctattgctcggctcggcgctggggccgctgctgggcggcatgatattgcgcgccggcagctggcgcggcatcttctgggccatcctgccctgcctgccggccgcctggtgggcggcgcggcaactgcccctgcgcccgccggcgccgcaagcgccgcgctatcaccccgcggctttcatctggctggtggctgcggcctttctgctgcagtggctgatccagcaactgccctaccagctgttcggccatccgcaatggctgctgggtttgctggcggccgcgctggcttgctgcgccgccctgcgcctgcgccatcccggcggcgccagcgaccgcgagcgctggcgggcgctgaagcagccgggctacctgctgggtctgttttgctacgcctgctgctacctgctggtttcggccaatagctacatcctgccggcggtggccatccaggcgctgggcttcgacgtgccgaccagcggcgcgctgctggccgtcagcttcttcgccggcatggccgcgtccctgctgtacgccgtcctgctgcgctcgcgccgcccgcccagcctcgccgccgccatgctgtgcggctgcctgttgctggcgctgtacggctggcggatgagcgcgctgaacgccgaagccagccagctgcggctgacattgacgctgctgctcaacggcggcttcatgtcgctgttcatcatggccaccgcgcaacgcgcgttccgcgacatcgcgccggccgccttcggccacgcgtatcaaaccaagaacatcgtgcgccaggtgtccatctccgccggcgtggcgctggccaccgtgttcctgcaggcgcgcaacgcgctgcactacagccggctgggcgagaatttttcttggaatacgccacagtttgtcgaggttttgcatcaaatgcgacaattgatgcccgaattgagcgatactcaacgcttgggagtgctggccggcgaactcgcccggcaggccacgctgctgtcctgcctggactttttccggctggaaagcggcatcgcgctgggcctggccgctgccatcgcctgcctgcgcaagcggatgtga

SEQ ID NO: 986 - DNA, 645 bp, Chromobacterium substugae
atgcgtaaaagcggcagccaatcgccgacctttgacaagatcatcgaagccagcctgcagctgttcaaccaggagggcgagcgggtgatcaccaccaaccacatcgccgagcggatgaacatcagcaccggcaagctctactaccacttccgcaacaaggaagagatagtcaatgagctgtaccagcgctacgtgaaaggcatgggtgaacaactgtccgccgccatcaaccattgcaactcgatagaggcgatggtgggcgcgatggaaaagacgctgcgccacatctggagcttccgcttcctgccgcaaagcctgcccagcctgttttgcgtcaacccgacgctggccgagaaccaccagcagatttcgcgtggccagctcagcgacaagctggcccagctgttcgcccgcctgcgcgaacagggcatgctgcaaggcgacgacagccagctgcagcacctggtccagcatttccagatggtgcagaccggctggatcaacaccatcaagcagaacgccagcccggccgagctggaaaaactgatccagtccggctgccgcagcctgatgtatctgctgacgccctacgtcagcccgcgcttccagtcgccgttcgagcgcgcctgcgcgcgcttcgcctga

SEQ ID NO: 987 - DNA, 885 bp, Chromobacterium substugae
atgagcgtattggtaaacaaagacaccaaagtgctggtgcaaggcttcaccggcaagaacggcaccttccacgccgaacaggcgctgaaggtcggcaccaaggtcgtaggcggcgtgaccccgggcaagggcggttccgagcacctgggcctgccggtgttcaacaccatgaaggacgccgtgcgtcagacccaggccgacgcctcggtgatctacgtgcccgcagccttcgccaaggattccatcctggaagccatcgacagcggcgtgaagctgatcgtctgcatcaccgaaggcgtgccgactctggacatgctgtacgtgaagaaggccgtcgacgaagccggcatccgcctgatcggcccgaactgccccggcatcatcaccccgggcgagtgcaagatcggcatcatgccgtggcacatccacaacccgggccgcatcggcatcgtgtcccgctccggcaccctgacctacgaagccgtggcgcaaaccaccgcgctgggcctgggccagtccacctgcatcggcatcggcggcgacccgatcccgggcaccagccacatcgacgccttgcgcctgttccaggatgatccggacaccgacgccatcgtgatgatcggcgaaatcggcggttccgccgaggaagaagcggccgagttcgccaagtcctacgtgaccaagccggtagtcggctacatcgccggcgtcaccgcgccgaagggcaagcgcatgggccacgccggcgccatcatctccggcggcaagggcacggcggaagagaagttcaaggctttcgagaaggccggcatcgcctacacccgcagcccggccgaaatcggcaaaaccatgttcgaactgctgaaaagcaaaggcatgatctaa

SEQ ID NO: 988 - DNA, 1173 bp, Chromobacterium substugae
atgaacctgcatgaataccaagcgaaagagctgctgagccgttacggcctgccggtgcaacaaggcattctggccaagtcgccggaagaagcggctgccgcttacgacaagctgggcggcaaattcgccgtcgtcaaggcccaggtgcacgccggcggccgcggcaaggccggtggcgtcaaagtggtgaagagccgcgaagaagccgccgaagtcgccaagaccctgatcggcaccaacctggtgacctaccagaccgacgccgccggccagccggtgaacagcgttctggtctgcgaagacatgtacccggtgcagcgcgaactgtacctgggcgccgtggtggaccgcggcagccagcgcgtcgtgttcatggtttccaccgaaggcggcgtggaaatcgagaaggtggctgaagaaaccccggaaaagatcatcaagatcgaagtggacccgctggtcggcatgcagccgttccaggcgcgcgacgccgcgttcgcgctgggcctgtccggcgcgcaagtcgccgcgttctccaagctgatgctgggctcctaccaggccttcgtcgaaaacgacttcgccctgttcgaagtgaacccgctggcgctgcgcgaaaacggcgagctggcctgcgtggacggcaagatcaacctggactccaacgccctgtaccgccacccggaactgctggcccagcgcgacaagagccaggagaacgagcgcgaagtgaaggcttccgagttcgacctgaactacgtggccctggaaggcaatatcggctgcatggtgaacggcgccggcctggcgatggccaccatggacatcatcaagctgaagggcggccagccggccaacttcctggacgtgggcggcggcgccaccaaagagcgcgtgatcgaagcgttcaagctgatcctggccgacacctcggtgcaaggcgtgctgatcaacatcttcggcggcatcgtccgctgcgacatgatcgccgaagcgatcatcgccgccgtgaaggaagtgaacgtgaccgtgccggtggtggtgcgtctggaaggcaacaacgccgagctgggcgccaagatcctggacgaatccggcctgaaactgacttccgcccagggtctgaacgacgctgccgagaagatcgtcgccgccgtcaaggccgtggcctga

SEQ ID NO: 989 - DNA, 1434 bp, Chromobacterium substugae
atgagccaacagtttgatgtggtagtgatcggcggcggcccaggcggttacgttgccgccatccgcgcggcccagctgggcttcagcgccgcctgcgtagacgcgttcaaaaacccggaaggcaagcccagcttgggcggcacctgcctgaacgtaggctgcattccgtccaaggcgctgctgcagtcgtcggaaaacttccacgcggtgcagcatgatttcgccaagcacggcatcagcgtgtccggcgccaagatggacgtcggccagatgctggcccgcaagaccgacatcatcaccaagaacgcttcgggcatcagcttcctgttcaagaagaacaaggtcgccaacatccacggcctggccgccttcaagggccgccagggcgacaagtgggtgatcgaagtcaccgacaacggcgcggtggtggacacgctggaagccggccacgtgatcgtggccaccggctccagcccgcgcgcgctgccgggcctggccaccgacaaccagctggtgctggacaacgagggcgcgctggcgctctccgccgtgccgaagcgcctgggcgtgatcggcgccggcgtgatcggcctggaaatgggctctgtctggaagcgtttaggcgctgaggtgaccattctggaagcgatgccgaccttcctggcggccgccgaccagcagatcgccaaggaagccttcaagacgctgactaaagatacgggcctcgacatcaagctgggcgtgaagatcggcgaagtgaaggctggcaagaagagcgtcaccgtcaattacgaattgaacggcgaagcggtgaaggccgagttcgacaagctgatcgtctccatcggccgcgtgccgaacacccagggcctgggcgccgagactgttggcctgcaactggacgagcgcggcttcgtcgcggtggacgagcactgccacaccaatctgcccaatgtctgggcgatcggcgacgtggtgcgcggcccgatgctggcgcacaaggcgtcggaagagggcgtggccgtggccgagcgcatcgccggccagaagccgcatgtcgatttcggcgtgattccgtgggtgatctacacctcgccggaaatcgcctgggtcggcaagaccgaagagcagctgaaggccgagggcgtcgagtacaagaagggcacctccggcttcggcgccaacggccgcgcgctgggcctgggccaggcgcaaggcacggtgaagatcctggcttgcgccaagaccgaccgcatcctgggcctgcacatgatcggcccgatggtgtccgagctggtcagcgaaggcgtggtgtcgatggagttcaaggccgccagcgaagacttggcgcgcatcgtccacgcccacccgtcgttgtccgaagtgatccacgaagccgcgctcgccgccgacaagcgcgcgttgcacggctaa

SEQ ID NO: 990 - DNA, 186 bp, Chromobacterium substugae
atgaatctgcctgactggttttacggcgtggcctcggtgctggccggcgtggtgctgctcttcctgacctggaagaagcatcagcgcggcgtgcgtgaggacagctacagccgggtgggcaagatcgtcatcgcgctgttcatgatcgctttcggggccttgctgttcaaagtcggcaaggcctga

SEQ ID NO: 991 - DNA, 1245 bp, Chromobacterium substugae
atgctgattgaagtcaaagtcccgcaactgccggaatccgtatccgaagccacgctgatgagctggcacaaaaaggtcggcgaattcgtcaagcgcgacgaaaacctgatcgacctggaaaccgacaaggtggtgctggagctgccggccccgcaagccggcgtgctggttgagatcatcgagcaggacggcgccaccgtggtgtccggccagctgatcgccaagatcgacaccgcagcccaagccggcgacgccgctcctgccccggcagccgccgctccggcagccgcgccggctccggttcaagccccggccgccgcgccggcggcaggcgccgccgccatgccgtccgccgccaagctggccgccgaaaccggcgtgaacctggcgaatgtcgccggttccggccgcgacggccgcatcctgaaggaagacgtgcaagccgccgccaagccggccgccccgtcgcaagccggcccggtgtcctccggcgcggcgctgtcgtcgaccccggccgccgtcaacatcgccggcatcctgtccggccgtccggagcagagcgtgccgatgtcgcgcctgcgccagcgcgtggccgagcgcctggtgatgagccagcagaccaacgccatcctcaccaccttcaatgaagtgaacatgaagccggtgatggacctgcgcaacaagtacaaggacaagttcgagaaagagcacggcatcaagctgggcttcatgggcttcttcgtcaaggctgtggtttcggcgttgaagaagtacccgatcgtcaacgcctccgtcgacggcaacaacatcatctaccacggctacttcgacatcggcgtggcggtaggcagcccgcgcggcctggtggtgccggtgatccgcaatgccgaccagctgagcctggcggacatcgagaagcagatcgccgacttcggcaagcgcgcccaggaaggcaagctgaccgtggaagagctgaccggcggcacctacaccatctccaacggcggcaccttcggttcgatgatgtccaccccgatcatcaacccgccgcaatcggcgatcctgggcatgcacgccaccaaggagcgcgccgtggttgagaacggtcaagtcgtggtgcgcccgatgatgtatcttgcccagtcctacgaccaccgcatcatcgacggccgcgaagcggtgctgtccctggtggcgatcaaggacgccatcgaagatccggcccgcctgatcctcgacctgtaa

SEQ ID NO: 992 - DNA, 2829 bp, Chromobacterium substugae
atgatgcaatccatgtacagccattcttacctgttcggtgggaatgcaccgttcatcgaggagctgtacgaacagtacctcgctgacgccaattcggttccgaacgagtggcgcgactacttcgacaagctggcgcaggcgccgggcgccgccgagcgcgacgtgccgcaccagccgatccaggagtcgttcatccagctggccaagaagccgctgtccggccagcgcagcagcgccgccgccgactgggacgcgatgcagaagcaggtgggcgtgctcaagctgatctcggcctaccgcgtgctgggctcgcgccaggccaacctcgacccgctgaagcggatggaccagcagacgctgcgcgaactggatccggccacccacggcctgaccgacgccgacatggcggtgcagttcaacgtcggctcgctggtgggcccgcagaagctgccgctgtccgacatcctggcgcgcctgaagcagacctactgcggcaatatcggcgtcgagttcatgcacatcacccagtccgatgaaaaacactgggtgcagaagcgcttcgagggcgacctgtccaccccgcgctacgacgcggccaagaagcagcgcatcctgaagcagatcaccgcggcggaaacgctggaacgctacctgcacaccaagtacgtcggtcagaagcgcttctcgctggaaggcggcgaatccgcgatcgcggcgctggaccacctgatccagaacgccaccgcgcaaggcgtgcaggaactgatcatcggcatggcccaccgcggccgcctgaacgtgctggtcaacaccctgggcaagcagccgcgcgacctgttcgccgaattcgaaggcaaggccgcccagcagatggcttccggcgacgtgaagtaccacatgggcttctcgtccgacatcccgaccgccaatggcccgatgcacgtgtcgctggcgttcaacccgtcgcacctggaaatcgtcaacccggtggtggagggctcggtgcgcgcgcgccaggagcgccgcaaggacgcggaacgcaagaccgctgttccggtgctgatccacggcgactccgccttcggcggcctgggcgtcaaccaaggcaccttcaacctgtcgcagacccgcggctacggcaccggcggcaccatccacatcgtcatcaacaaccaggtgggcttcaccacttcggacacccgcgacatccgctcgacgatgtactgcaccgacgtggccaagatgatcgaagcgccgatcctgcacgtgaacggcgatgatccggaagccgtctgctacgtgatgcaggccgcgctggattaccgcatgaccttcaagaaggacgtggtgatcgacctggtgtgctaccgcaagctcggccacaacgaaggcgacgatcccttcctgacccagccgatgatgtacaagaagatcgccaagcaccagggcgtgcgcgcgatgtacgccgagcgcctggtgcaggagggcgtgctgaaggcggaagaaggcgacgcgcagatccaggcctaccgcgacgcgctggacaagggcgagcatgtcgaacagaccgcgctgaccaactaccgccgcgaacacgcgctggacttcagccagtacctgggcacccactgggcgcacccgaccgacacctcgctgccgcaggccgacatccagcgcctgaccgacaagttcacctcgctgccggaaggcttcaagctgcacccgaccgtgcagaaagtgctggccgcgcgcaaggcgatggccgccggcgagcagaatgtcgactggggcatggcagagacgctggcctacgccagcctggtgaccaacggcttcggcgtgcgcatctccggcgaagactccggccgcggcaccttcagccaccgccacgcggtgctgcacgaccagaaccgcgagcgctgggaccagggcgcctatgtgccgctgcgcaatatgtccgacaaccaggccgatttcctggtgatcgactccatcctgaacgaggaagcggtgctggcctacgaatacggctacgcctgttccgctcccgaccagctggtgatctgggaagcccagttcggcgacttcgccaacggcgcccaggtggccatcgaccagttcatctcttccggcgagaccaagtggggccgtctgtgcggcctgaccaccatcctgccgcacggctacgatggccagggcccggagcactcctccgcccgcctggagcgctggctgcaactgtgcgccgagcacaatatgcaagtggtgatgccgtccgaagccggccagatgttccacatgctgcgccgccaggtgctgcgcccgtaccgcaagccgctggtgatcttcctgtccaagcgcctgctgcgcttcaaggattcgatgagcccgatcgaagacctgaccagcggcagcttccgcccggtgatcggcgacgccatcgtcaaggatccgaagaaggtcaagcgcgtggtgctgtgcgccggccaggtatattacgacctcgccgccggccgcaaggaacgcggtctggaagatgagatcgccatcgtccgcatcgagcagctgtacccgttcccgaccgagcaggtggccgccgagctggcgcgctacacccaggccaaggaagtgatgtgggtgcaggaagagccgcgcaaccagggcgcttggtaccagatccgccaccgcctggaaggcctgttgtccgccaagcagcaactgtcgttcgccggtcgcccgtcgtcggcgtcgccggcggtcggttatatgagcaagcacgtcgcccagctgaaagccttcgtcgaagaagcgatgtcggtcgcccgctga

SEQ ID NO: 993 - DNA, 1290 bp, Chromobacterium substugae
gtggaaactaatcgcaaagtcacgctcagctacaacgagggtaaggactccatcgacctgccggtcctggggggctcgctgggtccggacgtcgtagacatccgctctttcggcaagaccgggatgttcacgttcgacccgggcttcctcgccaccgccagctgcgaatccggcatcaccttcatcgacggcgacctcggccatctgtactaccgcggctacccgatcgagcagctggccgagaagagcgactatctggaagtgtgctacctgctgctgaacggcgagttgccgaccgcggcgcagcgcaaggaattcgaacgcggcgtgatgcgccacaacatgctgcacgaccagctgatgagcctgttcaagggcttccgccgcgacgcgcatccgatggccgtgatggtgggcgtggtgggcgcgctgtccgcgttctaccatgactcgctggacatctccaatccggaacaccgccgcatctcggcccaccgcctggtggccaagctgccgaccatcgccgcccaagcctaccgctacaacaagggcctgccgttctcctacccgaaaaacggcctgaactacgcggaaaacttcctgcacatgatgttctccaccccgtgcgaagagtacaaggtgaacccggtgctggcccgcgcgatggaccgcatcttcaccctgcacgccgaccacgagcagaacgcctccacctccaccgtgcgtctggccggctcctccggcgcgaacccgttcgcatgtatcgccgccggcatcgcctgcctgtggggcccgtcgcatggcggcgccaacgaagccgtgctgaagatgctggacgagatcggctcggtggacaatgtggccgacttcatgcagggcgtgaaggacaagcgctacaagctgatgggcttcggccaccgcgtgtacaagaacatggacccgcgcgccgccatcatgaagcagacctgcgacgaagtgttgaaggaactgggcctgggcgacagcccgaagttcaagctggcgatggagctggaaaagatcgccctgaacgacccgtacttcatcgagcgcaagctgtacccgaacgtggacttctactccggcatcgtgctgtccgcgatcggcatcccggtttcgatgttcaccccgatcttcgcgctggcccgcaccgtgggctggatcgcgcactggaacgagatgatcggcgacccgggcatgaagatcggccgtccgcgccagctgtacaccggcgctccgcgccgcgacttcgtggaagtggcgaagcgctga

SEQ ID NO: 994 - DNA, 249 bp, Chromobacterium substugae
atgacgacttacgatccgatagaactgaagcggatgcgctggcgctcgcgccgcggcctgctcgaactggacctggtgctggagaaattcctggccgggccgttcgggcggctggccccggccgagatcgaggcctaccgccgtctgctggatctggccgacaccgattttctggatatcgtcagcggcaaggccgatctcgaggatccggaagagatggccattgtggcgatcctccgatcgctgtaa

SEQ ID NO: 995 - DNA, 711 bp, Chromobacterium substugae
atgactaccgaaaccatcaaattccgcatctaccgctacaacccggaccaggatgccaagccgtacatgcaggacatcagcgtggagatggacgccaccgagcacaagctcttggacgcgctggtcaagctgaagatcaaggacgacacgctgagcttccgccgttcctgtcgcgaaggcgtctgcggctccgacgcgatgaacatcaacggcaagaacggcctggcctgcgtcaccgacttccgcggcctgaagcagccgatcgagctgcgtccgttgccgggcctgccggtggtgcgcgacctgatcgtggacatggcgcagttcttcaagcagtaccactcgatcaaaccgtacgtgatcaacgacacgccgccgccggaacgcgagcgccgccagtcgccggaggaccgcaaggagctggacggcctgtacgagtgcatcctgtgcgcgtgctgctcgacgtcctgcccgtcgttctggtggaacccggacaagttcgtcggcccggccggcctgttggccgcctaccgcttcatcgccgatacccgcgacgaagccaccagcgagcgtctggacaatctggaggacccgtaccgcctgttccgttgccacaccatcatgaactgcgtcgacgtctgcccgaagggccttaacccgaccaaggcgatcggcaagatcaaggacctgatggtcaagcgcgcggtatga

SEQ ID NO: 996 - DNA, 1740 bp, Chromobacterium substugae
gtgggcgccggcggcgccggcatgcgcgctgcgctgcaactgtcggaagccggcctgaagaccgccgtgctgtccaaggttttccccacccgctcccataccgtggccgcccagggcggcgtgtccgcttcgctcggcaactccgagccggacaactggcactggcacatgtacgacaccgtcaagggttcggactggctgggcgaccaggacgcgatcgaattcatgtgccgcgaagccccgaaagtggtggtggagctggagcactacggcatgccgttcgaccgcaatccggatggcaccatctaccagcgtccgttcggcggccacatgtccgacttcggcgaaggcaagccggttcgccgcgcttgcgccgcggccgaccgcaccggccacgcgatgctgcacgcgctgtaccagcgcaatgtgcgcgccaacactcacttcttcgtcgagtggatggcgcttgacctgatccgcgacgccgaaggccgcgtgcagggcgtggtcgccatggaaatggaaacctcggaaatcgtggtgttccaggccaaggccaccttgtttgccaccggcggcgccggccgcatcttcgcttcctccaccaacgccttcatcaacaccggcgacggcgtgggcatggcggcgcgcgccggcatcccgctggaagacatggaattctggcagttccacccgaccggcgtggccggcgcgggcgtgctgatcaccgaaggcgtgcgcggcgaaggcggcattctgcgcaacgcgcagggcgagcgcttcatggagcgctacgcgccgaacgccaaggacctggcttcccgcgacgtggtgtcgcgcgcgatggtgaccgagatcaacgaaggccgcggctgcggtccgaacaaggatcacgtgctgctggacatcacccacctcgaccccgaggtgatcatgtccaagctgccgggcatccgcgagatctcgatcaagttcgccggcgtggacccgatcaaggccccgattccggtggtgccgacctgccactaccagatgggcggcatccccaccaattaccacggcgaagtggtgatccacggcgaggcggtgcatggcttctacgccgccggcgaatgcgcgtgcgcgtcggtgcacggcgccaaccgcctgggcaccaactcgctgctggacttgctggtattcggcaagagctcggccaactcgatgatcgaattcatcaagcagcatccggaagacctgccggagctggctatggccgacgtcgagcgttcggtcgcccgcgtcgcgcgtctggacaaccagaccaacggcgtgcaggtgcacgaggctcgcgccgcgctgcagcgcaccatgcaggcccactgcggcgtgttccgcttcaaggacatgctggccgaaggcgtggaaaagatcctggaagtggccgacatggtcgccaagaccgaaatcggcgacaagtccaaggtgttcaacaccgcccgcatcgaggcgctggagttggagaacctgatcgaagtggctaaggccaccatggtttccgccaatgcccgcaccgaaagccgcggcgcccacgtccgcgacgacgcgctggacaccgaggccaccccgaacggccgcgacgacgtcaactggctgaagcacacgctgtggttccgcgacggcaaccgcctggagtacaagccggtgaacatgcagccgctgaccgtggacacgatcaagctgaaggcccgcacctactaa

SEQ ID NO: 997 - DNA, 345 bp, Chromobacterium substugae
atggtaaaccgcaatgttgtcggcgccggctacggcctgcgcgattgggtgatgcagcgcgtcaccgccgtggtgatggtgatctacaccgtggccctggcgttgttcctgttggcgctgccgtccggctatgaaggctggaaagacctcttcagccatacctgggtgcaggtgctgacccagaccacgctgctggcgctgttcctgcacgtatgggtgggcatccgcgacgtgtggatggactatgtgaagccggtgggcatccgcctggcgctgcacatgttcaccatcgtctggctggtttcctgtttcatctattccgttaaagtggtttgggggctgtaa

SEQ ID NO: 998 - DNA, 378 bp, Chromobacterium substugae
atgcagaagcaaagaccgaagcatctggacttggccaggatcagactgcccgtgccgggcttcgtctccatcctgcaccgggtcagtggtgtggcgctgttcttctccctcccgctgttgatctatctgctgcacggttcgctcagttcggccgaatcgtttgaaacctaccgcgccgtggtcgcccacccgctgatgaagctggtgctgctgggcctgatctgggcttacatgcatcacttctgcgccggcatccgcttcctgtttctcgatattcacaaaggtctggaacttgagaccgcccgcgccaccgccaagaccgtgctggtcgtcagcctggcgctgaccctggttctgggaggcatcgctctatggtaa

SEQ ID NO: 999 - DNA, 735 bp, Chromobacterium substugae
atgacggccaataccctgaaaagacagccgctttatgcccaggtcaaacagcggctgctggaaagaatgggcgagggcgagtggcaggcgcatgaggcgctgcccagcgaatgggagctggctggcgagctgggcgcgagccaaggcacggtgcgcaaggccttgtccgaactggaggccgccggcctgctttaccggcagcaggggcgcggcacctatgtggccccggtgccgggcgactggggcgacgcggcgctgctgacgcctgggctgttcggcgagcagccggacgatctggcgcgggagtttttgggcctgtcgcggctgaacgccagcgaggacatcgccgacgcgttgcaattgcggcgcctggcgcctttattgagaattcgccagctgtggcgctggcacggcgcgccggtggcgctggacgacgtgctgctgccggcggaaagattcgatggcatggaagcgcgctggctgcgcaattcggccggcgtctacgccaccttgcagcagcgtttcggcgtgcgcgtgcgcgtgcgcagcgagcagttccgcgccgagatgctgccgcgggaagaggcggggcttctgggcgtgaccggcatggtggccgatgtgccggcgctgtgcctgctgcgcttgtccgaaggcatggacggcagtccgctggaatggcggcagcgctactgcctgacgcaccagctggcttatacagtgaaacacggctga

SEQ ID NO: 1000 - DNA, 981 bp, Chromobacterium substugae
atgaaagcccccgttcgcgttgccgtaaccggcgctgccggccagatcggctatagcctgctgttccgtatcgccagtggcgaaatgctgggcaaggaccagccggtcattctgcatctgctggatctgccgcaagcccaaaccgcgctgaagggcgtgatgatggagctggaagactgtgccttcccgctgttggccggcatggtggccaccgacgacccgaacgtggccttcaaggatgtcaaggttgccctgttggtcggcgcccgcccgcgcagcaagggcatggagcgcaaggacctgctggaagccaacggcgccatcttcaccgtgcagggcaaggcgctgaacgaccacgccgcccgcgacgtcaaggtgctggtagtcggcaacccggccaacaccaacgcctggatcgcgatgaagtcggctccggatctggacccgaaaaacttcaccgccatgttgcgtcttgaccacaatcgcgcgctgtcgcagatcgccgccaaaaccggcaagccggtggcttcgatcgagaagctggcggtatggggcaaccactcgccgaccatgtacgccgactaccgcttcgccaccatcgacggccaatcggttaaaaccctgatcaacgacgacgtgtggaaccgcgacgtgttcctgcccaccgtgggcaagcgcggcgccgccatcatcgaagcgcgcggcctgtcctccgccgcctccgccgccaacgccgccatcgaccacatccacgactgggtgctgggcagcaatggcaaatgggtgaccatgggcgtgccgtccgacggctcctacggcatcccggaaggcgtgatgtacggcgtgccggtagtatgcgaaaatggcgaatacaaacgagttgaaggcttggaaatcgacgcgttcagccgcgagcggatggacctgaccctggccgaactggaagaagagcgcgcagccatcgctcacctgtttggctga

SEQ ID NO: 1001 - DNA, 900 bp, Chromobacterium substugae
gtgctggtgctggacagcatcaacgccaccctcgctgacagccgcgaactgttcgacatgggcaagagcgaagacgacgacgacaccatcctcgccgtgcaagccgacctggaaggcgtggaagagaaagtggcgaagatggaattccgccgcatgttccacgacccgatggaccccaacaactgcttcctggacatccaggccggcgccggcggcaccgaagcccaggactgggccggcatgctgctgcgcatgtacacccgctacgccgaacgcaagggcttcaaggtggacgtgctggaagtgtccgaaggcgaagtggccggcgtcaccagcgccacgctgaagatcgaaggcgaatacgcctacggcctgttgcgcaccgaagtgggcgtgcaccgcctggtgcgcgtgtcgccgttcgactccaacgcccgccgccacacctcgttctcgtcggtattcgtctacccggaagtggacgacagcttcgagatcgacatcaacccggccgacctgcgcgtggacacctaccgcgcctccggcgccggcggccagcacatcaacaaaaccgactcggcggtgcggatcacccacatccccaccaacaccgtggtgcagtgccagaacgaccgttcgcagcaccgcaaccgcgacgaggcgatgcagatgctgcgcgccaagctgtacgagctggaactgaaaaagcgcaacgaagccaagcaggcgctggaagacaccaagaccgacgtgggctggggccaccagatccgctcctacgtgttcgaccagtcccgcatcaaggatttgcgcaccagccacgaggtgggcaacatcaagggcgtcatggacggcgacctggacggcttcatcgaagccagcctgaagcacggcgtctaa

SEQ ID NO: 1002 - DNA, 1509 bp, Chromobacterium substugae
atgtctgatcacgaacaagcaccggcgcaaagccaagacgaaaaccagatcatggcggaacgccgcctgaaactgcaggcgatccgcgaaaaaggcatcgcctaccccaacgacttcaaacgcagccacttcgccaaaccgctgcaggacgaccacgccgccaaagaagcggaagcgctggaagccgaaaaaatcgaagtcgccgtcgccggccgcatgatgctgaaacgtgtgatgggcaaagccagcttcgccaccctgcaggacgtgagcggccgcatccaggccttcatctcccgcgacaacgtgggcgaagacgtctacgccgacttcaagcgctgggacctgggcgacatcatcgccgtcaagggcgtgctgttcaagaccaagaccggcgaactgacggtgcaggccagtgaagtgcgcatgctgtccaagaacatccgtccgctgccggaaaaattccacggcatcagcgaccaggaaaccaaataccgccagcgctacgccgacctgatcatgagcgaggaaagccgcgacaccttcatcaagcgctccaagatcgtgcagaaggtgcgcgacgtgatggtgggcgaaggctacctggaagtggaaaccccgatgatgcacccgattccgggcggcgcgtcggccaagccgtttgtcacccaccacaacgccctggacatgccgctctacctgcgcatcgccccggagctgtacctgaagcgcctggtggtgggcggcctggaacgcgtgttcgaaatcaaccgcaacttccgcaacgaggggatgagcacgcgccacaaccccgagttcaccatgatcgagttctacgaagcgtacagcgactaccagcgcatgatggagatgaccgaaaccatcatccgcgaatgcgcgctggtttcctgcggcgccaccaccgtgagctaccaaggcaaggaagtggacctgggcaagccgttcgaccgcttcaccatcgtggaagcgatcaagcactacaacccgcaatacaccgacgcgcaactgtccgactccgcctgggtggccagcgagatcaagcgcctgggcggcaagctgcccccggcgccgggcctgggcagcctgcagctggcgctgttcgaagaatgcgccgagtcgctgctgtggaacccgaccttcatcatcgactacccggtggaagtctccccgctggcgcgcggctccgacacccagccgggcctgaccgagcgcttcgagctgttcatcgtgggccgcgagcacgccaacggctactcggagttgaacgatccggaagaccaagccgcgcgcttccaggcgcaagtcgcccagaaggatgccggcgatgatgaggcgatgcactacgacgccgactacatccgcgcgatggaatacggcctgccgccgaccggcggttgcggcatcggcatcgaccgcctggtgatgctgctgaccgatgcgccgtctatccgggatgtgatcttgttcccgcacatgcgtccggagtaa

SEQ ID NO: 1003 - DNA, 1431 bp, Chromobacterium substugae
atgatagagggcatagttaaaaagtataatgatggggtgattgatgatgatggcttgtttcgcagccttttttcggctcattttttgattgatatttatcaggcgaaatataaaaatagttccgcaaaaggtattgataggattaatggctttcaattttcatcgagggctgctgcggaaatatatttggcttgtgagaaaagtataaatgggacgtatagattttctccttacttagaggttcttaaggtaaaaaatagagaaaagccacccagattaatttccgttccaacaatacgcgatagaataattctttcccagctaaataagtttctgtcgataatctatcctgaaagagttactaggaacatcgcaagcgtatatattcgggatatttctggaaagttagctgagctacctatggattccacgtgggtttgtggggcagatattgttacattttatgatgatgtagatataagtaggttgattgcactgctttctcgccgtattaaatcgaaaattgcattgaaactgattaagagctctttggttactccgacggttccgaaaaattgctctaaaaatttatatcataaatataagagggcgtgtggaatacctcagggtcttgctatatcaaatatattgtcatctatctatatgcagccaatagatgatggtatggtggggatgggtgttgggtatcatcggtatgtagatgatgtgttaatgtatggtgagagagatagtgtggaatttgcatttaaatccttgaaaaggaggcttcagactagggggttgaaactacatcccttaagttcagaaaagacacactttggaaggcgatgcgagccatttttataccttggatatcgttttgatggtgatactctcacggttaggcatgccacagttgaaaggtttttgcagtccattgcagcaaagtttagtgattttagacataataaaagtaaaagactggaaagattaagttatttaaattcaagcaggttaaaagatatatttgtttctgagctaaatgagaaggtggctggtgctatatcagataataaaagatatggttggattgcatattttaatcagataaatgatatgagtttgctgtatagaattgacaatgcgattagtaatttgtttggccggcttggtgagtttgattttacggccccacccaatttgaaaaaattgtctagagcatactgggagatgaagtttaacccgacaggtggctatgttaaaaattatgattcaattgttagtttggttgataagttagaatttttagtagcgaggggtagagtcgcaccagatgagtctttgagtgatgagcaaatagaaagccgatttcaaagctataagaggtttgtattgtcatcaatgcatgcggatgaaggggttgtgtattga

SEQ ID NO: 1004 - DNA, 264 bp, Chromobacterium substugae
atggaaaacacaacaaaacccttaaccgcccgcgcggttttcgcccgcaacctgcggattgccagacgtctgcacgatgtgtcgcaggaggcgttggctttgcaggcggggatgagcagaacctatgtgtcagagatcgagcgcggcgagcgcaatgtctccatcgacaatatgggagcattggccgacgccttgggcgtggcgctgagagacttggttgacccggagatgtttggcggcttgctggataaggcgagcaagtag

SEQ ID NO: 1005 - DNA, 417 bp, Chromobacterium substugae
atgcctagcatcacccgcagttcatcgcatctcgcgctttccctgaaaaaccgccaccccgcccgcagccgttggctgctgcacaacccagtccccacccatccgcccagcctgctggccatgacccggctgcacgaagcctttgccgccttgcaagagcaactggccggcaaggatcaagccaaggtcagagaaccggccgcgcgcgtggcgcatttgtgccacgacatcgagcaggcggtggtggagtccatctgccacctcgcccatggccaattgggtttgcaatccgtgatcgagctgctggcttgcctgggcgacgatgtccgcctgccttccagccgcatcacggagttgctgtcgccgctggacaagcgcatggacgagtcgctgtcgctgctcacccgcgtgctgtaa

SEQ ID NO: 1006 - DNA, 144 bp, Chromobacterium substugae
atggctgcatccaatcgtttcaagccgggtattgcaccctacgcttgcgacgcccgccagccctccagccgtatcaccgagttgctgatgccgctgggcaagcgcatgcacgagtcgctgacactgctcacccgcgtgctgtaa

SEQ ID NO: 1007 - DNA, 624 bp, Chromobacterium substugae
atgccgcgcgcaagctatggcgggccgtggcgggagcatcattccgatgcgccggtggtgaagccggtacgccaatcccgccatgcgcctgccgccctgccccgcaagcggcaggtcaaagcgcttcacacgtcaattccaaatcgatatagtctgccgggttgccgcgccgcgcgcggctgcgcttcttggcgccacatggagatgcagatgagcgagaaatacaccgggcagtgcctgtgcggcgcaatccagtatgccgccgccgccgaaccgctgttcaccggcaactgccactgcctagattgccagcgcagctccggcagcgcctatattccggccatggtttttcccgaagcggcggtggaaattgtcggccaggccaaatacttcgcaaccaccgccgatagcggcaatacccacagccggggcttctgtccgaactgcggctcgcaattgttcgccagattcagcgccatgcccggcctgctgggcatcaaggccggcacgctgcacgacacctcgcgctacgcgcccaagctggattttcacgtggccagcgccgcggcctgggactacatgaatccgcagttgccgaagaagccggggccggcgcaaggctaa

SEQ ID NO: 1008 - DNA, 618 bp, Chromobacterium substugae
atgaacatgccattcgcggcctggatgcgccgccttgccccggccgccttgctgctgctagccgcccacgccagcgccgccaccgaaaccatcgtgatgatccgccacggcgaaaaaccggaccagggcctcggccagctgacctgccagggcctgaaccgcgcgctggcgttgccgcgggtgctgaccagcgccttcggcgcgccggacgccatcttcgcgcccgatcccgccacccaggtgtccgattccggcgccaactactactatgtgcggccgctggcgacgatagagcccaccgccatcagcctgggcctgccggtcaacaccgcttacggcttcacccagaccgccgacctggcctcgcggctgctggcctccgactatgccggctccaccgtgttcgtggcttgggagcacaagaagatcgtcacgctggccaagcagatcttcgccaacctcaaccaatccgccaatattccggcttggtcgggatcggacttcgacagcatctacgtcatcaccatcaatagctccggcagccgccgcaccgcctcgttttccatccaggcccagggcctgaacggccagagcacggcctgccccggccccaactag

SEQ ID NO: 1009 - DNA, 1617 bp, Chromobacterium substugae
atgactgtgtccaagaaaatccttctgctgattctgctctccatcctggcccagatcggcatcagcgcttacagcctccatacccagtcccagctggccgacaccgccaccagcttcgcaaacgtcgactatcccagcctgattaacttagggcagttcagcaatgcggtgggaacgctgcgcttggccggcctgcacgaattgacctccaccaccgccgccgaccgcgccgcggccagaagcaaagtcggcgacgcctaccagagcgccaaggcggccttgggcgaataccagaaaatgatcaacgacgatgaagaccgcgggcacttcaacgacgatggccgcctgctggaccaatactacgcggcaatgcagcctatgctggcagcggcggagcgcaacaatctggaagacgcgctcaagattcgcgccgatgcggtgacgccggccggcaatgcgctgaccaaggcgatcagcgcccacatcgactacaacaagcgctatgtcgaaaaggaagtggccgaggcccaggccttgatcggcagcacccgcgtcatcacgctggccaccaccgcggtgctcaccctgctgctgggggcgctgggcctgcgcacctacctatccatcacccgtccgctgcatgagctgaaccacgcgatgaaccagatcggcgagcgcctggacttcacccgccaggtcaaggtgcataacgccaaggacgaaatcggcaataccgccgccgccttcaaccagctggtgcagcgcatccgccacagcctgcgcgacatcctgcacaactgcggcaaagtggcgggctacagcgccgacctcggccaggccgccaaccacgtgcagaccgcggcggaaaaccagaaccaggcctccgctttcatcgccgccaccatggagcagctgaccgtcagcatcaaccacgtcggcgatcgcgccgagcaaagcaaccagcaaagcgaagaggccagccgccacgccggcaacggccaccaggtgatcgccaagaccgtggaggaaatccgttccatctccgataccgtcggccacgccaataccagcctcaccgaactggaggcgcaaaacagccgcatcgccaactcggtgggcagcatcaaggacatcgccgatcagaccaatctgctggcgctgaatgccgcgatagaagcggcgcgcgccggcgaaaccgggcgcggcttcgccgtggtggcggatgaagtgagaaaactggccgagcgcaccgccatcctcaccagcgagatcgaccaagtgatacgcggcgtcaccgacacctcgcggcaaaccaccagccggatgagcgaaacccagcaactggtcgcttccggcgtggtgtgcgccgacgaggcgatgacagccatcggcgaaataggcaaatcatccggcaccgccatgcagatggtcagcgaaatcaccgacgccatccgcgaacaggccaatgcctgcaacagcatcgccaaccaggtggaaaagatcgcccagatggccacccagtccagcgcggccgcgcagcaaaccgccaccaccgcccaacagctggacaaggcggtgctggcgatgaacgaggcggtcaaacgctacacgctgtga

SEQ ID NO: 1010 - DNA, 1968 bp, Chromobacterium substugae
atggcaagcacgacagatctcccgcaacacccgccttccgggtccggctccgcgcccgatcccggccagccgttcaccctgccggatttcatccaactgcgcgccgacggcttttttgtcgcgaccgagctattgagcggcgccgaagccttccgccaggcgatagaccagatcttcgccgccggttttttcctgtccggcctcgattacccgaaactgtgttactacctgtacgacttcgatgcggccaacgccggccctgggcagcggatcgcgcaatgcatcctgtctttcgccgaggaacggcgcgcgctgtatcacgcggtgatccaggtggaggccggcgttgaatacctgttcgagcaggtgttcctgaccagaaacgtcgcgacgccggtctacggccgcgacccggcgggccagccgatggtggtcggccagcgcgaagagtcgcaaaccctgccttcccggctggagttcgacgagatggtcgcccatctgtggcagcagggcatccgcttcgggctgaaccgcgccgtcatcgacgactgcctggcccagcgcaaggtggggcgttttctgatcgcctgtccgcagccgccggtgcccggggtggacgccggcgtgcaggagaagacggcggcgatccgccgcgacgaccacccgcgcaaactgtccggcggccgggtggacctgacccagttccagaaccgctacccgcaaatcaaagcgaatacggcgctgctgatgaagacacctagtgtgcccagccggccggggcgcggcctggacggctgcgtgatccccatcgccgcgccgcgcgatttcgacctggccaccctggccggcgaaggcaccgaggtgcgggagatggagggccaggagttcatcgtcgcggtgcgcgacggctttctcagcatcgacgccgaaaccaaccagatcgccatcgtcgacaagatcgtcaaccgcgaaggcgttagtgtccgcaccaccggcgacctggccttgcagggcgacgaatacgaagagcacggcgaagtgcaggagcgccggatcgtcaccggcaagaacctgaccctgtgcaacgacgtgtacggcacggtccgctccaccggcggccgcatcctgttgaagcaaaacctggtgggcggcgccgcgctgaacgacgacgggccgatcagcgtcgagggcatggtgtccaacgcccaggtgcgcgccgagcgcggcgacatcaccatccagcgcgcggaaaacgcgctggtgatcggccggcaggtgcgcatcgccgaggccagccgctgcgtgatcgtcgccgatgaagtcgatatcgacagcgcgatgggttgcgccatcgccgcgaagtcggtgcgcatagcccgcgtcggcgcgcgcgccagccaggagacggcgatttccatcttgctgccggacttgtcggctttcgccgcccggcaggactggctggaaaagcggcagcaggagggggcgcagaaaacggcgacggcgcagcaggcggtggcggcgctgatgggggatgaaaccgtcaagcgttacgtgggcctggcggcgcggctgaaaaagggcgaactgcaactgtcggccgagcagcaggcaggctggaagcggttgtcggaacaggccgcccccaagctcaagcagctcaaccagctgaacgcgatgctgaaagcgctgcaggacgagcaggccgacttccgcagccaggtgggcgcgctggccgaggagcgcaatgacgcgatttccggcatacgctgccgactggaggagctgagcggcgaaaccgtggtgcgctcgctgattcgtccgctcaacgctccggcgctggcatcgctgccgctggaacaactgcgcacccggctgcgggcggccgacgaccagaccaaggagttgttttcagacagcagcggctgcttcacctggcaatactcggcgcgcttcgccagcccttga

SEQ ID NO: 1011 - DNA, 126 bp, Chromobacterium substugae
atggggttggccagcctggcggcgtctgcgcggactgtgcgcctgatgatcattttaatgcaaaaggaatgccgcaggctggcgaggtggacggcgccgcgcgccgggcgcgcaaagccggcatga

SEQ ID NO: 1012 - DNA, 468 bp, Chromobacterium substugae
atgaaacaggattttgtcatcagagccgcgcaaacaggcgattacgccggctggcggccattgtgggacggctataacgcgttttacggccgcgccggcgacaccgcgctgccggaggccatcaccgcgcagacctgggcgcgctttttcgacccggccgagccggtggacgcgctgctcgccgagcaagacggccgcatcatcggcctggtccacaccgtcatccaccgcagcaccacccggctggcggacgtctgctatctgcaagacctgttcaccgcgccggaggccaggggccgcggcgcggcgcgcgcgctgatcgaggcggtgtatcggcaggcagccgcgcgcggctgcaaccgcgtctactggcaaacccacgacagcaaccgcgcggcgcgcgcgctgtacgacaaagtgggcgagaacaagggcttcatcatctacggcctggagctgccggcctaa

SEQ ID NO: 1013 - DNA, 1224 bp, Chromobacterium substugae
atgacttccatccaaaaaacgcatgaccagattttggccgccgcgccgtcgcgcgccgaccagcctggcaaggcgctgactttcctgctggccgccggcgcggggctgtcggtggcctcgttgtattacagccagcccatgctgggcattctggccgccgacattggcgccggcagccgtgagatcggcctggtgccgacgctgacgcagctgggctacgccttggggattttgctgctggccccgctgggcgaccgccacgaccggcgcgccatcatcctggccaaggcggcgctgctggtgctggcgctgctggcctgctcaatggcgccttcgcttccttggctattggcggccagcttggccatcggcctgacggccacgctggcgcaggacatcgtgccggcggcggctaccctggcgcatgaacagcggcgcggcaaggtggtgggcacggtgatgaccggcctgctgatggggatcttgctgtcgcgggtggtgagcggcgtggtggccgggcactggggctggcgcagcatgttcatgctggcggccggcggggtggcgctgatcggcgtgtccgcctggctgtggctgccgaagttcgcgccgaccacggccctgccttatcgccaactgctggcttcgctatgggcgctgctgcgccgccacgccagcctgcgccaggcggcgctggcgcaaggcttgctgtcgatgggcttcagcgccttctggtccaccttggcggtgatgctgcacgcggcgccgtttcatctgggcagcgccgccgcgggggcgttcggcctggccggcgccgccggcgcgctggccgcgccgatggccggccatctggccgaccgccgcggcccggcggtggtggcccggctgggcgcggggctgagcgcgctgtccttcgccgccatgtgcctgatgccgctgctggaccccgtcgcccagctgtggctgctgggcctgggcaccgtgggtttcgacctcggcgtgcaggcttcgctgattgcgcaccagaccatcgtctacggcatcgaccccggcgcgcgcagccgcctgaacgcggtgctgttcgtcagcgtgttcatcggcatggcgggcggagcggtgtgcggcagcatgttgctggcgcaatggggctggctggctgtgaccacgctggccgcgctgctggcgctggcctcgctggcggtacgctgggggcgctggcagtaa

SEQ ID NO: 1014 - DNA, 1005 bp, Chromobacterium substugae
gtgggccgccgcgcagatttgttatacattttacgtatgaaaaaacccatcatcagcgatctgtacccgcagccgggcgtcagcctgccggccagcgccggcgaccggctggaactgatgcagaccttcgtccgcatcgtcgaggccggcaatctgtcggcggcggcccagcaactgggcaccacccagccgaccatcagccgccggctgcaggcgctggaaaaatcgctgggaatgaagctgttgcagcgctccacccacagcatgcggctgaccgacgacggcgaacgctgcttcgcccgcgccaaggagctgctggccggctgggccgccttcgaatccgacctcaggggcgcgcgcgaagagccggagggcatgctgcgggtggtggcgccgcacgccttcggccaggaaaggctggtacggccgctggccgattatctgcagcgctatccgcgcatgaaggtggagtggttgctgcacgacgacagcgcggcgcaggacttcatcgccgccggcatagactgcgcgatccaggtcggcgaggtgaccgattcgtcgctggtggcgatcaagctggcggaagtgccgcgcatcgtggtggcgtcgccggcgctgctggcgggcggacccatcccgcaaaccccggccgagctggccggcctgccgtggctggcgctgcgcacctactaccgccacgaaatccgcctgcgccgcgtcgacggcgaagaagaggcacgcctgccgatagagccgcgcctgagcaccgacagcctgtacgcgctgcgcagcgcggcgctgatggggctgggggtcggcgtgggttcggcctgggtgatgacggaagacctggccgccggccgcctgatccagctgacgccggactggcaggccgcgccgctgccggtcagcctggtgtatccgtacagccgtttttatccggcgcggctgcgcggcttcgtggaggtgatgcgcgccgcgctgcccgacgcgatccgcgattag

SEQ ID NO: 1015 - DNA, 603 bp, Chromobacterium substugae
atgcgattcggatgggtggtttggtgtttgacgctgtggctgaccggctgcgccggctggccggcggatggcggcggctatatcgtgatagccgacaaggcgatcgcccccggcgagatcggggtgggcggcgcggcgatttcaaccgaccccgaggtgtggatccgcgatgtctatttcaacggctcctacatgatggtggtcaaccgctacgccggcgagcaagagaacgccgacgtctacgatatccgcgacagcaagtcgttcaacggctccactttccagcgcatccacaccgacacctgctgctacggcctgccccggcagtggcgccccgggctgcaggcgctggtggagtggacgcagagcccggcgcggccgggcgggcagccgcaggcgcccaccccgcaccgggtattgttgaacttgcccaagtacgacgatccggcctcattgcggctggtgttcctgccctgcggcgacctcaccgcggtcatcgattaccagctgcgcgcgcgggtgttcctgaccgatccgccgaaggggccggccgagctggccaggcggctgggcggccggacgcgctgcgaggcgggcggctaa

SEQ ID NO: 1016 - DNA, 549 bp, Chromobacterium substugae
ttgtggctgacggtctgcgccggcctggcggcgtgccaaacgccggaatcggccaagcgcaagctggtttccgccaccttcgtcaatgtcgatccatcctcccaggtgctgttcgccagcttcgacggcaacagcgtgtgcagcagcagcggcgacacctgcagcgtgtggctgcccgagcaatggcagccgggtcggcgcgccatcgtcaaatggacgcaggaccccagccccgaacgcaatgcggatggcagcaagcgcccgccgtacgggccgggcggcacgaccacccgcgagctcgatcactggcgcgatatgcatgacaacaaccgcgtgctgctggcgctgaatgtcgaggtgccgcgctacgccagcccgtatcatttggagctggtgttcctgccatgcaagcgcgtcgccgtgctgatcgacgccgcagacattcgccgcgtgatggggaatttgcccggcggccaggcgtatgaggcagaaatccgccgccgcttgggcgcggccggcgattgccagccgccgcgggccggcgagtga

SEQ ID NO: 1017 - DNA, 1290 bp, Chromobacterium substugae
atgaagcggccgcagtggagccggcgccagctattggccgcaggcggcgcggccggcgcggcggcgttgctaggttcgttgcgccccggcgagcgcggcagcccgcacgatggttatttccgccagttgtcggccgcgttgcgcgcggccggcatcgccacgccgacgctggtgctggaccgggagcggctgcgcgccaacgtcggccaggtgctgcgcaatctgaacggccgcatcccgctgcggctggtggtgaaatcgctgccgtgtccggcgctgttgcgcgaggcggcggcgctggccggcactcgccggcacatgttgttcagcttgccgcagctgttggcgatggcggagggcgaccacgacattttgctgggcaagccgctgccagccgccgccgcgctggccttctaccgcggtttcccgcccggcgcttttcagcccgagcggcagctgcaatggctggtcgacaccccgcaacggctggcgcaataccgcgagctggcgcgggcgcagcggctgcggctgcgcgtcaatttcgagatagacgtcggcctgcaccgcggcggcatcgccggcggcgacgagatgcgggcgatgctggacatcctgcgttccgagccccggctgcaatgggccgggttgatgggctacgacgcccacgtcgccaagctgcccgatctgcccggcctgcgcgctcgggcgcacgcccatgcgcggcaggcgtacgccggcttcgccgagcaaatcaaggcctggccggggctgatggccggctccggcagcccttgcttcaatgccggcggctcgccgacctaccggctgtacgacggctccggggtggagaacgaggtggcgctgggctcggcgctggtgaagcccggcgatttcgacagcgcgctgctggccgacctgctgccggcctgtttcatcgccgcgccggtgctgaaggcgttgccgcgtttccaactgccctacggcgtcgagtggctgggcgggctgctgcgcgcctgggacgtcaacgcgcggcgcgcctactttctctatggcggcaactggctggccgatccggtttcgccgccggggctggccggcagcgcgctgtatggcgcgtcgtcgaatcaacaggtgttgctgggttccggccggcaggcgctgaaggtcgacgacacggtgtttttccgcccgcgccagagcgaggcggtgctgcagcagttcggcgccatcgccgtgtaccaggacggccgcatcgtcgagatgtggcagccgtttccggcgacggcgtga

SEQ ID NO: 1018 - DNA, 1383 bp, Chromobacterium substugae
atgaagccggccgccgtcactcgccgccgctggctgcagctgggcggcgccgccatgctggccgggctggcggctcgccccggcgcgccagccgcggccaagcctgccggcgcttatctgtggcgcagctggagcggcctcaaccagtgccgggcgcaggcgctggccacgccggccgacgaagccgaactggcggcgctgctgcgcggcggcggcccgctgcgctgcgtcggctccggccattcgttttcgccgctggtgcccaccggcggccggctggtgtcgctcgaccggatgtccggcctgaaaacgcaggaccagcaggcgctgaccgccaccgtgctggccggcacccggctgtcgcagttgtcgcgccagctggatggccatggcctggcgctgcgcaatctgccggacgtggacgcgcagactttcgccggcgccatcagcaccgccacccacggcaccggcgcgcagctgccggcgctgcatgccgacgtgctgtcgctgcggctgctgactccggccggagaggcgctggcatgcagcctggagcggcagccggagctgctgcaggcggcgcgggtgtcgctgggctgcctgggggtgatagtcgaggccggcatccgggtggtgccggcgtattcgctgcggcgccggctctggctgaaaccggtgggcgagatgctggaggcggcgccggaactggcgcggcggcaccgccatttcgaattcttctatctgcccttcaccggttacgccgccgccatcacccacgacatcagcgccgatggcgcggtatcgcatccggattcgcaggatgaagacatgctgcgcgaattgcgccggctgcgcgactggctgggccgcgcgcccgagctgcggcgctgggtggcgcgcaaactgatagacccggggctggtcgagcaggcgcgggacaagtcctggcggctgctgtccaccgccaggccgacgcgtttcaacgagtcggaatgccatgtgccgcgcgaggccggcatcgcctgcgcgcgcgcggtgatcagccggctggagcgtcgcaacgaggtgttctttccgatggagtttcgcttcgtccaggccgacgacgcctggctcagccccttttaccagcgcgactcctgctccatcgccgtgcacgcggcggccggcgaggcttgcgattacctggtgagcgacatcgcgcccatcttccgcaaataccagggccggccgcactggggcaagctgcatgcgcaccaggcggcggatttcgccgccctctacccgcgctggaacgacttcttgcagctgcggcgtgagttggacccggacggacggctgctcaacccgcacctgcgccgggtgttcgggataaggacatga

SEQ ID NO: 1019 - DNA, 384 bp, Chromobacterium substugae
atgcccattccattcgcgcttgatgcgcggcgcgcgctgtccgtcggcgcgctgctttgcctgggggcctgccaggacggcaagccgcaatcggcggatctgcaaaaagccgaaacgctgcgcccggccgatgcccggctggccgaaaagtacgagcgctcctgcctgggctgccatggcgcggcggccagccaggcgccgctgaccgccttcgccgcggcctgggcgccgcggctgcggcagggcatgccggttttgctcgcgcacgcgcgcgacggtttcaagacgatgccggcgatggggtattgcaacgactgcagcgacgaggagctgcggcgcctgatcgtcttcatggccggcgcggcggcgggagcgcgttcatga

SEQ ID NO: 1020 - DNA, 144 bp, Chromobacterium substugae
atgggcatatcgaactcgctccggatggcgggagcgcagcgctcccggacaaaaccagagcatcgcgcatccgcgccggccggcccccagcacaagggacaggtccgcccgcctcccggcccgcccaccccgtattcgccctag

SEQ ID NO: 1021 - DNA, 978 bp, Chromobacterium substugae
atgaccatccatcccgcagacggctacccgcacaccagcaagcattacgcctattccgccggcgaccgggccaggcagtgcttccagttcgtccgcgacatcgacgccgcgatgcgcgccaactattccgccaatatcgaagcgataggccgcaacatctatcccatcctgttcgccgaatccaccttcgacggcggccgctacacgctggtggtgaatcccgacatccgccacgtcaaggaaaacgtctgtccgatctacgaccagtgcaaggcgatctcgcacattccgctgggcatctactccatcctgtccgcctaccagtgcgactccaccctgcagcagtgggcgccggcgctggccgcctaccatgaccagatccagcatgtgcacgaccatctggacgagctggaatggccggatgccggcatcaggcaggccaaccgcgagatcctgcacgcgtcgctgcatttcatccgccacacgctggagcgcggccgctacgatatggaggagttcagccactactcgcgcaagctcaccgcgcagatcgtgctgaaccagaccaccgccgcgcagaaccaggtgcgggtgatgtccgacacgctgcgcgaatggaaggcgatgctgggcgaccggtggcgcgatctctacgtggtggtgtcggcgctgtggacgctgtcgcaggagagcgcgcacgaggagatcatcggcgccttcatggacgaagaccgccgcgaaacccacatgattgtttcggagacgccgcattcggtggacgacgcccaggcgctgctgggccgcatcgtcggcgaccgcatcatggcggagatggtgttctcgccgcacggcaccgagaccgagaaggaaaacatctattcgctgtccaccaagcgcgacctgctgtcgcaagccattgaaaaagccatcgccgaaggcgcgggcggcaccgccgtctgcccccacctgtcgcgctga

SEQ ID NO: 1022 - DNA, 426 bp, Chromobacterium substugae
atgaaacacgtgatgacagccgcggcgctgatcgccgcctccctgaccagcctgcccagccaggccgccgatgtcggcgtttccatcagcgtcggccagcccggcttctacggccagatcgacatcggcggctacccgccgccgcaagtggtctatccgcagccggtgatcatacagccggtgccagtcggcctgccgccgctgtacctgcgggtgccgcccggccacatgaagcactgggaccgccactgccgcgaataccatgcctgcggccgccgagtcttcttcgtccgcgacgactggtacaaccgcgtctacgtgccgcactaccagcagcgccatttcccgcatcatgacggctacgagcaccgcgaccaccacgaagagcatcgcgacgaacatcgcgactacccgcgcgaccgctaa

SEQ ID NO: 1023 - DNA, 1008 bp, Chromobacterium substugae
atgccgactcgccatgctgtccatcgccgcctgctgcccgcgctgctgttgctggcgccttccgcatccgcgctggcctgcgccagttgcggctgcacgctcagttccgactgggaaagccagggcttcgccacccagcccgggctgaaaatggatatccgctacgactacctgaaccaaaaccagctgcgcagcggcagcggcaccatcacgccagcagccgccagccagctgaaccagggcaatcaggaagtggagcagtacacccgcaacaattacctgacgctgggtttcgactatgccttctctccagcctggggcgtcaatgtgcaggtcccgtacatagaccgcagccacagcacgctgggcaccggctccgacggcgccaacgcggccagcggcggcggcgcgtacgactccagcacctccggccttggcgacatcaaggtgataggccgctatcagggcttcgccgccgcgcgcaatttcggcctgctgttcggcctgaagctgcccaccggcagccatagcgaaaccggcgtctccaccgatccggccaatccgggcgccgccgcgccgatagaccgcggcctgcagccgggcaccggcaccaccgacgccatcgtcggcgcctactattacggcgaccttggccgcagctggagctacttcacccaggccaccgtgcaaagcgcgctggacagcgccaaccagtaccggcccggcaccggcgtcaacctgaacctgggcgtgcgctatgccggcttctccggctggatgccgcaattgcagctcaacgcccgctacgtgcgacacgacgccggcgacaacgccgacaccgtcagcaccggcggcacgctggtctacctgagccccggcctgaccgtgccgctcacccggcgggcctcggtctacggcttcgtgcaactgccgctgtaccagcacgtcaacggcgtgcagctggcgccgcgctacaccacgtcgataggcgcgcgctacgcgttctga

SEQ ID NO: 1024 - DNA, 4353 bp, Chromobacterium substugae
atgggagggcggatgacggcgcgcaagaacgggctgacctgggtggtcacgtcggcttatgcagtgatcgcttcgatctggatcatcgtgccggatgtgctggtggacaccgaccgcgccataggaggggtggtcggcggcctggcttgggacggtctgttcacttttgtctcggcggccttgctgtatcttgccttgcggcaattgccggaagaaagcctgtccaaactggccccgcctggccgcttgccgcgctggctggccgcgcgcccgcgccatcagccggcggcgctggcgctcgggtacgcgctgttgactttattgatgatgaccatgccggattggctgcagagcggcatggcgagtcggcagtggcaagtcaggctgaccctgtgctgggacgcgctgtatgtggcggccaccgccatcctgctgttccatggcttgcgccgcttgcggcggcccggtgatgaggtggccggacgccggcacggttccgactatttgttcgccatcgtcagttcgctgctggtcatcggcatgcgcgcgcaattgcatccggagttcggcaagcaccaccggatgctgctgtttctgataccgataagcctgagcgccttattgggcggcgtggggccgggcttgctgtccaccggtctgatcacctctgtcatcggctacctgtttttcacctcgacgccggatatggcgggcagcccgatgtcgtttctgctgtcgctcagcctgttggcgctcaatggcgtgttgctcagcctggtgagcgaaatccacctgcaggggaaagcgaagctggaggcggcgctgcgccggcagagcgccgacgccgaagcgctgcggcagagcgacgagcgttttcgcgcgctgttcgagggcagcccggtggcgatggcgatctcgcgattggccgacggcctgctggaggaggtgaacgaggcttttctggatatgtttggtctggaggaacaggctgtgctggggcgcacgacgggcgagctgggcatctggcaggacgtcgccgaccgtcaggccattgtgtcggcattgcgggagcaaggctgcgtgcaaggcgcgccggtggcgctccgccgctccgacggcagcgtgctgtatgcgctgctgtcctttcgccaggtgcgtttcggcgggggcgagcatatccacggcgtggtgctggatgtcagcgcccagcatgccgcgcagcaggcgctgctaaggatcgagcacgagttccggttgctgatcgactcgatcaccgactacgcttttttcctgttgtcgccggagggcctagtgctgaactggagtaacggctcgcagggaatcaaggggtatacgaccgaggaaatcgtcggccgttctttcgattgtttctataccgcagaagaccaggcggcaggcgtgccgcaacaattgcttgccaatgcggcgcagcagggccgcgatgtgcacgaaggctggcgggtgcggcgcgacggcagccgtttctgggcgcgcgccatcctgtacgcgatccgcggcgacgacggcgagttgcaaggctatgccaaggtgacccaggacctgaccctgcagcaggcggcggagcgggagctgcgcgacagcgaggcgcgctacgccggcatgatacgttcggcgatggatggggtgatcagcatagacgccggtcagcgcatcactttgttcaatccggcggccgagcggatgttcggctacagcgtcgacgcgatgctgggtcagccgctggaccgcctgttgccgccaatgttgagcgaactccaccgcggcaaggtggaggctttcggccgggggatggcgagcagccggcggatgggcggccagggaaagatccagggcatgcgagccggcggcgagctgtttgatctggaggcgtcgatttcgcggctggaggtggcgggagagcgcagctacacggttatcctgcgagacgtcagcgagcgcgagaacacgttggccgagttgcggcgccacttgcagcagctggaatccatgaatgagctggcgcgcgccattctggcagccggcatgccggaacaggtggcgcagctgggcctgcgctatttgcggcgcctgctgccgttctggggcgccaccgcgatgatcgtcgactgggaggcgggcgctacccgggtgctggcggtggagcgcgagcccggcgccagctacgatcccggccagcggctgacgctgatcagctacggcctcgaggatctggagaggctgaagaaggggctggtttgccgggtggatgatctggacgcgctgccaaggcgctcgtccacgctggagaggctgcgtctgcagggtatgcaatcgtatatccgcattccgctgatggcggctggcgagttgctgggcatgatgaatctggcatcggacaaattgggcgcgttcagcgaagcgcagcaggaggtggcggacgtattcgcccagcaactggcgatcgcgttgcagcagtcgctgctgcgtcagagcgtggagcggcttggcagggtgtaccggctgctcagccgcgtcaatacgctgatcgtgcgctgccatcagcggcgggagctgttcgacggcgtgtgccggatcgcggtggaggatggcgcttaccgcatggcctggataggcgtgatggatccgcaaagcggcgacggcgaggtggcggctttttgcggcgaggacgacagttatcgggcgctgatccgcctgagcgcgcgcgccgattcgccgtttgccgacaggccggcttgccgggcggtgcgcgaacaggaaatggtggtatgcaacgatgtgcaagcggacccctctttgcgggcgctggctcgggatctgatggcgcgcggcctgcgcgcggtggcttgcctgccgatcgtgacggatggacgggcgcaggcggtgctggcgctgttttccgaggcaagcggcgctttcgatcgccaggaggtgcagctgctgcgcgagttgtccggcgatatcgccttcgcgctcagccatatcggccagacggagcgattggactacctggcctattacgacagcctgaccggcctcgccaaccgcgggctgctggcggagcggctggcgcaacgcatcaccgacgcggcggagcgccgcttcgccatcgcgtttctcgatctggagcatttcaagtccatcaacgacgtgttcggccgcgtcattggcgaccaggtgctgcagcgtttcgccgaccgcttgcttcggcatgtgcaggatgcctcgcagctgtcgcgcatcggcgccgaccagttcgcgctgatcctgccgcaggcgggcggggaggaggaggcggcccgccaggtgcagaaattgcagcttgaatgcctggacgcgcagatggagataggcggcgccgagctgcggctatcggccaaattcggcatcgccatgtatccggacgatggcgcgcaggcttcggatttgatggagcatgtcgagtcggcgctgaagcgggccaaggccgccggcgccaagagcctgttttaccggcaggagatgaccgaacgggcggcggcggcgctggaactgggcaatctgctgcatgccgcgttggcgcgcgggcagttcgagctgcactaccaacccaaggtcgaggccaacagccatcacttggtgggcgtggaggcgctgctgcgctggcgccatcccgagcgcggcctggtgtcgccggaacagttcgtgccgctgctggaggagctgggcctgatcgtggaagccggtcgctgggcgctggagcaggcggcgcgcgaccatcgcggctggcgcgaagccgggctggcgtcgccgcgcgtcgccgtcaacgtttcgccgcggcagctggggcaagcggatttcgtggcgatgctggcggaggtgctggcgccgtacggcgccgaccacggcatagatctggagatcaccgaaagccagatcatggaggatgtggacggcggcatcgccaagctgcgcgaggcgcgcgaattgggcgtggccatcgcggtggacgatttcggcaccggctattcgtcgctggcctatctggcgcggctgccggtgcaggcgctgaagatagaccgctccttcgtcatgggcatgctggacgagcccgagtcgatgacgttggtggaaaccatcatttccttggcgcacgcgatgcagttggaggtggtggccgaaggcgtggagaacgccgagcaggccagggtgctggccggcctgaattgcgatgtgctgcagggctactggctgagccgcccgctgtccgccgaccaactggcggacaagctgcggcaggagcggcgctgggccagcccgcttaagcgcggatga

SEQ ID NO: 1025 - DNA, 2811 bp, Chromobacterium substugae
atggctcaacaagcagacgataaatccaccgccagctctggcttgaatctgagggatgtgtttctcatcgccgtgatactcggcttgctgattccggcctccatcatcagttatctcagcttcaacattcagaaggacaacctgaccacccagctggaaaccgaccagcgccgtctgctcgacatcgtcgcgctgggcatgcaggagccgctgtggaacctcagccgccaggccggcaatccgctgatttcgtcggtgatggaagacccgcgcgtgatttccatccgcgtcaccgacacccagtccaaccaggtattcctgtcctcggtgcgcagcgagcgccgcatcggcagcgtgtcctacgtcgagaagccggtgatctaccgcggcgaggccatcggccaggtgacgatggagttcgacaacgagaacctggccatcgcgctgagcaaccaggtgaagaacatcctgatgatactggcggcgcagctggtgctgtccatcatgctgatcatgagcatcctgcactcgcgcttcctcagcccgatgcggttgttgaccgagcaggcgcggctgttggccgagctgaagctggatacgccgttcgagtggtcgcgccgcgacgagctgggccggctcggcacccacctggagtggacccgctccgaattgaagcggctggtcgacgaattgcgcgccaagacgctggcgctggaggccgacatcgcccgccgccgcgaggtggaggacgcgctgcgccgctcggagaacaaataccgcgagctgttctggtccaatcttgacggcatcgtcatcagctcgctggacggccaggtgatagacgccaacccggccttcctcaatctgatgtgctacagcctggaccagctcaagcagcagaacttctggagcctggtggccgaagagagcgaggcgctggagcgcttcaacctcgacaacaaggtgctgcgcttcggctattgcgacgaattcgaagccacctatctgaaccggttcgacaaccaggtgccggtcagcgtcaagacggtggcgatgcgcgacgccttcggccgcatcaacgcggtgtggcggatggtgcgcgacatctcggaaaagcgcgccgccgaagagcgggtgcagctggcggccaaggtgttcgaaaataccgtcgaaggcatcatgatcaccgacgccgaccgccgcatccgcagcgtcaaccgcgccttcaccgaaatcaccggctacacccagcacgaggtgctggggcagaagaccagcatcctgtcgtccggccgccacgaccagcccttctacgaccagatgtggcaggccatcgccgaagacggctcctggcagggcgaactgtggaaccgccgcaagaacggcgaagtgtatccggaatggctggcgataaacgcggtgcgcaacagcctggaggaaatcacccattacgtggcgatcttcagcgacctgaccgaacgcaaggccgccgacgagcgcatccagttcctggcccacttcgacgtgctgaccagcctgcccaaccgcatgcacatgcaggaccgcgtcgagctggccatccacaacgcggtgcgcgacaaccagcggctggcgctgctgctgctggatctcgaccgcttcaagaccgtcaacgaatcgctgggccactcggccggcgacaccttgctgcaggtggcggccgaccgcatccgcactgtgctggggccgggcgaaatgctggcgcgccaggggggcgacgaattcatcgtgctgctgccgctggtgtccgatccgggcgaggcggcgctggcggccgagcgggtgcgcgaggtgttcgccaacccgatcgagctgcacaaccacgtgatcaccatcacgccgtccatcggcatcagcgtctatccggacgacggccgcgactacgaaaccctggtgcgcaacgccgacgcggcgatgtaccacgccaaatcgtccggccgcaacagctacaagttctacaccgccgacctcaacgcccgcgcccgcgaaatcctggcgattgaaagccagctgcgcttcgcgctggagcgcgacgagttcgtgctgcactaccagccgcaagtggagatgcaaagcggccgcatcgtcggcgccgaggcgctgatccgctggaaccacccgtcgctgggcctgctgggcccggtgcgcttcatccaggtggcggaagagcgcggcttcatcgtgcagatcggcaactgggtgatcggcgaagccacgcgccagctggtggcctggcgccaggccggcctgccggagctgacgctggcggtcaatctgtcggcgctgcagttccgccagcccgatctggccgaacagctgcagcacgcgctggcctccagcggcctgccaggccacgcgctggacatcgaggtgaccgagagcatcatcatggaagacgcgcaggccaccatccagaccatagacaatatgaagaacatgggcctccggctgtcgatcgacgacttcggcaccggctactccagcctgtcctacctgaagcgcttcaaggccgacaagctgaagatcgaccgctccttcgtgcgcgacatcccgcaggacgccgacgacagcgccatcgcccgcgccatcatcaatatggccaagaacctgaacatgcaggtggtggccgaaggcgtggagacgatggagcaatggcagttcctggagcaggagggctgcgatttcgtccagggctacctgatcgccaagccgttgccggccgacgacttcgccgcgctgctgacgcgcgacagcctgctgccgcaaagctga

SEQ ID NO: 1026 - DNA, 1320 bp, Chromobacterium substugae
atgccgcagtcacgttatgaaaagattatctccgcccgctggatcatcaccgtggaaactgacggcgaagtcctggaaaaccacgcagtcgcgatcaaggatggcaggattgccgccattattccagcggcgcaggccgccggcctggatgcggacgaacggctggagctgcccgatcacgtgctgatgcccggcctcgtcaacctgcacggccactcggcgatgacgctgctgcgcggcctggccgacgacaaggcgctgatggactggctgaccaaccatatctggccggccgaaggcaagcacgtccacgacgacttcgtgttcgacggcgcgctgctggcgatgggcgagatgatacgcggcggcaccaccaccatcaacgacatgtacttctacaacgccgcgatggcgcgcgccggcctggcgtccggcatgcgcaccttcgtcggctgttccatcctggaattcccgaccaactacgcggccaacgccgacgactacatcgccaagggcatggccgaacgcagccagttcctgggcgaagacctggtcaccttcaccctggcgccgcacgcgccctacaccgtatcggacgacaccttccgcaaggttgtgacgctggccgagcaagaagacatgctgatccactgccacatccacgaaaccgcggacgaagtgaacaacagcgtcaaggaacacggccagcgcccgctggcccgcctgcagcagctgggcctgctgtcgccgcgcctggtggccgcccacatggtgcacctgaacgacgccgagatcgaactggtggccaagcacggtctctccaccgcccacaacccggcctccaacatgaagctggcctccggcatcgcccccatccccaagatgctgcaggccggcatcgcggtcggcatcggcaccgatggcgccgcctccaacaacaagctggacatgctggcggaaacgcgcctggccgcgctgctggccaaggtgggcacgctggacccgacctcggtgccggccgccgccgccatccgcatggccacgctgaacggcgcgcgcgcgctcggcatcgccgacaagaccggctcggtcaaggaaggcaaggacgccgacctgatcgccatcgacctgtcggcgctggagaccgcgccggccttcgatccgatctcgcacgtggtgtacgccgccggccgcgagcaggtcagccacgtctgggtcaagggccgcgcgctgctggccggccgcaagctgaccaccctggacgaatccaacttgaaaacccgcgccgacgattggcgcaaccgcatcctggcgaagtaa

SEQ ID NO: 1027 - DNA, 702 bp, Chromobacterium substugae
atgagcaatgtagacgaactcgaaatcgacaaattcagccagctggcgcacaagtggtgggacaaggacagcgaattcaagccgctgcacgagatcaacccgctgcggctggacttcatcgaccgccacgcctccctcgccggcaagaaagtgctggacgtcggctgcggcggcggcatcctggccgagagcatggcgcaaaaaggcgcgcaggtgaccggcatcgacctggccaagaaatcgctgaaggtagcgcagctgcacagcctggagtccggcgtgcccatcgactaccgctgcgtggcggtggaggatctggcagcggagatgccgggcgccttcgacgtggtgacctgcatggaaatgctggagcacgtgcccgatccgcaaagcgtggtgcgcgcctgcgcccaattggtgaagccgggcggctgggtgttcttctccacgctgaaccgcaacgccaaggcctatctgctggccgtggtcggcgccgagtacgtgctcaacatgctgccgcgcggcacccatgaatacgcgcgcttcctcaagccgtcggagctgggccggatgacgcgccatgccggcctcagcctgcagacgctgagcggcatgggctacaacccgctcacccgcatctactcgctgaacgacgacaccgctgtcaattacctgatggccacccgcctgccggccgcctga

SEQ ID NO: 1028 - DNA, 669 bp, Chromobacterium substugae
atgactttcaaggccaacgacctgctgaccgagcagatcgcccaatacctaggcaaacagatcatccagggcgacatgcaaccgggcgagcgcatccaggaattgcggatcgccgccgaactggaggtcagccgcggctcggtgcgcgaggccttgctgatattgcagcgccgccatctggtggacattttcccgcgccgcggcgcggtggtggccagcataggcgcgcgcgacgtgcgcgatttcttcgacctgtggttcctgctgctggaccgggtggcgcaaaacctggccgccggctggcagaacgacgacctggcgcgcttcatcgagctgatggcccagctggaggaagacaaccgccgcgatgacctgcaggccttctacgagcacggcatcgaattcctgtcggcgctgtacaaccatgccgacaaccgctacctgaccgataccctgaacgacatgctgccgctgacccagcgctgcctgtacgcgatactgcgcgccggcaagagccagatggacaacacctaccgtttcctggaaagcctgctgaagacgctgatcgcgcgcgacaccagccggctcaagcaaatggtggccactttcggccaggaatacagccagctggcgcaaaccgcggccgaggcgctggaaggccgccgctaa

SEQ ID NO: 1029 - DNA, 498 bp, Chromobacterium substugae
atgacggcgcagaacaaaccgcggctgaccctggtggcggcgatggcgtccaaccgcaccataggtgtggacaaccagctgccctggcatctgccggaagacctgaggcatttcaaggcggccacgctgggcaagccggtgatcatgggccgcaagacctgggactccatcggcaagccgctgccgggccggcgcaacatcgtggtgacccgccaggccgattggcgggcggacggcgcggaagtcgcccactcgctggaggaggcgctggcgctggccggcgcggtggaggaggtgtgcctgatcggcggcgccgagctgtaccggcaggccatcgccgtggccgaccgcttgtgcctgaccgaaatcgccgacgcctacgacggcgacgcccacttccctgaattttccgccgccgactggcggcaggcctcgcgcgaggaagcggtcagcgccggcggcctggcttacgccttcgtcaattacctgcggcgctga

SEQ ID NO: 1030 - DNA, 795 bp, Chromobacterium substugae
atgcaacagtatctcgacctgatgcgccatgtgatggagcatggccacgacaaggccgaccgcaccggcaccggcacgcgctcggtgttcggctaccagatgcgcttcaacctggccgacggttttccgctggtcaccaccaagaagtgccatctgcgctccattatccatgaactgctgtggttcctgtccggcgacaccaatatccgctatctgaaggaaaacggcgtgtcgatctgggacgagtgggccgacgaaaacggcgacctcggcccggtgtacggctaccagtggcgtagctggccggcgccggacggccgccatatcgaccagatcagccagctcctgggcatgatcaagaagaatccggactcgcgccgcctgatcgtatcggcatggaacccggctttggtggaccagatggcgttgccgccgtgccacagcctgttccagttctacgtggccgacggcaagctgtcctgccagctgtaccagcgttcggccgacattttcctcggcgtgccgttcaatatcgccagctacgccttgctcaccatgatggtggcgcaggtatgcgggctgcaggccggcgatttcatccacacgctgggcgacgcccacctgtacagcaaccatctggagcaggcgcaattgcaattaacgcgcgaaccgcgtccgctgccgacaatgaagctcaatccggcggtgacggatctgttcgccttccgtttcgaagacttcgagctgcaaggctacgacccgcatccccacatcaaggcggcggtggcggtatga

SEQ ID NO: 1031 - DNA, 1110 bp, Chromobacterium substugae
atggcgcgggaagacggcaacatcccccgctcgcgggagttgtcgacgttcgccgtcaccatggccggggtatcgctgctgatgaacctgggcggcaagatcggcaccttcctcggcgacaccatgcgccacctgctgaccttcgaccagagcacggtgcaaagcaccgagccggtgctgctgcgcttcaaggaagccattttcggcgcgctgtggcaattggcgccgttcttcgccggcctggcgctggtggcgctgttcacgccgatgctggtaggcggctggaacctgacgctgaaagcgatcggccccaatttcggcaagctcaaccccttgcccggcatcaagcgcttgttttcgctgaacgccgtcaccgaaggcttcaaagccattctgaaaagcctgctgataggcggcatcgccacctggtacatctggcgcgagcgcggcgaagtcatcggtctattggcgatgccgctggaatcggccatcctgaagatgaccgacctgatcatccacaccttcttcatcgtcgcctcggcgatgatcctgctggtggcgatagacgtgccctaccagctgtggagctactacaagaagctgcgcatgaccaaggaagaggtcaagcaggaatacaaggaagccgaaggctcgccggaagtgaagggccgcatccgccagatgcagcgcgaggcggcgcgcaagcgaatgatgcaggaggtgcccaaggccaacgtgatcgtcaccaacccgacccacttcgcggtggcgctgaaatacgacgacaccatgcgcgcgccgcaggtggtggccaagggttcgctgaagctggcggaaaaaatcgtcgacaccggcaagggcagccatgtgccggtgatgcgctcccccagcttcgcgcgggcgctgtacttcaacgccgagctgggcgaggacattccggcgccgctatacgcggcggcggcgcaagtgctggcctatatcttccagctgcagcaataccaggcggtcggcggcctcgcgccggtgttcccggacaagctggaagtgcccgccgagcttgacccctacagcaaacgtccgcaagattcggcgcctgaagaaagcctataa

SEQ ID NO: 1032 - DNA, 2082 bp, Chromobacterium substugae
atggactccatcctacagatcctccgcagcctcaagatctcccagctcgccgggccggtgctcatcatcctgatcctgacgatgatggtgctgccgctgccgccggtgctgctggacatcttcttcaccttcaacatcgcggtgtcggtgatcgtgctgctggtcggcatcaatgtcaggaagccgctggatttctcgtcctttccctcggtgctgctggtcaccacgctgctgcggctgtcgctgaacgtcgcctccagccgggtagtgctgctggaaggccataccggcccggacgccgccggcaaggtgatcgaatcgttctcccacttcctggtgggcggcaacgtcgccatcggcatcgtggtgttcgtcatcatcaccatcatcaacttcgtggtgatcaccaagggcgccggccggatcgccgaagtgtcggcgcgcttcaccctggacgcgatgccgggcaagcagatggcgatcgacgccgacctcaacgccggcctgatcggcgaggacgaggcccgcaagcgccgctccaccatcgccgaggaagccaacttcttcggcgcgatggacggtgcctccaaattcgtccgcggcgacgcgatggccggcatcatgatcatcctgatcaacatcatcggcggcctgatcgtcggcgtggtgcagcacgacctgccggccggccaggcggccgaaacctatacgctgctgaccataggcgacggcctggtggcgcagatcccggcgctgatcatctccaccgccgccggcatcgtggtgtcgcgcgtcggcaccgaacaggacatgtcggagcagttcctgacccagctgttcaccaagccgcaggtgctgtacatcacctcggcggtgataggcatgataggcctgatccccaacatgccccatctgtccttcctgctgatcgccggcgcgctgctgctcctggcccggatgatggagcaacgccggctgcgcgacttggcccgcgaacagcaggccgcccagccgccggcgccgccggagcagcaaggcgcggaagtcagctggaacgacgtccagcacgtcgaccagctcggcatggaagtgggctaccggctgattccgctggtggaccgtacccaggacggcgagctgctgcgccgcatccgcggcatccgcaagaagatcgcgcaggatctgggcttcctggtgccgccggtccacatccgcgacaatctggaaatcaagcccaacgcctaccgcatcctgctcaagggcgtggagctgggcaagggcgaggcctatatcggccagttcctggcgatcaaccccggccgggtcagcaaggagatcgccggcaacgccaccaccgacccagccttcggcctgccggcggtatggatagaggccggcaagcgggaagaagcgcaatctctgggctataccgtggtggatgccagcaccgtggtggccacccatatctccaacctgctgcaaacccactcagccgagctgctgggccgcgaagaagtgcaggcgctgatagaccaccaggccaaggaatcgccgaaactgatagaagacctggtgcccaaggtggtgccggtcggcacgctgcagaaagtgctgcaacagctgttgaacgacggcatccacatccgcgacttccgcaccatcgtggaaacgctggccgaccatatcggcgtcacccaggatgtggacgagttgaccggctccgtccgtaccgcgctgtcgcgggtgatcgtgcagcagctcttcccgggcgaagccgaactgccgctgatgacgctggagcctcagcttgaaaacgtgctgatgcaggcggtgcagtccaaggccggcggcggactggagcccggcctggcggaaaacctgctgtccagcgcggcgcaacagaccgaacaggtggagattcagggttacaatccggtactgctgaccgcacccggcctgcggccgctgctggcgcgtttcctgcgccgggcattgccgcagctgcgtgtgatttcgcataatgagattccggacaataaatccattcgtataattgcggtaatcggcggcagcaagggctaa

SEQ ID NO: 1033 - DNA, 1479 bp, Chromobacterium substugae
atggtggtgaaaaagttcttcgggaagaccactcgagacgcactcaggcaagttcgcgaagaactgggggcggacgccctcattttgtccaatcggcccaccatgggcggcggcgtcgaaatcatggcggtggccgacgccgacgtcgccaacctggccagcacgctgtccacctccagcagcaagcacccgccgcgcaacgcgccgccggcggtgaaccgcccgcagcagcccgcgcccatcccgcccaacggcagcgcggtgaaccgcgccatcgcccgcacctacgcgatgccggtggagccgctggaaagcccggcggcgccgcgtctggaaagcgcccctcggccgcggatggagccggtctacgcgccgcccgagccggcgcaggccccgccgcgccaaagcgcgcaaccggtccgtccagccgccgcgccccagccggcccaagcgcgcccggcggcgcggccgccgcaaatgccggcgtcgccgccgccgacgctgtcccacgccaatggcgaggagccggaacaaatggcgcaggaactcagacagataggcgacgagatcaagctgctcagaagcctgctgcaaagccagctggccagcttcgcctggtccgacatggagggcaaggcgcccaatcgcatcgagctgttcaagcacctgctggcgatgggcttctccgcgcagctgatccgccaactgattgaaaaaatgccggcgcaataccaagccgaagtggcggtgaaatgggcgcgctcggcgttggtgcacaatctgaaatgcgccgacgccgaccgcgaggtgatggaccgcggcggcatcttcgcgctggtcggccccaccggcgtcggcaagaccaccaccgtggccaagctggccgcccgcgcgacgatgcgcttcggcgcccagcacgtggcgctgatcaccacagatagctaccggatcggcgcgcaggaccagttgcgcatctacggcaagatcctgggcgtgccggtattttccatccagaacgagggcgacctgcagctgacgctggccgacctgtccaaccgccacatcgtgttcatcgacaccgtcggcatgggccagcgcgacgcgcgcgtgctggcgcagatcgacatgctgcgcaccgccggccggccgatagagcggctgctgctcttggccgccaacaccgacggccatacgctggaagacgtggtgaaacgctaccgcggcgacggcctggccggctgcatcctgtccaagatagacgaagcggtggcgcaaggtcccagcctggatgtgatcatccgcaaccggctcaagctgtatttcatcaccaacggccagcgcgtgccggaagacctgcactcggccaacgccgccttcctggtggaccgcgcgatgcgcgcgcagcagataggctcgccgttttcgctgcaggccgatgaattgcccatcatgcaggcggctcaggccggatggctgtga

SEQ ID NO: 1034 - DNA, 879 bp, Chromobacterium substugae
gtgaacgcgatgacggatcaagccgccagcctccgcctgctcgccgcgcagcagaaccgcgctcccagcttcgccttcatcggctcggagcgctccggcaccagcaccgtggtgaccgagttggcgctgggcctggcctatgccgggctgcggccgctggtggtagactgttgcctggggcaggtgcagacgcgccgcctgggcgtccccgccaccgccacgctggaaagccaggtggtcaacgccggcgggctggacgacatgatgatcacctcgcgccagggggtacagctggtcaatctctatgcgcggccggaacagcgcgcgctgttctccgcccaactgtggctcaggctgggcagcgaattcggcgcgcaggagcgcgacgcctcggcgctgctgatcgacgtgcccaaccccggcctggacgccatccccgccagcgtggccgacaacctggtgctggtgctgaccccggccgccgaatcgctgaccgccgcctacgccaacatcaagcgcctggccagcctgtacggccgccagcgcttcaatgtgctgatcaaccgcgcgcgccatctggacgaggcgcgcgagctgttcacccgcctgtcggccgtcaccagcgaattcctgacggtgtcgctgcgctgggtgggcttcgtgccgcaggacagcgccgtgcgccgcagccagacgctgcaccgtccgatgatggaagccttccccgacagcgaggccgccgcggcgttttcccagctggcggcggtgctgctgcattgggacgcgccggaaaccacacgtgacaataccggatacatggacttgctgattgccgcctcgcgcgactgggccgaggcagatggagccaaacccctatga

SEQ ID NO: 1035 - DNA, 741 bp, Chromobacterium substugae
atgaacccgtcctttcgccgatcgggctacgccaatgcggcccccagcgtcgagatagacgtggaggcccacgcgccgctggtacgcaaactggccagcatcatgatcgcccggctgccggcctcggtggatctgggcgacctgatccaggtcggcatgatcggcctgatcgaagccgcgcgccagttcgacccggcgcagggcgtgatgttcgaaactttcgccagtcagcgcatccgcggcgcgatgctggacgaactgcgccgcgaggactggctgccgcgccaggcgcgccgccaggcccgccagatcgaagaagcgatcgcccggctcgaacagcagctcggccgcgcgccgctggagtcggaaatcgccgccgagctgggcgtggagctggagcagtaccaggacatgctgggagaatgcaagggcaccaccctgctacacttcgaggacttcgccagcgacgacgagaacccgcacaacccggtggccaacgtcgccgacgacgattcgccggacccgctggcgacgctggccgacgacagcttccgccagcatctgatcagcgcgatcaaattcctgcccgagcgcgaccagctggtgatggcgctgtactacgagcaggagctgaacctgaaggaaatcggcgcggtgctcggcgtcaccgagtcccgggtctgtcagctgcacagccaggccatcgccaggctgcgggcaaaactgaaagactggctgtaa

SEQ ID NO: 1036 - DNA, 750 bp, Chromobacterium substugae
gtggacaagatcagtcttatcgccatcatcctgggcctgaccgccatcgtcgccggccaggccatcgaagggggcagcctcggctcgctgatgcagctgaccgccttcatgatcgtcatcggcggcaccaccagcgcggtgatgctgcaaagcacgcccaagcagttcatggccggcctgcgcatggtgcgctggatcttccgcccgcccaatttcgaccacgagaaaatgatccgcgaagtggtgaactggagccagacctcgcgcaagggcggcctgctggcgctggaaggcgtgatcaatcagcaacgcgatcccttcaccaagaaagcgctgcagatgctggtggacggcaccgagccggacacgctgcgcgcggtgatggacgtggaaatcagcatgttcgagcacgcccgcaagcaggcggcgcggatctgggaatcggccggcggctattcgccgaccatggggattctgggcgcggtgctgggcctgatccacgtgatggaaaacctctccgacccatccaagctgggcggcggcatcgcggtggccttcgtcgccaccgtctacggcgtcggttcggccaacctgtttttcctgccggtcggcaacaagctcaaacacttggtggcgtcggagctggcgatgaaagagctggtggtggagggcatagtcgccatcgccaacggcgaaaacccgcgcatcatcgaaagccggctgcgcggcttcctggcgatgcatgaataa

SEQ ID NO: 1037 - DNA, 1416 bp, Chromobacterium substugae
atggatagattgaataccctgtttgaacaaccctgcgccatcgtcgatctggaaaccaccggcggcaatatcagccgcgaccgcatcaccgaggtgggggtgatcctgatcgacggcgagcgggtggagcgccatgcctggctggtcaatcccggccagccgattccgccgttcatcgaaaacatgaccggcatcagcaatgagatggtggccgcggcgcggccattcgccgaactggccgaggagctgctggcgcggttgcaaggccgcctgttgttggcgcataacgcccgcttcgactacgggttgctgaagaacgaatttcgccgccacggcctgcgcttccagacgcgggcgctgtgcacggtcaagctgtcgcgccggctgtatccgcagcatttcaagcacagcctggatagcctggtggcgcgtcacggcatagacatgccggagcggcaccgcgcgctggccgatgccgaggcggtgtaccgcttcctgcggatcgcggaaggggagctgggacaggggcgcctggcgcatgaggcggagcaactgttgtcgcagccggccgaacttggcgatcttgcgccgcagttgcagcaacagatcgaggagctgcctgattcggctggcgtctatgcgctgttcggcgcggcgggcgaggcgctgtatgtcggccgcgccgccaatctgtaccgcaaggtgctggggcatttcgccaaggccaagcccggacacaagagccacgaggtgcgcatcgacgagccggtggcgcgggtggagtggcgggagagcctgggcgaattcggcgcgcatctgcaggagctgcagtggctgcgcgcctatcagccgctgcataacccgcgcgcgcggatgttgagcgaggcctgttcgctgcaactgcgggtggaggaggacggtttcgcgcggctgcgcgcggtgtcggcgcaggatatcgatttcagccgcaccaccgatctttacggcctgttccgccacgcgcgcgaggcgcgcaaggcgctggcgcagatcgcgctggcgcaggggctgtgccaggcggtgctgggggtggagcaggtgaccagccgcaagggcgtagcctgcaacgcctacagcctgaatcgctgccgcggggcctgcgtcggcaaggagggcgcggacagccataatctgcgcctggtgtcggccttgcagcgcctgaaggtcaggcagtggccgttcgaaggggcggtggcggtggtggagcgcgacgaggtgtgcggcgacgtggtcgagcatctgttcgaccgctggtgctaccttggttcgcgccgcaacggcggcgaactggatggcgagccggctttcgatctggactactacaagttgctggagagcgagctgcgcaagccggagcgggaactggcggcgcagtga

SEQ ID NO: 1038 - DNA, 74 bp, Chromobacterium substugae
gcacccgtagctcagttggatagagtatctggctacgaaccagagggtcgggcgttcgaatcgctccgggtgca

SEQ ID NO: 1039 - DNA, 72 bp, Chromobacterium substugae
gtccctatagtttagcggttagaacaccgccctttcacggcggtagccggggttcgattccccgtggggacg

SEQ ID NO: 1040 - DNA, 74 bp, Chromobacterium substugae; identical to SEQ ID NO: 1038

SEQ ID NO: 1041 - DNA, 72 bp, Chromobacterium substugae; identical to SEQ ID NO: 1039

SEQ ID NO: 1042 - DNA, 462 bp, Chromobacterium substugae
ttgatattcgccatcggcttgtccgaactgctgaaaaacgacccgtttgtcatgagtgcgatccagatcgccggcgtgggctatattctttacctcgcgtatcggcaatggaccagcaagggcgtgcggatggaagtggcgggtttgtcgagtgatatgagattcggccagttgttcatcaagggcatgctgaccggattttcgaatcccaagacgattctgatgttcagcgcggtattcccgcagtttgccgggcgggcgggcagccgggcggcggacatcgccatcctggggctgacttttctgctgctgcagttcgccagcgggtgttcctattgttatttcgggcagcggatcaagcatgtgctggatcagccgagaagacagcgcctgatgcagaggatcacggcggtgctgctgctgggcgtggcgggaatgctggtgaatagctttgccgcctag

SEQ ID NO: 1043 - DNA, 1419 bp, Chromobacterium substugae
atgccaatctccccgatcgcctttcatccaggcagtcccaaggttcagcaaatcgtcgaatccctgagcgaagccatcctgcagggcaccatccctgcgggcagcaagctgccatcgatccgcgagctgacgcgcctatttggagttgggaaattcacggtcatcgacgcgctggataggctgcgcggctgccatctggtgtcatcccggcaaggccggggctttttcgtctccccgctcaatgcggcgccgactgcggcgccgctggccgacttgatgccgcaagacctgatcagcatcctgcgccgctcgctgatagccgacaacggcgccatgcgccccggcagcggccacctgccggaaagctggctggataccgacgcctaccgccaggcgatgcgcgcaaccgtgcgttcgccgctgctgaggatatccggctacggcagcccggccggctatctgccgctgaggcaagcgttgcagcagcggctgagcttgcaaggcatgaccgtccaactggaacagatcgtcactaccgccaataccgtgcaagcgatagacatgctgctgcgcctgctgctgcgccccggcgacaccgtgctgctggacgatccctgctatttcaactttcacgccaatctggcgctgcatggcgccagcgtcgtcaccatcgcccgcaacaccggcggcatcgatttcgatcagctggaaacgctgctggccgcccgaaagccgcgcatctacctgaccacctccctgctgcacaatcccaccgggcactctttcacacccgcccaatcctaccgcctgttgcagctgaccaagcaatacggctgccacatcgtggaagacgacctatacggcgacctgcacagctcgccgccgccgcggctggccgccctggccggctttgatcatgtcagctacctctccggcttttccaaggtgctgagcgccaacacccgagccagctacgtggtgaccacgcccgacctgtcggccaagctgtgccatttgaaattgatgagcggcggcatcacgtcggagctgctggaacaactgctttgccgcatgctgaccgagggcagctacggcaagcaccgcaatcgcctggtggttcgcctgctggagtccggttcccgggtggccgagtggctgcggcagagcggctgcgagccggcccactcctttgacggcggcatgttcatctgggcgcggcttcccgccggcatcgatgcggaagaactggcgcaacgcgggttggaacaagatctggtgctcgcgccgggcacgctgttcagccggaatcccgacgcgcgccgcttcatgcgcttcaatgtcgccagcagcgacgatgccggcgtcgcccacagattcgccatgctgctgagccaagcccgcgccgccagcagggtctga

SEQ ID NO: 1044 - DNA, 2706 bp, Chromobacterium substugae
gtgagaatccaacacaagataaacacatatgtcattcccgccttgctcggcctcgcggccgttccggcgatggccgctgccggcgatgccgacagcgcggcgctggagcgcgtcaccgttaccggctcgcgcatttcccgctccgcccaggaaggcccgaccagcgtcaccgtgctgaccggcagcgacatcgaaaaacagggctacaccaatgtctacgacgcgctgaacagcctgccgcaaaacaccggctttacccagggcgccgacttcggcaacaccttcacaccggcagccaacgccatcagcctgcgcggcctggggcccaaccacacgctgacgctgatcaacggccgccgggtcgccgattacccgacggcgtacgacggctcggtcaacttcgtcaatctggccaatattccggccgcgatgatagaccggatagaaatcctcaacggcggcgcttccgccatctacggctccgacgccatcgccggcgtggtcaacgtcatcctgaaaaagaagaccgatggcgtggacgtcaacgtcaaggtcggcgccagcgagcaccatggcggcgagaatggcaggctgcaattgagcggcggccacagctgggatcaactcagcttggtctacgggctggagctgagccagcgcaacgccatctggagcaaccagcgcggcttcatggccgacaacagctcggacggctccgccccaaccaccatctggtcgcaacagatcaaacaggggccgaacaaggggaaatacataggcgcaggcgattgcagcgctttttccagcctgttcaacggcagcgtccgcccctacacgatcaatagccggaccggcaacggcgtggtctgcgccagcggccaggccagcccggactactggaccatccagaccgccaaccagagccagaacggctacctgagcgccaattaccagctcaacgagcacgccgagctgttcagcgatgccctgctcggcttcaatcacaccgaaaacaacacccgcggcccggcctggacttcgctgggcggatccagccaatacttcctcaaccaaaacaccggccaatacgagcaatggacccgacggctggcgccggaggaaatcggcggcgccaccgtctacaaccgcaaatgggacgacctgtccgccaacctcaccttcggcgtgcgcggcgacctgcccggcaccagctggaactatgaagccgcgtacaacgcctcgatctacaccagccagcaggccgcgccgaggctgctatccaacgtggacagcttcttccttggcccgcagcttggcaccgacagcaacggcataggcatctacgcgcccaacgcggcccacttcgccgccccgatcacgccggcccaattcaacagcatcgtcggcagaagcttcgagcaggacaagtcctggctgcaggcgctgagcctcagcggcagcggcgacctgttcaagctgcccgcaggcgcggtcaaattggccggggcgctggaatggggcagccagggcttcagcaacgatcccgacatccagctggggcaaggcgtgttctatcgagcctcgcccggcagccatgccggcggcacccgcgcgcgccaagccgccggcgcggagttgttcattccgctgcataagcgcctgaacgtcaccctatcgggccgctacgaccgcctggccatcgccgacagcagcgtcggcaagttcacttatggcagcggcctggaattccgcccgctggacacgctgctgctgcgcggcaactacgccaccagcttccgcgcgccggacatgaactacctgtttctgacgcaaagccgcggctactatcccagcgtgaccgactactggcgctgccagcaggcgggccagcccaccgccacttgcgactacaaggacctgacagccaatttcgtcaaaagcggcaatccggacctgaagccggaaaacggcaaatcctacggcttcggcttcgtttggtcgcccagcgccgacgccgacctgtcgctggactactggaacatcagcatcaacgacctggtgaccgacctggatcaggacaagattctgcgcgacgaggcggcttgccgcagcggccagctggacagcaactccagcctgtgccaggacgcgctgcgacgggtgcagcgcaacccggccaacgccgtgctggacccgggcgccatcaaccagatcctgaccaatccgatcaacgccgccaacgaacgcaccagcggcatagacctgaacggcaagctgcgctggcggaccgcgaaatggggccgcttccagctgcaggccagctactcccaggtgctgaccttcacctatcagcaattcgccggcgaccccacccaggacaggctgcaagacctgagcaacagcgactggcgcaacaagctgagcgccagcctgggctggagcatcggcaactggtcgtccaccctgcaactgacgcgctacggcaaggtgcccaacaacgcccaaaccggctacctgacgcccaccatcctggccaatctgagcctaggctatcagctaagcaagcagacttcgctaggcctgatcgtcaacaacctgcaggacttcatcaagaaagactacagcgacggctcgccgttctatccggtcggcacctacctaccctacggccgccaggcctggctggagctgaatcaccacttctga

SEQ ID NO: 1045 - DNA, 72 bp, Chromobacterium substugae; identical to SEQ ID NO: 1039

SEQ ID NO: 1046 - DNA, 74 bp, Chromobacterium substugae; identical to SEQ ID NO: 1038

SEQ ID NO: 1047 - DNA, 91 bp, Chromobacterium substugae
ggagaaatggccgagtggtcgaaggcacttccctgctaaggaagcatacgggcttaaacctgtatcgagggttcgaatccctctttctccg

SEQ ID NO: 1048 - DNA, 1332 bp, Chromobacterium substugae
gtgggccggcatgttcgactttgccaattcagccttgcatttatcgacattctgtggtcagaatcgaagctcgacatttcaaccattttgaaacaagaagcacgtatggcactcatcgtacagaagtacggcggcacctcggtcgggacaaccgagcgcatcaagaatgtggcccgtcgcgtcgccaaatggaaggcccaggggcatgatgtggtggtggtggtttccgcgatgagcggcgagaccaaccgcctgatcgccctggccaaggatattcaggattacccggacccgcgcgagctggacgtgatcgtttccaccggcgaacaggtcaccatcggcctgttggcgatggcgctgaaggaaatcggcgtgccggccaagagctattgcggctggcaggtgaaggtggtgaccgatcagtcgcacaccaaggcccgcatccagtcgatagacgaggaggtgatgcgttccgacctgaaggaaggccgcgtggtcatcgtcgccggcttccagggcgtggatgaggaaggcaacatcaccacgctgggccgcggcggctccgatacttcggcggtggcgctggccgccgcgctgaaggccgacgagtgccagatctacaccgacgtcgacggcgtctacaccaccgatccgcgcgtggtgccggaggcccgccgcctgaagacggtcactttcgaagagatgatcgaaatggcgtcgctgggctccaaggtattgcagatccgctcggtggagttcgccggcaagtacaaggtacgcttgcgcgtgctctccagcttcgaagacgaaggcgagggcaccctgattacgtttgaggaagatgagagcatggaaaaggcggtagtggcaggcatcgcattcgatcgcaacgaggcccgcatcaatgtcaagggcgtgccggacaagccgggcatcgcttaccagatcctgggcccgatcgcggatgccaacatcgaagtggacatgatcatccagaatgtcggcgaaaacggcaccaccgatttctccttcaccgtgccgcgcggcgagttccagcgcacgcttgccatcctgcgcgaggtgcagacccatatcggcgcggccaagatcgatgccgatgacaaggtggccaagatttccatcgtcggcgtcggcatgcgttcgcactgcggcatcgcttccaccatgttccgcacgctggccgaagaaggcatcaacatccagatgatctccacttcggaaatcaaggtttcggtgctggtggacgagaaatatctggagctggcggttcgcgttttgcataaggttttcggcctggaccaggcggcataa

SEQ ID NO: 1049 - DNA, 915 bp, Chromobacterium substugae
atgactgcccctgttcaaccctggcgctggatccggctggaaatcggcctggtcgtcaacgggggaatccagtacgcgctgttcatcgaccatcccttgttctggccggctctcggccttaccaccctgctgttgctgctgttgctgctgtggccgcgcagcctgcccgccgcctcccgcccgccgccgcgcgacatcggctcgcaggcgcaatactggcgcgatgtcgccggccatgtttacgcgctattgccgctgtgggccggccacatcgccttggggcgcgaacagatagacgaggccgccggccggctgaccgggcactgcgacaatatgctgcgccagcttggataccaggcgccggagccggcggatgccgccgccgagcagaaaacggccgacgcccccccgctgggcgcgccaagcggcctatcgccgccggacaggatgctgatgcccatgctcaagcaactgcagcaatcggccctgcaactggaagcgctggctcaggcgcgggaaaacagccagccggatgggcagatcgccagccaggtcggcaatctgctgcggcagctggaaacgctggagcgcgactcccagcctccgcccggccagaagcgcgacggcaacgcggccggcttcgatctgcgggccgccgccgaggacacgctgacccagttgcagttccaggaccgggtcaaccagatcctgtcccacgtccagaacgatatctggcagctggaagccatgttgcacgaggcgttgagcagcgaggacgagctgccggccccgccggataccgaagcctggctcagcgcgctcaaaagcagctacaccacgcacgagcagcgcgcgctgcacaaccgggacggcggcgaccgccctcccgggcctagcgacatcaccttcttctga

SEQ ID NO: 1050 - DNA, 369 bp, Chromobacterium substugae
atggccaagaccatattgatagtcgacgactccaccaccttgcggcaggtggtgagaatgaccttggccggcgccggctatgaagtgctggaggccggaaacggcaaggaggcactggacatcctggatgggcgcaaaatccatctgatcatctccgacgtcaacatgccgctgctggacggcatcggcctgctcaagcacatcaagcagctgtccagctacaagttcaccccggtgatcatgctgaccaccgagtcggccgaagagaaaaagcgcgaaggcaaggaggccggcgccaaagcctgggtggtcaagcccttccaacccccggtgctgctgacggcggtcgccaagctgatcctgccctga

SEQ ID NO: 1051 - DNA, 276 bp, Chromobacterium substugae
atgccgcttgcgatccgcgccggccacgagcaaaccatctaccaggcggcccagttgcgcgcgcagttggccggcgcgctgcgggacggcgccggcgttacgctggacttgtcggccgtggaggagatcgactgcgccggcgcccaggtcctgctatggctgcagcgcgaaggcatccgcctgggacagccggtggcgctgctgtcgcccagccgggccgtgcgcgactttgtccagctgatggggctgcagcgcgaactgcggctggagccctga

SEQ ID NO: 1052 - DNA, 2136 bp, Chromobacterium substugae
atggatctggaacaggcgctgcaaaccttcctggaggaatcgcgcgaactgctggccgacatggaaagcaccctgctggacatcgaggccgaacatgccgacgccgagcagctgaacgcgctgttccgcgccatgcacaccatcaagggctccgccggcctgttcggcctggaggaaatcgtcaatttcacccaccaggcggaaaacctgctggatcaactgcgcgacggccacctgaggctggacgacgagctggtcggcctgctgctgcgctgccacgaccatgtgaagctgatgatacaggcgctggccgccaagcaggatctgacggcgctgcgcgacgaaggcttgctggcggcgctgcgggactacctggcgcatccgcaggcgccgcccgcggccgactctgccgacattgagccgccgccggcgccggccagcagccgctggctgctatcgctgcgtttcggccccgacgcgctgcgcaacggcctcgatccctcgtccttcatccgctatctggcctcgataggccggatcgagcagatcgaggccatctgctgcgcgctgcctgacggcgacgccttcgaccccgaatccaactatctgcggctggaggcgctgtatcacggcgagcaggatgagaaaagcctgctggacgtattcgaattcgcgcgcgaagacagcgccatccatctctggccgctggcgctcgtccagcccagcctgcccgacgcctgcgcgaacgccggcgccgaagagacggcggcggtgcggcaggcctggacgcgcttcggcgttctggagcccatcgacgcggcggctgacgcccagcccgaaccgcccggccatgccccgctcccggcggccgccgaaaccgcagcggacggcgaagcccgcagcgccaaaccggcggagagccgtttcatcaaagtggaggccggcaagctggacaacctgatcaatctgatcggcgagctggtgatcgccggcgcggcggccaacctgatcgcccgccgcgcacagcaaacgccgctggtggaggcgacgctgaccatcgccagcctgatcgagcagatccgcgccggcacgctgtcgatgcggatggtgcagataggcgagatcttccagcgcttcccgcgggtggttcgcgatgtgtcgcgcgagctgggcaaggacatccacctgcacatcgtcggcgccgaaaccgaactggacaagtccatggtggaaaaactgggcgatcccttgctgcacatcgtgcgcaacgccatcgaccacggcatagaggccaccgatctgcgccaggcccacggcaagccggcccagggcaacctctggctcaacgcctatcacgaatccggcagcgtggtgatcgaggtggccgacgacggcggcggcctggaccggcggcgcatcctggccaaggcgcgcgaacgcggcctgctgggcccggacgacgagccgcctgacagcgcggtgttccagcaaatcttcgcggcgggcttctccaccgcggaacaggtgaccaatctgtccggacgcggcgtcggcatggacgtcgtcagacgcagcatccagcagctgcacggcacgatagacatcgacagcgagcccggccgcggcaccaccttccgcatccgcctgccgctgacgctggccatcatcgacggcttcctggtggaagtggccgcctccaccttcgtgctgccgctggaagcggtggtggaatgcatagaactgccggacggcctgcctgccaacggcgtgcacgactggatcaatctgcgcggcgagctgctgccgctgctgcacctgtcgtcctttttcgaactgcccgccaaggccgcgccgcgccgcaacgtggtggtggtccactacgacgaccgcaaggcgggcctggtggtggatgcgctgcaaggcgaattccagaccgtgatcaaaccgctgggcgcgttgttcagcacgctgaaggccatcagcggctccaccatactgggcagcggcgaggtggcgctgatcctggacgtgccgtcgctgctccgccatgcctgccgcaaggaggctgagcattttccgccgcccgatggcgcggcggcccgctcccacgccccgctgccgggaaacgcgcgatga

SEQ ID NO: 1053 - DNA, 1593 bp, Chromobacterium substugae
atgaccgccttctccggcatgcgcatcgccacccggcaggcgctgggctacggcgccgtcatcctgctgatgctgctgtgcatcgcggtggcgctgcagggtttcggcaatatcaacagcgccgtccacaacatcacccgggtcaacaatgtcgaagcccgcctcgcccaccaactgctggagtccaaccagctggcgcggctcgaaatacgcaacggcctgctggccagcaaccgcggcgagctggaacgcgccggacggaatctgcaggacgcgctgcgccgctaccaggaagccgagcggcaactggcgcagatgttccagcgcgaagccggcaccaacgcgcgcgagcgggagctgatggccgccatccagaacggcagccgcgacgcccatcaggattacctgcaggcgctggcgctggtcggacagcagaaaccccgcgacgcgcgcgcgctgctggccggcaagggcggccggctgaacgagcagatcagcgcgttggccgatgtcgaagacggactcaacgaggagctggcgcggcaaagcgcggccgcctaccaggccagccgcggccggatgctgctgctggccgcgctggcggtcgccgccagcctgctgatcgccgccgccatccgccgcaatctgctgcgcacgctgggcggcgagccgcaggcggtggccggcgtgatgcgcgaagtggccaacggcaacctgcagtgcggcatcgcgctgcgccccgacgatcagaccagcctggccgcctccatcgcccaaaccatccagacgctgggcgccatcatcggcgaggtgaagaacggctcggaaagcctgtccgtcgcctcccagcacatccacgccacctcgcagatgctggcgcgctccgccagcgagcaagccgcaggcctggagcagacctcgtcgtcggtcgcgcagatgtcggcgtcgatcaaccagaccaacgacaacgcccggctgacggaaagcatggcggaaaaggcgtcgcgggaggccggccagggcggcgaggcggtgcagcagaccatacgcgcgatgcgcgagatcgccgagcggatcggcatcatcgacgacatcgcctaccaaaccaacttgctggcgctgaacgccgccatcgaggccgcccgcgccggcgagcacggcaaaggcttcgcggtggtggcggccgaagttcgcaagctggccgaaagcagccaggtcgcggcgcgggaaatcggcgcgctggcgcgcgacagcgtgctgctggtggacgaagccggcggcctgctggaagagatagtccgctccagccgccgcacctcggacctggtgcaggaaatcgccgccgcgtccaacgagcagtcggacggcgtcggccagatcagcctggcggtgcagcagctgaaccagaccacccagcagaacgccagcgccagcgaggaattggccgccaccgccgaggaaatgaaccgccaggccgaaaacctgcacgacctgatcggcttctttcatctgggcgccctgcgcgccggcgtggacgcgcgcgggacgccggcggcgccggaagccgccgcgcgcggccgaatgccattctga

SEQ ID NO: 1054 - DNA, 546 bp, Chromobacterium substugae
atggccgcactcaatatcctgcgccgcgccgatagcgacgccgccgaagcggaagcggcggaactccggcagttcctgacattccagctggcgggggaaaccttcgccatcggcattttgcggatacgggaaatcctcgaatacatccggccgacctcggtgccgctgatgccgccgttcatccgcggcgtgatgaacctgcgcggcgcggtggtgccggtgatagacctgtcgctgcgcttcgcccgcgacgaaaccgcgatccaccgccgcacctgcatcgtcatcatggaagtggagcatgaggagcagtggcagttgatcggcgtgctggtggacgccgtgcacgaggtgctggcgattcccgacgacgccatcgagccgccgccgcagttcggcagcaagatccgcgtcgacttcatcgagggcatggcccggctggacgaccacttcgtggtgctgctgaacgtggacaaggtgctgtcggtgcacgagatgtcgctgctgtcggagctgagccggcaggaagaggcggaggaggaatga

SEQ ID NO: 1055 - DNA, 1626 bp, Chromobacterium substugae
atgaagcatttcagcattcgacaccagttcatcctgctgaccaccggcgtgctgctgggcctgggctgcctgaccgccaccgcctggcagggcttgcgcacggtgatgatcaacggcgacatgtaccgccaggtggtgcttggcaaggacttcatcaacgacctggatccgccgacgctggagctgcaagccagcttcctgctggccaaccagctgcgcggcgccatggatccatccatccgccagcaactgctcaaccagatgcaggcgcaacgcgccgaattctacgacgggctgaaaaaatgggaagccaatccgttgccggccgagatgcgcgccaccctggcgcaaaaggtgcagcccagcggcgacgccttcttccaggaagtggacacccgcttcctgccggcgctggacgcgcacgaccaactggccatcaatctgtccttcgaccggctggccgcccagtacgaccgcaaccatcagaccatcctgccgctgatcgaacaaaccagccggatgcaacggcagatggaggacgaagcgcagcgcatcaccagccagaccttcgcctggctggccggcgtcagcctgacggtgctgttgctgctggccggcttcctgctgctgatctaccgccagctgatccgccggctgggcggcgagccccgcgacgtggcgcgcgccacccgcgaggtggccgcgggccggctggacatcgagctggcgccggcgccggaaggcagcctcagcgaagcgatacggctgatgtgcctgcaattgcgggcgatcatcggcgaagtgaagaccgcctccgacggcgtggccagcgccgcgcagcagatcagctccaccgcgctggcgctgtcgcagggagccagctcttccgccgccggcctggagcaaagctcggcctcgatagagcaggtatcggcgtcgatcaaccagaccagcgacaactcccacaccaccgaagcgatcgccgaacaggcctcggctgaagccaccgaaggcggccaggcggtgcagcagacggtgcaggcgatgcgccagatcgccgaccgggtgggcatcatcgatgaaatcgcctaccagaccaacctgttggcgctgaacgccgccatcgaggccgcccgcgccggcaagcacggcgccggcttcgcggtggtggcggccgaagtgcgcaggctggccgaacgcagccaggtggcggcgcaggaaataggcgagctggccgagcgcagcgtcgccgtggccgagcacgccgggcggctgctgaaggagatcgtccgctccagcggccgcaccgccgacctggtgcaggagatcgccgccgccaccaaggagcaggccggcggcatcggccagatcaaccaggctatcctgcacctgaaccactccacccagcagaacgccgccgccagcgaggagcttgcctcgacggccgaggaaatgacccagcaggccaaccggctgcagcaggcaatggatttcttccggctggcggccagcaccgccgccctgcccgttgcggccgcgcccgcagcccgcgcagactcggcgcctccgccggccgagcctccggcccacgatcaggaacagctggacgacatgttccgcttttga

SEQ ID NO: 1056 - DNA, 591 bp, Chromobacterium substugae
atggcattgactccgccgctaccggcggcggcgcccgcgcccgacagccggccaagcgcaacggcggccgccgacgccgccggcgacgccatcttcctccacccaggcgactggcacttcggcggccgcggcacccgcatccgcacgctgctgggttcctgcgtctccatcatcctctggcatccccaggcccaggtgggcggcatgtgccactacctgctggcccagcgcaccaaccgccgcggcgaagccctgtccggccgctacggcgacgaggccatgctgctgctgctgcgcgaaatcctggcctgcggcctgccgctgcaggagttccacgcccggctgataggcggcgcctcgatgctgatcagccgcgaacgcaaactcacccatgacgtgccggcgcgcaacatcagcctggcgcgcgccatggtcaagcagcttggcctgcgcctgcaggcggaagacctgggcggcaactgtccgcgcctggtgttgttcgatgtcgccagcggcaacgtctggatcaagcaatcgcaagaggccgagctggaactggttccgcccaaaaatacaaggatgcgaacatga

SEQ ID NO: 1057 - DNA, 1098 bp, Chromobacterium substugae
atgagtatcaaggttctgatcgtagacgactccgccgtggtccggcaggtgctaagccaggtgttcaccgaggccagcggcatagaggtgatggatgtcgccaacgatccctacatggcgatggacaagatgaagctgcgctggcccgacgtggtggtgctggacgtggaaatgccgcgcatggacggcatcaccttcctcaagcagctgatgagcagccgccccaccccggtggtgatctgctcgtcgctgacgcaaaagggcaccgacatcagcatgcaggcgatggcggcgggcgcggtggaggtgatcgccaaaccgacttccggcgtcaagggcttcctggaggaaagctcggcccagctggtgatggcggtgcgcagcgccgccgccgcgcggatgaaccgggtgcgggtgatgccgtcggccagcggctcgcccacggccgcgccgtccggctccaatccgctggaaacccgtcccaagctgtcggccgacgccatcctgtccgcgcccaccggcagcaatgtcttcgccaccaccgagcgcatcatcgccatcggcacctccaccggcggcacccaggcgctggaaaccgtgctgaccgagctgccgcgcacctgtcccggcctcgccatcgtccagcacatgccggagaaattcacccgctccttcgccgaacggctgaacagcctgtcgcagatagaggtgaaggaagccagcaacggcgaccggatcctgcccggccgcgcgctgatcgcccccggcggcaagcacatgatggtcaagcgcagcggcgccttctaccaggtggaagtcgtcgacggcccgctggtcagccgccacaagccgtcggtggacgtgctgttccgctccgccgccaagttcgccggcaagaacgcgctgggcatcatcatgaccggcatgggcgacgacggcgccaagggcctgaaggaaatgcacgactgcggcgccaaaaccatcgcccaggacgaagaaagctgcgtggtgttcggcatgcccaaggaagcgatcaagctgggcgccgccgacgaagtgatggcgctggacatgatagccaaggccatctgccgctga

SEQ ID NO: 1058 - DNA, 1179 bp, Chromobacterium substugae
atggaactggacgacatcctggtgatcgacgacagcaaggtgcagcgccagcatgcgctggaactgtgccgcgcgctgggcgccgccagcgtgcgcgaggccgccgacggcgggcaagggctggccatgatgcgggagcgcctccccagcctggtgctgctggatctggagatgcccggcatggacggcgtgcgggtgatgcagggcatggccgcctccggcctgcacacgccagtggtggtcgcctccagcaaggactacctgctgatttccacagtggagatgatgggccgcgagctgggcctgccggtgctgggcgcgctgcaaaaaccgctgcggctggatgcgctgcgcgacctggcgcaaagagcctggacgccggatgcgcggatggacggccgcgagttcgcgccggcggagttgcgcgcggcactggacgcggaccagatccgccccagctaccagcccaaggtcgatctggccgacggcgcgctcaaaggcgccgaggtgctggccagttggcggcacccgcaactgggcgcaatcgacgccgacagctttctgccggtcatagaacaatccggctgggccaccgaactgaccatgcagatgctgacacaaggcttggggcaatggcgggaatgggcgcgccagggtctgcgcctgccgctgtccctcaatctggagccgcgctcgctgcaagaggatggcctggtcgagcagatcgagcgcatcatcgccgacagccatgtgccggtccgcttcatcagcttcgaagtgacggaaaccgcgatcgcggacaatctgtcgcgggcgataggctgcgccgtgcgcttgcgcatggccggagtaggcctggcggtggacaatttcggcaccggcttcgccgccatgcagcagctggagcgctttccattcaccgaattgaaaatcgacccctcgctggtgacctcgatcggcggcaaaccccatctgcaagcggtgctcaacagcatcgtcgagctggcgcgccggctgaagctggcgacggtggccgagggcgtgcaaagccaggaagactgccagttgatggccgagcgcggctgccagctgggccagggccgctatttcgccgaagcgctgccgccggacgaactcctggactggagccgcgcccgcaccgccgcggcgtctaaatga

SEQ ID NO: 1059 - DNA, 990 bp, Chromobacterium substugae
atggataccaccttgcctccccctttcgccgcgctgacgccggacgccattctcgacgcggtcgagagcctgggcctgcgcgccagcggcagcctgctggccttgaacagctatgaaaaccgcgtctaccaggtcggcatcgacgacggcgcgccgctggtggccaagttttaccggccgcagcgctggagcgacgacgccatcctggaggagcacgccttctcctggcaattggccgagcgcgaaattccggcggtgccgccgttgcggctgcagggacgcacgctgcacgaacacggcggcttccgtttcgcgctgttcgagcgccgcggcggccgggtgccggaactggaccgcgacgacaccttgcagtggataggccgtttcctcggccgcatccacgcgctgggacgggtggaggattaccgcagccgcccgacgctggaccagcaaagcttcggccgcgagccggcggactttctgctgcagggcggatggctgccgccggagctgggcaatgtctaccgcggcgtgttggagcaggccttggaaggggtggcgcgctgcttcgagcgggcgggccaggcgagccagttgcgcctgcatggcgactgccatgtcggcaacctgctgtggaccgacgccggcccgcatttcgtcgatttcgacgacagccgcatggggccggcggtgcaggacttgtggatgctgctgtccggcgagcgcgccgagcagtcgcggcaactggccgaggtgctggccggctatgaagacttctgcgagttcgacacgcgcgagctctatttgctggaaggcctgcgcacgctgcggctgatccattacagcgcctggctggcgcggcgctggcacgatcccgcgtttccggcagccttcccgtggtttggcggccagcgctattgggaggagcagatcctggcgctgcgagagcagatcgcgctgatggacgagccgccgctgtggtcttgctga

SEQ ID NO: 1060 - DNA, 261 bp, Chromobacterium substugae
atgaaaccgcacctcccccctctttccttccacctcgatggagaccagctgcggcacggctccgagcgttgggccaacctgactttgcaaggctggctggtgctgctggaccgcggcgcccgccgccaggcctggcggcgcctgcttgaacaccggttaaacacgcggcagctgctgcaaggcttcgcctgctggctgagcggcagcttggtgctgctcgcgctggcctacctgctctatctggtttccacgcgctggtaa

SEQ ID NO: 1061 - DNA, 933 bp, Chromobacterium substugae
atgaaacacccacacgcaacagaaagcggagacagcgctgaacgccagaaaaccgcgcgcgccagcacgctggtcagcgtggcggtcaatgtgctgctgtcggcattgcagatcatcgccggcgtctgggcccattcctccgcgctgatagccgacggcatccactcgctgtccgacctgctgtccgacttcgtcgtgctggtcgccggccgccacagcggcaagggtcccgaccacgaccatcagtacggccatcagcgctacgaaaacgccgcctcgctggccctgggcctgctgctgctggccgtcggcgccggcatgctgtattcggcagccaacaaattcatccaccccgccgatattccggcagtccacagcctggccttgtggatcgccgcgctggcgctggtcgccaaggaaagcctgttccgctacatgttggccgccgcgcagaaagtgcgctccagcctgctggtggccaatgcctggcatgcgcgctccgacgccgcctcctcgctggtggtggccgccggcgtggcgggcaatctgctgggctatccgatactggatccggtggcggcgctggtggtgggcctgctggtcggccgcatgggttggcgcttcgcctgggacgcgctgagcgacctgatggatcgcgccgccagcgaggacgacatcgccgccattcgcgccaccttgctcgccaccccgggcatcgtcggcatccacgatttgcgcacccgcaaaatgggagacatgatcctggtcgacgtgcacctggaagtggacggcaacatcaatgtctaccaggcccacgccatcaccgaagaagcgcagcagcgcgtgctgcgccagcaccctgtgctggacgtgatgacccacgtcgacccggccgagcattaccgcgacggcaacatgcccgttgccggttaa

SEQ ID NO: 1062 - DNA, 282 bp, Chromobacterium substugae
atgacgataccatttcaatccattccgcgctggctgctgcacgccctgctgttgctgccgctgctgtggcagtttgaaaactacgccgtcagccgcgcgccgttcaacggcaacccccagcctgccaccatcagcacctggaccgaacactggccggcggacacgcctttcctgctggtgcaggaagtgcgcgaccagctgcgccacgccgacgccaaacgcgatgccggcacgccggtgcgcgatgtcgccgccatgccgcgccccagcgacgccagctga

SEQ ID NO: 1063 - DNA, 267 bp, Chromobacterium substugae
atgaaaagaaaatggatcgccgcgctgggcgcggggggcgcgatgctgggagtcggcgcgatttgccaggcctcgccgctgccgatgtcggcgggcgcgccgacgctggacagccacggcagcgccagcctggcgcagggcaagcagggagcgcaaggcgaggccgacaggctgagccggctgcgcgcgctggtgcacaatagttcgatccactgcagcaatcccggctgcccgatctgccacccgcagccaagcgcgtcgctgtaa

SEQ ID NO: 1064 - DNA, 1362 bp, Chromobacterium substugae
atgttgttttccgaactcggcctgtcgccggaaatcctgcgcgccatcgaagagcagggctatagccagccgacgccgatccaggggaaggcaatcccgctggtgctgtccggccgcgacctgctggccgccgcgcagaccggcaccggcaagaccgcggccttcatgctgcctatcctggagcgcttgaagaaattcgccaataccagcgtgtcgccggcgatgcacccggtgcgcgcgctggtgatttcgccgacccgcgagctggccgaccagatcggcgagaacgtcaaaagctataccaagtatctgccgctgcgcgcgaccaccgtctacggcggcatgaatatggatccgcaaacccaggagctgcgccgcggcgtggaaatcctgatcgcgacgccaggccgcctgctcgaccacatccagcagaagaacgtgcagctgggcaaggtggaagtgctggtgctggatgaggccgaccgcatgctggacatgggcttcatccaggatatccgcaagatcatggggctgctgcccaaggagcgccagacgctgctgttctcggcgacgttcgcgccggagatcaagcgtctggccgccgatttcatgcattcgccgcagacggtcgaggtggcgcgccagaacgccaccaacgaccaggtggagcagctggtgttcaaggtggacgccttccgtaagcgccaggtgctggcgcaactgatccgcgcgcgcgacatgagtcaggtgatcgtgttctgcaagaccaagatcagcgccgaccaactggcgcgcgacctgaagcgcgatggcctggatgccgaggccatccacggcgacaagacgcagggcgctcgcctggagacgctggcgtcgttcaaggacggcgaactgcgcgtgctggtcgccaccgacgtggcggcgcgcggcctcgacatttccgagctgccctacgtggtcaactacgaaatgccgaactccccggaagactacgtgcaccgcatcggccgcaccggccgggccggcgccaagggcgtggccatctcgctgatgagccccgatgaaacccgccagcacgaggcgatcgaaaagctgacccgccagacgctgacgccgcaaagcgtggacagcttcatgccggcgcagccgcctgcgcgcgccaagccggccgcgcgtgaacgcgaacagggcggcgaccgcgagcccgcagccatgcgcgaacgcgaacgcgaagttccggcgctaaccggcaatggcgaaggcctgaagcaggcccgtcccgccaggcgcaaccgcaaggcccggcgcgaggttccggcattgttgttgccgccgcgctacaaggtggaaatcatccgctaa

SEQ ID NO: 1065 - DNA, 921 bp, Chromobacterium substugae
atgaccctgatttccctgattctcgctctggctttggagcaactgcgaccgctcggcaatcgcaaccgggtgtggttgttgttcacccgctacgctaaccatcttgagcgcaacctgaatgccggcgccgagcgccatggcgtgctggcctggctggtcgccatcgtgccggtgctgctgctcagcctgttgctgttctattcgctgaaagccgcgagcccgctgctggcgctggcgctcaatgtgctggtgctgtatctgaccatgggcttccgccatttctccagcgcattttccgagatatcgcaagcattggccgagggccgggatctggatgcgagagtggcgctgtccaactggaccggcctgccgacggcggagctgtcggtagaggagatctcgcggctggcgatcgagcaaggcgtgctggacagctaccgccatgtgttcggcaccatgttctggttcgtggtgctgccggggccgtcgggagcgttgttgttccgcctgtgttcgatgctgaaccagaagtggggcagccgcaatgccgcggaagacccgttcggcgtgttcgccgcgcgcgcggcggcctggctggactggattcccgtccggctgacggcggcggctttcgccatcatgggcgactttgaagacgcgatctattgctggcgttcgcaagccaggacttggggcaactacgccaacggcatcctgctggcgtctgccgccggcgcgttgggcgtgaagctgggcgacccgctgcggcaggactattcggtgaaataccggccggagctgggcctgggcgacgatgccgatcccagtttcctgaaaagcgcggtcggcctggtatggcgttcggcgctgctgtggctggccgtcaccctgttgatcagcgtggccagccatatgggctga

SEQ ID NO: 1066 - DNA, 396 bp, Chromobacterium substugae
ttgctggagcaggagcaggccctgctgatacagggcgaggagcacaagctggaggcgctggccgacaacaagagcgccgtgctcgacgaactggcgcggcagtcctccgtccgcggccggctgatgaccacgctgggcgtgcaggaccgcgacacgctgtatatctggctggcggacaagcctccggcctgcgaggcctggaccagtcttgaggacgcggtcaaccgggcgcaaagcatcaatcagctgaacggcagtttcgtcagcgagcggctggccatggtggaggagtcgttgctggtgctgcgcactgccgcggcgtccacgctgggctatgaccgcggcggcaaccagccggaggtggtgacaggccgccgcctgctgggttcggcttga

SEQ ID NO: 1067 - DNA, 297 bp, Chromobacterium substugae
atgaagatcgacaattcgggcaagctgtcgggaacctacagcacccagagcaagaccactgcccgtgcgccgtccagttcgaccagcagccaaggcagcagcagcgacagcgtgcagatcaattccgtcgccagccgtctgagcgccatcggcaatgatcccagccagcagccggccttcgatgcggccaaggtcgaatcgatcaagtcggccatcgccaatggcagcttcagcatcaatccggacaagatcgccgacggcctgatttcatcggcccaggagctgttgcagggttga

SEQ ID NO: 1068 - DNA, 663 bp, Chromobacterium substugae
ttgtggttttgcggcttgttggcggccatgccggcctgtgccgacggcatccagaacctggtccagctggagcggctggccgatcagtttctcaagcatgagctggagttgcgcgccgccacctggcggctgggacagttggacaggaggctggcgctgcccgcctgcagccgtcccaaggcggattgggcgacgccgggcgtcaccaccggagcgactttcgtcgcggtgtcctgcccggatctgggctggtcgctgcggattccggtcagcatcaatgaaaagcggatgggcgtggcgctgagccggccgatggccgccggcgagacgataggcgccgccgacgtccggttggtggatatcgccaaccccgcgctggcgagcaatgtgctggacgatctcaacctggcggtcggccaggtgttgcggaccggcgcgccggcgggcgcgtggctgcgcactttcatggtgcgcgcgccgtatctggtgcgcagcaaccagcaggtgaaggtgctggcgcagggcgacggcttttccgccgaagccgagggcatggcgatgggcaacgccgcccagggcgagcaggtgatggtcagattgagcagcggcagggtggtgcggggcaccgtgcaggccgatggcagcgtggccgtgattttttga

SEQ ID NO: 1069 - DNA, 2124 bp, Chromobacterium substugae
atgcgtagtcgcttgaccgctctcgccctggccaccgcccttgccctgccggccgcagccaacgcttacagcaacatctattactttggggacagcctgtccgatgtcggcgccttcggcggccaatccggcctgcccgccggcgcccgctggaccaccggctacggtcccaactggaccaatgtgctgagcggccatttcggcctgcaatcagtcgccaacaacccgctcaacgccactaccagcagcagcggcaacaactatgcccagggcggcgccgtcgcccaaacctaccaggccatcacccagtatcccaacacctccggcagcagcggctctgtcgagcaatacggcccgggcggcaccctgctgatccaggaactgccgcaacagaccgcggcctatctcgccagcaccggcggcaaggctgatccgaacgccgtttattcggtctggatcggcggcaacgacgtgatcgccgcgcttggcacggcctccagcaccagcggccagcaactgctcggcgcttcggcccagtacaccgccgccagcgtgcaggccttggtcaaggccggcgccaaaaacgtcatcgtgcccaaccttcccaatatgggcgccgcgccgctggcgatttacgcttcgctgaccgcagtccagcaaaccgtcaacgcgcaggttccaggcctcgtcaccaccaccgcggtcaacaacgcctgggtagcggcctggcaagtcatcagcgcgcagaatgtcggccccagcaattccgccgccgtcatccaggccgcgctgaccgccgccaacacctcgctctccaccgccaccggcggcgcggtgccggccggcagcgtggccaccgcctacaatggcaacggcacggctgccaaccccggcgtccagcccagcctgcagcaattggccgccggctacaaccagctcaccgacatgacgctgtccggcgccggcgtgcagcacaatatcgttcgcccgaatatctcgctgctgttccaggaaatcctggccaaccccggtcaatacggcttcaccaataccatcggctccgcctgcgccacctccgccatccagtgcgcggccaatacgctgcctggccaaagctacgtcttcaccgaccagctgcaccccactccggcggcccagcaaatcatcggcgactacgtctacggcctgcttcaagcgccttactacgccgcggcgctgcctgactccgccttgaacaacgcccgccagctgggcggcgcgctggacagccgctaccaggccatccgctcgcaaaaacgcgcggtcggcaccgtcagcgcctttgtcgacggcgccttcaacgacgacaagatcggctacaacaacctggccgccaaaccgaagggccagctgtacacgctgggcctcgactaccaggccagcccggcgctgagcataggcgtggcgatgtcgcgccagcagggcaagaccgacatctccagcacaggcaccccgggcagcgtggacgaccgcaccacgctgatgtccggcctggtcagctacaaccaggacaagttctggatcgacggcgacgttcacatcggctccggcgatctggacaccagccgcgccgtcaccctggggccgacccaggtgcagatcaacggcagcacccgccagacccagtacggcctgcgcatcggcggcggctaccggctgcagtacggcaacttcaccaccggcccggtggccggcctcgactacgcccacgtcaaggtggccggcttcgccgagcaaggcggcagcagcagcatggccttcggcggccagaacgccagctcgctggtgggacgcgtcggctggcagcttgacgccgacgtcggcaagttcagcccctacgccaaggtgagcttcgcccacgagttccagcaagacgaccgcaacatcaccgccggcctcaccagcacgctgggcgactggaccaccaacatcggcaaggcggacgccaactggatggagtggaccgccggcgtcagcgccaacttcagcaaaaccgtcaccgcctacggccagttctcggtcaccagcggcaggagcggcggcaatcagaccggcggcaacctcggcgtggccgtgtcgttctga

SEQ ID NO: 1070 - DNA, 1410 bp, Chromobacterium substugae
atgaaatatgtcagtacccgcggcggcatggcgccgctgccgttttgcgaaaccgtgctgatgggcctggcgccggacggcggcctgctgctgccggagcgctatccccggatagaccgcgccacgctggacgcctggcggcagctgggctacgccgagctggcgttcgagatcatccgcctgttcgccgacgacattccggcggatgatctgaaaggcatcgtttcgcgcgcctaccgggccgagaccttcggcagcgaagccatcgcgccgctcaagcgcctgcatgacggcctggccatcctggagctgtccaatggcccgacgctggcgttcaaggacatggcgatgcagttcctcggccagctgttcgaatatgtgctggagaagcgcggcgagaagctgaacattctgggcgccacttccggcgacaccggctccgccgccgaatacgcgatgcgcggcaagcgcggcatcaatgtgttcatgctgagcccggacggcaagatgagcgctttccagcgcgcgcagatgtacagcctgcaggacgagaacatccacaacatcgccatccagggcatgttcgacgactgccaggacatagtgaaggcggtgcagaacgaccacgttttcaaagcgcggcacaagatcggcaccgtcaactcgatcaactgggcccgcgtcgtcgcccaggtggtgtactacttccacggctatttccgcgcgacggccagcaatgacgaaaccgtaagcttctgcgtgccgtccggcaatttcggcaatgtctgcgccggccacgtggcgcggcagatgggcctgccggtggagcgactgatcgtcgccaccaatgaaaacgacgtgctggatgagttcttcaagagcggccgctacgcgccgcgcggcagcgagcgcacctacgtcacctccagcccgtcgatggacatttccaaggcatccaacttcgagcgtttcgtgttcgacctggtcggccgcgacggggcgaaggtgaagcaattgtgggccgaggtggacgcgggcggcggtttccagctggatggagaaaccatgcgccaggtgcgcgacgcgttcggcttcgtctccggcaaaagcgcgcatgccgaccgcatcgccaccatccgcctggtggacgccgacgatggcgtggtggtggacacccataccgccgacggcatcaaggtggcgcgcgaactgcgccgcgaaggcgaaaccgtggtgtgcctggaaaccgcgctgccggccaagttcgccgaaaccatacgcgaggcgctggaccgcgaaccgccgcgtccggcgggcttcgagcgtctggagtcgctgccgcagcgggtagtgaccttgccagcggatgccggccaggtgaaggcgttgatggagaaggcgctgggctga

SEQ ID NO: 1071 - DNA, 336 bp, Chromobacterium substugae
atgactaggcattggcaagccggcctgtgcgccgcgctcttcaccggtttcgcggcggccacgccgctcagccccggccagcaccagctgctgcagggcttcttgatgcgcggctgcgtcaagcgcacgccggcgtccgacggcgtcggcctgcccggcaacgagcaggtgcagcgctactgccagtgcgccagcgagaagctggccagcactttcaccgcggaagaggtgatgggcgtggtgaccggccagatcaagaaagacgatccgcgcggcaagcagcgcctgaaggaagcctccgccgcctgcggccaatacctggaaccacagcaatga

SEQ ID NO: 1072 - DNA, 1311 bp, Chromobacterium substugae
atgaaaccgatccatatcggcctgctgggcgtcggcaccgtcggcggcggcaccgccaccgtgctgaagcgcaacgccggcgagattacccgccgcgccggccgcgagattcgcctgatccaggctgccagccgcgacctggccaaggcgcgcgccgtgctgggaccggaggtggcgctggtggacgacgcgcggcggatcgtcgacaacccggacgtcgacatcgtggtggagctgatcggcggcgacaccatcgccaaggagctggtgctgaaggcgatcgagaacggcaagcacgtggtcaccgccaacaaaaagctgctggcgctgcacggcaccgagatcttcgcccgcgcgcaggaaaagggcgtgatggtggcgttcgaagcggcggtggccggcggcatccccatcatcaagaccctgcgcgaaggcctggcggccaaccgcatcgagtggatcgccggcatcatcaacggcacctccaatttcatcctgaccgagatgcgcgacaagggcgccagcttcgccgacgtgctggccgaagcgcagaagctgggttatgccgaggcggaccccactttcgacatcgagggccatgacgccggccacaagctgaccatcatggcggcgctggccttcggcattccgatgcagttcgaccagtgctatctggaaggcatcagccagctggacggccgcgacatccgctacgccgaggaactgggctaccgcgtcaagctgctgggcctgactcgccgcaccgacagcggcgtggagttgcgcgtgcacccgacgctgatcccggaaggccggctgatcgccaatgtcaacggcgtgatgaacgcggtgctggtcaaaggcgacgcgttggggccgaccttgtactacggcgccggcgccggggctttgcccacggcctccgcggtggtggccgacatcgtcgacgtcacccgcctgctgacctccgatccggaacaccgggtgccgcacctggccttccagccggaccagttgcaggacttgccgattctgccgatctccgaggtcaccagctcctactatctgcgcatcggcgcgatagaccgcgccggcgtgctggccagcatcacccggctgttggccgagaacggcatctcgatcgaagcgctgatccagaaaggctcggtgtccgacggcaccgccgaagtggtgatcctcacccaccgggtgcaggagaaggcgatcaaccatgccatcgccggcatcgaagcgctggacagcgtggccggcaaggtggtgcgactgcgcatggaagaattgaatgactag

SEQ ID NO: 1073 - DNA, 138 bp, Chromobacterium substugae
atggatcggtttcataaatctgtctccgttcagtcccttgattttttattcaggccaaaggccgtctggacaggcgcgtcctgtccgggcggtcctcgggcggcgggaatctgtcccgccgccgctgccggcgcttag

SEQ ID NO: 1074 - DNA, 1233 bp, Chromobacterium substugae
atgcagccagtccacaaatcgcagaaactcgccaacgtctgttacgacatccgcggcccggtgctcgagcacgccaagaggatggaggacgaaggccaccgcatcatcaagctgaacatcggcaatccggcgccgttcggcttcttcgccccggacgagatcatcgaggacgtgatcgtcaatctgccggcggcgtcgggctattccgattccaagggcctgttcgcggcgcgcaaggccatcatgcattacgcgcagcagaagcatctgcccaatgtggcgatggacgacatcatcgtcggcaacggcgtgtccgagctgatcgtgatggcgatgcaggcgctgctggacaatggcgacgaagtgctggtgcccgcgccggactacccgctgtggaccgccgcggtggggctggccggcggcaaggccgtgcactacctgtgcgacgaggagcagggctggttccccagtatcgccgacatccaggccaagatcacgccgtcgacccgtgccatcgtcatcatcaatcccaacaacccgaccggcgcggtgtacccgccggcgctgctgcagcagatcgtcgaggtggcgcgccagcatcagctgatcatctacgccgacgaaatctatgacaaggtgctgtacgacgccgccagccacacctcgataggctcgctggcgccggacttgttcgttgtcaccttcaacgggctgtcgaagaattaccgcgcctgcggctaccgcgccggctggatggtgctgtccggcgagaagaagcacgccaaggactacatcgaaggcctgaacatgctggcctcgatgcggctgtgcgccaacgtgccggcgcagtacgcgatccagaccgcgctgggcggctaccagagcatagacgacctggtggcgccgggcggccggctggcgcgccagcgcgacctggcctacaagctgctgaccgatattccgggcgtgtcctgcgtcaagccgcagggcgcgctttacctgttccccaagctcgatcccaagatctatccggtgggcgacgaccagcaattcatcctggaattgctgcagcaggaaaaggtgctgctggtgcagggcagcggcttcaactggattgcgccggatcacttccgcgtggtattccttcctaatacggatgatctggtggaggccatcggccgcatcgcccgtttcctggagaactaccgcaagcgtcacggcagcgccgactaa

SEQ ID NO: 1075 - DNA, 165 bp, Chromobacterium substugae
gtggactggctgcatggcggcgacggcttccgtttcaggccgcccgccggatgggacggcatgcttgtggcggtgtggttgctgtttcatgggatctctgtattccgcccggcggctaaagccacattcagggcgtggtcgcttgagccccgggtctgggtataa

SEQ ID NO: 1076 - DNA, 369 bp, Chromobacterium substugae
atgaaaatgcaccagtcgctgggacagggcaaaaacctgttcaccggctacggcgacggccacgtgctgatcaatgcccagcgccacgacggcaacctgatcgtcagcgccgacgaggtggccgcctgggccgcgccggacttttccggcctcgccgccgcgcacttcgacgcattgctggcctaccagccggaagtggtgctgttcggctccggcgaaagccagcgcttcgtccacccgcggctgtacgcggcgctgaccgaggccggcatcggcgtggaatgcatggacacccaggccgcctgccgcaccttcaacatcctgctggccgaagaccgccgcgtggtcgccgcgctgctggcgatctaa

SEQ ID NO: 1077 - DNA, 1317 bp, Chromobacterium substugae
atggagatggagttgggcaagtggctggacgagcggccgctgggcgggtttcagtaccggctgttggttttgtgcgggctgtgcatgatcctggacggtttcgatgtgcaggcgatgggttatgtcgcgcccgcgctgctggaggactggggcatcgccaaatcggcgctggggccggtgttcggcgccggcttgcttggcttgatgctgggcgccttgctgttcggcgccttggccgaccgcattggccgccgcccggtgctgctgggctgcgcgctgctgttttccgccggcatgctgctgaccgcgggtgccgccaatctgccgcagctgattgcgctgcgctttgtcaccggggtgggactgggcggcatcatgcccaacgcgatggcgctggccggcgagtacagcccggcgcggcggcgcgccagcctgatgatgctcatttcctgcggcttcaccgccggcgccttgctgggcggcttgctggcggcctggctgattcccgcgcacggttggcgctcggtgttcatcgtcggcggcgtcgcgccgctgctgctgtggctgccgatgtggcgcggcttgccggagtcggccaaatttctgctgctgcgcgatcggaccggtcaggccgaggcctggttgcgcaggatggagccgtcgctgccggcgggtattcggccatggctggcggagcggccggcccgcagcaatccggtggccgagctgttccgcaacggcttggcccggcgcacgctgctgttgtggctgctgagcttcctcaatctgatcgtgctgtatttcctgtccaactggatgccgtcgctgttgcgcgcgcaggggctggacatgcgccatgccttgctggcgggcagcatgctgcaactgggcggggtgataggcacgctggccttcggctattggatagaccgggccgggtttcgccgcgcgctgccgccttgctttctgttggccgcgctgggcttatggctgttgggcagggcgcaaggcgaggcgctgtggctgcatatgctgctgttcggcgccggcttctgcatcataggcgcgcagccggcggtgaacgcgctggcggccagcgcttatccgaccagcctgcgcgccaccggcgtaggctggagcctgggcatcggccgcatcggttcggtgctggggccgtggctgggcggggtgctgatcggcctggcctggagccaggcggcgctgttcgcgttgctggcgctggtggcgctggccgccgccgccgtggtgctggcctaccaccgcgagccggcgcggcgggtaggggaagcggtttag

SEQ ID NO: 1078 - DNA, 1317 bp, Chromobacterium substugae
atgctaagccgaaacgcggcgctgccgcgcatcgtcatcgtcggcggcggggccggggggctggagctggccacccggctgggccgcacgctgggcgcccgccaccgcgcgcaggtcgtgctggtggatggctcgcccacccatatctggaaaccgctgctgcacgaagtggccaccggcgcgctgaacaccggcgaggacgaggtcaactacttcgcccacggctaccgcaacggctacgacttcgagttcggctatatgcaggggctggaccaggcgcgccgcagcatccgcctggcggcgataccgggcagcgacggccaacagctaagcccggagcgcgagataagctatgactggctggtgatcgccgtcggcgccgaggccaacgatttcggcaccccgggcgtggccgagcacgcgatgttcctgaacacgcccaacgacgccgaaaagctgcgccaccgcgtgttggagcaggctttccgcgccagcagcggcgatgcgccggcgcgcgcgctgtccatcgccatcgtcggcggcggcgccaccggcgtggagctggcggccgagctgaaccacaccatgtgcgaattgcaccactacggcgcgcggctgcagccggagcgggtgaggatcagcgtgatcgaaggcgcggagcgcatcctggccgccgcgccggcgacgctgtcggcttacgccgaggagcagttggccggcaagcgcatccaggtgctgaccaacagccgggtggcggcggtggaggcggacggcgtggcgctggcagacggccgcaaggtggacgccgacatcacggtgtgggcggccggggtgaaagctccgggctggctggccggcctggacggcctggagaccaaccgcgtcaaccagctggtggtggatacccggctgcactgcgccggcggcgactgcgtatacgcgatgggagactgcgcggcggcgccggacggcgacagcggccgcatgctggccgccaccgcccaggtggcgcaccagcaggcgcgctatctggccgacgaattggcgcgcaggctggacgacaagccggcgcggccgtttgtcttcaagccgcagggcatgatggtgtcgctgggcaagcacaccgcggtgggcagcctggcggcggtggtggggccgaagcgcgactaccacgtggaaggccgcggcgcgaagctgatctacgcgtcgctgtaccggatgcaccaggcggcggtgcacggctgggcgctggcgatcctgctgttcatcggcgacaagctgcggcgcgcggcgcggccggcgttgaagctgcactga

SEQ ID NO: 1079 - DNA, 1527 bp, Chromobacterium substugae
atgtcgatatcgcgttcgctgaagatagttgccaccctgtaccgctacggtctggacgatttcctcgagggccattccaaactggcctttttgcaccgcttgttcgcgttgtgcccggtgggccgcgacatccgcgccccgctgcccgagcgggtgcgcttggcgctggagagcctggggccgatcttcgtcaagttcggccaggtgctgtccacccggcgcgacctgctgccgccggagtacgccgacgaactggcgcggctgcaggaccgggtgccgccgttcgacggcgacatcgcccgccaggtggtggaaaacagcctggggcgcaaggtggaggagctgttcgtcgatttcgacctcaagccggtggccagcgcctcggtcgcccaggtgcacaaggcctggctgcgccagcccgatggcagccgcggccgcgaagtggcggtcaaggtgctgcggccgggcatcctgccggtgatcgagcaggatctgtccttgatgcgcacgctggccggctgggtggagaagctgttctccgacggcaagcgtttgaagccgcgcgaagtggtggccgaattcgacaaatacctgcacgacgagctggacatgatgcacgaggcggccaacgcttcgcagctgcggcgcaatttcaagggctcgcagcagctgatcgtgccggaagtgttttatgactactccagccgcgacgtgctgacgctggagtggatgcacggcatcccggtggggcaggtggagcggttgcgcgaggccggcgtggatctgcagaagctgtcccgcttcggcgtggagatcttcttcacccaggtgttccgccacggcttcttccacgccgacatgcacccgggcaatatcttcgtcgcgccggatggccgctacatcgcgctggatttcggcatcgtcggcagcctgaccgacaccgacaaacattatttggcggtcaacttcctggccttcttcaaccgcgactaccaccgcgtcgccaccgcccacatcgaatcgggctgggtgccgaaggatacccgcgccgaagagctggaagcggcggtgcgcaccgtgtgcgaaccgatctttgaaaagccgctgagccagatttcgttcggcatggtgctgctgcgcctgttcgagaccagccgccgcttcaatgtggaaatccagccgcagctggtgctgctgcaaaagacgctgctgaacatcgaaggcctgggccgccagctggatccggagctggacttgtgggacaccgccaagcccttcctcaccaagtggatgaacgaacaggtgggttggcgcggcctgctgcgcacgctgaagaatgaagcgccgcaatgggcgaccacgctgccgacgctgccgcgcaagttgaatgaggcgctgggttcggccaagaccgagctgttggtggagggctacatccagctgatgcgcgaacagaagcggcagaatttcctgctgatgctgatcgccattttgctggcgggattgctggccaaggtgttgtggtaa

SEQ ID NO: 1080 - DNA, 585 bp, Chromobacterium substugae
atggcactgaccatcgctgccttcaatcatcttttaaaccagcatccggcgcggcgcgccgagctggccgcccatgccggccgccgcgtggccatcgcgctgccgcccttgcatgtggccggggtgattaccgacgaaggctggctggccgcctgcgagggcgagccggaggctaggctgaagctgcgccacggcgcggtgctgtcgcagctgagcgggcagccgccgcaactgtccgacatcgcgctggagggcgacgccgagctggccgccgcgctgggccgcatcgtcggccagttgcattggcatgcgggcgaagacctgtcgcgcctgttcggcgacgtggcggcgcagcggatggaaaccctggcgcgcggcctgttcggcgtcaagggccagctggctttccgcctggcggaaaactgggtggaacacctgcgcgaggaagcgccggtgctggccagccgccgcctggtgcagcgcttcgtgtccgaagtggaccatctgcgcgacgacgccggccggctggataagcggctggcgcggctggaggccgcgctcaataaaccgaataccccgacctga

SEQ ID NO: 1081 - DNA, 516 bp, Chromobacterium substugae
atgcaggccgagctggcggcgcgtctggctgaactggggatagatcccgccagcttgctggcgcgggggctggagacgcatcccgagccggcggagctggcgctggcggaaaccaatgccgaggggcgcgagtttcacctcacgcccgcggcggcgcaagcttggacggcgatgcgacgcgcggcggctgaggatggcgtggagatgtttctgctgtccgctttccgcagcgtggcgcggcagcatgaaatcgtcgccgccaagctggcgcgcggcttgagtttggacgatatcctgcaagccagcgccgcgccgggtttcagcgagcaccataccggctgcgccgtcgatatcggcgcgccgggatcgccgccgctggaagaagcgttcgaaaccaccgccgccttcgcctggctgagccgccgcgccgcggctttcggctttcacctgagctatccgcgcggcaatgcctgcggctatctgtatgagccctggcattggcgctggcgggtttag

SEQ ID NO: 1082 - DNA, 735 bp, Chromobacterium substugae
atggacaagaccacgcatttcggtttcaagaccgtcgatgaaagcgagaaggccggcaaagtggccgaagtcttccattcggtggctggcaagtacgatgtgatgaacgatctgatgtcgggcggcctgcaccgggtgtggaagcatttcacgctgaccacctccggcgtgcgcgccggcgacaaggtgctggacatcgccggcggcaccggcgatttggcgcgcggctgggccaagcgcgtcggcaagaccggcgaagtgtggctgaccgacatcaacagctcgatgctgaccgtgggccgcgaccgcctgctggacgaaggcgtgatcctgccggtatcgctggccgacgccgagaagctgcccttccccgacaattacttcgacgcggtgtcggtggccttcggcctgcgcaacatgacccacaaggatgcggcgctgcaggaaatgtgccgggtgctgaagccgggcggcaagctgttcgtgctggagttctccaaggtgtggaagccgctgtcgccgatctatgatttctactcgttcaaggcgctgcccatcatgggcaagctggtggcgaacgacgccgacagctaccagtacctggccgaatccatccgcatgcacccggatcaggaaacgctgaaacagatgatgctggacgccggcttcggcaaggccgactaccataatctgaccggcggcgtggtggcgctgcacaagggcttcaagttctga

SEQ ID NO: 1083 - DNA, 423 bp, Chromobacterium substugae
atgcaaagcgcggcgcctggcgccgcggcagaacccatagaaagcaagaccatgtccggagtcgccccccaagccgcccagccggtggaaatccagctgcaccaagtgtcgaagatgctggaaatcgccttcgacgacggcgcccgtttcgaattgccctgcgaatacctgcgcgtccattcgccgtcggcggaagtgcgcggccacggcgtcggccaggaaacgctgcagaccggcaagaggcaggtcggcatcacggcgctggagccggtcggccactacgcgctgaagatcaccttcgacgatggccacgacagcggcctctacagctggacttatctatacgaactgggcgccaagcgcgaccagtactggcaggaatatctggacaagctcgccgccgccggcgcgagcagggagtga

SEQ ID NO: 1084 - DNA, 1023 bp, Chromobacterium substugae
atgcagctctccgacttcgattatcacctgcctgaggcattgattgcccagcatccgcccgcggtgcgcggcgccagccgcctgctgcacgtggacggcatgaacctgtccgaccagaccttcgccgatctgccgaccaaactgcaggccggcgacctgttggtattcaacgatacccgcgtgatccgcgcccgcctgttcggcgaaaaagccagcggcggcaagatagaagcgctgatcgagcgcgtgctggacgaccacaccgcgctggcgcacgtgcgttcgtccaaatcgcctaagccgggcagccggctgatcttcgccggccgctgggaggccgaaatgctggagcgccagggctcgctgttcaagctgcgcttcctggccgaggacaagctgttcgacatcctggaggcttccggcaagttgccgctgccgccttatatagaacgcagcgccgagggcgacgacgacgagcgctaccagaccgtttacgcccgggaacagggcgcggtggcggcgccgaccgccggcctgcacttcaccgacgcgctgttggagcagctgcgggcgcagggcgtggaaaccgccttcgtcacgctgcacgtcggcgccggcaccttcttgccggtgaaggtggagaacgtggccgagcacaagatgcacagcgagatctatgagatcccgcaagcgacggtggacgccatcgcccgcgtccgcgcccgcggcaaccgcgtggtggcggtgggcaccaccagcgtgcgcgcgctggaatcggcggcgcgcggcggcgaactggccgccggccgcggcgagaccgacattttcatcacgccgggctaccgcttccgcgtggtggaccgcctgctgaccaatttccacctgccgaaatcgacgctgctgatgctggtgtcggccttcgccggctacgacgaaattttccaggcttaccgccacgcggtggagaaggagtaccgtttcttcagctacggcgacgccatgctgctggagaaaaagggctaa

SEQ ID NO: 1085 - DNA, 183 bp, Chromobacterium substugae
gtgataatcgaagtcggagagctgcatacggaaacaatcaatcagaatcggcaaattatacccgcgcccaccttcccggcacagtgccgcgcatcacatcgccgacgcacacagcttgacccatgccgatattccatttacatattgcaaacatgccacaccgattttccccttaaaatctaa

SEQ ID NO: 1086 - DNA, 471 bp, Chromobacterium substugae
atgaaaaacaggagtcaggctttgagccgatccatccttgtgctgcacggccctaacctcaatctgctcggggtgcgggaacctcaacactatggccgggacacccttgacgacatcaaccagcgcttggccaaacaggccaaggccgccggtttttccctgtcggcgctgcaaagcaatgccgaacatgtattgatagaacgcatacaccaatgtctggatgacggcaccgccttcatcctgatcaacccggcggcgttcacccacaccagcgtcgcgctgcgagacgcgctggccggggtcaagctgccgttcattgaagtacatctatccaacgttcacgcccgcgaaccgttccgccagcattcctatttttccgacctggcggtcggcgtcatctgcgggctgggcgcccacggttacgagctggcgcttgcgcacgccgtacggcatcttgccgcgcaagcctga

SEQ ID NO: 1087 - DNA, 468 bp, Chromobacterium substugae
atggacctgcgtaaactgaaaaaactgatcgacctggtcgaagagtccggcatcgccgaactggaagtgaccgagggcgaggaaaaagtccgcatcacccgcgtatccgccagccaacagcaggtttacgcgcagccgatgccccagatgtacgccgccccggccgccgcggctcccgccgccgccgccgcaaccgatgccgccccggccgcggctcccgccgccgccagcgacaagaacgcgatgaagtcgccgatggtcggcaccttctaccgctcgcctagcccgggctccaagtccttcgtcgaagtgggccagagcgtcaacgccggcgacactctgtgcatcatcgaagcgatgaagctgatgaacgagatcgaagccgaccgctccggcgtggtgaaagccatcctggtggaagacggccagccggtggaatacggcgaaccgctgttcgtcatcgagtaa

SEQ ID NO: 1088 - DNA, 1356 bp, Chromobacterium substugae
atgttcgaaaaaattctgatcgccaaccgtggtgaaatcgcgttgcgcatccagcgcgcctgccgtgaaatgggcatcaagaccgtggtcgtgcactccgaggccgaccgcgaagccaaatacgtgaagctggcagacgaatccgtctgcatcggccccgcgcccagcggcaagagctatctgaacgtgccggcgctgatcgccgcggcggaggtgaccgacgcccaggccatccaccccggctacggcttcctgtcggaaaacgccgacttcgccgagcgcgtcgagcaatcgggcttcgtgttcatcggcccgcgcgcggaaaccatccgcgccatgggcgacaaggtgtcggccaagcacgcgatgattgaagccggcgtgccctgcgtgcccggctccgacggcgcgctgccggacgatccggctgaaatttccaagatcgccaagaagatcggctacccggtgatcatcaaggcctccggcggcggcggcggacgcggcatgcgcgtggtccactccgaaggcgcgctgatcaactcggtgcagatgacccgcaccgaagccggcgccgcgttcggcaaccccaccgtatacatggaaaagttcctgcaggaaccgcgccacatcgaaatccagattctggccgacgaatacggcaacgccatctatctgggcgagcgcgactgctcgatgcagcgccgccaccagaagatcatcgaagaagcgccggccccgggcatcaccgacaagcagcgcgagaagatcggcgaagcttgcgccgaagcctgccgccgcatcggctatcgcggcgccggcactttcgaattcctgttcgaaaacggcgagttctacttcatcgagatgaacacccgcgtgcaggtggagcatccggtaaccgaaatgatcaccggcgtcgacatcgtccaggaacagatccgcatcgccgctggcgaaaaactgcgctataagcaaaaagacatcgttttgcacggccacgcgatggaatgccggatcaatgcagaggacccgttcaccttcgtgccctccccgggcaagatcgagagctaccacccggccggcggccccggcatccgcatcgattcgcacatctaccagggctacaccgtgccctcgcactacgattcgatggtgggcaagctgatcgcctacggcgacacccgcgagcaggcgatggcgcggatgcgcgtggcgctgtcggaaatggcgatttccggcatcaagaccaatatcccgctgcaccaggagctgttcctcgatgcggccttccagcgcggcggcaccagcatccattatctggagcaccgcctgcagcagaaaaaaggggaagcctga

SEQ ID NO: 1089 - DNA, 897 bp, Chromobacterium substugae
atggcctggttgcaagccaccattgattccgactccgccgtcgcggaaaagctggccgacgcgctgatggacgcaggcgccttgtccaccgcgattgaagacgcctgggccggcaccgaccgcgagcagccgatcttcggcgagcccggcgagccggtggaccaattgtggagccagagccgcatcatcaccctgttcgacgaaaacgccgacgtcgcgctgttgatcgccgccgccgccaacgcctgccagctggcgatgcccggctacagcgtggagcgcgtcgaagagcaggactgggtgcgcctgacgcagtcgcagttcgaacccatccgcatctccgaccggctgtggatcaccccgacctggcacgacgcgccggcgcccgacgcggtcaatctgcagctggacccgggcctcgccttcggcaccggcagccaccccaccacgcggctgtgcctgcagtggctggacaagcagctgcaaggcaatgaaagcgtgctcgactacggctgcggctccggcattctggccatcgccgcgctgaagctgggcgcggcctccgccgtcggcatcgacatcgacgcccaggcggttcgctccagcgccgacaacgccgcgcaaaacggcgtcaaggccgatttcttcctgccggacgccaatccgcaagcccagtacgacgtggtgctggcaaacatcctggccaatccgctgcgcatgttgggcgagctgctgtctagccatgtcaaaaccggtggtagaatcgtcctttccggcatcctcgccgaacaggccgacgaactgtccgccatctacagccagtggttcgagatggacgcgccggtgttcgacgaaggatggactcgattgacaggaacccgacgcgccacggtatga

SEQ ID NO: 1090 - DNA, 984 bp, Chromobacterium substugae
gtgttcaaggcgccggatcatttcgtcgtcacgcagccggctcccgagccggctgtcgcccagccggcgcccgctccggagccggccgccgaacgcgaccccatcgacgacttcgagctggaagtgccggatttcgatccgcaaggcaatcatcccgacatcgacatccccgccgacaatccgctgatcgccccgccgccgtccgcgatgccggcggccgagcctgaacccgaagcggcgccgcaggcggaaatggaagaattccagcgcgcgctggccgaggcgatgcaaaaccgccaggccaccgcgccgataggcaaccccttcgacgatccgcagccgatcgccgccgccgaaccggaagtcttcggccgccgccgccgcgcggaagcgctgccggagccggaaagcaagccggcgcgcgcgcctatcgaagaagagccgctgttcaccgacgccgacgccgaggaagaagcggaagccgccagccaccaacccgccggcccctggctcaacggcgtgctggcggtgctggcggtgatcggcatcctgttcctcgccgcgcagctggtctacatcaaccgcacccgcatcgccgccgaagtgccggaaatgcggccggcgctggaaagcatgtgccgcgcgctggattgccaggtgccctggccgaccgacatcgcgctgatccgcaccgaatggtccgagctcgccttcgtgccggactaccccaacctgatccagttgtcggccacgctgaaaaaccacgcccagtacgcgcaagccttcccgatgctggaggtgacgctgaaggacagcgacgaccaggtgctgatccgcaaagtgttcgcgcccaaggaatatctgaagccggacgatctgaagctgggacgcttcaaccccaacagcgaggcgaagatcaccatgcggctggatgccggcaaggtgcatgcgatgggttacagcctgtactggttctatccctga

SEQ ID NO: 1091 - DNA, 321 bp, Chromobacterium substugae
atgcggaaaacgaaatggctggccggcctgttggccgccggaatggcggccggcgccgttgcggcgggctgctcgcatcaggaggcgccggattacccgttgaaggcattgcgcgacgaggtgggcggcgtggtcaaggtgatgttccagacccgggccgacggcacggtggccggcatccagagcgcggattggcgccagattccgccgcagtaccgcagcggctttcgctacgagatcaataaagccttgcgcgaataccgctgcacgccgggcgccagcctgacgcaggagttcgcattccggatggaggaggagtga

SEQ ID NO: 1092 - DNA, 255 bp, Chromobacterium substugae
atggcggcgccggcgtatccgatacgggccgagatggacaagatcgcaggcgacgtgacgctggtttttcacaccgatgcccgcggccgttacgacggccgggcaagcatggtgttttccgcgacgattcccgaggcttaccgcgaggattttcgtttggcgctcgacgccatgctggaggaatatcgatgccggcccaatgccaaccttcaactcaagttgagattcgtgccggatgacggcgcgcagcgatag

SEQ ID NO: 1093 - DNA, 885 bp, Chromobacterium substugae
atggaccgcttctctgaaatccgcgccttcgtcgcggtggccgagctgggcagcttcgtcgccgccgccgacaggctggagctgtcgcgagcgatggtgaccaagctggtggcttcgctggaaaaccggttgggcgctcggctgatgcaccgcaccacccgcaaactgtcgctgaccgaggccggcgaaacctatctgtcgcaggcgggcagcctgctggcggagctggacgaactggacgcgctgctgtcgcacggcgccagcgagccggtggggcggctcagggtgtcggcgccggtgtccttcggcatgcgctacctgggccgcatcatcggcggcttccaccagcgccatccgcagatagaagtggagctcagcctcaacgaccggcgggtggacctggtggaagagggcttcgatctggcgctgcgggtgtccaacctcagcgactccacgctggtggcgcgccggctggcgcagatcgacgatctgctggtggctgcgccgtcctacctcgcccgccacggcgcgccggcgcatccgtcggagttggccgcgcatcaatgcctgctgtacgcgctgacgtcgcagcccaatgtatgggactaccaagcgccggatggcagccgcgacaaggtgagggtgaaggggccgctgaaggccaataacggcgatgtgctgaccgatgcggccatcaacggcatgggcatcgtgctgcagccgcgcttcctggtggagcaggctttggccgagggcagcctggtagccatcctgcaggactacaactggcattgcctggacctgtcggtggtttacccggtgcgtcggcatgtgccgggcaaggtgcgggtgtttgtcgattatctggcggagttcttcgcttga

SEQ ID NO: 1094 - DNA, 399 bp, Chromobacterium substugae
atgaatcgactgcaaaaccccgcgctcgccgccctgctgctgcgcctgtccctcggcctgatgtatctcgcccacggcgcgctgaagctgttcgtgttcactcccgccggcaccgccgagtacttcgccagcctgggcctgcccggcttcttcggctatgtcgccatcgtgatcgaaatcggcggcggcctgttgctgctggcaggcgtcaaggcgcgctgggtcgcgctgctgttgatcccgcaattgctcggcgccattgcgctggtgcacggcgccaagggctggatgttcaccaacgagggcggcggctgggaatatcccgccttcctgatcgccgcgtcgctggcgctgttcctgctgggcgaaccggcccgcagccaatccgccgcccgataa

SEQ ID NO: 1095 - DNA, 2418 bp, Chromobacterium substugae
atggtcggcgacggcatctcgctcgaccccacctccggcagcctgctggcgccggtggccggcgtggtcagcaatctgcattccgcccatcacgcgctgaccatcaccaccgccgaaggcgtggaagtgatggtgcacatcggcatcgacaccgtgatgctgaagggcgaaggcttcttcccgctggtcgagcagggccagcaggtcagcgccggccaggccgtgatcgacttcgacatcgaccaggtgggccgccgcgccgccagcctgctgacccagatcatcgtcaccaatggcgacagcgtgcacagcatgcagccggcccggggcatggtgaacgccggccgcgacgtggtgctcagcctgacgctggccaatggccaggccgcggcgcaagtccagagcggcgagccgcagctgtcggccgccatcgccatcggcaacccggccggcctgcacgcccgcccggccgcggtgttcgccagcaaggccaagagtttctcctccgacatccagctgatcctcgccgacaaggaggccaatgccaagtcggtggtggccgtgatgggcctggccaccaagctgggcgacgcggtgcgcatccgcgcgcagggcgccgacgccgccatcgccatcgccgagctgacccaattgctgaacgagcgctgcggcgagaaggccgacgaggcgccggccgccccggccgccgcgccgatcgccatccagcaacaggatagcgagagccagctggccggcgtcggcgcttcgcccggcatcgccatcggccgcatcgtccatcaccgtctgcaggaattcgacgtgcccgagcagggcaagggcggcaatgtcgagcagcaggccttcgcccgcgccgccgaagaggccgcggcccagatcgagctggtcaaggcccagctgtccgacccggccaagcaggccatcctgtccatgcaccaggaactgctgcaggaccccgacctgctggcgctgacctataccggcctggccgaaggcaagtcagccggctgggcctggcgcgccgccttcagcgcctactccgcccgcctggaggcgcaggacaacccgctgctgcgcgaacgcgccaatgacatccgcgacgtcggccgccgcgtgctggcgctgctggccggcgtcaagcaagccgcgctggaattgccggccggctccatcctgatcgccgaggatctggcgccctccgacaccgccgcgctggatccgtccaaggtgatgggcttctgtacccgcaccggcggcgccaccagccacgtcgccatcctggcgcgctcgctgggcattccggcgatctgcggcatctcccaggccgcgctgaaactgccggaaggccgccaggtcattctcaacggcagcgaaggcacgctggccatcgcgcctagcgccgacgacctggccgccgccgagcgcgagatcgcccgcctggccgagcgccgcgccgccgaagccaagggctcgatgcagccggcgcaaacccgcgacggcgcgcgcatcgacgtggtggccaatatccgcaacgccgccgacgcgcgcgaagcggtggccaagggtgccgagggcgtgggactgttgcgttccgaattcctgttcgacaaccgcgacaccgcgccgaccgaggccgaacaggccgccgaatactgcgcggtggccgaggcgctgggcaaggagcgtccgctggtggtgcgcacgctggacgtgggcggcgacaagcccttgtcctacctgccgctgccgaaggaagacaaccccttcttgggcctgcgcggcatccgcgtcagcctggaccgtcccgacctgttgcgcacccagctgcgcgccattctgcaagcggctcctctgacccagctgcacatcatgttcccgatggtggcctcgctggaagagctgcgcgccgccaaggcggtgctggccgaagagcaagccgcgctgggcgtcgccgacgtcaaggtcggcatcatggtggaagtgccttccgccgccgtgctggccgcgcgcttcgcgcccgaggtggacttcttctcgatcggcaccaacgacctgacccagtacgtgctggcgatggaccgcggccatccgcagctggccaagcaggccgacgcgctgcacccggcggtgctgaacatgatagcgatgacctgcgacggcgcgcgcgcccacggcaagtgggtgggcgtctgcggcggcctggcctccgacgaacgcgccgcgccgctattggtgggcatgggcgtcaccgagctgtcggtcagcactccggccgtcgcctcggtgaaagccacgctggcgcgctggagcctggacgagtgccgcgagctggcccgcgccgtgctggcgctgtccaccgtcaccgacgtccgccaccacctgaaccaacacgctcgttaa

SEQ ID NO: 1096 - DNA, 1764 bp, Chromobacterium substugae
atgtttagtcaatcattcgcttttctgcagaagataggcaaatcgctgatgctgccggtcgcggtgctgcctgtcgccggcctgctgctcggcatcggcgcgaccgacttccacaccacgaacagcgtcgctctggcgatcctgtccttgatgaagaactccggcgacgtgatcttcggcaacctgccgctgatcttcgctgtcgcggtggcgctcggcttcaccgagaacgatggcgtcgccgccatcgccgcggtgatcggccacctggtcaccaccgtcaccctgggcgtgatggccggcctgatgggcgtgaaaaccgccaccatcatgggcctgccgtcgatccagaccggcgtgttcggcggcatcctggccggcggcatggcggcctatctgttcaaccgcttctaccggatcaatctgcccacctacctgggctttttcgccggcaagcgcttcgtgcccatcatcaccgccatcagcgccatcggcctgggcgcggtgctgtcggtgatctggcgtccgatcggcgaaggcatcgccaccttctcgcactgggccgccgtcagcgacccgcgcaccgccgccaccgtgtacggcttcgtcgagcgcatgctgatccccttcggcctgcaccatatctggaatttgccgttcttctttgaaatgggcgacttcgtcgacgccaccggcaagcacgtgcatggcgacatcaaccgcttcttcgccggcgacagcaccgccggcgtactggccggcgccttcttcttcaagatgttcggcctgcccggcgccgccatcgccatctggcattcggccaagccggaaaaccgcgccaaggtcggcggcatgatgatttccgccgcgctggcgtccttcctcaccggcatcaccgaaccgatcgaattctccttcctgttcgtcgcgccggtgctgtacttcatccacgcctgcctggtggcctcggcccagttcatcgccaacacgctggacatgcacatgggcttcaccttctcgcaaggcggcatcgacttcgtgctgttcaacctgatcggcgacaaggccaagcacgccggctatgtgttcatcctcggcccgatctacttcgtgatctactacggcgtgttccgcttcgtgatcgccaagttcaacctgaaaaccccgggccgcgaagatgaaagcctggaaaccgccggcgccgtcagcgaagaccagcgcgcgcgcgaactggtgctggccttcggcggccgctccaacatccgcacgctggacgcctgcatcacccgtctgcgcatctcggtgcaggacaccgccaaagttgaccaagccaagctcaaagccatgggcgcctccggcgtggtggtggtcggcaacggcatccaggccattttcgggccgctgtcggaaaacctgaaaaccgatatggacatctatctgcgcagcgccggcagcgatgccgagctgtcgtccgccccgcttgcggcccccgcgcctgtcgcggtggctcccgccgcgccggcggctgccgccaaggcagatatcgccgcgctgaagcaggcgctgggtggcaacgccaacctcggcaaggtggaagccatcgcccacacccgcctgcgggtggaactgaaggacgccgcccgcttcgacgaagccgcggcccgctccgccggcgtcatggcggtgatgcaggtcgcgccgggcacgctgcacctgatcgtcggcgatcaggcggccgcgctggccgcagcgctgctagcctga

SEQ ID NO: 1097 - DNA, 798 bp, Chromobacterium substugae
atgtcttaccgtttcatcgcttcagatctcgacggcacgctgctggaccagcaccatgccgtcaattccctcaccgccgccaccttgcagagcctggaagcccgcggggtgcaattcgcgctggccaccggccgccatcacctggacgtgaagggcatccgcgacgcgctgggcgtgcgcgcccacctgatcacttccaacggcgcccgcatccacgacccggacggcaggctgatccaccgccaggacatcgcgccgcagctggtgcgggcgctggcgcagccggaatacgccgccggctccatcctcaatttctatctggacgacgagtggctgatcgatcagccctgccagtccttcctcgacatgcaccgcgattccggcttgagctaccgggtagacaatctggccgagcatgacggcgtcggcgtcggcaaggtgctgtacattggcgagcacgcgcacctgctgcgggtggaggaggcgttgcagcggcgcttcggcgaccagctctacatcaccttctcgctggagaactgcctggaagtgatggcggcgggcgtctccaagggccacgcgctgcggctggtgctgggccggctggatatcgatccggcgcattgcctggctttcggcgacggccagaacgacgtggagctgctgcgcgccgccgggcatccgcgcctgatgggcaatgcccatccgcggctcagcagcgaaatgccggacgcccatcgcatcgccagcaacgctgaatccggcgtggcgcagcacctgcgcgaattgttcgcgctgtga

SEQ ID NO: 1098 - DNA, 441 bp, Chromobacterium substugae
atgaacccgctttcccttgccgcccacagcggcgccagcctggacgccttgctgcgccaggccgtgatccagcttggctgccccgaaggacggctggccgacgtggaccagcacgccaccctcgccatccagctgcaagcgctgcccgacgtgatggtgtcggcgctggacgaccgcctgtgggtatggagcattctgcccggcctgtccgaagccaggctgcacgcgatggcggccgagacgctggccatcctgctggagccggtggaagacgtggaaagcggccagctagcgctgggacgcggcgagcacggttatgaattgaaagcgctggtgaggctggactgcctgagccgcgatggcgggctgcagcctgtgctggccgctttcatcgagcggctgcgcgcgctgtgccagacgctgaacctgacgggagaatga

SEQ ID NO: 1099 - DNA, 984 bp, Chromobacterium substugae
atgccgggcatcaccacgatttcccacgccggcggcgcccagcgcgccgcctcgccctccaccccggccgctccgcgcgccggccagccaaccgggctgacaagcagcccgctccccggcccgacatcgtcgcgccaagcggtgatctacgcgccgttcgccgccggcgacgtggtgacccagagcctgggcaagaacctggtgcgcgagcaaaacggcaaaccactgctgccgctgatcgcgcaggacgaccaggcccatgtccggctgcagcagctgcagcagcagcaggttcaggatctgcgcggcaagggctcgctgtttcccgaccaaatccgcaaattgcagcaacagcacaatctgtcgcaagacgtcctgcgccagcatatcggcccggccgaattcgacaaggcgatgcaggcctctgccaccttcgcccgccaggccgacgtgctgcagcggatggagatccgcagcaacgagcacggcgcggagctgggccggctgcagccgcagcgcgacaagatctacatcgtcggccacggcggcccgggcatggacatcctggcggccgaccagcaggtgacccagggcaaggccacgtccgccgatgtggcgcaacagctggcagccggcggcctggaccgcgccttccgcgatttccgcgccaccgcctgcttcagcgccgacacccgcgagccgacctccttccacccggcagacctgggccgcgccgccgcgccggcgctgggaccgcgcccgggcttcctgcagttgttcggcaaacggccggtgctgagccagcctttcgcccaatcgctgagcgacgagttggccaagcagggcttcaaacagccggaggtcgccggctaccacggcgccggcgtgaccttcagccagatcggccacagctcgcgccgcctgcctggcgccgccgatagccgggcgtcggagctgaagcaggtattcactccgcgcaagtaa

SEQ ID NO: 1100 - DNA, 405 bp, Chromobacterium substugae
atgccagacctcgccgccttccaccattgcgccaatgaactgctgcaacacctgggcttcgacgccatcgtgccggccagccatcaggaagtgatcagcctgaccgtggagcagcgcttcgccgtccacctgggcgccatcgaccaagaccattggttcatgcaggccgagctgggcgaacatccgctgcgtgacgccgacccgctgctggcgcaggctttgcgcggcaaccagctgtgcggccagtcctggcagccggtagcggcgctggatgccgaacagcggctgtgttgctggctgcgcctgccgtgccgcggcctcgacctgccgcagctcgccgccgccttcgacgcgctgatcgcccgcgccgaagcgctgctggacagcgccgccgccgcgcgctga

SEQ ID NO: 1101 - DNA, 1389 bp, Chromobacterium substugae
atgagcaccatccacaccggcattcacatgatccggcccaacctgtcccagctgaacgaactgggcgccggcctgcgcgccgacagcgcccgcatcggcatccgcaaggacggcagcctggtggtctacaccggccgctcctacctgctgcacccggaccagacccgccgcgcgcagcagttcctgcgccagaaccacttgctggagccgcaagagcgcccgcgcgacatccgcctgctcgacctggtgacgcggctgaacacccgcgccaacagccacacccgtcccagcccgcaggatctggcgcagcggaccgacgccggcgccaagccgcatctgcgctgggctgaccagcagccgccgcgccaggaagccgcctcgctgagccagcgccgcggcctgcagcatctgaaactggcaccgcagcccgccgccgcgccggcaaacccgcaggccgcgctggcgcgcgcgctgggcagcagcgacaaccgcgtcggcctgtccagccagctgcaacagcaagccggcccggccgccagcggcgcggccttcatcaatgacctggccggcgcgcgcttccgcgacatccccaccgccgccgccaccctggtgcgggcgccggacggcgcgcagctgccggccaaccgcgtgcaggtgggcggcgccaatgtcgccatcgccagccaatatccgacggcgggccagctggagagctatttcggcatgctggccgccaaccgcactccggtgctggtggtgctggcctccgaccacgacatcgccaagagccagggcggcggcaatccgctgccgccttacttctcgcaaagcggccaatacggcaaggtggccgtcagcgcgcgcgaaggcagccatagccaactggcgggcggcctggaagtgcgcgcctaccagttggcggtgcaggacggcggcggcaagaaaatctccatcccggtgctgcacgtgcccaactgggctgatttcggcgcccaaggcccggtcgctctgaaagcgttggccgaacacgtcaacgcggtgaaggagaagcagatcggcgtctaccagcgcggcaacagcagcgcgctgaacgacccggacaagctgctgccggtgatccactgccgcgccggcgtcggccgtaccggccagttgatcgccgccaccgagctgctgaagcccggcgcgtccagtctggagtccatcgtcggcgacatgcgccgcagccgcaaccacctgatggtgcagacggcggagcagctgaatacgctggccgacctggcccaacaacagggccgcgccgtcgtcgcctcccagccggccgccgccggcaatcagccgatatacgccaataccgccccgccgctgccgccccgccatccgcgctaa

SEQ ID NO: 1102 - DNA, 1188 bp, Chromobacterium substugae
atgagcaatcgatacggccagttgttccgcacgccgggtgtcgccgagcttgcgctggccggctgggtggcgcgcctgcccggcaccatggtggccgtcggcgtcatcaccatgctgtcgctgagccgtaacagctatagcctcgccggcgcggtcgccgccaccttgacgctggcctccgcgctgctggcgccgcaggtatcgcggctggccgaccgctacggccaaagccgggtgctgccgccggccaccggcatcggcgcttgcgcgctgctggcgctgattctgtgcaaccatctgcacgcgccggcgtggacgctgtacctgtgcgcggcgccggctgcctgcctgcccagcatcccggcgatgacccgcgcgcgctgggcgcgactgctggaaggccagccgctgctgccgacagcgttcgcgctggacagcgtcttgagcgaaaccgccttcgtcatgggtccgccgttgtcgataggcctgtgcatggcctggtttcccgaagccggcccgctgttggccgcgctgctgatcctgttcagtgtttccgcgctgctacgccagaaagccaccgagccgccgccccatcccatcacgtcggacagccgccgtccggcgctcttcctgcggccggtgccggttctggccttgctgatgggcacgctgggcgccatcgcgggcaccatagacgtcgcctcggtggccttcgccaaggcgcagggccagcccgccgcagccggctgggtgctggcgctgtacgcgctgggctccggcataggcggactggccttcggcgcgctcaagccggctctgccgctgggtaggctgctgctgggctgctgcctggccaccgcggccagttccaccctgatcgcgctggcgccgaatgtgatatggctggcggcggtgatgctgttgtcgggattgtccttcgcgccgacgctgatcgtcgcgatggaaatggtggaaaaggccgtgccgcgcgcgcgtctgaccgaaagcctgacctggctggtcaccggcatccagttgggcgtcgccggcggcgcctcgctgtgcggcctggcgaccgacgcctacggcgcccgggccggcctgagcctggcgctggcggctggcctcgcctcgctatcgatcgccgccttgcaaccgcgcgtagtacccacgaaaagcgcttgctga

SEQ ID NO: 1103 - DNA, 1536 bp, Chromobacterium substugae
atgcaaacccgtttattagccagtcttctgactctaaccttattgagcgcatgcacaagcacacagctcgctggcgatcctttaaatgaaaaaccagatagccaatctggaactgtcatcttatcgctcaccatcaatactggtgaagtaccgcccattgagcttattgaactgaccagaaatgaggatcccacatcaggatttaataaaaaatatcagctcaagaatatcgttccaggcctctcaaaagatactgcactttatattggcacccttccagctggaacctataaacttgactacttgcgtgctcaattgaaatttttgtcagtatctccaggacagcgagagctagttggagattttcgcgttgaaccagggaaaacctcagatcttggtcgacttattctgacagcgatcaactacaaagtagcctttggacgcagtcttcatgaaaaagacaaccgaaaattagtagcgcttgcggcgccgtcataccaaagtctctatcaacaagcctcatcaacaggctggctgaaaaccgagccaacagaccgcattgaggcatacgcgctcagcagaccgcaaggggctggcggctttagcgaattagctgatcataggataataggtgggtcaaggtttggcagcatattggtacgccaagattctggccactggaaactgattggaagaactggtgaactcaattccattctattcaccactccctatcccatccagccctatatggcggttgccgtcggtgagttcggtagttttttcaaagtgcgcatggatggcaaaaccttgcctatcgaccgaggaaatcttcctcttggaaattatttcttcatagacagttctccagatcaaaaacactggtttgtcggagtccagctgcctggaaaagtatccttgtatgaatccaatcaattggaaaatggaaactggaaaattgcaagagaaaatccggcaggaatattatggctatggcactatcctggcggtattggttatgcatcaagctcggtccgagtgattgcctgctatgactatgcgcaaaagcaatggcgccaaaatgatactcctgaaaagcgttatatcatctcagtggccggtggaccgacaaagtcggtcggcgtgctaactcaggtaggcttaggaattgcgggagtattcgccaaaacccattacagctcagattgcggagccaactggaaagaaactcactccccctataccgtcaaagcttccgctcccatcattctgccatcaggccagattttggaaagcggtggcgtattcggcgataccggcatttaccgcagtgacgatggtagcaactggagcaagatttacagcgatcagctgatattgcgcgatcacatctgggtcatgccgacggcaggcctgatcagcgtatcgaatagcattaacggagttgaggacatccaatattcgaatgatggaggagctacctggagtactgaagtcacgagctacgactcaaggcaaaataacacaaaggactga

SEQ ID NO: 1104 - DNA, 73 bp, Chromobacterium substugae
ggccagttagctcagttggtagagcagcggattgaaaatccgcgtgtccgtggttcgattccgcgactggcca

SEQ ID NO: 1105 - DNA, 73 bp, Chromobacterium substugae; identical to SEQ ID NO: 1104

SEQ ID NO: 1106 - DNA, 645 bp, Chromobacterium substugae
atggctgaacgcgtcctgtacggctacttccgctccagcgccgcataccgcgtccgcatcgcgctgaacctgaagggactggcttaccagtatcgggcggtgaacctgctcaagggcgagcagcgcagcgccgactatctggcgatcaacccgtacggcctggtgccgctgctggacgatggcggcgtgcagatcgcgcagtccttggcgatctgcgaatacctggacgaagcctatccggacacggcgcggctgctgccggccgagccggcggcgcgggcgcgggtccgttcgatcgcgctggccatcgcggcggacatccaccccttgcagaaccctagggtgggcaagttcctgcaggccgagcacggcgcgagcgaagagggcaagaccgagtggatccgccactggatccgcaccggcttcgacgcgctggagcggcagctggcgcagactgccggccgttatgcggtaggcgacgcgccgacgctggctgacgtgtgcctgctgccgcaggtattcagcgcgcgccgcttcggcgtggacctggcgccgtatccgaccatcgtccgcattgcggaggcgttggaggcgctgccggcatttgccgacgcgcatcctgccaagcagccggacgcggtgtaa

SEQ ID NO: 1107 - DNA, 978 bp, Chromobacterium substugae
atgaaattagccacttatcacaaccacacccgcgacggacagctgatggtggtcagccgcgatctgacccgcgcggtggccgtttccgccatcgccgccacgctgcagggcgcgctggacaactgggcgcaggccgcgccgcgcctgcaggaagtctacgccgccctgaaccagggcaaggtgccggacgaggtcgccttcgactccgggcgctgcctcagcccgctgccgcgcgcctaccagtgggccgacggcagcgcctacctgaaccacgtcgagctggtgcgcaaggcgcgcggcgccgaggtgccggaaagcttctacaccgaccccttgatgtaccagggcggctccgacgccttcctcgccccgacggccggcatcccgctgcgcgacgaggcctggggcctggatttcgagggcgaggtagcggtggtcaccggcgacgtgccgctgggcgcgccagccgatgagaagcacatccgcttgctgatgctggtcaacgacgtgacgctgcgcaatctgatcccgcctgagctggccaagggattcggcttcttccagagcaagccggccaccgccttttcaccggtcgccgtcacgccggacgagctgggcgacgcctggcagggcggcaaggtgcatctgccgctgttggtcgactacaacggcgcgttctacggcaagcccgattgcggcgtggagatgcagttcagcttcccgcagctggtggcgcacgtctccaagacccgcgagctggtcgccggttccatcgtcggctccggcaccatctccaacaaggaccgcagcgtcggctcctgctgcctggccgaacagcggatgatagaaaccatcgagcagggcgcggcgaagacgccgttcatgaaggtgggcgacacggtgcgcatcgagatgaagagcgcggccggcgacagcatcttcggcgccatcgagcaaaccgtggtcgcccatggctga

SEQ ID NO: 1108 - DNA, 1134 bp, Chromobacterium substugae
atgcgtaaatggatcagttacccccaccgcgaaggcacgttctcgcgccaggcccacgccgattttccggccgaggccatttacgagcgggaagtcggccgcagcggcttcttcggcccggccacccatctgcaccacaagcacccgcccacggcctggagcgcgtgggagggcccgttgcgcccgcgcgcctttgacctgaacgagctgccgcacggcgcgccggcgccgtgggacgcgccgctggtgttgcacaacgcccagtgcaagctgcgcatctggcgctgcgagcaggcgatgacccagctgttccgcaatgccgacggcgacgacctcttgttcatccacgccggcagcggcgaattgttttgcgattacggccacttgagctaccgcgacggcgactacatcctggtgccgcgctccaccagctggcgcatcgagccggccagcccgaccaccatgctgctggtcgagaccagcaacggcgcttaccagctgccggaaaaaggcctggtcggtccgcacgcgatcttcgacgaggcggtgctggacgtgccggcgatcgatgatgtcttcaaggcgcagcagacggaggacgaatggcaggtggtgatcaagcgccgcggcgcgctgtccatcgtcacctatccgttcaatccgctggatgccatcggctggcacggcaacaattcggtggcgcgcgtcaactggcgcgacatccgcccgctgatgagccaccgctaccatctgccgccgtcggcccacaccaccttcgtcgccgacggcttcgtgatctgcaccttcgtgccgcggccgatcgagtccgacccgggcgcgctgaaagtgccgttctatcacaacaacgacgattacgatgaagtgatcttctaccacgccggcgactttttcagccgcgacaacatcaaacctggcatgctgaccttccacccggccggcttcacccatggcccgcacccgaaggccttcgccaaggcgatgaccgagccgaagaaattcaccgacgaagtggcggtgatgatagacgcccgcgacgccctggagcaggggccgggcctggccagcgtcgagtggcaaggatacgtggacagctggaagcccaagccggtttga

SEQ ID NO: 1109 - DNA, 1077 bp, Chromobacterium substugae
atgaaaatggaagccatgctgcaaaatccgctagccaccgacggttttgagttcgtcgaatacaccgcccccgacgccgagggcgtggagaagctgaaccagctgttcctgtcgctgggcttcaccgaggttgcccgccaccgcagcaaggacgtgcgcctgtatcgccagggcgacatcaacttcatcctgaacgccgagcgcagccagccggccagcgagttcgccaaggcgcacggcccgtccgcttgtgcgatggcctggcgcgtcaaggacgccgccaaggcgtatgaatacgcgctgtcgcacggcgccaagccgtatcagcgcccggtcggcgcgatggagttgaatatcccggcggtgcagggcatcggcggttccgccttgtacttcgtcgatcgttacggccagggcaaggacatctacgagatcgacttcgtgccgctggaaggcgtggaccagcacccgttcggcgtcggcctgaccctgatcgaccacctgacccacaatgtggcgcgcggcaatatggccacctgggccgacttctacactggcatcgccaacttccgcgaaatccgctacttcgacatcgaaggcaagctgaccggcctggtgtccaaggcgatgaccagcccctgcggcaagatccgcatcccgatcaacgagtcgtccgacgacaagagccagatcgaggaattcctgcgccagtacaacggcgaaggcatccagcacatcgcgctgaccaccgacgacatctacgccacggtggaaacgctgaaggcgcgcggcacccgcttcctcgatacgccggacacctattacgaaaaggtggacacccgcgtgccgaaccacggcgaggacgtggcccgcctgaagaagaacagcatcctgatcgacggcgcgccggtggaaggcatcctgctgcagatcttcaccgaaaccgtgatcgggccgatcttcttcgagatcatccagcgcaagggcaacgagggcttcggcgaaggcaacttcaaggctctgttcgagtccatcgaggaagatcagatccgccgcggcgtgctgaaggccgattga

SEQ ID NO: 1110 - DNA, 486 bp, Chromobacterium substugae
atgccaagtctcacattagacaagacagacttgcgtattctggccgagctgcagcttgacggccggttgaccaacgtcgagctggccgagcgcgtggccctgtcgccatcgccctgcctgcgccggctgaagcaactggaagagtcgggcgtgatccgccaatatgtcgccctgctggatcctgcgcatatcggtttgggcctgcaggcctgggtgcgcgtgacgctggaaaaacgcggcaatctgcatctgcaaagcttcatcgaggcggtgcagagctggccggaagtgatcaactgcttcgcgatgaccggcgagatggactatctgctgcaggtgtatttcgaagacatggagcatttctcgcgcttcgtgatggacgaactgctgcagcacccgggcgtggaagacgtgaagtccagcttcgtgctgaaggagatcaagcgcaccaccgcgctgccgctgggacagctgcgcagcatgtaa

SEQ ID NO: 1111 - DNA, 546 bp, Chromobacterium substugae
atgcaagaaaacataacgaatcgccgggagcccaggaagtcgctgctgggccaggtcatcttcagcagccgctggctgcagctgcccatctatctgggcctgatcgtggtgcagggcgtgtacgcgtggaaattcctcgcccagctgtgggagctgctggaggggctggaccacctgaccgagaccgacatcatgctggcggtgctcggcctgatcgacgtggtgatgatcgccaacttgctggtgatggtgacggtgggcggctacgagactttcgtgtcgcggctgcgcatcgacacccacccggaccagccggagtggctggatcatgtcaatgcgtcggtgctgaaggtgaagctgtcgatggccatcatcagcatctcgtcgatccacctgctgcaaaccttcatcaacgccagccgcatcgacgagcacaccatcaaatggcagctgttcctgcacctggccttcctgctgtcggcggcggccatcgcctataccgacaagctgctgtccagcaccgccgcccatcatcaggggcattga

SEQ ID NO: 1112 - DNA, 840 bp, Chromobacterium substugae
atgatgacgcagacgccacgcaccttcagtttcgagtttttcccgcccaagacgccggaaggcatcgccaagctgcgcaccacgcgccagcagctggcccagttcaagccgcagtttttctcggtgactttcggcgccggcggaactacccgcgacggcaccttgtccaccgtgctggagatccgcagcgaggggcacgcggcggcgccgcacctgtcctgcatcggctcgacccgcgagaacatcgcggcgatcctcgacgaataccgcaacaacggcatccgccacttggtggcgctgcgcggcgacatcccgtccggcatggtggcggccggcgaattccgctacgccaacgagctggtgtccttcatccgcgagcagcacggcgagcacttccacatcgaggtggcggcctatcccgaattccacccgcaggcgcgctcggccgaagacgacatcaacaacttcgtgcgcaaggtgcgggccggcgccaactcggcgatgacccagtattttttcaacgcagacgcctatttccgcttcgtcgacgagatccaggcgcgcggggtggacattccggtggtgcccggtatcatgccgatctccaatttcggccagctgtgcagattttccgacatgtgcggcgcggaagtgccgcgttggctgcggcagcggatgcaggcctattatgacgacaccgcttccatccgcgcgctggggctggatgtggtgaccgagctgtgcgaccgcctgttgcagggcggcgcgcccggtctgcatttttacactttgaaccaggcgggcctggtctccaccatctggcagaggctgggcctgtga

SEQ ID NO: 1113 - DNA, 1401 bp, Chromobacterium substugae
atggctgatttttccgattttcacgtagctgacatcaaccttgccggctggggccgcaaggaactgaacatcgccgagaccgaaatgcccggtctgatggcgacccgcgacgaattccgcgccagccagccgctgcgcggcgcccgcatcgccggcagcctgcacatgacggtgcagaccgcggtgctgatcgaaaccctgaccgcgctgggcgccgaagtgcgctgggcgtcgtgcaatatcttctccacccaggaccacgccgccgccgcgatcgccgccgccggcattccggtattcgccttcaagggcgagagcctggacgagtactgggaattcagccacaagatcttcgaatggcccgagggccagccggccaacatgatcctcgacgacggcggcgacgccaccttgctgctgatgctgggcagcaaggcggaaaaggacatcggcgcgatcgcccatgccaccaatgaggaagagaccgcgctgttcgcgtcgatcaagcgccacctggccatcgatccgtactggtattcgaagcgcctgcagcacatccagggcgtgaccgaggaaaccaccaccggcgtgcaccgtctgtaccagctggaaaaggacggccacctgccgttcccggcgatcaacgtcaacgattcggtcaccaagtccaagttcgacaatctgtatggctgccgggaatcgctggtcgacggcatcaagcgcgccaccgacgtgatgatcgccggcaaggtggcggtggtgctgggctatggcgatgtgggcaagggctgcgcgcaaagcttgcgcggcctgggcgccacggtgtgggtgaccgagatcgacccgatctgcgcgctgcaggcggcgatggaaggctaccgcgtggtgcggatggacgaggtggccggcgaagccgacatcttcgtcaccgccaccggcaacgtcggcgtgatttcccacgagcacatgaagaagatgcgcaacaacgccatcatctgcaatatcggccacttcgacagcgagatcgaagtcgcctccctgcgccagtaccagtgggagaacatcaagccgcaggtcgaccacatcatcttccccgacggcaagcgcgtgatcctgctggccgaaggccgcctggtgaacctgggttgcgccaccggccacccgagcttcgtgatgtccaacagcttcaccaaccaggtgctggcgcagatcgaactgttcgccaacggccagaagtacgacaagaaagtgtatgtgctgcccaagcatctggacgagaaggtggcgcgcctgcacctggcccgcatcggcgcgcggctgaccgagctgtccgatcagcagtcggcctacatcagcgtgcccaagcaaggcccttataagccggatcactatcgttattga

SEQ ID NO: 1114 - DNA, 1596 bp, Chromobacterium substugae
atgcccttcgtgttcacaccgctggccgcgctgtccggcctcgccgcgctgttgtccgccgccatcagcgtcatcgcctggaaccgcaggcagttcgccggcgtgcgctggctggccttgctgatggcctcggtggcgttctgggccgccggcgcgatgtgcgaactgtcggccaccagcctgtccgccaaagtgctgtggtccaaggtggaatatctgggcaccctctccaccccggtgctgttcctgctgctggcgctcgactacaaccacatcgacctgatgcgccgccgccgctggctgccggtgctgttcgcgattcccgcgctatgcctgctgctggccgccagcaacgaataccaccagctggtctggaccagctaccgccccagcccgtccggctacaatttgctgatctacggccacggaccggcgttctggctgggcgtggccggctattcctacctgatgatgctgctgggcagcctgctgctgatccgctcgctgcattactacccgccgcatttccgcggccagtccatcacgctgatgctcagcgcgctggcgccctggctgggcaacatcctctacctgagcggcctgttccccctgcaggggctggatccaaccccgcactccttcgccttcaccggcatcgtcttcgcgatcgacctgctctacctgcgccagctctatctggtgccggtggcgcgcgcccgcgccttcgaggcgatgggcgacggcatcgtggtggtggatcagcagctgcgcattctcgacatcaatccttccggcgcgcggatgctgggccagccggccggacagctgcaaggcagcgcgctgcccgcgccctggctggacagcgccaggctgcggcgcgaaggccagttgctggagatgatggcgccggccagcggcaagattctggacatccgcgcctacgccatcgaccaaggccggcatcccggccacaccctgatgctggtgatgcgcgacatcacccagcgccgcgaggcggaggacgcgctgaaaaacgccaaccagcaactggtggaacggctggcgcagatcgaacagctgcaggcggcgctgcgcgaacaggcgctgcgcgatccgctgaccggcctgtacaaccgccgctacctggacgaaaccttcgagcgcgaaagccggcgcgccgaacgcgaaagccagccgatcgcgatggcgatactcgatctggacaacttcaagcagatcaacgacagccatggccaccaggtcggcgaccgggtgctgcaagcgctggcccgcctgctgcagcgcgaatgccgcgccaccgacatcgtctgccggctgggcggcgaggagttcctggtattgctgcccggcagcgacgccgaacaggcccaggcgagggtggagggctggcgcggcggcttcgcccggcttagccatgccggccgcgatcatccattccaggccagcttctcctgcggcatcgccgcgctgccgcgccatggccgcgcgctgtccgaactttaccatcatgccgaccgcgccttgtaccaggccaaggccgccggcaagaactgcagcgtgcgcgcccccgcctga

SEQ ID NO: 1115 - DNA, 1170 bp, Chromobacterium substugae
atgagtgaatacctgtttacctcggaatccgtatccgaaggccaccccgacaaggtcgccgaccagatctccgacgccatcctcgacgcgatcctgcgcgaggacaagcacgcgcgcgtagcggccgagaccctggtcaataccggcctggtggtgctggccggcgaaatcaccaccaccgccaatgtcgactacatcaaggtggcacgcgaaaccatcaagcgcatcggctacgacgactccgaactgggcttcgatttccgcggctgcgcggtgatggcctgctacgacaagcagtctccggacatcgcccagggggtcaacgagggcgagggcatcgacctgaaccagggcgccggcgaccagggcctgatgttcggctacgcttgcgacgaaactccgacgctgatgccgttcccgatctactacgcgcaccgcctggtgcagcgccaggccgaactgcgcaaggacggccgcctgccgtggctgcgcccggacgccaagagccagatcacctgcgtgtacgatgccgccaccggcctgcccaagcgcattgacaccgtggtgctgtccactcagcacagcccggacatcgaccacaagacgctgaccgacgcggtgatcgaggacatcatcaagccggtgctgccgccggagatgatcaccccggaaaccaaattcctgatcaacccgaccggccgcttcgtcatcggcggcccgatgggcgattgcggcctgaccggccgcaagatcatcgtcgacacctacggcggcgcggcgccgcacggcggcggcgcgttctcgggcaaggatccgtccaaggttgaccgttcggcggcgtatgccggccgctacgtggcgaagaacatcgtcgccgccggcctggcgcgccagtgccagatccagatctcctacgccatcggcgtggccgagccgacttcgatcgcggtcgacaccttcggcaccaacaaggtgccgaacgaaaagatcgtcgaattggtgaagaagcatttcgacctgcggccgaaaggcatcatccagatgctggacctgctgcgtccgatctacggcaagaccgcggcttacggccacttcggccgcgaagagccggaattcagctgggagcgcaccgacaaggtggaggcgctgcgcgccgacgccggtctgtaa

SEQ ID NO: 1116 - DNA, 777 bp, Chromobacterium substugae
atgcggctgcgggagaatcttagttctagtaaaatcttcgaaaactatcaggttttaccacgcgaagtcaaacgcagcgcggcggaaaccggcaagggcgcgctggagctggccatcgcctggtgccgcagtccggaagacatcgccgcgatggtcaaaagctgcgacggttggcatcacgtggagtcggcgctggctcaaggcaatggcattatattcgtaactccgcatttgggcagctacgatatcgccggacgttatataagttcgcgtctgcccttcccgctgaccgcgatgtaccgcccgcccaagctcgcctggctggagccggtgatgcaagccggccgctcgcgcggcaagggcaagaccgcgccggccaccgccgccggcgtgcgggtgctgatgaaggcgctgaaatccggcgaagccaccatcatcctgcccgaccaggcccccggcaacggcgaaggcgcttgggcgcccttcttcggccggccggcctacaccatgacgctggtgccgcggctggcgcagatgagcggcgtggccacgctgttcttcgtcggcgagcgcttgccgcgcggccagggcttcgccgtccacatcgaaccgctggcccagccgttcaccggcgacaaggaagcggattgtgccttgatgaacgcccaggtggaaaacctgatccgccgcttccccagccagtacctgtggagctacaaccgttataaatgcccggccggcgtcacccggccggacgatgcacaaggacacgcatga

SEQ ID NO: 1117 - DNA, 867 bp, Chromobacterium substugae
atgagactcgctttcgccctgttgtggctgatccgcctgttgccgatgcgggccatcggcctgatcgccgccggcctgggcaatatcgcctacttgctggccggcggccgccgccgcgtcggcctgatcaacctccggctttgcttccccgacatgccgctggccgagcgcaggcggctggtgcgcaagaactgccagcacatgatgcggctggtgctggaatacggcgtctgctggtggagttcggccaagcgcatcgacaacctggtcgacatcaagaacctgcattacgtcaccgaactgcgcgacaagggcgaggacgtgatcctgttctatccgcatttcgtcggcttcgagatgtgcgtatacgcgctgaaccaatacatcccgctggtcagcgtctattcgcaccagaaaaacgacacgctggaccgccagatctacgccggccgccagcgctacgacaacgcctacatcgtgtcgcgccaggaaggcctgcgcccgatcatcaaggcgatgcgcaaggaccacgcgcccttcctgtatctgccggaccaggacttcggcgtgcgcgactcgctgttcgtcgacttctttggcgtcaaggccgccaccatcaccggcatgtcgcgcatcgccaagctggcccgcgccaaagtggtgcccgccatcgcccgccgcgtcggcgaccgcttcgagctggagttctatccgccctgggacaactacccgagcgaagacatcgaagccgatacccgccgcatgaacgccttcctcgaagagcgcgtgcgcgaaatccccgaccagtatttctggctgcacaagcgcttcaagaaccgcccgcaaggcgagccgcgcttctactga

SEQ ID NO: 1118 - DNA, 735 bp, Chromobacterium substugae
atgctcaaattcctattgtcttcccttgccgcgctgctgttggccggcgcggcgcaggccaagccgctgcagcccgcccggcacggcgatttcgcccattacaccttcgcgctgacctggcagcccggcttttgcgccaccggcgacggctgtctgccggagcagcccaagcagccgctgatcggcctgcacggcttgtggccgtcgctgccgcaaagcctcatccagcagggcgtgccggtgcagcagtggtgggccaagggctgcgctttcttcccgcacgcgctggccatcgcgctgccgccgaccgagctgcggcagcgtttgagccaggtgatgccgcagctgaaggatgatttgtacacccacgaatacgtcaagcacgtgcagtgtttcggctacaacggcgtcgacttcttctcgacggcgatggacatgcgccaggcggtggcagacagcggcttcggcgcctatctcttggcgcaggccggccaggtgcggcggcgcgaggagttggaagaggctttcgtcaaggccttcggcaccgatcaggcgcgctcgctgcagctgcagtgcggcaaggacaagcaaggccgcaatgtgctgacccaggcctggttcacgttgaaggcggacaggctggcggacttcccgaaggccgaggcttttgtgaatacgccggacggcgagtacgaggatacctgcaaggagcctttcctgttgcctgcttggtag

SEQ ID NO: 1119 - DNA, 297 bp, Chromobacterium substugae
atgcaaagcagcatcaccattctgctcctgctggccttcgcggccgccaacctgccgttcatcaccacccgtgtggccggcttcgtcaaggtggcgcgcaagcatttcggctggcaggcgctggagctggcggcgctgttcttgctgatgggcggcctggccaggctgctggagtcgcggcagatgccggtgcacgagcagaactggcagttttacgtcaccaccttctcgctgttcctggtggcggcctttccgggcttcgtctaccgctacttctggcgcaagccaggccagtag

SEQ ID NO: 1120 - DNA, 1455 bp, Chromobacterium substugae
atgaattgggctgatctcaacctgatacccgccttgccggagctgttcctgatcggcgcgctgctggtggtgctgatgctggatcttttcatccccgatgaaaagcgctgcatcacctacggcctgacgctgctgaccctagccggcaccgccgtcgcgcaggtctacacctttacgccgtacccggtgaccaccttctccggcatgtacgtcgccgatccgctggcggcgctggtcaagctggcgatgtacggcgccaccgcggtggtgctggtctacagccgccagtacaccgccgaccgcggcctgtacaagggcgaatacttctcgctggcgttgttcgcgctgctgggcatgaacctgatggtgtcggcttcgcacttcctcagcctgtacatgggcctggagctgctgtcgctggcgctgtactcgctgatcgcgctgcaacgcgattcggtggccgccaccgagtcggcgatgaagtacttcgtgctgggcgcgctggcttccggcctgctgctgtacggcatctcgatgatctacggcgccaccggcacgctggagttggccggcgtggccaagtccatcaagttgcacgccgccaacccgatgctgctgctcttcggcctggtgttcatcgtggcgggcctcagcttcaagctgggcgcggtgccgttccacatgtgggtgcctgacgtctaccagggctcgccgacttccgtcacgctgatggtcggcgcggcgcccaagctggccgccttcgtgttcgtgctgcgcatcctggcccaaggcctggacgtgctggtcggcgactggcagggcatgctggtgatcgtggccgtgctgtcgatggccatcggcaacatcaccgccatcgtgcagaccaatatcaagcggatgctggcctactccaccatctcgcacatgggcttcctgctgctgggcgtgctgtccggcacccagcagggctactccgccgcgctgttctacgcggtggtgtatgtggccatgtcgatggtcggcttcggcatcatgctggcgctgtcgcgcaagggcttcgagtgcgagaagatcgacgacctgaagggcctgaacagccgcaacagctggtacgcgctgttgatgctgctggcgatgttctcgatggcgggcatcccgccgctggccggcttctacgccaagttcgtggtgatcaaggccatcctggacatcggcatggtcaagctggcggtgttctcggtattgatgtcggtgatcggcgcgttctactacctgcgcgtggtgaaggccatctacttcgacgatgcggctgacaacagcccgatcgccgtgcgcgccgacatgaagctggtgctgtcgctgaacgcgctggcgctgctggcggtgggcgtgctgccggaatcgctgctggagctgtgcctgcaagcgatgcgccaatcgctgaccgtgatctga

SEQ ID NO: 1121 - DNA, 1500 bp, Chromobacterium substugae
atgttcacaaatctgttaagtctggtgatctggacgccgatactggccggcttggtagtgctggccactggcggcgaccagcgcgcgccgctggcgcgctggctggcggtggcgggcgccctggcgggcttcctgctgtcggtgccgctgttcaccgaattcaacaacctcaacggcggcatgcagtttgtcgaaagcaagccgtggatcgcctcgctgggcatcaactaccgcctgggcgtggacggcatctcgatgctgttcgtggtgctcaacagcttcaccaccttgttggtggtgatcgcgggctgggaagtgatccagaagcgcgtcgcgcagtacatggccgccttcctgatcatgtcgggcctgatcaacggcgccttcgccgcgctggacgcgatcctgttctatgtcttcttcgaaggcatgctgatcccgatgtacctgatcatcggcgtctggggcggtccgcgccgcgtgtacgcgtcgatcaagttcttcctgtacacgctgctgggctcgctgctgatgctggtggcgctgatctacctgtacttcctggccggcaagagcttcgacatccaggctttccatcagatcgccaagatcccgctgaccgcgcagctgctgctgttcggcgcgttcttcctgtcgttcgcggtgaaggtgccgatgtggccggtgcacacctggctgccggacgcccacgtcgaagcgccgaccggcggctcgatggtgctggccgcgatcacgctgaagatcggcgcttacggcttcctgcggttcgcgctgcccatcctgcctgacgcctcgcgcgaactggccccggtcatcgtcggcctgtcgctggtggcggtggtctacatcggcctggtggcgctggtgcagtcggacatgaagaagctggtggcttattcgtccatctcccacatgggcttcgtcaccctgggcctgttcatgttcaccggttcggagatgaaccagtgggcggtggaaggcgcgctggtgcagatggtgtcgcacggcttcgtctccgccgcgatgttcttctgcatcggcgtgatgtacgaccgcgtgcacagccgcaacatcgccgactacggcggcgtcgccaacaagatgccgatcttcgccgccttcatgatgctgttcgcgatggccaactccggcctgccggctacttccggcttcgtcggcgagttcatggtgatcatgggcgccgtgcaggtgaatttctggttcgccttcgccgccgccaccacgctgatcttcggcgccgcctacaccctgtggatgtacaagcgcgtgatcttcggcgatgtggccaacagccacgtggccgaactgtccgacgtcaacaagcgcgagttcctggtgctggccatcctggcgctgatggtgctgggcatgggcctgtatccgcaggccttcgtttccaagatgcacctcgcggtgaatgacctgatcgcgcatgttgcgcagaccaagctgccgtaa

SEQ ID NO: 1122 - DNA, 2052 bp, Chromobacterium substugae
atggatatgaagagcttatacctgctgattgcactcgctccgctggcgggttccatcattgcaggcctgtttggatgggcgatcggacggcgcgcttcgcacgtcgtcacgatagccggcgtggcggtttccgccgcgctgtcgctcaaggtgcttctgggcttcctgaatggaagcgcggaagtgttcaacggaccggtctacacctggctgacggtagggggctacgagttctcggtaggcttcctggtggacgcgctgaccgcgatgatgctggtggtggtcaccagcgtgtcgctgatggtgcatatctacaccatcggctacatgcaggaagacccgggctaccagcgcttcttcagctacatctcgctgttcaccttctcgatgctgatgctggtgatgagcaacaacttcgtccagctgttcttcggctgggaagctgtgggcctggtgtcctacctgctgatcggcttctggttcaagcgcccgaccgcggtgttcgccaacctgaaggccttcctggtcaaccgcgtcggcgacttcggcttcctgctgggcataggcatggtgctggcctacttcggcggctcgctgaactacagcgatgtgttcgccgccgctccggcgctggcgcacaagaccatcgaaatcatcccgggccacgaatggtcgctgctgaccgtcacctgcatcctgctgttcatcggcgcgatgggcaagtcggcgcagttcccgctgcacgtgtggctgcctgactcgatggaaggcccgaccccgatctcggcgctgatccacgcggccaccatggtgaccgccggcatcttcatggtgtcgcggatgagcccgctgttcgagatgtccgacaccgcgctgaacgtggtgatggtggcaggcgcgatcaccgcgctgttcatgggcttcctcggcatcgtccagaacgacatcaagcgcgtggtggcttactccacgctgtcgcagctgggctacatgaccgttgcgctgggcgcgtccgcctactcggtggcgatgttccacgtgatgacccacgccttcttcaaggccctgctgttcctgggcgccggttccgtgatcatgggcatgcaccacgatcaggacatgcgcaatatgggcggcctgcgcaagtacatgcccatcacctggatcacttcgctggtgggttcgctggcgctgatcggcacgccgttcttctccggcttctactccaaggactcgatcatcgaagcggtcgccgcttcgcatctgtccgcagccggtttcgcctatttcgccgtggtggctggcgtgttcatcaccgccttctactcgttccgcatgtatttcctggtcttccacggcaaggaacgctggatgcagaaccatggttcgcaccacgagcatcatggcgacagcgatgaagaagaggtgtcgcatgaccaccatcatggcctgggcccgaacgacaagccgcacgaaagcccgtgggtcgtgaccctgccgctggtgctgctggccatcccgtcggtgctggtaggcttcttcggcatcgacaagttggtttacggcagcttcttcggcaaagcgatcagcgtcaacgaagcgctgcacccgggcatggaagagctgcaccacgagttccacggcgccgtcgccatggcgctgcactcgttcaccaccttgccgctgtggctggccatcgccggcgtcgtggttgcctggtacttctacatgaaggcgccgcacatcccggccgccatcaaggaaaagtgcgcgccgatccacaagctgctggaaaacaagtactacctggacgagatctacttcgccgtgttcgccaaaggctcgcgcgcgctgggcaccttcttctggaagatcggcgacatgctgctgatcgacggcctgctggtgaacggcacggccaagctggttggttgcttctccgccgtgatccgccgcctgcagaccggtttcatctacagctacgccaccgcgatgatcatcggggtgctggcgctgatgacgatatcgttctggcagctgatctggcgttga

SEQ ID NO: 1123 - DNA, 306 bp, Chromobacterium substugae
gtgctgacactgactcactttctggtgctggccgccatcctgttcgccatcagcgtgttggggattttcctgaaccggaaaaacctgatcgtgctgctgatggccatcgagctgatgctgctggcggtgaatttcaacttcatcgcgttctcgcattacctgtcggattcggcaggccagatcttcgtattcttcatcctgacggttgccgccgccgagtccgccattggtctggcgattctggtggtgctgttccgcaacctgcagagcatcaacgttgaagacttgggcagcctcaagggctaa

SEQ ID NO: 1124 - DNA, 642 bp, Chromobacterium substugae
atgaaccttacaacggtaattttctacgttctgtccgccattctgatcttcgccgccctgcgcgtggtgacggccaagaacccggtgcacgccgtgctctacctggtgctggctttcttcaccagcgccggccactggctgctcttggaggcggagttcctggcgatcacgctggtgctggtatacgtcggcgcggtgatggtgctgttcctgttcgtggtgatgatgttggacatcaatatcgagaagctgcgcgaaggcttctggaacaacctgccggtggccgccctggtcggcgccatcatggtgttcgagatggcgctgatcctgatgagcccggcaaccggcctcggccagttcaaggccgccgcgccgctggccgccgactacagcaacgtcaaggtgctgggccatcagctctacaccacctacctgctgccgtttgaaatcgccgccgttgtgctgctgctggccatggtggccgccatcggcctgaccatgcgcgcgcgcaaagacagcaaggcgatcgatccggccatccaggtgaaggtccgccgcgaagaccgcgtgcgcatcgtcaagatggatgccgtaaaacaagtggaagaggccgcggccgattccggtgagcaacaggcctga

SEQ ID NO: 1125 - DNA, 489 bp, Chromobacterium substugae
atgaattcgatccgcaactttttcaagaccttcctgctggtggagctggtcaagggcctgatggtcactggccgctacttcttcgcccgcaagatcacggtgcagttcccggaagagaagaccccgctgtctccgcgcttccgcggcctgcacgcgcagcgccgctacgccaacggcgaagagcgctgcatcgcttgcaagctgtgcgaggcggtgtgcccggcgctggccatcagcatcgaatcggagcagcgcgaagacggcacccgccgcacctcgcgctacgacatcgacctgaccaagtgcatcttctgcggcttctgcgaggaagcctgtccggtggatgcgatcgtggaaacccacatcttcgaataccacggtgaaaaacgtggcgacctctactacacgaagccgatgctgctggcgatcggcgacaagtacgaggccgagatcgctgccaacaaggcagccgacgccaagtatcgctaa

SEQ ID NO: 1126 - DNA, 1050 bp, Chromobacterium substugae
atggagttcttgcaaggtattcttggcaatgaagcggggctcctggtctggaccctgctgaagattgtcgccatcgttctgccgatgttgggctgcgtcgcctacctgacgctggccgagcgcaaggtgatcggctacatgcagatccgtatcggccccaaccgggtcggtccgttcggtctgctgcagcccatcgccgacgcggtcaagctgctgatgaaggaaatcatcctgccgaccaactccagcaagggcttgttcctgctggcgccggtgctggccatcggcccggcgctggcggcctgggcggtgattccgttcaccgagcacctggtggtggccaacgtcaacgcctcgctgctgtacatcctggcgctgacctcgatgggcgtgtacggcgtgatcatcgccggctgggcgggcaactcgaagtactccttcctcggcgcgatgcgttccgccgcccagatcgtgtcctacgagctggcgatgggcttcgccctggtcggcgtgctgatggtgtccggcagcctgaacctggtcgacatcgtcaagcagcagtcgttcggcatgggcggcggctccatcgtgtcgtggaactggattccgctgttcccgctgttcatcgtctacctgatctccggcgtggcggaaaccaaccgcgccccgttcgacgtggcggaaggcgagtcggaaatcgtcgccggtttccacgtggaatactcgggcatggccttcgccatcttcttcctggccgaatacgccaacatgatcctggtcgccgcgctgaccgccatcctgttcctgggtggctggctgtcgccgttcccggcttcgtggggcctgctgggcgccggcggcttccactggctggcgatcaaggtgtcgctggtgctgttctgcttcctgtggttccgcgccactttcccgcgctaccgctatgaccagatcatgcgcctgggctggaaggtgttcatcccggtgaccctggtgtggatcctggtggtgggcgtgtggatgtttaccccgctgtccatctggactcattga

SEQ ID NO: 1127 - DNA, 2352 bp, Chromobacterium substugae
atgcttgaaatcgaaatcgacggtaaaaaactgacggtgccgcaaggcagcaccgtcatcgaggcggcccactcggtgggcacctacattccgcacttctgctaccacaagaagctgtccatcgcggccaactgccggatgtgcctggtggaagtggaaaaggcgccgaagccgctgccggcctgcgccacgccggtgaccgacggcatgaaggtccataccgcgtcgccgctggccaagaaggcgcagcagggcgtgatggaattcctgctgatcaaccacccgctggattgcccgatctgcgaccaaggcggcgaatgccagctgcaggatctggcggtcggctacggcaactccacctcgcgctacgaggaagagaagcgcgtggtggtgggcaaggatatgggtccgctggtttccgccgaggaaatgtcgcgctgcatccactgcacgcgctgcgtccgcttcacggaagaagtgggcggcttccaggaaatcggcatggccaaccgcagcgaattctcggaaatcctgcccttcctgggcaagaccgtggattcggaaatctccggcaacgtcatcgacctgtgcccggtgggcgcgctgacctccaagccgttccgctacagcacccgcgcctgggagctgtcgcgccgcaagtcggtcagcccgcacgacggcctgggctccaacctggtggtccaggtgaagagcaacgaagtgatgcgcgtgctgccgctggagaacgacgccatcaacgaatgctggatcgccgaccgcgaccgcttctcgtatgaaggcctgaacagcgccgagcgcctgcaaaagccgatgatcaagttcgacggcaagtggcacgagaccgactgggaaaccgcgctggaatacgtggtgaagggcctgaacggcgtgtccgccgatcacggcaaggacgccatcggcttcctgaccagccctcactccaccaccgaggagctgttcctggcccagaagctggcgcgcgccttcggcgtcaacagcatcgactaccgcctgcgccgcagcgacttctcggccgacagcgccaagcagggcgccgaatggctgggctccaccatcgccgaactggctgccgccaagtcggtgctggtggtcggctccacgctgcgcaaggaacaaccgctgctggcttcccgtctgcgccaatcggtgaagaagggcggcgagctgaacattatccatgtcgccgacgacaacctgctgacccagatcaagggcaagctgatcgtctcgccgctggcgctggtgaacgcgctgtcgcaggtgctgaaggccgtggccgagatcaagtcgggttcgaccggcatcgatctggccgcagttgaagcatcggccgaagcgcgccgcatcgccgaaagcctgaccggcgcggaaaccgcgtccgtcgtgctgggcaacgtcgcccagcatcatccggcttacggccagctgctgtcgctggcgcaggaaatctcccgcctgtcgggcgcgcgtttcggcattctggccgaagccgccaacagcgtgggcgccgaactggtcggcgcgctgccgacccgcggcgcgctcggctccgccgtcaacgccggcgacaacgccgccgcgatgatcgccaagccgcgcaaagcctatgtgctgctgaacaccgaagtggaattcgacagctacgacagccaggccgccgtggccgcgatgaagcaggccgccaccgtgatcgcgctgaccgcctataagggccagggcctgctggattacgccgacgtgctgctgccgatcgcgccgttctccgagaccgccggctccttcgtcaacatggaaggcaagctgcagaccttcaatggcgtggtgcgtccgctgggcgaaacccgcccggcctggaaggtgctgcgcgtgctgggcaatatgctgagcctgccgggcttcgactacaacagcgccgaagaagtgcgcgccgagttcgccgccggcaacctggcggccgcgctgaacaacgcgctgtcggcagtggccgcgcaaccggccgccgcggccggcatcgtccgcgtcggcgaagtgccgatgtaccaggccgacgccatctgccgccgcgcgccgtcgctgcaagccaccaacgaggccaaggccccggtggcacgcgcgcacggcagcctgctgcagaagctgggcatcgccgccggcagcaccgtggtgctgaagcagggcgcgggcgaggcgcgcgtcgcgctggaagccgacgacagcctgccggccgacgtggtacgggtggccaccgcgcacgcagcgacgctgcagctcggcggcatgttcgacgcaatcgagatcaagcaggggtaa

SEQ ID NO: 1128 - DNA, 1296 bp, Chromobacterium substugae
atggcagtcttcgtcaatggcgtaattttcgacggcgtcgataccagccagcccgactgctggcgtctggacgcctatgtggcccgcggcggctaccaggcgctgcgcagcatcctcgagcgcaagatggcgcaagaggacgtgatcgccgaagtgaagaactccggcctgcgcggccgcggcggcgctggctttcccaccggcctgaagtggagcttcatgccgcgctcgttcccgggcgacaagtacgtcgtctgcaacaccgacgagggcgagccgggcaccttcaaggaccgcgacatcatccgctacaatccgcattcgctgattgaaggcatgatcatcgccggttacgcgatgggcaccaaggccggctacaactacatccacggcgaaatcttcgaagactacgtgttgttcgaagaagcgctggaagaggcgcgcaaggcgggcttcctcggcgagaacatcctgggttccggcttcagcttcgacctgttcgcccaccacggctacggcgcctacatctgcggcgaagaaaccgcgctgctggagtcgctggaaggcaagaagggccagccgcgcttcaagccgccgttcccggccagcttcggcctgtacggcaagccgaccacgatcaacaacaccgagtcgttcgcctcggtgccgttcatcatccgcgacggcgcgcagaagttcctggaagccggcaagccgaacaacggcggcaccaagctgttctcggtgtccggccacgtcaaccgtccgggcaactacgaagtgccgctgggcacgccgttcagcgcgctgctggaaatggccggcggcatgaaggacggcaagaagctgaaggcggtgatcccgggcggctcgtccgctccggtgctgcccgccgacgtgatgatgcaatgcacgatggattacgacagcatcgccaaggccggctccatgctcggctccggcgccgtcatcgtaatgaatgaagacgtgtgcatgatcaaggcgctggagcgcctggcctacttctatcacgaggaatcctgcggccagtgcacgccgtgccgagaaggcaccggctggctgtacaaggtcatccaccgcatcgccaacggccagggccgcaagggcgatctggagcttctggattccgtgggcaacaacatggccggccgcaccatctgcgcgctggccgacgccgcggtgttcccggttcgcagtttcaccaagcatttccgcgaggagttcgagtacgcgatcgaacacggaaagaccttggtggaccacaaatggtgttga

SEQ ID NO: 1129 - DNA, 501 bp, Chromobacterium substugae
atgctgtccgcacaatcgttagcattgatagaccgcgaggtcgccaaatatcccgcagaccagaagcgctcggccgtgatgggcgcgctgcgcatcgcgctggaggagcgccgcgagagcggcagcacgccggaagagcgctgcctgaacaccgggatcatcgagttcgtcgccaactacctgggtatcgccccggtggccgcctacgaagtcgccacgttctacaacatgtacgacatgaagccggtgggccagtacaagatcaccgtctgcaccaatctgccctgtgccttgcaaggcggcgtcaacgccgcccagtacatttcgcagaagctcggcatcgccatcggcgagaccagcgcagacggcaagtacacgctgctggaaggcgaatgcatgggcgcctgcggcgacgcgccggtcttgctggtcaacaaccacaagatgtgcagcttcatgacggccgaagccatcgataaaaaactggcggagttgaaataa

SEQ ID NO: 1130 - DNA, 1254 bp, Chromobacterium substugae
gtggctgagatccgtaactacaccctcaacttcggcccgcagcacccggccgcgcacggcgtattgcgcctggtgctggagctggacggcgaagtcgtccagcgcgccgacccgcacatcggcctgctgcaccgcggcaccgagaagctggccgagcacaagaccttcatccagtcgctgccgtacatggaccgtctcgactacgtgtcgatgatgtgcaacgagcacgcctactgcctgaccatcgaaaagctgatgggcatcgaggtgccggagcgcgcgcagtacatccgcgtgatgttcgccgagatcacccgcgtgctgaaccacctgctgtggatcggcgcccacgcgctggacatcggcgcgatgaccatgttcctgtacgcgttccgcgaacgcgaggacctgatggactgctacgaggcggtttccggcgcgcggatgcacgcggcttacttccgcccgggcggcgtgtaccgcgacctgcctgacagcatgccgcagtacacggtgtccaagattaagaacgccaaggagctggcgcgcctgaacgaaggccgcaagggctcgatgctggacttcatcagcgatttcaccgaccgtttccccggctacatcgacgaatacgaaaccctgctgaccgacaaccgcatctggaagcagcgtaccgtgggcatcggcgtggtgacgcccgagcgcgcgctgaatctgggtctgaccggcccgatgctgcgtggttccggcatcgcctgggatttgcgcaagatgcagccgtacgacgtgtacgacaagatggacttcgacgtgccggtgggcgtgaagggcgactgctacgaccgctacctggtgcgcgtggaagaaatgcgccagtccaaccgcatcatccagcagtgcgtggcctggctgcgcgccaaccccggcccggtgatcaccgacaaccataaagtggcgccgccttcgcgcgaaggcatgaagtccaatatggaagacctgatccaccacttcaagctgttcaccgaaggcatgcacgtgcccgaaggcgaggcctatgtcggcaccgaacacccgaagggcgagttcggcgtctatctggtatccgacggcgccaacaagccgtaccgcctgaagatccgcgcgccgggctacgcccacctggcggcgctggacgagatggccaagggccacatgatcgccgacgtcgtcgccatcattggtacccaggacatcgtatttggggagatcgaccgctga

SEQ ID NO: 1131 - DNA, 597 bp, Chromobacterium substugae
atggcctccaagaaaatggaagcgctgggttcggtcgttgccgcggcgctgggcgacaagctcgtgcgcagcacgctggccctggatgagctgaccatcgtgtgcaaggccgcggacctgctgtccgtggccgagacgctgcgcgatcacgccgaactcgctttcgagcagtgcatcgacttgtgcggcatggactacagcgcctaccgcgacgagccgtgggacggtccgcgcttcgccgtggtctatcacctgctgtcggtcaagctgaaccaccgcatccgcctgcgcgtcttcgccgaagacgactccttcccggtcgtcgcgtcggtcaacggcatctggaacgccgtcaactggttcgagcgcgaagcgttcgacctgtacggcatcgtgttcgaaggccaccccgacctgcgccgcctgctgaccgactacggtttcgtcggccacccgttccgcaaggacttcccgctgtccggccatgtggaaatgcgctacgacccgactcagcagcgcgtgatctatcagcctgtcaccatcgaaccgcgcgaaatcacgccgcgcatcatccgcgaggagaactacggtggctga

SEQ ID NO: 1132 - DNA, 477 bp, Chromobacterium substugae
atgggagtagaagggattctggagaaaggcttcgtcaccacgacggccgacaaacttatcaactatacccgcacgggttccttgtggccgatgactttcggcctcgcctgttgcgcggtggaaatgatgcacgccggcgcggcgcgctacgaccttgaccgcttcggcatcgtgttccgccccagcccccgccagtccgacctgatgatcgtcgccggcacgctgtgcaacaagatggcgccggcgctgcgcaaggtctacgaccagatggccgagccgcgttgggtgatttcgatgggctcctgtgccaacggcggcgggtattaccattattcctattctgtagttcgcggctgcgaccgcatcgtgccggtcgatgtctatgtgccgggctgtcctccgacggccgaggcgctgctgtacggcatcatccagctgcagaacaagatcaaacgtaccaataccatcgcccgctaa

SEQ ID NO: 1133 - DNA, 357 bp, Chromobacterium substugae
atgctgcaaaactactttcccattctgatgtttgtcattgtcggacttctggtcggcgtgggccctatcgcattgggcaaattgctggcgccgaatcgtcccgactctgagaaactttctccatacgaatgcggcttcgaggccttcgaagatgcccgcatgaagtttgacgtccgctattacctgatcgccattctcttcatcctgttcgacctggaaatcgccttcctgtttccgtgggccgtggtgttgaaggatctgggcgtctatggtttgggcgtgatggtcgaatttctcgccgtgctgacgctcggcttcgtctacatgtggaagaagggagctctggaatgggagtag

SEQ ID NO: 1134 - DNA, 82 bp, Chromobacterium substugae
gccgacatggtgaaattggtagacacgctatcttgagggggtagtggcgaaagctgtgtgagttcgagtctcactgtcggca

SEQ ID NO: 1135 - DNA, 159 bp, Chromobacterium substugae
gtgttcttctcgacttccatggcgctggcttatctttccgggggtggaaaagataatctgggcgtgatgggtggcaagattgaacaggttgcgccgcaaatcccggcaggcgcgcctaataacaaagcttcgggcccagcttccaagatcccggagtaa

SEQ ID NO: 1136 - DNA, 750 bp, Chromobacterium substugae
atgtccggcaagttggtgattggcaactggaagatgaatacccgcggcgacagcgcgggccggctggcggcggagctgctggcggatcaggacaccaatcgcgaaggcgtcggcatcgccgcgccggcggtttacctggccgcgctggccgcgcagctgcgcggaagccacatcgccttgtcggcgcaggatgtcagccgctacgacgcggacggcgccttcaccggcgaggtgagcgccgcgatgctggccgacgtcggctgccgctatgcgctggtgggccattccgagcgccgccagtatttcgccgaggacaacgcctcgctgttgaagaagatgcgccacgcgatcgccgccggcctagtgcctgtgctgtgcgtgggcgaaaccctggaacagcgcgaggcggggcagtatctggaagtggtgcgcgggcaacttgcgcttctggctgagatcggccatggtgatgaatacgtcgtggcttatgagccggtatgggcgatcggcaccggcaaggtggcaaccctggagcagatcgccgagatccatgcattcatcaaaaattggtgcttgcaaaacgcgggaggctcggctaagattcgcgtcctctacggcggcagtgtcaaagcagagaacgccgagtccatcctggcgacggaaaacgtcgacggagcattggtcggaggggcctctctggacgcccgttcattcagagtgatttgccaagccgcaggaaaaatgatatag

SEQ ID NO: 1137 - DNA, 996 bp, Chromobacterium substugae
atgatcgcgggttcggtctatgcggccgacatcaccggcgccggcgcgaccttcccctacccgctgtacgccaagtgggccgccacctacaagggcaacaccggcaacaacatgaactaccagtccatcggttccggcggcggcatcaagcagatccagtccaagactgtagacttcggcgcgtccgacatgccgctgaaacccgaagagctggagaaatccggcctgacccaattcccgaccgtaatgggcggcgtggtgccggtgtacaacatcccgggcatcgccgccggccagatcaagttcaccggcccgctgctggccgacatctacatgggcaaggtgtccaagtggaacgacgccgccatcgccaagctgaacccgggcgtcaagctgcctgaccagcgcatctcggtggtgcgccgctccgacggctccggcaccactttcattttcaccaactacctgtccaaggtttcgccggaatgggcgaaggatgtcggctccaacaccgccgtcagctggaagggcagctcggtcggcggcaagggcaacgaaggcgtcgccaactacgtgtcgcgcatcaagggcgccatcggctacgtcgaatacgcgtacgccaagcagaacaagctggcctacggcctgctgcaaaaccaggccggcgccttcgtgaagccggacgaggcatcgttcaaggccgccgccgccaacgccgactggaaaaaggccccaggcttctacctgctgttgaccaaccagccgggcaaggccagctggccgatcgccggcgccaccttcatcctgatgcacaagaagcaggataagccggctcaagccgccgaagtgctgaaatacttcgactgggcctacaagaacggcgacaagaccgcgcaggagctggactacatcccgatgccggacaacgtcaagaccgtcatccgcaccagctggaagcagatcaccgacgccagcggcaagactgtctggaactga

SEQ ID NO: 1138 - DNA, 963 bp, Chromobacterium substugae
atgcaaaaactgagcaatgagcagcagatgaattaccagatgctgctggacaagctgttccgcatcaccacccgctgcttcgccttcctggtgctagcgctgctggtgggcatcctcatttcgctgctgatcggcgcgatgcctgccatcaaaggcttcggcctgggctttttgaccagcaccgactgggatccggtccagcagaaattcggcgcggtggtgcccatcttcggcacgctggccacctccatcatcgcgctgctgattggcgtaccggtcagcttcggcatcgcgctgttcctgaccgagctatgccccacctggctgaagcggccgctgggcatcgccatcgaactgttggccggcatcccgtccatcatctacggcatgtggggcctgttcgtattcgcgcccttcttcgccgaccatatccagccgtgggtgatagaccacctcggccccttcccgctggtgggtttcctgttccagggcgcgccgatgggcatcggcctgttcaccgccggactgatcctggccatcatggtgattccgttcatcgcctcggtgatgcgcgacgtgttcgaagtagtgccgaccatgctgaaagaatccgcctacggcttgggctccaccacctgggaagtggtgcgctacgtggtgctgccctataccaagaccggcgtggtcggcggcatcatgctgggcctgggccgcgcgctgggggagaccatggcggtcaccttcgtgatcggcaactccacccgcttcgccgccagcctgttcgagccgggcaactccatcgcctcgtcgctggccaacgaattcgccgaagccaacggcgacctgtacatgggctcgctgatcgagctgggcctgatcctgttcttcatcaccttcgtggtgctcgcctgctccaagctgctgctgctgcgcctgaagaagcaggaaggccagccttcctga

SEQ ID NO: 1139 - DNA, 894 bp, Chromobacterium substugae
atgtgcgaagcccttccgcgcgccagcgcgcccgtcagcctgaagcaggacagcctcacctaccgccgccgccggctggtcaaccgggtgaccatggcctgctcgatgttcaccatggccttcggcctgttctggctgttctggatcctggccaccctgctgcaatacggcctgtccggcatcgaatggcgggtgttcgtcgaaagcacgccgccgccgggcagcgccggcggcctggccaacgccatctacggcagcctggtgatgaccggcttcggcaccctgttcggcacaccgatcggcatcctggccggcatttacctggccgagtacggccagcgcggctggctggcgccggccacccgcttcatcaacgacatcctgctgtcggcgccgtccatcgtcatcggcctgttcgtctacgaggtgtacgtggtgtcggtcggccacttctccggctgggccggctccttcgcgctggccatcctggtgatcccggtggtggtgcgcaccaccgagaacatgctgcgcctggtgcccaacagcctgcgcgaagcggccatcgccctgggcgcgccgcaatggaaggtgatcctcaccgtcacgctgcgctcggccaaggccggcgtgctcaccggcattctgctggcggtggcgcgcatttccggcgagaccgcgccgctgctgttcaccgcgctgaacaaccagttcttcaacagcaatatgaaccagccgatggccaacctgcccatcgtgatcttccagttcgccatgagcccctacgaggactggcacaaactggcctgggcgggttcgctgctgatcaccttcagcgtgctgaccctgaacatcgtcgcccgctggatgggcggcagcaaaaatcaatcgaattaa

SEQ ID NO: 1140 - DNA, 765 bp, Chromobacterium substugae
atggcaagcccctccaccaagctcgaggtccgcaacctcaacttcttctacggcaacttccacgcgctgaaaaacatccagctggaaatcgcgccgcacaaggtcaccgccttcatcggcccgtccggctgcggcaagtccacgctgctgcgcaccttcaaccgcatgtacgagctttaccccggcctgcgcgccgatggcgacatcctgctggatggccagaacatcctggcgcgcgacatcgacgtcaacctgctgcgcgccaaggtgggcatggtgttccagaagcccaccccgttcccgatgtcgatctacgacaacatcaccttcggcgtgaagctgtacgaaaagctgtccaaaggcgagatggaagaccgggtggaatgggcgctgcgcaaggccgcgctgtgggatgaggtgaaggacaagctcaagcagtccggccactcgctgtccggcggccagcagcaacggctgtgcatcgcccgcgcggtggcatcgaagccggaagtgctgctgctggacgagccgacgtcggcgctggacccgatctccaccgcccatatcgaagagctgatccatgaattgaaagaggactacaccatcgccatcgtcacgcacaatatgcagcaggcggcgcgggtgtccgacttcaccgcctacatgtacctgggcgaactggtggagttcggcaagaccgacaccatcttcaccacgccgcagcagaaggcgaccgaagactacatcaccggcaagttcggctga

SEQ ID NO: 1141 - DNA, 153 bp, Chromobacterium substugae
atgggtgtcgagcccggagaacaggtccagcatggcgagtctgcgataatcgtaaaggcgggattgttgtgttccaggccagtggcgtcaagtgtttataaaaaaaaaataaaccgtgtggttttgcctgtgaaaacggcaaaatcaacttga

SEQ ID NO: 1142 - DNA, 1455 bp, Chromobacterium substugae
atgctggacctgttctccgggctcgacacccatgtagccatcactttgatgctttcgctgggcttcgtgctcgcatttgagttcatcaacggtttccacgataccgccaacgctgtcgccaccgtcatctacacccagtcgatgaagccgcgccttgccgtgttctattccggcatctgcaacttcctcggcgtgatgagcggcggcctggccgtcgcctacgccatcgtccacctgctgccggtggatctgctgatttcggtgaacaccacccgcggcatgtcgatggtgttcgcgctgttggcggccgccatcctgtggaacctgggcacctggtatctgggcctgccggcctccagcagccacacgctgatcggcgccatcctgggcgtcggcgtggccaacagcctgatcaaccacacctcgctgtcgcacggcatcaactggggcaaggcggtggacgtcggcgcctcgctgctggtttcgccgctggtgggcgccttggtcgccggcttgatcgtcatcctgctgcggcgcttccgcccgcacagcaacgtgcacaaaaccccgtaccagcgccagcaggtggaaggccgcaagcatccgccgttctggacccgcttcatgctgatcgtgtcggcgatgggcgtcagcttcgcccacggctccaacgacggccagaaaggcgtcggcctggtgatgctggtgctgatcggcatcgtgcccgccaagttcgtgctgaacctggacagcaccccgtaccagctggagcgcacccgcgacgcggcgcagcatctgcagcagttctaccagcgccacgaggcggacctgtccaagatcatcgtcaaatccaccagcaccagccagtacgaatgccacccgcagcaaaccgtggccaccgcgcagaacctgctgaccctgatgggcgacggttccgactaccacaagctgagcgcttcgcaacgctgggacgtgcgcacccagctgctgtgcctggatgacgccgccaagaaggctgccaccctgcccaagctgagctcggacgacaagcagctgctggacaatctgcgcaaggacctgaccaccaccaccgaatacgcgcccacctgggtgatcgtcgccgtggcgctggcgctgggcatcggcaccatgatcggctggaagcgcgtggtgaagaccgtcggcgaaggcataggcaagaaggacatgacctacgcccagggcgtggcggcgcaagccaccgccgcggtgtccatcggcctggccagctggttcggcttcccggtgtccaccacccacgtgctgtccagcggcgtggccggcaccatgatcgccgacaaggccggcctgcagatgggcaccatccgctcgatcgcgctggcctggctgttcacgctgccggcgtcgatggcgctggccggcggcctgtactacctggcggcgcagtggttctga

SEQ ID NO: 1143 - DNA, 2049 bp, Chromobacterium substugae
atgactccgccgatcgatctcgccaaccagccgcccgcggtgccggctgcgttggccaaaaagctggagaagctgggcatacgccgccgcttcgacctggtgctgcatctgccgctgcgctatgaggatgaaacccatctgtacccgatcgccgacgcgccttatggccagccggtgctggtggagggcaccgtggtgtcgcatgaggtcagcttccggccgcgcaagcagctcagggtgcagatcgaggacggcagcggcgcgctgctgctgcgcttcatccatttctatcccagccagatcaagcagttcgccgaaggcagccgggtgcgggcgctgggcgagatccgccgcggcttcgccggcgacgagatggtgcatccgaagacgcgggaggtgcgcgaaggcgcgccgctggcggaaagcctcaccccggtctacccgacggtcaacggcctgacccagcctatgctgcgcaagctggtgcacggcgagctgcgcctgcagacgctggacgagctgctgccgctgccgctactggagccgctggcgctgcagccgttcgccgaggcgatccgcctgctgcatcagccgccgccggagtggtcggcgcagcaactggccgatccgcggctgccggcctggcagcggctgaaattcgacgaattgctggcgcagcagctgtcgatgcggctggcctaccgcgcgcgccggctcggcagcgcgccgcgcatcgtcggcgacggcagcctgagcgagcgcctgctgcgcaatctgccgttcccgcttaccggcgcgcagcgccgggtgctggcggacatccgcgccgacctggcgctgccgcacccgatgcaccggctgttgcagggcgatgtcggcagcggcaagaccatcgtcgcggcgctggcggggctgtcggcgatcgaggccggctatcaggtggcgctgatggcgccgaccgaaatcctggccgagcagcactacctgaaattgtccagctggctggcgcccttgggcataggcgtggcctggctgtccggcagcctgaggaaaaaagcgaagcagcaggcgctggacgagatcgcttcaggccagtgccggctggcggtgggcacccacgcgctattccaggatgacgtggcgttccagaagctgggcctcgccatcgtcgacgagcagcaccgtttcggcgtcggccagcggctggcgctgcaggacaagggcgaggagccgcaccaactgatgatgtcggccacgccgattccgcgcacgctggcgatgagcttttacgccgatctcgacgtgtcagtgatagacgaattgccgccgggacgcacgcccatcgtcaccaagctgatcggcaatccgcgccggcccgaggtggtggggctggtggagcgcacctgcgccgaagggcggcaggcgtattgggtatgcccgttgatcgaggaatcggaggcgctgcagctgcagacggcggtggacagccaccagcaattgcagcaggacttgccggggcggcgcatcggcttggtgcacggccggatgaaggcggcggagaaagcggcggtgatggcggccttcgcggcggcggagctggacgtgctggtggccaccacggtgatcgaggtgggcgtcgatgtgcccaacgccagcctgatggtgatagagcacgcggaaagaatgggcctggcccagctgcaccagctgcgcggccgggtagggcggggcagcgccaggagcgtgtgcgtgctgctgttcgacagccccttgtccgacctggccaaggccaggctgaaggtgatctacgaaaacgtcgatggtttcgagatcgcgcgccaggatctgcagatccgcggtcccggcgagtttctcggcgcgcgccagagcggcctgccgatgctgcgcttcgccgacctggagcaggaccaggcgctgctggaggcggcgcgcgatctggcgccgcaattgctggagcgctggccgcgcgaggcggaggcgcatctggagcgctggctggctggccgcgagcaatttctcaaggcatga

SEQ ID NO: 1144 - DNA, 432 bp, Chromobacterium substugae
atgattcgaatcgccaaagccgcttgcctggctaccgcgctgggcctggccagccaattggctctggctggcagcgccgccggcctgtggaagaccatagacgacgagacccaccaggccaaggcgctggtgcagatcaacgaaagccccaacggcgagctgaccggcaaggtgatcaagctctacctgcacccggaggcggtgtgcgacaagtgcgacggcgccaacaagggcaagccggtcaacggcatgcagatcctgtggggtctgaaaaagagcggcgacgaatggagcgacggccagatcctggacccgaagtccggcaagatctacacctccggcgccaagctgatggaagacggcaagaagctgcgcgtgcgcggctacatcggtccgttcttccgttcccaggtgtgggagcgccagcaataa

SEQ ID NO: 1145 - DNA, 840 bp, Chromobacterium substugae
atggcgacttatcgtttcgagcttgtcaatgtgttcgccgagcagcgcttcggcggcaatccgctggcggtgtttcccgaagcggccggcctgtccgaccaggacatgcagctgatcgcgcgccagttcaacctgtcggaaaccgtgtttctgtttcccggcgacgccgaagctgccgccagcctgcgcatcttcacgcccagctacgagctgcccttcgccggccacccgacgctgggcagcgccgcggcgctgcacgcccgcggcgggctgggcgacagcttcgcgctgcgcacccgttccggactgatccccatccggcatcaggacggcctgttccgcttgagcgcgctgcccgccagcgtgcgggcggccggcttcggcagcgacacggcggccgccatgctgggtttggcgccggaggatatcgcccagccgccgcaatggctgaacgccggcagcgagcagctgctgatcggcctctccagccgcgaggcggtgctgcgcgcgcggccggagccggagctgttccgccgccacgccaccttgcacccgggccgcagcatcgcctacctgtggcaccagcagggcggcgtcgccaccgtgcgcttgttcttcgaccagcaaggctcggtgatagaagacccgggcaccggcagcgcctgcgccaacttgggcggctggtgcgcgctgaacggcctcgcgccgctgtcctggcggctggagcagggcgaggcgatagggcggcccaatgtgctgtacctggatgtcgacgccgcagggcgggtcgaggtgggcggccgggcgcaggcggtcggcagcggcgaattcacgctgtga

SEQ ID NO: 1146 - DNA, 471 bp, Chromobacterium substugae
atgaaagcagtcttactggtttgcctgggatggacggcggtgtgctgccaggcgcaggtattcaagtgccgcgatgcggacggcggcatcagctacagccagcagccatgtccggcgggcagccgcagcttggcgatggatggcagcgcgccgctcagcgtgatcgacggcggcgacagccagcgcgcggcgcggcagcaataccgccagtcgctgcgggattggtcaggccggcgcgacaaggcgcgccaggcggaagagctggccgcgcagcgcgagaggctggccggacgcaagaaatggctggcggagcgccagcattgccagcgcttggcgggcaagcaggcgtcgttgcggcaaggcctgcgccaggggcagacggctagcgaactggagcgcttgaagttccgccttgccaaggtggaagatcagatgcaggatcgcgcatgtcatttatataaggacgattga

SEQ ID NO: 1147 - DNA, 381 bp, Chromobacterium substugae
atggctaaagaaatcatccacaccgacaaagccccggccgccatcggcgcttactcgcaagccgtcaaggctggcaataccgtctacctgtccggccagatcccgctggacccggccagcatgaccgtggtggaaggcggcttcgccgcggaaacccaccaggtattcaagaatatgaaagccgtgtgcgaagccgccggcggcagcctggaccagatcgtcaaactcaacgcctacctgaccgacctgtccaacttcggcaccttcaacgaaatcatggcgcaatacttcagccagccttacccggcgcgcgccgccgtcggcgtggccagcctgcccaagggcgtgctggtggaagccgaagcggtgatggtgctgtaa

SEQ ID NO: 1148 - DNA, 1191 bp, Chromobacterium substugae
atgagcgtgatcgatctgtcggcgctgacgggcggcctgcgcgagctgccgcccctggcgctgtacgtccacttcccgtggtgcatccgcaagtgtccgtattgcgacttcaattcccacgagccgaagaacggcttcgacgagatggcctatgtcgacgcgctgttgcgcgatctggaattcagcctgcccgaagtatggggccggccgctgaccagcatcttcatgggcggcggcacgcccagcctgttcagcccgcaggcgatggatgccttcctggccggggtgcgcgcgcggatgaagctgcatccggacgccgaaatcacgatggaggccaatcccggcactttcgagatcgagcgcttccgcggctaccgcgaggccggcatcaaccgcttgtccatcggcatccagagctttaatcccaagcatttgcaggcgctgggccgcatccacgacggcgacgaagccaagcgcgcggtcgagatcgcgctgacctacttcgacaacgtcaacctggacctgatgtacgcgctgccgggccagaccctggaccaggcgctgtccgacctgaacaccgcgctgtcctacggcatcactcacctatcggcctaccatctgacgatagaaccgaatacgatgttcgcggcgcaaacgccgaagaacttgccggacgacgaggtgtcggccgatatgcaggaagcgatagaatcctgtctggcagccgccggtttcgatcactacgaaacctcggccttcgccaagcccggccgccacagccgccacaatctcaactactggcagttcggcgactacgtcggcatcggcgccggcgcccacggcaagatcagcagccacgccggcatcgtccgccagatgcggcacaagcagccggcggcctatctgaaggcggtggcggatggcgcgccgttgcagagcagtcaaaaggttgcccgcgccgacctgccgttcgaattcatgatgaacctgctgcgcctgaccggcggcttcgagagccgcctgttccaggagcgcaccgggctgccgctggcgtcgatccgccgccagctggacgaagcccaggcgcaaggcctgctggacgatgacggcgcgatcctgcgcccaacgctgaaaggccagcgcttcctcaacgatttgctcaccctgttcctcaaagaaggagatgaataa

SEQ ID NO: 1149 - DNA, 594 bp, Chromobacterium substugae
atgttcgatcaattggttctcgccagcaataacgccggcaagctgaaggagttcggcgcgctgttcgccgaactgggcgtcaccgtgcgcccgcagcgcgacttcgatgtgccggagtgcccggagccgcatcacaccttcctggagaacgcgctggagaaggcgcgccacgccagccggctgaccggcctgccggcgctggccgacgattccggcatctgcgtcgaggcgctgggcggcgcgccgggcgtgtcctcggcccgtttcgccggcgagcccaagtccgacgcgcgcaacaacgcgctgttggtggaaaagctgcagggcgaggccaaccgccgcgcctggtactactgcgtgctggtgttggtgcgccatgccgatgacccgcaaccgctggtggccgacggcatctggctgggcgaagtgcgtgacgaggcggccggcgaaggcggcttcggctacgacccttacttcttcctgcccagccacggcgtgtcggtggccgagctggacgccgccgaaaagaaccgcgtcagccaccgcggccaggcgctggccgcactgatggccaagctgaaggcgctggcatga

SEQ ID NO: 1150 - DNA, 1074 bp, Chromobacterium substugae
gtgaaaaagttgcaaaagttgatgctggccctgagcatgtccaccagcctggcttacgccgggcctagcgacgtgctgcacatctacaactggagcggctcgctgtccgacaacatcgtcagacagttcgagaagcgctgcggctgcaaggtggtgcaggactactacggcgacaacgaggaaatgctggccaagctggccgccggcgccaaaggctacgacatggtgtttccctccagtttcgtcgtgcaggcgatgaccaagcagaagctgctgcaacccttggaccaccgccagattccgaatctgaaaaacgtggcgccggcctatctgtcgcaaagctacgatccggacaacagctacaccatccccaccgtgctgtcgctgacgtcggtgggatacaacgtggagaagctgaagcagttgggcgtggacccaactagctggtcggtgatcttcgatcccaaggtgctgcggaagatcaagggcaaggtgacggtgctggacagctcgcgcgaggtgttcgccgccgccttgttctacctgggcaaagatccgaataccgcgactgacgccgacatgcgcgccgcgcgcgacgtgatcaagcaggccaagccgtactgggccgccttctccaacgccagctatctgaagcagctggcggtcggcaatatctgggtggcgctgggctattccaccgaattcttccaggccagcgaggacgcgcgccagaccaagcggcccttccatatcggcaatgcgccgcagcgcgaaggcaacgagatcggcgtggacaccatggcgatcaccgccagcgccaagcggccggatttggcgcaccagttcatcaatttcatgctggacggccagaacgcggcgcagttgaccaacctcaatggcgcgaccaacccggtggccaccgccagcggctacttccgcgccgatctgaaggccagcccagtgatcaatccgacggccgaacaggcgaagagatggacggtcttgcgcgaactgacaccgaaagaacgtcgttccttggcgcggatgtggacggaagtgaaggtcagccgctaa

SEQ ID NO: 1151 - DNA, 1071 bp, Chromobacterium substugae
atgcgtcgcagcgtgtccggccaggccgcgcgttttgccgctgcgaagaattggttttcccggatgaatcaaacgtttgccacccgccgcgcgttgccgccgcggcgtctgtccgtcgctccgatgctggactggaccgaccgccactaccgttatttcgcccgccagatcacccgccacacctggctgtataccgagatggtgactaccggcgccttgctgaacggcgatgtcgcgcgccatctgcgcttcgacgaggccgagcatccagtcgcgctgcagctgggcggctccgagcctgccgagttggccgcctgcgccaagctggcggagcaatggggctatgacgaggtgaaccttaacgtcggctgcccgtccgagagagtgcagaagggcgctttcggcgcctgtttgatggcggagccgcagctggtgtccgactgcgtcaaggcgatgcgcgatgccgtgggcatcgacgtcaccgtcaagcaccgcatcggcatcgatcagatcgagcattacgattacctgcgcgaattcgtcgacaccgtggccgaggccggctgccgcactttcatcgtccatgcgcgcaacgccatcctgaagggcctgagcccgaaggaaaaccgcgagatcccgccgctgaagtacgactacgtctaccggctgaagcgggagaggccggagctggaaatcctgatcaacggcggcgtcaagaccaatgccgagatcgccgagcatctgcagcacgtcgacggcgtgatggtgggccgcgaggcgtatcacaacccgtggttgatggccgagtgggacgcgcagttctacggcgacgcggccgccggccccgagcgcgcggcggtggtggaggcgatgatgccctatgtggcggcgcgtctgggcgacggcagcaatgtccgccacatcgcccgccacatcctgggcctgttccagggcctgcccggcgcgcgcaactggcggcggatgctgtccgactccaagctcttggacggcgccgatgccggcctgctgcgccaggcctacgaggcgactctggcgggccgccgcgcctga

SEQ ID NO: 1152 - DNA, 612 bp, Chromobacterium substugae
atgacggaaacgatggcgatggaagcgctggcggcgcatccggaatatgtgtcgattgccggcatcgacggtttgagcctggacctgcgttatgccggcagcgacaacttcgtggggcgcgatctctacggcgggacggcctgcgcgctgttgcaccgccgcgccgccggcaagctggccgcagccgcgcgggaactgcggcgccggcttcccggccataggctgcgcattttcgacgccttgcgccccgggcgggtacagcgcgtgctgtgggagatcgtcaaggacacgccgcaacgcatttacgtcgccgatccggcgcgcggctccatccacagcttcggcatggcggtggatctgggcatcgaggacggcgaggggcgcgagctggacatgggcaccggtttcgacgatttcaccgagctggcgcagccgcagcgcgaagccgaaatgcgggcggccggccgcctgagcgaggcgcagctggccaaccgcctgctgctgcgcggctgcatggaggccgccggcttccgcgccatcgccaccgagtggtggcatttcgaagcggacgaccgcgactgggtgcgcgcgcatatgcggctgatcgagtga

SEQ ID NO: 1153 - DNA, 1593 bp, Chromobacterium substugae
atgaccctgccccccctcctcaaaaccctgtgtctggcggcgctgctggccggcgcgctgcccgcggcggcatcggcggccaaaccgctggtcttctgcgccgaggcctcgccggaaggcttcgaccccgcgctgtgggacagcgccaccacctacaacatcaccaagccggtattccagggcctggtcgagttccagcgcggcggcgtggcgctgcgccccggcctcgccgaaagctggaccgtgtcgccggacgggctgaattacaccttcagactgcgccgcggcgtcaagttccaccagaccgcctatttcacccccagccgcgacttcaccgccgacgatgcggtgttcaccatcagccgctggatccgccccgacctgccgttcaaccaggcgttcaaaacgccgttgaccgggccggacggctacggcctgtccaagctgatagagtcggtgcagaaagtcgatgcccgcaccgtgcgaatccggctgaaggagcgcaacgccaccttcctcaccttcttcgcgatgggtttcgccggcatgcagtcggccgaatacgccgagcagctgctgaaagccggcaagccgcaacagatcaaccagctgccgataggcaccggcccctaccgcttcaagagctacgccaaggattccatcatccgctatgaggccaatccgcagtactggggcaaaccgcagaaaacccgcgacctgatcttcgccatcgtcgccgacccgcaggtgcgcatccagaaattgaaggccggcgaatgccaggtggccgccgcggtgcgcgagtccgacctcgacgcgctgtcctccgacaaaaacgtcaagatcgcctccaccggcgccagcaacatctcctacctcgcctacaacctgaagcggccgcaattcgccaagcgcgaggtgcgggtggcgctggacatcgccatcaaccgcgacgcgctgttcaaggcgctgttccccaagggcggcgccacccaggcggtgaatcccttcccgccgtccacctggagctggaacccgcgcacccgcaacgagtacgacccggccaaggcgcgcgcgctgctggcccaggccggctaccccaacggtttcaccgtcaacctgtgggccttgccggtgcagcgccccaccaatcccaacggcaagctgatggcgcagatgatccagcaggactgggccaggataggcgtcaaggccaatatccagtcctatgaatggggcgaatacctgaaacgcgccggcgccggcgaacacgacgtctacatgtccggcctgacgagcaactccggcgacccggacgacttcctgtggaacagcctgtcctgcagcgtcagcaagggcggccagcgcttctgcaacgccgagttcgaccgcctgctgcaacaaggccgccagaccaccgaccagaaaaaacgcgcgcagtactatctgcaggcgcaggacatcttcaaacgcgagcggccgtggatcaccatcgcccattcgcgcatctatatcccgttgcgcgccaatgtgcagggcttcatcatgaatccgaatggctcattcgatttcgaggatgtatggctgaaatga

SEQ ID NO: 1154 - DNA, 984 bp, Chromobacterium substugae
atgaacccggcctggccgcctggcttcgccagccaccgctaccaagcgttgcggtcggggccgcggctgatcgtcaccggcgcggtgcatggcgatgaaacctgcggcgcccaagccatccgccgcgtgatggcggagctggagcaaggcgcgttgtcgcttgccgccggccggctgaccctggtgccggtggccaacccgctggcttaccagctgggccggcgcggcggcgagcgcaatctgaaccgcaacctcgccccggcagcctcgccgcaggactacgaggaccatgtcgccaactggctgtgcccgttgctggccgagcacgacgcgctgctcgacctgcattccttccaatcccccggccaacccttcgtgtttctcgggccgcgcgacaacgccggcgagctggagccctttgtccacgccgccaaggaagaggcgctggcgcgccggctgggcgtgggccgcgccgtggacggctggctggccacctacgcgctgggcgtggcgcgccgccgccaggcgccggccggcgacccgcagttggccgcgctgggggccgacccgcgctatggcgtgggcaccaccgaatacatgcgctcgcaaggcggctgggcgctgacgctggaatgcggccagcacgccgacccggccgcgccgcagatcgcctatcaggccattctcgacaccctggcgcacctgggcatgcgcgacgccgcgccgccgaccccgcgggcgcaagaatggctgagcctgtacgaggtggtggacaagctggacgacggcgaccgcttcgcccgcgcctgggccagcttcgacccggtggagcgggacgaattgataggctggcgcgccgacggcagcccggtgcgcgcccaagcccctggccgcatcgtgtttcccagccccggcgcgccggtcggccaggaatggttctacctggctcgcccctcgtcccggctatcggcgccggccgcctga

SEQ ID NO: 1155 - DNA, 1092 bp, Chromobacterium substugae
atggaacacgaaatcgaacacttgctgcagccgataggcggcggcgctccggccggcgaagacctggcctattccgccactttcgaccagatccgcgaagcgcgccgcagcgacgatccgtcgctgtcgcagggcgactgggagcagacgctgaaaacggcggaatggccgctggcgatccggctgtgcgaagacgcgctgcggaacaagagcaaggatctgcaactggtggcctggtacgccgaggcgcaggtgcaggccaacggcgtggccggcctggcgcgcggcctggcgctggccgccggctggctggaacgctattgggaaaacggttttccggagctggacccgcaggatctggacgaacgggtggccaagctggagtggctgaaccagcagctgggcggcgcgctgcgcaatgtgccgttgatcaagccggagttcggcgcctacagctggaaccagtggcagcagtcgcgcgaggtggaaaacctgggcttgaaggacagctacgcccgcgaggccgccatcgccgaaggcaaactcagcggcgaggtgtttgaaaaggccgccacccagtccggccacggctggtttcaggccaaggccgaggagctggtcagcgcgctgaccgcctacgaggcgctggacgcccaggtggatctgcgcttcggcgccgccgcgcccagcctggccgacatccgcaacgccatctacgcctgccaggacctggtgctgcgctatcgccagcagtttgccgtcaacaagccggccgcggccccgcagccgcagcccgccgcagaggaaagccgaaccgtgagccacgccgcccccagcccggtgtacaccgccgcccccgccagcgcgtttgatggccagatccgcagccgcgacgaagccgtgcgcatgctgggcgaggtggcgcgctatttccgccacaacgagccgcacagcccggtttcgctgctggcggagcgcgccgcgcgctgggccgagatgagcctggaggagtggctgcagcatgtggtgaaggacagcggcacgctcagccagctgcaggagctgctggacgtgcgccaggaccaggactaa

SEQ ID NO: 1156 - DNA, 264 bp, Chromobacterium substugae
atgaaagcggcaatccgtttgggcgaccccaccgaccacggcggcaaggtggtgagcgccgcctcgtccaccacgctgttcggcaagcaggtggcttgcgtcggcgactccgtcagctgcccgcagcagggccacgtcaactgcaccatcgtcgaaggcgacggcggctggctggtgggcggcaaggcggtggcgctggatggccacaaggtcagctgcggcgccaccctgatttccaccctgccgcaagtcagcaagggctag

SEQ ID NO: 1157 - DNA, 1434 bp, Chromobacterium substugae
atgtggagaatgttgggcctgttcggcggcatcaccctgggttggtgggctttgctgtggctggtgctgccggtgagctggcagcgcatcagcccgtccgccatcctgatgctgcacctggcgccgccgatgctgctcagcgtcggcatcaagctgtgggcgcatctgaaggaaacgcgggccaaggccgaagcgctgcggcaggaggaggcggcgcagagcgagcgcgacggcaagcgcgcagcggcgcgcgcccagcatgaggcggcgctgcgggagcgccagcgcgcggtgagttgccgctggctgtgggccgccgcggtgctggccaaggacgagccggcctggctggccgagaccgccgacggcagctactggctggcgctggccaaggacgaggtggagccgggcgaagcgctggacgcgctggagccccatctggccgagctgctggccagcctatacgccgaagcgccgggcgcggcctggctgccgttatacctggaagcgatgccgctggtgcccggcgtggagcagctgaaccgggtcaaggccttgaagcaggccgcggtggccgacgcgctgggggccgattgccatgtcgccggcgattgccgcttcctgccgggcagcgggccgatcgccgaccgggtgctgcaggcattgcagcaagatccggagctgccgggcctgttggtgctggccgccgacgcgccgctggcgcagcgcgacgatgacgaggattggggcgatgtcgacccagccttgcaggcgcaccgccgttggcatggcgagccgggcatggcggcggtggcgatgctgttcctgcgcgatggcctgccgctgccgcaggagatgcggcaggacgagggcgccgacccctaccagccgtattgggagaaggagttttccggaccggcggcgggctggggcgcggtgccggccagccgccaggccagcctggcgcagttgccgctgctggcggtgatggcgcagtccagctcggccgacctgtcgcaggaccgggcgctgcaactggcgcgccagctgcagccggtgctggacaacgcgctggtcaatgccggtttgctggactatccgttcagcccggaagaggccaagccggatggtggccaggccgccaccctggcctggctgtgccacaacagcgggcagatcgacgtcggcggtgtcaggctggcggccatcgccaccgcgttgtcgcggcacgaggtggagctgcacccgatagacgaggccagcaacgtggtgcgcgaatggggcgacgccggcgcggcgacgccgatgctgctggcggccgtggctgccagccactgcgcgcgcctgcaggcgccggccgtccttacccagtttcaacacgacagggtgtcgctggcgctggccaggccgcccctggaggaggttagcgaatga

SEQ ID NO: 1158 - DNA, 2643 bp, Chromobacterium substugae
atgtccgtatcgctgaaatccctgataggccgactgacgccgaccgcgcgccaggccatcgagcaggccgccagccgcgcgctggcccgcacccacttcgagatcgagatcgagcatgcgctgctggcgatgttcgatcaggacgacaacgccgcgctggcggccttgcgcgcgctgggcgccgatctggcccgcgtcgagcgcgagctggacgccgcgctggacaatttccgcagcggcaacacccgcaatccggtgttgtcgtcctggctgcccaagtggctggagaaggcctggttgctggccagcgccgagcatggccaggacaatgtctccacgctggacctgctgctggcgctgtggcaggacgacgccttgcgcggcgcgctgcaatccggcgcgccggcgctggcgcgccaggatgccggcaggctgcagggcgcttacgcggcgctgcgccagcacggcggcgaaacgggcaacggcggcgcgcagcctgaggcggcggatgacgcggatgccggcgagcagccggccgcgccgcaaggcaagcgcggcagcccggcgctggacaagtacaccatcgatctgaccgcgcaggcgcgcgccggcaagatcgaccccatcctgggccgcgacgtcgaaatccgccagatgatagacatcctgatgcgccgccggcagaacaaccccatcctcaccggcgagcccggcgtgggcaagaccgcggtggtggaaggcctggcgcgcaagatcgtgctgggcgaagtgccgccggtgctggccggcgtgacgttgcgcacgctggacctgggcctgctgcaggccggcgccagcgtcaagggcgagttcgagaaccgcctgcgccaggtgatagacgaggtcaaggccagcccggtgccgatcattctgttcatcgacgaggcgcacaccctgatcggcgccggcggcgcggccggccagaacgacgcggccaatctgctgaagccggcgctggcgcgcggcgagctgcgcaccatcgcggcgacgacctgggccgaatacaagaaatacttcgagaaggacgccgcgctggcgcgccgcttccaggtggtgaaggtggaagagccggcgccggagatcgccgtgcagatggtgcgcggcctgaccggcgcgatggccggccaccaccaggtggaaatcctcaacgaggcggtggcagccgccgtgcatctgtccagccgctacatcgccggccgccaactgccggacaaggccatcagcgtgctcgacaccgcctgcgcccgcgtcgcgctgtcgcgcgccggcaagcccggcccgatcgaggacgtgtcggtgctgattgaaaacatcgaccgcgaaaccgcggcgctggagcgcgaagaaggccacgccgagcgcatcgccgagctgcaggcgcggcgcgccgagctggaacaggacctggccgcgctgcaccaggcctgggaggcgcagcagaagctgatcgccgagatcgacgcattgaaggcggcccaggacgaagccaagccggccaagggcaagaagatcagcccgctgcaggccaagcgcaaggaattgcgcgagctgcaaaagcaccagccgctggctttcgaatgcgtggacgagagcgtgatcgccgacgtgatttccggctggaccggcatcccgctgggccgcatggtcagcaacgagctggagcaggtgcagaagctggcccagctgctgggcgagcgcgtcatcggccaggaccacgcgctggagcaaatcgccgagcgggtgcagatcgccaaggccggcctggaggacccgggcaagcccaagggcgtgttcatgctggtgggcccgtccggcgtcggcaagaccgaaaccgcgctggcgctggccgaggcgctgtacggcggcgagcgcaacctgatcaccatcaatatgtccgaataccaggaagcgcacagcgtgtccggcctgaagggctcgccgccgggctatgtcggttacggcgagggcggcgtgctgaccgaggcggtgcgccgcaagccgtattcggtggtgctgctggacgaggtggagaaggcccaccctgacgtgctggagctgttcttccaggtgttcgacaagggcgtgctggaggatagcgaaggccgcgaggtggacttcaagaacaccatcatcctgctgacttccaacgccggcaccgatctggtgatgcgcgcctgcgagcacggcgtgacggtggaggatgtcaaccgcgacccgacggcggaagacctggtggaaatcctgcggccgacgctgcagaaggcgttcaagccggctttcctcggccgcctgaccatcgttccttatttccctatcggcgacgaggtgctgcgcgccatcgtcggcctgaagctggagaagatccgccagcgcatcgccgacaaccacggcgcgcaggtcgagttcccggccgatctggccgagcagatggcgtcgcgctgcctggatgtggacagcggcgcgcgcaacgccgacgccatcctcacccgcacgctgctggcgcagatttccaacgacctgctggcgcggatggcaagcggccgtgcggtgaagaaaatcgccgtctcgctgaagggcgagcaggtgaaagtgcgcttgagctaa

SEQ ID NO: 1159 - DNA, 708 bp, Chromobacterium substugae
atgagcattctgtcgcgcatcctgggccgcaaagcgatgcccatccaactggccgagccgcaggatgcgccgccgcagctgcgcgccgcgctggacgcgctgcaacgcgaggaatggcagcaggcgttgaagctggcgcagccccacctggaggcgaagtccgccagcttgcgcgccgacgcctaccgcttgtgcgcgctggccagcagccggcagatgcagtggagcacggcgctttcctgctggcagaagctgttcgagctggagccgtcagcccgcaatgcgttgcaattggccagttgttcggtgatggccggcgaggtggcgcggggcaaggcctggttgatgaagttcgatgaactgaaccacgccagccgcgaggtgccgtgcgcggcggcttatgtcaatttcatcgcggcgctggctcaagccggccatgcgcgcgaaacgctgccctacctcgcctggctgcgcgagctgtaccgccagctgaggatcaccgacgatcagtttttgcagcagcgcggcgtgccgtttttcccggtcttcctggagaacagctggcccttgctgcggcaatgcttggatgaccaggcgctgctcaactggtacgcgccgatgctggccgacctggacgaaaacggatgcgcggcgctgcgaggctggctgggcgagatgatgccggccgcagccgccaacgacgaatga

SEQ ID NO: 1160 - DNA, 1017 bp, Chromobacterium substugae
atggccagcccgagccggcgaagccctcgtgatctgacgcgcgagctggccgccgacgccagccagttcggcttcttccaggcagtgcgcctgctggggctggccgggcgcaagcgcggcgccaagcgcggccgtttgccggatgcgctgcgtttccgcacgctggcctccttgtcgttcccggccagcgagctgacaacttaccgccaggcggaagcgggcagcggcggccaggacgagatgaccatcagcttcctcggcctgaccgggccgagcggagccttgcccaccgcctataccgagctgctgctggagcgcaagctgcgccaccgcgacagcaccatgcatgctttcttcgatctgttcagccaccgcgccggcgcgctgttcttcgaagcctggtgcaaataccgcagctgggtgaatgtcgaagccggcgagcgcgacggcttcacccgcaatctgctggacctgggcggagtgggcctgggccagctgcgccagcagatggggccgggcgccgagctggacgagcgcatgttcgtctactacgccggcctgctcagccaaaagccgatgtcggcgcaagccttgaccacgttggtggagggcttcttcggcgtgacggccagcctggagcagttcgtcggccaatggctgccggtgccgcgcgccgagcagagccagctgggaatggaaggctgcgagctgggtttttccgcctttgccggcgagcgcatctgggataggcaaaccaaactcaagctgcggctggggccgttgcggcgcgcgcagttcgacgcgctgcagccgcacgccgccggcgcgcaggcgctgcgcgcgctgatgaagttcgcgctcggccacgcgctggcggtggaggtatgcctggtgctggacaagcgcgacgtcgcggcggcggtgctgggcgacgcgtcgctgcgcctgggcggcgatggctggttgggcaagccggcgggccatcccgacgatatgcgttacaccctgttgtcctga

SEQ ID NO: 1161 - DNA, 1860 bp, Chromobacterium substugae
atgctcgaatccttactcccctactacgaacgcgagctcggccacctgcgcgagctgtccggcgaattcgcgcgccgctatccgaagatagccggccggctgcagatggaaggcgaccagtgcgccgacccgcacaccgagcggctgatcgaggcgttcgcgctgctggcttcgcgcgtccacaagaagctggacgatgaatacccggaggtggcggaaagcttcctcgacgtgctctacccgcactatctgcagccgattccgtcggccaccatcgtgcagttcgagtgcgatccggcgcggccggagatcgccaagcgctaccgcgtggagcgcggccagccagtgcatgcgccggccatcggcggcgtggtgtgcaaattccgcagcgcctacccggtggacctgtacccgctgtcgctggaaaacgccaagctggagttgaccagcggctcgccctatttgcgccagctggcgccggacgcggcggcgctgttgacgctggagttccacacccacggcggcctggcggtgagcgacatcggcctggagtcgttgcgtttcttcctggacggcgaaccggcgctgatgcatctgctgtacgaactgctgctgtccaaggtgctgcgcatccgcgtcggcgacggcagcgaggatccggcgcacagcgcgctgctgccggcctcggccatcctcccggtgggcttcggccgcgacgagggcatgctggagtatgacgagcgctcgttcatgggctaccggctgctgaccgaatacttctgctacccggaaaaattcctgttcgtcgatatcggcgaactggccaaggcggcgccgcggctgacaggggagaagctggtgctgcaactggtgctggccgactatccggacagcgagcgccaccaccggctgcaggcgcagttgcaggcccatcatctgaagctgggctgcgcgcccatcgtcaatctgttcaaccacccggccgagcccatccgcgtcagccaccagaaggccggctacgcggtgctggcggattcgcgcaagccgctggcctacgaggcgatccagatccgccgcgtggtgcgggtggagaaatcgggcgagggcgaaagcagcgaggaggtgccgccgttctacgccacccgccacggcagcgaaaagcaggcgccgcgcttctactggcacgccagccgcgagggctcgccgcgcgccggcgacaagggcaccgacctggagctgcacctggtggacctggcgttcaatatggtgcgcccggcggccgaggtgctgagcctggacctgctgtgcagcaaccgcgatttgccggagcagattccgttcggcggcagccagtccacccagcgcaccgatttttcgctgccgggccattcggtggtgaagcgggtgaggctgctgcgcaagccgtccgccagccagcgcagcccgctgggccgcgccgtgcagtggcggctgatctcgcacctgtcgctgaattacatgtccatcgtcgactccggctgcgccgccctgcaggaaatgctggcgctgtacaatctcaccgcttctccggtgaacgtgcggcaaatccagggcatagtaggcattcacagcgaggcggcggtcacccgcgtcagcggccgcgatttcgccggcttcgtgcgcggcagtgaaatccgcctgaaacttgacgccgattattatgtcggcggcagcgtttacctgttcgcgtcgatcctggagcgtttcttcgcgctgtactgcgcgcccaacagcttcacccggctgcgggtggaaaccgtgcaacaaaacgaggaggtggcggtatggccagcccgagccggcgaagccctcgtgatctga

SEQ ID NO: 1162 - DNA, 126 bp, Chromobacterium substugae
ttgcgaatttttgcgccgttatccgaagatagccagccgctgcagatggaaggcgaccagtgcgcagatctgcatgccaagtggctgatcagggcgctggcgctgctggcttcgcatgtccgctag

SEQ ID NO: 1163 - DNA, 1608 bp, Chromobacterium substugae
atggaattcacctatgaggaggtggaaaacggcctgaaggtgaaaaaacccaccagcctgtcagatcgtcaagccgccatgaaggagggcatgaccaaagtcctgaacaagctggcccagccggacttcaaaccgcagctgctgaagatcaagctgtgcgtttacggtttctcgcgcggggcggccgaggcgcgagcctttttgtggcggctgaacgaacagatgccggacgggacgtttttcggcatcccgttggaagtgaaatttctcgggatattcgataccgtggcctcggtgggcttgaccgagctagcaccgggtgccaccggccacttggactggggtggcgacatggcgctgcctgacaaagcctggttgctgtgctgcgcgcacatggtcagcgcccatgagcagcggttgtgctttccgttggactccgtgggcaatagcgcctccggcggctacccaagctgcgtccagggtgaatgggtgtatcccggcatgcatagcgatgtcggcggcggttatccgcccaatgatcagggcaaggcgcgtggagagcagggcctgctgttgtcgcagctgcctttgaatcatatgtacaggctggcgtttgatgcaggcgcgcccttgaagatcaatgccgctgtattgcaggaaggcgccgccgcggacaaggccaaactggcggtgctgcagaagcaggagtcgtggcgctttatgagtcaggaagttatcggcctgtttagtacaaaaccattacttgaggttagattcaatgcttggcgcgaagcctccaaagcttccggctcgctgacggccatcctgcaggagcaaaccgcccagatcaacgcctggcgcatcgagcgctacgcgggcgggctgaaatgccaaggtgggcagggccagcagaacgccgattatttcaaatacgcgcaggcgaaacgggaaacgccatcctgggccattgatcaggaaaacgcggcttggagcaagcaaagcagcacgggtagagccgatgaggtgcatatgacgccgccgacctggaagcttccatccgcgcaggagagacgctttgttgatgtgcctatcccggaggacaaactgagcgatatggacaaggcctatatcggcaagccattcacccccaatttgtccaaagtatatgagccgacgcgggacggcacccagttgcaggcgggggccaaagatttcagcgatgactaccagggaaaaattagcgtgggatttaacccggttggatggttggcgaccatgtttacggccgtctcgcgaatgttcagcaaagattgcaccggcaaggagcgggctttgttgatcgacaagagcgaaaaactctacccggatgtgaaagataatgcggaattgatggcgctatatgatgaacatgtgcatgactcgcgcgcctggttcatgtattcggctctgagcaaattagaaccgaatggttcgtactggcgttatcgcacggttttctttgttcacgacgataacaagaagctgatctgcgaatcggatgaagccaatgaggcgttcaagaaagagttggagcgcagggagcaggtgaaggcttttactcagcgatga

SEQ ID NO: 1164 - DNA, 792 bp, Chromobacterium substugae
atgaagccgcaaatcgtgatgaccgccccaagcccggaagcctggctgtacaggctattgcagacggcacgagagctcgagctgccatggctggacttgatagtcgatcaggccgagatgggatcgcgctggcaaagcctggtaggcaccctgtacccgccgcgcatgctgctgcaggacaccccgcatgccgacgcagccgacgaaggcccggttttggtgcgcctggacgccaatcagccgcaaacgcgcttgctgaaactgctgcggcaatggcagggacagccgcgggtgctggcgctgttcagcgggtgggactacgaccaactggccgaacggctgacgctatgcatgcaggcctcctgggacaagggcttgcagcaaggcgtgctgcgcttccacgacccgcggctgtttgccgctgtggttgacgcattggacgaaccgcgccgccagttgctgctggagccggcgctgcaatggcactggctggaccgtgatggccacgcgcggatgttggacgccaccgcgctgcaggcgctggcgccgctggagtggaagcatgacgcgctgacgctggagccgccacatatcgacgcgctggcttgctggcatttggcggaaatctggcggcaaaaccacctgttggtgccgcagttgtatggcctggattccgaagaggaactggtgcgccggctggcgctggcccaccaggcggcggacaaggccaagctgtggtccgaggcggagcggatgccggaagtggaacgcatgctcagggaacacgcatga

SEQ ID NO: 1165 - DNA, 690 bp, Chromobacterium substugae
atggaaaccggccccgacgaaatcagcgcggacaacgccaaaaccggcaagaaatcccaaggccacctgcaacaccacgccgacgcgctgaaggcctgggaagccggcagcaacaccgacaaagacggcaaaaccgcccaggaccaagccggccaacagccgctgctggtgctgtccggcccggccggcatcgccgccctgaccgagcagagccagacgatatcggccggccagaacctcaacctggtcgcccaacgcgacgccaaccacacgacgggccggcgttggatccacaacgtcggccagcacctcagcctgttcgtggcgggggtgaaggacaaggtggcgctgaagctgatcgcggcgaaggggaaggtgcaagtgcaggcgcagagcgatgcgatggagctgacggcggatcaagacctctccatcacctcggtgaaacagaagatccacctcaacggcaaacaggaaatcttgctgaccagcggcggtgcctatgtgcggatcaaggacggcaagatcgagctgcatgcgccgggcaccgtcagcatcaagggggccagccatgattggagcgggccggaccagatgaatccgccgctgccgcgcttccccaatacggtgtgcaagcaatgcatggctcaggggttcagccaggctaatccgctggtggccgccaaatga

SEQ ID NO: 1166 - DNA, 144 bp, Chromobacterium substugae
  modified_base (106)..(106): a, c, t, g, unknown or other
atggaaaccggccccgacgaaatcagcgcggacaacgccaaaaccggcaagaaatcccaaggccacctgcaacaccacgccgacgcgctgaaggcctgggaagccncaccatcctgcacgacttctgaggaggacgccgcatga

SEQ ID NO: 1167 - DNA, 132 bp, Chromobacterium substugae
gtgatctaccagacctacggcgaggactaccacgtcacgccgcggcctgagccgctgccggcggcggccggccaggccgatgagccgcgctaccccgacgacggggtggagagcgatgggggcgagctgtaa

SEQ ID NO: 1168 - DNA, 609 bp, Chromobacterium substugae
atgaaacccatccttttctacgacaccgaaaccaccggcctgccgaactggagcgcaccatctgacgacccgtcgcagccgcacatcacccagctggccgccgaactggtggacgaggacaccggcgacgtgctggacagcatggacatgctgatccagccggatggctggacgatacccgacgacgtggcggcgctgaccggcattaccaccgagcgggccgcagaattcggcgtgccgctggcgcaggcgatggattcgttcctggccctgtgggcgcaggtggagcggcgcatcgggcataacgagccgttcgacgctcgcatgatccgaatcgagctgatgcggctgtatggtgacgagcgcgccgacgaatggaaagccggcgcggcgttctgcacctgctcgaacagcaccaaactggtcaacctgccgccgaccgagaagatgctggccgccaagcgcaccgggccgaagccgccgaatttggcggaggcctacaagttcttcactggccaggatctgctcggcgcgcacaacgccatggtggacgtggccggctgccgcgaggtgtatttcggcatcctgcggcaccgggaggcagcgtga

SEQ ID NO: 1169 - DNA, 1809 bp, Chromobacterium substugae
atgaaaatctcatccatcaccatcaagaatttccaggggctgcgtaatgcggccctttccttttccagccgcatcgcgctgatcgccggcgacaacggcgccggcaaaagctcgctgcgcgacgccattgccatggcgctgaccggcgtggccacccgcgtggagcgcaagaaggatttcggccagttggtgagcgagggggccaagaacagcggcgtgcgggtcgactttgacgacggccgccatgccgcggtgtcgctgccagacggtaaaaccgccggcatcgcgatcgacaacgacacggcccaggacacgctgccctacgtgctggccccggagatgttcgcggccgcgccgacggattcccgccgcgcgctgctgtacgcgctgaccggttgcaacgccaacgccgccgaagtggaaaagcggctgaagaagcgcggcgccgagcagcgccacatcgacgccatcatgccgctggtgctgtccggtttcccggcggcgctgaaggacgcccaggcccgcgccaccgaggcccgcggcgcgtggcgcgcgctgaccggcgaaacctacggcgacaagaaggctgagggatggcagcaggacgcccaggcggtgcaggacggcgatattcagcaggcccagcaggacgcccaggcggtgcaggacgagattgcccaatgccagcagcggctgggcgaactgcgcgcccgccggcagcagcaggacgaccgccagcgccagctgaccgggctgaccgcagccgcggcaccgctagagcgcatccagactcgcttgaaggtggatctggtggagctggcgcgcgtccgcgacgaggtggaggctatcaccgccggcccggcgccgcgcgttgggctggtccacgacctggcgcgcgcgctgaatctgtctctgacgatggcgatcccgctggggcagatgaacccggagcagcgccagcacctgaaaacggccaatgccgcgctggaccagtacgccgccgagcatggcagcctggcagacgacggcgtgccgccgagcgccgaagatatggcgcgcctgccgcagctccagcactcgctggacatgatgagccgcgccgtcgccaacgatgagcgtgacctgaagatcgccgcggacgccgccgcccaactgcaggcgctgcatggtgccgagcaattggcgccggtgacggacgcagaggtcgcggccctggtcgaacgcatcaccacgctgcaggccagccaccgccagttggccgacaccctggccaccctgcaggagcagaaccgcgtcgcggctgacgctgtccagcgcacccggcaggccgcccagcaccacgccgacgtgcaggcctggacgctgatcgccgacgccatggcgccggatggcatcccgggcgagatcctggccgacgcgctgcgcccggtgaatgaccggttgttcgagctggcgcgcttggccggctgggcgcggccgctcatcgccaacgacatgtcaatcagcgccgacagccgcgcctatggactgctgtccgagtccgagaaatggcgcgtcgactgcatcatcgcgctggcgctgtcgatcatgagcggcctgcggctggtgctgctggaccggttcgatgtgctgtctatcgccggccgcggcgaattgttggatctgctggaggcgctggacgacgaactcgacaccgccctcgtgttcggcaccctgaagtcgccgccggcaggcgatgaggttatccagtccgtctggatcaagggcggcgaggtggtcgtctccgaaaccatcccgcaagcggcgtaa

SEQ ID NO: 1170 - DNA, 249 bp, Chromobacterium substugae
gtgagcaaccacatcaccaccatgcgctatgcgatggaaatcgccacgctggcccaggctgtggccgagcgggacggccagatcgagcagatgcgcatcctgatcgaaatgaaggaccagcaactggatacggttctgaaaagtgccaaggatttggccgatcagaacaccgcgctggtcgcgcgcgagaatcgccgcgctgaacgcatgagcgccgaccgcgccaaagaaaggagcaaggcagcatga

SEQ ID NO: 1171 - DNA, 882 bp, Chromobacterium substugae
atgaacgcaccccgcgattttcgcgccatgaccgccgacagcatcggcaaagacctgttgggcgcgctgctccaggaaatcaagctgatgccggacgtgtggcagaagctgccgcagcagaagcaggacgatgtgatcgaccgcattcgagcccgcgtggaaaccaacatccgcatggcggtgcatgtcctggccagcgagggccggaccacggtggtcggcgaactggatcaggtggtccgcaaggacggcatcaaggctgtgttcaagatcaacagcaacgccgaaggccggcatgagctgttcgacagcgagcgcaaggcgtgcctgatcatcatcgcagacgctggcgagaacctggccggcatggacgacatccacggcgagaccgaccagcgcgcgctggacctgggccacgagtaccacaacaacgacggcggcggcatggacgacgtccaggacggcaacgtggtcgatgccgagttcgaggaggtgaagcagttgccggcgccgggagacgccacgccgacggaggcggaactcgatgcggcgttcgacgccgggtatgacgccgccgaggcgggcgagccggagagtgcgtgcccggtgatggccggcgcgctgtgcatcgagtgggtgaagggctggaaggccgccaaggaagacgccgctggcgctgagctgttcaccgacaagcagcccgagccggagcccgagctggaacgaaagatcacgcagccagctgtccgctaccgccaccccacgaacgaaaaccagacctggaccggccgcggccgcaagccggcctgggtgcaggcgtggctggatgccggcggcacgctggaagagctggccgtcgacgacgagccagaagccgcataa

SEQ ID NO: 1172 - DNA, 213 bp, Chromobacterium substugae
atgggccgcgtcatcgctacgcggccggccagctcgatctacacgcccgaccggctgaaggaactgctatcggatgcggaaaccaatgccagcagcgattgggaccgcaatttcatcgactccatgcaagagcgcctgcgcctgtacggcatgggcatgcatatcagcgctctccagcgccaccacctcgaacgcatcgccgccaatttttga

SEQ ID NO: 1173 - DNA, 1191 bp, Chromobacterium substugae
atgaccggagcagcaaccaatctcgccgagctgaagcgcgtttcgaagatgccggcggcacaggccggtatcggcagtgtgaaaaccttcttcgaaagccagaaggccacgctggtcgccgtgttgcccaagcacgtcaacgccgaccgcatgctgaaaatcgccctgggcgcgctgcgtaccacgcccaagctgatgaatgccaccgtggagagcctgatgggcgccgtggtgcagtgttcgcagctgggactggagccgaacacgccgctgggccatgcctacctgatcccgttcgacaaaaacaagaaggtggacgggcagtgggtggtggagaaaaccgaggtgcagatcgtcttcggctacaagggcctgatcgatctggcgcgccgctccggccagatcatcagcatttccgcgcacgaggtctgccagaacgacttcttcgagtacagctatggccttgacgaaaagctggtgcaccggccggcgatgagcaaccgcggcgaggtgatcgctttctacgcggtcgccaagctggtcggcggcggccacgccttcgaggtgatgagccgtgagcagatcgaggagatccgcaacgcttcgcagggctggcagtcggccaagcgccggaacaaggaaggtgacagcgtgtggggccagcactttgtccagatgggccgcaagacggtgctgcgccggctgttcaactacctgccggtatctatcgagctggccaccgctgcggcgctggatggccgcgccagcgatggcgcaagccagggcctggataacgtgctgcagggcgagttcagtgtggtggacgacgatgctccgcagatcggccaggacgatgccggccgcgaggatgggcagcaggccgccctgggcgcgccggccgacgtcgataccgacaccggcgaggtgctgacgcagcagcagttccggcgccagcgccaggcggatccggtttatcaggcagccgaggccgaggagtcgcagcagcgcgcggaggcgcagccgatgttcggcctgcaggatgcgttggccgccgtgcgcgccggcaacctggacgacgcccgcgacatggctcgcagtctgtccgagaaggaccagcagatcatcgagcagaccatcgccaacgagcagcagcccgcggcgcgccagcggcgccagcgcgatctggagtag

SEQ ID NO: 1174 - DNA, 819 bp, Chromobacterium substugae
atggctgaaccctaccgcgtgcgcgccagcagctgggcgtcgttgttcgactgcgcccaccgctgggagggcacgcacatcctcggcatgcggatgcccagcagcccgcgcgcccagctgggaaccgcgatccatgcggccacggcggcatttgacgaggccgtgctcgccggccaggccatccggcccgtcgacgtggcgccggtgctggtggacgagttggcctcgcccgaccgggaggtcgactggtccgccgacgagctgacccggcgcgacgccgagcggatcggcctgcagctggtgacgcgctactgcctggagatcgcgccgcgctaccactatgtcgccgtcgagctggaggtggtgccctggctgatcgactgcggcggcggcatcgtcatcgagattcgcggcacgctggaccggagccgggcgcgagctgacgggaccggcggcgtgggcatctgcgacctgaaaagcggcgtcaacgccgtcagccaggggcgagccaaaacgaaagggcacgccccgcaaatcggcacttacgagttgctgtacgagcgcaccaccggccaggcggtgacgctgccggccgacatcatcggcctgaaaaccagcggcgcgccggaggtggccgtcggccagatcgtcggcgcccgcgagcagctgattggctcggacgactcgcccggcctgatggactacgcggcggacatgttccgcagcggcctgtttccccccaaccccaccagccaccggtgcagcgccaaatactgcgcgcggtggcgcgtgtgcaaattcaaggatgaccaaccatga

SEQ ID NO: 1175 - DNA, 504 bp, Chromobacterium substugae
atggaacacacattcaagatcctcgtcctgcacgagggctactactccgacagcggtgcggaaatcaccgacgagaatggtttcgtcatcatcgacgcgcgccagacggccatcctcctcggctacgccgacaagctgggcatcgattgcccgtccgacgatgagcgcgcgcgcctggagttcaccaaggagcagcaggccgccaacgcccgccgcatcgtggcctgcgtgaatgcgtgcgccggactgtccgacgccgtggtatcgcatgggctggtgcctgccagccggcattcaacggtggcgcaccagcgcgaccagctgctggcggcattgcggaaggtcttggagttgtcgaatgaagcgggggctgatctgcattgcctgcttgagggtgataccaaaaaagcccgtctggatgcccgggatgcagaaattcatctgctggcgctgaatgatgtcgccaaggccgccattgctgcagtggagtccggccatggctga

SEQ ID NO: 1176 - DNA, 315 bp, Chromobacterium substugae
atgccgtgcgctgctgtcggcagcctgtggcaacacctgatgattcaggaccgcgctgagcgtcaggccgatcatctgaaggaaaaggcgggcgagtttcaagtcgcgtacaccaacggcgggatcgattgggaggacgtcgccggcagcaccgaggccacgctggcgatgaatgcccagctgctggacctcgtccacaagatgccggactgcccggcgcgccggctgacggtggaaatgctggaggcggcccgcgccgactacgtggcacgcaagctgcgggaatatgtggcagcgcagaggaaggtggcgtga

SEQ ID NO: 1177 - DNA, 129 bp, Chromobacterium substugae
atgtccccattgctgcaaaccatcaaccgcatcgagcggcgccgcgcggtagtggcggccgccaaatccatcgcggtctgcgtcggcatcgtcgtactgctggccgccgtcaacctgattgggagctga

SEQ ID NO: 1178 - DNA, 225 bp, Chromobacterium substugae
atgtcaaggaaacgagctgatcgaaagaaccacgtcaagtccagcctgaccgaccgcacctacgacgccatgcagcgctatatggagctccacggcatcgataccgagtcggcggcggttgccaggatcttggatctggctctgctgggcatggtgggaagtattccggagatgctgatcgagcacactccgtccaacaacgggacgaaaaggattgcagcatga

SEQ ID NO: 1179 - DNA, 306 bp, Chromobacterium substugae
atgcgcctgaaagccggcgagcttggtatcgacccggacgccgagaaggagcggttcatcctccaccaccaggccgcgacaacgctccgcgctgacgaaaccgcctggcagaagcaattcgggaaatggctgctggatcagcaccagatcaatgccgaccgcgagcgcatcacgcaatcgcggatgcaggccagccagagcaacaccggcaaccgccaggcggccatgtcctcgatgtacaacccaccgcgccgcgatatgcccgcagagcgtgagattcagggggaaacgatccatgagcaatga

SEQ ID NO: 1180 - DNA, 801 bp, Chromobacterium substugae
atgagcaatgacctgatcaccggcgcaaccggaagcatccctctgcgctgggtggacgagattttccggcgcctgatggggcgatttggcgcgcagttcgccgacaaataccgcgacggccagcaagctaccgtcggcggcacaatcgtcgacgccggcatcgaagaggcgaagaaggtctgggccgaagagctggacattgccggcgccaccccgaaccagattgtgcgcggcctggcgcatcgctacacctacccgccgacctgcgacgagttcatccgcgcctgcatgggcgaaatcgccagcaacaaccgcgacccggaggttttgttctaccgcgcggtaacggagatgacgaagcgccgccggcacgagccgcaggactggccgagccagcccgtgttctgggcagcggtagccatgggcgatgatctgctgcgcggcgactacaaggctatggccggtcgatggcgcgccgccctggatgcaaaccgcgagcgcatggcggatatcccggatgtgagcccagatcacgccctgccggcgccgaagatgagccacgccgacgtgcaagtacacctcgccgacgtgcagcgcgcggcaaagcgcatgcggttcccggatgaagggcggatgcgtctggacaactggctcaagatcgccgacgaggtggcccgtggcgtctaccgtggcaccacgatcggcaagcagcatgccgccgccgcactgaaaaaagccggccacgcggtgcctgattcgctcatcccctatctgccggaatccacggagcaaagcacatga

SEQ ID NO: 1181 - DNA, 147 bp, Chromobacterium substugae
atggaaatgcacgaggtcaaggggcattggcaggacgatgcgcgcgccaagatcaagattgctgcggaccagtacccgttccgtttcatcgccgtgaaggtccaagcaaaacgggatggtggcggctgggcagtcgaagagttctga

SEQ ID NO: 1182 - DNA, 339 bp, Chromobacterium substugae
atgagcatggtgatgcggtggctcgacaagcacaccgagtttcgggagcaatacgcgcgcgccagggagatccaggccgacaccctggccgacgagatcctggacatcgccgacgacggccagaacgacacctaccccatcgatggcacgggcgcgaccggcgtaaaccacgacgtgatagcccgcagccggctgcgcgtggatgcccgcaagtggtacgcgagcaagctggcgccgaagaagtacggcgagatggtgaagcaagagataaccggcgccgatgacggccccctgatcgtggagattgtccgctatgccccggataagcctgccgaataa

SEQ ID NO: 1183 - DNA, 1455 bp, Chromobacterium substugae
atgccccggataagcctgccgaataactggaagcctcgcggctaccagctaggcatgtggggctatctggaacgcggcggcctgcgggcggtggaaatcgcgcatcggcgctggggcaaggacgaggtgtgcttgcactggactgccgtcgccgcccaccagcgcgtggccacgtactggcacatgctgccgcaggccagccaggctcgcaaagccatctgggaggcggtgaacccccacaccggccggcgccggatcgatgaggcattcccggtggaactgcgcgccaccacccgcgaacaggagatgatgatccggttccgcaacggcagcacctggcaggttgtgggctcggacaatttcaactcgctggtcggctcgccgccggccggcgtcgttttctccgagttcgcccttggaaacccggcggcgtgggcgtacttgcgcccgatcttggccgaaaacggtggctgggcgctgttcatcacgaccccgcgcggcaagaaccacgcctacaagctgctgcagactgcccaagcatccgcggactggtggggagaagtgcagaccgccgaagatactggcgtattcactgaggagcagctggccagcgaacgccgtgagcaagtggacctgttcggcgaagatgccggcgaggcgttctaccagcaggagtatttctgctcgttcgaggctgccgtcctcggtgcctactacggccgcgagttcgccacgatgcgccgagaaggccgcatcacgaaggtggcgcatgatccagcctttccggtgcattgcgctttcgacatcggctggagcgatgacacgtccatctggtggttccaggtgatcgccggagaggtgcggattctggagtcctacagcgagcacggccagaccgtcgccgacatcgttggtgagctcgcgggccgtgaatgcgaaatggacatcatcgccggagaggtcaagttccgattcagcgatgacatcgaggggctggagcatcgccgcgcctaccgctacggcacgctctggctaccgcatgacggcgccgccaaaacattcgccgccagcggcaagagcgtgcaggagcagctggccgcgcatttcggctggggcagcgtccgcatcgtgccgtccctatcgctgcaggatggcatccaggcaacgcgcgcgctgttgcggcggtgctggatggatgcagaccgctgcacagacggcatttccgccgctgaggcataccagcgcgagtacgacaccgagaatcgctgtttcaaggaagtccccctgcacaactggacgtcccacttgtctgacggtctgcgcatgctggccgtggcctggcgcgagccagtggaaaacgagcagcagaagccggcaccaaaattcttcgagcacatgaccgctgatgatctgttctggggcgacaccggcccagcgcaacgcaaacggatataa

SEQ ID NO: 1184 - DNA, 2391 bp, Chromobacterium substugae
atgaccactgaaacccagattccggccgatccggaggctgcgcgctggatagcggaaatcaaccgctacgaggccaaggccggcccctggcatgagcgcggcaagcgcatcgtcaagcgctacaaggacgagcgagaaagcgagttggccaaaaccgccagccggtacaacgtcctgtggagcaacctgcaggtgatgctgccagcggtctacgcacgctgcccgaaaccggaagtggagcgccgctacaaggacgacgaccctgccggccgcgtagccagcgaggtgttggagcgctcactcgcgttcacccagcagctgaccgggttccatttcatcgtcaagaacgccgtgcgcgaccgcttcctgtgcggccgcggcgtggcatgggtgcgctacgtgcctcacctgcgcgatgccagcgtagagggagacgccgacgtccgagctgccggcgcccagctcaccgacgacgcgccagatggtgacgagtccgccggccagctggcgcatgtgccggatggcaccgagatggtcgactacgaagaggtgatgcccgattacgtgcattggacggacttcggccacaccggtgacgcccgcgtctgggaagaggtgacggccgtctggcgccgggtgtactgcacgcgcgccgagctggtgaaacggttcggcgaggaaatcggcaacgccgtgcctctgaccaaggcggccacgcctgacggcaaccagacggacagcgccacggtcccgcagaaagccatcgtttacgagatctgggacaagccgaccaggacagccatctgggtctgcaaggaccatccgcagaaggtgctggaccagcggcccgaccctctgaagttgaaccagttctggccgtgccctcgcccgctgttcgccacgctggcgggcgatacctgcatcccaacgccggactacgccatctaccaggaccaggcagaggagctggacggcctgacccagcgcatcaacgcactggtcaaggcggtcaagctggtgggcgtgtacgacggcagtgccgagggcgtcgagcggatgctgtcggagggggttgaaaaccggctggtgccggtcaagaactggccagcgttcgcagaaaagggcggcctagccggctcggtgcagttcctgccactggaacaggtggccgcagcgctgatgcagctgtacgaggcgcgcgagaaggtcaaacaggagatgtacgagatcaccggcatgtccgacatcctgcgcggcgccaacgacccaagcgagacggccacggccacccgcgccaaaggggcgttcgccagcatccggctgcgcgacatgcaggacgaggccgcccggttcgcccgcgacctgctggcgctgatgggcgaggtgatggcagcccatttcggcatggccaccctgctaacgatcagcggcgtggagttgctgccgcaggcgcagaaattgcagctccagcagatgcaacagcagccggccatgcctcaaggccacccccaagcaccgcagcagcctggccaaccgccgcagccggcaccagcgccagcccctcagctgtcgccgaaactgctgaaggcgatggccgaccccagcatcgaggaggtcgatgcgctgctcaagaacaacgcggcgcgaacgttccgcatcgacatcgagacggacagcaccatcggcgacgacgagcagcaggagcaacagcagcgcatggcgttcctggacagctgcagcaagttcctgcaggcggctgtgccggcggccgagcagaacccgaccatcgcgccgctgctgggcgagctgctgatgttcgccgtgcgctcgttcaaggtcggccgcagcctggagggcgcattccaggccacgttggacagactgcagcagctggccagccagccgcagccgccgaagcccgatccggagatgatcaaagtgcagggccggctgcaggaggtgcaggccaagggccaggtcgaaatgcagctggagcagatgcgcggccaagtttccatccaggtcgaacaggcaaagctggcggcgctgaaggatctggagcagttcaaggcccagctgcaggcccaggtcgacacgtccgcccaggccgcccaggcgcagcagaacgcgcaccagaacgcgctggaggctcagcgcgagatgatgcagcagcagttcgacgagaggatggagcagatgcggatggtgctggagcagcagcgcgccgaggccgaccagaatctgcagatcatcctggccaatctcaacaatgccgcgcgcgtggaggtggccgagattaccgcccagaccacgctgcagacggcccagatcagcgccgccgccgcagccgagcgcgcagacagcgcagaacccaacgggagcgacgagtaa

SEQ ID NO: 1185 - DNA, 366 bp, Chromobacterium substugae
atgcccatctacgtcatgaagtgccagcactgccagcacaccctcgacatctaccggcgcgtcgccgagatgaacgacaacctgccggagtgctgcgggctggtgatggaacgccagatcaccgcgccattcatccagcccgaccagccggcctatcaggccatggccatcgacagcaaaaccggcaccgcgccgatgatcgagggccgcgcccagcaccgcgagttcctgcggcgaaacgactatgtagagctggggccggagagcagcaagccgaaaccgcgcaccgaggtgctgggcgacttcaacgtccggcgcgagttgaccgaggccacccgcgaggtgctggccaaacacaacgcctga

SEQ ID NO: 1186 - DNA, 360 bp, Chromobacterium substugae
atgaccgaaaccaccatcgagcagcaaatccaggccaaagggctgaccgcgccgcgcatcacgccggctgacgtcgaatccgccatcgccagcgagcactactttaccgccggccagggtgtggcaggtgccaccggcgtctaccccaatgacggccatccgggccagcccctggcgctgctgaccttctgcgtgctggtgctgaagaacggtttcaccgtcaccggcgagagcgcctgcgccagcccggagaacttcgacgctgagatcggccgcaagatcgctcgccagaatgcagtcaacaagctctggccgctgctgggcttccagctcaagcaaaagctgcacgacgccaaataa

SEQ ID NO: 1187 - DNA, 1119 bp, Chromobacterium substugae
atgagcgaacacgctactgcagtccccggcggcgaggaagagaacgacgccggcgaacagtccctgcgtgagcagctgcaggctgcctacaccgaacttaacagcgcgccgaatgacccgccgccgcagccgaagccggccgctgagcagcagaccaccggccagggcgagcccaagcccggcaccgccgcgcgcgatcaacagggccgcttcactgcgaagccggaaggcgcgcccgctgccgcagcagccgctgcccagtcggtggacaaaaccgccgtggccgcgcctgctgcagatgccagcgctgcgcaacccgcagccgctaccgcgccgccgccaagctggtccgccgaggcccgcccccattgggaaaaaatcccgccggaggcgcagcagtacatcgccacccgcgaagcccagatgcagcagcagttcagccgcatggacgacgagcgccagaccggccgccagttccgcgaggcgctgaagccgttcgaacacacgatccgccagttcaacgtgccgccggtggtggccgcccagcacctgttcgccgccgacgccgcgctgcgttacggcaacccggaccagaaaatccagatggtccaccagatcctgcgcgactacgccattccactggatgccgtggcgcagttccagccccagcaagttgaccctgccgtcgcagcgatgcagaagcgcctgcagcagctcgaacagatgcaactgcaaggggtacagcaacagcatgaagcccagcaggctgacatgcagcgccagatcgaggcgttccagcaaggcaaaccgcacttcgaacaggtgcgcggcgacatggccgtgcttctgcagtcggggatggcgagcagcctggatgatgcctacgaacgcgccgtatgggcacggcccgacctgcgccagaacctcatcagcaaacacgatgctgaccagagggaggcagcagcccaggccgccagccaacgagcccagcaggccaaagctgccggcgtcagcctcagcggcgcgcccggcagtgtcacccccgcagccgcaaaccagaacctcagcctgcgcgacgagttagcacaaagcctccgcgccgcccgcggccaggtctga

SEQ ID NO: 1188 - DNA, 990 bp, Chromobacterium substugae
atgggactgcagaacccgtcggcaacgatgacggaaatcgtcaccaccacgctgcgcaaccgcagcgggaaaatcgccgacaacttcaccaagaacaacgccctcctctaccgcctgaagcgcaaaggcaaggtcaagccagtgtccggcggtcgcaccatcgtgcaagagctggaatacgccgagaacagcacttacaagcggtattcgggctatgagcagctgaacatcagcccgtccgacgtgttcaccggcgcggagttcaactacgcgcaggcggccgtggccatcagcatcagcggcctggaggagctgcagaacagcggcgaggagcaggttatcgacctgctggagggccggatctcgaacgccgaacgcaccatgaccaacaacgtggctctggactgctacagcgacggcaccgccgacggcggccgtcaaatcggcggcctgcagctgctggtcagccagaaccccgcgcagggcatggtgggcggtatcgacgcctccaccagcatcggcgcgttctggcgcaacctggcgttttccgcgttgcgcaacggtggcgcggccgtcaccccgcagaacatccaaggctacatgaaccagctgtggatcaacctgcttcgtggcgccgacaagaccgacctcatcgtcgccgacaacaactactacctggcctacctgtccagcctgcaggccatccaacgcatcacctcgtccgagatggccgaggccggcttcgagtccctgaagttcatgggcgccgacgtggtcccggatggtggcgtcggtggtggtgccccggcgaacagcatgtatttcctcaacacgaactacatcttcctgcggccgcacagcgcgagaaacttcgcgccgatcggcgataaccgctatgccaccaaccaagacgcgatggtcaagctcatcggctttgccggcaatatgacttgctcgaaccgtcgtctgcaaggcgtgctctgcgcgtaa

SEQ ID NO: 1189 - DNA, 867 bp, Chromobacterium substugae
atggcacgttggactatgcaggacgccctgatcggcaccgtcgatctgggcagcgtcgacccggtcggcccggggccggaaatgctggtcggcccgaacgccggcaaaatgggccgctacaacctgccgtcgcagttcgtggacggcacccattcggtgctgggcggcggcttcttcgcgttcgcccaggttgcaccgatcgcggcccaggccgtgcaatccatcaccgtggcggccggggtagcaaccctgaccacgactgctccgcatggcctggccgtcggcgcggcgatctccatcgctggcgctcagccggcaggctacaacggccagttcatcgtcgcgtcggtgccgtctaccaccacgctgactttcaacgtcggcctggtgatcgacaccaacagccagcagccgattgccaacccgaacacgccgaccggcaacgcaactgtcgtcggctcgtacacggccggcatcggcgcgggccaggtggttcagttcacccacacgctggatggcaacggcaatctgatcctgcaggctcagccgtgggcgggggtgaaaaactccggcctgtctctgggcgcagcgatcagcaacccgcccgccggtcagtgggcgtggttccaggtaggtggcgccatgatcgtctacacctcgggcgcgcctgcggttggcggccaggcgtatttcggcgcggctggcagcgtgcagccgggcgcgtctgcctcgctgcagatgcagggcgtgcagtacgcgtcggcggccggcgccaccatcggcagcggcaacggccagatcgtgctgccggcaaaccaggcggtgctgtggggcaccttcccgctggcgcagggagccatcacctga

SEQ ID NO: 1190 - DNA, 240 bp, Chromobacterium substugae
atgaacatcaccaccgaagaaatccgcctgatcgcgctggccttcgccgctaccaaccgccaccccgatccgcacgcccacgctgacgaagttgtggccgcgttcaatgaactggtgtcccacatccccggcggattcagccaagcgccggcggcgccggcatcgctgtatgccgcgccccagcaggaacacgccgagcccgccgcccagcagccctacatccccactttgaacaactga

SEQ ID NO: 1191 - DNA, 669 bp, Chromobacterium substugae
atgaacgacgcattcgccccggaaaaatacagtttttccccgggccaaaccatcgcgcaggtatcccatggcaacgataccggcctatacgtcgaattccacaccgaggccgtccatcagccgttcgagagccagcaagaagggcggccgattttcagcgaaatccctttcatcacgatcctgttccccggcgacaagaccaagaaggtggtccgccccgtcaagctgcaggacgatgaagccggtccttctgacctgcgccgcttcccgaaccaatgggccgccttcaaacaggagatgacgcagcacggcgacggtattccgctggagcagtggccgcagatcagtaaggtggaggtggccgagctgaaggcgctgaacatccacaccgtcgaccagttggcggcactcgcggacggcaatttgtcctggctcggtggccggcaactgcgcgaccgcgcccggacttggctggaagccgccgccggcaatgcgccgatggcgcgcatgcagtccgagctggaggcccgcgacaacaccatcacccggatggaacagtccatggctgccatgcaggctcagatagaagacctgcagaataagctgcaagagccgcgcaccgccgccgaagctgctgaaagcacctctcgcaggagccgcaacgcatga

SEQ ID NO: 1192 - DNA, 462 bp, Chromobacterium substugae
atgcgctggcagctgctgggcccggcaacgccgcaggaatggcaggtgctgaagtccgcagtggtgccactggggccgcgccggcgctggcgtgtcctagccggccagtttgtgctgttcccggtccccagccccaccgacaacaacacgctggtctacgagtactacagcaactgctggtgccagtccgccaacaatgtgccgcaaccgcagttcgccgcggacacggacacctacctgctagacgacaacgtgatggtgttgggcatcatctggcgctaccgccggaaaaaggggctggagttcagcatcgaatacgaggactggaagcgcgcgcgcgatcgggcaatcgcctcccaggccggcatgcgcgatctgtcattgaccagcggttcaggcctgaaccccttcatctccacagcaaacatccccgataccgggtatggaaacataggctcctga

SEQ ID NO: 1193 - DNA, 1533 bp, Chromobacterium substugae
atggcatcgttttcgcccaccaccagcggcgtcagcgtgccggcgccggtaggcggctggaacgcgcgggacgccattgccaacatgccggccaacatggcctgcatcctgatcaacatgttccccactccatcggatgtggaaatcaggcctggattccagaactgggccaccgggctgccgggccaggttgacagcgtgttcgcctacaatgggccggccgcacgattgtttgccgcgtccagcgctggcatctacgacgtgacgaactccggcgccgtcggcgcgcccgcggtggccggccagtcatccgaccggtatgtcaccgcccacatgacgacaccaggcgggacgttcctttatgcagtgaatgggctggactacccccagttgtacaacggcagcagttggcagcaggtgacggccaccagctcgcccatcagcattaccggcatcccgctgaaccagatttcattcgtacatacggcaaaatcccggatctggttcgtgattggcggcacgcaggcggcctatttgcccgtgcagtcgctgggcggcgcggcacagattttcgacgtcggcccagtgttccgaaacggcggcaagctggtggcggttggaagctggagcgtcacgggcggtttcggcgcccaggatctgacggttttcgtctccaacaccggagaggtggcgatctaccagggcaccgacccatcgcagctcaccacatggtcgctggtcggggtctggcagttcggctcgccgatgggcaaccgctgcctgacgcggttcggcgatgacctgctctacctgagcaaggacgggctgcagagcatgaaccagggccggttcttcgccgacgtgagcgacaacaagtccgcgctgaccgacaacatccagtgggcaatcagcaacgccaccagcagttacccgaacaactacgggtggcaggccatcgcctaccctaccgccaacgcccttatcgtcaacgtgcccgtcagccagggtcagcagcaacagtatgtgcagaacaccgtcaccggcgcgtggtgccagttccagggatggaacgcgaatgcgttcgaggtgtttcacgaccagctgtacttcggtggcgccggcatcgttgcccaggcctggaaaggatggagcgacaacggcgcagcgatccaggcagaggcgctgccggcgttcagcaacttcggacagccggccacgctgaagaactggacatccgccaaacccattttttcgtcgtctggccagccgtccttcctgatgatgctgaacatcgactacgacaccacgccgccaatcggcatgatgtccacggcaccgatcaccatggccatgtggggatcggcgatatggggaacgtcgacctggccgtatgggcagaccatcatcaataactggcagtcggtaacgggtatgggctacaccgcggcgctgcacctgaaaatcaccacgaatggcgccaacgtgaagtggatggccacagattttgcattcgagatcgggagcgtgatgtga

SEQ ID NO: 1194 - DNA, 405 bp, Chromobacterium substugae
gtgaagcggatcattttcgatgagcccgaacgcgtcgggcgctgggtctgcgaggcggccggcggccggtgggtggaggggaatccggccatcggcatggaggtcgacggccagctggtggtgggcgtcatgtacgacagttggacgggcagttccatcgccatccatagccggtgcgacgacccgcgcgcgctgaatcgtgagttctaccggcacattttcggctaccccttcaaccaactcggcgtgcgtcggctgaccggcctggtgggtgccagcaacatgcgggcgcgtcggctggatgaacggctcggcttccggcaagaggccacgctggccgactatttccccgatggcgacgccatcgtctacatcatgcggcgcgaggactgccgtttcctctga

SEQ ID NO: 1195 - DNA, 1290 bp, Chromobacterium substugae
atgcgatacgaccacttcaccatgctgccggagcgtgcgttccggccggcaggcttcggcacgtccaagctcgccaccctggagggtggcggcaaaggtggctcagcgccggccgcgcctgatcctacggcgaccgcggccgcccagactaccagcaaccaacagacggccgcctacaatgcggcgctgaaccgcaccaacacctataccccgctcggaaacagcacctggacccagaacggcaccgaccccaccacgggcgcgccgatctggtcccaatccatcaacctgagccctggccagcagcatctgtacgactcgaacatgcagggttcgcagatgatgcagaacacctccaaccagctgttggggaatgtgggcagtcagctttctagcccggtgtctacgaatggcatgcctgccgtgcagtccagcgtcagcaccagcggcatgcctggctacgctgggccggtgaacggcggcgatctgaccggcctggcccagaacgcgacgaatgcgtcctacaacagccagatgtcgctgctgcagccgcagatggaccaggccaacaagtcgctggctgcccagctggcaaaccagggcatcacgcccggtagcgaggcctacaacaacgcgatggacaaccaggcgcgccagcagggattcacgcagtcacaggccgccaacaacgccaccctgcagggcatgcagtaccagaaccagctgttcaaccaagggctgcaaaacgccaacctgcagaacacggcgcaggccggcctgttcgggatcggcatgcagaacgcccagctgaacaacagcgccaaccagcagatgctgcagaaccagttgacgatgcgcaaccagcctctgaacgagttgaacgcgctgcgcaccggttcgcaggtgcagatgccgaacttcagcggcgcacctggcgtcagcatgaaccccaccaacaccatggcggcgactcagatggcctatcaaggccagctgaacgcctacaacgcccaggcaggccagtcggcagggatgatgaatgggctgttcagcctaggcggtatgctgggatcggcctatatgttgtccgatcggcggctgaaaaaggccgtgcaacgcatcggtactggcgtgcgcggcttggcgctgtacgcattccgctacctctggcagtccgaccgcgcaccgcgcaccgtcggctatatggcgcaggacgtccgccgcgtcgcccctggtgcagtatttgatgcgggcggtggcaacctggcggtgaacatgggggcgatatga

SEQ ID NO: 1196 - DNA, 1728 bp, Chromobacterium substugae
atgatgaacggcatgaacttgctgtaccccaacctggcgcaaacccaacagcagatcgagctggaacgccaggtgggcatgcaggccatgaaccagggtatgcaaccgcagccgctccaatcggtggggggcgtggcgattcgacagtccccactggaggggctcgcgcgcatgctgcaaacctggaccggcgcggccatggccaaaaatgccatgtcgcagcagagcgagctgaaccagcagtatgcccaatacctgcgcggccaattcggcgccgacggcgctggcgcgcaaccggcgacccagcaacagagcgacccgggtctatccgatgctggcaacggcagcaatcccgcatatgccgccgcgctgcaggctctggccgagcgtggcgcaacggctgggccaaccaggcaggcgacggcactcgctcaggctctgcaacagtccagcagcggcggcggagatggtggcggcgctgggcagactccggcccctcctccggctacaccgccctctgccggcggcgcatccatgaccctgccgggcatgacgccgcagcaggctatggcgatgtacttgatgaacccagacaaatacaccgaggcgatgctgtcgcagtacaaggcgccggacgtcgtcaccaagttgcgcgccgccggcatagacccgtcgtcgcagctggggcgccaggtgcttcaggacagcatcgccaaggacaactacatcgcacctgtccccgtgcgcccaggcggtggcctggtcgacccgcgcaccggacacatcaccacgatgccagctgctgcacctgaggggttccagagcgtgcaaaccgcggatggctcatgggctatggtgccagtacagggcggcactgctgccgtgcagtcgtccgcacaggccaaagcggccggcgcggctgccgtcaaaccgatgacggcatacgacgccgatggaaacccggttttcaccagcgagctgcaggcgtcaggtggcgcgccggcgggcggtggcggacggttcgccggataccaggctccgggacaagcggctggcggcaaccttcggccggcaccaatcgcaggcaccaacgacagccgcgtcaccatcgcccaggccaacgccaaacgctacaacgacctgacgacggcagcgacggatagccctacgcgcgtcaacgtgctggacaacatcatccagctgtcgcagaacggcgtgaacaccgggccgggctcggcctggcagaacaaaattctggggtacgccgccaattctccggtgctgggatcgctggtggccggcaagaaggacagcgtgacgcaattccaggaaatgcagaaattcctggcccagaatgggctgcggcaatggcaggcgtccggtggcacgggcaccgacagccagctcaacgccgcaatgcacgcgaacccgaacgatgagcatttcccgcaggcgctgcaggcgctggcgacctggaacaaggccggcgaaatggccttgcaagcgaaggcagccgccgccagccagtacatggcgcagcatgggaatgacgccacgcagtacaaccagttcgacaacatgtggcgtcagaacttcgacccgcgcatcgcccagatgcagctgatgaacccgcaggatctgcagcagttcgtcggcaagctgcagcccgcggacaaggcccaactgctgcggaaataccaattcgtcaaacagcaaggatggatgtga

SEQ ID NO: 1197 - DNA, 2466 bp, Chromobacterium substugae
atgcaggagaacccgaaaggcaacctgtccgccgtcggccccgtgccggcggtcggcgacccgaacgaccgcgccatcgggctgatgcagatccggcagagcatcgccaacaagctcggcatcgacccgcgcgaccccgcgcaggctattgacggcgcggcgcagctgctggctggttcgctgcaacggaacggcggcgacccggagatggccgtcaccgagtatcacggcggcacgaacccggcgaattgggggccgcgcacgcaagactatgtgagcaaggtggctggctacttccagcaattgaaacagcagccccagccccagatggctcaggccgcgaaagccgcaccgccgccggccggtgccgacccgatcatggccgcgctgtctggtacggcagcgccggccgcagccggtagccaggggcagagcgacccgatcttggccgccctgcaatcaaagtcgcctgtgccggttgcccagaccaaagccgcaaagccggctactccagccaccgacaatgtcgctaccacgctgtcggccgtactgccgggcggactcggcaaggatctggcgaacagcggcgtgggcgacttcatccgtgccggtcagcaccacctgctaaatcccgttctgggcgcgtcccagttgctggataacggggtggatgcagggctgcagatgctgccggacaaccctgtttcgcggtactggcatggcgttacccagaacaacaacgcctacatggcgcagcgcgagcagcaataccaggcgaacacgccgaccaacgccgccagcgtagccggcgcagcgattggtgatgcggcaccattcctggccagcggcggcgcgtcgttgctgggccgggccggatctatcgctgaacggctgccgctggtatccagcagcgccagcgcccggcgcattgccaatgccgtcgcccagggcgcaacggtcggtgccatgcagcccgttacgaatgccgtgccgccgaccatgagcgacctgataaccggccagggcagcaaagcgcccagctattggcaggaaaaagcccttcaaaccgccatcggcggtgctatcggtggcgcagtatccggtgcagccaatggcgcgcgcggcctttaccaggccgccaaaccggtaatctcgccccgggcaaccgccgccgacacgctggccgccgcgttgcgcacgccggcgcaatccgctgcaacagcccccgcagttgaaggggctggcgccagcgcggcagcgcctgctggtgctgcgggcccggcagccggcacggcatcgaacgccgccgacctggccgccgcgttgcgcacgccggcgcaacagttcgtgccgggctcgcggccgacgctggcgcaggtgctgcagacgccgcaggccgtacagttggaaaaggccgtctcgaacctgccgcagtaccgggcgatgttcgagcagcgcgcgatcgagaacaacgcagcgcgcctgcaggccatccagggggtagctggtacgccggacgccatggcaggtgcaatccaggcgcggcaggatgccgccggtccgctctacgccgcggcgcgccaggaatcgtatgttcctgactcgacgctgacggatctgctgtccacgccggccggcgcgtcggcgttgcagcgcgcgcgccagttggccgccaactcgatggatcgcgcaccgatcatcaccgacgacggcgacctgaccggcaccggcggccattatatgaagatggcgttcgatgctatgctggacgaagggcaacggaccggcatggcgggcgcagagcaaaatgcgatacggaatcttcgtgggaatttcctcgactggctcgacacgcagtctccaaattacgcgagtgcgcggcaatcgtatcgagacgcgtctgtacccatttccgacatggaggccggacagtcgattctggacaaccttggcaatcgcgctcttaacgccgctggtgatccatctattacgctgaacggctacaactccgcgctggcgcgcgctctgcgcaattccgactacggcatcagcgacgatgccaccgcagccctgacgggcgtccagcaggatctgcaacgttcttccatcagcaacagcctgaaatcatccggtagcgacaccttgtccaacctggccgccaacgactggctgatgcgacagctgaccggagaaggctcgtccggcggcaccgcccagaaagcggcagcggcggccatcggcaccgtcattcctggcgtgggcaccatgggcggctggctcggcgctggcgcactgcaggacgccgccacccggcgcgcggccgaccagttggcgcaggcgctgctcaatcctgacgtggccaaccagctgctgcagagccagactaccgtcagcccgctgctgctgcaggcgctgcgcggcacgccggccgccgccgccaacgttggcgcccaagctgcgccgtaa

SEQ ID NO: 1198 - DNA, 2517 bp, Chromobacterium substugae
atgcgaaacggatcagggcaatacaacccgccggcaggtaacccggttcaggctggcacgctgatggaccccaacgcgttcaacagcaccatttccgacatcgggtcggaaatcaccaacagcgtgccgcgcgatggccaggcggcccccactgccaacctgccgatgggcaacttcagacatacgggggtggccaatggccaggcgcgaaacgactatgccgcgttggcccaggttcaggacaacaccgtccagaccctgaccagcgtgggcggaactgacaccatcgtcgccaccgttctgccagcgtttcagagctatgcagttgggcaggttttccgtggggtaatggtcggctccaatgcgacgacgagcccgacgctgaatatcaacagcgtcggggcagtcccgattgttctacctggcgcgaaaaccgtgtcggtaggcgatatcccggcaaacggcgcggtttttttctacaacgggacgcaattcgttttgctgaatcccgtttcgacatatagccatgttgtgccgaatttaaccgcagtgcgtgcgctcgttaaaaccggtgcgccaaatgcgtttgtaaccgggcacgatgcgcagggggatggcgggggcggaaactattacctcgacccgctggacaccaccagcgcagacaataacggcaccatcatcgtcgccaccgacggcggccgctggaaattgtcccccgtcggatcaaacatcaatgtccagacattcggggcaaaatgcgacggcgtaaccaatgacaccgctgccgttcaggcggcagatatttatgcggctgccgtccataaaaagctgaaaatacccggtgtctgctatttgccgacctatgtatttacgtctgaattagaggacacgatggggcagatgtttaccccgaatagcaacgtcactatatcggcaaacagttttgttcgcccggaatggtgggggacgcaaaacaatatcgtagacctggcaatccacgccctgcctgcatctggcggcatcgttcaactggaggacaaaacctatccgccaaatggatatgcggtgggaatgagcggtgtaggcagcgggaaatatatctccaaggacaatgtaaaactggtcgggcgtaaaatgccgtcgctaaccaacgactgcaaagcgcttactggtggcacgattattcagggcatgctgctggcgtgggcgaatcagtttgaaatgtccgaccttggtattgattgcggctataccgttctgcaaaacgtgtatggaggcgttgaagcggctggcattactgaggcctacaatttcacgtacccggacacaaccaccgctgccagcccaccggctgcaccgaaaatgtcgtccaaactgcataacattatcggattatgcagctctccaggcgcaccgacgcacgccatgctgatcggcgaagggctccaaggcctggaaacctccggcgtgataatggccgtatatggccagcacggcgtcgttataaagtgcaagaacgcattcgtggagcggattgaagcttatatgaatcaatccgattcggttatattcaaggccgatgccggggctacgcaaattgcaggcggcgtagacgtggaaagtatttactgccgagcagctgggccaattaacaccgctccctatgcaacatcgcaatgcaacgctggggtgatgctgaacgcccacgccaataatctggacgatatcaaaattggcaccatccattgcgaagggtatccattctcggtttattacacctgggatggaccctatgcaatcagcagcatcgacatagaccacattttctccgatcaattcggcgtaacggtcgcaggcagaaccgcagtatcaatgaatggcaccgccggtcaaagccttcaacggaacagcataaagtcaatcgatgccagaaatactatattcgcggtcgctcacaatatgcagggcggcgccgggctggtttctgaaatcggccgccttgaggctacaaacgtacagaatgcggtaaatgtgggctatggctctgtattgagcataaacgttctgtctgtcaccagcgccagcgatgcggtgtatttcattactggcagcccgcgactgctggtgaatatgctgttcaaggacgtggcgacacccgccgtttatagctcgctttctggtagcactccgccaacactgtcaaatagctgggcaaatcaaggtggcgtcggcaatgagcaattcggcgtcgatttgctgggcggtaaaatatcgttgaaaggacttttgacgcccgggacttcaaacgtcattgccacgttgccatattgggcgcggccagtatcgaataaacgctatagcgcagtaggctttgtcgctccgaataacgtttattccgtgccaattactgttggctctaatggagtggtcacagtaaatgaagtggtcggcggtacagctaattgctctacctacgtttcgctgtcgggaatttcatacgacatcgtcagctaa

SEQ ID NO: 1199 - DNA, 303 bp, Chromobacterium substugae
atgggagaaagccaggatgtaacggtcgcccggctggacgagcgcatggaagggatgcagcgcgagatgtcggccatggcacagcacatgcaggggctggcgtcggccgtgcaggaaatgacgcgcgcgcaggcccgcatatccaccgtcgaggcgcatatctcgacgctgcaatccgggcaggacgcgatctggaaggagattcgacgcatcgacgggcgccgggaaaacgggattttcgaggtagtgaaactgatcgtctactgcgccgccggcgcgttcgtgtctcatgtagtcagatag

SEQ ID NO: 1200 - DNA, 483 bp, Chromobacterium substugae
atggccaatttcaacgcagcattcaccgcgctcatcggcaacgagggcggctacagcaacaacccgcatgaccccggtggcgaaaccatgtggggcgtaactaagcgcgtggcggtggccgccggctacaccggcgccatgcgagacatgccgctggccaccgcccaggccatcgccaagcgcgagtattgggacaaattccagtgcgacgcgctaccggatgcgctcgcgttccaggtgctggacgcggcctacaacggcggattccccgccaagtggctgcagaacgccgtcggcgttcatcctgacggccacatcggccaggccaccattcaggccgccaacgccatggaccccgcgcgctcggtgctgcggttcctggcctaccggctggcctacatgaccacgctgcgcacctggccgacattcggcaaaggctgggcggcgcgtatctcccgcaacatgctgaaaggagcagtttga

SEQ ID NO: 1201 - DNA, 585 bp, Chromobacterium substugae
atggacccgatttctatcgctatgggcctggcctcgttcgtgcccgacatcgtgaagtggatcagcggcagcgacaaagccgccgacgccgcgcagaaggtggtcagcatcgcccagcaggtgacgggcacttcgagcggcgacgacgcgctggcggccgtgcgcggcaacccgacgctggcgctgcaactgcagcaggaactggaccggcacagcgagcagctgaaccagatcagccaggcggtacagctggccgagatccaggcggacacggccgacaccgcagcagtcaacgcgacgatgcaggctgaagccaagtcggaccactggccgacctattcctggcgacccttcatcgggttctgcttcgggctgctggcgctgatcagcggcattaccgttgcagcgtgctatctgggggtgatgttcgggggggagaatccgcaggtgctggcgcagctgccggggatgatcggcgcggaggccggggtgatggcgacgatggcgccggtgctgggtatcgcgtcgtggttccggggcaagatgcaggccgacccgcgagtccagacggataacaggggatga

SEQ ID NO: 1202 - DNA, 786 bp, Chromobacterium substugae
atggctgagggtatccagatatgggcggcgcctaccgagcgttgcgatgacgctgcgctgcggcaggcgtacatcgcgctgttgtcggatgaagaggcggcgcgctggcgcgctttcgcgttcgatcgcgacaggcatgtctacctggtggcgcgcgcgctggcgcgaacagtgctgggagaggcgctgggtatgagtccggccagcatcgagtttcagcaaggcccgtatggcaagcccagcctgcgcggcgcggcggcgggggttggcctgcgtttcaacctgtcgcacaccaagggcatggtcgcgctggcgctggcgcgggaccgggagctgggggtggatgtggagggcgtcgagcggcgggcggcgctggatgtcgcctgggaaaatttctcgcgcgacgaggcgcgcgagctgtcggcgcggcaggggcaggcgcaggccgaccgcttctggacgctgtggacgctgaaggaggcgtatctgaaggcgctgggttgcggattaagcgcgccgctggactgcatttctttcgtcgacgacgatcagggcgggctgcggtatgcgcggcggggttcgggccatgccgatgatgggcgctggcatttctggcacggggtgctggcgggaacgcatgccgtatcgctttgcgccggcgcgcgggaaggcgaggaggtgcctgaactgattctgcgcgagacggttccgctgctggccgcgcgcgaagtgccgttcctgccggcgttggggccgatccgggaagaggggaccgcgtcatcctga

SEQ ID NO: 1203 - DNA, 1386 bp, Chromobacterium substugae
atgagcaaatcgcaacgcgtggaaaccgacagcttcggcccgatagacgtggccggccacgccctgtggggcgcgcaaacccaacgctcgctggcgcacttcgccatctccagcgaaaagatgccgccagaactgatcttggcgctggcgcgggtgaagcgcgccgccgcgcttgccaacctggagctgggcctgctggacggcgccaaggcccaggccatcgtcaccgccgccgacgaggtgctggcggggcgccacgacggacaatttccgttatcggtctggcagaccggctccggcacccagagcaatatgaacatgaacgaggtgctggccaaccgcgcatccgagcttttgggcggcgagcgcggcgtgcgccggctggtgcaccccaacgacgaagtcaaccgcggccagtcgtcgaacgacatcttccccaccgccatgcacgtggccgccgcgctggggctgagcgaacggctgctgcccagcctggctgcgctgcgccagatgctggaagccaaatcgcgcgaattcggcggcatcgtcaagataggccgcacccatttgcaggacgccacgccgctgacgctcgggcaggaaatctcaggctgggcggcgcagctgcagctggcggaacaggcgctgcaagccagcctgccggccttgtgccagctggcggcgggcggcaccgcggtcggcaccggcctcaacactcatccgcatttcggcacccgggtcgcggaagtgctgtcgcagcaaaccggcctgcccttcgcgtccgccgccaacaagttcgccgcgctggccggccacgaacccttgctggccgcccacggcgcgctgaagaccctggcggccgcgctgatgaagatagccaacgacatccgctggctggcctccggcccgcgctgcgggctgggcgagctgactctgccggaaaacgagccgggcagctccatcatgcccggcaaggtcaatcccacccagtgcgaggcggtgaccatgctgtgttgccaggtgctgggcaacgacgccgccatcgccatcggcgccgcctccggcaatttcgaattgaacgtgtacaagccgctgatcgcgcacaatttcctgcaaagcctgcgcctgttgagcgacggcatggccagcctggccgagcattgcgtgcagggcatgcagcctaatcgcgaccgcatcgcccaattgctggagcagtcgctgatgctggtcaccgcgctcaacccgcacatcggctacgacaaggccgccgccatcgccaagcacgcgcatcagcatggcggcacgctgcggcaggcggcgctggcgctgggccatgtcagcgccgagcaattcgacgcctgggtcaggccggagagcatgatttaa

SEQ ID NO: 1204 - DNA, 1023 bp, Chromobacterium substugae
atgagcgcaaccattctcgtcaccggcgccgccggttatatcggatcccacacctgcgtcgagctgctggcggccggcttcgacatcgtcgcggtggacaatttctgcaatagcaaattcgaggcgatccgccgggtgcaggagctggccggccgcgagctggcattccacgaagccgatgtgcgcgaccaagccgccctcgacgccatcttctcccgccaccggatcgacgcagtgatccacttcgccgcgctgaaggcggtcggggagtcggtcgcgcagccgctgcgctattacgagaacaatgtggtgggcacgctgacgctgctggaggcgatgcggcgcgcccaggtgcgccagatcgtgttcagctcgtcggccaccgtgtacggcgatcccgcctccgtccctatccgcgaggatttcccgatcggcgcgatcaccaatccttatggccgcagcaagcgcatgatggaagagattctcgaagatcttgcccgcgcggaggccggttggaagataggcctgctgcgctatttcaacccggtgggcgcgcacgccagcggccggataggcgaagaccccaatggcgttcccaacaacctgatgccctatatcagccaggtggcggtgggcaagctgccgcgcttgagcgtgttcggcggcgattatccgacgcccgacggcaccggggtgcgcgactacatccacgtggtggatctggccatcgcccatgtcaaggcggtgcaggcgctgccgggcgtggacggcgtgctgacggtgaacatcggcaccggacagggctattcggtgctggacatcatcaaggctttcggccgcgtcagcggacgggagattccttaccaggtggcgccgcgccgcgccggcgacatcgcctgctgctacgccgacccgggcaaggccgcgcaggcgctgggctggcaggccgaacgcacgctggacgacatgtgccgcgacagctggcgttggcagcaggccaatccgcgcggctacgagtcctga

SEQ ID NO: 1205 - DNA, 1422 bp, Chromobacterium substugae
atgctgaaaagtctgattgatggcttggccggacgcctgaagaaaacgacgacagaggaagagacgccggccgcggcggccaagccggacagaaccctgctggatccgccgccgcccgacgacgagccggtggatctgccgcctaccctgggctttgtctcccaccagccggtgatggacaagcagcagcgggtggtcgcctacgactttttcgtccggcagggcaagcgcaatgtcgaggccggcaagcagcaggagttcgaccggctgctgctggccaccttgcagaatatggacatcttccggctgctggcctaccgccgcgccttcgtgcacatctcgatgacctcgctggacgaaccgctgctgcgcgacatgcccgccggcagcgtgattttcgtgctggaagcggggccgggcatgatagtcaacgaatacatgctcaatcagctggaccagctgcagaagctgggcctgcgcttcgcggtggagccggcggcttacgagcagggcgcgctgagcgccgccttgcaggccgacttgttcggccgggtcgacttcatggtgctggacttcgccggcccgtccacccgggtgctggcgcccattctggaccaattgccgaagcgctatccgggcgcgcgctggatggcgcgcaatgtcggcaccgccgaagatctggatgtctgcctgcgcgcgccggggcataaccgcttcgcgctgttccacggccccttcgtcaccaccgcccacgcgctggaaggcggcaaggtggacaccagccagacccgcgtgctgcagatcatgcggctgctgcgcgccaatgccgaccccaaggaagtggaggcgcagttcaagctggattcggtgctgctgttcaagctgctgcgcttcatcaattcgccgatccacggcctggcgcgcaaggtgcagaccatagaggaaaccctgctgctgctgggccgggaaaccatgttcaagtggctgtcgatgctattgttcacttcgcgcaaggaggacggcaccgcggtttccctgctggaaaagtcgctgatccgcgcgcgtttcctggaaaaactgggcagttaccgcggcaacaagctggaatcggaacacctgttcctcaccggcatgttttcactgctggacgtgctgctcaatgttcccttccccgatgtgctcgacccgctggagctgccgttgacggtgcgcgaggcggtggtcgagcaaaagggcatcttcgctccctatctcgcgctggcattggcttgcgagcatggcgacaacgtccagatcgaggccctggccagggtgctggatttcgacctcgacctcgccaaccagtactacctggactcggtggtgtgggcgcaggtggtgctgcgcgacagcgaggtccacaacaacgtcgaagccgtttga

SEQ ID NO: 1206 - DNA, 1101 bp, Chromobacterium substugae
atgtctggcaatagcatggggcgcttgttcacggtaacttccttcggcgaaagccacgggccagccataggctgcgtggtggacggctgcccgccgggcctggcgctgaccgaggccgacatccagctggagctggaccggcgcaagcccggcaccagccgccacgtcacgcagcggcgcgagccggacgcggtggaaatcctgtccggcgtctacgagggcaagaccaccggcacgccgatcgcgctgttgatccgcaataccgaccagcgcagcaaagactacggcaatatcgccgacaccttccgccccggccatgccgactactgctactggcataaatacggggtgcgcgatccgcgtggcggtggccgctcgtcggcgcgcgagacggcggtgcgcgtcgccgccggcgctatcgccaagaaatggctgagcgagaaatacggcatcgtcattcgcggccacatgacccagatcggcgaggtggccatcccgttcaaggggtgggaacatgtcggcggcaaccccttcttcagcgccgatccggacatcgtgccgcggctggaggattacatggacagcgtgcgcaagagcctggactccatcggcgcgcgcttgcgcgtggtggcggacaatgtgccggtgggctggggcgagccggtgttcgaccgcctggacgccgacatcgcctacgcgatgatgagcatcaacgcggtcaagggcgtggagatcggcgccggcttcggctgcgtggcgcagcgcggcagcgagcacggcgacgagttgacgccgcagggcttcgccagcaaccacgccggcggcgtgctgggcggcatctccaccggccagcagatcgacgtctccatcgccatcaaacccacgtcgtccatcgcccagccgcgccgctcgatcaacaagcaaggcgaggcggtgacgatggaaacccacggccgccacgacccttgcgtcggcatccgcgccacgccgatcgccgaggcgatgctggccttggtgctgatcgaccacgcgctgcgccaccgcgcgcagtgcggcgatgtgcgggtggaaacgcccagaattgccgggcgcatcggctag

SEQ ID NO: 1207 - DNA, 1419 bp, Chromobacterium substugae
atgagcgcatcgacacaagcattggcccgcaagctgggcggctggcaactatgggggatcgcggtggggctggtgatctccggcgaatacttcggctggagctatggctgggcccaggccggcacgctgggatttctctgcacctcgctgttcgtggccctgatgtacaccgccttcatcttcagcttcaccgaactgaccaccgccatcccgcatgccggcggccccttcgcctatgcgcgccgcgccttcggtccgctgggcggcttcatcgccggcttcgccacgctgtgcgaattcgtgttcgcgccgcccgccatcgcgctggcgatcggcgcctatctgaacgtgcagttccccggattgcaagccaagtggaccgcctgcggcgcctacctggccttcatggcgctcaacatcgccggcgtcggcatcgccgccgccttcgagctgtgcgtcacgctgctggccatcttcgaactgctggtgttcatgggcgtggtggcgcccggcttcgactgggccaacttcacccgccacggctgggccagacaggacgggtttcattggggcgcggtcggcggcatgttcgccgccatcccgttcgccatctggtttttcctggcgatagaaggcgcggcgatggcggccgaagaggccaaggacccggcccgcaccataccgcgcgcctacatcgccggcatcctcaccctggtggcgctggctttcggcgtgatggtgatggccggcggctccggcgactggagcctgctggccaacatcaacgacccgctgccgcaggcgatgaagctgatcgtcggtgagcacagcagctggctgcacatgctggtctggctgggcctgttcggtctggtggcctcgttccatggcatcatcatgggctattcgcggcagatcttcgcgctggcgcgcgccggctacctgcccgcctggctggcggcggtgcatccgcgcttcaaaacgccgcatcgcgcgatcctggccggcggcgccgtcggcatcgccgccattttcagcgacgacctggtgcagatcgccggccagccgctgaccgccaacatcgtcacgctgtcggtgttcggcgccatcgtcatgtacatcgtttccatgctggcgctgttccggctgcgcggccgcgaaccggcgctgttccggccgttctccgcgcccgcctatccctggctgccggcgcttgcgctggcctgcgccacggtgtgcctgctggcgatggtgcgctacaacctgctgctggcggcgatttttgctgttacgctgctgctgggcttcgcctatttcctgctgacgcgcaagcagcgcgacgcggccggcggcgacgccatgctggaggggacggccgacgccgcccccgcgccccaatccgcccgagcgccgacatga

SEQ ID NO: 1208 - DNA, 1383 bp, Chromobacterium substugae
atgagccacgccatcaccgtaggaccgcgccgttaccgtttcgacgacctgaaaaccctgctggcgcgcgccagccccttccgctccggcgaccagctggccggcgtcgccgccgccagcgccgaggagcgggtggcggcgcagatgtgtctggccgacctgccgctgaccgtctttctcaacgaggcgctgatcccgtacgaggaagacgaggtcacccggctgatcctggacagccacgacccggccgccttcgccgccgtatcgcatctgaccgtgggcggcctgcgcgactggctgctgtccgacgccgccaccgcggaaacgctggcggcgctggcgccggggctgacgccggaaatggcggcggcggtgtccaagctgatgcgcaaccaggatctggtgcaggcggcgaagaaatgccgcgtcgtcaccgccttccgcaatacccagggactgcccggccgcatgggggtgcggctgcagcccaaccatccggccgacgacgcgcgcgccatcgccgccgccacgctggacggtctgctttacggcgccggcgacgcggtggtgggcatcaacccggccggcgacagcccggacgacatccgtaccctgctgaccctgctggacgaagtgcggcagcgctacgcgatcccgacgcagagctgcgtgctcacccacgtcaccagcacgctggagctgatccgccaaggcgcgccggtggatctggtgttccagtccatcgccggcagcgagaaagccaatgccggtttcggcgtcagcctggccgtgctggacgaggcgcatcaggcggcgcgggagctgaagcgcggcacggtgggcggcaacgtgatgtatttcgaaaccggccagggcagcgccttgtccgccaacgcccactggggcgtggaccagcagacctgcgaggcgcgcgcctacgcggtggcgcgccgctactcgccgctgctggtcaacaccgtggtcggcttcatcggcccggagtatctctataacggcaagcagatcatccgcgccggcctggaagaccacttctgcggcaagctgctgggcctgccgatgggctgcgacatctgctacaccaaccatgccgaggccgaccaagacgatatggacgcgctgttgacgctgctgggcgcggccggcgtgcatttcatcatcggcgtgcccggcgccgacgacatcatgctgggctaccagagcacctctttccacgacgcgctctacctgcgcaatgtcctgggcctgaagcgcgcgccggaattcgaagactggctggagacgatggaaatcacccgcggcggcaagctgctgccgcaggacaaacggcagcggctgctggccttgatggagagcgtggcatga

SEQ ID NO: 1209 - DNA, 798 bp, Chromobacterium substugae
atgaaggacaagaacccgatcaccgaggacggctggggcgagctgtctcggctgaccgccgcccgcatcgccctaggccgagccggcaacagcctgccctgccgcgaaaccttgcgcttcgccctggcccacgcccaggcgcgcgacgcggtacacacgccgctggatgtgtcggccttggccggcgaactggcggccgacggccatcgcgttgtcgaaatccacagcgcggcaagcagccgcgccgaatacctgcagcggccggacttgggccgcaggctggacaacgccagccgcgaacagctgctggcggagcaggacaaaggctgcgacctgctgattctcatcgccgacggcctatcctcgcgcgcgcccgcccaacacgcggttccgctgctgcgcgagctgctgccgcgggtgcgggagctgggcctgaacgtcggcccgctgctgatcgcgcgcgaggcgcgggtggcgctgggcgacgaggccggggagatcatgcaggcgaagatgacggcgatgctgataggcgaacgccccggcctgagttcgcctgacagcctgggcctctatctgaccgccgcgccgcgcgccggccgcagtgacgccgagcgcaactgcgtgtccaatgtgcggccggacggccttccctacccgctggcggccttcaagctggcctggctgataaacgccgcgctgcgccagcccaccggagtggcgctgaaggatggcagcgcaacagatccgcgctgggcggcgctgttggcgagacaggcctgcctagtcaaagactga

SEQ ID NO: 1210 - DNA, 630 bp, Chromobacterium substugae
atgactgcgctgcaattcgaactcgaagccgtactcgacaccctggcagatcagggctggatcgtcattccccatgccttgtcggccgaactggtcgccaatctgcgcgacgcctgcctgcaggtgtgggacgagggacgcttccacgaagccgccaccggccgcgccggcggccaggcgcgccgcgccgagatccgctccgactcggtgctgtggctggaccaggtggccgagctgccggcggtgctggcctacaacgccgcgatggatgagatcatgctggcggtgaaccgcggcctgtatctgggcctggtcgagttggagtctcacttcgccgtctatccggaaggcgcgttctacaaaaagcatctggaccgtttccgcgacgacgacgcccgcgcgctgaccacggtgttttacctgaatgaaaactggccggccgatggcggcggccagatccgcctgtacctggacgacgcctgcgagcggttcatcgatgtggagccggaagccggcaccctggtgctgttcctggccgaccgtttctggcacgaggtgctgccggccaagcaacagcgtttgtcggtcaccggctggtatcgccgccagggcggcagtttgccctggtga

SEQ ID NO: 1211 - DNA, 1224 bp, Chromobacterium substugae
atgggagttgggccgtattcccaaacggtcgctttctcacattacaataatctgtcggcgcaattgccggtggatccgatgaccgggaagctggtggctggcggcgcgaaagaacaggctgaacagtgcttcaggaatatcaaggcgattatcgaaagcatcggccatgtaatggatgatgcggtcagaatcaccatttttctgaaggatatctcggatatgcatagcgtaagcgatgtctattcgactttcttccagaattatgtccccactctgacggtagccgcggttgccgccttgcctctggatgccttggtgcaagtcgaagcgttgctttccaatggcgagggcaccattcccaatgcgccgcaggctggcgatctggtcaaaatcgccagcaatacgaaccaggcgccgaccagcgcgctgtctactcaatcggtggccttttcccattacaacaatatctcggcgcaattgccgattgatccccaatccggaaagctggtggccggcggcgccagggagcaggctgcccagtgcttgcaaaacatcagggcgattctggaaagcatcgccgttccgtttgacgacatcgtcaaaatcaatatcttccttaagaacctgtcggatatcgagcaggtcaacgcggcttaccgcgcgtttttcccggattcggctatcgcccgggcggtggcttatgtgccggctcgcaccgtggtcgaagtcgccgcgctgccgatggacgccctggttcagattgaggcggttgtgtcgcatggcgacggcacgccgccgcaagcggttgaagatcggcacggcattgtgatcaaggcgcataacaccgaaaaagctccccgatgcgcgcttgccacgcaaacggtggctttctctcattacaaccatctttccgctcagctgcctttgaacgcagagacgaatgaaatggtggtcggggatgtgagagagcaggccagacagtgtctgaaaaacatcaaagccatcgtggaaagcgtgggccacgcgatgagcgatgtggtgaaggtcaatattttcctgacgaacatcgccgagatcgatgcggtcgacgaggtatacgcggcattcttcccgggcggcgttcccgcgcggaggaccgtgggcgtttcggctttgccgcgcggcgcgatgattcaaatcgacgcggtggtagccaatgccgagggcacgccgccgcaagcctaa

SEQ ID NO: 1212 - DNA, 921 bp, Chromobacterium substugae
atggagaaactgcagcaagacctgtttgtgccggtgggagacggcgagcggctgtatctgaagcgcatctgcggccgcgaaggcggcgcgccggtgctgatggtgcacggcgtgatggccaatggccgcaccttttatactgaatccggcaaggggctggcccatttcctggccgatgccggctacgacatctatgtggccgacctgcgcggccgcgggcgcagcacgcccaagatcggcccggacagccgccacggccagaccgaaaccatttgcgaggacctgccggcgctgcacgatttcgtccgcaggaaaagcggcggccagcaggtgcattggatcgcccactcctggggcggcgtgcacatgacgagctgcctggtgcgcttccccgacattgccgcccaggtggcgagcgcggtgtatttcggctccaagcgcagcgtgcgggtgcgcaacctgaacaagctgatcgaggtagacttcatgtggagtaccgccgtgcgttggctgatcaaggcctgcggctacctgccggcgcggcgcatccggttgggggccgacgacgagagcgacaagagccatctgcagagcaagctgtgggccgagcccaagccgtgggtggatagcgacgacggcttcgattacgccgccgccgcgcgcgccggccatctgccgccggtcctgtattttgccgccgccaacgatccctgccgcggccatccggaagacgtgcgccgcttccgcgacgaatccggcccgcatctgtcgcggctgcacctgttggggcggcgcgccggccatctgcacgattacaaccacgtgtcgctgctgacccacccggacgcgccgcgcgaccatttcccgctggcgctcgactggctggcgggccgctatgacgcggtggcggagaattattga

SEQ ID NO: 1213 - DNA, 1176 bp, Chromobacterium substugae
ttgctgtcgtcttttttattgtctttgtcgcgcgcggtcatcatgccgttgctggtgctgactttggcgcgccagcttggtttgtccttgcaggccactggcggcttgctgggagcggtgttgctggcttcggcgctgttcgggctatacggcggctactggctggaccggctgccgcgcggcccggccttgcgcgcggcggcggtgctgatggcgctgggcagcgtgctgctgccgtacggccggggctacacgctggttgtggcggcgctggcggccggcgaattggcgatgaccctgtacggcatcgcggtgaaggcgatattgagcgatctggtggcggcgccgcagcgcgccagggcgttttcgctgcgctacacgctggccaatgtggcgtgggcggtggggcctctgttatgcagcggcatgcttatgtggcgggagctggcgccgttctggctgggaggcgcgctggcgctggccggattgctggttcagcccaggctgccagccgcggccagggatgcgtccgagttgcccgacggttttgccgcaaccgtgcgcacgctggccggcgatcgggtgctggtgtggtttactttgagcagcttgctggcctacgtggtgtatgggcgcttctccagctatctgccgctatatctgctgacgcggatgggcgaggccgaggcgatgcgctggatgtcggcgctgatcagctgcaacgcggtcgtggtggtgctgctgcaatatccgctgggacgctggctgcaacccaagcggctggtgcacgcggtggtggggggctttctgctgataggcgccggcatgctgtggctgggcggcgtggacagcttgccttggatgtgcgcggccatcgcgctgttcacgctgggcgaggtggtgctggtgccggccgagtatctgtacatcgacgccatcgcgccggaagccttgaagggcagctattacggcgcgcagaatctggcctcgctgggcggcgcgcttgggccggcgctggcgggcgcgttgctggcgcatgggccggcctggacgctgttcgcctcgctggcgctgttgtgcgggctgggcgcgggactggccgtcttcagcgaacggttgcgcttgcggcggcaggatgcgggtgcggcttttcctttgccgggttctttgtcatga

SEQ ID NO: 1214 - DNA, 1659 bp, Chromobacterium substugae
atgaggctgcaacaacagtaccagcggctctacctggcctatggcgacgcgccggcgcagcccggcctgccgcaattggccgaactgtggcaatgcggcgagcgcaatgcgcggctgcaactggccaggatgcgcgagctgggctggctggcgtggcagcccggccgtggccgcggcaagcgctccaccctcaggctgctgcggcggcccgacgaactggaatggcagcgcctgcagcggctgctggcgcgcggccagctggagcaagccttctcccagttggagccggcgcggcagcagcaactgctgtccgccctgcccgcccacctgggcgccagcgacagcggccgcagcctgcgcatccccatcccgcacgcgccgttgacgctggacccgcagcaggtcaactcccggctggaagcgcacctggtgcggcagatcttcgaccgcctgtgccgccacgacaagcagggccgggaattgcggccggcgctggcccacagctgggaaagcggcgcggcaggccggcgctggcgcttctggctgcgccctggcctgcgcttccacgacggctccgcgctggatgcggacaccgccgccgcaagcctgctcaggctcaagcaagcggacaatccctgccaggcgctgtacgcccatctgctgcaagtggatgtccacgacgcgctgtcgttcagttgccagctggcggaacccgaccaactatggccgcagcggctggccgccgccaacgcgtccatcgtgccgctgcggcgcgacgccgacttcgcgcgcctgccggtgggcagcggcccgttccgtgtcgagctgcacagcccgcagcggctgaagctggccgcttacgagcagcactaccgcgagcgcgcgctgctggacgcgatcgagctgtggatcatcccatcgccggacgagcaggatttccatctgcggctggaatacggcaaccagcgcggcgccaccatgctgcaatcggcctgcacctatcttttgctgcgtcccggcggcgcgagcatccccgacggccaacgcctgccgctgatgagtttcctcgccgcgccgcacccggtcgccgccagcgaggagcgcgcgccggcgctgggcttgcagccaggctggatccatccacgcccggccgctgccgcgccgccccggttgagccgcggcaagctgacgctgtttcattacgatctgccttgcttcccgccgttggcggcggcgctggcggaacggctgtctgcgctggagatcaagctcgacatccgctgcctgacgcgccgcgacttcttcaactccgccgcctggctcgaacaggccgacctgatcttgtgcagcgagctgctgcacgacgaccgcgactacggcatgttcgaatggctgagcggctgcagcacgctgcagcttggcctgtcccccgccgcctcaagccgcttggccggcgacatgcgcggcctgcaaggcgaagcggcgttcgccgcgcgcgaggacggctaccgccgcgccggcgactggctggtggccgaaggctggctgctgccgctgtcgcacgagacgctgggccacgacgccagcccgcaactggccggcctgcagctgggcggcaacggctggaccgacttcgccggcctgtggctgcgcggctga

SEQ ID NO: 1215 - DNA, 426 bp, Chromobacterium substugae
atgagcatgctgcctgcccgccatagcctgtttgacgagtttttccgcgacttcaccccgggtttcttcatcaagccgctgcatggcgacgcgccgccggcgcagatcaagatggacgtcagggaaaccggcgaggcttaccaggtggaggccgaactccccggcgtcggcaaggaggacatccatgtcgagatcgacggcgcgctggtgacgatccgggccgaagtcaagcagttcgaccagcaaggccaggacgagcgcgcgctgcgcagcgagcgctactacggcctggtgtcgcgcagcttccagctgccgcaggaaatcgaccgcgaagccgcggcggcccgctacgaaaacggcgtgctgaacctgacgctgcccaagcgccgcaacggcggcggcggccagcggctgcgcatcgaataa

SEQ ID NO: 1216 - DNA, 2619 bp, Chromobacterium substugae
atggcccagcagccagaagtgaagtaccgcaaggattaccaggccccggccttcctgatcgaccgcgtcgacctggtgttcgacatcgaggacaacgccacccgcgtgcactcgcggctggtgatcacccgcaacggccagtcgcaggccgccgacctggcattgagcggcagcgccaagctgctgagcgtgacgctggacggcgatcggctggacgacagccgctacgcgttggccgacgacacgctgacggtgcgcggcgtgccggacagcttcatcctggaggtggagaccgagctcgatccggccgccaacaccagcctgatgggcctgtacgcgtccggcggcaatctgttcacccagtgcgagccggaaggcttccgcaagatcacctactatctggaccgtccggacgtgatggccaagttcaccaccaccatcaaggccgacaagcagaagtacccggtgctgctgtccaacggcaacaaggtgggcgagggcatggtggacaagaagcgccactgggtgaaatgggtggatccgtaccgcaagccggcgtatttgttcgcgctggtcgccggcaagctggtggccttgaaggataagttcaccaccatgcgtggccgcgaagtggcgctggagatctggaccgaaccggccgaccaggacaagacccagcacgcgatggactcggtccgccactcgatgaagtgggacgaggagcgctacggcctggagtacgacctcgacatctacatgatcgtcgcggtcggcgacttcaatatgggcgcgatggagaacaagggcctcaacatcttcaacaccaagtatgtgctggcgcgccaggacaccgccaccgataccgatttcgaaggcatcgagcgggtgatcggccacgagtacttccataactggaccggcaaccgcgtcacctgccgcgactggttccagctgagcctgaaggaaggcctgaccgtctaccgcgaccaggaattcggcgccgacatgaacagccgcgcggtcaagcgcatcgaggacgtcaagggcctgcgcgtgtcgcagtttccggaggacgctggcccgaccgcgcacccgatccggccggacagctatatcgagatgaacaacttctacaccatgaccgtgtacgagaagggcgcggaagtggtgcggatgtacgaaaccctgctgggccgcgacggcttccgcaagggcatggacctgtacttcaagcgccacgacggccaggcggtcacctgcgacgatttccgcgccgcgatggccgacgccaacgacgcggatctggaacagtttgcgttgtggtacagccaggccggcacgccgcgcctggcggtgtcgtccagctacaatccggccgagcgcagctacaccttgacggtgaagcaaagctgcccggccacgccgggccaggagcgcaagctgccgttccacatcccgctggcgctgggcctggtgggcgcagacggcaaggacctgccgctgcgcctgaagggcgaggccgaggcggccggcgcttcgcgcgtgctggacgtcaaggccgccgagcagagcttcaccttcgtcgacattccggccgagccggtgccgtcgctgctgcgcggcttctcggccccggtcaagctggaatacgactggcgcgacgaccagctggtgttcctgatggccaacgacagcgacagcttctgccgctgggaggcgggccagaccttcgccgagcgcctgttcaagcaactgatcgccgacgccgccgccggccgcgaattgaagctgtcggaaaccttcgtcgccgccttccgcgcggtgctgaaagaccatgctgccgatccggccttcaaggcgctgatgctgacgctgccgagcgaggccgaaatcctggaaatggtggatgtcgccgatccggcggtcatccatcaagtgcgcgatttcgtgctggaccagctggcgcaagcgctgcgcggcgaatggcgcgaggcttacgagctcaacctcacccgcgactacaagccgcaggacgccggcaagcgcagcctgaaaaaccgcgccttgtggatgctgaaccggctggacgacgcctggccggcggagatggcggccaagcagtgtctggacgcggacaatatgaccgaccagatgggcgcgctgctggcgctgcgcgaccgcgacggcgaggagcgcgacgcgtgcttcaccgctttcgccgcgcgctggaacgatgacgcgctggtgatggacaagttcttcagcctgatcggcggcagccagctgcagggcaccttgcagcatgtcgaagcggcattggcgcatccagccttcagcatgaagaaccccaacaaggtgcggtccttgttgggcgctttcggcggcaatatggcagtgttccacgccgcggacggcagcggctatcgcttcctggccgaccgcatcctggagctggacccgatcaatccgcagggcgccagcggcctgacccgcgccttccgccggctgaagaagctggagccgggccgccaggcgctgatgcttgagcaattgcgcaggatggagaaggccgaattgtcgaaggacgtgtacgagatcgtatccaagatcttggcttga

SEQ ID NO: 1217 - DNA, 114 bp, Chromobacterium substugae
atgacaaaccgtggcgacttgaactttttccccgcatcccaatctgcagagaagaagtcagccgcggggaaccgatctatttcaaagttgaaccaggtgcttgacctgtactga

SEQ ID NO: 1218 - DNA, 1425 bp, Chromobacterium substugae
atggaaacgcaatccacttataactataaggtggtgcgccaatttgccatcatgaccgtagtttggggcatagtcggcatgttggtgggcgtcatcattgcggcccagctggtatggcccgagctcaatttcgggccctggttccacttcggccgcctgcgcccgctgcacaccaacgccgtgatcttcgccttcggcggctgcggcctgttcgccacttcctattacgtggtgcagcgcacctgtaacgtccgcctgatttccgacaagctggccgccttcaccttctgggcctggcagctggtcatcgtgctggccgccatcaccctgccgctgggcttcaccttcggcaaggaatacgccgaactcgaatggccgatcaagctgctgatcgccgtcacctgggtggtgtacgcgatcgtgttcttcggcaccatcgccatccgcaaggtcaagcacatctacgtggccaactggttctacggcgccttcatcctggcggtggcgctgctgcacatcgtcaattccgccttcgtgccggtgacgctgtggaagtcctattcggtctactccggcgccgtcgacgcgatggtgcagtggtggtacggccacaacgcggtgggcttcttcctgaccgccgccttcctcggcatgatgtactacttcgtgcccaagcaggccggccgcccggtttactcctaccgcctgtccgtggtgcacttctgggcgctgatcttcacctatatgtgggccggtccgcaccacctgcactacaccgccctgccggactggacccaatcggtcggcatggtgttttcgctggtgctgctggcgccgtcctggggcggcatgatcaacggcatcatgacgctgtccggcgcctggcataagctgcgcaccgacccggtgctgaaattcctggtggtgtcgctgtcgttctacggcatgtccaccttcgaaggcccgatgatgtcgatcaagaccgtcaacgccttgtcccactacaccgactggaccatcggccacgtgcactccggcgcgctgggctgggtgggcttcatcaccatcggctcgatgtactacctgattccgcgcctgttcggccgcgattccatgcacagcgtcaagctgatcgaagcccacttctggctggccaccgtcggcgtggtgctgtacatcgccgcgctgtggatttccggcgtgacccagggcctgatgtggcgcgcgctgaacccggacggcacgctgacctatgccttcgtcgaagcggtgaaagccacctacccctaccacttcgtgcgcttcctgggcggcgccctgtacctgtccggcatgctgctgatggcttacaacaccttccgcaccgtctcctccggccgcgccgtggatgccaagattccggccctcaccgctgaagcccactaa

SEQ ID NO: 1219 - DNA, 615 bp, Chromobacterium substugae
atggacaaaatccagaaactgatcgaagaacacgtgggctggctgatcgtgctgaccctgctggtggtaagcgtggcgggcctggtggaaatcctgccgctggcgttccagaaatccgtcaccgagcctgtcgccggcgtcaagccctacaccgcgctgcagctggccggccgcgacatctacgtgcgcgaaggctgctacaactgccactcgcagatgatccgcccgttccgcgccgaaaccgaacgctacggccactactcggtggccggggagtcggtttacgaccacccgttccaatggggctccaagcgcaccggccccgacctcgcccgcgtgggcggccgctattccgacgaatggcaccgcgtgcacctgaacaacccgcgcgacgtggtgccggagtccaatatgccggccttcccatggctggccaaaaacctggtagacgccgaggtgatgccgctgaagatggaggcgctgcgcaaagtgggcgtgccgtacagcgacaaggacatcgccgaggccaaggctcaggtcgagggcaaatccgaaatggatgcgctggtcgcttacctgcaaggcctgggccttgcgctgacgaataagcgctga

SEQ ID NO: 1220 - DNA, 156 bp, Chromobacterium substugae
gtggtctgcttcgcgttcttcatcgtggtgctgatcatcgcctacagcaaacgctccaaaggccgctatgaggaggcagccaacctgcccttcctcgacgacgacaaggtgcaggaagccggccaggagcaggcttccaacggagcaagaaaatga

SEQ ID NO: 1221 - DNA, 930 bp, Chromobacterium substugae
atgaatcaatacctgagtgatttctggagcatctggatttccgtgatcgtgctggggggattgatctggctgaccctgctggtgttcacccagtccaagaccacggtcaagaagggggaagaagtcgaaatcaccggccacgtctgggatggcgacctggccgagtacaacaatccgctgccgcgctggtggatgctgatgttctacatcacgctgctgttcgccatcgtctacctggtgctgtacccggggctgggcaacttcaagggcctgttcggctggacatcggtggatcagtacacggtggagcgcaacaaggccgaagccaaataccgcccgctgtacgacaagtacctgaaacaggacctgaaaacggtggccgccgacccgcaggcgcaggaaatgggcaaacgcctgttccagacctactgcgtgcagtgccacggcgccgacgcgcgcggcgccaagggcttccccaacctggtgaaccatgactggctgtacggcggcgaaccggccaccatcaagaccaccatcatgggcggccgccacggccagatgccggcctggggcgcgacgctgggcgaggaaaaggtcaaggacgtggccaactacgtgctgtcgatctcggccaaagcccgcaagtacgacgccgaacgcgccagccgcggcaaggaaaccttcgccgcgctgtgctcggtctgccacggcgtggacggcaagggcaagcaggaaatgggcgcgcccaacctgacccacccatccggcagctggctgtacggcggcaccgagaaggccatcatcgaaaccatcaccaatggccgcaacggccagatgcccgcctggaaagacttcctcggcgaaggcaaggtccacctgctggccgcctacgtctggagcctgtccaacaaccccaaagccccgcaataa

SEQ ID NO: 1222 - DNA, 1434 bp, Chromobacterium substugae
atgtcagactcgttgaagaaaatcccgatcaaggttgaaaacagcggccaggacaccgccaccgtctcgctgtacgaggctcagaagaaaatctacccgcgcgcggtcaaaggcgtgttcaacaacctccgcatcctgttcgtcgtcggcacccagctgctgtacctcggcctgccctggctgcaatggaacggccgccaggcggtattcttcgacatggtcggccgcaaattctacctgttcggcctcaccatctggccgcaggacttcgtctatctcgccgcgctgctgatgtgctgcgccttcggcctgtttacctggaccaccatcgccggccggctgtggtgcggctattcctgtccgcaaacggtgtacaccgagatcatgctgtggatagagcaatgggtggagggcgaccgcggcaagcgcatgaagctggacgccgcgccgatgagcctggccaaattccggctgaagttcaccaagcatttcatcatgctggcattctcgctgtggaccggcttcacgctagtcggctatttcacgccgatacgcagcctggtggccgccattcccagcttcggctacggaccgtgggaaaccttctggatgttcttctacggcggcttcacctatctgttcgcggtattcatgcgcgagcaagtgtgcaaatacatgtgcccgtacgcccgtttccagagcgtgatgttcgacgcagacaccctgatcatctcctacgacgaggcccgcggcgaaccgcgcggctcgcgcaagaaaggcgccgatccaaaagagcagggcctgggcgactgcatcaactgcagcatctgcgtgcaggtgtgcccggtgggcatcgatatccgcaacggcctgcaatacgagtgcataggctgcgccgcctgcatcgacgcctgcgacgacgtgatggacaagatgagctacccgcgcggcctgatccgctataccacggaaaacgcgctggaaggcaaatatccggaaaaagccatcccctcgcggctgaaacgcccgcgcgtggtgctgtacagcctggtgttgctcatcatatttaccgccgccatcacctcgctggcgctgcgcaagccgttcaaggtggacatcatccgcgaccgcgcctcgctggtgcgcgaaaccgacgagggctggctggagaacacctatatcgtcaagatcatcaacaccacggaacaaagccagcgcttccgcatcacagccgaaggcctgcccggcatccgcgccaaggcggaaaagccggaaatccgcgtcgacgccacccagaccgaagccgtcaccgtccacgtggaggccgacccgcagtacgcgaccaagggcagccacccgatccgcttcgccatccagtccatcaacaacccttccctgcgcgtggaagagaagtccagcttcatcggagagtaa

SEQ ID NO: 1223 - DNA, 531 bp, Chromobacterium substugae
atgcaacacaccgcccacccgccccgcccctggtaccgcgaaccctggccgtggatcctgttcggcatcccgctggtctccatcatcgtcggcatcggcttcctcgccgccgccatcaagtcggacgacggcctggtgaccgacgactactacaagaagggcaaggccatcaatatggagctgcggcgcgacaaggccgccgcgcggatggggctgaccgcgcaattgatgctgggcagcgacggccgcagcctgcgcctggtcaccagcagcaaggcgccgctgccagacaccatcgcgctgagcatgatccacccggcgcaggacgactacgacctgtccgccgaaatgacgctggccggccccaatctgtaccagggcatcctgcccaagacgccggtcatcgccaaccactggtacatccagctggaagaccacgccaagacctggcgcatccagggcgagtggaagcccggcgaaggcccgatggtgcagctgggccagcccaagctggagccggccgccaattaa

SEQ ID NO: 1224 - DNA, 1206 bp, Chromobacterium substugae
atgtccgcggtttcttccctttctttatggcggcagccggtgttcgccggcctgttcgcttccaccgcgctgctggcgctgggcggccagatctatcagctggccctgcccttgatcctgtacgagctgacccattcgctggcggcgatgagcaatctgcgcgcggtggagtttttgcccaatctgctgctggcggcggtgatcggcgtgtgggtggaccgggtatgccgccgccgctgggcgcagcgcgccttgctggcgatggccgcgctgctgggcgtttgcgcgctggcgctggccggcggctggatggccgcatggctgttctatccgctgaccttttgcgtgatgctgtgcaactacgtgaccgccatctgccggatggcgctggtgaaggagagcgtgccgccggcgcagctggtgcaggccaatggttatctgggcagcttgttcgacgtgttcgccgtcagcggtccggtgttgtccggactgttgatcgcctgggcgcgtccgcattggagcctgggcgtgccggcgctgatgtttttgttgtcggcgctgctgatggccagggtgccggcgccagggcggggacaggccggcgagcggcgttttggggcggaattggccgccggctggcgggcgctgcgcggcaatccggcgttgtggcagctgagctgggtggtggtgctggccaatggcgcggcaggcgtcgccgaggtgttgtttctgttccgcgcccgcgaccagctgggtttttcgcccggccagttggggctgctgttcggctgcgccggcgcgggcggcatcgcggcgggcttgtgcgtggcgcgggtgcgcaaggcgctgggcctggggcggatgatctgcctggctttgctgttggaggcggccggcatggcggcgcaggcgtggcttggcgatctgcgctggctggcggcggcgatggcgctgcagagcttcgcggtggtgtgcggcaatgtcggcgtgtggagctaccgccaggaggcgacgccgacggcgctgatcggccgggtgtccggcctgaccggttccttgttcaagctgctgatgccgctggcgctggttttgggcggcgcgctgtcggcggacatgccgctgcgggatttgatgctggcgacggcggtctggcaggcgggggcggcgctattgtgcgggctgagccgggtaaggacgctggtctga

SEQ ID NO: 1225 - DNA, 1677 bp, Chromobacterium substugae
atgcgcctgctccaacactaccagcgactgagcctggcctaccccgcccacgacggcccggcgcggctggccgacatcgccgccgccctgcattgcagcccgcgccacgcccgcgaactgctacagagcatggcggataacggctggctgcgatggcagcccggccaggggcgcggccatgcgtcgcggctgcggctgctggcgccggccagccagcttgaaagggaagcggcgcgcgggttcctggccaacggcgacatcgaaaaagcgatgcggctgctgcccgccgccgcgcgccgccaaatcaccgaattgctgccggcctatctcggcgtcgccccgtccgaaccgcagacgctgcgcctgcccttctaccggccgctgcacagcctggacccggtccagatcaaccgccgcaccgagtgccacctgatccgccagattttcgacggactcacgcgctacgaccgcgcgcgggggcaaatcgtcccggcgctgtctcatcattggcgccatgacggcgaatggcgaaactggcgcttccatctgcgccccggcgtcgttttccacaacggccgcgcgctggatggcgaagacgtccgccagacgctgctgcggctgcgcgacgaggccggcccgcatcagcgcctgttcgcgcatctggctgatgtgaacctgccggcgccgctgaccgtccacatccgcctgacccgccccgatgctttgttgccgcggcggctggccgacagcgccgcctccatcctgccgcgggaatgctggccgcaagccgatttcggccgcttccccatcggcaccggcgcattccggctggaagccaacaacgactatcgcgccacgctgcgcgccttcgaccgccactggaaggaaaggccgctgctggacgcggtggatatctgggtggtggacgatcccgaggtgaaggccaggctggacgcgcgcttctgccatcccggcgaaccgggcggccaaccgtcgctgcgccggctggaggctggctgcagctatctggcggcgaatccggcccggctggactctgttcaacggcgggcgctggccgactggctgcatccggccgtctggcaggccccgctgcccggcgaagcggcgctgggcatgctgccgcaatggcggcaccggccggcgcccatccagccgccggcgcctcggctgccggcgacgctgcggctggccacctaccagttgcccgaccatatcgagctggccgaggcggtggcgcgccggttgcgggacgccggctgccgcatcgagctgacggtgatgccctaccccgacttcgcccgctgcgactggctggacggcgccgacctgctgctaagcggcgaagcgatggccgacgacgtggatttcggcgtctatcaatggctgtgccaggacgccggctaccactgctggctggaagcggcggcccggcacagaatgcgcgcggcggaacaacaactggcgatggagccggacgccgaacggcgctggcagggctatgaggcgctggcgcgcgcgctggtggcggaagccagcctgattccgctgcgccaccatgaacaggcgatggcgttcgcgccgcaattgcaggacgtcacgctggcgcagtgcggctggatggatttcgaccaggcctggctggccgcgccggattga

SEQ ID NO: 1226 - DNA, 345 bp, Chromobacterium substugae
atggccggcgcgagcgagccgctggccggctacgcgcgggcgatcatgggcggcgccggcgccgagcgcatcgtcggccgcgaagataagcaggacagctggcgcgaggccgactgcgaggtgacgctgcgggagcgggtgtaccgcttcgacaacggcgtggcgatccgccgcagcatagaggtggacgattaccccagcgagctggtctgcgccgagagctggattacctatgaagtattggagctgggcggctcgcccgggatagagccgatgcgcaagagtttcgacaacggctgccgcgaggctttctggctgcgctaccacgcggacctgtcgatctga

SEQ ID NO: 1227 - DNA, 477 bp, Chromobacterium substugae
atgtttgaacgtttgcggcagctgttgacggctgggggcgcccgctaccgggtgatcgagcatccggccgagggcaattcgcgcaaggtggccgatgtccgcggcaccgaggcgggtcagggggccaaggcgatgctgtgcaaggtggcggatcagaccggccaattcgtgctggcggtgctgcctggcgacgaacgggtggatttcgccaaggtggccgccgccatcggcgcgcgcaaggtgaagctggcggacgcggccgaggccgaagcggccaccggctgcgtgatcggctcgattccgccgttcagcttcagcccggtcatccggctggtggtggatccgcagctgctggcgcgttattcggagatcgcgttcaacgccggccggctggacgcgtccatcgtgctgaacggcgacgattaccgccggctcgcgcaaccgctgctggccgacatccgcaaggagagcgcctga

SEQ ID NO: 1228 - DNA, 576 bp, Chromobacterium substugae
atgctcaaactcaatctcggctgcggccacgaccggcgccccggcttcctcaacgtcgactcccaggcggcctgccaccccgatctggtggcggatctggaacagtttccctggccctgggacgacaactcggtggacgagatcctgatgagccatgtgctggaacacctgggcgccagcagcgcaacctatctcggcatcatcaaggagctgtaccgggtatgcgcgcccggcgcgctggtcaccatcatcgtgccgcacccgcgcagcgacaactacctggccgaccccacccatgtgcgccccatcaccgcggccggcctgcacatgttcaaccaggagctgaaccggcaatggatggccgaaggcagctccaacacgccgctcggcgtttacctgggcgtggattgggtgatggagtcatcggacgtgaagattctggagccctgggccacccgcttcaacagcggccaggtcaatgaaggcgacatcagcatggcggtgcagaacttcttcaatgtgataggcgaatgcaccttccacatgcgcatccgcaaacccgccaccgccatttga

SEQ ID NO: 1229 - DNA, 621 bp, Chromobacterium substugae
atgtcgaaagagcttgtcttctataccaacccgcaatcgcgggccaatatcgtgcactggatgctggaggaggtgggcgcgccctaccgcccggtgctgctggaatacggcgccgcgatgaaggcgcccgaatacctggccgtcaacccgatgggcaaggtgccggccatccgccatggcgaacagatcgtcaccgaaggcgcggccatctgcgcctatctcgccgacgccttccccgaggccggcctggccccggctccggcggcgcgcggcgactactaccgctggctgtttttcgtcgccagctgcgtcgaacacgcctggaccaaccaggccgccggcttcatccccagcgcggagcagcagcggatgttcggctacggctcctacgaggcgacgatggacaccctggccaaggcggtggccggccgccgctacctggccggcgaccgtttttccgccgccgacgtgtatgtcggccgcaccataggctatggcatcgagttcggcaatatgcgcgacaggccggagctggtcgcctactggaacggcctgaaggatcgccccgccctgctgcgcgccagcgaacaggccgagcgctggcaagcgcagcagccgtaa

SEQ ID NO: 1230 - DNA, 1389 bp, Chromobacterium substugae
atggcacgacgcattcccgagccctaccgcatcaagatggtggagcccatccaccagaccactccgcaataccgccgccaagcgctggacgccgccggctggaatccctttttgctccgctccgaagacgtgtacatcgacctgctgaccgatagcggcaccggcgcgatgtcagaccggcaatgggccggcctgatgaccggcgacgaagcctatgccggcagccgcagttttttccgcctggccgacaccgtgcgggagttgttcggctacgcccacaccatccccacccaccaggggcgcggcgccgaacagatccttttcccggaattggtcaagcgttgccgcggcgcgcggccgctattcctgtccaattatcatttcgacaccaccaaggcccacgtcgagctggccggcgcgcgggcggtcaatgtgctgacgccgcaagcgctggacaccgccgcgccttacgactggaagggcaacttcgacgtgccgcgcctggcggcgatcatcgccgatgagggcgccgccaatgtcgccggcatcatcgtcaccatcacctgcaacagcgccggcggccagccggtggcgatggacaatatccgcgcggtggggaagctggcgcgcgagcacggcattccgctggtcatcgacgccgcgcgcttcgccgaaaacgcctggttcatccgcgagcgcgacccggcctacgccggcagcagcatcgccgccatcgtgcgcgagatgttttcgcatggcgacatgttcaccatgtcggccaagaaggacgcgttggtgaacatgggcggcttgtgctgcttcaaggacgacgaggcgctgttccgcgcggtgcaggtgaactgcgtgccgatggagggcttcgtcacttacggcggcctggccggccgcgacatggaggcattggcgatagggctgcgggaggggatggacgacgcctttctcggctaccgcatcggccaggtggcgtatctgggagagcggctgcgcgaaggcggggtgccgatccagaccccgaccggcgggcacgcggtgttcgtcgacgccgcgcgcctgctgccgcacatcccggccgagcgctttccggcgcatgcgttggcctgcgagctgtatctggagggcggggtgagggcggtggagatcggttccttgctgctgggccgcaacccggctagcggcttgcaggagccgtcgccgttcgaattgatgcggctgacggtgccgcgccgggtctacaccaacgaccatatggactacatcgccgactgcctggtggaggtgaagcggcgcgccgccgaagtgcgcgggctggcgttcgattacgagccgccgatactgcgccacttcatggcgcggctgaggccggcgtag

SEQ ID NO: 1231 - DNA, 123 bp, Chromobacterium substugae
ttgaccaatcaattgtatacagtaaacgatagccatcatgaagaaaaagcatggcaaccaattaaatcgcccaataaaaatcatcaaaaaaacaaggcaaatgctctaattattacaatgtaa

SEQ ID NO: 1232 - DNA, 1377 bp, Chromobacterium substugae
atgtcgacacaatcgcatcccaaggggctctacctgctctttgtgaccgagatgtgggagcgcttcagctactacggcatgcgcgccatcttcacgctctacatgatcaaggctctgctgttcgacaaggcccatgcctcggacatctacggcacctacaccggcctggtctacctgacgccgctggtgggcggctacatcgccgaccgctactggggcaaccgccgctccatcctgctgggcggcgtgctgatggccatcggccagttcatgctgttcttctccggctcgctgcatgagaccaacgtcggcgccgcctcctggctgctgtacggcggcctgggcttcctgatcgccggcaacggcctgttcaagccgaacatctcgtcgatggtgggccagctgtacgcgccgggcgacaaacgcgtcgactccgctttcaccatcttctatatgggcatcaacgccggctcgctgttcgcgccgctggtgtgcggcaccctgggcgacaccggcaacccggccgacttcaagtggggcttcatggccgccggttgcggcatgctgctgtcgctggtcattttcagcctgttcaagaaccagtatctggtgacgccggaaggcaagcctatcggcctggcgccgaagcgccaccacgacagcggcgaaaaagtggtgcacgcgccgctgaccagcatcgagaaacagcgcctggctgtgatcctgatcgtgtccgccttcgtgatcttcttctggtccgccttcgagcaggccggcgcctcgctgaccttcttcgccgaagagcagaccaaccgcaacctgctgggctacaccgttcccgcctcgttcttccagtcgatcaacccgatctcggtggtgctgttcgcgccgctgttcgcctggatctggaccaagctgggcaacaagggcatggaaccctcgtcgccggccaagatggcgctgggcctgttcttcctggccatcggctacctggtgatcgccttcggcgtcgacggcctgcagccgggcgtcaaggtcagcatgctgtggctggtcagcctgtacatgctgcacaccttcggcgaactgagcctgtctcccatcggcctgtcgctggtggtgaaactgtcgccggcccgcttcaccagcctgatgatgggcatctggttcctgtccaacgccgccgccaacaagttcgccggcacgctgtccgagctgtatccggacccggccaagccggtgccgcacttcctcggctacgcggtcaacaatctgcacgatttcttcatgctgttcgtgttcatggccggcgccagctcgctgatcctgttcgcgctgtcctccgtgctgaaaaagatgatgcacggccgccagtaa

SEQ ID NO: 1233 - DNA, 1470 bp, Chromobacterium substugae
atgaaaaacgctgcaagctccaattggcggaaacacgccgtttacgcgctgatcgccctgctgttgatacgcctcgcggcgctgtgggccattccgctgaccgacaccaccgaggcgcgctacgccgaaatcgcccgcaagatgctggaaaccggcaactgggtgacgccgctgcacgactacggcgtgccgttctgggccaagccgccgctgtccacctggctgtcggcggccagcatggggctgttcggcgtcaatgaattcgccgcccgcctgccggcgctgctgctggcgctgggcgcgctgtggctgaccgccggcctgatgcgccgccgcggcggcgacgaagccgccaccgccgccgcgctgctgctgggcggcggcctgctgttctacggcgccgccggcaccgtgatgaccgacccatcgctgctgttctgcgtcacgctgagccaggtcgccttctggcatgcgctgcacggcggcggcaaggcctggcgctacgccttcttcgtcggccttgggcttggcctcctggccaaggggccgctggacgtggtgctggtgggcatgcccatcttcttctgggtgctgatccgcaacgaatggaaacggctatggaccgagctgccgtggatctctggcacgctgctggccgccgccatcgccctgccctggtatgtctgggctgaaatccgcaccccgggcttcctcaactacttcatcatgggcgaacacgtcagccgcttcctcgactccggctggaaaggcgacaaatacggcttcgcccacgccaccccgcgcggcatgatctggccctacgccttcggcgcgctgttcccgtggtcgatcgccatgctggcctggctggctagccaggcgcgccggctgccggccatcgtccgcgccggcgagaacgatggctggctgctgtacctctcgctgtggacggtgatgacgctgctgttcttcaccttgtccggcaacatcattttcccgtactcgctgccgatgctgcccggcgcggcactgctgatggccgaattgtggcgccgcggccgtggcgagcgcgccggccgcgcgctgccctggctggcgctgtcgtccggcattctggtgctggccggcatcggcctgcagcgctacgatggcgccaaatacttccgcacccagaaaccggtgatcgccgcttggcagcaacaaagccccgcggccgccgccatcctgatctactgggacagccgccgcgaattctccgccgagttctacagccagggcaaagtacgcaccaccgccaaaccggaggccctggccgccttgcttgccgcccaccccggcagcttcatcgtcaccgagcagcgcgactacgccagcctgccggccgcggtctccgccgcttacgccaaggcggcggaattcccggtgatgaaggaccgcatgctgctgctgcgccccgccgccagccgctga

SEQ ID NO: 1234 - DNA, 1014 bp, Chromobacterium substugae
atgactgacacccgcaaacccggcttcgtcccgccttacctgctggaactgcacgcggcggaacgcccgcgcgacccgctggtcagctgcatcatcccggcctacaacgagtcggaaaacatcgtgccgatgctggagacgctgcatcggctgctgacgcagcatggcctgcgccacgaactggtggtggtggacgacggcagccgcgacgacaccgtgcccaaggtgctggaggctggccagcggctgccggtcacgctgatacagctgtcgcgcaacttcggcaaggaaatcgcgctcaccgccggcatcgacaatatcgccggcgacgtggcggtgctgatagacggcgacttccagcacccgccggaaatggtgccggtattcctggaaaaatggcgccaaggctacgatatggtgtacagcgtgcgcgccaaccgcgacaacgaaaccctggccaagcgcgccttcacccgcgtgttctacgcgctgctcaacagcggcgcgccgctgaaaatcccggaaaacacccaggacttccgcgtgctggaccgcagcatcctcgacgcgctgcgccagatgccggagcgcaaccgcttcatgaagggcctgtacaactgggtgggcttcactcagctggcgatggaaaccgaaacccaggagcgccgcgccggcaagagcagcttcaatttccgcagcctgttcggcctgggcctcaccggtctcaccgccttctccaacatgccgctgcggatctggacgctggtgggctgcgtgatttccatgctgtcgataggctacgcgatctgggaattcatccacacgctgctgtacggcaaccgcgtcagcggctggccgacgctggcagtcgccgtcaccttcctcggcggtgtgcagctgttgtcgatcgggatactgggcgaatacgtcggccgcatcttcaatgaagtgaagggccgccccacctacctgatcagccgcatcagcaaaccgcaggccgggcgcggcgcatga

SEQ ID NO: 1235 - DNA, 390 bp, Chromobacterium substugae
atgagccggcaattgttctggttcggcgtggtaggggtgtcggcgatgctgctgcacttcatgctggtggcgctggtgatggtgccgctggggctgccgcccttggccgccaatgtgctggccttcctggcggccttccagctcagctactggggccaccgccatttcaccttcgaggcgcgccacgtgccgcaccgccaggcgctgccgcgcttcttcggcgtttcctgcctgagcttctgcgtcaacgaggcgatgtatttcctgctgctgcgcttcaccgcgctggattaccggctgtcgctgtgcatcgtgctgttcagcgtggcggtgctcaccttcgtcctcggcaagctgtgggccttcgccgcttctccgcaaacaaattaa

SEQ ID NO: 1236 - DNA, 813 bp, Chromobacterium substugae
atgacaaaacgattgacactctgcgccgacgacttcgcccagtccggcagcatcagcgccggcatcctgcaattgctggacgccggccgcctgtccgccaccagcgtgatgagccagtcgccgcactggccgtcgctggcggccgacctcaaggcccgttcgcagcgcgctgatataggcctgcacttcaatctcacccacagcttcgacgcgccggccaagccgctgtcgcactggctgatgaagagccagctgcgccagttgtcgctgccggcgctgcgcgacgaggcgctggtgcagatcgaccgcttcgccgagcatttcggccggctgcccgacttcgtcgacggccaccagcacgtgcacgcgctgccggtgatacgcgacgcgctgttcgacgcgatacagcggcgctggcaacagctgccgctgccctatctgcgcgcgccggacaagctgggccacccgggcgacaaccgcctcaagtcgctgatcctgcgcagcgtctgcatcaatttcgacgagcaggcgcaggaagccggcttcgccaccacgccgtggttcggcggcatgtattcgctgaccccgcaagcggacttctccggcctgatgcaagcttggctggcgcgcagcccggaacaggcgctgatcatgtgccacccaggcctgccggccagcgacgccgacgatccgatcgccgccagccgcagccgcgaattcgactacctctccggcgacgccttcgccgagcactgccgacagcacaaagtggagatcgtccgcttccagccggccgccgtcgccgccgcctga

SEQ ID NO: 1237 - DNA, 675 bp, Chromobacterium substugae
atgtataccctgatacaccaagatccccgtttctacctggtcgacaagcgcgccggcgccagcttccaccgcgaaggcgaagaggacggcctgatggacgcgctgcgcgccggcttgggcgacgacgcgctgtggccggtgcatcggctggaccgcatcacttccgggttgatcctggtggcgcgctccgccgagacggcgcggcaactgggcgaggcgctggccgggcgcgaggtggagaaatactatctggcgctgtccgaccgcaagccgctgaagaagcagggcaaggtgagcggcgacatggccaagggccgcggcggcgcctggcggctgctggccagccaggacaatccggcggtcacccagtttttcagttattcggtgcagccggggatccggctgtttttattgcgcccgcgcaccggcaagacccaccaattgcgggtggcgctgaagtcgcagggggcgcccatcttgggcgacgctctgtacggcggcggcgcggccgatcgcggctatctgcacgcctacgccttgcgcttcgcgctggatggcgaagcgttcagcttcgtctgtccgccatcgcagggcgagcgtttcgccgatctggcctgccgcgccttgctggctgagctggccgagccgtggacgctgagctggccgggagcgtga

SEQ ID NO: 1238 - DNA, 480 bp, Chromobacterium substugae
atgaatgaacaggcccaggggcaaagagaactggtgatgtcggtgttgatgacgccggacatggccaatttttccggcaacgtgcacggcggcgtgctgctgaagctgctggaccaggtggcctatgcttgcgccagccgctacgccggccgttatgtggtgacgctgtcggtggaccaggtgctgttcaagcaggccatccatgtcggcgaactggtgacttttctcgccagcgtcaaccatgtcggccgcacctcgatggaggtgggcatcaaggtggtggcggaaaacatccagcagcgcagccagcgccataccaacagctgctatttcaccatggtggcgttcgaggacggcaaggcggtggcggtgccgccgctggcgctggacacgccggaccagcagcgccgtttccgcggcgcggagatgcgcaagcagctgcgcatcgagatgcagcagcgcaaggacgccatcgcgtga

SEQ ID NO: 1239 - DNA, 708 bp, Chromobacterium substugae
atgtccatttccagtgtagccggcggctcttccagctacggaatcagcatgcatggcgccaattgccaatgccccgcctgccaagccctgcgctcgcaggccgccgccgttgcctccgcgccctcctctcccgcccaaaccgccaatgccgcggcgcccgccgccgggggccaggcaggcgcggacgcctccggccagaatggctccggcaacgcgaaaaacgcccagcaagccaatccagccgcgccgaaggcgccggacggcaagccgctgaacgatgcgcaacagaaagaagtggaagacctgaaggcgcgcgataccgacgtgcgccgccatgaggccgcccaccaggccgccggcggcgcgctggccggcgcggccagcttcacctaccaacaaggccccgacggcaaacagtacgcgataggcggcgaagtgcccatccgcctgagccagggcaacacgccgcaggaaaccatacagaacgcccaaacggtgcgggccgccgcgctggcgccgtccgacccctcaggccaggaccgcgcggtggcggccgaagcctcgcagatggaacagcaagcgcggacgcagctgctgcagcagcagaacggcaatcagcatctcagcccgctgcagaaagcccagcaagccgccaccccgggcggcagcccgcaggccaagggcggcaatatcgacacttacgcctga

SEQ ID NO: 1240 - DNA, 2073 bp, Chromobacterium substugae
atggactgcccgaccgaggcgaagctgatcgaaaaggcgttggccggcatggacggcgtggtggcgctggagttcaacttcatcgagcgggtgttgctgctgcgccacgacctgccgcaactggacgaagtgaagcgggcgatcgccaaggtgggcatgcaggcgatggagttggaagccgacgccaagatgctggcgccgcaaggccacggccgccgcgccaacctgctgctgctggtatccggcctgagcgccgccgcggccgaagccgccgcctggagcctgggcgacggcaagccggtggtggccgcgctggcgctggcctccattctgctgggcggcattcccaccttgaagaagggctggatcgcgctgtccacccgcaccctgaacatccatttcctgatgtcggtcgccgtgatcggcgcgatgctgatcggccagtggccggaagcggcgatggtgttgttcctgttcgccatcgcggaaaggctggaggcgatgtcgctggccaaggccggcgaggcggtgcgcgcgctgatggcgctggcgccggaaaccgcctgggtggcggcggctggcggctggcgcgaaacggcggccgccgaagtggcggtgggcagccgggtgcgggtgcgcccgggcgagcgggtgccgctggacggccgcattgccgacggccacagcagcttcaacgaggccagcatcaccggcgagagcctgccggtggacaagggacccagggatgcggtgttcgccggcagcatcaacggcgcgggggtggtggaaatcgaaaccacggcgtcggcgtccggctcggtgctggcgcgcatcatcgccaccgtgcgcgacgcgcaggcgtccaaggcaccgacgcagcgcttcatcgaccgcttcgccgcggtctacaccccggtggtgctggtcttggcagcgctgttcgccgtcgccgcgccgctgtcggggctgcagccctggcaccaggccatttacagcgcgctggtgatgctggtgatcgcctgcccgtgcgcgctggtgatcgccacgccggtgacggtggtcagcgcgctggcttcggccgcgcgccacggcttgctggtgaaaggcggcgcgccgctggagatggctgcccgcatcgacacggtttgcctcgacaagaccggcacgctgacgcagggcgagccgcgcgtcacccgggtgacggcgctggccggccaggatgaagacaccgtgctggcctgggcggcggcgctggacggccattccacccacccgctggcgcgcgcggtgctggatgccgccgcggcgcgcggcgtgagcgcgccggccgccagccaggtgagcgagctgataggccggggcgtcagcggctgggtggcggaacgccatttgcaactgggcagccgccggctggcggacgagcagggcgcgatgacgccgctgctggagcagacgctgcaggcgctggacgcggccggcgagggcgcgctggtgttgctggacggcggccaggcgctgggcgtgctggcggtggccgaccaggcgcggccggaagccgcggccaccctggcgcgcctgaagcggatgggggtggaaacggtgatgctcagcggcgacagcccgcaggtggcacaggcggtggccaggcaaaccggcatcggcgcggcttacggcggcctgctgccgcaggacaagttgcgccatatcgagcggctgcagcagggcggcaaggtggctatggtgggcgacggcgtcaacgatgcgccggcgctggcgcgcgccgacctgggcatcgcgatgggagcggccggttcggacagcgcgctggaaaccgccggcgtggcgctgatggacgacaagctgtcgcggctggccgacctgatcgcccacgcccgccgcaccgcgcgggtgctgaaggccaatatcgcggtcgcgctgggcatcaagctgctgttcttcggcctggcgctggccggggtggccagcctgtggatggcggtgttcgccgacgtcggcaccagcctgatcgtgatcgccaacggcctcaggctggcgcgccgggttcaggcgtaa

SEQ ID NO: 1241 - DNA, 261 bp, Chromobacterium substugae
atggccatgcgagcagcccgcggcgtgtttgtggtcgtggtcgtgggcatgatcatgcgaatcgccgtgatcgtgggaacacgccgcgccgggctgaggcgcttgcttgccatgatcttggccgcaagcgccaccagcgtggccatgcgtcttgggttccaaagccagcgcggcttcggccttggccgagcagcaatcgccgccgtgggcatgctggcggttctggtgcggtgcagccttgcggtaacgcgtcgcgcttga

SEQ ID NO: 1242 - DNA, 507 bp, Chromobacterium substugae
atgttgatcggggaactagcgcgccagaccggctgcgaagtggaaaccatacgctattacgaacgcgagggactgctgtcggcgccgctgcgctcggcttccggctaccgccgctataccgcggagcagctgggcgaattgaacttcatcctgcactgccgctcgctgggcatgtcgctggccgacatccgcaacctggcggcgttcaaggccgaccaccagcacgattgcgaggacatcaaccagctgatcgatcagcagatcgtcaaggtgcaccagcaagtggaggcgctgcgcctgctggagcagcaattgctggcgctgcgcgacaagtgccatgaaagccatccagccgccgactgcggcattttgcagacactggtggaggctgccgaaggctcgccctgcgtctgccacaccccgttcggccaggacaatcacggccacagccacgattacgaccacgcgggcaaaaaaaacggccgaccccacaagggccggccctaa

SEQ ID NO: 1243 - DNA, 684 bp, Chromobacterium substugae
atggagcatgaaatcgcattggtctcgttcgtactgacggtggtcttgtacggactggtgaaaaagtattacctgaaaacccgcagctggtggagcacgccgattctggcggtgccgttgctggtgatcggcctggtggtgctggcccgcgtgccttatcccacctatttcgccgatacccgctggctgacctggctgctggggccggcgacggtggcgttcgcgataccgatctacgagcagcgcgccttgatccgcaagcactggctgtcgctcagctgcggcgtgctggtggcgattccggtggcggtgttcagctcggtgtggctggcgcgctggctggatctgtcggaaatgatgcagaaaagcctggcgccgcgttcgatcagcacgccgttcgcgttggcggctgcgcacacgctgggcggctcggccgacctcaccgccttgttcgtggtggtgaccggggtgttcggcatgatggccgggcagctcatgctggcggtgttgccggtgcgctcggcattggcccgcggggccttgttcggcgccgccgcccatgcggcgggcacggccaaggcggcggagctgggcgcggaagagggcgtggtggccagcctcaccatgatgctggccggcgtggccacggtgttcgccgcgcctttgatcggatattggatttaa

SEQ ID NO: 1244 - DNA, 444 bp, Chromobacterium substugae
atggccagccgcttgtttcaccgcctcgcgcccttgctgcagactttcagccaggtgttgctgctgagcctggtgtggctggcggccagccagctgagccagcgctttctgccggcgatgccggccggcgtgctggggatgctgctggtgctggccggattgtggtctggcctgctgccgctgaaatggttcaagcacggcgcgcgctggctgctggcggagatgctgctgttcttcatcccggcggtggtggcggtggtgcaataccctcagctggtgctgagctccggcctgcgcatagtgctggtgatcggcctgtccaccatgctggtgatggcggtgacctcgctggtggtggaccgctgctaccggctggaactgatgttgcggcggcgcggcagcaatcgcaaggcgcagctgaaggcggaagtccatggagcatga

SEQ ID NO: 1245 - DNA, 897 bp, Chromobacterium substugae
atggaaatggacatccgcgcgctgcgttattttgtcgaactggtgaaatgccatagcttcaccaaggccgccgacgcgctgttcgtcacccagcccaccatcagcaagatggtgaagcagctggaggaggagctgggcatgccgctgatcctgcgcgaaggccgcagcttccgcctgaccgatgcaggccgcgtcacctacgagcgcggcctggacgtgctgtcggcgatgaaccagctcaaacacgagctggccgacctggcctcgctcagcagcggcgaactggtggtgggcctgccgcccatggtgggcgtggccttcttcgccccggtggtcagccatttccgccgccgctacccgcagatcgagctgaaaatggtggaggacggcgcgctcggcatagaaagtcggatcaagagcggcgacctggaaatcggcgtggcggtgctgccggtggacagccagctgttcgaccattattcggtggtgcgcgacccgctgtgcctggtggcgccggccggctcgcgctggcatggccgctcgctggtgcaactgaccgacatcgccgaccagccgctggtgctgtacccggacgacttcacgctgagccgccgcatcggcgacgccttccgcgagctgggcaagccgctcaacatcgtcggccgcagcgcgcactgggacttcatcgtcgagctggtggcggccaacctgggcatcaccctgctgccgcgctgcatcgtcagccgcctcaacccggagcagtacgacgtgatcccgctgtacgaccccaagttgtactggcacctggcgctgatctggcagcgcggcggctatctgtcgcacgcggcgcgcgcctggctcgcgctgacgcgggatgtgctgggcggacaagagtag

SEQ ID NO: 1246 - DNA, 750 bp, Chromobacterium substugae
atgagcaacaaacgcctgatacacggcttccacgccatcaacgcccgcctgtggcagaacccgaagagcctgctggaaatctggctggccggcggccgccacgacgcccgcgccaaggcggtgctggacaaggccggcgaggaaaagatcaagctgcacatcgtcgacaaggaacgcctggacagcatgagcggcaacgcccgccaccaaggcgtggtggcgatgatagacgccagcatgaactacgtggacctggacgacgtgctggaaaacctgtccgagccgccgctcttgctgatcctggacggcgtcaccgacccgcataatctgggcgcctgcctgcgggtggccgacgcgatgggcgcgcacgccgtcatcgcccccaaggaccgctccgccacgctgaacgccactgtctccaaggtggcctgcggcgcggccgaggtggtgccttacatcaccgtcaccaatctggcgcgcacgctgcgcgagctgaaggaccatggggtgtggatcgccggcaccacgatggaagccgataccgacctctaccatttcgaagccgccggcccgctggcctgggtgatgggcgccgaaggcgagggcatgcgccgactgacgcgcgagcactgcgacgtgttggtgtcgatcccgatgttcggcaccgtcgaaagcctgaacgtgtcggtatcgtccggcatggtgctggcggaaagccgccgccagcgcgtggtcaaggcgcagggctga

SEQ ID NO: 1247 - DNA, 3252 bp, Chromobacterium substugae
gtggaggagttgctggttttcctggggtttgccgcctgcctggccctgtggccgcgcagtccgcaggccgtgttgtctttggccagcttcgcgccgcacggcctgttctgctggcagctgctggcccgcggcgcgcggcgcagctggtggtggccgctggcggcggcgctgatcgccagcgaggcggcttcgccgctgtgggcgctggcgctggccggctcgctgtttctgattctgccgggtttgcgcctgggcggcttgctgcgcgcgcgcgcgcggccggccacgcccggcgagctgaggcatctgctgctgacgctgatagcgtacccggctttgctggtggcgttgctgctgggcgccggcgcgtggctggcgggcgggcagcggctgccgccctggtcgtggacctggcagtgctgggcggcggcgagttcggcgctgttcctgtgcgcgccgctggcctggccgccgcggcaacgcttggtcctgccgctgcgcatcgagctggcgctgatcctggcgttggtggcgggcggcgccatgctgttgctgtccagccaggcggccttgaacattcccagccagctgctgtttttccccctcatcctgtgggcggcctgccgcaccggcctgggcggcgccgcgctgaccgcgggcatggtgacactggccttgtcgctggcggcgctgtcgccggactggccgctgcatccgggcataggcaacgcctccaccgatctgctgctggcgctggcgctgaacgtgtccggcctcctggtggcgatcctgatggacggccaccgcgcggatgaagagacgctgcgcaccttccgggcgcggatcgagtcgctggtcaacaacagccccaccatgatgtcgttgaaggacatggagggccgctacctgctggtgaacgccgcctacgcgcgccgggtgggcgtgtcggcgcagtcgctgctgggccggcgcccggaggacgtgttcgaccgcgccgacgccgcccagatccgcgagcaggaccagcaggtgctcaacttgctggcgccgcgccagttcgaggagcatttcagcctgaacggcctggaaacctatctgctggcctccaagtttccgctgttcgacgccgccggccgtccggccggcgtgggcagcgtcgataccgacatcacgctgagcaagcgcgaacagaaagccaagcgcgaagccgaggagcgctatctggcgctggtggagcagtcgctggtgggcatctacatcctgcaggacgagcggctggtctatgtcaatcccaagctggccgacatcctcggctacgagcaggagcagatgacgggcatgaccatgggccaggtgctggcgccgggcgaggccaaccggctgcgccagcaggtgctgcgccgcttccgcgacaatatcgcggtgatgcactactccacccgggcgctgcgccgggacggcgtgctggtggacatggaggtgcacagccgcctgttcgagctggaggggcgcaaggccatcatcggcgtggtgatggacatttccgagcgcctgctggccgacaccaacctcaggctggcggccaaggtgttcgaaaactcggccgaaggcatcctgatcctggatgcggcggcgcgcatcatcgccgtcaacgacgccttcacccgcatcaccggctatgccgaggaggagacgctgggccgggcttcgcgcattttcagcctgggccagcgcgaacgcgaggcgatgcaggaggccttggccacgctgggccactggcagggcgagatgcaggaccggcgcaagaacggcgaatggtatccggcggagctgtcgatctcggcgctgcgcgatgaagatggccaactgtccaattacgtggcggtgttttccgacatcacccagcgcaaggaggcggaggagcggctgcagttcctggccaatcacgacccgctgacgcggctgcccaaccgcagcagcctcaccgccaggctggacgaggcgctggcgcagatggccagccaaggcggccagctggcggtgatgttcatcgacttggaccgcttcaagctgatcaatgactctttcggccaccaggccggcgaccagctgctgtgcgagatcgcgctgcggctgtcgcgggtggtgggcgagcgcggcctgctggcgcggctgggcggcgacgaattcacgctgttgatgagcggcttcgacaagcacaagcagctggccgagatggccggcgacatcctggccgaattggggcggccgctgagcctggaagcgcacgaggtgttcatcaccggcagcataggcatcagcgtgttcccgcacgacggccaggacgcgcgcacgctgctgaagaacgccgacgtggcgatgtaccgcgccaaggattccggcaagaacacctatcagttcttcgacatcggcatgaacacccagaccttcgagcggctgctgctggaaaacggcctgcgcatggcgctggagcgcggcgagttcgagctgcacttccagccgcagttgggcgccggcagccgccggctggagggcgccgaggccttgatccgctggcgccatccgcagctgggcctggtgccgccggtgcgctttatcgcgctggccgaggaaaccggcctgatcaagccgataggcgactgggtgctgcacgaggcctgccgccagctggcagcctgggaccgagaaggcgtgcgggtgcccaggctggcggtgaacctgtcgccgcgccagttcggccaaccctccttgccggccaaggtggccggcgcgctgcaggcggcgggcctggcggcggagcggctggagctggaaatcaccgagagcatgatcatgcaaagcccgaccgaggcggtcagcctgctgtcggaactgaaggcgctgggggtgtggctgtccatcgacgacttcggcaccggctactcgtcgctgtcgcacctgaagcgtttcccgctggacacgctgaaaatagaccagtccttcgtcgacggcctgccggcggacgaggacaacgccgccatcgccgaggcgatactggcgatggccaagaagctgaaattccacgtcgtcgccgaaggggtggaaaacgaggagcaggcggcatttttgcagaacaagggctgccacacgctgcagggctatcatttcagccggccgctgccggcgcaggagttcgcggcgctggccgccggctggcagctgcgcgaccaggcggccggcattccggcgtga

SEQ ID NO: 1248 - DNA, 189 bp, Chromobacterium substugae
atgccggatcttgccgatcgccgctccaccgccgccgccgcgcgggcggccgccatggatacattcttatttttgataccacaatggcattacgctttgtatttcttcatgccaaaatacagcgggcttgagccaaacgcatacgatagccgggattcccgccgcccgccagcttccgatcgcaggtaa

SEQ ID NO: 1249 - DNA, 3396 bp, Chromobacterium substugae
ttggatacgctcccgatcattccgccccgcggccagaaaacccgctgcgttcgcctgccggacgggctggacagccagaccgtcgccgcgctggcgcgccaacgccagccgctgctgatcctcaccgccgacgcccagtccgcgcagcggctgcaggccgagttgcccttcttcgcgccggaactctccatcgcgctgttccccgactgggaaaccctgccctacgaccatttctcgccgcacggcgaactggtcagcgaacggctggcgaccttgtggcagatccgccagcgcgaatgccaggtggtgatcgcgccggtgtccaccgcgctggggcggctggcgccggtgagctacctgctgggccgcaccttcttcctcaaggccggccagcagctggacgtggaaaagctgcgcggcgacatggtcaccgccggctaccagcacgtcacccaggtgatggcgccgggcgaattctcggtgcgcggcagcctgatcgacctctacccgatgggctcgccactgccgtaccggatcgacctgttcgacgccgagatcgacagcctgaaaaccttcgatcccgacacccagcgcacgctgtacccggtgccggaaatccgcctgctgccggcgcgcgagtacccggccgacgaaagcggcgtcaccgctttccgccagcgctaccgcgaaaagatggaaggcgacccaagcaagagccgcgtctacaaggacgtgtcgcagggcctgtggccggccggcatcgaatacttcctgccgctgttcttcgacgaaaccgccaccctgttcgactacctgggcgaggacgcgctgctggtgcttcaccacgacgtgcaggacgcggccgaaaccttctggcgcgacgcgcaaggccgctacgacatggcgcgcggcgatctggaacgccccatcctgccgccggccgacatcttcctgcgcccggacgaattgatggccaggctcaagccctacgcccgcatcgaactgtccgccgacgaagccgcccccggcctcgccctgcccgagctggcggtggaccgccgcgccgacgcgcccttgcaccggttgcaaagctatatcgcccagggcggccgccgcatcctgctggcggcggaaagcctgggccggcgcgaaaccatgctggccttcctggccgacaacggcatcaaaccgacgccggtcgacaactgggccgacttcgccggcggcaaagccgcgctggcgctggccgtcgccccgctctattccggcttcgccctgcccgagcagggcatcgcggtggtgaccgaaagcgagctgtaccagcacgtggcgcgcagccacacccgccgcaaggccaaccgcgccggctccgacgcgatgctgcgcgatctggccgaagtgaaagccggcgacccggtggtgcacgaggcgcacggcatcggtcgctacgtcggcctggtgaccatggatctgggcgaaggcgaaaccgagctgatgcagctggagtacgccgacggcgccacgctgtacgtgccggtgtcccagctgcagctgatctcgcgctacgccggcggcgccaccgacgacatccagttgcaccggctgggcaacccggcctgggaaaaggccaaaaaacgcgcggcggaaaaagcgcgcgacaccgcggccgaactgctcaacctgtacgcgcagcgcgcggcgcgcgagggccacagcttccagctgtcccacgccgactacgccgccttcgccgccggcttcggcttcgaggaaacccccgaccaggccggcgccatcgaggcggtgatccaggacatgtgctccggcaagccgatggataggctggtttgcggcgacgtcggcttcggcaagaccgaggtcgcgctgcgcgccgccttcgtcgcggtgatgggcggcaaacaggtggcggtgctggtgcccaccacgctgttggccgaacagcacttccagaacttctccgaccgcttcgccgactggccggtgcgcatcgccgaactgtcgcgctttcgtagcggcaaggaaaccaaggccgcgctggccggcttggccgacggcagcgtcgacatcgtcatcggcacccacaagctggtgcagccggatatcgaattcaagaacctgggcctggtcatcatcgacgaggaacaccgcttcggcgtgcgccagaaagagcagctgaagcggctgcgcgccaatgtcgacgtattgacgctgaccgccacgccgattccgcgcacgctgtcgatggcgctggaaggcctgcgcgacttctccgccatcaccaccgcccccagccgccggctggcggtgaaaaccttcgtcagcccgctctccaacggcgtgatccgcgaggcggtgctgcgcgagctgaagcgcggcggccaggtgttcttcctgcacaacgaagtcgacaccatcgaaaacatgcgggaaaagctggccgagctgatcccggaagcgcgcatcggcgtcgcccacggccagctgcgcgagcgcgagctggaacaggtgatgcgcgacttcctgcagcagcgcttcaatctgctgctgtgctccaccatcatcgaaaccggcatcgacatccccaacgccaataccatcctgatcaaccgcgccgacaagttcggcctggcgcagctgcaccaactgcgcggccgcgtcggccgctcgcaccaccaggcttacgcctacctgctgacgccggacggcatgacccgcgacgcgcagaagcggctggaggcgatccagctgtccggcgagctgggcgcgggcttttatttggcgatgcacgacctggaaatccgcggcgccggcgaagtgctgggcgaaggccagtccggcgagatgcaggaagtgggtttcagcctgttcaccgaaatgctgaaacaggcggtgcgcgacctgaaaaagggccgcgcgccagatctggatgcccccctgggcgtcaccaccgagatcaatctgcacagcccggcgctgctgccggacgcttactgcccggacgtgcacgaacggctgctgatctacaagcgcctggccagctgcgagaccgaggccgagatcgacggcatccacgaggagctgatcgaccgcttcggcctgccgccgcagagcgtgaagacgctgatcgaaagccaccgcctgcgcctggtggccaaggagctgggcgtgcaaaagctggacgccagcgaggtggcggtgcagatcgccttcatcaagaatccgccgatcgatccggtgaagatcatcatgctgatccagagcaagaagaattaccgcctggccgggcaggacaagttgcgggtggagcagccgctgccggaggtggcgcagcggatcgtgaaggtgaaggaggtgttgaaggagttgagcgcgtag

SEQ ID NO: 1250 - DNA, 771 bp, Chromobacterium substugae
atgagcgccattcccaagtttgccttcgccgcgctgttggcctgcggcgcagccggctacggcttcgccgagccggacgcggatgcgctcgcgctggtcaccggcgagtttccgccctataccggcgcggccctgccccagggcggcatcagcgcggtgctggtgcgcgaagcctttctggcggctggccagcccgcccccagcatcgttttcctgccctggaagcgagcctattcggaaaccgagcagggccgcttcgccgccagctttccctatgcccgcgatgaaaaccgcgagaaagcctttctgtattccgaaccgctgcatcaggaccgcttctcttacttcgcccgccaggacgacgaggatgcgcgcaagggacgctggcaaggcaagcgcctgtgcctgccgctgggctggaccaccgcctatgtcgacgccgacgtgcgcaaataccaattgcggctggagcggccgccaacgctggaaaactgcctgaaaatgctgaacagcgacaccgtggacctggtgtcctgcaacgacttcgtcgccgattacgcgatgcgccggctattcggcccacacgtgcccttcgccatcgccgatatcggcaaggcgcagagcagcgaactgtacctgatcgtcagccgccgccgccccgacgccgagcggctgatccgccaattcaaccagggcctggcggcgctgcgcgacagcggccgctatcagctgctgctgcggcaataccgcgagcagccccccagccgatga

SEQ ID NO: 1251 - DNA, 792 bp, Chromobacterium substugae
atgaaaaccctgtccgcccgccttgccagcctgccggttctgacgtgcgccctgctgctgacggcccaggccggcgcggccgaattgcgcgtcgccttttcctccagccggccgccgttttccttccacgacgacaagctgggcgacaccggcatcgaggtggagctgatgcgggcggcgctggagcggatgggctatgcgatgaaaatcatgatcgtgcccaattcgcggctgcggcgcgccgtcgccgccggcagcgcggacatcgcctcggcggtgcacgagcgcggccccgacggcaagggcgtctattattcggacgacttcatcgaataccgcaatgtcgccatcggcaagcagggccggcagctggatatccgctcgctgctggaccttggcggccacagcttcgccatctggcagaacggctggcgcgatctgggccccgtgttccaggccatctaccagcccgacccttccgggcgcttccgccacaactatcacgagagcgccagccaggaaaaccagtgccggatgttctgggccaaccgggtggagctgctgatcatcgaccgcgcggtgttcgactggtttcgcggcaagctcgccgccagcctgcccaccgctgaggccgtcaggtattacgacatcttcccgcaaaccaccggctatccagcggttttccatgaccgcgcgctgcgcgaccgcttcaatctggcgctgcggcaactgcggcaaaacggcgactaccagcgcatcgagcgacgctatcgctccggcgagcgcgactga

SEQ ID NO: 1252 - DNA, 519 bp, Chromobacterium substugae
atgccgctacgcaatatccgcatgctggtccgctacagcgcctgggccaaccagcgcctgctgggcgcgctggccgcgctgccggaaaccgaattgctcaaaccgcgcgccaccgtcttcggcaacatactcagcaccctcaaccataatctggtggtggaccgcatctggcaggcccatctgcagggacgcgcgcacggctacgccagccgcaacaccgagcgcacgcccagcctcgccgaactggccgtcgatcaggccgagctggaccgctggtatatcgattacgccgacgcgctggacccggcagcccacgaccaggtggtggatttcgccttcgtcgacggcggcaggggcagcatgcgccgcggcgacatgctgctgcacatcgtcaaccacaagaactaccatcgcggcttcgtcgccgacatgctgtaccagattcccgccctgccgccggccaccgatctaccggtctatctgcgcgatgcccatgatgaggccgagctcctgggctaa

SEQ ID NO: 1253 - DNA, 1278 bp, Chromobacterium substugae
atggccgacaatcccgcggcgccgtggcgggccgagcccgctggcgcggcggcagcgctgcacccgacctccatgtcaaaccaaaccatacaaaacatacaaagcattctggatttcaaggcgaccttgctcagcaccaccggctacaccgtcatgctgacgggcgtggcggtgttgttctggttatacaaccggaaggagcgcgcgctgctgactctgggcatgggcggcgcgtttgccgtgtgtggaaccctgctggcctacctgccgccgattttgccgccctggccgatgctgatgctcgacaccctgttgctgctgctgttccacccgctggcgttgatcgccacgcagcagatgttaggccgctccggcagttggggatacgccgccttgtcggtggcgctggtgatggcggcgttcgcgtactggggcggggtggagaactatggccgccgggtgatggtgacttccggctcgcatttgttgtactgggggctgattttccgcttgctgctgcaggagaggaagcaggggacgccggccggccaccggttggcgatgggcttggccgcggtgatgctgacgatttcggccagtcgctggagcgtggcctgctatgccggcgatccggattttggccggcattggtcgatgttcaacctcttcagcagccttggattgttctggtgcacgttctgcttcagcctcaacatgctgctgatcagttacgagcgcctgctgctgcaggtccggctgcaggcccagcaagacgggctgactcggttgtacaaccaccgcgccttccatgagaaggccgaaggcctgttcctgcgcgcgctggagaagcgcgctgaattggcattattgctgatagacctggatcatttcaaaagcatcaacgaccgccacggccatcaggccggcgacgaagtgctgcgccagctggccgactgcctgcgcggagaggcgcggcatggcgacctgctgggccggcacggcggcgaggagttcgtggtgctgctgccgcagaccggccggatcgacgcctacaataccgccgaccggctgcgcggcgccatcgccaacctggcgccccaggtgaatggccagccgctgcgcatcagcgccagcataggggtggcctgcctgcgtcccagcgaacattccaacctggccagcttgtttctggaggccgatgtgctgctgtaccaggccaagcacaagggccgcaaccgggtggaaatcgagcgcgagcgggtggttgaaccgctttag

SEQ ID NO: 1254 - DNA, 375 bp, Chromobacterium substugae
atgcgctttcgccatttcctgctgcccatggcgttttgcagcgcgccgctggcagccaagaccttgccttcctatgatttcgcgctgcaggccaagccggcggcggcgccgcgcatcaatatggccgcgccggccaagccgctgcaagtccagcccgcgctgcagctgcgcgatctggacgccccgctccagctgacgccgcgccaacagcaggaaatgctgcagcggatggaaaaccggcaaccgcaggcgctgcccggccagccgccgcgcgcgccctgggagcgcccccagccgctgccgcgcttcgacccgcaaaccggcaaaccccgcgccatcccgatgcacgagctgcccaagctgcccggccgctga

SEQ ID NO: 1255 - DNA, 1026 bp, Chromobacterium substugae
atgctgatgtcactttccacttcaggagcgatggcgatgcaaaaacgcactctgggccgcaatggcccgcaggtttccgcgctgggcctcggctgcatgggcatgagcgctttttacggcccgcatgacgacgccgagtcgctggcgacgctggacgcggcgctggatctgggcgtcaattttctcgataccgccgatatgtacggcccgcacacgaatgagcggctgttggccaaactgctggcccgccgccgcggcgaggtggtgctggccaccaagttcggcatcgtgctggacccggccgatccgatgaagcgcggcgtcaacggccggccggaatacgtccgcgccagctgcgaaggcagcctgcagcggctgggcgtcgatcatatcgacctttactaccagcatcgcatcgatcccgcggtgccgatcgaggaaaccgtcggcgcgatggccgacctggtgcgcgccggcaaggtgcgctatctgggcttgtccgaagcctcgcccgccacgctgcggcgcgcggccgccgtccatcccatccacgcgctgcagagcgaatattcgctgtggacgcgggatccggaagacggcgcgctggcggcttgccgcgaagtgggcgccagcttggtcgcctacagcccgctggggcgcggatttttgaccggcgccatccagagcccggatgatttcgcgcctgacgatttccgccgccacaacccacgtttccagggcgaaaacttccagcgcaacctcgacctggtggccaaggtgaaagcgctggccgccgacaagggctgcagcccggcgcagctggcgttagcctggctgctggcgcagggcgaggacatcgtcgcgattcccggcgcgcgcaaacaggccaatctgcgcgacaacctgggagccttgtctgtcagcctggatggcggcgagcgggatgcgctggcggcggtgttcgccgacggcggggccagcggcgcgcgctacgcgccggacgtcatgcagttgatcgaccgctga

SEQ ID NO: 1256 - DNA, 903 bp, Chromobacterium substugae
atgtcgcgtccccagcacgatgccctgcaagctttcgccctgatcgcccgcctacgcagcttcacccaagccgccgccgaactgggtgtcaccgcttccgccttgagccagaccatgcgccagctggaggcggagctgggcgtgccgctgctgatccgcaccacccgccaagtcgcgccgaccgaggccggcgacgcgctgctggagcggctggcgccggcgctggagcaaatccgccaggcgctggaggatgcgcgccagctgcagggccagcccgccggcacgctgcggctgacgctgccgcacagcgcggcgcaaatcgcgctctatccccatctggtcggctttcagcgccgccatccggccgtggcgctggagctggacatcagcgacggcctggtcgacatcgtcggccagcgcttcgacgccggcatccgcttcagcgaccgcttgcaacccggcatgcaggcggcgcagatcagccgcccgctccgcttcgtcgcggtggccacgcccgaatacctggcgcgccatggcgcgccgcaaaggccggatgatctgttgcggcacgcctgcataggctaccgcttcggcgccagcgggccgcagtaccgctggcagttcgtcgaggacggccagccgcgccagctggcgctgcgcggcccgctgctcaccaacgacaaccaggcccggctgctgggcgcgcgcggcggcatcggcatcgcctacctggccgaaacgctggtgagggatgacatcaccgccggccggctgctgccggtgctggagtcctacctgccgccggccgaggcgctgtacctgttctacccgcagcagcgccgcctgccggccaggctcagagtgttgatagactttctgcgcgaagccaacggcgtcgtctga

SEQ ID NO: 1257 - DNA, 1392 bp, Chromobacterium substugae
atgccaggagaacaacagaccctgcaccgcgggctggaggagaggcatatcaacctgatggcgctgggcgcgacgataggcgtcggcctgttcctggggtcggccaccgcgatcaagatggccggcccggccatcatgctggcctacggcatcggcggcctggccattttcatgatcatgcgcgcgctgggcgaaatggccatccacaatccggtggccggctcgttcagccgctacgcgcaagactacctcggccccttggccggctacctcaccggctggaactactggttcctgtggctggtgacctgcatggcggaaatcaccgccgtcggcgtctacatgggcatctggtttccggacgtgccgtcctggtactgggtgctggcggcgatgctggcgatgggcggcgtcaacctgatcgcggtgaaggcctatggcgaattcgagttctggttcgcgctgatcaagatcgtcaccatcgtgctgatgatagccggcggcttcgccatgattattttcggcttcggcaatcacggcgtcgccaccggcatcgccaatctgtgggcgcacggcggcttcatgccgcatggcttctccggcgtgctgatgtccttgcagatggtgatgttcgcctacctgggcgtggaaatgctgggcctgaccgccggcgaggccaagaatccgaaaaaggcgctggcgcgcgcggtggattcggtgttctggcgcattctgatcttctacatcggcgccttgttcgtgatcctgtccatttacccgtggaacgagctgggcacccgcggcagccccttcgtgatgactttcgagagcctgggcattccggccgccgccggcatcatcaacttcgtggtgctgaccgccgcgctgtcctcgtgcaatagcggcatctacagcaccggccgcatgctgttcaacctggccgagcagaaacaggcgctgccgctgttcgccaaggtttcgaaaagcggggtgccgctgccggcgctgctgctgtccatcgccgcgctgctgttgggcgtgctgctgaactacctggcgccgaaggaggtgttcacctggctgaccgccatctcgaccttcggcgcggtgtggacctggctgatcatcctgctggcgcagctgcgcttccgccgttcgctgtcggccgagcaactggccggcatcagtcaccgcatgccgctgtggccgtacggctcctacctgacgctgggcttcctggcgctggtgatagccctgatggcctacttcccggacacccgcgtggcgctgatcgtcggccccggctggctggtgttcctggtggcggtgtactacttgctgggctaccacaagcaggatgccgcctggcggctggcgcagcaggggcgctag

SEQ ID NO: 1258 - DNA, 2664 bp, Chromobacterium substugae
atggccgttagcaatcaaatcgaactcgacgccctggtggcacgcgtcaagaaggcgcagcaggccttcgcgcagttcacgcaagagcaggtcgaccacattttccgcagcgccgcgctggtagccgccgacgcacgcatcccgctggcgcggatggccgtggccgaaaccggcatgggcgtgatggaagacaaggtgatcaagaaccacttcgcttccgaatacatctacaacaagtacaaggacgagaagacttgcggcgtgctgtccgaggatgacactttcggcaccatcaccatcgccgaaccgataggcgtgctgtgcggcatcgtgcccaccaccaacccgacctccaccgccatcttcaaggcgctgatctcgctgaaaacccgcaacggcatcatcttctcgccgcatccgcgcgcgcgccgctccacttgcgaagccgcccgcctggtgctggaagccgccgtcgccgccggtgcgccgcaagacatcataggttggatagacgagccgtccgtcgcgctgtccaaccagctgatgcaccaccccgacgtcaacctgatcctggccaccggcggcccgggcatggtgaaggcggcttactcttccggcaagccggccatcggcgtcggcgctggcaacacgccggcggtgatagacgaaaccgccgacatcaagcgcgccgtggcctccatcctgatgtccaagaccttcgacaacggcgtggtgtgcgcgtccgaacagtcggtcatcatcgtcgatgaaatctacgacgcggtgcgcgaacgcttctccaggcacggcggctacattctgtccaagagcgaagccgaggcggtgcgcaaggtgatcctgcaggacggcagcctgaacgccgccatcgtcggccagagcgcggccaagatcgcagcgatggccggcatcgaagtgccgccgaccaccaaggtgctgatcggcgaagtgacggaagtgtccgaaaacgaagccttcgcccacgagaagctgtcgccgaccctggccatgtaccgcgcgaaggatttcctcgacgcctgcgacaaggcggccgcgctggtgaccatgggcggcatcggccacacctcggcgctgtacaccgatcaggacctgcaggaagagcgcgtgcgctacttcggcgacaagatgaagaccgcccgcatcctgatcaacaccccgtcctcgcagggcggcatcggcgacttgtacaacttcagcctggcgccgtcgctgacgctgggttgcggctcctggggcggcaactccatctccgagaacgtcggccccaaacacctgatcaacaagaaaaccgtcgccaagagggccgagaacatgctgtggcacaagctgccgaagtccatctacttccgccgcggctccctgccggtggcgctggaagacctggccggcaagaaacgctgcctgatcgtcaccggccagtatctgttcgagaacggcttcgtcgacgagcctatccgcctgttgaagaagatgggcctggaagtggaaaccttcttcgaggtgccggctgatccgacgctggcggtggtgcgcaagggcaccgatctggcccacgccttcaagccggacgtgatcatggcgataggcggcggctcgccgatggacgcggccaagatcatgtgggtgatgtacgagcatccggaagtgcatttcgccgacctggcgctgcgcttcatggacatccgcaagcgcatctaccagttcccgaaactgggccaaaaagccatgatggtggcggtgccgacgacttccggcaccggttccgaagtgactccgttcgcggtggtgaccgatgaagtgaccggcgtgaagtatccgatcgccgactacgaattgacgccgaacatggccatcgtcgacgccaatctggtgatggacatgcccaagtcgctgaccgctttcggcggcatcgacgcggtgacccacgcgctggaagcgtatgtgtcggtgatggccaacgagtactccgatccgcaggcgctgcaagccttgaagctgctgaaggaatacctgccgtcgtcctaccagaacggcgccaaggacccgaaagcgcgcgagcaggtgcacaatgccgccaccatcgccggcatcgccttcgccaacgctttcctgggcgtctgccactcgatggcgcacaagatcggcgccgagttcggcttggcgcacggcctggccaatgcgctgctgatcagcaacgtgatccgctacaacgccgccgatgtgccgaccaagcaaaccgccttcagccagtacgaccggccgaagagcgtggcgcgctacgccgaaatcgcccgccacctgggcctggaagccagccgcgaccacgaaagggtggaaaagttgatcgagtgggtggatgagctgaagaagaccttgggcatcccggcgtcgatccaggccgccggcgtggccgaatcggacttcctggccaaggtggatgaactggccgaagccgccttcgacgaccagtgcaccggcgccaatccgcgctatccgctgatcagcgagctgaagcagctgctgctggacagcttctacggccggccgtacaaggaagcctgggagcgcgaggaagatgccgcggaagccaagccggccaagggcaagagcaaagccaaggcctga

SEQ ID NO: 1259 - DNA, 120 bp, Chromobacterium substugae
atgaaattgccgggcatctatttattcgttttcagctgtttattttcgaaaacgaaaaaattggcagaaaaaccagctgccgacgcgcaaacggcgcggacgccattcaagcttgtgtag

SEQ ID NO: 1260 - DNA, 1059 bp, Chromobacterium substugae
atggcgttgccgctgctgctggcgttgcagtctgcatgggcggacgatgcgccgggagcgccggaaccgcaggtgcagcaggtgatcaagctgccgttgcggccgggcaagccggcgcaggcgccggatggcgccgcggccgcgccgccgcagtcggcgtcgccatccggcgcgaattcgcccaagccgggcaagcccgcggaggctggcaaaaagatggatgcgggcaagggcggcgccaaggctgacgtccaggcggcgccggagaaaatggcgccgtcggtgccgatgggcaaaccgccggcgcgcgacctgagccagcccagtccggaagtgacggcgccgggaggcaggccgcacgccgcccgcaaggcgcgcgccaaggccaggcatccggcgcgcgcggcggcgacggtcgcggcaggggaggccggccaggtgaaaagcgtggtgggcagcatattgaaggccaacggcgcctatatcgccaagcattcgccgggctatctcgccaagctgggcggccgccagacgccgcgcgccacggtggtgacctgctccaatccgggcggccaggtgggcatgctgggcggcgacgccgacggcgaactgttcgtgatcagcaatctgggcaaccagctggccacctccgagggctcggtggagtacggcgtccgccatctgcacacgccgctgctgatgttcatcagccataccggctgcggcgcgatcaaaaccgccgccggcgattacagcaatatggagccggccatccagcgcgagctcgacaatatcgaaattcccaagggcatcgacgcaaccaacggcgcgctgatcaacatcaacaaccaggtggaaggctccatcctcaagttttccggcgaggtggaggccggccggctggcggtgctgggcggttattacgactacaacaacgatctgaagcagggccgcggccggctggtgatcaccaatatcaacggcgagaccgatccggcgcgcatccgcgagctgacccgcagcggccagtatttcaagtacggcttcatgggccggtag

SEQ ID NO: 1261 - DNA, 864 bp, Chromobacterium substugae
ttgccttatctcgccctgacgctggccatgttcctgtggtccagcgccttcatcgtgctcaaatacgtattccagttctatcatccgctggcggtgctgttcgcccgcatgctgatcgccagcctgtgcctgctgccgctggcgatgagcggccgcatccgctggcgctaccgccgcggggactggcgctggttgttggcgatggggctggccgaaccctgcctgtatttcctgttcgaagccaatgccttgacctataccagcgcgtcgcaggccggagtgatcaccgccacgctgccgatgctgatggcggtcggcgccagcctgttcctcggcgagcgccagccgcgccaggtatggttgggcatcgcgctgtctttcgccggcgtgatctggctgagcatggacagccgctccggtccgggcgcgccggacccgctgctgggcaacgcgctggagttttgcgcgatggtgtgcgcctgcggctatgtgctgatcgccaagcggctgtcgacgcgctactcgccgctggccatcaccggcattcaggcgctggccggcagcgcctggttcggtttggcgatgctgacgccatgggggcaatggccgcagcggctgctgctggcgccgagcttgtgggtgctgtacctgggcgcggtcatcacgctgggcgcttacggcctctatacctgggcggtgtcgcggattccagtggctcgggcaggcgccttcaacaatctgatcccggtttttaccgtcctgctggcctggtggctgttgggagagcgcttcgaggcctggcagggtctggccggcgtgctggtgttcgccggggtgtggctgagccagcgcaagcaggcttga

SEQ ID NO: 1262 - DNA, 393 bp, Chromobacterium substugae
gtggtgctgggttttttgcaggaggtgcgttcgggcgtcaatcctgacgccgtcagccgctatatggcgaccagcgtcgccgcgcatcagctggagtcggaaaatccgcgcaccctggcgcgcagcccggccaattacgccgagcacgtgcgcgaattcaagcgcctgttcggcgatttccagctgcggatagacgaactgctggtggatggcgaccgcgcctatgcgcgctggacccagcttggccgccatttgggcgagctggacggccatgcggccagcggcaggccgctggcattggtggatagcgcttgctatcgggtggcggacggcaagatcgtcgagtactggatacaggccgaccgcatggggctggcgcggcaattggaatga

SEQ ID NO: 1263 - DNA, 138 bp, Chromobacterium substugae
atgagcacgttgctgatcatgctcagacagtggcgggattggtggtggcagggcatggccatccatgcccggcatgtctgccgggatgagatggaagcgctgcagcgcatccgcaaccttatggagggaaggcgatga

SEQ ID NO: 1264 - DNA, 120 bp, Chromobacterium substugae
atgatcagcaacgtgctcattttcgcctccactgttcaatcattcatcatgaggcatatcgtatacacgctggttttattgaaaaagcccattcgtcatgacacactgttcatgaaatga

SEQ ID NO: 1265 - DNA, 966 bp, Chromobacterium substugae
atgagaacaaatcacctacccgatgcccaggcgatgctggccttcgacgcgctggtgcggcgcggcagcttcactgcggccgccgaagaattggactgcaccaagagccgggtcagccaactggtgaaagcgctggaaaaagacctgggcagcgtgctggtgctgcgcaacacccgccgcgtggcgctcaccgaggccgggcagcggctggccgcgcacgcgcgcgaattgcgcggtctgctggagcgggcccgcctggatgtcaacgaaaccgagggcgaagtcagcggtccgctggtgatcagctccatcacctccttcgcccaatacctgctggcgcccatactggccgagctggcggtgctgcaccccggcctgcagttgaagctgcaagttgagaaccggctgcaggacccgatagcggaaggcctggacttctgcatccgcacccgcaacgtccatgacgacgcgctggtggccaaaccgctgggcttcgtgcgcgaatgggcgttcgcctcgccggactatctggccaaggcgccgccgctggaagcgccggacgacctgatccaccaccgcatcctgctggacaccagccgccccaagctgcgcgacgcgccggaatggctgctggaaaaggacggcgcgcaaaaactgatccgggtgcagccggtgctgtccagccaccagtacgcgccgctgctgtccggcgccatcgccggcagcggcatcgccctgctgcccccctacgtagcggccgagcacctgaagtccggccggctggcgccggtgctgccgggctggagccacgactgctggccggtattcctggtctacccttaccgccatccgttgccgcgcaaatacgaggccttcatccagcacgtggtgccgcggatgcgcgcgctgctggagaacagccttgatccaggccaaggcggcgcggcggcgccatcgtcagaatga

SEQ ID NO: 1266 - DNA, 1191 bp, Chromobacterium substugae
atggaacaccgcgacatcgtcatcgtcggcggcggcatggtcggcagcgcgctggcggcggcgctggccggcaacggcctatcgatctgcgtgctggagcgcgaagcgccggcgcccttcgacccggagcaagaccccgacctgcgcgtgtcggccatcagcccggcgtcggcgcgcttcctggccgggataggcgcctgggacaaggtgctggcgatgcgcgccgcgccttaccgccgcatgcaggtgtgggagggggaggaaaaccgcgccgccttgttcgacgccgccgaggccgatgtcgaacaattgggccatatcgtggaaaaccgcgtggcgcagctggccgccaccgcggcgctgcgggacaagggcgatgtcgactaccgctgcccggcggcggtgagcggcatcgtctaccgcccgcaggccacgcaactgacgctgagcgacggcagccaactgcaggcgcggctggtcgtcgccgccgacggcgcgcgctcgctggtgcgcgaggcggccggcatcggcgtcaccggctgggactacccgatgcacgcgctggtgctggcctgccgaaccgatggcggccagcaggacatcacctggcagcgcttcacgccggacggcccgcaagccttcctgccgctgtgcggcgacgctgcctcgctggtgtggtatcaccgcccggaggaagtgaagcgcctgctcgcgctcccggaggcggaattgatcgccgccgtcgcccaggcctttccgcgcaagctgcccggcatcgtccgcatcgcggcgcgcggcagcttcccgctcacccgccgccatgcccagcgctatgtccgcgacggcgtggcgctggccggcgatgccgcccacaccatccacccactggcagggcaaggcgtcaacctgggcttccaggacgccgccgcgctggccgacgtcatcctgtccgcccgcggccaaggcgaggactgggccggcgccgccacgctggcccgctacacccgcgcccgcaagccggccaatctggcgatgcaggcgggcatggacgccttctgctatggtttctccaacgacatcgccccgctcaggctgctgcgcggcctggggctgcggctggccgacaaggccggcccgctcaagcgcggggcgatccgttacgcattgggactggggccgctgcgccgctga

SEQ ID NO: 1267 - DNA, 1143 bp, Chromobacterium substugae
atgaaacttcccattctgccggccctgctggcccttgtcctggccggcggcgtccgcgccgatgaaacgctggcgcgcgatctgggcgaagaagtgctgcaattgccggtgcgcctgcccggcggcatccacgccatgaccatcaccgtctaccatccgtccggccccggcccccacccgctggcggtgctcagccacggccgcgccacgaccccggcggagcgcgcccgtccatcccgggtgcgcatgctggacgccgcccgctatttcgtgcgcaaaggcttcgtggtgatcgtgccgacccggcaaggctacggcgccagcgccggcggagcggatccggaagactccggcccctgccgcgacaaggactatgccgactcgctgcgccccgccgtgagcgaaatcctggccgcgctagactacggccgccgcctcgacgaagtggacagccagcgcatgctactgctgggtcaatcggtcggcggcatcagcacggtggccgccgccgccgaaaaccctcctggcgtgatggcggccatcaatttcgccggcggcgccggcggcgacccggccagccatcccggcatcccctgcgccgagccccagctgcggcggctgttcgccgagttcggcgcgcagtcccgcacgccgatgctgtgggtctacacccgcaatgaccacttcttcggcccggaatacacgcaggaatgggcgcgcgcctaccgcgaggcgggcgcccggctggactaccggctgctgccggccttcggcgacaacggccacctgctgttcgccgacggtccggacatctggatgccgctgctggaggcctatctgggcagcctgggctttcgccaacccgacatcccgccgcggccggcgcccagcggcttcgccgcactgaacgacagcgaacgcattccctatctgaagcccgaggacaggcgcgacgcttacgcccgctttctgtccagcccctttccgcgcgccttcgccatcagcccggacggccattggggctatgcccacggcggcgacgccgccggccgggcgctgggcttctgccagaaccatagccccagcccctgctcgctgtacgcggtggaccaggacgtggtgtggccgggcggccagccttga

SEQ ID NO: 1268 - DNA, 1002 bp, Chromobacterium substugae
atgaaactggcgatattgggagccggcgcctggggaaccgcgctggcgatagcttttgcccgtcaccatcaggtgacgctgtgggcgcgcgacgccggccaggcggcgcagatgggcgaggagcgcgtcaatcggcgttatctgcccgactgtccgtttcccgaaggcttggcgttgaccgccgatctggcggccgcgctgcaggacgcggagctggcgctgatcgtcacgccgatggccggcctgcggcccacgctgaaggcgttgaaggccttgaagtcgctgccgccggtgttgtgggcctgcaagggctttgaggccggttccagcctgctgccgcaccaggtggtggcggaggagttgccggccgaccatcgctgcggcgtgctgtccggccccagcttcgcccgcgaagtggcgcagggcctgccggccgcggtgaccatcgcgtcggacgacgccgagttcgccgcccgcgtggcgcgcgagctgcacagcccgctgctgcgcctgtacgccaacgacgacctggtgggcgtcgaggtgggcggcgcggtgaagaacgtgatggcgatcgccaccggcgtcgccgacggcctggatttcggcctgaacgcccgcgcggcgttgatcacccgcggcctggccgagatcagccggctgggcgtcgccctgggcgccagcccgcaaaccatgatgggcttgtccggcatgggcgacttgatcctcacctgcaccggcgccttgtcgcgcaatcgccaggtgggcctgaaactggccgagggcaagccgctggaacaggcgctgcgcgagctgggccatgtcgccgaaggggtggccaccgcccgcgaagtgctgaccatggccgagcgtctggaagtggacatgcccatcaccgccgcggtgtgcggcctgctttaccagggcaacgacccgcagcaggtggtggccggcctgctgggccgctcgcccaaatccgaatccggcgcgatgctggattga

SEQ ID NO: 1269 - DNA, 441 bp, Chromobacterium substugae
atgaagcgcctcgtcattacgctgctgttggccctgggcgttgcccaggccgcccaggccctggaattccgctcggtcaaggaaaccggcgtcgcactgtacgaggcgccggcgctgtccgcgaagaagctgttcgtggtcagccgctattacccggtggaagtgctgcagagccagaaggaatgggcgcgcgtgcgcgacgccaccggcggcatcgcctggattccggccgcggcgctgtccaagcagcgctggctgctggtggtgtcgactcaggccggcgtgcgcgacaaggccggcgaagacggcaagctgctgttcaccgtgcccaaggatggcgtgctggagctgatggaagcgccgcaggccggctgggccaaggtgcgccaccgcgacggcagcgtcggctatgctcgtattaccgatttgtggggtttataa

SEQ ID NO: 1270 - DNA, 453 bp, Chromobacterium substugae
atgagcgaacaacaagagctgcaaccggcgttttccatcgagaaaatctacgtaaaagacctgtcgctggaggtgccgaacgcgccgcaggtattcctggagcaggctcagccggaaatcgacatgcagctggccagcgccggccagcaactggacgatggcttctacgaagtgaccctgaccgtcaccgtgaccgccaagctgccggaaaaaaccatgttcctgtgcgaagtcgcccaatccggcatcttccagatccgcaacgtgccgggcgaagacctggatccgatcctgggcgtggcttgcccgaacattctgttcccgtacgcccgcgaagcggtgtccagcgtggtgaaccgcgccggcttcccgccggtgctgctggcgccgatcaacttcgaagccctgtacatgcagcagcgtgcgcagcaggctgaagccggcaacgcctga

SEQ ID NO: 1271 - DNA, 258 bp, Chromobacterium substugae
atgaaaccggttaccatgtacaccaccgcggtatgcccgtactgcgtgcgcgccaagcagttgctggcgagcaagggcgtgagcggcatccaggaaatccgcattgatctggacccggagcagcgcgacaagatgatggccatcaccggccgccgcaccgtgccgcagatcttcatcggcgacacccatgtcggcggctgcgacgacctggtcgcgctcaaccacgccggcaagctggacacgctgctggccgactga

SEQ ID NO: 1272 - DNA, 1398 bp, Chromobacterium substugae
gtgaacatgacgggtaaactgattctgctggctgctttgacggccagcgccgcgccggtccaggcgctggacctgcatggcttccagccggatgagatcgcggtgtgggccgcgccggtggaaggcggcagcccggtggccgaataccgcgccgaccaggcggtgaatccggcctccaccatgaagctgctcaccggctgggcggcgctgaaccaattggggccggactaccgctggaagacggcgctgctgtccgaagcgccggtgcggggcgacacgctgaaaggcgatttgtattggctgggaggcggcgatccgcgcttcgacaacggcaatctgctgagcctgctgtacagcctgcgcctgcgcggcatccgccagctggacggcaggctgctgctggacaagcgcgcgttcagccgggtgggcggcgccgacgacttcgccggcgacgccggcaaggccttcatggtgagcgcggacagccacctgaccaatctgaaagtcgcctggctgactttctacaacgacgacaagggcgcgcgggtggtgctggacccgccgctggccggcgtcagcctgcaggccgagctcaagcccggcggcgacgagccctgcccggacgtgcgccgtttcgtcgccatccgcaacgatggccgccatgtcggcgtgcaaggcagcgtgccggcggcctgcgacggcgctcgcgccttcgtcagcgtgctggagcacgatgacttcgctggccaggatttcaccgcgctgtggcgggcgctgggcggcgtggggccgctggcggtgggactggggacggccccggccgccgcgcgcgaactggcggtctggcagtcgcagccgctgacggtggcgctgtccgacaccaacaagtacagcaacaacaccatggcgcgcacgctgttcctgacgctgggccgggaggcgggcggcgaggacaccgccgccgccgccgaacgcgcgctgcgcgggcaattggcgcagaagggcatagccgacgccggcgcgctggcgctggagaacggctccggcctgtcgcggcgcgagcgggtaagcgcccgcctgatgggcgaggtgctgctggacgccgcgcgcgggccttacgccggcgagtttctggccagcctgcccatcgccggcgaggacggcacgctgaagaagcgtttcgccggcctggggccgcggctgcgcttgaaaaccggcacgctgcgcgacgtgagggcggtggctggctactggctagcggcggatgggcgccagctggcgatcgtcgccatcgtcaacagcccgcgcgcgccggagatggccaaggcgctggacgcggtggtggccgacgtggtcggcgctttcgacgcggcggcgcgatccagcgcaaaccgctga

SEQ ID NO: 1273 - DNA, 2061 bp, Chromobacterium substugae
gtgtgtggcgtggttgtcgcgccgataccgggggagggtgtcgccgaggtcgacgccgccaagctgcgatgcatcgaaagcgtgctcgacggactgccggcgctgccggaagagtttctggcgctggcgcgcttcgcctccggctattatcactatccgctgggacctacgctgttcaccgcgctgcccaccggcttgcgcgagccgcgcgacgtcatccgccccgaccgccggtcattcctcctgaccgccgcgggcttggccgaggcgccgccggcgcggcagcgggccaggctggcgttgtggcaggcgctgcaggacgggccgctggacctggccgcggccaaggcggtgacgccgcaggccggcaagctgctggccgattggctggccgagggcaaggcggcgcgcgcgacgccggagccggcgccgctgcggctgggcgaagcgccggcgctgaacgccgagcagcaggcggcgctggacgcgctgcgcgccagccaaggttttcagccctggctgttgcacggcgtgaccggcagcggcaagaccgaagtctatctgcagctgatcgccgatcatcttgccgcgcggcggcaggtgctggtgctggtgccggaaatcaatctgacgccgcagctgatcaaccgtttcgccgaccgctttcccggcagccgcatcgtggtgcagcacagccacctggccgatggcgaacggatgcacggctggctggacgcctggcatggcgacgccgaggtggtgataggcacccggctgtcggtgttcacgccgctgcccaggctgggcttgatcgtggtggacgaggagcacgacggctcgttcaagcagcaggacggcctgcgctaccacgcgcgcgatctggcggtgtggcgcgcgcgccgcgccggcatttccatcgtgctgggctcggctactccctgcctggaaacagtggccaatgtcgaggccggccgttaccgcaagctggcgctgatccggcgcgcccacggcgcggcgcggatgccggacgtgcggctggtggacacccggcgccggcgtctggccgagggcctagacgaaggcgtggtcgaggcgttgcgggcgcggctcgcgcggcgcgagatgagcctggtgttcatcaaccgccgcggcttcgccccggtggtggcctgcaccgcttgcggctggctaagcggctgcccgcattgctcggccaagctggtggtgcatttgctggagcgcaagctgcgctgccaccattgcggctgggaagagccggtgccgcgcgcctgcccggattgcggcgaccccgacatcaagccgctgggcgagggcacgcaaaggctggaggcggcgctgcagcggatgctgccggaggcgcgggtgctgcggatagaccgcgacaccaccagccgcaaggacgcctgggacgaggtgtaccgcaaggtgcatggcggcgaggtggacatcctggtcggcacccagatgctggccaagggccacgatttcggcaccctgtcgctggtggcggtgctgggggctgacggcggcctgtattcggccgacttccgcgcttccgagcgcctgttttcgcagttgatgcaggtggcggggcgcgccggccgcgccgaagcgccgggcgaggtgctgatccagacgcaatggcccgagcatccgctgtaccaggcgttggcggcgcatgacttcgacggttacgcctccagcctgctggacgagcgccgccaggccggcttcccgcccagcgtgttccaggcgctgctgcgcgccgacagcccggagttggcgcaggccgccgcctttctcaaggaggcgcgcgcgctgctggagcccttggccgacggcgtattgatttccggcccggcgccggcgttgatggcgcggctggcgcagcgcgagcgcgcgcagctggtgctggaggcgccgcgccgcgccgcgctgcacagcctgctcgcgcaggcgcaagccttgctcgacccgctggcgcgctgccatggccgcggcttgcgctggtcgctggatgtcgatccgcaggaattatga

SEQ ID NO: 1274 - DNA, 222 bp, Chromobacterium substugae
atgctggtgccgcgcccggtgcgcggcgcaccagcgtggtgcgcgcggatgttgctgaatgaattcttgtttctgtttaaacagaattcttatcttttatgcagaaaacctgtggaaaaaaaccgcggttttttaagaatttattgcgcttgtcgtatcgaagccttgggcggccgccagggtatcgacgcccgtcagaccggctttcgtttctgtttttag

SEQ ID NO: 1275 - DNA, 1065 bp, Chromobacterium substugae
atgacccagctgagcaacgataccttcctgcgggccctcttgaaggagccggttgaatacaccccgatctggatgatgcgccaggccggccgctacctgccggaataccgcgccagccgcgcgcgcgccggcagcttcatggacttgtgcaccagcccggccttcgccaccgaagtgacgctgcagccgctggaccgttttccgctggacgcggcgatcttgttttccgacatcctcaccgtgcccgacgcgatgggcctgggcctgtatttcgccgaaggcgaggggccgaagttcgagcgcccgctgcgcgacgaagccgccatccgcgcgttgcgcccggcgccgctcgacaagctgcgctacgtgttcgacgcggtggccagcatccgccaggcgctgaacggccgcgtgcccttgatcggcttttccggcagcccgttcacgctggcctgctatatggtggaaggcggcggctcggatgacttccgccatgtgaaggcgatgctgtacagccgtccggagctgctgcaccacatcctggaaatgaatacccagtcggtgatcgcctatctgaacgcgcagatcgacgccggcgcgcaggcggtgcagattttcgacacctggggcggcgcgctcagccatgccgcctatcgcgaattctccctctcctacatgcagcgcatcgtcgccggcctcaagcgcgaggccgacggccggcgcgtgccggtgatcgtgttcaccaagaacggcggccagtggctggaagacatcgccggcatcggcgccgactgcgtcggcctggactggaccaccgacatcggcctggcgcgcgcgcgcgtcggcgccaaggtggcgctgcaaggcaacttcgatcccaacgccttgttcgcctcgccggaagccatcgagcgcgaagcggggcggatcctggccagctacggccagggcagcggccacgtgttcaatctgggccacggcatctcgcagttcgtcgacccggcccacgccggcgcgctgatcgaggcggtgcaccggctgtcgcgcccctatcattcccagtga

SEQ ID NO: 1276 - DNA, 846 bp, Chromobacterium substugae
atggtgagggtgttgagcatatggctgctgtgctgcctgctgccgatggcgcaggcggctggcatgtccatcaactacgcgctggtgtccggcgacaacgacccgcactggccctacatgcaggcgctgttgcagttggcctgcagccagatgcgcgagcgttgcgtgctcttggcggcgcgcgacatgaaccaggggcgcgccaccgagcagatgctgcgtgccggcggcagcgtcgacttgttctgggggatgaccagccgcgagcgcgaaagcaagttgctggcggtgaaggtgccgctggacaaggggctgataggctggcgggtgccgctgatcagcgccgaccggccgcagctgttcaagggcgtgaaaacccggcagcaattgatggcgtttcgcgccgggcagggacaggactggccggacacccagatcctgcagcatgccggcctgccggtggtgaccagcgtcgattatcccaacctgttctccatgctgcgccagcgccgctacgactactttccgcgcagtgtgatcgaggtgcggcaggagctggagtcgccgaacagcaaggggctgatgctggacccctacctgctgctgcactaccccaccgccttttatttcttcgtctcgccgaagcgcccggagttggccaggatgctggagcagggcctggagaggagcgtcgccgacggcagtttcgagcagctgttcaagtctttcaacggcgatcatctgcgcggactcaatctggcggcgcgcaccatcatcgaactggacaacccgctgctgccggaggacacgccgctgcggcggcgcgagctgtggtttcacccctga

SEQ ID NO: 1277 - DNA, 516 bp, Chromobacterium substugae
atgattctgttggtgctgctgtggcatttcagcctgatgtcgctgctggcggtgggcggcgccaatgtgctgttgcctgagctgcagcggctggtggtggccgagggctggatgagcgccggccagttcgccgagctgttcgccatcgcccaggccgcgccgggccccaatgtgctggtggtcagcctgataggctggcatgtggccggcctggccggggcgctggtctgcatgctgggcatgtgtctgccgtcgtcgctgctgagcttctatgtctcccgctggtgggaggccaaccagggcggcgaactggcccggctgctggcgcgcgccttgctgcctctgacggtgggcctggtcggcgccagcgcctgcctgttgctacaggcggccaaccgcgacgccgccggctggggcgtgagcctggcggtggcctggatcgcctggcggcgcaactggaatccgctgtggctgctgctgctgggcgggctggcgggcggcttgggctggctctga

SEQ ID NO: 1278 - DNA, 558 bp, Chromobacterium substugae
atgaatagcgatctgattcttcccagccggcgcgagctgttcgccggcttcttctccatcggcgtcagcggtttcggcggcgtgctgccgcaggcgcacagcatgctggtgctgaagcggcgctggctgtccgaggccgacttcgccgagcagctggggctgtgccaggtgctgcccggtcccaatatcgtcaatatggcggtgtcgataggcgcgcgcttccacgggccgagcggcgcgctggcggcggtgtgcggcctgctgttggcgcccatggtcatcgtactgttgttggcttccgtttacggccgctaccgccagctgccgctggtggagcatgtgatgcatggcctggcggcggccgccgccggcctgttactggcgatggcgctgcgtttgctgtccaggctggagcggcgtgtctggagcgcgctggtggtggccgccaccttcgccgccatcgcggtgttccgcctgcctttgctgtgggtgctgctggcctcggcgccgttggcgctggcgctggcgtggctgaacagagggagggcggcgacatga

SEQ ID NO: 1279 - DNA, 885 bp, Chromobacterium substugae
gtggaccgactgctcagcatggaattgttcgtcgcggtggtggagaagggcagcttcaccgcggcggccgacgcccaccggttgtcccagcccatggtcggcaagcatatcgcggctttggaggcgcggctgggcggcaagctgctggtgcggaccacgcgccggcagcagttgaccgagctgggccagcattactttcaacgctgccgcgccatcctggccgaattggcggcggccgaggacgcggcggcgctgctgcgggcgcagccgcgcggggtgctgcggatcaatgcctcggttacgttcggcacgctgaggctggcgccgctgttggccgatttcatggcgcgctatccggatatcggggtggagctggaactgagcgaccagctggtggatctggtggccgacggctatgacgcggtgttccgcatcggccatctggccgattccggcatggtggcgcggcgtttgcggccgtaccggatgatgatcgccgcctcgcccgcctatctggccgcgcgcggcacgccggcgacgccggccgatctggcggagcacgactgcctgggcttcagccgctggcggcgcgacgacggctgggaggcgctggcgcagcggcatggcctgcggatgcgcgccagccgcttcctgtgcaatcagggccaggctttgcgccagctggcgctctccggcgcaggcatcgcgctgcaggcggaggcgttattggccggggatgtggcggagggcaggctggtgtcgctgctggacggctatctgcccgatcccaagcccatgcacctgatttacccggccgaccgccaacccttgcccaagctgcgggttttcgtcgatttcatagccgagcggctgggcgaactgtga

SEQ ID NO: 1280 - DNA, 597 bp, Chromobacterium substugae
atgaagattctgctcgtaggcgccagcggcacgctgggccgcgccgtgcatcaagcgctgtcccaccatcaagtcatcaccgccggccgcggcagcggcgacctgcgcgtcgacatcaccgacagcgccagcgtgcagtggatgttcgagcaggccggccgcctcgacgccatcgtcagcgccaccggcagcgtgcacttcgccccgctggccgagatgactgccgccgacttccgcatcggcctgaacgacaagctgctgggccagatcgacctggcgctgaccggccagcattatctgaatgacggcggctccatcaccctgaccagcggcatcatcagcgcccaacccatccgccagggcgccaacgccaccgcggtcaaccgcgcgctggaaggcttcgccgccgccgctgcgctggagctgggccgcgaccgccgcatcaatgtggtcagccccaacgcgctgcaagagtcctgggacggctacgcgcccttcttccccggcttcgagccggtgccggccgcgcgcgcggcgctggcctatgtgcgcagcgtggagggcatcgccaacagccagacgctgaccgtgtggtga

SEQ ID NO: 1281 - DNA, 597 bp, Chromobacterium substugae
atgaagatactgctagtcggcgccggcggaaccataggacgttccgtgtcgcaagcgctgtcacatcatcaagtcatcgcagccagccgcagcggcggggaggtccgcgtcgacctctccgagccgtccagcatccgcgcgctgtttgaacgcatcggcaaggtggacgccatcgtcagcgcggccggcagcctgcacttgggctcgctgaccgaaatgtcgtccgagcagttccgcatcggcctggacggcaaattgctggggcaggtgaacctggccctgatcggccagcactttctcagcgatggcggttcgatcacgctgaccagcggcatgggcaatgaaataccgatccgacacggcagcaacgcctgcgccgtcaatgccgcgatagaaggcttcgtccggggtgccgcagtggagctggcagccggccaaaggatcaacgtcgtcagccccggcgttttgcaagagtcctgggaagctctgaaggacttattccccggcttcgaggccgtgccggccgccagagccgcgcgcgcctatcaacgcagcgtcgaaggcgtggagaccggacaagtcttcaaggtctggtaa

SEQ ID NO: 1282 - DNA, 714 bp, Chromobacterium substugae
atgaaagctatcctgtggggcgggctggcgctgctgctatgcccgctctttccccatgccgagccgataccggcgtacagccaggcgatagagccctggggcgatccggccagcggcgacggcctgacgccgcgctttctcggctggctggccgcgcaaagcgggctgcggctggcgcaggacacccggccgctgccgcgcctggtggaagacctgaaagccggccgcgacgcgctggcgctgatcaccgcctcgccggagcgcgacgccttcggcctggagctgtgtcgtcccgccgccatccggctgtcgctgatccaccgccaggccagccgcccgctgcggcccgaggacttccggcgacgaccggtgggcatactgcgcggcacccatacgctggacgcctttctgacggcttccgccgccgccccggtgcgggtggccgacatgcgccagggcttcggcatgctgcgcatcggccggctggacgcgatgatgtgcgtgcggcccggctgcggccgcgtgctgcgcgaactgtcctcccccgccgacaaatggaccgaattgccgatcagcagcgagccgatggcggtatacgtgtcgcgcgcccacccgctggcgcgcgatgcggcgacgctggaaaaactgcgcgcggcctgcgtttccgccgccggccggcgcgagatggcggcgctgctggcgcgctacgattag

SEQ ID NO: 1283 - DNA, 1965 bp, Chromobacterium substugae
atgagccaacaatacgacgaatcctcggtacgggtgctgaaggggctggagccggtgaaagagcggcccggcatgtacacccgcaccaccgaccccacccacatctgccaggaagtgatagacaacgccgccgacgaggcgctgggcggctacgcgcgcaagatcgccgtcaccgtgcatcaggacggctcgctgacggtggaggacgatggccgcggcattccggtgggcctgcatccgcaagaaggcgtgccggtggtggaactggtgttcacccggctgcacgccggcggcaagttcaacaagaaggacggcggcgcctacgccttttccggcggcctgcacggcgtaggcgtgtcggtgaccaacgcgctgtccacccgcctggaagtggaggtcaagcgcgagggcggcgtgcatcgcctggtgttctcgggcggcgatgtgatcgaacccttggcccgcatcggcgactgcggcccgcgcaccagcggcacccgggtgcgggtgtggccggacggcaaatatttcgaaagcccgcgctattcgatgcaggagctggagcgcctgctgcgcgccaaggcggtattgctgcccggcgtggcggtgacgctgacggtggaaaagtccagcggcgacgaggtgaaggtgtggcagtacccggaaggcctgaagagctatctggcggagctgtgcggcgacgacgagccggtggcgccgctgttcgccggcgaagcgtatatcggagacgaccacgagcaattcgccaagggcgagggcgcgcagtgggccatggcctggttcgaggacggcgccagcggcgagagctacgtcaacctgatccccaccccggtgggcggcacccacgaggccggcttgcgcgccggcgtgttcgacgcggtgaagagcttcgtcgatcaccacaacctgttgccgcgcggcgtcaagctgatggcggaggacgtgtggagccgcgtgcgcttcgtgctgtcggcccgggtgctggacccgcagttccagggccagaccaaggacaagctgaccagccgcgacgcgctgaagctgatttccggccttgcccgcgatccggtggagctgtggctgaaccagcacgtggaagccggcaagaaaatcgccgagctggcgatccgccaggcgcagagccgtctgaagtcggtcaagaaggtggagaagaagaagggttccggcgtggccgtgctgccgggcaagctgaccgattgcgagagcgaggacatcgagcgcaacgagctgttcctggtagagggcgactccgccggcggctcggccaagctagcgcgcgacaaggagtaccaagccatcctgccgctgcgcggcaaggtgctcaacagctgggagacggacaaggaccagctgttctccaatgccgaaatccacgacatttccgtggcgataggcgtcgacccgcatggcccgaacgacgcgccggacttgtccggccagcgctacggcaagatcgccatcctgtccgacgccgacgtcgacggctcgcacatccaggtgctgctgctgacgctgttcttccgccatttcccgcggctggtggagaacggcaatgtctacatcgcgcagccgccgctgttccgcgtcgacgtgccgggccagggcaagacccggccgccgcgcaagctgtacgcgctggacgaaggcgaaatggcggccatcctcgaccgcctgcgcagcgaaggcgtgcgcgagaacgcctggagcatttcgcgcttcaaaggcctgggcgagatgaatccggagcagctgaaggacaccacgatgaacccggacacccgccggctgagccaggtgcgggtgcgcgagggccagctgcagcagacgctggacactttcgtgatgctgatgggcaagggcgaggcggccagccgccgcagctggatggaagccaagggcaacgaggtcgaggccgacatctga

SEQ ID NO: 1284 - DNA, 114 bp, Chromobacterium substugae
ttgttggctcatattcttggtcttgctttatccgcgactcgcgcctgcgccgctccggcaagagcggcgggaaaaaagacagcgggcatcggcccgccgtgtgggtatagctga

SEQ ID NO: 1285 - DNA, 525 bp, Chromobacterium substugae
atgctggaccgggacggataccgcccaaatgtcggaatcatcctcaccaactccaggaatgaggtgttctggggcaagcgcgtgcgcgaacactcttggcagtttccgcaaggcggcatcaagccgggcgaaagcccggaagcggcgatgtaccgcgagctgctggaggaggtgggcttgctgcctcagcacgtgaagatcctgggacgcacccgcgactggatgcgttacgaggtgccgacgaattgggtacgccgcgaatggcgcggcagttacaagggccagaagcagatctggtttctgttgcggctggtcgggcgcgacagcgacgtctgcctgcgcgccaccagccatccggagttcgatggctggcgctggaatgattactgggcgccggtggacgcggtgatcgaattcaagcgcgacgtgtacgagcgggcgctgtcggaattgtcgcgctttttgcgcggcgtggagagccaccacgcctaccaggcgcgcaccggcgcgcagagcgagcattga

SEQ ID NO: 1286 - DNA, 1341 bp, Chromobacterium substugae
atggcatttctgcttacccgaccaacgctttcccgtctgccctggctgcctctgcggccggaagacttctccacgctgctgcaaactagcgagttccgcctgcgcctgctggccggcatcgccgccgccgagcaacgcatctatctgtgctcgctctacctggagaacgaggaagccggccgcgaaatactggacgccctctaccaagccaagcagcgccgcccaagcctggacatccgggtgatggtggactggcaccgcgcccagcgcggcaggatcggcgaagaccagtcgcactgcaacgccgcctggtatcgcgacgaggcggcgcgccgggagctggacatcccgatctacggcgtgccggtgcaaacccgcgagctgttcggcgtgctgcacctgaagggcttcgtcatcgacgataccgtctactacagcggcgccagcctcaacaatgtctacctgcacaagctggacaaataccgtttcgaccgctaccacctgatccgcaatccggagctggccgacgcgatggccggcttcatggccgaacagttcttcaacgacccggcggtgttccgcctggacaagccggcgccgtccacccgcagcatacgcaaggaaatccgccagctgcgcgacaagctggtgcatagccaataccggctggccggcggccaggcggcgcccgatcagcttagcgtcagccccatcgtcggcataggcaagggcaaccgcctgaaccgcgccatcctggacgtcatcgccagcaccgagcgcaagcttttcatctgcacgccctatttcaacttcccccgctcggtggtgctggaaatcaaccgcgcgctgcgccgcggcgtggagatcgacatcgtggtcggcgacaagaccgccaacgatttctacatcccgcccaaacagccgttccgggtgatcggcgctctgccttatttgtacgagatgaacctgcgccgcttcgccaagcgccagcgccagttcgtcaaccgcggcgaactgcgcgtccacctgtggaaggacggcgacaacaccttccacctcaagggcatgtggggcgacgagcgctacatcctgctgaccggcaacaacctcaatccgcgcgccttccggctggatctggaaaacgccttgctgctgcgcgatccgcagcgccagctgcaggctcagagccaggccgaacaacaaagcatcctgcgccacaccaccttgctcaagcactatcgccagctggaagacgtccgccactacccggaacagatcaagaagctgctgacccgcctgagccgggtgcggatagaccgcatgctgaacctgatgctgtaa

SEQ ID NO: 1287 - DNA, 1791 bp, Chromobacterium substugae
atggccacccccaaggtagaaacccgcaatctagacgtcagccacgattacgcggaaaaatggcagcaagtgctggacctgctggccaggatagtcagcattccggcggcattgatcatgcaggtgcagccgccgcgcatcaaggtcttcctctccagccacagcgccggcaacccctacgaggaagacgaaatggccgacctcggcaccggcctgtactgcgaaaccgtgatgagctcccgcaacgagctgaccgtgcccaatgcgctgaccgatccggactggtgcgacaaccccgatatcaagctgggcatgatctcctatatgggcatgccgctgacctggccgaatcaggacatcttcggcaccatctgcatactcgaccgcgtcgaaaacgcctacacccccatctaccggcagctgctggcgcagttccgcagcatggtggagcgcgacctcaagcagatctacaacgacaaggcccgcgcgcaggaagacgccgccctgcgcgccgacgaggccgagcgggtgcgccgcgagttcgaactgctgcgcgccggcgagcagaaagccttgcgcgcgctgcgcgagagcgaggagcgctggcacttcgcgctggaaggcgccggcgacggcgtctgggactggaacatcgccaatggcgaaatctttttctccagccgctgccagcaactcttgggcttgtcgcggccggccgacatcgccgatttccagctctggcaaaccggcatccaccccgacgacctgccgaccgtgctggccgacctggccagctatctgcgccaaccccagggttccttcgtcaccgagcatcgcttccgcaaggaccaggactggatctggctgctgggccgcggcatggtggtcagccacgacgcccaaggccagccgctgcgaatgataggcacctactccgacatcagccgccgcaagcacgcggaaggcgagctgcagctattgaacagccatctggaagaacgggtggccagccgcaccgccgagctgaagaaagcgatgcaccaaatcagcatcgccgaaaagcagacggcgctggcccggatggtggcaggcatggcgcacgagctcaacaccccgataggcaacatccttctatgctcgtcgcagatccaggccgacgtggccgacatcgcccgcgccgacgccgacaagcagctgtcgcgcaagggactgcaggatttcctgctgaaggccggcgaaacctgtgaactgttgcaacgcaacagcgaacaggccggcgatctgatcggccgcttcaagcagattgccgtcgaccagctggaccagcccaaacgcgtgttcagccccggcgaagtcatcggccagctgctgaaagcgctgctgccgcccgagcatcacccgcatctgctggtggagatgcacgcgccggcccacctgatgatagaaaattatcccagcgcgctggagcagctggtttcgcacctggtcgccaactcgctgacccacggcttcgaagggcgcaaccagggctgcatagccatcaccatcagccaatcgcagggcgacatcacgctgcgctacgaggacgacggcaaaggcattccggcggagttgcacggcaaggtgttcgatccctttttcaccacccgcatggggcaaggcggcgtggggctgggcctggcgatggtgcacaatatcgtgcaggtgatcctgaagggacagatccggctggaaagcgagccgggccacaacactgccttcatcatcaccttcccgccgaatcccgcctga

SEQ ID NO: 1288 - DNA, 915 bp, Chromobacterium substugae
atggtttctcgcagcagcaagcccgtccggcgaattctggcgggcgatcgcagcctgttcatccacagcatgccgcggcattcgctgcatgacctataccattactgcatgaccatcagctggccgcgtttttacctgttcatcgcggcggctttcctggccttgaacctgttgttcgccggcttttaccagttgcagccaggcggtatcgccaaccagtttccacaaggttttctcggagcattcttcttcagcgtcgagacgctggccaccgtcggctatggcgacatgcatccgcaaaccctgtatacccactggatttccatgctggaaatctttatcggcatgatgagcatagccttgatcaccggcgtcacctttgctcgcttttcgcggcctagggcgcgcatcgttttcaccagcctagcggtggtgaggccgttgaacggcgagccggcgctgatgctgcgcgcggccaatgccagaaacaatgtgatcatcgatgccagcgcccgtctgcgtttgttgcaacatgaagttacggcggaagggacggcgtttcgcaagctctacgacctggaactggtgcgcgacgagcacccgatgttcgtgctgggctggacgctggtgcacaagctggatgagcgcagcccgctgtatcggcgcgatgccgagtcgctggcggcggtgaaggcgcagttgatcctgtccatcagcggcatagacgaaaccaccatccagcccatggtggcgcgtcataccttctcgcatctggatatccgctggaatcatgttttcgccgacctgatctataccgacgaagaagaaaacgaccatgtcgattatcagttgttgcaagaggtgaggccgctgcgcgccgatggcggccaatcggacgaggctgagcggcgctag

SEQ ID NO: 1289 - DNA, 118 bp, Chromobacterium substugae; identical to SEQ ID NO: 426

SEQ ID NO: 1290 - DNA, 267 bp, Chromobacterium substugae
atgaaaaaatcgaagttcaccgaagaacagattgccttcgccttgcgccaggcggagtccggcaccaccatcgccgaggtctgccgcaagatgggcgtctccgaagccaccttctacaactggaagaagaaatacggcggcctgggcgtcagcgagctgcgccgcctgaagcaactggaagaagagaacgcccgtctcaagcgcatggtcgctgacctgagcctggacaagcagatgctgcaggaagtcatccaaaaaaagctgtga

SEQ ID NO: 1291 - DNA, 837 bp, Chromobacterium substugae
gtgaagccggctcgcaaacgcgagctggccaacttcctgatcgacgcgtaccgcgtcagcattaggcgtgcgacggccgttattcagctgcggcaagctacctatttttatcgccctcaccctcgagacgatcgtgcggagcggcagcgaatcctcgagatcgccgccactcgcattcgttatggcgcgcgccgcatctacgtcctactgcggcgcgaaggctggcggatccatcacaagaagacctaccggatctattgcgaggaaggcttgaatctgcggcgcaagcggcccaaacggcgagtggcagcggcgcatcgccacgctcggccggccgtctccaatttgaacgcgtgctggagcatggatttcgtcgccgatcagctgttcaacggccagaaaatccgggccttaactgtggtggataattttagccgggagagcttggcgatcacggtggatttcgcactgaaagccgcggacgtggtggctacgatgcagcatgtgcaagccttgcgcgggacgccgcaacggattcaggtcgacaacggcagcgagtttatttcgttggcgctggaccagtgggcctatgagcaaggcgtcacgctggacttctcacgaccaggaaaacccacggataatgcctttatcgagtcatttaacggcagtctgcgcgatgagtgcctgaatgtgcattggtttctatcgctggacgacgcacgtgaaaagatcgagcgttggcggcaggattacaacgaattcaggccgcacagttcgctgggcgaccagaccccgagcgagttcagacttgctcaccttgaagccggaaatctctag

SEQ ID NO: 1292 - DNA, 1494 bp, Chromobacterium substugae
atgtctaccggtacgatcaattggcagaaaaaagcagagcaattgcatttcgaaggccgcgcttacatcgatggcgcttaccggaaagcgctgagcggcaaagagttcacaacgatcaatcccgcaaccggcaaggtgttggcatctattgagtggtgcggtgaagaggatgtggagctagcggtgcgtgcagcgaggcgggcattcgatggtggcgcatggtccgagctggcgccgcgttccaagatggaaatactgaaacgatttgcttcgctcatccaggacaatattgaagaattagcgctcttggaatcattggatgttggcaaacccatcgccaacgctctaagcgttgatatttccaatacggcttactgcatcagttggtttgccgagctgattgacaaggttccgggtgaggttgtgcctgtcgatccggcgttgcttggcatggtgacgcgcgagcctgtcggcgtggtggcagctattgtgccgtggaacttccctttgctgatggcaagctggaagtttgctccggcgttagccgcaggcaatgcggtcattctgaagccctctgagaagtcgccccttaccgcaatccgtattgccgctctcgctgaagcagcgggcattccgcctggtatttttcaggtcttgccgggggcggggaacgttggccaggccttggcatcacatctggatgtggattgcgtcgcctttaccggatcgacggcggttggcaagcagatcgccaactatgcggcacaaagcaatctcaagcgcgtgtggttggagttgggcgggaaaagcccgaatattatcttggcagactgcaaggatcttaaggcagctgcgagagcggcagctggtgctatttgttataacgctggtcaaatgtgtacggcagggtctcgtgtcttggtggctagagaaatacgcgaagccttcttgtctgaactgaaagtggcgatggctgattatcgtcctggagatccattgtcacctgaaacgaacttgggtgcagttgtcgatcaacggcagtttgataaagtcctgtcatatatagcgcaaggacaaaaagaaggcgctacgctgctacaaggtggtgctgctgtccaagctatccacccagatggtttgtttattgagcctgctatttttgattgcccgcagccaaacttgacgatttgccgtgaagaaatatttggccccgttttatcagtgattacctttgatgatgtggatgaggccgtgcagattgccaacgatagccaatatggacttggggcggcagtgtggactcaggatgtctcgacagcgcataaagtggcgcgtcagcttcgtgcgggtacggtttgggtcaactgctatgaggagggtggggatatgaacttgccgtttggcggctataaacagtctggcaatggtcgcgacaagtcattacacgcgcttgaaaaatacacagagctgaagagtactttgatcaagctataa

SEQ ID NO: 1293 - DNA, 1296 bp, Chromobacterium substugae
atggaaagcgtaccagcgattgcagcaaagaagatcacagttagaattgtgccctggctgatcatttgcctaaccatggcctacatcgacagaaccaacctggcttttgcacagttctctttagcaaaatcattcggtattgatccattggtttttgggacggccgcaggggtattttttgccggatatattgccgcagaaattcccagtaatttattgttgctaagattcggcgcacggaggtggttggcaagaattatgatcagctggggcgtggtcacgatgtcaacttactacgtccacacagatactcagctgtatattgtcagatttctgcttggagtgtgtgaggcagggttttatcccggagtgctgttttatttgacacgcttcattccaatagagaatcgtgcaaaaaccaatttccttttcatctccgccatcccactatctgcagtgattggcagtatattttcgggctggttgttggaaacgatctctaaatcgcactacttaggcttggctgcatggcagtggttgttctggacagaaggtcttatgaccatttttattggtattgcactgctctatgtgctgccggagagcatcaagtctgtaaagtatttaactgatgctgaaaaattgcagttaagcgcccacatacaagcacaggaagaaaccaaagctgtgattgggtcgccgctgaaagcgctgttggacttaaaagtttggatatatgcaatcgtgacttctgcctcagccttttccatgtattgcatttcattctggctcccgcagatcatcaaatcctttgatgttgccgatatattgcatatcggcttgatcaatgccatcccatggggcttggcactgatcgcgctagcgacgtcatttttgatgatcggaaccataaaacggccagtttttgtcttgtccctgttgtacggggttgggtgcttatcattttcggccatcttgattaatggcataagcgtgacaacaaagcttggcttaatttcgattgcgactactgcgattatgctgacctatccagtattttggtcgctagtcaatttccttaaaggcaaggctgcggcagttatttttgctgtgatcaattccattggcagcttggctgggtttgtgtcgcccatcatgatgggatacgtcatcaaggcaacggggagtccgcagcttggcatcgtaatcatgtccagctttatggggttggctgtgattttgctttttgtgattcacattgcttttacagaaaacaagcgtgccgcagctttctga

SEQ ID NO: 1294 - DNA, 243 bp, Chromobacterium substugae
atggagttcgatatgtcgcatctagtggaaaccatggcctatgtcggccaaatcccttggcatggcttgggcaactgcctgccggctgggcagcctgtcgaggtctggcagcgcgaggcgggactggattggtcgatccaggaagcggaggtgctgttcaacaacaccgctgccgatgccatccatatccgcgctcacagcgatgccaaggtgctgtatcgtcggatacgctggcgccgctga

SEQ ID NO: 1295 - DNA, 465 bp, Chromobacterium substugae
gtggacgagcagtgctatcagcgcctgatcctgccctatctgatcgagcacgatattccattgctattcgtggtgaatcaggtagacaagatcgagccgtgccgggaatgggacttcatccacagcatgcctggtccgcaacagctgacccacatcagccgcaagcagatgcagatcagccagttgttcaacgcgccagtaacccagatcttcatcatttcagccatggaaggctacggcctgcagatcctgatcgagcaaatcatccataggctgcccaaagaaaaaaagtggagcgtcacgcgagagacccgcgccgagtacgtgacgcctgccatgcagcgggaatccataggtgggctgtgggatacgatcaaagaagccgccaagacgatcttgcgcgaaacctggaccacgatctcacatcgcgtggaaagctggttcagcaaacggttcggctggtag

SEQ ID NO: 1296 - DNA, 74 bp, Chromobacterium substugae
cgcggggtggagcagtctggtagctcgtcgggctcataacccgaaggtcgtaggttcgaatcctgcccccgcaa

SEQ ID NO: 1297 - DNA, 621 bp, Chromobacterium substugae
atgtcgagaagaatgacgctgttgttggagttgctggtcaattttctgctgccctggctgtgctaccgctgggcgcggccacattggggagagatgggcggcttgctgctgtctgcagcgccgccgctgatgtggagcggctgggagctgtggcgcagccggcgggtagacgcgatgagcatgctggtgctgttgggcatcgcgctgtctctgctggggatggcgctgggcggtggagagaagatgctgctgctgcgcgaatcgttgttgtcggggctgttcggcgcggcgtttctcttgtcgctgctgtttccccgtccgctggtgtttttcctggcgcgggccgcgctggaaaggcagcggcaagatggccgcgagcattgcgagtggctttgggcgcaagctgcctttcggcgcggcatgcggttcatgacggcgatgtggggcttgggcctggtatcggagatgctgttgcgcagctggctggcatggcattggccggttgaacgctccgtgctgttgctgccctggatcagttatggggtgatgggcttgctgtgcggcgccacttggctgttgcgcaggcgtttgaccgtcgcgatgcagctggccgcggcatag

SEQ ID NO: 1298 - DNA, 186 bp, Chromobacterium substugae
atgaaaatttcgcaattgaagccgggctacaaagtttttgagcacaaggacagcggcagcgtggtccactatgaagtggtcagcatccgccaagtcggcaaaatgtttgaagtgactttcaaatcggctttgggtttggccagcgccatgtatcctgccaatggtttcattcaggcggcagcctga

SEQ ID NO: 1299 - DNA, 2061 bp, Chromobacterium substugae
atgaccaaacgcaagattctggtgaccagcgcgctgccttacgccaacggcgcgatccacctcggccatatgctggagcagatccagaccgatatctgggtgcgcttccagaagatgcgcggccatgagtgctactacgtctgcgccgacgatacccacggcgccccgatcatgctggcggcggaaaagcgcggcatctccccggagcagctggtggacgaagtccgcgcgctgcatgtggccgattcgcaaggcttcctgatcggccatgacaactactacagcaccaacagcccggaaaacaaggagctggcggagcaggtgtacaaggcgctgcgggccgacgacaagatcgcggtgcgcaccatcgagcagctgtacgacccggaaaagcagatgttcctgcccgaccgcttcgtcaagggcgaatgcccgaagtgttcggccaaggaccagtacggcgacaactgcgaagtctgcggcgccacctacaatccgaccgaactgaagaacccgtattcggcggtgtccggcgccaagccggtgttgaaaacctccgagcactacttcttccgcctgggcgaatgcgccgatttcctgaagcagtggaccagcggcgccagccgtcgcgccgacggcgtcgagcagccgcacctgcagcaggaatcgctgaacaagatgaacgagtggatcgacggcggcctgcaggactgggacatcagccgcgacgcgccttacttcggcttcgagattcccgacgcgccgggcaaatacttctacgtgtggctggacgcgcctatcggctacatggccagcttcaagaacctgtgcgaccgctccggcctgaagttcgacgaatggttcgccaaggacagccaggcagagatgtaccacttcatcggcaaggacatcctgtatttccacgcgctgttctggccggcgatgctgaattattccggcctgcgcgcgccgaccggcgtgttcgcccacggcttcctcacagtggatggccagaagatgtccaaatcgcgcggtaccttcatccaggccaagagctacctggactgcggcctgaacccggagtggatgcgttactacatcgccgccaagctgaacggccgcatcgaggacatcgaccttaacctgaatgacttcgtcgccagggtaaactccgacttggtcggcaagttcgtcaacatcgccagccgctccgcgggcttcatcgccaagcgcttcgacggccagctggcggccagcgtgtcggatctggacatcctggccaagttgcaggcggccgccgaggatctggccgccgccttcgaagcgcgcgaatacgcgaaggccttgcgcgacgtgatggcgctggcggacatggtcaacgtctatgtcgacgccaacaaaccgtgggaactggccaagcaagaggggcaggacgcgcgtctgcaggaagtctgcacggtgctgatcaacgctttccgcctgctcaccatctatctgaagccggtgctgccgaagctggccgaaggggtggaagccttcctggaggtggcgccgctcgcctggagcgatgcgcaaaccctgctgttgggcaagaaaatcaacgcctaccagcatctgatgcagcgcatcgacccggcgctgatcgacaaactgatagaggcgaacaaggaaaacatgcaagcgactcaagacacgccggccgccgccgcgcacgagcctttggccgaaaccatcaagatcgacgacttcgccaaggtcgacctgcgcgtcggcaaggtgctggaatgcggcttcgtcgaaggttcggacaagctgctgcagttcaaggtggatctgggctttgaaacccgcaacattttctccggcatccgcaaggcttatcaggagccggaaaaactggtcggccgccatgtgatcgtggttgccaacctggccgaacgcaagatgcgcttcggcgtgtcgcagggcatgatcgtctgcgcgtcgggcaccgacgatagcgaaggcctgtacctgctggatgtggacgcaggcgtcaagccgggcatgcgcatcggctga

SEQ ID NO: 1300 - DNA, 1260 bp, Chromobacterium substugae
atgcagtccaaacacgccaaacttacctggtccaatctgctgttcccgctggccctggtgctgttcgaattcgccgtctacatctgcaacgacatggtccagccggccatgctttccgtcacccgcgaatttctggtcgacgcctcctgggcgccgacgtcgatgaccgccttcctggtgggcggtgcgctgctgccgtggctgaccggcccgctgtccgaccgcatcggccgccgcccggtgctgctgttcggcgtcgcttacttcaccatcgcctgcttggccacctatctggtcagctcgatcgaggccttcatcgcgctgcgcttgctgcaaggcgtgggcctgtgcttcatcaacgccgtcggctacgcctcgctgcaggagtcgtttgaggagaccgccgcggtgcgcgtcaccgcgctgatggccaatgtggcgctgatcgcgccgctggtcggccccttggccggcgcggccttgctggagctggcgccgtggcgcagcggcttcctgttcatcgccggcctgtctttcctcgcgctggtgggcttgtatttccgcatgccggaaaccgtggcgcccagccatgagaagctgccgctgtccagcatggggcgcgactacctgaaagtcttcggccacagccgtttcgtgctggccgcgctgtgcatcccgctgctggcgctgccgctgatgggctggatcgcgctgtcgccggtgctgctggtgcgcgacctgcacatgagcgccgtcgcgtacggcctgatgcagattccggtgttcggcggcctgatcgccggcaacctggcgctggccgtgatcgccgaccgctggccgctgggccgctccgcgttggtgggcatgtggcccatcgtcggcggcctggcggtgatggtcggcggcgtgctggtttcgtcgcttccccaatactggatggtggctggcatgagcctgatggccttcggcgagggtctggccttcggtgtgctgtaccgcttcgcgctgatgtcctgcgacgtggccggccgcggcaccatttccgccagcatgagcatgatctcgatggccggctacgcggtgggcatcgagctgttccgccaggtttaccaggcctcaggcctcactggttttgcggtgctggcgctgtgcttctcgctggcctacgtgctgctgggccgcaagatggtgggcatcgccatggccgagcgcgccgcgccggctgtcgaagacggcaggctggccagccagggcgcctga

SEQ ID NO: 1301 - DNA, 1221 bp, Chromobacterium substugae
ttggccggcgcgatgcgcgccgcagcgaatccgactaaaatactcggaaatcatcacccggaacgccgcatgttctccaaactcacccgcctgttcggcggtcaagccgaccaggccacgcaaaacgaaaccatggcacagctcgaatcccagatcctcgataccctcaaaccgctgatcgacgccaataccggcaaagggtatgtggcggccaagaacgtcaagaacctgcagatcgacgacaaggccatccgcctggacgtgacgttggcctacccggccaagagccagttcgacgcggtgcgccaacagtttgaaaccgcgctggcgccgctggccgaagggcgcgccgtggaagtgcgggtcgacagccagatcgtcagccactccgcccagcgcggcgtgccgctgctgccgggcgtgaagaacatcatcgccgtcgcctccggcaagggcggcgtcggcaaatccaccaccgccgccaacctggcgctggcattgtcggccgaaggcgcgcgcgtcggcctcttggacgcagacatctacggcccgtcccagccgctgatgatgggcctgcagggccagcggcccgaatcggccgacggcaagctgcggccgctgatcggccacggcatccagaccatgtccatcggctacctggtagacgccgaccaggcgatggtgtggcgcggcccgatggtcagccaggcgctgcagcaactgctgaacgacacccgctgggacgatctggattatctagtcatcgacatgccgccgggcacaggcgacatccagctgacgctgtcgcagaaagtgccggtcaccggcgcgctgatcgtcaccaccccgcaggacatcgcgctgctggacgcgcgcaagggcgtcaccatgttccagaaggtgaacgtgcccattctggggctggtggaaaacatggccatccacatttgctccaactgcggccacgccgagcacatcttcggcgagggcggcgcggcgcgcatggccgccgatttcggcgtggagctgctgggctcgctgccgctggagctggccatccgcctggccgttgacgccggcaaacccagcgtggccgccgacccggccggcacgccggccgagctctaccgcgccatcgcccgccgcgtggcggtgaaagtgggcgaaaaagcgcaggacttctccggcaaattccccaagatcgtcatccagaacaactga

SEQ ID NO: 1302 - DNA, 777 bp, Chromobacterium substugae
atgattgcgatgtacgattccggcctgggcggactgtcggtgtggcgcgcggtgcgcgccgcgctgcccgcctggccgatcacctacctggcggaccaggcctattgcccgtatggccagcgcagccggcgggaaatcattgaacgcagcctgaaagtcggccattacctggtcagccagggcgccaccatcctggtggtggcctgcaacaccgccaccaccgcggcggtgtccagcatgcgcgaacagctgcccatccccatcgtcggcatcgaaccggcgatcaagccggcggcggcgatgagccgcaccggccgcatcgcggtgctggccaccgagtacacgctggccagcgaccgggtgaaagccttgctcgacgcccacgccggcgatgtggaagtgctgcgccgccccggccacggctgggtggagcaagtggaggccggcgagctggacagcgaacgcacccgccagctggtgcgccaggtggtggctccgctgctgggccagggcatcgaccatatcgcgctgggctgcacccactatcccttcctggccccgctgatccgcgagctcaccggcgacggcatccagctgtacgaccccgccgaggccatcgcccgccgcgtctgcgacctgctgcgccaacacggctgcgacagccagggcgacggctattgccgcttcatcagcaccgccgacggcaacgacatggccctgcgcctgccgcagctgataggccgcagcgacccggtggagtcggtgccgctggactga

SEQ ID NO: 1303 - DNA, 450 bp, Chromobacterium substugae
atgaaacgcccgctgtccttgctcgccgcgctgctcgcggccatcagcctgaacgcgcatgccgcgcccggctgcttcaatgtcgccggcgacatcgcgcgccagaccggcaaccgcctggatcgccaggaactgacggaagtgctgcagtcgctatcccgcagcggccagctgccgcctaaattcgtcaacaagaagcaggcgcgcgcagccggctggcaacccggccgcagcctgtggagcgtgccggcgctgcagggaaaatcgatgggcggcgaccgtttcggcaactacgaaaagcggctgccggctggccagtggcaggaggcggatctgggctataaaggcggcaagcgcggcgcctaccggctggtgttcagccaccaggggcagcgctacgtcagcgtagatcactacaaccgcttcatcgaggtgccgccatgccagtga

SEQ ID NO: 1304 - DNA, 279 bp, Chromobacterium substugae
atgccagtgaaagtgtgcgaactgcgccacatcgtcagccaggagcaattattcgacgaactcagccgccagctgcggctgccgccccacttcggccgcaatctggacgcgctgtacgactgcctggccaacgacgcgtccgggccgttcgagctggtctggcgcgacaccgccgaatcgaaacaggcgctgggcgccgacctttacgccaccgtgctggagattctggagaccgtcgccgaagcgcgcggcgacgtcaccctggacatccaccactag

SEQ ID NO: 1305 - DNA, 1245 bp, Chromobacterium substugae
atgaagtcgaaaaaactcacggccttgattctggtcggcatgctgctgggcattctggtcggctacctattccgtcagcacgccggcaatgacgccgccgcgatcaagtccttcgtcgatggcatgtccatcctcaccgatatcttcctgcgcctgatcaagatgatcatcgccccgctggtgatctccacgctggtggtcggcatcgccaagatgggcgacgcgaaatcggtgggccgcatcggcggcaagaccatgggctggttcgtcagcgcctcgctggtatcgctgaccctgggcctgatcatggtcaacatcctgaagccgggcgtggcgctgaacctgccgctgcccgacctgcacgccgactccggcatcaaggccagcgccatttcgctgaaggacttcgtcacccacgccatccccaagagcgtgttcgaggcgatggctaacaatgaaatcctgcagatcgtgatcttctcggtgttcttcggcagcgcgatggccgcgctgggcgagcgctccaaggcgctgatcgacgtgatcgacgtcgtcgcccacgtgatgctgaaagtcaccagctatgtgatgaacttcgctccgctggccgtgttcggcgccatcgccgccaccgtcgccaaggaaggcctgtccatcctcggcacttacggcaagttcatggcgcagttctacctgtccatcggcatcctgtgggtgctgctgatcgccgtcggcgtgctgatcgtcggcccgcgcctgttgcacctgatgggcatgatcaaagaaccgctgctgctgtcgttcaccaccgccagctccgaagccgcctatccgaaaaccctggaacagctggaacgcttcggcgtgtccaacaagatcgccagcttcgtgctgccgatgggctactcgttcaacctggacggctcgatgatgtactgcaccttcgcggtgatcttcatcgcccaggcctacggcatagatctgacgctggcgcaggaaatctccatgctgctgatcctgatgctgacctccaagggcatggccggcgtgccgcgcgcgtcgctggtggtgatcgccgccacgctgtcgcagttcaacatcccggaagccggcctgctgctgctgctcggcatcgaccacttcctggacatgggccgctccgccaccaacgtggtgggcaactccatcgccaccgccgtggtggccaaatgggaaggcgagctgaagccgggcaagcacgcctga

SEQ ID NO: 1306 - DNA, 87 bp, Chromobacterium substugae
ggagaggtggcagagtggtcgaatgtacctgactcgaaatcaggcgtacgtgcgagcgtaccgagggttcgaatccctccctctccg

SEQ ID NO: 1307 - DNA, 186 bp, Chromobacterium substugae
gtgaccgccgcggtaccggccccgccggtctaccgctacacccagcgccgcgacggcgccgtcatctacgttggcccggagccgccgacgcccgagcccggcaccagctgcacccggatggagtgggtggcggtgccgggcatggagtggggcggccagtgggccgatcctgagattgtgttttga

SEQ ID NO: 1308 - DNA, 837 bp, Chromobacterium substugae
atgcaacccctgacccaactggcggacgccgcacgcgccgcaatcgctgtcggcgatctgccggacagcgtgatcgaggccaccgcagaggccatcggcaaagacgcatacgactgcgtccgcgtctggtctgcctggggcgtcggcaccatggggccggacgatttcgtgcccatcgctgacgatggtgatctcgttgctgaaatcgccagggcggccatcgagtcgtatttagccgcaatgcagccggcgcaggccgccaccgagcagagcggcgaggctgaccgcatgggtgaactgccgaaggtgcgcagagacagccacgcagcggcaatcggcaacctgcgcgacatggcaagcagcatgctggagcgcgacgaaagcgtcggcatattcgccgacgaagatcagcatgcgctgctgatggcactggctgatttgctggaggaggccgaggggaatacgccggttgcgctctacacctgcccgcagcccgcgccggctgtgccggaggggtggcgtgacgtgctattcggcaatttcgatgccttagacgcagcggccgattccatcgatgcccgagggatgaactgccatgcagaggggattcgtgcggtagcgcacgcgctgaagcaactcgccgccacgccgcggccgcgcgacgcggcacgctggcgctacgccgctgagaatgggttcccgcgcagcttccggcagattcaccccacgcgcggaccccgcgagtggcatatcggggagcatgtgcccggcgcgctgacctacgaaacccctgaagctgctattgacgccaccatggcgcagcaggatcagtcgtga

SEQ ID NO: 1309 - DNA, 132 bp, Chromobacterium substugae
gtgatctaccagacctacggcgaggactaccacgtcacgccgcggcctgagccgctgccggcggcggccggccaggccgatgagccgcgctaccccgacgacggggtggagagcgacgggggcgagctgtaa

SEQ ID NO: 1310 - DNA, 285 bp, Chromobacterium substugae
atgatccgaatcgagctgatgcggctgtatggtgacgagcgcgccgacgaatggaaagccggcgcggcgttctgcacctgctcgaacagcaccaaactggtcaacctgccgccgaccgagaagatgctggccgccaagcgcaccgggccgaagccgccgaatttggcggaggcctacaagttcttcactggccaggatctgctcggcgcgcacaacgccatggtggacgtggccggctgccgcgaggtgtatttcggcatcctgcggcaccgggaggcagcgtga

SEQ ID NO: 1311 - DNA, 267 bp, Chromobacterium substugae
atgaaaaaatcgaagttcaccgaagaacagattgccttcgcgttgcgccaggcggagtccggcaccaccgtcgccgaggtctgccgcaagatgggcgtctccgaagccaccttctacaactggaagaagaaatacggcggcctgggcgtcagcgagttgcgccgcctgaaacaactggaagaagagaacgcccgtctcaagcgcatggtcgccgacctgagcttggacaagcagatgctgcaggaagtcatccaaaaaaagctgtga

SEQ ID NO: 1312 - DNA, 1302 bp, Chromobacterium substugae
gtgagccgtttctgccatgctctggcgctgtgcgccgcgttggccgggtgcgcgatgtcgccgcgggggggcgagctgtgcagcttctccggcgcggcgcagtcggcaaggccgggggcggtgatcgtcaatctgtacgctttgggagagggcctgccagagctggccgcgcagcaagtgttgccgcagggtggggagtggcggctggcggccgcgccggggcgctatctggcgttggcgttccaggacgaggcgggcgaccagcaatggagcggcggcgagtcttggggcgaggccggcggcggcgagccgctggtctgcgcgggaggcaggccgctgcgcggattggatatcgatctgggatcgcggcagccaggcggcgaggtgcgcaagatgctgcaggagtcacggcctgggccgcttgctctgccgcagggccgcgcgttgagcgtgggggaggtcggcaggatggatgatccgctgtggacgccggagtatgggcagcagggcatctggcatccggacctgtttatgcgccaggcgcatcccggcatttatttcctgcatccgtaccaggagggcaagatcccggtgctgttcattcatggcatgggcgggacgccgcgcaacttcgacacgttggtccagagtttggacgtcagccgttttcagccatggctggcgttttaccccagcgggagcgatttgacggtttcggcgcaaatgctgcacgtggttttgctgcaattgcagcggcgctttcattttccgagtttggtggtggttgcgcacagcatgggcgggctggtggcgcgccagctgttgctggacatggctgtggatcggtcggcggtcacggtgccgctgctgttgacactggcgacgccatgggccggggatggcggcgcaggcgtgggggtgaggcgcacgccggcgccatgggtagtggacagctggcgcaatctggcgccggacagcgtttttttgcggcaattattcgtgcgcgcggacggctcgcccaagacactgccggcggcgacccggcatgtgttgctgttcggctttcagcgcggcagatggatgtcgcgggaaccaggggatggccgggtagcgctgagcagccaactgcgcgacgaggcgcagagccaggcttcccgcatcaagggttaccagcaatctcatgccggcattctgcatgcggatgaagtgtcgcgcgatgtcagcgcggcgctggccagctatgcgctgccggctgctggtcagccggatggcgggcgaaggccgccaatgctgcgccgctga

SEQ ID NO: 1313 - DNA, 768 bp, Chromobacterium substugae
atggtcatctcgccggccaagacgctggactaccagacgccccccgcctccgcgcaattcagccagcccagcctgctggagcacagcgccgaactgataagcgagctgcgacgcaaaagcccgctggaaatcagccagttgatgagcatcagcgacgcgctggccaacctcaacgtcggccgctacgccgactggcagccgccatttgccccgaacaacgccaaacaggcgctgtacgccttcaagggagatgtctacgaaggcctcgacgccggtagcctgagtcccgacgccaccggctacctgcagcagcgcctgcgcatcctgtccggcctgtacggcgtgctgcgtccgctggacctgatgcaggcctaccgcctggaaatgggcacccggctggccaacccgcgcggcaagaacctgtacgagttctggggacggatcgtcaccgacgcgctgaacgcgcaactggaacagctgggacaaagcgtcctggtcaacctggcatcggaagagtatttcaagtcggtcaaagcgaagcagctgaacgccgccatcgtgacgccggtattccaggaccgcaagaatggccagtacaagatcatcagcttctacgccaagcgcgcgcgcggcctgatggcgcgctgggccgccgagcatcgcgtgctgcagccggaagctttgcgcgacttcgacagcgaaggctacgctttcgacgcctcagcctccagcgagctgacctgggtgttccgccgcgatctggaataa

SEQ ID NO: 1314 - DNA, 453 bp, Chromobacterium substugae
atgcgggtgttggtgcagagagtcagccaggcggaggtgacggttgccggcgaggtaaaggggcgtataggcgaaggcttgctgctgctggtgggcgtggaagaggcggatggcggcgacgatatcggctggctggtgcgcaaaatcagccagctgcgcattttcggcgacgagaacggggtgatgaaccgttcgctgctggagagcggcgggcaggcgctggcggtcagccagttcaccttgcacgccagcgtgaaaaaaggcaatcggccatcgtattcgcgcgcggcgcgcggcgagatttcgcagcccttgttcgaccgcttcgtcgccgaactggcggcggcgctgggcaagccggtgcctaccggggtgttcggcgccgacatgctggtgagcctggtcaatgatggtccggtgaccatctggctggatagccgcaatccggagtga

SEQ ID NO: 1315 - DNA, 1056 bp, Chromobacterium substugae
atgaacaagctgccgtggcgggtgctggtggtgccgtattacctgaaccgctacgcgcgccaggtgcatgtgttgcgggtggcgctggcgtttttgttcggcttgctgctgacgctctggtccggcatgccgcatggcggctggatgctggtgacgattttgatcgtgttgggcggcgcgccgcactggggcggcgttcagcgcaaggccttggagcgtatgggcggttcgctgctgggggcgctggccggcctggccgccatcgtgctgcatggctggtcgccgtatgcctgttatgcatggatggcggcggtggtgggtctgagcacctggcacgcccagggccgcggcggttacctggccttgctgaccggcatcacgctggtgattgtcggcggcctgggcgacgaacccatcgccgaagcgctgtggcgcagctgcaatgtgttgatcggctcgctgatcggcatggcggcggcggccacgctgccgttgcgggcgatagacagctggcgctttctgctggcggacaatctgcgcgaggcggcgctgctgtacaaccgcatcgcgcggcgcctgccggtggagggcgatgccgcgctggcggagttcaacgctcggttgatcctgatgcggggcttgctgccggcggtgacgcaggagtcgtcgctggcgcacggccggctggagcaggtgcagcgttgccagcgcggcatgtggacgctgctggaccggatggcggaagtggcggcggcgacgccggccttggcggaggagcgttcgccgcggcgcgccatcgtgcgcaccttgctgcgcgcggcgcatgcgttgcgtttcaaccagccgcagctgctggagcagcccttgccggcggctgacaatccgtcgcggatgcagtggccgtcgcattgccattggctggtggcggagttgacgctgacggtggaggagttgcggcaaaacctgcgccagacgctgccgcagctgatcgcggtgccgccgccggcgcgcagcctggtgcggcgcatgctgggtttggggcgggggatgaaatag

SEQ ID NO: 1316 - DNA, 1698 bp, Chromobacterium substugae
atggccgccggcctggatatgatgctgcagaactccagcctgttgcgcaatggcgacgacgtctggaaacgggccagggaaggtttccggctggacgaggtcaacgccgacaccgtgcgccggcaggagcgtttctacgccagccggccggaatacttcaagcgcacgctggaccgcagccgcaaatacctgttccatatcatgaacgaggtggagcgccgcggcatgccgaccgaaatcgcgctgctgccgatggtggaaagcgccttcgttcccaccgcgctgtcgcgcgtgcccgcttatatctcccccaccggcgcgtccgggctgtggcagatcatgccggccaccggccgtcaatacggcctggagcaaacctggtggtacgacggccgccgcgacgtgatggagtcgacccgcgccgcgctggactacctgcaaaacctgtacgcccagttcggcgactggaacctggcgctggccgcctacaactggggcgaaggcaatgtcgcgcgcgcgcttgccaaagcgcaggccgcaggccagccggccacctacgaaagcatccgcctgcccaacgaaacccgcaactacgtgcccaagctgctggcggtgcgcaacatcctgctgaatccggaaaaattcggcgtgcggctggacaagtttcccaacaagccctacttcgtcgcggtttccgccagcaagcacatgaacatcgacatcgccgcccggctggccggcatatcggtggcggagttcaaagagctgaacccggccttcaacctgccggtgttcgcctacaaggccggccggcagatgctgctgcccgccgccaaggccgacaagttccaggccaatctggacaaatggaaccagccgctgctgacctgggaagtctacatccccaaaaccgatgaaagcgccaacagcatcgccagcagccacggcatgagcgccggccagctgcaagcggccaatcgcctgaacagcccgacgctgaaggccggccaaccggttctggtggcgatgaacaaaaccctgaacgatggccagccgctggagtccaccgatgcgcagatcggcgacgcgccggccggcgccaccctgctggccaaggccgacaccgccgccgcgccgcagccggcgcccgcagttgctcaggcaactcccgcccccgtcatcatgaccgctaccgccgcccccgcggcgccccaggcgcaggatgccgccccgcgtcaaaccgtggtgatcgccagcgccggagttcaggacggcgccgccaagtcgctggccacccgcgatatcggcagctataccgtcgccagcggcgacaccctgtacagcatcgcccgccgcaacaatctggccgtggaagaactcaagtcgctgaacaggctggacggcaatatggtacaagtcggccagcaactgcagctgcaatccgtcgaacaaggcgagactcagctggccagcgccggcccgtccgaccgcgacgccgacccggccctgatccaggtcagcgacagccggcccgcgccggcccgccactccaccgaatacacggtgaaacgcggcgacaccctgttcagcatcgcccgccgcttcggcgtcaagcacgacgacatccagcgcctcaatggcagccgccaggccagtcgcctgcagccggggcaaaaggtgaagatcgtcggcctgtga

SEQ ID NO: 1317 - DNA, 768 bp, Chromobacterium substugae
atgccagccaagttcagcgtcaccccggtcggggcgttctcagacaattatatctgggttttgcggctcgacgatcgcgccgttgccgtcgaccccggcgacgcggcgccgttgctagcgttcctgcgccgggaaaagctgcggctcgaggccatcctgatcacccaccaccacgccgaccactgcggcggcctggccgaactctcccgcgactggccggatgcgccggtatacggcccgccgggcatctccggcgtgacggcggcggtcaaggaaggcgatgaagtgccgctcgcgttcggaccggccgaggtgctggcggtgcctggccacacgctggaccacctggcataccggatcggcgaccacctgttttgcggcgacacgatgttcgccgcaggctgcggcagggttttcgagggcacgcccgcgcaactgctcgcttcgctgaaaaaactggcgcaactgccgccccggaccaaagtttaccccgcccacgagtacacgctgtcgaatctgcgcttcgccctagccgccgaccccctcaacccagtgctggcgatgcggcaaagccgcgaccaggcgctgcgcgagcagggcttgcccacgctgcccagcaccatcgccgtcgaactggccagcaaccccttcctgcgctgccaggagccggccatccgcgcatccctgctggcgcaaggcggccgcgccgacgacgcagaggccgacagcttcgctcgcctgcgcgcctggaagaacgatttccgctaa

SEQ ID NO: 1318 - DNA, 768 bp, Chromobacterium substugae
atgaaaaattcgtttggcggctggctgaccggcaccgaactgggccgttatctgctggcgcgcgagcaagattacttcgaacgggcggtggctgacgtgttcggctaccacgcggtgcaggtgggcgtgccggagatggactgcctgcgcggcaaccgcatcccctggcaatgccgggtggcggaggccggagaggtggatgtccgctgcgatccggccttcctgcctttcgagaaccgcagcctcgatctgctggtgatgccccatgtgctggattttaccactctgccgcaccaggtattgcgtgaagccgaccgggtgctgatgcctgaggggcggttgatcctcacgggcttcaatccgctgtcgctgtggggcgtgcgccgcttgatccaggggcgcgagtcggtgccgtggaacggcagcttcctgacccaactgcgggtgaaggactggctgacgctgctggatctcgagctggaagaggcggccttcatggcctatgcgccgccgttcgcgcgcggcgactggctgtgccgctgcgacttcatggaagacgccggcgagcgctggtggccgctggccgccggggtatacggcatcgaggcggtgaagcgccagcgcggcatgcggctgatcaccccaaactggaagcagaagcaggccaagaacaagggcgcgctgggagtggtggctggcaacgagcgccagcacacccacaagcgccccgacgcaaccgagcgggacggcgcgccgtcctgccattga

SEQ ID NO: 1319 - DNA, 444 bp, Chromobacterium substugae
atgacaacggaagacaaggtcgagatttacaccgacggcgcctgcaagggcaatcccgggcccggcggctggggcgcgctgctgcgctacaaggggcgggagaaggagatattcggcggcgaacccggcaccaccaacaaccggatggagatcatggcggtgatccgcgcgctggcctcgttgaaccggccgtgccaggtggtggtctataccgactcgcagtatgtgcagaagggcatctccgagtggatacacggctggaaggcgcgcggctggaagaccgcggccaaggagccggtgaagaacgccgacctgtggcagcagctggacgccgagcgcaaccgccatctggcggtggagtggcgctgggtgaagggccacgccggccacgaattcaacgaaagagccgaccaactcgccaacaagggcgtggagacggtctga

SEQ ID NO: 1320 - DNA, 720 bp, Chromobacterium substugae
atgagacagattatcctcgataccgaaaccaccggtctcgatcctaaccagggccatcgcatcatcgaattcgccggcctggaaatggtcggccgcaagctgaccggcaagcacctgcatctttacatccatcccgagcgcgacatcgatccggacgcgcagcgggtgcacggcatctcgctggagtttctcgccggcaagccggtataccgccaggtggcgcaggaaatcgcagatttcctgcgcggcgccgaactgatcatccacaacgcgccgttcgatgtgggcttcctcaacgccgaattcgccaagctgggcctggagccgatcgacaagctgtgcgccagcgtgatcgacacgctgcgcgaagcgcgcgacatgttcccgggcaagcgcaacagcctggacgccttgtgcgaccgcttcgagatcgaccgctccaaccgtaccttgcacggcgcgctggtggactgcgagctgctgtccgaggtgtacctgtggatgacgcgcggccaggaaagcctggcgatggacatcgacgtggagctgcccggcgacgccggcggcgccatccagttcgagcgcaaaccgttgacggtgctggccgccagcgaagcggagcaggccgaacaccaggcctacctcgacgcgctggacaaggcggtgaagggacagtgcctgtggcgcagcctggagcagccggcgcaggcggagggctga

SEQ ID NO: 1321 - DNA, 687 bp, Chromobacterium substugae
atggccaggtatatcgccctggtgccggcggccggctccggcagccgtttcggcgcggccagtcccaagcaatacttgcagctcaacggcaagccgctgatgtggcacacgctggccacgttggcggcggtgtcggcgatagacgaagtggcggtggtgatttcgccgcaggacgaatggttcgacgacttcgcctgggatctgcccaagctgcgggtttgccgcgtggggggggcttcgcgcgccgaaagcgtgggcaacggcctagcggcgctgggatgcgatgccgacgactgggtgctggtgcacgacgccgcgcgctgctgcctgtcggtggcggcggtggagcgcctgatcgccactctgtccggccaccaggtgggcggcctgctggcgctgccggtgccggacaccgtcaagcgcgcggacagcgaaggccatgtcggcgccacggtgccgcgcaacggcctgtggctggcgcagacgccgcagatgttccgcgccggggtgttggaaaaggccttgcgcgagcagccggccgacgacatcaccgacgaggcgtcggcggtcgagcgcgccggcctgaagccgctgctggtggaaggcgacgcgcagaatttcaaagtgacctacccgcgcgacctggcgctggcgcgcgccatcctggcggcccgcgacggccagtga

SEQ ID NO: 1322 - DNA, 477 bp, Chromobacterium substugae
atgttccgtatcggacaaggctacgacgtgcatcaactggtggaaggccggccgctgatcctgggcggagtgcgggttccgcatgagaagggcctgctcggccactccgacgccgacgcgctgctgcatgcgattaccgacgcgctgctgggcgcggccgcgctgggcgacatcggccgccatttcccggataccgccgccgagttcaagggcgcggacagccgcgcgctgctgcgcgaggccgccgcccgggtgcgcgccgccggctggcggccggtcaacgtcgacagcacgctgatcgcgcaaaaaccgaagctcgcgccccacatcgacgcgatgcgcgccaatatcgccgaggatctggggctggagatcggcgcggtcaacgtcaagggcaaaaccaacgagaagctgggctatctggggcgctgcgaggcgatagaggcccaggccatctgcttgctgatgccggcttga

SEQ ID NO: 1323 - DNA, 660 bp, Chromobacterium substugae
atgctgacccaggatcaactgaagctcgccgtcgccaagaaggcgctggaattcgtgccggacgacgccataatcggcgtgggcaccggcagcaccgtcaacctgttcatcgaggaactggccggcatcaagggccgcatcaagggcgcggtgtcgagctccgaggcgtccaccgcccgcctgaaagcccatcacattccggtgttcgacctgaacgaagtggaaaagctgacggtgtacatcgacggcgccgacgagatcaaccaccacctgcacatgatcaagggcggcggcgcggcgctgacgcgcgagaagatcgtcgccggcgtcgccgacgaattcatctgcatcgccgacgagaacaagtacgtggccatgctgggcgcctttccgctgcccatcgaggtgattccgatggcgcgcagctatgtcgcgcgcgagctggtgcgactgggcgggcacccggagctgcgccagggcgtgaccaccgacaacggcaacgtgatcatcgacgtgcacggcctgcagatcatgaagccggtggagctggaggaaaccatcaaccacatcgccggcgtcgtcacctgcggcttgttcgcccgccgccgcgccgacgtgctggtgctgggcaagcaaggcggcgtggaagtgctgcgctaa

SEQ ID NO: 1324 - DNA, 705 bp, Chromobacterium substugae
atggcagatcacatttccaaacagttcgatctggaactggaaaccatccggacccgcgtattgcaaatgggcgggctggtggagcagcagattctgtccgccatcgaagcgatgatgtccggcgacatcgcccgcctggacaaggtgatggccgaggacgcgctggtcaatgcgatggaagtgggcatagacgacgactgtctgcacatcatcgcgcgccgccagccggcggccagcgacctgcgcatcgtcttcaccgtgatcaagatcatcaccgacctggagcgcatcggcgacgaagcggcgaagatcgcgcgcatgggcaagaccatccatcaggcggaacgctaccagatgccgcgcttccgcgagatcgagaagatggccgccgtggcgctggcgatgctgcgccgcgcgctggacgccttcgcccggctggacaccagcgccgcgttggaattggcggaagaggacgagcggctggacgagaatttcgccgccgagctgcgccagctgatcactttcatgatggaagacccgcgcaccatcagcatgtctatcgacacgctgttcatctccaaggcgatcgagcgcatcggcgaccattcgaagaacatctccgaatacgtggtctacctggtgaagggcaaggacatccgccacaccacgctggaagacaagaagcgcgagacgctgggacgctga

SEQ ID NO: 1325 - DNA, 1494 bp, Chromobacterium substugae
ttgacacacgccacgcccccccacaccgtactggccaccatcgacctgggctccaacagcttccggctgcaggtttcccgcgtggtggacgaccagctgtacacgctggacgtgatgaaagagaccgtgcgcctgggcgccggcctcaccgccgacaaatacctgaacgacgacacccgcgagcgggcgctggcttgcctcgcgcgcttcggcgagcgcctgcgcggcttcgtggccggccaggtgcgggtggtcggcaccaataccctgcgggtggcgaagaacgccgccggcttcatcgccgaagccgaagagcggctgggcttcccgatagaagtgatcgccggccgcgaagaggcccggctgatctatctgggcgccgcccactcgctgccggacaccaaggagcggcgaatggtggtggacatcggcggcggctccaccgagttcatcatcggcagccattacaaggcgctggtcaccgaaagcctgccgctgggctgcgtcagctacacgctgcgcttcttcccggacggcaagctgacgcgcaacaacttccgcgacgcggtgctggcggcgcgcaacgagatccagcgcatccgccacgaataccgtcccagcgagtggcagctcgcggtgggcacttccggcaccgcgcgctcgctgcgcgacgtgctggagatcaacgactggagccgcgccgacatcacgctggccggcatggagcggctgcgggcggttctgatcgagcagggcagcatggacgcgataaaggtcaacggcctgaaggccgaccgcgcgccggtgctggccggcggcctagccatcatgatcgcggtgttcgaggagctgcaggtcgagaagatgatcgtcaccgaaggcgcgctgcgcgacggcgtgctgtacgacctgctgggccgccagcgcgagaaggacatgcgcgacagcacggtggcgctgttcaagcgccgctaccacgccgacacccagcaggccgagcgcgtcaacctgctgtcggaacggctttaccggatggtggccggagaggatgtcgaccaggacatgctcaagcgcctctcttgggcggccaagttgcacgagatcggcctgaccatcgcccacaccgcctatcacaagcattccgcctacatcctgcagaacgccgacatgccgggcttttccaagcgcgagcaggcgacgctggcgaccatcgtgctgggccaccgcggcgacatgggcaagatggcgcagtacatcggccagccggcgctgtggcaggcggtggtggcgctgcgcctggcagtgctgttctaccgcagccgcatcaatgtcgagctgccgggcaggctggacctgcgccagcacgcgcgcggcttcacgctgtcgctgagcaagagctggctcagcgacaatccgctgtcggccagcagcttccgccaggaagtggggcagtggaaaaacgtcggcttccagctggacattgtgcaggaatag

SEQ ID NO: 1326 - DNA, 1065 bp, Chromobacterium substugae
atgcggcacccggaattgaaggagcggctgcccacgctgggcgaacaggcggggacgctgctgtcggtgggcgaggccaagcatgccggcaccaaactgtccttgttcgatttttgcgccgatgaggcgatcgagctggccgagctgccgctggccaatctggcgagctaccgccgccgcggcgaggtgctgtggctcaacgtctacggcctcagcgacgccgccgccatccaggcgataggcgagcgcttcggcctgcacccgctggtgcaggaggacatcctcaatgcgcgccagcggcccaagctggaagactacgacgattacctgttcctggcctgccgggtgttcgactaccagcagggcgggcggctgcagtccgaccagatgtacctggtgctgggcgacggtttcgtgctgtcgttccaggaaaagccgaccggggtgttcgagcaggtgcgagagcggctgcgcaagggccgcggcgcgctgcggcggcgcggcgccgactacctggcttattcattgctggacgccatcattgacgactacttcggcgtgctcggccagttcaacgacaaggtggagcgcaccgacggccagctgctggccggccgcgacaacggcgtgctgcgccagatccagcggctgaagcgcgattgcctgaagctgaggcgcgcgctgctgccgctgcgcgaggtgctgctgtcgctgaaccgcggcgacgaggagcgcttcggcgaggatacccgcgtctacctgcgcgacgcctacgaccacgtggtccatgtgctggaatcgctggagatgaaccgcgaaatggtcggcgacatgatggacctctatctgtccacccagtcgcaccggctcaatctgcagatgcgggtgctgacggtgatcacgatgatcttcatgccgctgacgctgatcgccggcatctacggcatgaacttcgagtacatgccggagttgaagtggcactacggctacttcatcgtgctgctggcgatgggcgggatttccgcctgcatgagctggtggttctggaagcggcggtggatttga

SEQ ID NO: 1327 - DNA, 600 bp, Chromobacterium substugae
ttgatcgtggtggatgtgcagaacagcttctgtcccggcggcgcgctggccgtccccggcggcgacgaagtggtgcccttgatcaaccacctggcgctgctgttcgaaaacgtggtgctgacccaggactggcacccggccggccacgtatcgttcgccggcagccacccgggcagcaagccttttcagacgatagacctgccctacggcccgcagacgctgtggccggcgcattgcgtgcaaggcagcgtcggcgccgacttccacccggaactggaaacccagcacgcgcggctgatcgtgcgcaagggcggcaacccgcaggtggacagctactccgccttcgtcgaggccgaccgcgccacccgcaccggcctggccggctatctggacgcgctgggggtgaaaaaggtctggctggccggcctcgccaccgatttttgcgtggcctggagcgccatcgacgcccgcgccgccggcttcgagactttcgtggtcgaagacgcctgccgcgcgatagacatagacggctcgctggccgacgcctggatgaagatgcgccaggccggcgtcaaacggctgcgatcggacgaggtgtaa

SEQ ID NO: 1328 - DNA, 2340 bp, Chromobacterium substugae
atgacccagtccctgcttaccctgccggtagccggcatgagttgcgccgcctgcgccgcccgcatcgagaaacagctgaaccgcctggacggcgtgcaggcctcggtcagcttcgccaatgaaagcgcgcagctgcgctacgaccccaatcaaacccagcccggacaactggtggacgccatcgtccgctgcggcttcgaggtgccgcgccagacgctgctgctcggcatcggcggcatgagctgcgcagcctgcgcggcccggctggaaaaggcgctgggccgattgcccggcgtggaggccagcgtcaacttcgccgccgagtcggcgaggatcgattacctgccggggctagccgaccgcgaccgggtgctggacgcggtgcgcaaagccggtttcgagccttctttgcgcgaagacggcggcggcgaagccgaggcgcgctatcgccgcgagctggcgtggttcgccgcgtcggcgctgctgacgctgcctttcatggtggaaatggcggcgatgttcgccggcggccaccacggctggctgcccaggctgtggcagctggcgctggcgacgccggtgcagttcgtcgtcggctggcgcttttaccgcggcgcctggcaggcgctgcgcggcggcgtcgccaatatggacgtgctggtagcgctgggcaccagcatggcctggctgctgtcggccgcggtgaccctgctgggtctggagggcgagcacgtgtatttcgaggccagcgcggcggtgatcacgctggtgttgctgggcaagctgctggaggcgcgggccaagggcaagacctcggcggcgatcgccgcgctggcgaagctggccccccgcaccgcccgcgtcgagcgcgatggcgagctgttcgaggtggcggtggagcaactgcaacgcggcgatgtggtggtggtgcgccacggcgaccgcctgccggtggatggcgaggtggtggagggccaggcctggctggacgagagcctgctgacaggcgagagccggccggtggccaagcaggccggcgacaaggtctacgccgccacccgcaaccaggacggcatgctcaaggtgcgcgccaccggcgtaggcggcgacacccagttggcggagatcgtgcgcatggtggcggcggcccagggcagcaaggcgccgatccagcggctggccgaccgtatttccgccgtcttcgtgccggcggtcaccgcgctggcgctgctgaccttcgccttgagcggctggctgttcggcagctggacgacggcgctgatccacgcggtggcggtgctggtgatcgcctgcccgtgcgcgctgggcctggccacgccgaccgcggtgatggtgggcgtgggcaacggcgcgcgccgcggcatcctgttccgcaacgccgccgcgctggagcaggccggcaaggtggacgtgctgctggtggacaagaccggcacgctgaccgagggccggccgacgctgcgccacgcgttggcgctggacggcgacgagaaccgcttgatccagctggccgccagcgccgaggccggctccgagcatccgctggcccatgccttgctgcagcgggcgaaagagcgggaactgcccttgctggcctgcgagcgctttcgcgccgatgtcggcagcggcgtcgaggccgcgctgccgggcgtgggcacggtcaaggtgggcgtgccgtcctggatcggtctggatctgccggcagaggcggctgactggccgcaggaaggcaataccgtggtggcggtgagcctggacgagcggccgctgggtctgttggccttggccgatccgctgcgcgacagttccaagggcgcggtggaagcgctacggagcttgggcatcaaagtggtgatgctgaccggcgatcatgagagcaccgcgcgcggcatcgccgccgaagccggcattgacgagtggcgcgccggcatgaagccgcaggacaaggccgatgtggtcaaatactggcaacagcaaggccgcaaggtggcgatgctgggcgacggcgtcaacgacgcgccggcgctggccgcggccgacgtcagcctggcgatgggcgccggctccgacgtggccatcgccgccgccgacatcacgctgatgcacggcgacctggcgcacgcggcggacgccatccggctgtcgcgcgccagcctggccaaaatccgccagaatctggccttcgctttcgtttacaacgtgctgggcattccgctagcggcgctgggcatgctcaacccggtgatcgccggggcggcgatggcggccagctcggtgtcggtggtatccaattcgctgttgctgcgccgctggcgctga

SEQ ID NO: 1329 - DNA, 210 bp, Chromobacterium substugae
atgactgaactggttttgaacattgacggcatgacctgcggcggctgcgtcaaaagcgtgagcggcatcctgggaaccatggccggcgtcgccgaagtgcaggtcagcctggaagagaagcgggcgacggtggattacgacgcggcggtggtgtcgccgcaggagctggcggcggcggtggccgacgccggtttcgacgtcagcttctga

SEQ ID NO: 1330 - DNA, 1020 bp, Chromobacterium substugae
atgtgcacgcattttctgctgcagtcgcaggacaagcaggtcgtggtggggcgttcgatggatttctcccggccgctgacgccggcattctacgtgcaacgccgcggcgagcgcttttcgcagccggtgtgggccggcgcggagttccgcaagatggccgacgccgaggcctggcgggtccgccatggctatgtcggcgtttgctcttcccacttgccgctgcccggcatttcccagcgcatcgtcaccgacggcctgaacgaggcggggctgagcgtcagcttgctgtggctgccgaatgcccgctaccaggaattttccagcctgggcaccacggtgctggcgcccttgttcgccgactgggtgctggcgcattgcgccagcgtggccgacgtctgggagatgctgcccagccggcagttctggctgccggcctggctggccaagtcgctgccgttgcatgccgccatcgtggacaaggacggccgttccatcgtggtggagttccaggacggccagcagaagatctacagcaatccggcgggcgtctgcgccaatgcgccgtggtttccctggcatctggacaatctgggccattacctcggcctgacgcccgacgatccgccgccgcgggagttcggcaatctgcagctgcaagccagcggcggtggcggcctggccaatctgcccggcggctattcctcgccggcgcgctttgtccgcgccgcctatctcaagcagttcgccgatccggcggcggatctgggcgcagcctatgcgctggccgcccagctgctgggcgcggtggagacgccgcgcggcgccatccgcgacggcgccgcgcgcgagcacacccagtggacggtgctgacggggctggccagcggcgaaatcgcgctgcgcgcctatggcggcatgcgttattgcggcctgaggctggccgatatcgatttcgccgcggtgaaaagcggcgaaatcccgctgccggggctggacgacatcgccttcatgcgcgcttag

SEQ ID NO: 1331 - DNA, 318 bp, Chromobacterium substugae
atgcaaggttatcagctgtcgtttttcacccagcagggacaccgtcatcacggcgtgccgctggccgaatggatactacaggaagcccaccgcctgggcataggcggcgccaccctgttcgccgccagcgagggcttcggcaacgaccgccgcatccacgccgcccgctttttcgagctggccgaccagcccgaggaagtgacgatggcgctgagcgcgcacgaggccgagcgcctgctggagcggctgcgcgaagaaggcgtcaaagtgttctacgtgaaaacgccggtggagtacggcacgctgggcgcggactaa

SEQ ID NO: 1332 - DNA, 768 bp, Chromobacterium substugae
atgcatatccgaatcctgggcgcctccgcctgcgtcggccatcctggccagaccacctgctttcaggtgggccaggacacgctgatagactgcggcaccggctgcggcagcctcgataccgaagagatgctcgccatccggcgcgtgctgctcaccaacagccacatcgaccactgcgcgctgctgccgctgctcgccgacgtccacgccggctaccgcggcagcggcctggaagtctatggactggcggaaacgctgaacattctgcgccagcacctcttcaacggcgccatctggccggactacacccgcctgccctcgccggaatgcccatggctgcgcatgatgccggtgcaggtcggcgacaccgttcccctcgtcgacggcctggccaccgccctgccagcccagcgccacgtgccggcgatgggctggctgatagaaggcccgtggcgggcgctggccttcagcggcgactccgcgccctgccctgccttctggcactgggtatgcggcgtgccgtcgctgaccgatgtgatctgcgaagtcacctacagcaacgaccgccagcacgaggccgacgagcagagccatatggcgcccgccacgctggcgccgttgctggccaatctgcccgccaatgttcacctgtggatatcgcacgcctatccctgctgccgcgacatgctgctgcaggagatgcagggcggcgcgccggcaggcctgcgcgtatgcccgttgaaggaaggcacgttgatcgagctgtga

SEQ ID NO: 1333 - DNA, 1866 bp, Chromobacterium substugae
atgcagaagcaaattctgaccgcgctggcggcgtcgctgttggccggttcggcgctggccgcggatattccgctgcgcgactttttccgcaacgccgagcaaagcggcttcagcctgtcgccggatggccaaagcgtggctttcctgtcgccgtgggagagccgcaagaacatcgtggtgcgccgccagggcaagcccgaccagcgcgtcaccgcgatcaaggaccgcgacctgtccggctatttctggaaaggcaacgaccggctggtgtatgtgaaggacaacgccggcgatgaaaacttccacctgtacagcgtggatctcgccagcggcgagagcaaggacctgacgccgttccccggcgtgcgcgtcgacatcgtggacggcctggtcgaccgcgacgacgaactcctggtgcagatgaacaagcgcaacccggagctgttcgacgtttaccgcgtcaatctgaaaaccggcgagttgaagctggaagcggaaaatccgggcaaggtggccggctggctcactgatcacgacggcaatatccgtttggcgatcgaaagcgacggcgtcaacaacacggtgctgtaccgcgacgagccgggcggccccttccgcaagcttttcaccaccaatttccgcgagaacttcacgccgctgttcttcaccttcgacaatcagcgcttctacgcggccagcagcctgggccgcgacaaggccgccatcgtcgaatacgacccgaaaaccggcaaggaagtgagagaagtctacgcccgccaggatgtcgacgtcgccggcctgggcttctcgcacaagcgcaaggtgatcacctgcgccgactttgaaaccgacaagccgggccgccagtgcttcgacgcgcaaagcgaagccttgctatccggcctggaggccaagctgccgggttaccaagtggacatcacctccagcaaccgcgatgaaacccgcttcatcgtgaccgcctggaacgaccgcacccgcggcaagagctatctgtatgacaagagcagcggcaagctggaactgctggccgagctggcgccgtggctgccggaagacaagatggccgtcatgaagccgatccagtaccagagccgcgatggcctgaccatcaacggctacctgacactgccgcagggcaaggaagacgccaagggcctgccggtgatcatcaatccgcacggcgggccgtggtatcgagacagctggcatttcaacccggaagtgcagtttttcgccagccgcggctgggcggtgctgcagatgaacttccgcggctccaccggctatggccgccagttttgggaggcctcgttcaaggagtggggcggcaagatgcaggatgacgtcagcgacggcgtcgactggctggtcaagcaaggcgtggccgatccgaagaaggtgtgcatctacggcggcagctacggcggctacgccaccttgtccggcatcaccaaaacgccggagctgtaccgttgcgcggtggattacgtcggcgtgtccaacctgttcaccttcatgaagaccattccgccgtactggaagccgttcctggattcgatgtacgagatggtgggcaatccggaaaaggataaggatctgctgcgcgaacgctcgccggtgttccatgtcgaccgcatccagtcgccgctgctggtgctgcagggcgccaaggacccgcgcgtcaacatcaacgagtccaaccagatcgtcgacgcgctgaagaagcgcggcgtggaggtcgagtacatcgtcaaggacaacgagggccacggcttccacaacgaggaaaaccgcttcgccgcctatggcgcgatggagcaattcttcaagaagtacctggactga

SEQ ID NO: 1334 - DNA, 1371 bp, Chromobacterium substugae
gtgtatccgctggagatcttcagcgccatcgccgtcggctacctgctgttgtgcggcctgctgcagttgctggggcattggggcgcgcggcgctggcggcagccgctgtcgcagccgcgcttcaagccgggcgggttttccgctaaggtggcgctgtttccccacccctttcatgccatgcatccaacccatgcggcgaacgaccgcggcttctggcgcatcctgctggttttcctgaagttgggcctcacctccttcggcggcccggtcgcccacctcggctatttccgcgccgaattcgtcgagcgccggcgctggctgccggaacgcgactacgccgacctggtggcgctatgccaatttttgcccggtcccgccagcagccaggtcgggatggcgctgggcatgggccggggcggactcgccggcgcgctggcggcctggctgggctttaccttgccgtcggcgctgctgatgctgtcgctggcgctgggcttgtcgcatcacgcccaggccgtgccgcccggcgccttgcatggactgaagctggccgcggtggcggtggtggcgcaggcggtgtggagcatggcgcgccagctgtgcccagaccggccgcggttgacgctgatgggcgcaagctgttgcctggccttgttgatgcccgcgccctggctgtccttggccgtcatcgcgctggctggcgcggccggtcgccagtggctgacgcccccgccccaaagcgcgcctgggctcgacgacgccaccgcgcccagccgccgccgcggcgcgctgtggctggcgctgttcttcgcattgctggcaggcctgccgctgctggccgcggccggcccaagctaccggctggccttgttcgacgccttctaccgcagcggcgcgctggtgttcggcggcggccacgtggtgctgccgctgctggaaaccgcgtccgtcgccagcggctgggtgcccagggacgccttcctggccggctatggcgcggcgcaagccttgcccggaccgctattcgccttcgcggcctttctcggcgccgccggcgacggcagctggcaaagcggcgcgctggcgctggtcgccatctttctgcccggcttcctgttgctggccggggcgctgccgttctggcgccggctgcgcgccgcgcccggcgctcaatcggcgctggccggcatcaatgccgccgtggtcggcctgctgctcgccgcgctgtaccacccggcctggaccagcgcggtgcgcgcgccggccgatttcgccgccgtcctgctggccttgctggcgctggccgcatggaaactgccgccctggctggtggtgggcttgtgcgcggcggccggctggctggcgctgtaa

SEQ ID NO: 1335 - DNA, 741 bp, Chromobacterium substugae
atgaccccacccgcctggctcggccacaactggctggagccgcattacctgatctggctgggcaagggcgcgctgctgaccggctggctgtccctgctggtcatcgccgccgccagcctgctcggcgtcgccttcaccgcgctgctggacggcgcgccgcggccgctgcggctagcgacgcggctattcgtcggcctgcaccgcaatacgccgctgatggtgcaattgctgctgtggtatttcggcgtgtccggcctgctgccggacgaggcgaagatctggctgaacacgccgcgcgcgcttgagctgccccttggcctggcgttgccgtggccgtcgttcgaattcctggccgccttcaccgcgctgacgctgtacagcgccgccttcatcagcggcgagctgcaggccggactgaacgcggtgtccaaggggcagcggctggcggccaaggcgctgggcatgagcggctggcaggcgctgcgcctggtggtgctgccgcaggcctggcagttggtgaagcggccgctggtcggccagtacaccgccatcgtcaaaaacacttcgctgacgatggccatcggcctggccgagctgtcctacgcctcgcgccaggtggaaaccgaaacgctgctggccttccagtcattcgccgccgccaccgcgctgtatctgatcctggtgctgatcacccaactgctggcccaaaggccggagcctgaatggaggacattgcgatga

SEQ ID NO: 1336 - DNA, 804 bp, Chromobacterium substugae
atgaaaaagacactcgccctcgcactcgccgtcgccctgacctccaccgccgccctggccgaccgcctggacgacatcaagaaagccggcgtgctgcgcgtcgccgccttcgacagcaacccgccgttcggcttcctcgatgccaaaacccgccagatttccggcctggatgtcgacgtggcccagcacatcgccaagaagctgggcgtgaagctgcaactggtcgccaccaacccggccaaccgcgtgccgctcttggtatccggcaaagccgacatcgtcgccgccaacttcaccgtcaccgacgagcgcaagaagcaagtggacttcagcctgccctacttcgcctccggccagcagttcatcgtccgcaagggcacgctgcaaaagccggaacagctggccggcctgcgcgtaggcgtggacaagggcaccacccaggaagtgtacctgcgcgaaaaatacccgaagaccaccgtggtggcgtatgacgacaccccgctggccttcaccgcgctgcgcaacggcaacgtccaggccatcacccaggacggctccaagctggccgcgctgttggccaacgcgccggataaggccaagtacgagctggcgccgttcacgctgacccgcgaataccaggccatcggcctgcccaagggcgaggcgcgcctggccaaggtagtgaacgacacgctgcagcagctggaaaagagcggcgacgccgccaagatctacgaccgctggttcggtcccaagaccaaggccccgctgccgcgcgacttcaagatcggcgacgcggtctga

SEQ ID NO: 1337 - DNA, 852 bp, Chromobacterium substugae
atgctgattcatcctcagttcgacccggtcgccgtccatctcggcccgctggcggtccactggtacggtttgatgtacctgctgggcttcaccctgttcctcgtcatggggaaataccgcctgaaaaaaggcaatgacgtgctgaccgtcgcccagctggacgacatgctgatgtacggcgccgtcggcgtggtgctgggcggacgcctgggcgaggtgctgttctaccagcccggcttctacttcagccatccgctggaaatcttcatggtgtggaagggcggcatgtccttccacggcggcttcatcggcgtgctggtcgcggtggcgctgtacggccgcaaggtgaaccgctccttctggcaactaaccgacttcgtcgcgccgctggtgccgctgggcctggcggccggccgcgtcggcaacttcatcaacggcgagctgtggggccgggtggccagcccggacctgccgtgggcgatgctgtttccgcaggcgcggctcgacgacgtcgccgaggcgcagcaatcggccgacctgatgaacatgctgatgcagtacggcggcctcgcccgccatccgtcgcagctgtacgaattcgcgctggaaggcatcgcgctgttttccgcgctgtggatctacagcgccaaaccgcgcgccaccggcaaggtgtcggcgctgttcctgatcggctatggcttagcgcgtttctgcagcgaattcttccgcaatccagacgccggcatcttcggcaagtccgatgtgatcagcatgggccagtggctgagcctgccgatgatcatcatcggcgtcgccttgttcgtattcttcggcaagcgcaaggccgcttga

SEQ ID NO: 1338 - DNA, 129 bp, Chromobacterium substugae
ttgaggcatgaggcttcctttatctgttcaaagccggtcgtcgttccgtcacgccagcagggtaagctggcggcgtttggcccatgggtgccgggtggcccaaaccagaagccgagtcgccgcgggtga

SEQ ID NO: 1339 - DNA, 1854 bp, Chromobacterium substugae
atgcctcaataccgctcccgcacctccactgccggccgcaacatggcgggtgcccgcgcgctgtggcgcgccaccgggatgaccgacgccgacttcggcaagcccatcatcgccatcgccaactccttcacccagttcgtgcccggccacgtgcacctgcagaacatgggccagctggtggcgcgcgagatagaaaaagccggcggcgtggccaaggagttcaacaccatcgccatcgacgacggcatcgccatgggccacggcggcatgctgtacagtctgccttcccgcgatctgatcgccgatagcgtggaatacatggtcaacgcccactgcgccgacgcgctggtgtgcatctccaactgcgacaagatcacgcccggcatgctgatggcggcgatgcgactgaacatcccggtggtgttcgtctccggcgggccgatggaggccggcaaggtgcagtggggcaacgaggtgcgcaagctggatttggtggacgcgatggtggaggccgccaacagcgcggtgtccgacgaagacgtcgatcgcgtcgagcgttccgcctgtcccacctgcggctcctgctccggcatgttcaccgccaactcgatgaactgtctgaccgaggcgctgggcttgtcgctgcccggcaacggcagcctggtggccacccacgctgaccgcaaggaactgttcctcaaggctggccgcctgatcgtcgagctggccaagcgccattacgagggcgaggactattccattctgccgcgcggcatcgccaccaaggcggccttcgagaacgcgatgagcctggacgtggcgatgggcggctccaccaataccgtgctgcacctgctggccgccgccagcgaagccggggtcgacttcaagatggccgacatcgaccgcatcagccgcggcgtgccgtgtttgtcgaaggtggcgccggcgacgcagaaatatcatatggaggacgtgcatcgcgctggcggcgtgatcggcatcctggccgagctggaccgcgccggcctgattcaccgcgacgtgcctaccgttcacagcccgacgctgggctcggcgctggagcagtgggatgtgatgcgccatggcgaaggcagcgagccgcaccgtttgttccgcgccgcgcccggcggcgtggccaccaccatcgccttcagccagagcatgcgctacccgacgctggacgacgaccgcgccgacggctgcatccgcgacaaggcgcacgcctattcgcaggatggcggcctggcggtgctgtacggcaatatcgccgagcgcggctgcatcgtgaagacggcgggcgtcgatgattccatcctgaaattcaccgggcgcgcccgcatcttcgaaagccaggacgcggcggtggaaggcatcctcgccgaccagatcgtcgccggcgacatcgtcatcatccgctacgaagggcccaagggcgggccgggcatgcaggagatgctgtacccgacctcctatctgaagtccaagggcctgggcaaggcctgcgccttgctgaccgacggccgcttttccggcggcacctccggcctgtcgatcggccacgcttcgccggaagcggccgagggcggcgccatcggcctggcgcaagagggcgacaccgtggagatcgacatccccaaccgccgcatccatctggcggtgccggacgaagaattggcgcgccgccgcgcggcgatggaggccaaaggccgcgacgcctggaagccggtgggccgaaatcgcgtggtcagcccggccttgcgcgcctacgcggcgatgaccaccagcgccgacaccggcgcggtgcgggatgtgtcccaggtcgagaaatga

SEQ ID NO: 1340 - DNA, 120 bp, Chromobacterium substugae
atgacctatcgggatggcatgaaaaagcagccgcttgcggctgctttttttattttccttaacatgtattcaacgactgttcatacatccggctatctgtttgattatgatgccatttga

SEQ ID NO: 1341 - DNA, 321 bp, Chromobacterium substugae
atgaaaaccatctatctgttgttcgtgctggcttcggcgctgatagaagtgggggccaacctgatgctggaaaaatcggacggcttccgccgcaaggcctggggcttcggcgccatcaccttggtgtggctggctttcgccttgctgggccaggcggtgaagggcatggatctggcgatagcctacgcgctgtggggcgccatcggcatactcggcaccgcgctgggcgcgcgcgtgctctacaagcagaaactcaaaccgataggctgggccggcatcgccatcgtctccgccgcggtggtgacgctctccaccgtgtaa

SEQ ID NO: 1342 - DNA, 369 bp, Chromobacterium substugae
atgtataaaaaaatatcctccccattattcatcgcctgggcgctgctgatggccgccatcggctgcgaaatcgtcggcacttcgctgatggccatggccgcccgcagcggcagctacctgggctacatctggatggccgccgcgctggccctgtcctattacctgctgtctctggccttgcgcgccatttcggtcggcgtcgcttacgcagtgtgggaaggcttgggcctggcagggttgaccgcggtcagcgtctggctgttcggcgaaaagctggtgccgcaggaatggctgggcctgggactcgcgctgctggggctggcttgcgtcacgctgggcgaaacccatgacgaggaggccgccgcatga

SEQ ID NO: 1343 - DNA, 156 bp, Chromobacterium substugae
gtgagaatcgtccgcaaagtccaacaccgcctctggcggtttttttacgcctttttcacccatatgcgcccaattccgccgatatgccggttttatttatcgagacggccaggaactcggccgattggggccgagtctgacccttgtcttgtttaa

SEQ ID NO: 1344 - DNA, 1089 bp, Chromobacterium substugae
atgcccatacacagcctcagcctgtccggcttccgctccatccgcaaactcacgctggagctggatgcgctcaatgtggtggtcggcgccaacggctgcggcaaatccaatctctacaaggcgatcaagctgctgcacgacgccgccgaaggccgcctgtcgccggcgctggcgcaagaaggcggcgcgcaaaaagcgatgtgggccggcggcccgcgccgcggcgaccgcgccggcgcccccaggcggatggcgctgtcggccaagctgagcgatttcgactacgagctgcagctgggctacccggaacccagcctcagcctgttcgcgctggacccgctggtcaaggaggaaagcctgtggctagccggccagggccgccgcccatccaccctgctgctggaaagacgcaaccaagccgccttcctgaccggcatcgagggagagcgcaacgcctatcccgccgccctgcgcgccgaggagtccatcttcggccaactggccgagcctcaccgctacccagaactgtcgcaagtgcgcgagactttgcgcaactggcgcttttaccacgaattcgccgtctggccgggctcgccgctgcgcgcgctccaggtcggcatccgctcgccggtgctgtcgcacgacggcgccaacctggccgccgcctaccagaccatcgtcgagatcggcgatggcgagctgctgggcagcatcctgtccgaagccttccccgacagccgcttccaggccgatgcccagcacggacgcttccagctgctgatgcggcgcgacggcttgctgcgtccgctggaagccgccgaattgtccgatggcaccttgcgcttcctctgcctggcggtggcgctgctcagcccgcgcccgcccgccttcatggccttgaacgagccggaaaacagcctgcacccggcgctgctgccggcgctggcaaggttaatcgccgaagccagccgttacagccagctctgggtgaccagccattcgccgcaactggccgaactgatcgagcggcgacgcccgatcaaacagttcgcgctggccttgcaggatggcgaaaccgtgctgcagtga

SEQ ID NO: 1345 - DNA, 1083 bp, Chromobacterium substugae
atggacgccgtccgccatattcttcccgatccgcgccagtaccacccgcaggtttccctgaccaaccgcctgatccaccatgcccagtcggcgctggacgccgccgacgccggcgagcgcgacatgtggcgccaggccctggtgggagccatggatgaaatgctgcagcgcggcgagctattgtcgatttcggtggcgctggccatggtgccgacccaggcttgctatcagttggtgtgggacgcgctgcgccaggcggtggaggaaaccggcggcgcgcgcgcgcaggtgttcgcgatgccgctggtgctggtggccggcagccgcaacgaagcgacgctgccgggcgagatcgccgatgtcgcgggcctgaacgcgctgctgcgccagcatggcgttttcgccgccgacggcgatgtcgccatatccggcgcgctgctgcatccagacagcctggtgggcttggacgcgatccggctgcatcaattggcccgccaggatggcgcgtcggcccgcgccggcttgccgagccaggcggcgccgatcacggtgaaggaagaaggcgtgttcctgcgctatctgatgggcgtggcggcgcagcgcgacggcgaggcctcgccgctgcgccagggcggctcggtcggcgcctggggcatgccgctgatgaagttcctgggcgagcagctcaagaccgaaggcgtgacgctgttccccatcgcccggccgccgctgccggcgatgcaggcgctggtggcgggcaacttcgcccgcttcgaggtggcgctgcaggtgttcgccagcagccagatccgccgcctgcgcgaattggacaaggagccggtggcgattgtctccgcccatgaaaacggcgaattgcacttcaccttgtcggccaagggcgacgagcgcaattgggaggctttcgtctggccgctggcgtcgctggacaacgtcaagctgatagaagagaacttccgcgagctgatggccgagtgccacgtgcgcgaggtgcatgtgatggccgaactgcagccggaaagccgcgatggcattccgctgttcttcaccgccgacgatttataa

SEQ ID NO: 1346 - DNA, 930 bp, Chromobacterium substugae
atgaaacgacttcccgacctggaagcctgggccatcttcgccaaggtggccgaatgcggcgccttcgcccgcgccgcggaagagctgggcttgtcgcaggccacggtgtccaaggcggtatcgcggctggaagaccggatgaaaaccgtgctgctgcatcgcacctcgcgccagttgtcgctgacgacggccggcgacgccgcgctggagcgcgccgcgcgcatcctggcggagggcgaggcggtggaagcggacatcgccgagcaatcccgcgcgctgcgcggcccagtgcgcatggccgcgccgatgtccttcggcctgtcgcatctggcgccgctgctgccggacttcatggcgcggcatccggaggtggaactggacctgcgcttcagcgacgagcaggcggacctggtggcggaacggatggacctggcgctgcgcatcgcctcgccggccgactccagcctgctggcgcgccggctgtgcgcggtgcgcatcctgctggtgggcgcgccgtcctacttcgcgcgccacggcaaaccggagcaccctgcgcaattggcccggcaccgcgccttgcaatacagcaacgcgcctggcggccgccactggcgcttccgccacgccgatgaaggagagttttcgctggaaatgcacgcgccgctgcgcgtcaacaacgccgacgcgctggcgccggcgctgcactcgggcctagggctggcgctgcagccggaattcctggtctggcgggatttgcaggacggccggctggaaaccgcgatgcccgattggcaggtcgaccccatcgcgctctacatcctgacgccgccgggccgcggccgcccggcgcgggtgcaggcgctgatcgactacctggcccgccgcctggcagactcgccctgggcgcgcacgccagccgccgccgactga

SEQ ID NO: 1347 - DNA, 702 bp, Chromobacterium substugae
atgatcgaacgccgtccctacgccagcctgggcgcagcccagcacggctggctggatgccaagcaccacttttccttcgccgaataccgcgatgccgagcgcacccgctgggggcggctgcgggtgtggaacgacgacaccattgccgccggcaccggcttcgatccgcatccgcacgccgacatggaaatcatcacctatgtccgcgaaggcgcgatcagtcacgaagacagcctgggcaaccgcggccgcaccgaggccggcgacgtgcaggtgatgagcgccggcagcggcatcacccactccgagtacaaccgggaagccgtcgccacccgcatcttccagatctggatctacccggaccgccacggcggcgagccggcctggggcaacaagccgtttcccaaggccgatcgctccggcgctttcgtcgcgctggccagcggcatggacggcgacgccgacgccttgccgatacgggccgacgcccgggtgctgggtgccaccctgaaggccggcgagagcgcgggctaccgcttcggcgcggcgcggcgcggttacctggtgttgtccagcggcgaggcgcaggtgaacggcgtcgccctgcaggccggcgacggcgcggccatcgccggcgaagcgttgatcgaggtgtcggccagccgcgacgccgaactgatcctggtggacacccgcgagtaa

SEQ ID NO: 1348 - DNA, 1248 bp, Chromobacterium substugae
atgtttgctgccgaccagacgattgccaaattcgaccccgaactcgccgccgcgattgccgccgagtgccagcgccaggaagatcatattgaactgatcgcctcggaaaactacaccagcccggcggtgatggaagcccagggctcccagctgaccaacaagtacgccgaaggctacccgggcaagcgcttctatggcggctgcgagcatgtcgacatcgtcgagcaactggccatcgaccgcgtcaagcaactgttcggcgccgaatacgccaacgtgcagccgcactccggctcgcaggccaaccaggcggtgtacttctccatcctgaagccgggcgacaccgtgatgggcatgaacctgggccacggcggccacctgacccacggctccccggccaacctgtccggcaagatgttcaacatcgtcgcctacggcctgaacgacaaggaagaaatcgactacgacgacatggagcgcgtggcgatggaaaccaagccgaagctgatcatcggcggcgcgtcggcttacgccttgcgcttcgacttcgagcgcatgggccagatcgccaagaaggtcggcgcttacttcatggtggacatggctcactacgcgggcctggtggccgcgggcctgtacccgaacccggtgccgcacgccgatttcgtcacctcgaccacccacaagaccctgcgcggcccgcgcggcggcatcattctggccaaggccgagttcgagaagagcatcaacagcaatgtgttcccgacgctgcaaggcggcccgctggagcatgtgatcgccgccaaggccgtcgccttcaaggaagcgctgcagccggaattcaaggaataccagcagcaggtgctgaagaacgccgccatcatggccaagaccctggccgagcgcggcctgcgcatcgtgtccggccgcaccgagagccacgtgttcctggtcgacctgcgcgccaagggcctgaccggcaagcaagccgacgcgctgctgggccgcgcccacatcaccgtcaacaagaacgccatcccgaacgatccggaaacgccgttcgtcacttccggcatccgcatcggctccccggccatcaccacccgcggcttcaaggaagccgaggccatcgaagtggccaacctggtcgccgacgtgctggacaacccgaacgacgacgcgctgatcgcccgtgtcgccgagaaggccaccgcgctgtgccaccgcttcccggtgtacgccaagtaa

SEQ ID NO: 1349 - DNA, 687 bp, Chromobacterium substugae
atgcaagtgtttcaacgcgccgtcgcgctcgccctcctcgccctccccgcagccgccttcgcccagagcgacgatgcccagttcgcagtgggcgccggtctcggcaccaccggctacgatctgatggccagctacaaagtgctggacaatctcaacgtccgcggcaccctctctggcctgaactacagccgcgacggcgactacaacaccgacacccactacaacggcaagttcaagctgttccagaccggcgtattggccgactacttcccgttcggcaacagcttccgcatgagcggcggcctggcgctgaaccagaccaagctgggcctgcaagccagcgccggcagcagcaccacctaccgcctcaacggcaacacctactattccaaccaggtcggcgacctggacggcgaagccaaatggaacaagccggcgctgtacctgggcctgggcttcggcaacagcgtgaagaacaagggcctgagcctgagcggcgacttcggcgtgctgctgaccggcaagccggataccaccctgaccgccagctgcaccagcgcgctgagcgcggcgcaatgccagcaattgcaaaacgatgtcggcgtcgaacagaacaagctgcgcgacgacaccaacaagctgaacttctggccggtggcccgcctgactcttaactacgcgttctga

SEQ ID NO: 1350 - DNA, 459 bp, Chromobacterium substugae
atgaaatgcgcgttttgcggcaacgccgatacccaggtgatcgactcccgcgtcagcgaggatggggccagcatccggcggcggcgccgctgtccggtatgcgataaacgcttcactaccttcgaaacggccgatgtgcgcatgccgcaggtggtgaagaccgccggccatcgctccgagttcgatatcgagaaagtgcgcaccagcttcctgcgcgcgctgcacaagcggccggtgtccaccacgctggtggacgaagcgatagaccgcatctgccacaagctgctgcagcttggcgagcgcgaggtgagcagccggcagatcggcgagatggtgatgaacgagctggcgcggctggacaaggtggcctatgtccgcttcgcgtcggtttaccgcagtttccaggatatttccgaattcaccgatgcgatcaaggaaatccagaagtctgcgcattga

SEQ ID NO: 1351 - DNA, 525 bp, Chromobacterium substugae
gtgggcattcgcgaggccgatccggcgcgcgacgcaccggccttgttcgccttgatggcaagcagccgtccgacgttggcgcaatggctgtccagcacggtcaggccccaatcggcggcggatatggccgccttgctgctggcgcaggcgcgcagcaaccaggaagggcgcgccgcccacaggctgattgaggtggacagcgaggtggccggcgtctgctcgctgcatggcatcaatctggcgcatggctacgcgcgcctgggctactggctggcggatcatcacgtcggcaaagggacgatgggcctcgcgttgcggctgttgctggcgtacgcgttcgacgaactgggcctgcaccggctggaactgggctgcgcgccggagaacctgcgcagctgccgtgtcgccgaacgcctgggtttcaagctggagggagagctgcgcgacgcgcaatttctcaatggccgtttctggaacatgcgttgttacggcctgttggccgatgagtggaagaatcgaacatga

SEQ ID NO: 1352 - DNA, 1104 bp, Chromobacterium substugae
atgacggactatagcgccgacgatcacctgcacatgcagcgcgcgctgcgcctggctgaagccgccacccgccgcgccgcgcccaatcccggcgtcggctgcgtgctggtgcgcgatggcagggtgataggcgagggcgccacgctggcggtagggtcggaccacgccgaaatccaggcgatcaaggattgcctcgcccgcggcgataccccccgcggcgccaccgcctacgtgacgctggagccctgcagccaccacggacgcacgccgccgtgcgcggagcgcctggttgcggagggcgtggcgcgcgtggcggcggcgatggtcgacccctatcatgaagtggccgggcgcggcatcgccatgctgcgcgcggccggcatcgaggcatcggccgggctgatggagacggaggcgcggcgcacgcaccggggcttcctgtcgcgtgtcgaacgcggccggccgtgggtgacgctgaaggccgcggccacgctggatggcaagaccgcgttgctcaacggctgcagcaaatggatcaccggcgcgcaggcgcggctggatgtgcagcgcctgcgcgccgagaactgcgccatccttaccggcagcggcaccgtgttggccgatgacccgcaactgacggtgcgcgaggttccggtggcggcgcagccgtggcgggtggtgctggacggcgcgctgaaaaccgatcccgccagccgcatttaccagggcggacggacactgctggccagctgcgtaagcgatgccgggcggctggccgcctaccgcgagcgcggcgtggagacgctggcgctggcaggctgcgccggcgaagcggatcttggcgatctgttgcggcaactggcggcgcgcggcgtcaaccaactgatggtggaggccggcgccggcttgaatggcgccttgctgcgagccgggctggtggacgagatcgtgctgtacctggcgccgtcgctggcgggcgatgcggcgcgcggcctgttcgcctggccggcgttgaccgacctggccgacaaagtgaggctggacatcgtcgacttcggcaaggtcggcgatgatttgcgcctgatcctgcggccggcggcctga

SEQ ID NO: 1353 - DNA, 681 bp, Chromobacterium substugae
atggcggatgtggcatcggcgctgggcgcgtatctgcacctgattgaccgtttgggcgcgaaggccgaggtggtcgaacagcggcgggcgttgttgctgcgcctgctgaagcggctggagagccaggcgcgcaatgccgaagcctatcatgccgcggtagagcttttcgtcgccgattgcccgccgcgcgagcgggtgctggcgatgacctgcggccgcgaattctactgcttctggctggacgacatgaaaaaggtggtggagatcaccgcccgcaacggtttttcgctgcacaatccgcaaatgctgaatgtcggcacgttcgatcatctggtcgcgcagatgcggcaaaagcgcttccgccatttccccccttcgctgggcctgtatctgggcaagctgttcgaggacggccatcccgaggagggcatacgccagcgcgacattctgctgaaggcgctgttgttcctgctgtccccccatccctttcattccaccagctaccggatggcggtggacgccttgttgctgcacttgcaggatcgcgccgagcgccagctgctgttgccggcggtgcgcgaatactttccgtactggcaagcttttcccttcgcccggcagcgggcgcaggcggagcgggaggccggcggcgagcccggcgccgcccaggataaggcatga

SEQ ID NO: 1354 - DNA, 1488 bp, Chromobacterium substugae
atggggaatcagacggcctatcagagcctgacccaaactttccagcgtttgcatcgtttcggccacctgtccgcgatcgccagttgggaccaggcggcgatgatgccggccaaaggcaacgaggcgcgcgccgccgcccaggccgaattgcaggtgctgatgcaccagctgatcaccgctccggaattgaaaacgcagctggacgccgccgcacaagaagaactggacgcggcgcaacgcgccaatctgcgcgaaatcggccgcgaatggcggcaggcgaatttgctgccggccgcgttggtggaagccaaggcgctggcggcggcccgctgcgagcacgcctggcgcagccagcgcaagaacaacgactggcaggggtttctgcctaatttccgcgaggtgctgcgcctggcgcgagaagaggcgacgctgctggcggaggcgacaggcgtcagccgctacgacgcgttgctggacaagtacgagccggggatgaccagcgccaatctggagcgcattttcggcgacgtcaaaacctggctgccgggcttgatcgcccaggtgcgggacaagcagtccggcgagcgcgtgatccagccgcaaggccctttcccggtggagaagcagcgccagctgggcctggaggcgatggggctgctgggtttcgatttcgatggcggcaggctggatgtcagcagccatcctttctgcggcggcgtgccggaagatgtgcgcatcacgacccgctatcgcgacgacgatttcgtgcaaagcctgatgggcatcgtccacgaaaccgggcacgcccgctacgagcagggcctgccgcgcgactggctgccgcagccggtcggccgcgcccgctcgatgggcatccatgaaagccagagcttgtcgttcgagatgcagctgggccgcagccgcggcttcctgcaattgatcgcgccgctgatccgcaagcatttcggcgaccagccggctttcgacgccgacaacctggcgcgcctgtacacccgggtgcagcccggctacatccgcgtcgacgccgacgagctgtgctacccggcgcacgtgatcctgcgcttcgagatcgagcgggcgctgatcgacggcgagatcgaggccgaggacgtgccggcgctgtgggacgagaaaatgatggcgtatctgggcgtggatacccgcggcaactaccgcgacggctgcctgcaggacatccactggaccgataccttcggctatttccccagctataccctgggggcgatgtacgcggcgcagtatttctcggtattgcgcaagcagacgccggatctggacagccgcatcgcgaagggcgatctcgcgccggtgttcgattggctgaacgccaatatctggagccagggcagccgctggagcactgacgagctggtggcccgggccaccggcgaggcgctgaacccggcgcactaccgcgcgcatctggaagcgcgttacctgggttga

SEQ ID NO: 1355 - DNA, 867 bp, Chromobacterium substugae
atgaagccctcccgcagccaatacctcacgctcaatcaacgccgctgccatatccgccgctgggggccggaacaggcgccgctgctggtgctgctgcatggctggatggacagctcggccacctttcaattcatggtggacgccctggccggcgactggcaggtggcggccccggattggcgcggcttcggcgacagccaatggaatgacggcagctactatttccccgattacctggcagacttggacgatctgctgcggcaactgtcgccgcaacaaccggtgaacctgctgggccacagcatgggagcgatgatcgccggcatctacgccggcgtctgtccgcaacggatccatcgactggtgctggctgaaggcttcggcctcggcgccacccgtccggccgaggcgccgggccgctacggccgctggctgcgcgagaccagccaggctatggctttcgagccgatggagccggcccaggcggcggacaagctgatggcgcgcaaccccttgctgaccggggaaagggcgcgctggctggcggctgaattgacgcgcccggctgacggcggcgtgatctaccgcgccgatccgcgccacaagatggtcaatccggtgctgtaccggctggaggaagcgatggcctgctggcgccgcatcgccgcgccgacgctgtggctgctgggagagcgctcgttcgagcatccggcgatcagcggcgtgatggacaccctggatcagcgccgctcctgcttcgcccatctggatgaagtcaagatcgccggcgccggccacatgctgcaatgggaaaaaccggaacaaatggcggcggaagtcgaacgcttcctgctgcgcggcgaataa

SEQ ID NO: 1356 - DNA, 528 bp, Chromobacterium substugae
atgaaacagatcgtaactgccgcgctgatcggactgggtttgtattccacgggcgccatggccgctgacggcaccatcaccgtcaatggaaacgtcgttgcccagacttgcacggtttccggcaatggcgccagcgccaatgtgactgtgacgctgccgaccgtcggcgcgtccgcgctggccagccaaggccaaaccgccggcgccacgccgttcaccatccgtctgagcagctgcccgtccggcctcaacaacgcccaaacccgctttgaagtgggtccgaacgtcaactcggtatccggcaacctgctgaacgccgtcggcaagacctacgcctccaacgtggaagtgcagctgctgaacaacagcttcaccgccatcaacctgaacaacaacgccaattcccagatcgtgtcgatcaacaacggctcggccacgatgaactactacgcgcagtactacgccaccggcgccgccaccgcgggttcggtgaacagctccgttcagtactcgatgacctatcagtaa

SEQ ID NO: 1357 - DNA, 750 bp, Chromobacterium substugae
atgaaacaagcagtaaggcgagcggcgctggcgctgatgttggcgggcgcggcactgagcggcgcggcccaggcgggcgtggtgatttccggcacccgcgtggtgtacaaggcggatgaccgcgaggtgaccgtcaaggtcaacaatccgggcaaggagccctccctggtgcaggtatgggccgacagcggcaatgagaagtcggttcccgataccgccgacgcgcctttcctgatcatgccgccgattttccgcgtcgacccgaccaagggccagaccctgcggctgaccttcaccggcgccgatctgcccaaggacaaggagtcggtgttctggctgaacgtgctggatgtgccgccgttgcccaagctgaccgcggagcagcgcaatttcatgcaagtggcctttcgttcgcgcatcaagctgttttaccggcccgccgggctggcgggcacgccggacgatgccgccgacaagctttcctggactttgctgccgcaggccggcggcaaaggctatacgctgcgggccaccaacccggccgcgtaccatgtttctctgaatcgggcgattctcttgtccggcaagcatgagttcgacacggatggcggcatggtgccgccgggcggcagcaaggatttcgcgctgaaggatgcgaagttcaagccggaaggcggcctcaagctcaattacgaaagcatcaatgactacggcgctccggtgatgcatagcgcgccgctggctccctga

SEQ ID NO: 1358 - DNA, 2577 bp, Chromobacterium substugae
atgaagcacttgactacacggcggcacgatcgccgctgggcgctcagcccgctcagcctgttgatctgcggcctgttcggcggccaggccgcctgggccgacgcgcccgcggcggcaagcgcccctgccgacgacgtccagttcaatccggtgttcatcaatcagaactccaacggccaaaaggtggatctatcccgcttcaaccagacgggtggcgctctgcccggcaactaccgcgcggatgtctacgtcaatgatgtctggctggggcgtcgcgacgtgctgatgaaggagatggccgagcgcaaggtgctggcctgcttcaaccgcgcgatgctggacgagctgggcgtggatttcgcgcgcttgggagaaacggccgaactgcccggacgggacgagcccggccgctgcgcggatatcgccgcggtggtgccgggcgcgcgttccagtttcaacagcaccgatttgcgcctggatgtcagcctgccgcagaagtatctgcgcgcccaggcgcgcggctatgtcgcgccggaatactgggatgccggcgcgccgctggccggcttcctcaattacaacgccaatggctaccgttacgacaacggcgcctccggcaaatccacgcagttctatttcggcgccaacgccggcctcaacgtcggcttgtggcggctgcgctacgacggcgcgctgacgcaacagaacagcggcaacggccaaagccagcgcaactaccagcacgcctcgacttatgttcagcgcgacatcaccggctggcgttcggtgttgaccgtgggcgactacttcaccccgtccgacctgttcggcagcgtggccttccgcggcgtgcagctcagctccgacgaccggatgcagccggagtcgctgcagggctatgcgccggtggtgcgcggcgtggccgagaccaatgccaaggtatcgatccgccagaacggcaacctgatctacgaaaacgcggtgccgccgggcgagttcagcatcgacgacctctacaacaccggtttcgccggcgatctggaagtgactgtagccgaagcggacggccgcgtgcgcaaattcgtggtgccttacgcggcggtgccgcagctgctgcgcgacggccagtcgcgctatgccgtgatggccggacaatggcgcggcgcctccttgagcaagcttcccgtcttcgcgcaggcaacctaccagcgcggcatcagcaacggcctgaccttgtatggcggcctgatcgcggcagaccattaccaatccgcgctgttcggctccggcatcaatacgccgctgggcgcgctggcgctggatgtgacgcagtcgtgggcgagcggcttgccttacggcggggcggacagcgatatgcagggccaaagctaccgggtcacctacagcaagctgatcgaatccacccgcaccaatttcacggtggcagcgtatcgcttttccaccgccggttttctcgaactgggcgactacgtcaacctgatcaaccagcagggcgcggtcttccgcgccaagaacaaattccagctcaacgccgaccaggccctggccaagggctggggacatatcttcatggccggctcgtcgcaggattactggaatcagcaagggcgagatctgacctatcaactgggctacggcaacagtttccagtcagtgagcttcaacctgagcgcgggccggactcacgatgctagcggacgcaatatcaatcagtacatgctaagcgtatcgatgccgctggggcgcgagccttatgcgccgctgttgagcgccagcgcgagcagcagcagcgaccgcagcgccagcgggcagctcagcttgagcggctcggccggcgagctgcgcaatctcagctacaacctgtacgccaataccagccgcaacagcgcgggcggcaacagcagcggcggcggcggcagcgtgcagtacgccagctcgatcgccacgcttaccgcgggggccagctccggcggcggttcgtcgcaagccaatgtcggcttgagcggcgcgctggtgttccatcccgggggggtgacggcggcgcagtcgctgggcgaatccttcgcggtggtggaggcgccgggcgctgagggcgcggcggtcagcaataccagcggcgtgcgcgtcaatagccgaggctacgcggtggtgtccagtttgatgccgtatcgccagaacgaaatcacgctggaccccaagggcatgagccaggatgtggaactgcaggaaaccagcgtgcaggacgcgccgcgcgcaggcgccatcgtcatgctgaagttcaacacccagcagggcaagccggtgatcgtgacgctgcggcgggcggacggcagccatttgccggtgggggccaccattgccgccgacggcggcgaagacgcgcgcgccatggtggggcagggcgggcgcgccttcctgcgcgggctggagggcaagccgctggtggcgcgctggggcggcgaaccggaccagcgctgccatttccgttacgcgctcccgcaagcgacaggcggagcggcgtatctgcagatggacgcggtctgcgcgccgcaatga

SEQ ID NO: 1359 - DNA, 1008 bp, Chromobacterium substugae
atgatattcaaccgtggcggcatcgcccgtcgggaaacgatgacaatgaaaaaatggatcactcagggattgcgcggatggttgctggcgctgtgtttggccatgccgctgaccagccatgcgctgggttgctggaatggcgacgacggctcgggcggcgtgacgtcgaccttcaacctgcccggcaatctgtacgtcgccgccaatgcgccggcaggcaccatcatctggcagtcgccgctgcagaacctcaaactgtattgcacgcagagcataggcgaaaacgtgtatttctgggtgaacccgcaaagccaggcgctggcgccgggcttgcagatcggcatcctgttcaagggccggacctatacccagagcagcggcgccatcgataccggcatctatgtgccgtggaacggctggatcaataccacgctgcagtactccatcgtgttgctgaagacctccggcgcgccttccagcggcaccgccacggtcagccagtactcggtgttccaattggacggcatcggcgggatcaacgccacgcccaatatcaacttcaaccagctgatcaacggcacggtcacctttacccccggcggcacttgcaatctgagcgcgaacggccagtacacggtcaatctgccgactgtcggcagcggccagttcgcggcggtgggcagcgcggcggcccgcaccggcttcaccatcagggccaccgattgttcggatggcgtgaagacggccaccttccgtttttccggcgcgcaggacaagaacaacgcggtgttgttcgccaatagcggctcggcgcgcggcgtggcgatcaatctggggagttcggacgatggcgcgaatatcggcgccaacaagaccaacaatacccgggtagtcaatgtgcagtcgaagtcggcgcagctggggctgttcgtcgagtacatgcgaacggccgccattgtgccgggcagcctgcaaaccgcgattacgatagacatgttgtaccaatga

SEQ ID NO: 1360 - DNA, 303 bp, Chromobacterium substugae
atgaaaaaagtcatcatcaccctggcagcgctggcggctctgcaatctggcttggctctggcctccgacggcggcaccgtttacttcaatggctccatcgtcaaggaaccgtgcgccgaggctggcagcacgctgctgagctacgcgacgaatccgcgccaataccaggccgcccgcaagatcgcgtccggcaatgcctgctccggcatggacagcacccagtcgctgagcgtttcctcggtcaatatggcaggcgccaccgcctccgccagcggccaactggttaccatcgtttacaactga

SEQ ID NO: 1361 - DNA, 1617 bp, Chromobacterium substugae
atgagcaacagcatcgcatcgtcggccgccggcgcagccggcatcagccgcgccgagcgcaaggtgattctggcctcgtcgctaggcacggttttcgagtggtacgacttcttcctgtacggcgcgatggccgccatcatcggcaagcagttcttcaccggcgtcaacgaaaccaccgccttcatcttcgcgctgctgaccttcgccgccggcttcctggtgcggccgttcggcgcgctggtattcggccgcctcggcgacatggtgggccgcaagtacaccttcctcgccaccatcgtcatcatgggcctgtccaccttcctggtgggcgtgttgcccggttattcgacgctgggcatcgccgcgccgctgatcctggtgtcgctgcgcatgttgcagggcctggcgataggcggcgaatacggcggcgccgcgatctatgtggccgagcatgcgcccgaccacaagcgcggcggctacaccagctggattcagaccaccgccggcgccggcctgttgctgtcgctgctggtgatcctggcctgccgcaagctgaccggcgacgccttcaacgactggggctggcgcctgcccttcctgctgtccatcttcctgctggccatttccacctggatccggctgtcgatgcaggaatcgccggccttcctgaaaatgaaggcggaaggcaagcactccaaggcgccgatcagcgaagccttcggcaactggagcaatctgaagatcgtgctgatctcgctgttcggcttcaacggcggccaggcggtcaccttttactgcgcgcagttctattcgctgttcttcctgacgcagatcctgaaagtggacccgcagaccgccaacctgatgctgatcgcgtctctgatcgtcaccacgccgctgttcctgtacttcggccacctgtccgaccgcgtcggccgcaaaccggtgctgatcgccggcctggtgctgggcctcatcctcaccttccccgccttccgctggctgaccgactacgccaacccggacgtcgccgccgcccaggccagcgcgccggtgacggtggtggccgaccccgccagctgccacttccagttcgaccccatcggcaaggccaagctcaacactccgtgcgaccaggccaagacgctgctggcgaagaacggcgtgccctaccagcaacaagcggccgccgccggcgtgaccgaaatccacatcggcgcgacggtgctgcagggcttcgacaagaaagcgctgcaagacggcctgaaacaggccggctatccggaaaaggccgatccggccaagatcaaccacctgatggtgattctggtgctggtgctgctgtcggtgatttcggcgctgacctacggcccgctggcggcgatgatggtggaactgtttcccacccgcatccgctatacctcgatgtcgctgccctatcacctgggcaacggctggatcggcggcctgatgcccacggtggcgttctcgctggtggtgtacaccggcgacatcctctacggcctgtggtatccgatcatcgtctacggcgtcagcctggtggtgagcctgctgtttctgcgcgaaaccttccgcaacgacatccataaacactga

SEQ ID NO: 1362 - DNA, 1653 bp, Chromobacterium substugae
atgttgagcggggagttcgattacatcatcgtcggcgccggcagcgccggctgcctgctggccaaccggctgtccgccgacgccgacaagcggttgctgctgctggaagccggcggcaacgacgactacccgtggatccacatcccggtgggctacctctactgcatcggcaacccgcgcaccgactggtgctatcagaccgcggcggaaagcgggctgggcggccgcgcgctgggctacccgcgcggcaaggtgctgggcggctcctcgtcgatcaacggcatgatctacatgcgcggccaggcggccgattacgaccactgggaagcgctgggcaatcccggctggggctggcgcgacgcgctgccccacttcatcgcgatggaagaccatttcgacccggcgcggcccttacacggccacggcggcgaatggcgggtggacaagcagcggctgtcgtgggagatcctcgacgccttccgcgccgccgccgccgagcagggcatcgcgccggtagacgacttcaaccgcggcgacaatgccggctgcggctatttcgaagtgaaccagaaaaacggccgccgctggagcagcgcgcgcgccttcctgcaccctgtccgccatcgccccaatctcacagtgctgaccggcgccgaggcggaaagcctggtcgtcgaacgtcagcgcgcccgcgcaatctcctttttgcaacaggggcagcgactgcaagcgcgctgccgcggcgaaatcatcctcgccgccggcgccatcggctcgccgcttttgctgcagcgcagcggcatcggcccggcccgcttgctggccgaatgcggcatcgcgccgcgccacatcctgcccggcgtcggcgccaatctgcaggaccacctgcagctgcggctggtattccagatagcgggcgcgcccacgctgaaccagcgcgcagccagctggcgcggcaagctggcgatggcctgggaatacctgtggcggcgcagcggacccatggccatggcgcccagccagttgggcgccttcgcccgcagcgcgccggacgtgcgctggcccgacctggaataccacgtgcagccgctgtcgctggaacgcttcggccagccgctgcacccgtttcccgccttcaccgcctcggtctgccagctgcggccgcatagccgcggccatgtcgagctgggcggcgcgccgctcgacgcgccgcccttgatccagcccaattatctcagccacccggaagaccagcgcgccgccgccgccgccatccggctgacgcgccgcatcgccgcgtcgccggcgctgtcgcgctacctgccggcggaataccggcccggcctccgctatcagaccgaagacgaactggtggaggccgccggccagatcggcaccaccatcttccacccggtcggcacctgcaagatgggcaacgacccgctggccgtggtcgacgcccggctgcgggtgcgcggcatcgccggcctaagggtggccgacgcgtccatcatgcctaccatcacctccggcaacaccaacagccccaccctgatgatcgccgccaaggcggcgcagatgatcgcgcaggacaacaaacagccgggcgcgttcgcgacgccggccaccccagcaaaggagacttcggcatga

SEQ ID NO: 1363 - DNA, 924 bp, Chromobacterium substugae
atgttcgactggaacgatgtccgttattttctggcgctgcagcgcagcggcaaactgctgggcgcggcgcgccagctcggcaccacccacgccacggtggcgcgccacatcgccgcgctggaggcggtgctgggccagccgctgttcatccagcaggccgacggctacacgctgaccgccgccggccgtcagctgctgccgctggccgaagcgctggagaacaccgcttcgcagatgctggacagcggctgcaaggggcatgccgaagtcagcggcgtggtgagggtgggcgcgccggaggggttgggcgcgttgtttttggcgcgccacatgccggccttgatggcgcggtatcccgggctggagatcgatctggtggcggtgccgcgctttgtcagcatcaccagccgcgaggtggacatcgccatcgcgctggagcggccgcaggccaatctggtggtgacgcgcaagctgaccaattactgcctgggcctgtacgcgacgccgggctatctggccgggcatccgcctatcgccgagcgcgaagacctgaacggccacgccatcctcgcctatgtcgacgacctgctgttcacccgcgaattgatgtaccaccacggcctgtgtcgccatccgcgcatgcctttgcgcaataccagcgtggtggcgcaaaaggaggcggcgctggcgggcggcggcatcgcggtgctgccttattacatggtttacgacgatgcgcggctggtgcaggttttgccggaattgcgcatcgtccgttcgtactggatcagcgcgcgcagcaacatccgccgcacgctgcgctaccgcgtggtatgggattacgtggtggatttgtgccagcgcatgcaatggctgctgttgcaacagccaactcagcaaaacgaatcaatcgatgcgggataa

SEQ ID NO: 1364 - DNA, 864 bp, Chromobacterium substugae
atgagaacgctctatcgcaacggcggcccggattcgccgtatttgtggcggatgctgcgggcgctggactacctgtggcgccatctggacgggccgctgccgctggaaaggttggcggaggaggcctgcttgtcgccctttcactttcaccgcgtgtatcgcggcctgatggctgaaacggtgggagagacccggcagcggctgttgctgcaccgcgcggccggacagttggacggcggctcgctgcctttgtctaaggtggcggcgcgcgccggctacggcggcaccgcggccttcgtcagggccttcgccagggcttacggcgagagtccgggccgctaccgccagcgcagagcgttcatttctaggcaagactgggagaccgtgatgcatgaagtgacattgctcaaacaggataaggggctgacggtgctgatgcgccgccatgccggcagttatatggagatcggccaggccttcggcgccttgcaggccatcagcccggcttgcgcagtcggcgacgcgccaggccgcgcattcggaatatatctggatgatccggagcagacggaagaggccaagctgcgcgccatcgcctgcgtgacggtgccggatgcctggcagggcggccgctgccgggatgggtttgagtggggagagattcccgccggagagtacgcttgcgtgacgcatcagggaccgtacgcggagctgtccacggcctggtcctggttgtaccggcactggctgcccggcagcgggcgcgcgcccggcggcgtgccgtgcgtggaagaatatttgaattcgccgtacgacaatccgcccaccgccttgcgcacccggctgatgttgtcgctggcctga

SEQ ID NO: 1365 - DNA, 1464 bp, Chromobacterium substugae
atgcgtatcatcgagaaagcctatactttcgacgacgttctcctcgtcccagcccactcggaagttcttccgcgcgacgttaccctgaccactcagttcacccgcaacatcacgctgaagctgccgctggtttccgccgccatggacaccgtgaccgaagctcgcctcgccatcgccatggcgcaggaaggcggcatcggcatcgtgcacaaaaacatgaacgccgaaaaacaggccgccgaggtctccaaggtgaagcgccatgaaagcggcgtggtgaaggatccgatcaccatcgccccggacatgctggtgcgcgacctggtgctgctgacccgccaatacaagatttccggcctgccggtgatcgaagccggcaaagtggtgggcatcgtcaccaaccgcgacctgcgcttcgaaacccgtctggaccagaccgtcggctccatcatgaccccgcgcgagcgcctgatcaccgtcaaggaaggcgccagcatcgacgaagcccgcgagctgatgcacacccaccgcctggagcgcgtgctggtgatcaacgacgcctgggagctgaagggcctgatcacggtcaaggacatcatcaagaccagcgaacacccgaacgccaacaaggatagccaaggccgtctgcgcgtaggcgctgccgtcggtaccggcgccgacaccgaggcgcgcgtagccgcgctggtggcggccggcgtcgacgtgatcgtggtcgacaccgcccacggccacagccagggcgtgctggaccgcgtgcgctgggtcaagcaaacctacccgcaagtcgacgtgatcggcggcaacatcgccaccgcccaggcggcgctggacctggtcaaggccggcgccgacggcgtcaaggtcggcatcggccccggctcgatctgcaccacccgcatcgtggccggcgtgggcgtgccgcagctgaccgccatccacaatgtgtccgaagcgctgaagggcaccggcgtgccgatgatcgccgacggcggcatccgcttctccggcgacatcgccaaggcgctggcggcaggcggcaacgcggtgatgctgggcggcatgttcgccggcaccgaagaagcgccgggcgaggtggaactgttccagggccgttcgtacaagtcctaccgcggcatgggctcgctgggcgcgatgagccagggctcggcagaccgctacttccaggacagctccaacgccgccgacaaattcgtgccggaaggcattgaaggccgcgtgccgtacaagggcccgatcggccaggtgatccaccagttggtgggcggcctgcgctcgtcgatgggctacctgggctgcccgaccatcgccgacctgcacgaaaaggcgcagttcgtcgaaatcacttcggccggcatccgcgaatcgcacgtccacgacgtgcagatcaccaaggaagcgccgaactaccacgtcgaccgctaa

SEQ ID NO: 1366 - DNA, 120 bp, Chromobacterium substugae
atgcggcgcactgcaaaaagagcgcgaagattcgcgctttttgcgcggcgctgggccaggccttacaatcggcggcaccgggaccaagcttggggatgccaatcatgcagtcatctatag

SEQ ID NO: 1367 - DNA, 432 bp, Chromobacterium substugae
atgcagtcatctatagtatggacgtttttgctggcattgctattgccgggcgccgccgcggccgaggtctatacctggaccgacgccaacggcaagaccgtgtattccgaccagccgccgccgcatgtcaacgcccgcaagctgaatgtgcgcgcgcagcggccagccggcgcgtcggcgccgaaggcggagaagaaggccgacagcaagccggccgccaacaagcaggtggcgtccgacaacgccgccgtcgccgccgccaatgccaaggtcaaagcgcagaactgcagcgcggcgcaggccaatctggccactttgcagcaaaacggccgcatccgcatgcccggttccaccgcgctggccaccgacgcccagcgcaacgagctgattcgtcaggcccagaaggatgttcaaacctggtgcaataaataa

SEQ ID NO: 1368 - DNA, 1806 bp, Chromobacterium substugae
gtgtccaaacccgaattcgactaccagaacgtattgcagaacctgccggccttgcccggcgtctaccggatgttggatgccgagggcaaggtgctgtatgtcggcaaggcgatagacctgaagcgccgcgtcagctcgtatttccagaagaacgacctgtcgccgcgcattcggctgatggtgcggcagatcgccagcatagaaaccacggtcacccgctccgaggccgaggcgctgatcctggagaacaacctgatcaaggcgctggcgccgcgctacaacatcttgttccgcgacgacaagtcctatccctacctgatgctgagcgggcacgatttcccgcagatggcttattaccgcggcgagccgaagaagcccagccagtatttcggcccttatcccaacggctacgcggtgcgcgaaagcattcagatcctgcagaaggtgttccggctgcgcacctgcgaggacgcggtgttcgccaaccgctcccgcccctgtctgctgtaccagatcaagcgctgctccggcccgtgcgtcgagcatatttcccgcgacgaatacgcggccgatgtcgccagcgctgtggcttttctcagcggcaggcagagcgagctgatagaggagctgaaccggcgcatgatggcggccgccgactcgatggagtttgaacaggccgccgagctgcgcgatcagatccaggcgttgtcgcgggtgcaggaaaagcagttcgtctccagcaaccagagccagcaggattgcgacgtggtggccgcggtgctgaaggatggcatgccttgcgtcaatctggtgatggtgcgcggcggccgccatctgggcgacaagagccacttcccggtgggcggcgaggccgataccgcgcaggaaatcctggaggctttcctggcgcagcattatctgaccgccggcgtgccgccggccttgctggtgaacggccaattgagcgacgctttgcacgaattcctgcagcagcaggccggacgcaaactggcgatcgccagcaatccgataggcgagcggcgagtgtggctggaaatggcggagaagaatgccgaactggccatcctgcagcggcagggcagcaaggccacccagacccagcggctggcgaagctgaacgaggcgctggaactggacgacgccggccgtttcgaatgcttcgacatcagccacaccatgggcgaagccacggtcgcctcttgcgtggtgtacgacaagggcgcgatgcagccgtcggaataccgccgtttcaacatcaccaccgccaagcccggcgacgattacgcggcgatgcgcgaagtgctgtcgcgccgctatggcaaactggcggacggcgaaggcaaactgccggacgcggtattcatcgacggcggcaagggccaggtgggggtggcgctggaggtgctggcggaactggggctggccttgcccatcgtcggcatcgccaagggcgaggagcgcaagccgggtctggaaacgctgatcctgccatacttggaaaagacgttacaattgcgccaggaccatccggcgctgcacctgatccagaccgtgcgcgacgaggcccaccgcttcgccatcaccggccaccgcgcccggcgtgccaaggcgcgcaccgcctccacgctggaagagatacccggcatcggagccaagcggcgccagcagctcttgatgcgcttcggcggtttgcgcggggtggcggcggccaatgtcgatgatttgtgccaggtggaaggcatcagcaggacgctggcggaaaagatctacaatgccctgcattga

SEQ ID NO: 1369 - DNA, 582 bp, Chromobacterium substugae
atgcccttcaatttgccgatattcctcacctggctccgggttgccctgatcccgatctgcgtggcggtatttttcctgccggactccattctgttgctgcacagccgcaacgtcgtgggggccggcattttcgcattggcggccgccaccgactggctggacggctatcttgcccgcaagctggggcagacctcggcgttcggcgccttcctcgatccggtggcggacaagttgatcgtggccgccgcgctgatcctgctggtgcagctgggccgcaccgagggctggatggcgatgatcatcatcggccgcgagatcaccatctcggcgctgcgcgagtggatggccggcatggggacgcgcggcagcgtcgcggtagcttatatcggcaagctgaaaaccgccgcgcaaatgctggcgattaccctgctgctgtacgatggcgcgttgattccgggcctgaatgcgcgaatcgcaggaaatttttccatgtatatcgcggtgattttgactttatggtcaatggtttactatctgcgcatggccgccaaagagtttgccggcaaaaaaatcgatgtttga

SEQ ID NO: 1370 - DNA, 73 bp, Chromobacterium substugae
gcgggaatagctcagttggtagagcgcaaccttgccaaggttgaggtcgcgagttcgagcctcgtttcccgct

SEQ ID NO: 1371 - DNA, 73 bp, Chromobacterium substugae; identical to SEQ ID NO: 1370

SEQ ID NO: 1372 - DNA, 73 bp, Chromobacterium substugae; identical to SEQ ID NO: 1370

SEQ ID NO: 1373 - DNA, 73 bp, Chromobacterium substugae; identical to SEQ ID NO: 1370

SEQ ID NO: 1374 - DNA, 73 bp, Chromobacterium substugae; identical to SEQ ID NO: 1370

SEQ ID NO: 1375 - DNA, 73 bp, Chromobacterium substugae; identical to SEQ ID NO: 1370

SEQ ID NO: 1376 - DNA, 71 bp, Chromobacterium substugae
ggcggggtagcaaagtggttatgcagcggattgcaaatccgtctacgccggttcgattccgacccccgcct

SEQ ID NO: 1377 - DNA, 1113 bp, Chromobacterium substugae
ttgccgaagcccgtatccttcacgttcgacagcgaggcagagggcgacgcctactgcgccaggctggaagcgctgctggaccgtggcatcatcccggccgatcttgtcgacgagcggcccgcaatcgccaccatccgcgatgcgctgcgcatgtaccaggccagcgtggcgctggtggatagcgataagcaagttcaagcggcactggtagacaaggtgggcgaggttctgatgcgcaatgtctgctacacctgggcggaaagctgggtgcgggacatgaagcaagttgagaagctggcgccgtccaccatcagaatctatgtggggtcgctggcgcgctgtttcgactacctgacgcgcctgcctgatagcactttcgttaccaacccgctgcggctgctgccaaaacgctacgcgacatataccgacgccgacgccgcggtgctgcgcgccagcgcgaaagagggcgaggcggtagaggtgccgaccaacaccgagcgagaccggcgcctcctggaggcagaggaggcggcaattcgccgaatcctcgatggatgcaaaccagacggcaagcagaggccgcttgcctgcgcctggcgtggtgcgcttgagctgatgttggagctggcgctggaaacggcaatgcggatgcgcgagatttacacgctgacgctcgaccagatcgacatggagcggcgaaccattttcttggacaagaccaagaatggcgacaagcgacaggtgcctttgtccagcgtggcactggcggcactcgtgcgctaccgcgagcaggtagcggccggcgagcgcgatatgtcaggctggaaccatgagggcgacaggttgttgccgtggtggagtggcgccaatagccccgacgtgctgcggaagaccaccgcgctactgtcgcgccagtacgcgcggatttttgaggcggccggctgcggtgatctgcgcttccacgatctgcgccatgaagcgacgtgccggtttttcctgaaaacaaaactgtccgacctgcaaatcgccaaaatcaccggccacaaagacccgcgaatgctggctcgctatgccaatctgcgcggcagcgagctggccgatcagctctggtaa

SEQ ID NO: 1378 - DNA, 327 bp, Chromobacterium substugae
atgacaaacgacacgatgactcttgatgatgcggcaaccgcgctgaacatcggcaccgaaaccgcgcgccagctggcagatgctggcgtgctgccaggctgcaaaattggccagggttgggtgttcctgcgcgatgacgtgctgacctacctacgcgacgaaatccgccgccagaccaatgcacgtcgggcaatggcggatgctgtccggacggaaggccagagccgcaaaacggagcgagtcaaaacagccgccggcgctgctggcgtgcgaagcgcccgccgtcgcgagcaccccaatctggatttagtggagaaagcggcatga

SEQ ID NO: 1379 - DNA, 381 bp, Chromobacterium substugae
atgaacaccgccgcaatggaagtgcaaaccaacctctacacccggctgatgatggccgccaacggccgctatcgcgccgagctggacgccgtgaatagccagctacgcaacatcgaacgcgccgagcgcatggcgcgccgactgcgcgatgtcgaaatgaacgctgaggctcaggccggcgccggctatgtcccgttcatcgtcctgcgcctgtccatcgaggtgatgccaatgcagcactacgccctggcgctggccggcaacgccctggagcgccagctcgtcccgaacggccgcgacgcccagggccgggagcggttccaaattctggccgccggcgacgaacgcaccagcctggagctggtggtggaaggtatctga

SEQ ID NO: 1380 - DNA, 189 bp, Chromobacterium substugae
gtgaaaagcgaacgcaccagcagcgcggtggtggtttgcagatttctgcaggacggcgaattagagctagcccgcagtgcgctgaccaagcactttgaaccagctgaacaacggtatagcgagctggtggcgcgaatgagcgagctggcattgaagaaaaataccaacgaacaggagcaaccgcgatga
